United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 87

SEQ ID NO: 3111258 - RNA, 22 nt, Mycobacterium bovis subsp bovis AF2122/97
ucgucggcaugggccggcgccg

SEQ ID NO: 3111259 - RNA, 16 nt, Mycobacterium bovis subsp bovis AF2122/97
ucgucggccaccgcgg

SEQ ID NO: 3111260 - RNA, 13 nt, Mycobacterium bovis subsp bovis AF2122/97
ucgucggccagca

SEQ ID NO: 3111261 - RNA, 22 nt, Mycobacterium bovis subsp bovis AF2122/97
ucgucggccagcagaucagguc

SEQ ID NO: 3111262 - RNA, 16 nt, Mycobacterium bovis subsp bovis AF2122/97
ucgucggccgacaccg

SEQ ID NO: 3111263 - RNA, 15 nt, Mycobacterium bovis subsp bovis AF2122/97
ucgucggcgacggcc

SEQ ID NO: 3111264 - RNA, 20 nt, Mycobacterium bovis subsp bovis AF2122/97
ucgucggcgacggccagcgc

SEQ ID NO: 3111265 - RNA, 20 nt, Mycobacterium bovis subsp bovis AF2122/97
ucgucggcgcggcugucgug

SEQ ID NO: 3111266 - RNA, 15 nt, Mycobacterium bovis subsp bovis AF2122/97
ucgucggcggcgacg

SEQ ID NO: 3111267 - RNA, 15 nt, Mycobacterium bovis subsp bovis AF2122/97
ucgucggcgggcugc

SEQ ID NO: 3111268 - RNA, 13 nt, Mycobacterium bovis subsp bovis AF2122/97
ucgucggcgucga

SEQ ID NO: 3111269 - RNA, 22 nt, Mycobacterium bovis subsp bovis AF2122/97
ucgucggcgucgguggaggcgu

SEQ ID NO: 3111270 - RNA, 20 nt, Mycobacterium bovis subsp bovis AF2122/97
ucgucggcuuuggacagguc

SEQ ID NO: 3111271 - RNA, 21 nt, Mycobacterium bovis subsp bovis AF2122/97
ucgucggcuuuggacagguca

SEQ ID NO: 3111272 - RNA, 16 nt, Mycobacterium bovis subsp bovis AF2122/97
ucgucgggacgccgcc

SEQ ID NO: 3111273 - RNA, 17 nt, Mycobacterium bovis subsp bovis AF2122/97
ucgucgggacgccgccc

SEQ ID NO: 3111274 - RNA, 11 nt, Mycobacterium bovis subsp bovis AF2122/97
ucgucgggagc

SEQ ID NO: 3111275 - RNA, 18 nt, Mycobacterium bovis subsp bovis AF2122/97
ucgucgggaucggcgucc

SEQ ID NO: 3111276 - RNA, 17 nt, Mycobacterium bovis subsp bovis AF2122/97
ucgucgggcaugcucug

SEQ ID NO: 3111277 - RNA, 14 nt, Mycobacterium bovis subsp bovis AF2122/97
ucgucgggucaccc

SEQ ID NO: 3111278 - RNA, 18 nt, Mycobacterium bovis subsp bovis AF2122/97
ucgucgggucacccagau

SEQ ID NO: 3111279 - RNA, 20 nt, Mycobacterium bovis subsp bovis AF2122/97
ucgucgguaaugccgggccc

SEQ ID NO: 3111280 - RNA, 13 nt, Mycobacterium bovis subsp bovis AF2122/97
ucgucggucugca

SEQ ID NO: 3111281 - RNA, 17 nt, Mycobacterium bovis subsp bovis AF2122/97
ucgucgguguccucggu

SEQ ID NO: 3111282 - RNA, 18 nt, Mycobacterium bovis subsp bovis AF2122/97
ucgucgguguuccgccgc

SEQ ID NO: 3111283 - RNA, 20 nt, Mycobacterium bovis subsp bovis AF2122/97
ucgucgguguuccgccgcgc

SEQ ID NO: 3111284 - RNA, 16 nt, Mycobacterium bovis subsp bovis AF2122/97
ucgucgguuccgggcg

SEQ ID NO: 3111285 - RNA, 15 nt, Mycobacterium bovis subsp bovis AF2122/97
ucgucgguugccacg

SEQ ID NO: 3111286 - RNA, 18 nt, Mycobacterium bovis subsp bovis AF2122/97
ucgucgguugccacgccg

SEQ ID NO: 3111287 - RNA, 20 nt, Mycobacterium bovis subsp bovis AF2122/97
ucgucgguugccacgccgcc

SEQ ID NO: 3111288 - RNA, 17 nt, Mycobacterium bovis subsp bovis AF2122/97
ucgucguacaugggcag

SEQ ID NO: 3111289 - RNA, 20 nt, Mycobacterium bovis subsp bovis AF2122/97
ucgucguaccguucgggccg

SEQ ID NO: 3111290 - RNA, 18 nt, Mycobacterium bovis subsp bovis AF2122/97
ucgucguaguccaggccg

SEQ ID NO: 3111291 - RNA, 17 nt, Mycobacterium bovis subsp bovis AF2122/97
ucgucgucaacccggug

SEQ ID NO: 3111292 - RNA, 18 nt, Mycobacterium bovis subsp bovis AF2122/97
ucgucgucaacccggugu

SEQ ID NO: 3111293 - RNA, 20 nt, Mycobacterium bovis subsp bovis AF2122/97
ucgucgucaccgaugcgccg

SEQ ID NO: 3111294 - RNA, 24 nt, Mycobacterium bovis subsp bovis AF2122/97
ucgucguccgacgggccgucgccg

SEQ ID NO: 3111295 - RNA, 20 nt, Mycobacterium bovis subsp bovis AF2122/97
ucgucguccuguccgggcug

SEQ ID NO: 3111296 - RNA, 12 nt, Mycobacterium bovis subsp bovis AF2122/97
ucgucgucgaca

SEQ ID NO: 3111297 - RNA, 13 nt, Mycobacterium bovis subsp bovis AF2122/97
ucgucgucgacac

SEQ ID NO: 3111298 - RNA, 15 nt, Mycobacterium bovis subsp bovis AF2122/97
ucgucgucgcagugc

SEQ ID NO: 3111299 - RNA, 20 nt, Mycobacterium bovis subsp bovis AF2122/97
ucgucgucggcguagucgcu

SEQ ID NO: 3111300 - RNA, 21 nt, Mycobacterium bovis subsp bovis AF2122/97
ucgucgugagucacccggccg

SEQ ID NO: 3111301 - RNA, 18 nt, Mycobacterium bovis subsp bovis AF2122/97
ucgucgugcacggcggcc

SEQ ID NO: 3111302 - RNA, 18 nt, Mycobacterium bovis subsp bovis AF2122/97
ucgucguggagcucacgu

SEQ ID NO: 3111303 - RNA, 15 nt, Mycobacterium bovis subsp bovis AF2122/97
ucgucgugucgccgc

SEQ ID NO: 3111304 - RNA, 16 nt, Mycobacterium bovis subsp bovis AF2122/97
ucgucgugucgccgcc

SEQ ID NO: 3111305 - RNA, 20 nt, Mycobacterium bovis subsp bovis AF2122/97
ucgucguugagcaucaccgu

SEQ ID NO: 3111306 - RNA, 20 nt, Mycobacterium bovis subsp bovis AF2122/97
ucgucguugugugccagcgu

SEQ ID NO: 3111307 - RNA, 22 nt, Mycobacterium bovis subsp bovis AF2122/97
ucgucguugugugccagcgugg

SEQ ID NO: 3111308 - RNA, 20 nt, Mycobacterium bovis subsp bovis AF2122/97
ucgucuccuugaucgacaac

SEQ ID NO: 3111309 - RNA, 15 nt, Mycobacterium bovis subsp bovis AF2122/97
ucgucucggccacga

SEQ ID NO: 3111310 - RNA, 14 nt, Mycobacterium bovis subsp bovis AF2122/97
ucgugaagcgggug

SEQ ID NO: 3111311 - RNA, 14 nt, Mycobacterium bovis subsp bovis AF2122/97
ucgugaccgaccgc

SEQ ID NO: 3111312 - RNA, 15 nt, Mycobacterium bovis subsp bovis AF2122/97
ucgugaccgaccgcc

SEQ ID NO: 3111313 - RNA, 15 nt, Mycobacterium bovis subsp bovis AF2122/97
ucgugacgaucagcg

SEQ ID NO: 3111314 - RNA, 21 nt, Mycobacterium bovis subsp bovis AF2122/97
ucgugacguuguaggagaacg

SEQ ID NO: 3111315 - RNA, 23 nt, Mycobacterium bovis subsp bovis AF2122/97
ucgugacguuguaggagaacguc

SEQ ID NO: 3111316 - RNA, 23 nt, Mycobacterium bovis subsp bovis AF2122/97
ucgugagacugggcgcuggaggc

SEQ ID NO: 3111317 - RNA, 12 nt, Mycobacterium bovis subsp bovis AF2122/97
ucgugagccagc

SEQ ID NO: 3111318 - RNA, 17 nt, Mycobacterium bovis subsp bovis AF2122/97
ucgugagccccagcgac

SEQ ID NO: 3111319 - RNA, 14 nt, Mycobacterium bovis subsp bovis AF2122/97
ucgugagcggccag

SEQ ID NO: 3111320 - RNA, 19 nt, Mycobacterium bovis subsp bovis AF2122/97
ucgugagcuuuaucugcau

SEQ ID NO: 3111321 - RNA, 17 nt, Mycobacterium bovis subsp bovis AF2122/97
ucgugaggaaccccggu

SEQ ID NO: 3111322 - RNA, 22 nt, Mycobacterium bovis subsp bovis AF2122/97
ucgugaugucaacgugucccaa

SEQ ID NO: 3111323 - RNA, 23 nt, Mycobacterium bovis subsp bovis AF2122/97
ucgugcaaugcuuccagcaucag

SEQ ID NO: 3111324 - RNA, 19 nt, Mycobacterium bovis subsp bovis AF2122/97
ucgugcacgacgacaucga

SEQ ID NO: 3111325 - RNA, 21 nt, Mycobacterium bovis subsp bovis AF2122/97
ucgugcacgacgacaucgagc

SEQ ID NO: 3111326 - RNA, 24 nt, Mycobacterium bovis subsp bovis AF2122/97
ucgugcacgacgacaucgagccaa

SEQ ID NO: 3111327 - RNA, 16 nt, Mycobacterium bovis subsp bovis AF2122/97
ucgugcacgcacagcc

SEQ ID NO: 3111328 - RNA, 12 nt, Mycobacterium bovis subsp bovis AF2122/97
ucgugcacggcg

SEQ ID NO: 3111329 - RNA, 15 nt, Mycobacterium bovis subsp bovis AF2122/97
ucgugcacggcggcc

SEQ ID NO: 3111330 - RNA, 14 nt, Mycobacterium bovis subsp bovis AF2122/97
ucgugcagcccaag

SEQ ID NO: 3111331 - RNA, 15 nt, Mycobacterium bovis subsp bovis AF2122/97
ucgugcaggcgacgg

SEQ ID NO: 3111332 - RNA, 18 nt, Mycobacterium bovis subsp bovis AF2122/97
ucgugccacuuccacggc

SEQ ID NO: 3111333 - RNA, 22 nt, Mycobacterium bovis subsp bovis AF2122/97
ucgugccagcagcaaucagccg

SEQ ID NO: 3111334 - RNA, 15 nt, Mycobacterium bovis subsp bovis AF2122/97
ucgugccgccgcaug

SEQ ID NO: 3111335 - RNA, 12 nt, Mycobacterium bovis subsp bovis AF2122/97
ucgugccggcgu

SEQ ID NO: 3111336 - RNA, 13 nt, Mycobacterium bovis subsp bovis AF2122/97
ucgugccggcguu

SEQ ID NO: 3111337 - RNA, 13 nt, Mycobacterium bovis subsp bovis AF2122/97
ucgugccggggcu

SEQ ID NO: 3111338 - RNA, 14 nt, Mycobacterium bovis subsp bovis AF2122/97
ucgugccucggaca

SEQ ID NO: 3111339 - RNA, 15 nt, Mycobacterium bovis subsp bovis AF2122/97
ucgugccucggacaa

SEQ ID NO: 3111340 - RNA, 23 nt, Mycobacterium bovis subsp bovis AF2122/97
ucgugccucggacaaagccgucg

SEQ ID NO: 3111341 - RNA, 20 nt, Mycobacterium bovis subsp bovis AF2122/97
ucgugcgauuuugugucugc

SEQ ID NO: 3111342 - RNA, 13 nt, Mycobacterium bovis subsp bovis AF2122/97
ucgugcgccgacg

SEQ ID NO: 3111343 - RNA, 15 nt, Mycobacterium bovis subsp bovis AF2122/97
ucgugcgccgacggu

SEQ ID NO: 3111344 - RNA, 12 nt, Mycobacterium bovis subsp bovis AF2122/97
ucgugcgcggcc

SEQ ID NO: 3111345 - RNA, 20 nt, Mycobacterium bovis subsp bovis AF2122/97
ucgugcgcuuggucgaccgc

SEQ ID NO: 3111346 - RNA, 21 nt, Mycobacterium bovis subsp bovis AF2122/97
ucgugcgcuuggucgaccgcc

SEQ ID NO: 3111347 - RNA, 16 nt, Mycobacterium bovis subsp bovis AF2122/97
ucgugcgugcggcgaa

SEQ ID NO: 3111348 - RNA, 19 nt, Mycobacterium bovis subsp bovis AF2122/97
ucgugcguugccgucgaga

SEQ ID NO: 3111349 - RNA, 22 nt, Mycobacterium bovis subsp bovis AF2122/97
ucgugcguugucggcuggacgg

SEQ ID NO: 3111350 - RNA, 16 nt, Mycobacterium bovis subsp bovis AF2122/97
ucgugcucucggcgaa

SEQ ID NO: 3111351 - RNA, 21 nt, Mycobacterium bovis subsp bovis AF2122/97
ucgugcugccauugccgcaug

SEQ ID NO: 3111352 - RNA, 22 nt, Mycobacterium bovis subsp bovis AF2122/97
ucguggaacuccguccgccgua

SEQ ID NO: 3111353 - RNA, 15 nt, Mycobacterium bovis subsp bovis AF2122/97
ucguggagccggccg

SEQ ID NO: 3111354 - RNA, 20 nt, Mycobacterium bovis subsp bovis AF2122/97
ucguggagcucacgugcugc

SEQ ID NO: 3111355 - RNA, 22 nt, Mycobacterium bovis subsp bovis AF2122/97
ucguggagcucacgugcugccg

SEQ ID NO: 3111356 - RNA, 20 nt, Mycobacterium bovis subsp bovis AF2122/97
ucguggauccagccaugcgg

SEQ ID NO: 3111357 - RNA, 20 nt, Mycobacterium bovis subsp bovis AF2122/97
ucguggauggccgccaggcg

SEQ ID NO: 3111358 - RNA, 14 nt, Mycobacterium bovis subsp bovis AF2122/97
ucguggcgaccacg

SEQ ID NO: 3111359 - RNA, 18 nt, Mycobacterium bovis subsp bovis AF2122/97
ucguggcgacggcgucga

SEQ ID NO: 3111360 - RNA, 15 nt, Mycobacterium bovis subsp bovis AF2122/97
ucguggcgcucggcg

SEQ ID NO: 3111361 - RNA, 23 nt, Mycobacterium bovis subsp bovis AF2122/97
ucguggcgcugggguccgcgucg

SEQ ID NO: 3111362 - RNA, 12 nt, Mycobacterium bovis subsp bovis AF2122/97
ucguggcgucgu

SEQ ID NO: 3111363 - RNA, 19 nt, Mycobacterium bovis subsp bovis AF2122/97
ucguggcgucgugcgcggc

SEQ ID NO: 3111364 - RNA, 23 nt, Mycobacterium bovis subsp bovis AF2122/97
ucgugggccacuugaugcucgau

SEQ ID NO: 3111365 - RNA, 14 nt, Mycobacterium bovis subsp bovis AF2122/97
ucgugggcugugcg

SEQ ID NO: 3111366 - RNA, 21 nt, Mycobacterium bovis subsp bovis AF2122/97
ucguggggaucgaccaugguc

SEQ ID NO: 3111367 - RNA, 14 nt, Mycobacterium bovis subsp bovis AF2122/97
ucgugggucaacgu

SEQ ID NO: 3111368 - RNA, 12 nt, Mycobacterium bovis subsp bovis AF2122/97
ucguggguccgu

SEQ ID NO: 3111369 - RNA, 13 nt, Mycobacterium bovis subsp bovis AF2122/97
ucgugguaaccau

SEQ ID NO: 3111370 - RNA, 13 nt, Mycobacterium bovis subsp bovis AF2122/97
ucguggucgaucc

SEQ ID NO: 3111371 - RNA, 15 nt, Mycobacterium bovis subsp bovis AF2122/97
ucguggucgguggcu

SEQ ID NO: 3111372 - RNA, 19 nt, Mycobacterium bovis subsp bovis AF2122/97
ucguggugcaacacgccgg

SEQ ID NO: 3111373 - RNA, 20 nt, Mycobacterium bovis subsp bovis AF2122/97
ucguggugcaacacgccggc

SEQ ID NO: 3111374 - RNA, 16 nt, Mycobacterium bovis subsp bovis AF2122/97
ucgugguucggcgucg

SEQ ID NO: 3111375 - RNA, 18 nt, Mycobacterium bovis subsp bovis AF2122/97
ucgugguuguaccagccg

SEQ ID NO: 3111376 - RNA, 18 nt, Mycobacterium bovis subsp bovis AF2122/97
ucguguacauugccgacc

SEQ ID NO: 3111377 - RNA, 22 nt, Mycobacterium bovis subsp bovis AF2122/97
ucguguaucgagcggcacauca

SEQ ID NO: 3111378 - RNA, 18 nt, Mycobacterium bovis subsp bovis AF2122/97
ucgugucacccucgggcg

SEQ ID NO: 3111379 - RNA, 16 nt, Mycobacterium bovis subsp bovis AF2122/97
ucgugucaugcucacc

SEQ ID NO: 3111380 - RNA, 12 nt, Mycobacterium bovis subsp bovis AF2122/97
ucguguccaccg

SEQ ID NO: 3111381 - RNA, 14 nt, Mycobacterium bovis subsp bovis AF2122/97
ucguguccgccguc

SEQ ID NO: 3111382 - RNA, 23 nt, Mycobacterium bovis subsp bovis AF2122/97
ucgugucgccgccguugccgccg

SEQ ID NO: 3111383 - RNA, 16 nt, Mycobacterium bovis subsp bovis AF2122/97
ucgugucgcugcggcg

SEQ ID NO: 3111384 - RNA, 18 nt, Mycobacterium bovis subsp bovis AF2122/97
ucgugucugccucggggc

SEQ ID NO: 3111385 - RNA, 21 nt, Mycobacterium bovis subsp bovis AF2122/97
ucgugugguucacucucggcg

SEQ ID NO: 3111386 - RNA, 16 nt, Mycobacterium bovis subsp bovis AF2122/97
ucguguuggccggguc

SEQ ID NO: 3111387 - RNA, 19 nt, Mycobacterium bovis subsp bovis AF2122/97
ucguguuguugaagcccga

SEQ ID NO: 3111388 - RNA, 20 nt, Mycobacterium bovis subsp bovis AF2122/97
ucguuagcggcgggcacgca

SEQ ID NO: 3111389 - RNA, 16 nt, Mycobacterium bovis subsp bovis AF2122/97
ucguucagcgccagcg

SEQ ID NO: 3111390 - RNA, 14 nt, Mycobacterium bovis subsp bovis AF2122/97
ucguucagcgucga

SEQ ID NO: 3111391 - RNA, 19 nt, Mycobacterium bovis subsp bovis AF2122/97
ucguuccaggccgcgucga

SEQ ID NO: 3111392 - RNA, 14 nt, Mycobacterium bovis subsp bovis AF2122/97
ucguuccucgaccg

SEQ ID NO: 3111393 - RNA, 19 nt, Mycobacterium bovis subsp bovis AF2122/97
ucguucgucaccacgaucg

SEQ ID NO: 3111394 - RNA, 22 nt, Mycobacterium bovis subsp bovis AF2122/97
ucguugaccgggucgccgauga

SEQ ID NO: 3111395 - RNA, 22 nt, Mycobacterium bovis subsp bovis AF2122/97
ucguugacucugcguccaccac

SEQ ID NO: 3111396 - RNA, 23 nt, Mycobacterium bovis subsp bovis AF2122/97
ucguugagcaagugggugccggc

SEQ ID NO: 3111397 - RNA, 20 nt, Mycobacterium bovis subsp bovis AF2122/97
ucguugaguggaugcgccgc

SEQ ID NO: 3111398 - RNA, 23 nt, Mycobacterium bovis subsp bovis AF2122/97
ucguugaguggaugcgccgcacg

SEQ ID NO: 3111399 - RNA, 15 nt, Mycobacterium bovis subsp bovis AF2122/97
ucguugaugcuucga

SEQ ID NO: 3111400 - RNA, 14 nt, Mycobacterium bovis subsp bovis AF2122/97
ucguugccagggcg

SEQ ID NO: 3111401 - RNA, 19 nt, Mycobacterium bovis subsp bovis AF2122/97
ucguugccgcggucggcga

SEQ ID NO: 3111402 - RNA, 19 nt, Mycobacterium bovis subsp bovis AF2122/97
ucguugccggacaaccugg

SEQ ID NO: 3111403 - RNA, 13 nt, Mycobacterium bovis subsp bovis AF2122/97
ucguugccggcga

SEQ ID NO: 3111404 - RNA, 16 nt, Mycobacterium bovis subsp bovis AF2122/97
ucguugccggugccgc

SEQ ID NO: 3111405 - RNA, 16 nt, Mycobacterium bovis subsp bovis AF2122/97
ucguugccguagcuga

SEQ ID NO: 3111406 - RNA, 17 nt, Mycobacterium bovis subsp bovis AF2122/97
ucguugccguccaccga

SEQ ID NO: 3111407 - RNA, 15 nt, Mycobacterium bovis subsp bovis AF2122/97
ucguugcgcggucuc

SEQ ID NO: 3111408 - RNA, 12 nt, Mycobacterium bovis subsp bovis AF2122/97
ucguugcucggu

SEQ ID NO: 3111409 - RNA, 18 nt, Mycobacterium bovis subsp bovis AF2122/97
ucguuggcggcggucggc

SEQ ID NO: 3111410 - RNA, 19 nt, Mycobacterium bovis subsp bovis AF2122/97
ucguuggcggcggucggcu

SEQ ID NO: 3111411 - RNA, 15 nt, Mycobacterium bovis subsp bovis AF2122/97
ucguuggggcugccg

SEQ ID NO: 3111412 - RNA, 22 nt, Mycobacterium bovis subsp bovis AF2122/97
ucguuguagccgaaucccgcga

SEQ ID NO: 3111413 - RNA, 23 nt, Mycobacterium bovis subsp bovis AF2122/97
ucguugucagcgaacggccagga

SEQ ID NO: 3111414 - RNA, 13 nt, Mycobacterium bovis subsp bovis AF2122/97
ucguugucggcgg

SEQ ID NO: 3111415 - RNA, 22 nt, Mycobacterium bovis subsp bovis AF2122/97
ucguugugauccgguggugggc

SEQ ID NO: 3111416 - RNA, 20 nt, Mycobacterium bovis subsp bovis AF2122/97
ucguugugccggucgaugac

SEQ ID NO: 3111417 - RNA, 16 nt, Mycobacterium bovis subsp bovis AF2122/97
ucguuucgaagugccg

SEQ ID NO: 3111418 - RNA, 23 nt, Mycobacterium bovis subsp bovis AF2122/97
ucguuugcgccaggaguggccac

SEQ ID NO: 3111419 - RNA, 20 nt, Mycobacterium bovis subsp bovis AF2122/97
ucguuuucgccgaucccggc

SEQ ID NO: 3111420 - RNA, 20 nt, Mycobacterium bovis subsp bovis AF2122/97
ucuaaauaccuuuggcuccc

SEQ ID NO: 3111421 - RNA, 13 nt, Mycobacterium bovis subsp bovis AF2122/97
ucuacaucgucga

SEQ ID NO: 3111422 - RNA, 19 nt, Mycobacterium bovis subsp bovis AF2122/97
ucuaccaacaccgcccgca

SEQ ID NO: 3111423 - RNA, 21 nt, Mycobacterium bovis subsp bovis AF2122/97
ucuaccaccuugccgaacacu

SEQ ID NO: 3111424 - RNA, 18 nt, Mycobacterium bovis subsp bovis AF2122/97
ucuaccagccgccccggc

SEQ ID NO: 3111425 - RNA, 13 nt, Mycobacterium bovis subsp bovis AF2122/97
ucuaccuccgcca

SEQ ID NO: 3111426 - RNA, 15 nt, Mycobacterium bovis subsp bovis AF2122/97
ucuaccuuagcgccg

SEQ ID NO: 3111427 - RNA, 23 nt, Mycobacterium bovis subsp bovis AF2122/97
ucuaccuuagcgccguugccgcc

SEQ ID NO: 3111428 - RNA, 15 nt, Mycobacterium bovis subsp bovis AF2122/97
ucuaccuuuuuggca

SEQ ID NO: 3111429 - RNA, 13 nt, Mycobacterium bovis subsp bovis AF2122/97
ucuacgacgucgc

SEQ ID NO: 3111430 - RNA, 19 nt, Mycobacterium bovis subsp bovis AF2122/97
ucuacgucguccagcacca

SEQ ID NO: 3111431 - RNA, 23 nt, Mycobacterium bovis subsp bovis AF2122/97
ucuacucgcggccggcgucggcg

SEQ ID NO: 3111432 - RNA, 20 nt, Mycobacterium bovis subsp bovis AF2122/97
ucuagaugcggaacgccgag

SEQ ID NO: 3111433 - RNA, 14 nt, Mycobacterium bovis subsp bovis AF2122/97
ucuagcaaagccag

SEQ ID NO: 3111434 - RNA, 22 nt, Mycobacterium bovis subsp bovis AF2122/97
ucuagcggccuaggacgccgcc

SEQ ID NO: 3111435 - RNA, 16 nt, Mycobacterium bovis subsp bovis AF2122/97
ucuaggccucagaacc

SEQ ID NO: 3111436 - RNA, 15 nt, Mycobacterium bovis subsp bovis AF2122/97
ucucacccacaugac

SEQ ID NO: 3111437 - RNA, 13 nt, Mycobacterium bovis subsp bovis AF2122/97
ucucaccgggccc

SEQ ID NO: 3111438 - RNA, 18 nt, Mycobacterium bovis subsp bovis AF2122/97
ucucaccgucaacgccug

SEQ ID NO: 3111439 - RNA, 18 nt, Mycobacterium bovis subsp bovis AF2122/97
ucucauccuccugcgccg

SEQ ID NO: 3111440 - RNA, 22 nt, Mycobacterium bovis subsp bovis AF2122/97
ucuccaagcucgacaacugccc

SEQ ID NO: 3111441 - RNA, 13 nt, Mycobacterium bovis subsp bovis AF2122/97
ucuccaccaggug

SEQ ID NO: 3111442 - RNA, 13 nt, Mycobacterium bovis subsp bovis AF2122/97
ucuccaccccguc

SEQ ID NO: 3111443 - RNA, 20 nt, Mycobacterium bovis subsp bovis AF2122/97
ucuccaccggcgaucugcuc

SEQ ID NO: 3111444 - RNA, 17 nt, Mycobacterium bovis subsp bovis AF2122/97
ucuccaccgucgccgcc

SEQ ID NO: 3111445 - RNA, 21 nt, Mycobacterium bovis subsp bovis AF2122/97
ucuccaccgucgccgccgguc

SEQ ID NO: 3111446 - RNA, 13 nt, Mycobacterium bovis subsp bovis AF2122/97
ucuccaccuucug

SEQ ID NO: 3111447 - RNA, 21 nt, Mycobacterium bovis subsp bovis AF2122/97
ucuccaccuucugguccagca

SEQ ID NO: 3111448 - RNA, 19 nt, Mycobacterium bovis subsp bovis AF2122/97
ucuccagauccacgccgac

SEQ ID NO: 3111449 - RNA, 17 nt, Mycobacterium bovis subsp bovis AF2122/97
ucuccagcaccaaaagg

SEQ ID NO: 3111450 - RNA, 16 nt, Mycobacterium bovis subsp bovis AF2122/97
ucuccagcucgaacag

SEQ ID NO: 3111451 - RNA, 16 nt, Mycobacterium bovis subsp bovis AF2122/97
ucuccaguagccggug

SEQ ID NO: 3111452 - RNA, 18 nt, Mycobacterium bovis subsp bovis AF2122/97
ucuccauguuggcgaaug

SEQ ID NO: 3111453 - RNA, 20 nt, Mycobacterium bovis subsp bovis AF2122/97
ucucccagaggucgagcgcc

SEQ ID NO: 3111454 - RNA, 20 nt, Mycobacterium bovis subsp bovis AF2122/97
ucucccauacgccggccgcg

SEQ ID NO: 3111455 - RNA, 13 nt, Mycobacterium bovis subsp bovis AF2122/97
ucucccccaucgc

SEQ ID NO: 3111456 - RNA, 14 nt, Mycobacterium bovis subsp bovis AF2122/97
ucuccccgaccgcg

SEQ ID NO: 3111457 - RNA, 18 nt, Mycobacterium bovis subsp bovis AF2122/97
ucuccccgcuagcccacc

SEQ ID NO: 3111458 - RNA, 20 nt, Mycobacterium bovis subsp bovis AF2122/97
ucuccccguccugccagucc

SEQ ID NO: 3111459 - RNA, 13 nt, Mycobacterium bovis subsp bovis AF2122/97
ucucccgaccgcc

SEQ ID NO: 3111460 - RNA, 16 nt, Mycobacterium bovis subsp bovis AF2122/97
ucucccgaccgccgag

SEQ ID NO: 3111461 - RNA, 16 nt, Mycobacterium bovis subsp bovis AF2122/97
ucucccggccgcaccc

SEQ ID NO: 3111462 - RNA, 11 nt, Mycobacterium bovis subsp bovis AF2122/97
ucucccuugcc

SEQ ID NO: 3111463 - RNA, 23 nt, Mycobacterium bovis subsp bovis AF2122/97
ucuccgccaacaacuucucgucg

SEQ ID NO: 3111464 - RNA, 12 nt, Mycobacterium bovis subsp bovis AF2122/97
ucuccgccgccc

SEQ ID NO: 3111465 - RNA, 16 nt, Mycobacterium bovis subsp bovis AF2122/97
ucuccgccgucgccac

SEQ ID NO: 3111466 - RNA, 15 nt, Mycobacterium bovis subsp bovis AF2122/97
ucuccggcaacagca

SEQ ID NO: 3111467 - RNA, 15 nt, Mycobacterium bovis subsp bovis AF2122/97
ucuccggcaccgguc

SEQ ID NO: 3111468 - RNA, 22 nt, Mycobacterium bovis subsp bovis AF2122/97
ucuccggcaccggucuuggugc

SEQ ID NO: 3111469 - RNA, 17 nt, Mycobacterium bovis subsp bovis AF2122/97
ucuccggcgccaccgcc

SEQ ID NO: 3111470 - RNA, 21 nt, Mycobacterium bovis subsp bovis AF2122/97
ucuccgggucgaugucggggc

SEQ ID NO: 3111471 - RNA, 11 nt, Mycobacterium bovis subsp bovis AF2122/97
ucuccggugau

SEQ ID NO: 3111472 - RNA, 19 nt, Mycobacterium bovis subsp bovis AF2122/97
ucuccuccggaaagcucuc

SEQ ID NO: 3111473 - RNA, 18 nt, Mycobacterium bovis subsp bovis AF2122/97
ucuccucgccugcccgaa

SEQ ID NO: 3111474 - RNA, 17 nt, Mycobacterium bovis subsp bovis AF2122/97
ucuccucggcgaugccg

SEQ ID NO: 3111475 - RNA, 14 nt, Mycobacterium bovis subsp bovis AF2122/97
ucuccucgugcagc

SEQ ID NO: 3111476 - RNA, 19 nt, Mycobacterium bovis subsp bovis AF2122/97
ucuccugaguugcggugug

SEQ ID NO: 3111477 - RNA, 18 nt, Mycobacterium bovis subsp bovis AF2122/97
ucuccugcucguccaccc

SEQ ID NO: 3111478 - RNA, 15 nt, Mycobacterium bovis subsp bovis AF2122/97
ucuccuggaaaggac

SEQ ID NO: 3111479 - RNA, 16 nt, Mycobacterium bovis subsp bovis AF2122/97
ucuccuugagcuucuc

SEQ ID NO: 3111480 - RNA, 14 nt, Mycobacterium bovis subsp bovis AF2122/97
ucucgaaagccgcg

SEQ ID NO: 3111481 - RNA, 17 nt, Mycobacterium bovis subsp bovis AF2122/97
ucucgacaguggcgacg

SEQ ID NO: 3111482 - RNA, 16 nt, Mycobacterium bovis subsp bovis AF2122/97
ucucgacaucggccag

SEQ ID NO: 3111483 - RNA, 14 nt, Mycobacterium bovis subsp bovis AF2122/97
ucucgaccgcgccu

SEQ ID NO: 3111484 - RNA, 17 nt, Mycobacterium bovis subsp bovis AF2122/97
ucucgaccgcgccugga

SEQ ID NO: 3111485 - RNA, 18 nt, Mycobacterium bovis subsp bovis AF2122/97
ucucgaccgcgccuggag

SEQ ID NO: 3111486 - RNA, 22 nt, Mycobacterium bovis subsp bovis AF2122/97
ucucgaccguauugaccagcgg

SEQ ID NO: 3111487 - RNA, 17 nt, Mycobacterium bovis subsp bovis AF2122/97
ucucgacggcggccgcg

SEQ ID NO: 3111488 - RNA, 12 nt, Mycobacterium bovis subsp bovis AF2122/97
ucucgacgucgg

SEQ ID NO: 3111489 - RNA, 15 nt, Mycobacterium bovis subsp bovis AF2122/97
ucucgagcaugccca

SEQ ID NO: 3111490 - RNA, 15 nt, Mycobacterium bovis subsp bovis AF2122/97
ucucgagccgccgga

SEQ ID NO: 3111491 - RNA, 22 nt, Mycobacterium bovis subsp bovis AF2122/97
ucucgaucaucaugucggcgca

SEQ ID NO: 3111492 - RNA, 13 nt, Mycobacterium bovis subsp bovis AF2122/97
ucucgaucgcggu

SEQ ID NO: 3111493 - RNA, 18 nt, Mycobacterium bovis subsp bovis AF2122/97
ucucgaucuugggccacg

SEQ ID NO: 3111494 - RNA, 17 nt, Mycobacterium bovis subsp bovis AF2122/97
ucucgauuaucgcgcgc

SEQ ID NO: 3111495 - RNA, 15 nt, Mycobacterium bovis subsp bovis AF2122/97
ucucgcaagggggag

SEQ ID NO: 3111496 - RNA, 17 nt, Mycobacterium bovis subsp bovis AF2122/97
ucucgcaccagucgucg

SEQ ID NO: 3111497 - RNA, 15 nt, Mycobacterium bovis subsp bovis AF2122/97
ucucgcaccgcgccg

SEQ ID NO: 3111498 - RNA, 14 nt, Mycobacterium bovis subsp bovis AF2122/97
ucucgcaccgcguu

SEQ ID NO: 3111499 - RNA, 15 nt, Mycobacterium bovis subsp bovis AF2122/97
ucucgccgccagcgc

SEQ ID NO: 3111500 - RNA, 22 nt, Mycobacterium bovis subsp bovis AF2122/97
ucucgccgcgcaccgaccgcac

SEQ ID NO: 3111501 - RNA, 16 nt, Mycobacterium bovis subsp bovis AF2122/97
ucucgccgggaaacac

SEQ ID NO: 3111502 - RNA, 19 nt, Mycobacterium bovis subsp bovis AF2122/97
ucucgccguggauggcccg

SEQ ID NO: 3111503 - RNA, 16 nt, Mycobacterium bovis subsp bovis AF2122/97
ucucgccguuggcggc

SEQ ID NO: 3111504 - RNA, 14 nt, Mycobacterium bovis subsp bovis AF2122/97
ucucgcgaaccgac

SEQ ID NO: 3111505 - RNA, 16 nt, Mycobacterium bovis subsp bovis AF2122/97
ucucgcggaccucggc

SEQ ID NO: 3111506 - RNA, 13 nt, Mycobacterium bovis subsp bovis AF2122/97
ucucgcggacgga

SEQ ID NO: 3111507 - RNA, 14 nt, Mycobacterium bovis subsp bovis AF2122/97
ucucgcggugcggc

SEQ ID NO: 3111508 - RNA, 14 nt, Mycobacterium bovis subsp bovis AF2122/97
ucucgcugaccuuu

SEQ ID NO: 3111509 - RNA, 18 nt, Mycobacterium bovis subsp bovis AF2122/97
ucucgcuguugaagccgc

SEQ ID NO: 3111510 - RNA, 18 nt, Mycobacterium bovis subsp bovis AF2122/97
ucucggagcgcacgaacg

SEQ ID NO: 3111511 - RNA, 12 nt, Mycobacterium bovis subsp bovis AF2122/97
ucucggccaggg

SEQ ID NO: 3111512 - RNA, 21 nt, Mycobacterium bovis subsp bovis AF2122/97
ucucggccgcucguuacgccg

SEQ ID NO: 3111513 - RNA, 13 nt, Mycobacterium bovis subsp bovis AF2122/97
ucucggccggcgg

SEQ ID NO: 3111514 - RNA, 16 nt, Mycobacterium bovis subsp bovis AF2122/97
ucucggcgagcaccgu

SEQ ID NO: 3111515 - RNA, 17 nt, Mycobacterium bovis subsp bovis AF2122/97
ucucggcgagcaccgug

SEQ ID NO: 3111516 - RNA, 13 nt, Mycobacterium bovis subsp bovis AF2122/97
ucucggcgcagcc

SEQ ID NO: 3111517 - RNA, 14 nt, Mycobacterium bovis subsp bovis AF2122/97
ucucggcgcagccg

SEQ ID NO: 3111518 - RNA, 19 nt, Mycobacterium bovis subsp bovis AF2122/97
ucucggcgcagccggugag

SEQ ID NO: 3111519 - RNA, 23 nt, Mycobacterium bovis subsp bovis AF2122/97
ucucggcggccgcgugcucgccg

SEQ ID NO: 3111520 - RNA, 21 nt, Mycobacterium bovis subsp bovis AF2122/97
ucucggcgggucaggccaggg

SEQ ID NO: 3111521 - RNA, 14 nt, Mycobacterium bovis subsp bovis AF2122/97
ucucgggccagucg

SEQ ID NO: 3111522 - RNA, 13 nt, Mycobacterium bovis subsp bovis AF2122/97
ucucggucagccc

SEQ ID NO: 3111523 - RNA, 19 nt, Mycobacterium bovis subsp bovis AF2122/97
ucucggugaacgccgcccc

SEQ ID NO: 3111524 - RNA, 19 nt, Mycobacterium bovis subsp bovis AF2122/97
ucucgguggacggcaggcg

SEQ ID NO: 3111525 - RNA, 17 nt, Mycobacterium bovis subsp bovis AF2122/97
ucucggugguccagcgc

SEQ ID NO: 3111526 - RNA, 18 nt, Mycobacterium bovis subsp bovis AF2122/97
ucucggugguccagcgcu

SEQ ID NO: 3111527 - RNA, 21 nt, Mycobacterium bovis subsp bovis AF2122/97
ucucguaacgcggcaccacgu

SEQ ID NO: 3111528 - RNA, 14 nt, Mycobacterium bovis subsp bovis AF2122/97
ucucgucaaccugc

SEQ ID NO: 3111529 - RNA, 23 nt, Mycobacterium bovis subsp bovis AF2122/97
ucucgucgccccguucacgcucg

SEQ ID NO: 3111530 - RNA, 22 nt, Mycobacterium bovis subsp bovis AF2122/97
ucucgucgucgauuagcccacc

SEQ ID NO: 3111531 - RNA, 17 nt, Mycobacterium bovis subsp bovis AF2122/97
ucucguggaucugccuc

SEQ ID NO: 3111532 - RNA, 17 nt, Mycobacterium bovis subsp bovis AF2122/97
ucucguugauacggcau

SEQ ID NO: 3111533 - RNA, 18 nt, Mycobacterium bovis subsp bovis AF2122/97
ucucugagcgggcgggcc

SEQ ID NO: 3111534 - RNA, 20 nt, Mycobacterium bovis subsp bovis AF2122/97
ucucugagcgggcgggccug

SEQ ID NO: 3111535 - RNA, 16 nt, Mycobacterium bovis subsp bovis AF2122/97
ucucugcgccaggcgg

SEQ ID NO: 3111536 - RNA, 22 nt, Mycobacterium bovis subsp bovis AF2122/97
ucucuucgcgcgcugggcgcgc

SEQ ID NO: 3111537 - RNA, 19 nt, Mycobacterium bovis subsp bovis AF2122/97
ucucuuggugcccgacuug

SEQ ID NO: 3111538 - RNA, 22 nt, Mycobacterium bovis subsp bovis AF2122/97
ucugacaucggccaagguuguc

SEQ ID NO: 3111539 - RNA, 15 nt, Mycobacterium bovis subsp bovis AF2122/97
ucugacccaccgccc

SEQ ID NO: 3111540 - RNA, 19 nt, Mycobacterium bovis subsp bovis AF2122/97
ucugacccaccgccccggc

SEQ ID NO: 3111541 - RNA, 19 nt, Mycobacterium bovis subsp bovis AF2122/97
ucugacgaaauccgccggg

SEQ ID NO: 3111542 - RNA, 21 nt, Mycobacterium bovis subsp bovis AF2122/97
ucugacgaaauccgccgggcg

SEQ ID NO: 3111543 - RNA, 17 nt, Mycobacterium bovis subsp bovis AF2122/97
ucugacgacgcgacacg

SEQ ID NO: 3111544 - RNA, 13 nt, Mycobacterium bovis subsp bovis AF2122/97
ucugacgcggccg

SEQ ID NO: 3111545 - RNA, 23 nt, Mycobacterium bovis subsp bovis AF2122/97
ucugagcgcggguggcagcggcg

SEQ ID NO: 3111546 - RNA, 17 nt, Mycobacterium bovis subsp bovis AF2122/97
ucugaggcuuccagcuc

SEQ ID NO: 3111547 - RNA, 20 nt, Mycobacterium bovis subsp bovis AF2122/97
ucugaugguguacacgucgc

SEQ ID NO: 3111548 - RNA, 17 nt, Mycobacterium bovis subsp bovis AF2122/97
ucugcacauucagcgcc

SEQ ID NO: 3111549 - RNA, 13 nt, Mycobacterium bovis subsp bovis AF2122/97
ucugcacccgcca

SEQ ID NO: 3111550 - RNA, 16 nt, Mycobacterium bovis subsp bovis AF2122/97
ucugcaccggcaggcg

SEQ ID NO: 3111551 - RNA, 15 nt, Mycobacterium bovis subsp bovis AF2122/97
ucugcacgucggccc

SEQ ID NO: 3111552 - RNA, 23 nt, Mycobacterium bovis subsp bovis AF2122/97
ucugcagacgguccgcuacggcg

SEQ ID NO: 3111553 - RNA, 21 nt, Mycobacterium bovis subsp bovis AF2122/97
ucugcagcacgcgugguucgg

SEQ ID NO: 3111554 - RNA, 14 nt, Mycobacterium bovis subsp bovis AF2122/97
ucugcagcccaugg

SEQ ID NO: 3111555 - RNA, 14 nt, Mycobacterium bovis subsp bovis AF2122/97
ucugcagugcagcg

SEQ ID NO: 3111556 - RNA, 13 nt, Mycobacterium bovis subsp bovis AF2122/97
ucugcaugcgcug

SEQ ID NO: 3111557 - RNA, 18 nt, Mycobacterium bovis subsp bovis AF2122/97
ucugccacguugaucccg

SEQ ID NO: 3111558 - RNA, 16 nt, Mycobacterium bovis subsp bovis AF2122/97
ucugccaggcgcagcu

SEQ ID NO: 3111559 - RNA, 16 nt, Mycobacterium bovis subsp bovis AF2122/97
ucugccaugugucccg

SEQ ID NO: 3111560 - RNA, 21 nt, Mycobacterium bovis subsp bovis AF2122/97
ucugcccccgccggccgucga

SEQ ID NO: 3111561 - RNA, 23 nt, Mycobacterium bovis subsp bovis AF2122/97
ucugcccgagguccgcccucagu

SEQ ID NO: 3111562 - RNA, 20 nt, Mycobacterium bovis subsp bovis AF2122/97
ucugcccgauacccggugau

SEQ ID NO: 3111563 - RNA, 17 nt, Mycobacterium bovis subsp bovis AF2122/97
ucugcccgcccagcccg

SEQ ID NO: 3111564 - RNA, 20 nt, Mycobacterium bovis subsp bovis AF2122/97
ucugcccgcccagcccggcg

SEQ ID NO: 3111565 - RNA, 15 nt, Mycobacterium bovis subsp bovis AF2122/97
ucugcccugcacuuc

SEQ ID NO: 3111566 - RNA, 16 nt, Mycobacterium bovis subsp bovis AF2122/97
ucugccgccgcggcca

SEQ ID NO: 3111567 - RNA, 14 nt, Mycobacterium bovis subsp bovis AF2122/97
ucugccggccggcg

SEQ ID NO: 3111568 - RNA, 16 nt, Mycobacterium bovis subsp bovis AF2122/97
ucugccugcgcacgac

SEQ ID NO: 3111569 - RNA, 17 nt, Mycobacterium bovis subsp bovis AF2122/97
ucugccuuggccggcuu

SEQ ID NO: 3111570 - RNA, 15 nt, Mycobacterium bovis subsp bovis AF2122/97
ucugcgacccgggcc

SEQ ID NO: 3111571 - RNA, 20 nt, Mycobacterium bovis subsp bovis AF2122/97
ucugcgagauguccucccau

SEQ ID NO: 3111572 - RNA, 23 nt, Mycobacterium bovis subsp bovis AF2122/97
ucugcgcagaaauguauugcggu

SEQ ID NO: 3111573 - RNA, 13 nt, Mycobacterium bovis subsp bovis AF2122/97
ucugcgccacagc

SEQ ID NO: 3111574 - RNA, 18 nt, Mycobacterium bovis subsp bovis AF2122/97
ucugcgccacgucgacgg

SEQ ID NO: 3111575 - RNA, 19 nt, Mycobacterium bovis subsp bovis AF2122/97
ucugcgccagaaagcccag

SEQ ID NO: 3111576 - RNA, 13 nt, Mycobacterium bovis subsp bovis AF2122/97
ucugcgccaggcg

SEQ ID NO: 3111577 - RNA, 19 nt, Mycobacterium bovis subsp bovis AF2122/97
ucugcgccaggggcaccau

SEQ ID NO: 3111578 - RNA, 14 nt, Mycobacterium bovis subsp bovis AF2122/97
ucugcgcccacccg

SEQ ID NO: 3111579 - RNA, 14 nt, Mycobacterium bovis subsp bovis AF2122/97
ucugcgcccguccg

SEQ ID NO: 3111580 - RNA, 12 nt, Mycobacterium bovis subsp bovis AF2122/97
ucugcgccgccg

SEQ ID NO: 3111581 - RNA, 19 nt, Mycobacterium bovis subsp bovis AF2122/97
ucugcgccuucgccagcgg

SEQ ID NO: 3111582 - RNA, 21 nt, Mycobacterium bovis subsp bovis AF2122/97
ucugcgccuucgccagcggcg

SEQ ID NO: 3111583 - RNA, 17 nt, Mycobacterium bovis subsp bovis AF2122/97
ucugcgcgaugcccacg

SEQ ID NO: 3111584 - RNA, 14 nt, Mycobacterium bovis subsp bovis AF2122/97
ucugcgcgcggaag

SEQ ID NO: 3111585 - RNA, 19 nt, Mycobacterium bovis subsp bovis AF2122/97
ucugcgcggcuucgucgac

SEQ ID NO: 3111586 - RNA, 13 nt, Mycobacterium bovis subsp bovis AF2122/97
ucugcggccacgc

SEQ ID NO: 3111587 - RNA, 22 nt, Mycobacterium bovis subsp bovis AF2122/97
ucugcggccacgccgaugcggu

SEQ ID NO: 3111588 - RNA, 23 nt, Mycobacterium bovis subsp bovis AF2122/97
ucugcggccgcgugccgcccgcc

SEQ ID NO: 3111589 - RNA, 17 nt, Mycobacterium bovis subsp bovis AF2122/97
ucugcggccuagggcgg

SEQ ID NO: 3111590 - RNA, 14 nt, Mycobacterium bovis subsp bovis AF2122/97
ucugcggcggucuc

SEQ ID NO: 3111591 - RNA, 15 nt, Mycobacterium bovis subsp bovis AF2122/97
ucugcgggacgucgu

SEQ ID NO: 3111592 - RNA, 12 nt, Mycobacterium bovis subsp bovis AF2122/97
ucugcgggccgg

SEQ ID NO: 3111593 - RNA, 18 nt, Mycobacterium bovis subsp bovis AF2122/97
ucugcggggugagugacc

SEQ ID NO: 3111594 - RNA, 23 nt, Mycobacterium bovis subsp bovis AF2122/97
ucugcggggugagugaccacgcu

SEQ ID NO: 3111595 - RNA, 17 nt, Mycobacterium bovis subsp bovis AF2122/97
ucugcguauaggucaga

SEQ ID NO: 3111596 - RNA, 14 nt, Mycobacterium bovis subsp bovis AF2122/97
ucugcguccaccac

SEQ ID NO: 3111597 - RNA, 14 nt, Mycobacterium bovis subsp bovis AF2122/97
ucugcgugggccug

SEQ ID NO: 3111598 - RNA, 22 nt, Mycobacterium bovis subsp bovis AF2122/97
ucugcuagcuuggcggccagcg

SEQ ID NO: 3111599 - RNA, 13 nt, Mycobacterium bovis subsp bovis AF2122/97
ucugcuccgcagc

SEQ ID NO: 3111600 - RNA, 14 nt, Mycobacterium bovis subsp bovis AF2122/97
ucugcuccgcagca

SEQ ID NO: 3111601 - RNA, 13 nt, Mycobacterium bovis subsp bovis AF2122/97
ucugcucgccagc

SEQ ID NO: 3111602 - RNA, 17 nt, Mycobacterium bovis subsp bovis AF2122/97
ucugcucgccagccggc

SEQ ID NO: 3111603 - RNA, 15 nt, Mycobacterium bovis subsp bovis AF2122/97
ucugcucgccaggcc

SEQ ID NO: 3111604 - RNA, 13 nt, Mycobacterium bovis subsp bovis AF2122/97
ucugcucgccgag

SEQ ID NO: 3111605 - RNA, 18 nt, Mycobacterium bovis subsp bovis AF2122/97
ucugcucgccgggcagcu

SEQ ID NO: 3111606 - RNA, 19 nt, Mycobacterium bovis subsp bovis AF2122/97
ucugcucgccgugguggau

SEQ ID NO: 3111607 - RNA, 17 nt, Mycobacterium bovis subsp bovis AF2122/97
ucugcucggcaucggaa

SEQ ID NO: 3111608 - RNA, 13 nt, Mycobacterium bovis subsp bovis AF2122/97
ucugcucggcgca

SEQ ID NO: 3111609 - RNA, 23 nt, Mycobacterium bovis subsp bovis AF2122/97
ucugcugagcugcucgccggcca

SEQ ID NO: 3111610 - RNA, 16 nt, Mycobacterium bovis subsp bovis AF2122/97
ucugcugaucgagcgg

SEQ ID NO: 3111611 - RNA, 23 nt, Mycobacterium bovis subsp bovis AF2122/97
ucugcugggcacgauggcucuca

SEQ ID NO: 3111612 - RNA, 16 nt, Mycobacterium bovis subsp bovis AF2122/97
ucuggaaccccgagcu

SEQ ID NO: 3111613 - RNA, 17 nt, Mycobacterium bovis subsp bovis AF2122/97
ucuggaauccggccaga

SEQ ID NO: 3111614 - RNA, 20 nt, Mycobacterium bovis subsp bovis AF2122/97
ucuggacggucauccggccg

SEQ ID NO: 3111615 - RNA, 18 nt, Mycobacterium bovis subsp bovis AF2122/97
ucuggagugaggcugugc

SEQ ID NO: 3111616 - RNA, 17 nt, Mycobacterium bovis subsp bovis AF2122/97
ucuggauacccagcgcc

SEQ ID NO: 3111617 - RNA, 22 nt, Mycobacterium bovis subsp bovis AF2122/97
ucuggaugucccaugcacggcc

SEQ ID NO: 3111618 - RNA, 23 nt, Mycobacterium bovis subsp bovis AF2122/97
ucuggcagccgaaguggcgccuu

SEQ ID NO: 3111619 - RNA, 15 nt, Mycobacterium bovis subsp bovis AF2122/97
ucuggcaggccagca

SEQ ID NO: 3111620 - RNA, 20 nt, Mycobacterium bovis subsp bovis AF2122/97
ucuggccccaggggaggcga

SEQ ID NO: 3111621 - RNA, 14 nt, Mycobacterium bovis subsp bovis AF2122/97
ucuggccgaagccc

SEQ ID NO: 3111622 - RNA, 14 nt, Mycobacterium bovis subsp bovis AF2122/97
ucuggccugcccca

SEQ ID NO: 3111623 - RNA, 15 nt, Mycobacterium bovis subsp bovis AF2122/97
ucuggcgaacaguga

SEQ ID NO: 3111624 - RNA, 19 nt, Mycobacterium bovis subsp bovis AF2122/97
ucuggcgacgauucacggc

SEQ ID NO: 3111625 - RNA, 21 nt, Mycobacterium bovis subsp bovis AF2122/97
ucuggcgacucgugucugccu

SEQ ID NO: 3111626 - RNA, 17 nt, Mycobacterium bovis subsp bovis AF2122/97
ucuggcgcugcuggcag

SEQ ID NO: 3111627 - RNA, 19 nt, Mycobacterium bovis subsp bovis AF2122/97
ucuggcguagugcucgccg

SEQ ID NO: 3111628 - RNA, 15 nt, Mycobacterium bovis subsp bovis AF2122/97
ucuggcuacgggccg

SEQ ID NO: 3111629 - RNA, 18 nt, Mycobacterium bovis subsp bovis AF2122/97
ucuggcuacgggccgcgg

SEQ ID NO: 3111630 - RNA, 18 nt, Mycobacterium bovis subsp bovis AF2122/97
ucuggcuggaccacucgc

SEQ ID NO: 3111631 - RNA, 20 nt, Mycobacterium bovis subsp bovis AF2122/97
ucugggaccccgcugcgacg

SEQ ID NO: 3111632 - RNA, 22 nt, Mycobacterium bovis subsp bovis AF2122/97
ucugggaccgauaaguucggcu

SEQ ID NO: 3111633 - RNA, 15 nt, Mycobacterium bovis subsp bovis AF2122/97
ucugggccgcuccac

SEQ ID NO: 3111634 - RNA, 13 nt, Mycobacterium bovis subsp bovis AF2122/97
ucugggcgaucgc

SEQ ID NO: 3111635 - RNA, 20 nt, Mycobacterium bovis subsp bovis AF2122/97
ucuggggcaccacgcugugc

SEQ ID NO: 3111636 - RNA, 16 nt, Mycobacterium bovis subsp bovis AF2122/97
ucugggguccggugac

SEQ ID NO: 3111637 - RNA, 20 nt, Mycobacterium bovis subsp bovis AF2122/97
ucugggguuggcucggcgca

SEQ ID NO: 3111638 - RNA, 20 nt, Mycobacterium bovis subsp bovis AF2122/97
ucuggguccgucgagucgcc

SEQ ID NO: 3111639 - RNA, 21 nt, Mycobacterium bovis subsp bovis AF2122/97
ucuggguggacaggucgggcc

SEQ ID NO: 3111640 - RNA, 17 nt, Mycobacterium bovis subsp bovis AF2122/97
ucugguccagcaccggg

SEQ ID NO: 3111641 - RNA, 22 nt, Mycobacterium bovis subsp bovis AF2122/97
ucuggucgaccaucgguuugca

SEQ ID NO: 3111642 - RNA, 16 nt, Mycobacterium bovis subsp bovis AF2122/97
ucuggucggcggccuc

SEQ ID NO: 3111643 - RNA, 22 nt, Mycobacterium bovis subsp bovis AF2122/97
ucuggucggcuacggccagugc

SEQ ID NO: 3111644 - RNA, 19 nt, Mycobacterium bovis subsp bovis AF2122/97
ucuggugacggugaagccg

SEQ ID NO: 3111645 - RNA, 16 nt, Mycobacterium bovis subsp bovis AF2122/97
ucugguguccaccgca

SEQ ID NO: 3111646 - RNA, 17 nt, Mycobacterium bovis subsp bovis AF2122/97
ucugguguccaccgcaa

SEQ ID NO: 3111647 - RNA, 17 nt, Mycobacterium bovis subsp bovis AF2122/97
ucugguuguugccgacg

SEQ ID NO: 3111648 - RNA, 13 nt, Mycobacterium bovis subsp bovis AF2122/97
ucugucuggcccc

SEQ ID NO: 3111649 - RNA, 18 nt, Mycobacterium bovis subsp bovis AF2122/97
ucugugcgcggacaccuu

SEQ ID NO: 3111650 - RNA, 18 nt, Mycobacterium bovis subsp bovis AF2122/97
ucugugugacggaggucg

SEQ ID NO: 3111651 - RNA, 14 nt, Mycobacterium bovis subsp bovis AF2122/97
ucuguucgccgacg

SEQ ID NO: 3111652 - RNA, 18 nt, Mycobacterium bovis subsp bovis AF2122/97
ucuguugacucugcgucc

SEQ ID NO: 3111653 - RNA, 13 nt, Mycobacterium bovis subsp bovis AF2122/97
ucuuagccagcag

SEQ ID NO: 3111654 - RNA, 15 nt, Mycobacterium bovis subsp bovis AF2122/97
ucuuagccagcagca

SEQ ID NO: 3111655 - RNA, 18 nt, Mycobacterium bovis subsp bovis AF2122/97
ucuucaccggccggugcc

SEQ ID NO: 3111656 - RNA, 23 nt, Mycobacterium bovis subsp bovis AF2122/97
ucuucagguccaccgcugccggc

SEQ ID NO: 3111657 - RNA, 16 nt, Mycobacterium bovis subsp bovis AF2122/97
ucuuccacagcgcgua

SEQ ID NO: 3111658 - RNA, 18 nt, Mycobacterium bovis subsp bovis AF2122/97
ucuucccauuucggcaaa

SEQ ID NO: 3111659 - RNA, 18 nt, Mycobacterium bovis subsp bovis AF2122/97
ucuuccccucggccgccc

SEQ ID NO: 3111660 - RNA, 23 nt, Mycobacterium bovis subsp bovis AF2122/97
ucuuccggccacucaacgaccug

SEQ ID NO: 3111661 - RNA, 16 nt, Mycobacterium bovis subsp bovis AF2122/97
ucuuccucggccaccc

SEQ ID NO: 3111662 - RNA, 20 nt, Mycobacterium bovis subsp bovis AF2122/97
ucuucgccgucggcgacucc

SEQ ID NO: 3111663 - RNA, 23 nt, Mycobacterium bovis subsp bovis AF2122/97
ucuucgccgucggcgacuccucu

SEQ ID NO: 3111664 - RNA, 15 nt, Mycobacterium bovis subsp bovis AF2122/97
ucuucgcgcaaccag

SEQ ID NO: 3111665 - RNA, 13 nt, Mycobacterium bovis subsp bovis AF2122/97
ucuucgcgcagcc

SEQ ID NO: 3111666 - RNA, 13 nt, Mycobacterium bovis subsp bovis AF2122/97
ucuucgcgcgcuc

SEQ ID NO: 3111667 - RNA, 14 nt, Mycobacterium bovis subsp bovis AF2122/97
ucuucggaacgcca

SEQ ID NO: 3111668 - RNA, 17 nt, Mycobacterium bovis subsp bovis AF2122/97
ucuucggacagcagccg

SEQ ID NO: 3111669 - RNA, 16 nt, Mycobacterium bovis subsp bovis AF2122/97
ucuucggaggugaccu

SEQ ID NO: 3111670 - RNA, 13 nt, Mycobacterium bovis subsp bovis AF2122/97
ucuucggccagcu

SEQ ID NO: 3111671 - RNA, 18 nt, Mycobacterium bovis subsp bovis AF2122/97
ucuucggcggacaggccc

SEQ ID NO: 3111672 - RNA, 14 nt, Mycobacterium bovis subsp bovis AF2122/97
ucuucgggcagcgc

SEQ ID NO: 3111673 - RNA, 16 nt, Mycobacterium bovis subsp bovis AF2122/97
ucuucgggugcagcca

SEQ ID NO: 3111674 - RNA, 21 nt, Mycobacterium bovis subsp bovis AF2122/97
ucuucugccaucaacaggccu

SEQ ID NO: 3111675 - RNA, 12 nt, Mycobacterium bovis subsp bovis AF2122/97
ucuugaccagca

SEQ ID NO: 3111676 - RNA, 16 nt, Mycobacterium bovis subsp bovis AF2122/97
ucuugaccgcaccggc

SEQ ID NO: 3111677 - RNA, 23 nt, Mycobacterium bovis subsp bovis AF2122/97
ucuugaccgcggugacucggccu

SEQ ID NO: 3111678 - RNA, 16 nt, Mycobacterium bovis subsp bovis AF2122/97
ucuugcacucggcgcc

SEQ ID NO: 3111679 - RNA, 15 nt, Mycobacterium bovis subsp bovis AF2122/97
ucuugcaucgccaau

SEQ ID NO: 3111680 - RNA, 17 nt, Mycobacterium bovis subsp bovis AF2122/97
ucuugcaucgccaaugc

SEQ ID NO: 3111681 - RNA, 21 nt, Mycobacterium bovis subsp bovis AF2122/97
ucuugccgcgaaugaagcccu

SEQ ID NO: 3111682 - RNA, 17 nt, Mycobacterium bovis subsp bovis AF2122/97
ucuugcgacgcccgccu

SEQ ID NO: 3111683 - RNA, 21 nt, Mycobacterium bovis subsp bovis AF2122/97
ucuugcgacgcccgccuucga

SEQ ID NO: 3111684 - RNA, 20 nt, Mycobacterium bovis subsp bovis AF2122/97
ucuugcgcaaugccgacgcc

SEQ ID NO: 3111685 - RNA, 17 nt, Mycobacterium bovis subsp bovis AF2122/97
ucuuggaaggcgcgcgc

SEQ ID NO: 3111686 - RNA, 13 nt, Mycobacterium bovis subsp bovis AF2122/97
ucuuggccagcag

SEQ ID NO: 3111687 - RNA, 19 nt, Mycobacterium bovis subsp bovis AF2122/97
ucuuggcgaggauguaguu

SEQ ID NO: 3111688 - RNA, 18 nt, Mycobacterium bovis subsp bovis AF2122/97
ucuuggcgauccaggcca

SEQ ID NO: 3111689 - RNA, 19 nt, Mycobacterium bovis subsp bovis AF2122/97
ucuuggcgcccgccggcaa

SEQ ID NO: 3111690 - RNA, 21 nt, Mycobacterium bovis subsp bovis AF2122/97
ucuuggcguugaugucggcca

SEQ ID NO: 3111691 - RNA, 23 nt, Mycobacterium bovis subsp bovis AF2122/97
ucuugggccgggaugaagccacc

SEQ ID NO: 3111692 - RNA, 20 nt, Mycobacterium bovis subsp bovis AF2122/97
ucuuguuggcagcgggacug

SEQ ID NO: 3111693 - RNA, 19 nt, Mycobacterium bovis subsp bovis AF2122/97
ucuuguugugcugcaccgu

SEQ ID NO: 3111694 - RNA, 22 nt, Mycobacterium bovis subsp bovis AF2122/97
ucuuucccgccaccaaacccca

SEQ ID NO: 3111695 - RNA, 12 nt, Mycobacterium bovis subsp bovis AF2122/97
ucuuugagugcc

SEQ ID NO: 3111696 - RNA, 13 nt, Mycobacterium bovis subsp bovis AF2122/97
ucuuugcccgcca

SEQ ID NO: 3111697 - RNA, 15 nt, Mycobacterium bovis subsp bovis AF2122/97
ucuuugcccgccacg

SEQ ID NO: 3111698 - RNA, 20 nt, Mycobacterium bovis subsp bovis AF2122/97
ucuuugcucucggucugcau

SEQ ID NO: 3111699 - RNA, 22 nt, Mycobacterium bovis subsp bovis AF2122/97
ucuuugcucucggucugcaugc

SEQ ID NO: 3111700 - RNA, 16 nt, Mycobacterium bovis subsp bovis AF2122/97
ucuuugguagucugca

SEQ ID NO: 3111701 - RNA, 20 nt, Mycobacterium bovis subsp bovis AF2122/97
ugaaaaacgcccgcgcugcc

SEQ ID NO: 3111702 - RNA, 16 nt, Mycobacterium bovis subsp bovis AF2122/97
ugaaacagucgaccga

SEQ ID NO: 3111703 - RNA, 16 nt, Mycobacterium bovis subsp bovis AF2122/97
ugaaaccaccggccgu

SEQ ID NO: 3111704 - RNA, 23 nt, Mycobacterium bovis subsp bovis AF2122/97
ugaaacgauugcugcggcuuuca

SEQ ID NO: 3111705 - RNA, 20 nt, Mycobacterium bovis subsp bovis AF2122/97
ugaaagcuaccgaucgccaa

SEQ ID NO: 3111706 - RNA, 21 nt, Mycobacterium bovis subsp bovis AF2122/97
ugaaauccuaggguggcgauc

SEQ ID NO: 3111707 - RNA, 23 nt, Mycobacterium bovis subsp bovis AF2122/97
ugaacaagauucgcucaccaccg

SEQ ID NO: 3111708 - RNA, 19 nt, Mycobacterium bovis subsp bovis AF2122/97
ugaacaauccgguguugag

SEQ ID NO: 3111709 - RNA, 14 nt, Mycobacterium bovis subsp bovis AF2122/97
ugaacaccccuccu

SEQ ID NO: 3111710 - RNA, 16 nt, Mycobacterium bovis subsp bovis AF2122/97
ugaacaccggcgccuc

SEQ ID NO: 3111711 - RNA, 20 nt, Mycobacterium bovis subsp bovis AF2122/97
ugaacagcgacgccaugguc

SEQ ID NO: 3111712 - RNA, 23 nt, Mycobacterium bovis subsp bovis AF2122/97
ugaacagcgcgucggagccgggc

SEQ ID NO: 3111713 - RNA, 17 nt, Mycobacterium bovis subsp bovis AF2122/97
ugaacaguugcacaccg

SEQ ID NO: 3111714 - RNA, 17 nt, Mycobacterium bovis subsp bovis AF2122/97
ugaacaugugaccggcg

SEQ ID NO: 3111715 - RNA, 17 nt, Mycobacterium bovis subsp bovis AF2122/97
ugaaccagcugagccgu

SEQ ID NO: 3111716 - RNA, 23 nt, Mycobacterium bovis subsp bovis AF2122/97
ugaaccggccgcgacgacacgcc

SEQ ID NO: 3111717 - RNA, 15 nt, Mycobacterium bovis subsp bovis AF2122/97
ugaaccgggacacca

SEQ ID NO: 3111718 - RNA, 22 nt, Mycobacterium bovis subsp bovis AF2122/97
ugaaccgggucacuccggcggc

SEQ ID NO: 3111719 - RNA, 17 nt, Mycobacterium bovis subsp bovis AF2122/97
ugaaccguagcgcccac

SEQ ID NO: 3111720 - RNA, 22 nt, Mycobacterium bovis subsp bovis AF2122/97
ugaaccguagcgcccacuccaa

SEQ ID NO: 3111721 - RNA, 15 nt, Mycobacterium bovis subsp bovis AF2122/97
ugaaccuggcgacgc

SEQ ID NO: 3111722 - RNA, 17 nt, Mycobacterium bovis subsp bovis AF2122/97
ugaacgacauccggccg

SEQ ID NO: 3111723 - RNA, 23 nt, Mycobacterium bovis subsp bovis AF2122/97
ugaacgacccgcuggcucaucga

SEQ ID NO: 3111724 - RNA, 15 nt, Mycobacterium bovis subsp bovis AF2122/97
ugaacgagaugccgc

SEQ ID NO: 3111725 - RNA, 16 nt, Mycobacterium bovis subsp bovis AF2122/97
ugaacgagaugccgcg

SEQ ID NO: 3111726 - RNA, 18 nt, Mycobacterium bovis subsp bovis AF2122/97
ugaacgagaugccgcgau

SEQ ID NO: 3111727 - RNA, 13 nt, Mycobacterium bovis subsp bovis AF2122/97
ugaacgaucggac

SEQ ID NO: 3111728 - RNA, 18 nt, Mycobacterium bovis subsp bovis AF2122/97
ugaacgaucggaccacca

SEQ ID NO: 3111729 - RNA, 13 nt, Mycobacterium bovis subsp bovis AF2122/97
ugaacgcaccaac

SEQ ID NO: 3111730 - RNA, 14 nt, Mycobacterium bovis subsp bovis AF2122/97
ugaacgcaccaacg

SEQ ID NO: 3111731 - RNA, 23 nt, Mycobacterium bovis subsp bovis AF2122/97
ugaacgcacccgaauuugucggc

SEQ ID NO: 3111732 - RNA, 12 nt, Mycobacterium bovis subsp bovis AF2122/97
ugaacgccgcca

SEQ ID NO: 3111733 - RNA, 22 nt, Mycobacterium bovis subsp bovis AF2122/97
ugaacgcgaauaccagaccggc

SEQ ID NO: 3111734 - RNA, 21 nt, Mycobacterium bovis subsp bovis AF2122/97
ugaacgcggacaccgcggcga

SEQ ID NO: 3111735 - RNA, 16 nt, Mycobacterium bovis subsp bovis AF2122/97
ugaacgcguagucgcg

SEQ ID NO: 3111736 - RNA, 12 nt, Mycobacterium bovis subsp bovis AF2122/97
ugaacgcgugcu

SEQ ID NO: 3111737 - RNA, 18 nt, Mycobacterium bovis subsp bovis AF2122/97
ugaacgcuguaagcaugc

SEQ ID NO: 3111738 - RNA, 20 nt, Mycobacterium bovis subsp bovis AF2122/97
ugaacgcuuuccggcggugg

SEQ ID NO: 3111739 - RNA, 22 nt, Mycobacterium bovis subsp bovis AF2122/97
ugaacggcaaggucgcggccag

SEQ ID NO: 3111740 - RNA, 19 nt, Mycobacterium bovis subsp bovis AF2122/97
ugaacggcucgggaacuuc

SEQ ID NO: 3111741 - RNA, 16 nt, Mycobacterium bovis subsp bovis AF2122/97
ugaacgguucggccgg

SEQ ID NO: 3111742 - RNA, 22 nt, Mycobacterium bovis subsp bovis AF2122/97
ugaacgucacguggucggccac

SEQ ID NO: 3111743 - RNA, 16 nt, Mycobacterium bovis subsp bovis AF2122/97
ugaacuucccacccgg

SEQ ID NO: 3111744 - RNA, 16 nt, Mycobacterium bovis subsp bovis AF2122/97
ugaagaacuggcugcu

SEQ ID NO: 3111745 - RNA, 22 nt, Mycobacterium bovis subsp bovis AF2122/97
ugaagaagcccgaagacggggu

SEQ ID NO: 3111746 - RNA, 11 nt, Mycobacterium bovis subsp bovis AF2122/97
ugaagaagccg

SEQ ID NO: 3111747 - RNA, 19 nt, Mycobacterium bovis subsp bovis AF2122/97
ugaagaagccgguguugau

SEQ ID NO: 3111748 - RNA, 18 nt, Mycobacterium bovis subsp bovis AF2122/97
ugaagaauuucggcgccu

SEQ ID NO: 3111749 - RNA, 17 nt, Mycobacterium bovis subsp bovis AF2122/97
ugaagacaccggcgucg

SEQ ID NO: 3111750 - RNA, 18 nt, Mycobacterium bovis subsp bovis AF2122/97
ugaagaccaccgcccaca

SEQ ID NO: 3111751 - RNA, 22 nt, Mycobacterium bovis subsp bovis AF2122/97
ugaagaccaccgcccacagcaa

SEQ ID NO: 3111752 - RNA, 23 nt, Mycobacterium bovis subsp bovis AF2122/97
ugaagaccaccgcccacagcaac

SEQ ID NO: 3111753 - RNA, 20 nt, Mycobacterium bovis subsp bovis AF2122/97
ugaagcacacuguucccaca

SEQ ID NO: 3111754 - RNA, 13 nt, Mycobacterium bovis subsp bovis AF2122/97
ugaagcaguuggc

SEQ ID NO: 3111755 - RNA, 11 nt, Mycobacterium bovis subsp bovis AF2122/97
ugaagccagcg

SEQ ID NO: 3111756 - RNA, 13 nt, Mycobacterium bovis subsp bovis AF2122/97
ugaagccagcgca

SEQ ID NO: 3111757 - RNA, 22 nt, Mycobacterium bovis subsp bovis AF2122/97
ugaagccagcgcagcaccgaac

SEQ ID NO: 3111758 - RNA, 23 nt, Mycobacterium bovis subsp bovis AF2122/97
ugaagcccaacagcaacccgccg

SEQ ID NO: 3111759 - RNA, 17 nt, Mycobacterium bovis subsp bovis AF2122/97
ugaagccccuuggcgcc

SEQ ID NO: 3111760 - RNA, 15 nt, Mycobacterium bovis subsp bovis AF2122/97
ugaagccgcgcugcg

SEQ ID NO: 3111761 - RNA, 15 nt, Mycobacterium bovis subsp bovis AF2122/97
ugaagccgggcgcuu

SEQ ID NO: 3111762 - RNA, 21 nt, Mycobacterium bovis subsp bovis AF2122/97
ugaagccgggcgcuugcacca

SEQ ID NO: 3111763 - RNA, 14 nt, Mycobacterium bovis subsp bovis AF2122/97
ugaagcuuguccag

SEQ ID NO: 3111764 - RNA, 15 nt, Mycobacterium bovis subsp bovis AF2122/97
ugaagcuuguccaga

SEQ ID NO: 3111765 - RNA, 17 nt, Mycobacterium bovis subsp bovis AF2122/97
ugaaggcaaacaccagc

SEQ ID NO: 3111766 - RNA, 22 nt, Mycobacterium bovis subsp bovis AF2122/97
ugaaggcaaacaccagcccggc

SEQ ID NO: 3111767 - RNA, 20 nt, Mycobacterium bovis subsp bovis AF2122/97
ugaaggccccgccgguggcc

SEQ ID NO: 3111768 - RNA, 12 nt, Mycobacterium bovis subsp bovis AF2122/97
ugaaggcgccgg

SEQ ID NO: 3111769 - RNA, 19 nt, Mycobacterium bovis subsp bovis AF2122/97
ugaagggauccggaagccc

SEQ ID NO: 3111770 - RNA, 16 nt, Mycobacterium bovis subsp bovis AF2122/97
ugaagguucgaucgcg

SEQ ID NO: 3111771 - RNA, 18 nt, Mycobacterium bovis subsp bovis AF2122/97
ugaagucuuucgcuucgc

SEQ ID NO: 3111772 - RNA, 19 nt, Mycobacterium bovis subsp bovis AF2122/97
ugaagugggcguuggcggc

SEQ ID NO: 3111773 - RNA, 14 nt, Mycobacterium bovis subsp bovis AF2122/97
ugaaguuggcgugg

SEQ ID NO: 3111774 - RNA, 15 nt, Mycobacterium bovis subsp bovis AF2122/97
ugaaguugggaagug

SEQ ID NO: 3111775 - RNA, 20 nt, Mycobacterium bovis subsp bovis AF2122/97
ugaaucaccggagcgccgag

SEQ ID NO: 3111776 - RNA, 17 nt, Mycobacterium bovis subsp bovis AF2122/97
ugaauccagaccaugcg

SEQ ID NO: 3111777 - RNA, 21 nt, Mycobacterium bovis subsp bovis AF2122/97
ugaauccggcauacaucgccu

SEQ ID NO: 3111778 - RNA, 21 nt, Mycobacterium bovis subsp bovis AF2122/97
ugaaucgacugaucgccaccc

SEQ ID NO: 3111779 - RNA, 21 nt, Mycobacterium bovis subsp bovis AF2122/97
ugaaucgcgucgagagaacgu

SEQ ID NO: 3111780 - RNA, 19 nt, Mycobacterium bovis subsp bovis AF2122/97
ugaaucggaccgaccggcu

SEQ ID NO: 3111781 - RNA, 17 nt, Mycobacterium bovis subsp bovis AF2122/97
ugaaucgguucggccag

SEQ ID NO: 3111782 - RNA, 18 nt, Mycobacterium bovis subsp bovis AF2122/97
ugaaucucacgacgccuu

SEQ ID NO: 3111783 - RNA, 14 nt, Mycobacterium bovis subsp bovis AF2122/97
ugaauggcagcacg

SEQ ID NO: 3111784 - RNA, 13 nt, Mycobacterium bovis subsp bovis AF2122/97
ugaauggugaccg

SEQ ID NO: 3111785 - RNA, 16 nt, Mycobacterium bovis subsp bovis AF2122/97
ugaaugugcauagcaa

SEQ ID NO: 3111786 - RNA, 20 nt, Mycobacterium bovis subsp bovis AF2122/97
ugaauucgccgaacgguugc

SEQ ID NO: 3111787 - RNA, 16 nt, Mycobacterium bovis subsp bovis AF2122/97
ugaauucgcuugcagc

SEQ ID NO: 3111788 - RNA, 13 nt, Mycobacterium bovis subsp bovis AF2122/97
ugaauugccgggc

SEQ ID NO: 3111789 - RNA, 14 nt, Mycobacterium bovis subsp bovis AF2122/97
ugaauuggcgccga

SEQ ID NO: 3111790 - RNA, 21 nt, Mycobacterium bovis subsp bovis AF2122/97
ugaauuuggugaagccguaga

SEQ ID NO: 3111791 - RNA, 19 nt, Mycobacterium bovis subsp bovis AF2122/97
ugacaaaccugcaugccca

SEQ ID NO: 3111792 - RNA, 18 nt, Mycobacterium bovis subsp bovis AF2122/97
ugacaaccaucgguggcc

SEQ ID NO: 3111793 - RNA, 15 nt, Mycobacterium bovis subsp bovis AF2122/97
ugacaacugcgccgg

SEQ ID NO: 3111794 - RNA, 19 nt, Mycobacterium bovis subsp bovis AF2122/97
ugacaagcggcccgcugug

SEQ ID NO: 3111795 - RNA, 18 nt, Mycobacterium bovis subsp bovis AF2122/97
ugacaaggugcgcugggu

SEQ ID NO: 3111796 - RNA, 13 nt, Mycobacterium bovis subsp bovis AF2122/97
ugacacaacaccg

SEQ ID NO: 3111797 - RNA, 19 nt, Mycobacterium bovis subsp bovis AF2122/97
ugacacaacaccggcgugg

SEQ ID NO: 3111798 - RNA, 20 nt, Mycobacterium bovis subsp bovis AF2122/97
ugacaccaacaccgguggcu

SEQ ID NO: 3111799 - RNA, 15 nt, Mycobacterium bovis subsp bovis AF2122/97
ugacacccgggccac

SEQ ID NO: 3111800 - RNA, 21 nt, Mycobacterium bovis subsp bovis AF2122/97
ugacaccgaaccgccgcugcc

SEQ ID NO: 3111801 - RNA, 13 nt, Mycobacterium bovis subsp bovis AF2122/97
ugacaccgaccgg

SEQ ID NO: 3111802 - RNA, 19 nt, Mycobacterium bovis subsp bovis AF2122/97
ugacaccgaggucggccag

SEQ ID NO: 3111803 - RNA, 20 nt, Mycobacterium bovis subsp bovis AF2122/97
ugacaccgaggucggccagc

SEQ ID NO: 3111804 - RNA, 15 nt, Mycobacterium bovis subsp bovis AF2122/97
ugacaccggccacca

SEQ ID NO: 3111805 - RNA, 16 nt, Mycobacterium bovis subsp bovis AF2122/97
ugacaccggccaccag

SEQ ID NO: 3111806 - RNA, 19 nt, Mycobacterium bovis subsp bovis AF2122/97
ugacaccggggacgucgac

SEQ ID NO: 3111807 - RNA, 20 nt, Mycobacterium bovis subsp bovis AF2122/97
ugacacugccuuaaccgagc

SEQ ID NO: 3111808 - RNA, 17 nt, Mycobacterium bovis subsp bovis AF2122/97
ugacagacacagcaccg

SEQ ID NO: 3111809 - RNA, 17 nt, Mycobacterium bovis subsp bovis AF2122/97
ugacagcccgcuggccg

SEQ ID NO: 3111810 - RNA, 14 nt, Mycobacterium bovis subsp bovis AF2122/97
ugacagcuuucuug

SEQ ID NO: 3111811 - RNA, 13 nt, Mycobacterium bovis subsp bovis AF2122/97
ugacagugaccug

SEQ ID NO: 3111812 - RNA, 14 nt, Mycobacterium bovis subsp bovis AF2122/97
ugacaucgggccgc

SEQ ID NO: 3111813 - RNA, 18 nt, Mycobacterium bovis subsp bovis AF2122/97
ugacaucgggccgccgag

SEQ ID NO: 3111814 - RNA, 20 nt, Mycobacterium bovis subsp bovis AF2122/97
ugacaucgucgccagggccg

SEQ ID NO: 3111815 - RNA, 15 nt, Mycobacterium bovis subsp bovis AF2122/97
ugacauugaggucca

SEQ ID NO: 3111816 - RNA, 13 nt, Mycobacterium bovis subsp bovis AF2122/97
ugaccaacccucg

SEQ ID NO: 3111817 - RNA, 18 nt, Mycobacterium bovis subsp bovis AF2122/97
ugaccaacccucgccggu

SEQ ID NO: 3111818 - RNA, 14 nt, Mycobacterium bovis subsp bovis AF2122/97
ugaccaacgucgac

SEQ ID NO: 3111819 - RNA, 22 nt, Mycobacterium bovis subsp bovis AF2122/97
ugaccaacgucgcuccgaugug

SEQ ID NO: 3111820 - RNA, 22 nt, Mycobacterium bovis subsp bovis AF2122/97
ugaccaauccacugaucaaggc

SEQ ID NO: 3111821 - RNA, 19 nt, Mycobacterium bovis subsp bovis AF2122/97
ugaccaaugucagugcccc

SEQ ID NO: 3111822 - RNA, 21 nt, Mycobacterium bovis subsp bovis AF2122/97
ugaccacaaccgugagcacca

SEQ ID NO: 3111823 - RNA, 18 nt, Mycobacterium bovis subsp bovis AF2122/97
ugaccaccaccgagccgu

SEQ ID NO: 3111824 - RNA, 19 nt, Mycobacterium bovis subsp bovis AF2122/97
ugaccaccgccgacaggcc

SEQ ID NO: 3111825 - RNA, 20 nt, Mycobacterium bovis subsp bovis AF2122/97
ugaccaccgggcgcugcuug

SEQ ID NO: 3111826 - RNA, 22 nt, Mycobacterium bovis subsp bovis AF2122/97
ugaccacgaacgcgcgcagccg

SEQ ID NO: 3111827 - RNA, 15 nt, Mycobacterium bovis subsp bovis AF2122/97
ugaccacgccguggc

SEQ ID NO: 3111828 - RNA, 12 nt, Mycobacterium bovis subsp bovis AF2122/97
ugaccacgcugc

SEQ ID NO: 3111829 - RNA, 12 nt, Mycobacterium bovis subsp bovis AF2122/97
ugaccacgucgg

SEQ ID NO: 3111830 - RNA, 21 nt, Mycobacterium bovis subsp bovis AF2122/97
ugaccagcacaccgcccgcac

SEQ ID NO: 3111831 - RNA, 14 nt, Mycobacterium bovis subsp bovis AF2122/97
ugaccagcagcuga

SEQ ID NO: 3111832 - RNA, 17 nt, Mycobacterium bovis subsp bovis AF2122/97
ugaccagcaggccgggc

SEQ ID NO: 3111833 - RNA, 12 nt, Mycobacterium bovis subsp bovis AF2122/97
ugaccagcuucg

SEQ ID NO: 3111834 - RNA, 17 nt, Mycobacterium bovis subsp bovis AF2122/97
ugaccagcuucggcugg

SEQ ID NO: 3111835 - RNA, 11 nt, Mycobacterium bovis subsp bovis AF2122/97
ugaccaggcgg

SEQ ID NO: 3111836 - RNA, 15 nt, Mycobacterium bovis subsp bovis AF2122/97
ugaccaggcggcgcg

SEQ ID NO: 3111837 - RNA, 17 nt, Mycobacterium bovis subsp bovis AF2122/97
ugaccagggucugcuca

SEQ ID NO: 3111838 - RNA, 10 nt, Mycobacterium bovis subsp bovis AF2122/97
ugaccaggug

SEQ ID NO: 3111839 - RNA, 11 nt, Mycobacterium bovis subsp bovis AF2122/97
ugaccaggugc

SEQ ID NO: 3111840 - RNA, 16 nt, Mycobacterium bovis subsp bovis AF2122/97
ugaccagucgcggcgu

SEQ ID NO: 3111841 - RNA, 20 nt, Mycobacterium bovis subsp bovis AF2122/97
ugaccagugaucagcgcauc

SEQ ID NO: 3111842 - RNA, 21 nt, Mycobacterium bovis subsp bovis AF2122/97
ugaccaucguguacuggucug

SEQ ID NO: 3111843 - RNA, 22 nt, Mycobacterium bovis subsp bovis AF2122/97
ugaccaucguguacuggucugg

SEQ ID NO: 3111844 - RNA, 15 nt, Mycobacterium bovis subsp bovis AF2122/97
ugaccaugaugaccg

SEQ ID NO: 3111845 - RNA, 19 nt, Mycobacterium bovis subsp bovis AF2122/97
ugacccacacaccgagcac

SEQ ID NO: 3111846 - RNA, 21 nt, Mycobacterium bovis subsp bovis AF2122/97
ugacccaccgccccggcggcg

SEQ ID NO: 3111847 - RNA, 12 nt, Mycobacterium bovis subsp bovis AF2122/97
ugacccacugca

SEQ ID NO: 3111848 - RNA, 23 nt, Mycobacterium bovis subsp bovis AF2122/97
ugacccagaccggcucgucgggc

SEQ ID NO: 3111849 - RNA, 17 nt, Mycobacterium bovis subsp bovis AF2122/97
ugacccauucucggccg

SEQ ID NO: 3111850 - RNA, 18 nt, Mycobacterium bovis subsp bovis AF2122/97
ugacccauucucggccgg

SEQ ID NO: 3111851 - RNA, 19 nt, Mycobacterium bovis subsp bovis AF2122/97
ugacccccagcagggugug

SEQ ID NO: 3111852 - RNA, 20 nt, Mycobacterium bovis subsp bovis AF2122/97
ugaccccccgaccccgacgg

SEQ ID NO: 3111853 - RNA, 22 nt, Mycobacterium bovis subsp bovis AF2122/97
ugacccccggguagaccaccug

SEQ ID NO: 3111854 - RNA, 22 nt, Mycobacterium bovis subsp bovis AF2122/97
ugaccccgccggcugcggaggc

SEQ ID NO: 3111855 - RNA, 17 nt, Mycobacterium bovis subsp bovis AF2122/97
ugaccccggcagcgccc

SEQ ID NO: 3111856 - RNA, 13 nt, Mycobacterium bovis subsp bovis AF2122/97
ugaccccggcguu

SEQ ID NO: 3111857 - RNA, 19 nt, Mycobacterium bovis subsp bovis AF2122/97
ugaccccguaggcgccgaa

SEQ ID NO: 3111858 - RNA, 17 nt, Mycobacterium bovis subsp bovis AF2122/97
ugaccccuggccgccgg

SEQ ID NO: 3111859 - RNA, 19 nt, Mycobacterium bovis subsp bovis AF2122/97
ugaccccuggccgccggcg

SEQ ID NO: 3111860 - RNA, 19 nt, Mycobacterium bovis subsp bovis AF2122/97
ugacccgaaccgcaaggcc

SEQ ID NO: 3111861 - RNA, 15 nt, Mycobacterium bovis subsp bovis AF2122/97
ugacccgcaagucga

SEQ ID NO: 3111862 - RNA, 13 nt, Mycobacterium bovis subsp bovis AF2122/97
ugacccgcgggug

SEQ ID NO: 3111863 - RNA, 12 nt, Mycobacterium bovis subsp bovis AF2122/97
ugacccgcuggg

SEQ ID NO: 3111864 - RNA, 15 nt, Mycobacterium bovis subsp bovis AF2122/97
ugacccgcugggccg

SEQ ID NO: 3111865 - RNA, 17 nt, Mycobacterium bovis subsp bovis AF2122/97
ugacccggcagcccggc

SEQ ID NO: 3111866 - RNA, 22 nt, Mycobacterium bovis subsp bovis AF2122/97
ugacccggcagcccggcggccg

SEQ ID NO: 3111867 - RNA, 17 nt, Mycobacterium bovis subsp bovis AF2122/97
ugacccgggccgggccg

SEQ ID NO: 3111868 - RNA, 23 nt, Mycobacterium bovis subsp bovis AF2122/97
ugacccguacccacgacgggccg

SEQ ID NO: 3111869 - RNA, 20 nt, Mycobacterium bovis subsp bovis AF2122/97
ugacccguucagcgacggcc

SEQ ID NO: 3111870 - RNA, 21 nt, Mycobacterium bovis subsp bovis AF2122/97
ugacccguucagcgacggccg

SEQ ID NO: 3111871 - RNA, 16 nt, Mycobacterium bovis subsp bovis AF2122/97
ugacccguuccacgcc

SEQ ID NO: 3111872 - RNA, 21 nt, Mycobacterium bovis subsp bovis AF2122/97
ugacccucgggucgucgcgau

SEQ ID NO: 3111873 - RNA, 18 nt, Mycobacterium bovis subsp bovis AF2122/97
ugacccuugugccccgag

SEQ ID NO: 3111874 - RNA, 21 nt, Mycobacterium bovis subsp bovis AF2122/97
ugacccuugugccccgagcug

SEQ ID NO: 3111875 - RNA, 17 nt, Mycobacterium bovis subsp bovis AF2122/97
ugaccgaagaagcccga

SEQ ID NO: 3111876 - RNA, 23 nt, Mycobacterium bovis subsp bovis AF2122/97
ugaccgaagaagcccgacugguc

SEQ ID NO: 3111877 - RNA, 15 nt, Mycobacterium bovis subsp bovis AF2122/97
ugaccgaauggccgc

SEQ ID NO: 3111878 - RNA, 19 nt, Mycobacterium bovis subsp bovis AF2122/97
ugaccgaauggccgccgca

SEQ ID NO: 3111879 - RNA, 19 nt, Mycobacterium bovis subsp bovis AF2122/97
ugaccgacgccgucgagca

SEQ ID NO: 3111880 - RNA, 13 nt, Mycobacterium bovis subsp bovis AF2122/97
ugaccgaguugaa

SEQ ID NO: 3111881 - RNA, 14 nt, Mycobacterium bovis subsp bovis AF2122/97
ugaccgcaccggcc

SEQ ID NO: 3111882 - RNA, 16 nt, Mycobacterium bovis subsp bovis AF2122/97
ugaccgcaccggccgc

SEQ ID NO: 3111883 - RNA, 17 nt, Mycobacterium bovis subsp bovis AF2122/97
ugaccgcaccggccgcu

SEQ ID NO: 3111884 - RNA, 14 nt, Mycobacterium bovis subsp bovis AF2122/97
ugaccgcaguccca

SEQ ID NO: 3111885 - RNA, 15 nt, Mycobacterium bovis subsp bovis AF2122/97
ugaccgcagucccag

SEQ ID NO: 3111886 - RNA, 17 nt, Mycobacterium bovis subsp bovis AF2122/97
ugaccgccaucgccaac

SEQ ID NO: 3111887 - RNA, 18 nt, Mycobacterium bovis subsp bovis AF2122/97
ugaccgccaucgccaaca

SEQ ID NO: 3111888 - RNA, 15 nt, Mycobacterium bovis subsp bovis AF2122/97
ugaccgccgaugccc

SEQ ID NO: 3111889 - RNA, 20 nt, Mycobacterium bovis subsp bovis AF2122/97
ugaccgccgaugcccgacac

SEQ ID NO: 3111890 - RNA, 14 nt, Mycobacterium bovis subsp bovis AF2122/97
ugaccgccgccgga

SEQ ID NO: 3111891 - RNA, 15 nt, Mycobacterium bovis subsp bovis AF2122/97
ugaccgccgcgccgg

SEQ ID NO: 3111892 - RNA, 18 nt, Mycobacterium bovis subsp bovis AF2122/97
ugaccgccgcgccggcac

SEQ ID NO: 3111893 - RNA, 23 nt, Mycobacterium bovis subsp bovis AF2122/97
ugaccgccgcgccggcacgggcg

SEQ ID NO: 3111894 - RNA, 21 nt, Mycobacterium bovis subsp bovis AF2122/97
ugaccgccugcuggccgcggc

SEQ ID NO: 3111895 - RNA, 14 nt, Mycobacterium bovis subsp bovis AF2122/97
ugaccgcgaucgcc

SEQ ID NO: 3111896 - RNA, 21 nt, Mycobacterium bovis subsp bovis AF2122/97
ugaccgcgccggacagcgcau

SEQ ID NO: 3111897 - RNA, 14 nt, Mycobacterium bovis subsp bovis AF2122/97
ugaccgcggugacu

SEQ ID NO: 3111898 - RNA, 21 nt, Mycobacterium bovis subsp bovis AF2122/97
ugaccgcggugacucggccuc

SEQ ID NO: 3111899 - RNA, 21 nt, Mycobacterium bovis subsp bovis AF2122/97
ugaccgcguagagcagcagau

SEQ ID NO: 3111900 - RNA, 15 nt, Mycobacterium bovis subsp bovis AF2122/97
ugaccgcguccacgg

SEQ ID NO: 3111901 - RNA, 18 nt, Mycobacterium bovis subsp bovis AF2122/97
ugaccgcgugagcagacg

SEQ ID NO: 3111902 - RNA, 22 nt, Mycobacterium bovis subsp bovis AF2122/97
ugaccgcuaccagcugggcgac

SEQ ID NO: 3111903 - RNA, 15 nt, Mycobacterium bovis subsp bovis AF2122/97
ugaccgcugccgacg

SEQ ID NO: 3111904 - RNA, 15 nt, Mycobacterium bovis subsp bovis AF2122/97
ugaccgcuggugugu

SEQ ID NO: 3111905 - RNA, 18 nt, Mycobacterium bovis subsp bovis AF2122/97
ugaccgcuugcccgcgca

SEQ ID NO: 3111906 - RNA, 20 nt, Mycobacterium bovis subsp bovis AF2122/97
ugaccggaucugacggcgcc

SEQ ID NO: 3111907 - RNA, 20 nt, Mycobacterium bovis subsp bovis AF2122/97
ugaccggcaaccgccgugug

SEQ ID NO: 3111908 - RNA, 15 nt, Mycobacterium bovis subsp bovis AF2122/97
ugaccgggaggcggc

SEQ ID NO: 3111909 - RNA, 21 nt, Mycobacterium bovis subsp bovis AF2122/97
ugaccgggaggcggcgccgca

SEQ ID NO: 3111910 - RNA, 22 nt, Mycobacterium bovis subsp bovis AF2122/97
ugaccgggagucgguaucggca

SEQ ID NO: 3111911 - RNA, 22 nt, Mycobacterium bovis subsp bovis AF2122/97
ugaccggggcgcccggccaggu

SEQ ID NO: 3111912 - RNA, 22 nt, Mycobacterium bovis subsp bovis AF2122/97
ugaccggggucggccugcggca

SEQ ID NO: 3111913 - RNA, 20 nt, Mycobacterium bovis subsp bovis AF2122/97
ugaccgggucgaucaccgac

SEQ ID NO: 3111914 - RNA, 21 nt, Mycobacterium bovis subsp bovis AF2122/97
ugaccgggucgaugacgccgu

SEQ ID NO: 3111915 - RNA, 22 nt, Mycobacterium bovis subsp bovis AF2122/97
ugaccgggucgaugacgccguc

SEQ ID NO: 3111916 - RNA, 16 nt, Mycobacterium bovis subsp bovis AF2122/97
ugaccgggucgccgau

SEQ ID NO: 3111917 - RNA, 16 nt, Mycobacterium bovis subsp bovis AF2122/97
ugaccggucacccgug

SEQ ID NO: 3111918 - RNA, 23 nt, Mycobacterium bovis subsp bovis AF2122/97
ugaccgguucccgggcagccgca

SEQ ID NO: 3111919 - RNA, 16 nt, Mycobacterium bovis subsp bovis AF2122/97
ugaccguauagccgac

SEQ ID NO: 3111920 - RNA, 17 nt, Mycobacterium bovis subsp bovis AF2122/97
ugaccguauagccgacg

SEQ ID NO: 3111921 - RNA, 23 nt, Mycobacterium bovis subsp bovis AF2122/97
ugaccguauagccgacgccggug

SEQ ID NO: 3111922 - RNA, 16 nt, Mycobacterium bovis subsp bovis AF2122/97
ugaccguccaccgacg

SEQ ID NO: 3111923 - RNA, 22 nt, Mycobacterium bovis subsp bovis AF2122/97
ugaccgucugcgacccgggccg

SEQ ID NO: 3111924 - RNA, 12 nt, Mycobacterium bovis subsp bovis AF2122/97
ugaccgugccgu

SEQ ID NO: 3111925 - RNA, 15 nt, Mycobacterium bovis subsp bovis AF2122/97
ugaccguggcgccgg

SEQ ID NO: 3111926 - RNA, 20 nt, Mycobacterium bovis subsp bovis AF2122/97
ugaccguguggccguuggcc

SEQ ID NO: 3111927 - RNA, 16 nt, Mycobacterium bovis subsp bovis AF2122/97
ugaccguucggcgguc

SEQ ID NO: 3111928 - RNA, 18 nt, Mycobacterium bovis subsp bovis AF2122/97
ugaccucacgggcgccgc

SEQ ID NO: 3111929 - RNA, 15 nt, Mycobacterium bovis subsp bovis AF2122/97
ugaccucgcgcaccg

SEQ ID NO: 3111930 - RNA, 19 nt, Mycobacterium bovis subsp bovis AF2122/97
ugaccucgcgcaccggcug

SEQ ID NO: 3111931 - RNA, 18 nt, Mycobacterium bovis subsp bovis AF2122/97
ugaccucggcgaccagaa

SEQ ID NO: 3111932 - RNA, 14 nt, Mycobacterium bovis subsp bovis AF2122/97
ugaccucggcgacg

SEQ ID NO: 3111933 - RNA, 15 nt, Mycobacterium bovis subsp bovis AF2122/97
ugaccucggugaaga

SEQ ID NO: 3111934 - RNA, 14 nt, Mycobacterium bovis subsp bovis AF2122/97
ugaccucgucggcg

SEQ ID NO: 3111935 - RNA, 21 nt, Mycobacterium bovis subsp bovis AF2122/97
ugaccucuucgggcagcgcgu

SEQ ID NO: 3111936 - RNA, 16 nt, Mycobacterium bovis subsp bovis AF2122/97
ugaccugauccggccg

SEQ ID NO: 3111937 - RNA, 17 nt, Mycobacterium bovis subsp bovis AF2122/97
ugaccugcuggcgcacg

SEQ ID NO: 3111938 - RNA, 17 nt, Mycobacterium bovis subsp bovis AF2122/97
ugaccuguugaacggcc

SEQ ID NO: 3111939 - RNA, 13 nt, Mycobacterium bovis subsp bovis AF2122/97
ugaccuguuuggg

SEQ ID NO: 3111940 - RNA, 17 nt, Mycobacterium bovis subsp bovis AF2122/97
ugaccuguuuggggcug

SEQ ID NO: 3111941 - RNA, 15 nt, Mycobacterium bovis subsp bovis AF2122/97
ugaccuucaccugga

SEQ ID NO: 3111942 - RNA, 15 nt, Mycobacterium bovis subsp bovis AF2122/97
ugaccuucucgucgg

SEQ ID NO: 3111943 - RNA, 12 nt, Mycobacterium bovis subsp bovis AF2122/97
ugaccuugcccu

SEQ ID NO: 3111944 - RNA, 22 nt, Mycobacterium bovis subsp bovis AF2122/97
ugaccuugcccugcgugcagau

SEQ ID NO: 3111945 - RNA, 18 nt, Mycobacterium bovis subsp bovis AF2122/97
ugaccuuggccgugcccg

SEQ ID NO: 3111946 - RNA, 16 nt, Mycobacterium bovis subsp bovis AF2122/97
ugaccuugggaccacc

SEQ ID NO: 3111947 - RNA, 18 nt, Mycobacterium bovis subsp bovis AF2122/97
ugaccuuguugaccacca

SEQ ID NO: 3111948 - RNA, 15 nt, Mycobacterium bovis subsp bovis AF2122/97
ugacgaacccaccgu

SEQ ID NO: 3111949 - RNA, 22 nt, Mycobacterium bovis subsp bovis AF2122/97
ugacgaacuggucucggcugag

SEQ ID NO: 3111950 - RNA, 18 nt, Mycobacterium bovis subsp bovis AF2122/97
ugacgaacuucgaugccg

SEQ ID NO: 3111951 - RNA, 21 nt, Mycobacterium bovis subsp bovis AF2122/97
ugacgaaucgccuaccggccu

SEQ ID NO: 3111952 - RNA, 22 nt, Mycobacterium bovis subsp bovis AF2122/97
ugacgaaugggucuuugcccgc

SEQ ID NO: 3111953 - RNA, 20 nt, Mycobacterium bovis subsp bovis AF2122/97
ugacgaauugguugcccuug

SEQ ID NO: 3111954 - RNA, 18 nt, Mycobacterium bovis subsp bovis AF2122/97
ugacgacaaacggcgacc

SEQ ID NO: 3111955 - RNA, 17 nt, Mycobacterium bovis subsp bovis AF2122/97
ugacgaccaaccaccga

SEQ ID NO: 3111956 - RNA, 15 nt, Mycobacterium bovis subsp bovis AF2122/97
ugacgaccagccccg

SEQ ID NO: 3111957 - RNA, 16 nt, Mycobacterium bovis subsp bovis AF2122/97
ugacgaccagccccgc

SEQ ID NO: 3111958 - RNA, 17 nt, Mycobacterium bovis subsp bovis AF2122/97
ugacgacgagggccagc

SEQ ID NO: 3111959 - RNA, 17 nt, Mycobacterium bovis subsp bovis AF2122/97
ugacgacgagggcggga

SEQ ID NO: 3111960 - RNA, 17 nt, Mycobacterium bovis subsp bovis AF2122/97
ugacgacgccgucggac

SEQ ID NO: 3111961 - RNA, 19 nt, Mycobacterium bovis subsp bovis AF2122/97
ugacgacgcgacacgccga

SEQ ID NO: 3111962 - RNA, 13 nt, Mycobacterium bovis subsp bovis AF2122/97
ugacgacugggcg

SEQ ID NO: 3111963 - RNA, 20 nt, Mycobacterium bovis subsp bovis AF2122/97
ugacgagacgacgaccggcu

SEQ ID NO: 3111964 - RNA, 23 nt, Mycobacterium bovis subsp bovis AF2122/97
ugacgagcagcuagcccggcagc

SEQ ID NO: 3111965 - RNA, 16 nt, Mycobacterium bovis subsp bovis AF2122/97
ugacgaggcgagcggc

SEQ ID NO: 3111966 - RNA, 21 nt, Mycobacterium bovis subsp bovis AF2122/97
ugacgaggcgagcggccaguc

SEQ ID NO: 3111967 - RNA, 17 nt, Mycobacterium bovis subsp bovis AF2122/97
ugacgaguucgcugacc

SEQ ID NO: 3111968 - RNA, 19 nt, Mycobacterium bovis subsp bovis AF2122/97
ugacgaucagcgugaucug

SEQ ID NO: 3111969 - RNA, 15 nt, Mycobacterium bovis subsp bovis AF2122/97
ugacgaucaggucgc

SEQ ID NO: 3111970 - RNA, 18 nt, Mycobacterium bovis subsp bovis AF2122/97
ugacgaucgacagccccg

SEQ ID NO: 3111971 - RNA, 17 nt, Mycobacterium bovis subsp bovis AF2122/97
ugacgaucgagcugacg

SEQ ID NO: 3111972 - RNA, 17 nt, Mycobacterium bovis subsp bovis AF2122/97
ugacgaucgcggcgggc

SEQ ID NO: 3111973 - RNA, 14 nt, Mycobacterium bovis subsp bovis AF2122/97
ugacgaucggcggc

SEQ ID NO: 3111974 - RNA, 17 nt, Mycobacterium bovis subsp bovis AF2122/97
ugacgaucggcggcgcg

SEQ ID NO: 3111975 - RNA, 17 nt, Mycobacterium bovis subsp bovis AF2122/97
ugacgaugaccgcgcgg

SEQ ID NO: 3111976 - RNA, 16 nt, Mycobacterium bovis subsp bovis AF2122/97
ugacgauggccgccgc

SEQ ID NO: 3111977 - RNA, 19 nt, Mycobacterium bovis subsp bovis AF2122/97
ugacgauggccgccgcgag

SEQ ID NO: 3111978 - RNA, 22 nt, Mycobacterium bovis subsp bovis AF2122/97
ugacgauucgagcaacugcucg

SEQ ID NO: 3111979 - RNA, 14 nt, Mycobacterium bovis subsp bovis AF2122/97
ugacgauugccacc

SEQ ID NO: 3111980 - RNA, 14 nt, Mycobacterium bovis subsp bovis AF2122/97
ugacgcaacaucgg

SEQ ID NO: 3111981 - RNA, 15 nt, Mycobacterium bovis subsp bovis AF2122/97
ugacgcacagcagca

SEQ ID NO: 3111982 - RNA, 20 nt, Mycobacterium bovis subsp bovis AF2122/97
ugacgcacagcagcaccgcg

SEQ ID NO: 3111983 - RNA, 18 nt, Mycobacterium bovis subsp bovis AF2122/97
ugacgcacgacugugcgc

SEQ ID NO: 3111984 - RNA, 22 nt, Mycobacterium bovis subsp bovis AF2122/97
ugacgcacgacugugcgccgca

SEQ ID NO: 3111985 - RNA, 13 nt, Mycobacterium bovis subsp bovis AF2122/97
ugacgcagcccgc

SEQ ID NO: 3111986 - RNA, 21 nt, Mycobacterium bovis subsp bovis AF2122/97
ugacgcagcucgugaccgccg

SEQ ID NO: 3111987 - RNA, 11 nt, Mycobacterium bovis subsp bovis AF2122/97
ugacgccaacg

SEQ ID NO: 3111988 - RNA, 19 nt, Mycobacterium bovis subsp bovis AF2122/97
ugacgccacgaccgccgau

SEQ ID NO: 3111989 - RNA, 15 nt, Mycobacterium bovis subsp bovis AF2122/97
ugacgccaucgaucg

SEQ ID NO: 3111990 - RNA, 16 nt, Mycobacterium bovis subsp bovis AF2122/97
ugacgcccaucucaug

SEQ ID NO: 3111991 - RNA, 15 nt, Mycobacterium bovis subsp bovis AF2122/97
ugacgccggcgggug

SEQ ID NO: 3111992 - RNA, 16 nt, Mycobacterium bovis subsp bovis AF2122/97
ugacgccgguccccgc

SEQ ID NO: 3111993 - RNA, 17 nt, Mycobacterium bovis subsp bovis AF2122/97
ugacgccgucagcggcc

SEQ ID NO: 3111994 - RNA, 19 nt, Mycobacterium bovis subsp bovis AF2122/97
ugacgccgucggcgcgcac

SEQ ID NO: 3111995 - RNA, 16 nt, Mycobacterium bovis subsp bovis AF2122/97
ugacgccguugccacc

SEQ ID NO: 3111996 - RNA, 15 nt, Mycobacterium bovis subsp bovis AF2122/97
ugacgccguugccgc

SEQ ID NO: 3111997 - RNA, 17 nt, Mycobacterium bovis subsp bovis AF2122/97
ugacgcgacgagccgca

SEQ ID NO: 3111998 - RNA, 14 nt, Mycobacterium bovis subsp bovis AF2122/97
ugacgcggacgaac

SEQ ID NO: 3111999 - RNA, 13 nt, Mycobacterium bovis subsp bovis AF2122/97
ugacgcggccaca

SEQ ID NO: 3112000 - RNA, 15 nt, Mycobacterium bovis subsp bovis AF2122/97
ugacgcggccgggcg

SEQ ID NO: 3112001 - RNA, 20 nt, Mycobacterium bovis subsp bovis AF2122/97
ugacgcgucagcggcgagca

SEQ ID NO: 3112002 - RNA, 22 nt, Mycobacterium bovis subsp bovis AF2122/97
ugacgcguucaacaccgccgac

SEQ ID NO: 3112003 - RNA, 15 nt, Mycobacterium bovis subsp bovis AF2122/97
ugacgcuaacgucga

SEQ ID NO: 3112004 - RNA, 16 nt, Mycobacterium bovis subsp bovis AF2122/97
ugacgcuaacgucgau

SEQ ID NO: 3112005 - RNA, 18 nt, Mycobacterium bovis subsp bovis AF2122/97
ugacgcucggucgccacc

SEQ ID NO: 3112006 - RNA, 22 nt, Mycobacterium bovis subsp bovis AF2122/97
ugacgcucggucgccaccgccg

SEQ ID NO: 3112007 - RNA, 16 nt, Mycobacterium bovis subsp bovis AF2122/97
ugacgcucugcgaguu

SEQ ID NO: 3112008 - RNA, 22 nt, Mycobacterium bovis subsp bovis AF2122/97
ugacggaguucaagguguucug

SEQ ID NO: 3112009 - RNA, 18 nt, Mycobacterium bovis subsp bovis AF2122/97
ugacggaguuggcccgac

SEQ ID NO: 3112010 - RNA, 18 nt, Mycobacterium bovis subsp bovis AF2122/97
ugacggcagaccaugguc

SEQ ID NO: 3112011 - RNA, 15 nt, Mycobacterium bovis subsp bovis AF2122/97
ugacggccaguuggu

SEQ ID NO: 3112012 - RNA, 17 nt, Mycobacterium bovis subsp bovis AF2122/97
ugacggcgaacccgccg

SEQ ID NO: 3112013 - RNA, 23 nt, Mycobacterium bovis subsp bovis AF2122/97
ugacggcgaacccgccgaugcug

SEQ ID NO: 3112014 - RNA, 15 nt, Mycobacterium bovis subsp bovis AF2122/97
ugacggcgccaggca

SEQ ID NO: 3112015 - RNA, 13 nt, Mycobacterium bovis subsp bovis AF2122/97
ugacggcggcccg

SEQ ID NO: 3112016 - RNA, 19 nt, Mycobacterium bovis subsp bovis AF2122/97
ugacggcggcugucggccg

SEQ ID NO: 3112017 - RNA, 20 nt, Mycobacterium bovis subsp bovis AF2122/97
ugacggcggcugucggccgg

SEQ ID NO: 3112018 - RNA, 12 nt, Mycobacterium bovis subsp bovis AF2122/97
ugacggcggggc

SEQ ID NO: 3112019 - RNA, 21 nt, Mycobacterium bovis subsp bovis AF2122/97
ugacggcggguuuucucgccg

SEQ ID NO: 3112020 - RNA, 22 nt, Mycobacterium bovis subsp bovis AF2122/97
ugacggcggguuuucucgccgu

SEQ ID NO: 3112021 - RNA, 14 nt, Mycobacterium bovis subsp bovis AF2122/97
ugacggcgguaccg

SEQ ID NO: 3112022 - RNA, 18 nt, Mycobacterium bovis subsp bovis AF2122/97
ugacggcgguaccgccgc

SEQ ID NO: 3112023 - RNA, 17 nt, Mycobacterium bovis subsp bovis AF2122/97
ugacggcgucgaccucg

SEQ ID NO: 3112024 - RNA, 21 nt, Mycobacterium bovis subsp bovis AF2122/97
ugacggcuuccaacucggcgg

SEQ ID NO: 3112025 - RNA, 21 nt, Mycobacterium bovis subsp bovis AF2122/97
ugacgggaaacuccgcggcgc

SEQ ID NO: 3112026 - RNA, 22 nt, Mycobacterium bovis subsp bovis AF2122/97
ugacgggaaacuccgcggcgcg

SEQ ID NO: 3112027 - RNA, 24 nt, Mycobacterium bovis subsp bovis AF2122/97
ugacgggaaacuccgcggcgcgca

SEQ ID NO: 3112028 - RNA, 21 nt, Mycobacterium bovis subsp bovis AF2122/97
ugacgggcagaggcuggcgca

SEQ ID NO: 3112029 - RNA, 17 nt, Mycobacterium bovis subsp bovis AF2122/97
ugacggggcugaccgcc

SEQ ID NO: 3112030 - RNA, 19 nt, Mycobacterium bovis subsp bovis AF2122/97
ugacgggguugaccgccac

SEQ ID NO: 3112031 - RNA, 20 nt, Mycobacterium bovis subsp bovis AF2122/97
ugacgggguugaccgccacc

SEQ ID NO: 3112032 - RNA, 18 nt, Mycobacterium bovis subsp bovis AF2122/97
ugacgguacagcuccaca

SEQ ID NO: 3112033 - RNA, 19 nt, Mycobacterium bovis subsp bovis AF2122/97
ugacggucagccgcggggc

SEQ ID NO: 3112034 - RNA, 19 nt, Mycobacterium bovis subsp bovis AF2122/97
ugacgguccacgacgucga

SEQ ID NO: 3112035 - RNA, 16 nt, Mycobacterium bovis subsp bovis AF2122/97
ugacgguccccagguc

SEQ ID NO: 3112036 - RNA, 20 nt, Mycobacterium bovis subsp bovis AF2122/97
ugacgguccguucgaugcca

SEQ ID NO: 3112037 - RNA, 21 nt, Mycobacterium bovis subsp bovis AF2122/97
ugacgguccguucgaugccag

SEQ ID NO: 3112038 - RNA, 15 nt, Mycobacterium bovis subsp bovis AF2122/97
ugacggugcaggacc

SEQ ID NO: 3112039 - RNA, 14 nt, Mycobacterium bovis subsp bovis AF2122/97
ugacggugccgacc

SEQ ID NO: 3112040 - RNA, 18 nt, Mycobacterium bovis subsp bovis AF2122/97
ugacgguggggauggcgc

SEQ ID NO: 3112041 - RNA, 15 nt, Mycobacterium bovis subsp bovis AF2122/97
ugacgguguuggugg

SEQ ID NO: 3112042 - RNA, 20 nt, Mycobacterium bovis subsp bovis AF2122/97
ugacgguugccccggcgacc

SEQ ID NO: 3112043 - RNA, 22 nt, Mycobacterium bovis subsp bovis AF2122/97
ugacguagaagucgaucgccga

SEQ ID NO: 3112044 - RNA, 21 nt, Mycobacterium bovis subsp bovis AF2122/97
ugacguagaccacgccgguga

SEQ ID NO: 3112045 - RNA, 19 nt, Mycobacterium bovis subsp bovis AF2122/97
ugacguaggcggcggcccg

SEQ ID NO: 3112046 - RNA, 15 nt, Mycobacterium bovis subsp bovis AF2122/97
ugacguagggcagcg

SEQ ID NO: 3112047 - RNA, 22 nt, Mycobacterium bovis subsp bovis AF2122/97
ugacguagggcagcgccaggcc

SEQ ID NO: 3112048 - RNA, 23 nt, Mycobacterium bovis subsp bovis AF2122/97
ugacgucaagagugcucagcgcg

SEQ ID NO: 3112049 - RNA, 18 nt, Mycobacterium bovis subsp bovis AF2122/97
ugacgucaccacgaucgc

SEQ ID NO: 3112050 - RNA, 19 nt, Mycobacterium bovis subsp bovis AF2122/97
ugacgucacguucggcgca

SEQ ID NO: 3112051 - RNA, 13 nt, Mycobacterium bovis subsp bovis AF2122/97
ugacgucaggcug

SEQ ID NO: 3112052 - RNA, 12 nt, Mycobacterium bovis subsp bovis AF2122/97
ugacguccaaca

SEQ ID NO: 3112053 - RNA, 14 nt, Mycobacterium bovis subsp bovis AF2122/97
ugacgucgucggcc

SEQ ID NO: 3112054 - RNA, 16 nt, Mycobacterium bovis subsp bovis AF2122/97
ugacgucgucggccaa

SEQ ID NO: 3112055 - RNA, 22 nt, Mycobacterium bovis subsp bovis AF2122/97
ugacgucguggcgcucggcgag

SEQ ID NO: 3112056 - RNA, 18 nt, Mycobacterium bovis subsp bovis AF2122/97
ugacgugaguuucaccac

SEQ ID NO: 3112057 - RNA, 13 nt, Mycobacterium bovis subsp bovis AF2122/97
ugacgugcggcgc

SEQ ID NO: 3112058 - RNA, 18 nt, Mycobacterium bovis subsp bovis AF2122/97
ugacgugugagggccggg

SEQ ID NO: 3112059 - RNA, 14 nt, Mycobacterium bovis subsp bovis AF2122/97
ugacguugcagccg

SEQ ID NO: 3112060 - RNA, 18 nt, Mycobacterium bovis subsp bovis AF2122/97
ugacguugcagccggcau

SEQ ID NO: 3112061 - RNA, 15 nt, Mycobacterium bovis subsp bovis AF2122/97
ugacguuggcaggca

SEQ ID NO: 3112062 - RNA, 15 nt, Mycobacterium bovis subsp bovis AF2122/97
ugacguugugccuua

SEQ ID NO: 3112063 - RNA, 19 nt, Mycobacterium bovis subsp bovis AF2122/97
ugacguuguuggauccggc

SEQ ID NO: 3112064 - RNA, 22 nt, Mycobacterium bovis subsp bovis AF2122/97
ugacguuuggauggcuggccag

SEQ ID NO: 3112065 - RNA, 15 nt, Mycobacterium bovis subsp bovis AF2122/97
ugacuaccaccgcgu

SEQ ID NO: 3112066 - RNA, 22 nt, Mycobacterium bovis subsp bovis AF2122/97
ugacuccugcggcaccgcugag

SEQ ID NO: 3112067 - RNA, 21 nt, Mycobacterium bovis subsp bovis AF2122/97
ugacucgaucaccaugaugua

SEQ ID NO: 3112068 - RNA, 20 nt, Mycobacterium bovis subsp bovis AF2122/97
ugacucgggcacgggugacg

SEQ ID NO: 3112069 - RNA, 17 nt, Mycobacterium bovis subsp bovis AF2122/97
ugacucugcguccacca

SEQ ID NO: 3112070 - RNA, 19 nt, Mycobacterium bovis subsp bovis AF2122/97
ugacucugcguccaccgga

SEQ ID NO: 3112071 - RNA, 21 nt, Mycobacterium bovis subsp bovis AF2122/97
ugacucugcguccaccggacg

SEQ ID NO: 3112072 - RNA, 15 nt, Mycobacterium bovis subsp bovis AF2122/97
ugacugcacaccacc

SEQ ID NO: 3112073 - RNA, 19 nt, Mycobacterium bovis subsp bovis AF2122/97
ugacugcacaccaccgccg

SEQ ID NO: 3112074 - RNA, 15 nt, Mycobacterium bovis subsp bovis AF2122/97
ugacuggccgcccgg

SEQ ID NO: 3112075 - RNA, 15 nt, Mycobacterium bovis subsp bovis AF2122/97
ugacuugagcggcuu

SEQ ID NO: 3112076 - RNA, 17 nt, Mycobacterium bovis subsp bovis AF2122/97
ugacuuggagugcgggu

SEQ ID NO: 3112077 - RNA, 21 nt, Mycobacterium bovis subsp bovis AF2122/97
ugagaacaacgggauccgcgc

SEQ ID NO: 3112078 - RNA, 22 nt, Mycobacterium bovis subsp bovis AF2122/97
ugagaacaacgggauccgcgcg

SEQ ID NO: 3112079 - RNA, 12 nt, Mycobacterium bovis subsp bovis AF2122/97
ugagaagaagcc

SEQ ID NO: 3112080 - RNA, 20 nt, Mycobacterium bovis subsp bovis AF2122/97
ugagacaaaggugccgaccg

SEQ ID NO: 3112081 - RNA, 17 nt, Mycobacterium bovis subsp bovis AF2122/97
ugagaccagguucucgg

SEQ ID NO: 3112082 - RNA, 22 nt, Mycobacterium bovis subsp bovis AF2122/97
ugagaccuagcagggugccggc

SEQ ID NO: 3112083 - RNA, 17 nt, Mycobacterium bovis subsp bovis AF2122/97
ugagacgaaaagccgcg

SEQ ID NO: 3112084 - RNA, 16 nt, Mycobacterium bovis subsp bovis AF2122/97
ugagacgccggggaac

SEQ ID NO: 3112085 - RNA, 14 nt, Mycobacterium bovis subsp bovis AF2122/97
ugagacucgucgau

SEQ ID NO: 3112086 - RNA, 22 nt, Mycobacterium bovis subsp bovis AF2122/97
ugagacugccgccgcuuucgcc

SEQ ID NO: 3112087 - RNA, 16 nt, Mycobacterium bovis subsp bovis AF2122/97
ugagacugggcgcugg

SEQ ID NO: 3112088 - RNA, 12 nt, Mycobacterium bovis subsp bovis AF2122/97
ugagagaugguc

SEQ ID NO: 3112089 - RNA, 17 nt, Mycobacterium bovis subsp bovis AF2122/97
ugagagauggucgggcg

SEQ ID NO: 3112090 - RNA, 16 nt, Mycobacterium bovis subsp bovis AF2122/97
ugagauaccgacgcgc

SEQ ID NO: 3112091 - RNA, 19 nt, Mycobacterium bovis subsp bovis AF2122/97
ugagaucaugaggugagcu

SEQ ID NO: 3112092 - RNA, 20 nt, Mycobacterium bovis subsp bovis AF2122/97
ugagaucaugaggugagcug

SEQ ID NO: 3112093 - RNA, 20 nt, Mycobacterium bovis subsp bovis AF2122/97
ugagaucgcccgaguugaag

SEQ ID NO: 3112094 - RNA, 23 nt, Mycobacterium bovis subsp bovis AF2122/97
ugagaucgcccgaguugaagaag

SEQ ID NO: 3112095 - RNA, 19 nt, Mycobacterium bovis subsp bovis AF2122/97
ugagauggcggugagcacu

SEQ ID NO: 3112096 - RNA, 13 nt, Mycobacterium bovis subsp bovis AF2122/97
ugagcaacgcgac

SEQ ID NO: 3112097 - RNA, 23 nt, Mycobacterium bovis subsp bovis AF2122/97
ugagcaacuggcauuucagcugg

SEQ ID NO: 3112098 - RNA, 14 nt, Mycobacterium bovis subsp bovis AF2122/97
ugagcaaguccugc

SEQ ID NO: 3112099 - RNA, 15 nt, Mycobacterium bovis subsp bovis AF2122/97
ugagcaauggcgcga

SEQ ID NO: 3112100 - RNA, 19 nt, Mycobacterium bovis subsp bovis AF2122/97
ugagcacaccgacagcacc

SEQ ID NO: 3112101 - RNA, 15 nt, Mycobacterium bovis subsp bovis AF2122/97
ugagcaccagcagca

SEQ ID NO: 3112102 - RNA, 16 nt, Mycobacterium bovis subsp bovis AF2122/97
ugagcaccagcagcac

SEQ ID NO: 3112103 - RNA, 20 nt, Mycobacterium bovis subsp bovis AF2122/97
ugagcaccggauacagccac

SEQ ID NO: 3112104 - RNA, 15 nt, Mycobacterium bovis subsp bovis AF2122/97
ugagcaccugagccu

SEQ ID NO: 3112105 - RNA, 14 nt, Mycobacterium bovis subsp bovis AF2122/97
ugagcaccugggcg

SEQ ID NO: 3112106 - RNA, 22 nt, Mycobacterium bovis subsp bovis AF2122/97
ugagcaccugggcgcgcuggcg

SEQ ID NO: 3112107 - RNA, 22 nt, Mycobacterium bovis subsp bovis AF2122/97
ugagcacgcgcaacucgccacg

SEQ ID NO: 3112108 - RNA, 12 nt, Mycobacterium bovis subsp bovis AF2122/97
ugagcacguuca

SEQ ID NO: 3112109 - RNA, 16 nt, Mycobacterium bovis subsp bovis AF2122/97
ugagcagacccagucc

SEQ ID NO: 3112110 - RNA, 19 nt, Mycobacterium bovis subsp bovis AF2122/97
ugagcagcgggacauccag

SEQ ID NO: 3112111 - RNA, 17 nt, Mycobacterium bovis subsp bovis AF2122/97
ugagcagcuuagucagg

SEQ ID NO: 3112112 - RNA, 21 nt, Mycobacterium bovis subsp bovis AF2122/97
ugagcagcuuagucagggccg

SEQ ID NO: 3112113 - RNA, 23 nt, Mycobacterium bovis subsp bovis AF2122/97
ugagcagcuuagucagggccgag

SEQ ID NO: 3112114 - RNA, 20 nt, Mycobacterium bovis subsp bovis AF2122/97
ugagcagcuugguggcgugg

SEQ ID NO: 3112115 - RNA, 17 nt, Mycobacterium bovis subsp bovis AF2122/97
ugagcagggcggcgaac

SEQ ID NO: 3112116 - RNA, 17 nt, Mycobacterium bovis subsp bovis AF2122/97
ugagcauaugacgucgc

SEQ ID NO: 3112117 - RNA, 23 nt, Mycobacterium bovis subsp bovis AF2122/97
ugagcaugcccagcgcacggacc

SEQ ID NO: 3112118 - RNA, 14 nt, Mycobacterium bovis subsp bovis AF2122/97
ugagcaugcgacgu

SEQ ID NO: 3112119 - RNA, 15 nt, Mycobacterium bovis subsp bovis AF2122/97
ugagcaugucgucgu

SEQ ID NO: 3112120 - RNA, 16 nt, Mycobacterium bovis subsp bovis AF2122/97
ugagccaccaacaccg

SEQ ID NO: 3112121 - RNA, 19 nt, Mycobacterium bovis subsp bovis AF2122/97
ugagccaccaacaccgcgu

SEQ ID NO: 3112122 - RNA, 14 nt, Mycobacterium bovis subsp bovis AF2122/97
ugagccacguucgc

SEQ ID NO: 3112123 - RNA, 22 nt, Mycobacterium bovis subsp bovis AF2122/97
ugagcccagccgcgggccgcgu

SEQ ID NO: 3112124 - RNA, 21 nt, Mycobacterium bovis subsp bovis AF2122/97
ugagcccgggauaccgcucag

SEQ ID NO: 3112125 - RNA, 21 nt, Mycobacterium bovis subsp bovis AF2122/97
ugagcccggggagacgagcac

SEQ ID NO: 3112126 - RNA, 19 nt, Mycobacterium bovis subsp bovis AF2122/97
ugagcccguugaccugcgc

SEQ ID NO: 3112127 - RNA, 20 nt, Mycobacterium bovis subsp bovis AF2122/97
ugagcccugcgccucggcgg

SEQ ID NO: 3112128 - RNA, 21 nt, Mycobacterium bovis subsp bovis AF2122/97
ugagccgcagaugcaccugcg

SEQ ID NO: 3112129 - RNA, 15 nt, Mycobacterium bovis subsp bovis AF2122/97
ugagccgcagcaccu

SEQ ID NO: 3112130 - RNA, 19 nt, Mycobacterium bovis subsp bovis AF2122/97
ugagccgcagcaccucguc

SEQ ID NO: 3112131 - RNA, 14 nt, Mycobacterium bovis subsp bovis AF2122/97
ugagccgccccggc

SEQ ID NO: 3112132 - RNA, 21 nt, Mycobacterium bovis subsp bovis AF2122/97
ugagccgcucaucgaucccgu

SEQ ID NO: 3112133 - RNA, 19 nt, Mycobacterium bovis subsp bovis AF2122/97
ugagccgcucgauggccug

SEQ ID NO: 3112134 - RNA, 17 nt, Mycobacterium bovis subsp bovis AF2122/97
ugagccggcccugcucg

SEQ ID NO: 3112135 - RNA, 21 nt, Mycobacterium bovis subsp bovis AF2122/97
ugagccggucuugcaucgcca

SEQ ID NO: 3112136 - RNA, 22 nt, Mycobacterium bovis subsp bovis AF2122/97
ugagccggucuugcaucgccaa

SEQ ID NO: 3112137 - RNA, 23 nt, Mycobacterium bovis subsp bovis AF2122/97
ugagccggucuugcaucgccaau

SEQ ID NO: 3112138 - RNA, 16 nt, Mycobacterium bovis subsp bovis AF2122/97
ugagccgugccgccag

SEQ ID NO: 3112139 - RNA, 13 nt, Mycobacterium bovis subsp bovis AF2122/97
ugagccugccgga

SEQ ID NO: 3112140 - RNA, 21 nt, Mycobacterium bovis subsp bovis AF2122/97
ugagccuguccacguccagcc

SEQ ID NO: 3112141 - RNA, 13 nt, Mycobacterium bovis subsp bovis AF2122/97
ugagcgaccuggg

SEQ ID NO: 3112142 - RNA, 16 nt, Mycobacterium bovis subsp bovis AF2122/97
ugagcgagcgcgcgua

SEQ ID NO: 3112143 - RNA, 22 nt, Mycobacterium bovis subsp bovis AF2122/97
ugagcgcagcuugaucccaucc

SEQ ID NO: 3112144 - RNA, 15 nt, Mycobacterium bovis subsp bovis AF2122/97
ugagcgccacgccga

SEQ ID NO: 3112145 - RNA, 18 nt, Mycobacterium bovis subsp bovis AF2122/97
ugagcgccacgccgaggc

SEQ ID NO: 3112146 - RNA, 18 nt, Mycobacterium bovis subsp bovis AF2122/97
ugagcgccaggccgcaca

SEQ ID NO: 3112147 - RNA, 19 nt, Mycobacterium bovis subsp bovis AF2122/97
ugagcgccaggccgcacag

SEQ ID NO: 3112148 - RNA, 13 nt, Mycobacterium bovis subsp bovis AF2122/97
ugagcgccgaugu

SEQ ID NO: 3112149 - RNA, 19 nt, Mycobacterium bovis subsp bovis AF2122/97
ugagcgccgauguggccgg

SEQ ID NO: 3112150 - RNA, 16 nt, Mycobacterium bovis subsp bovis AF2122/97
ugagcgccgcggcgga

SEQ ID NO: 3112151 - RNA, 20 nt, Mycobacterium bovis subsp bovis AF2122/97
ugagcgccggcaucgcgcaa

SEQ ID NO: 3112152 - RNA, 21 nt, Mycobacterium bovis subsp bovis AF2122/97
ugagcgccggcaucgcgcaac

SEQ ID NO: 3112153 - RNA, 20 nt, Mycobacterium bovis subsp bovis AF2122/97
ugagcgcgaaguacgacgac

SEQ ID NO: 3112154 - RNA, 14 nt, Mycobacterium bovis subsp bovis AF2122/97
ugagcgcgcccaac

SEQ ID NO: 3112155 - RNA, 13 nt, Mycobacterium bovis subsp bovis AF2122/97
ugagcgcgcucag

SEQ ID NO: 3112156 - RNA, 16 nt, Mycobacterium bovis subsp bovis AF2122/97
ugagcgcgcuggccag

SEQ ID NO: 3112157 - RNA, 17 nt, Mycobacterium bovis subsp bovis AF2122/97
ugagcgcgcuggccagc

SEQ ID NO: 3112158 - RNA, 20 nt, Mycobacterium bovis subsp bovis AF2122/97
ugagcgcggcuacggucgca

SEQ ID NO: 3112159 - RNA, 23 nt, Mycobacterium bovis subsp bovis AF2122/97
ugagcgcggcuacggucgcagua

SEQ ID NO: 3112160 - RNA, 20 nt, Mycobacterium bovis subsp bovis AF2122/97
ugagcgcucgaaagagccgc

SEQ ID NO: 3112161 - RNA, 21 nt, Mycobacterium bovis subsp bovis AF2122/97
ugagcgcuucgagguggcugc

SEQ ID NO: 3112162 - RNA, 21 nt, Mycobacterium bovis subsp bovis AF2122/97
ugagcggccaccguagccagc

SEQ ID NO: 3112163 - RNA, 16 nt, Mycobacterium bovis subsp bovis AF2122/97
ugagcggccagcaucg

SEQ ID NO: 3112164 - RNA, 24 nt, Mycobacterium bovis subsp bovis AF2122/97
ugagcggccggcaugcuggcgauc

SEQ ID NO: 3112165 - RNA, 14 nt, Mycobacterium bovis subsp bovis AF2122/97
ugagcggccucggg

SEQ ID NO: 3112166 - RNA, 22 nt, Mycobacterium bovis subsp bovis AF2122/97
ugagcgggcaacugcagcaugg

SEQ ID NO: 3112167 - RNA, 22 nt, Mycobacterium bovis subsp bovis AF2122/97
ugagcgggcgggccugcgcgau

SEQ ID NO: 3112168 - RNA, 22 nt, Mycobacterium bovis subsp bovis AF2122/97
ugagcggggauguccgcggcca

SEQ ID NO: 3112169 - RNA, 19 nt, Mycobacterium bovis subsp bovis AF2122/97
ugagcgugagcgccgcggc

SEQ ID NO: 3112170 - RNA, 18 nt, Mycobacterium bovis subsp bovis AF2122/97
ugagcuacucacggugau

SEQ ID NO: 3112171 - RNA, 21 nt, Mycobacterium bovis subsp bovis AF2122/97
ugagcucggcugcucgacggc

SEQ ID NO: 3112172 - RNA, 12 nt, Mycobacterium bovis subsp bovis AF2122/97
ugagcuggcggu

SEQ ID NO: 3112173 - RNA, 16 nt, Mycobacterium bovis subsp bovis AF2122/97
ugagcuuccgcgcgca

SEQ ID NO: 3112174 - RNA, 16 nt, Mycobacterium bovis subsp bovis AF2122/97
ugagcuuggucgccau

SEQ ID NO: 3112175 - RNA, 17 nt, Mycobacterium bovis subsp bovis AF2122/97
ugagcuuggucgccggg

SEQ ID NO: 3112176 - RNA, 16 nt, Mycobacterium bovis subsp bovis AF2122/97
ugagcuuuaucugcau

SEQ ID NO: 3112177 - RNA, 18 nt, Mycobacterium bovis subsp bovis AF2122/97
ugaggaacguuucgcugu

SEQ ID NO: 3112178 - RNA, 16 nt, Mycobacterium bovis subsp bovis AF2122/97
ugaggaacuccgcgau

SEQ ID NO: 3112179 - RNA, 14 nt, Mycobacterium bovis subsp bovis AF2122/97
ugaggacauccggc

SEQ ID NO: 3112180 - RNA, 16 nt, Mycobacterium bovis subsp bovis AF2122/97
ugaggacauccggcgc

SEQ ID NO: 3112181 - RNA, 17 nt, Mycobacterium bovis subsp bovis AF2122/97
ugaggacauccggcgcc

SEQ ID NO: 3112182 - RNA, 20 nt, Mycobacterium bovis subsp bovis AF2122/97
ugaggacgagguucugccgc

SEQ ID NO: 3112183 - RNA, 18 nt, Mycobacterium bovis subsp bovis AF2122/97
ugaggagaugagcaccaa

SEQ ID NO: 3112184 - RNA, 19 nt, Mycobacterium bovis subsp bovis AF2122/97
ugaggaucccggccggguc

SEQ ID NO: 3112185 - RNA, 21 nt, Mycobacterium bovis subsp bovis AF2122/97
ugaggaucccggccgggucga

SEQ ID NO: 3112186 - RNA, 23 nt, Mycobacterium bovis subsp bovis AF2122/97
ugaggccggacuuuaaaccgaac

SEQ ID NO: 3112187 - RNA, 13 nt, Mycobacterium bovis subsp bovis AF2122/97
ugaggccggugaa

SEQ ID NO: 3112188 - RNA, 17 nt, Mycobacterium bovis subsp bovis AF2122/97
ugaggcugccgaaguug

SEQ ID NO: 3112189 - RNA, 16 nt, Mycobacterium bovis subsp bovis AF2122/97
ugaggcuuccagcucg

SEQ ID NO: 3112190 - RNA, 23 nt, Mycobacterium bovis subsp bovis AF2122/97
ugagggcggaaaaucggcuggcc

SEQ ID NO: 3112191 - RNA, 22 nt, Mycobacterium bovis subsp bovis AF2122/97
ugagggcggaauaucggccgaa

SEQ ID NO: 3112192 - RNA, 16 nt, Mycobacterium bovis subsp bovis AF2122/97
ugagggcucgguggcg

SEQ ID NO: 3112193 - RNA, 15 nt, Mycobacterium bovis subsp bovis AF2122/97
ugagguagccgaggu

SEQ ID NO: 3112194 - RNA, 20 nt, Mycobacterium bovis subsp bovis AF2122/97
ugagguaggggcaggccauc

SEQ ID NO: 3112195 - RNA, 18 nt, Mycobacterium bovis subsp bovis AF2122/97
ugagguaggugagcgcgc

SEQ ID NO: 3112196 - RNA, 18 nt, Mycobacterium bovis subsp bovis AF2122/97
ugagguauugggcgcggc

SEQ ID NO: 3112197 - RNA, 17 nt, Mycobacterium bovis subsp bovis AF2122/97
ugaggucaccggcgacc

SEQ ID NO: 3112198 - RNA, 20 nt, Mycobacterium bovis subsp bovis AF2122/97
ugaggucaucgggcagcggc

SEQ ID NO: 3112199 - RNA, 20 nt, Mycobacterium bovis subsp bovis AF2122/97
ugaggucuacuucggcgccg

SEQ ID NO: 3112200 - RNA, 22 nt, Mycobacterium bovis subsp bovis AF2122/97
ugaggucuuugcucucggucug

SEQ ID NO: 3112201 - RNA, 15 nt, Mycobacterium bovis subsp bovis AF2122/97
ugagguggccgcgca

SEQ ID NO: 3112202 - RNA, 15 nt, Mycobacterium bovis subsp bovis AF2122/97
ugaggugugccgacc

SEQ ID NO: 3112203 - RNA, 16 nt, Mycobacterium bovis subsp bovis AF2122/97
ugagguucaucgccgg

SEQ ID NO: 3112204 - RNA, 18 nt, Mycobacterium bovis subsp bovis AF2122/97
ugagguucaucgccggcg

SEQ ID NO: 3112205 - RNA, 18 nt, Mycobacterium bovis subsp bovis AF2122/97
ugaguaccaauccaggcc

SEQ ID NO: 3112206 - RNA, 16 nt, Mycobacterium bovis subsp bovis AF2122/97
ugaguaccauccgggc

SEQ ID NO: 3112207 - RNA, 14 nt, Mycobacterium bovis subsp bovis AF2122/97
ugaguagguccacg

SEQ ID NO: 3112208 - RNA, 19 nt, Mycobacterium bovis subsp bovis AF2122/97
ugaguccaauacucgccau

SEQ ID NO: 3112209 - RNA, 14 nt, Mycobacterium bovis subsp bovis AF2122/97
ugaguccagccggc

SEQ ID NO: 3112210 - RNA, 15 nt, Mycobacterium bovis subsp bovis AF2122/97
ugaguccagccggcg

SEQ ID NO: 3112211 - RNA, 20 nt, Mycobacterium bovis subsp bovis AF2122/97
ugaguccagccggcgcgccg

SEQ ID NO: 3112212 - RNA, 20 nt, Mycobacterium bovis subsp bovis AF2122/97
ugagucguuggacggcaccg

SEQ ID NO: 3112213 - RNA, 22 nt, Mycobacterium bovis subsp bovis AF2122/97
ugagucuuucccgccaccaaac

SEQ ID NO: 3112214 - RNA, 16 nt, Mycobacterium bovis subsp bovis AF2122/97
ugagugaccacgcugc

SEQ ID NO: 3112215 - RNA, 15 nt, Mycobacterium bovis subsp bovis AF2122/97
ugagugccggcgugc

SEQ ID NO: 3112216 - RNA, 20 nt, Mycobacterium bovis subsp bovis AF2122/97
ugagugccggcgugcgcgag

SEQ ID NO: 3112217 - RNA, 21 nt, Mycobacterium bovis subsp bovis AF2122/97
ugagugccggcgugcgcgaga

SEQ ID NO: 3112218 - RNA, 22 nt, Mycobacterium bovis subsp bovis AF2122/97
ugagugcggacaucguugaccc

SEQ ID NO: 3112219 - RNA, 16 nt, Mycobacterium bovis subsp bovis AF2122/97
ugagugcgucucggug

SEQ ID NO: 3112220 - RNA, 23 nt, Mycobacterium bovis subsp bovis AF2122/97
ugagugcgucucgguggcugcgc

SEQ ID NO: 3112221 - RNA, 14 nt, Mycobacterium bovis subsp bovis AF2122/97
ugaguggacggccg

SEQ ID NO: 3112222 - RNA, 16 nt, Mycobacterium bovis subsp bovis AF2122/97
ugaguggacggccgug

SEQ ID NO: 3112223 - RNA, 15 nt, Mycobacterium bovis subsp bovis AF2122/97
ugaguggaugcgccg

SEQ ID NO: 3112224 - RNA, 22 nt, Mycobacterium bovis subsp bovis AF2122/97
ugaguggcucgcucugcgcggc

SEQ ID NO: 3112225 - RNA, 19 nt, Mycobacterium bovis subsp bovis AF2122/97
ugaguguguuugaguugcc

SEQ ID NO: 3112226 - RNA, 21 nt, Mycobacterium bovis subsp bovis AF2122/97
ugaguuccuugaugcggccgc

SEQ ID NO: 3112227 - RNA, 18 nt, Mycobacterium bovis subsp bovis AF2122/97
ugaguucggccaccaacc

SEQ ID NO: 3112228 - RNA, 12 nt, Mycobacterium bovis subsp bovis AF2122/97
ugaguucggcgg

SEQ ID NO: 3112229 - RNA, 13 nt, Mycobacterium bovis subsp bovis AF2122/97
ugaguucggcggc

SEQ ID NO: 3112230 - RNA, 11 nt, Mycobacterium bovis subsp bovis AF2122/97
ugaguucggug

SEQ ID NO: 3112231 - RNA, 19 nt, Mycobacterium bovis subsp bovis AF2122/97
ugaguugcccguucaugcg

SEQ ID NO: 3112232 - RNA, 14 nt, Mycobacterium bovis subsp bovis AF2122/97
ugaguuucggcgca

SEQ ID NO: 3112233 - RNA, 17 nt, Mycobacterium bovis subsp bovis AF2122/97
ugauacagcgccagggg

SEQ ID NO: 3112234 - RNA, 13 nt, Mycobacterium bovis subsp bovis AF2122/97
ugauaccugccca

SEQ ID NO: 3112235 - RNA, 15 nt, Mycobacterium bovis subsp bovis AF2122/97
ugauagcggcgcagc

SEQ ID NO: 3112236 - RNA, 17 nt, Mycobacterium bovis subsp bovis AF2122/97
ugauaggcgcgcaguga

SEQ ID NO: 3112237 - RNA, 21 nt, Mycobacterium bovis subsp bovis AF2122/97
ugauaguggcgcgcggcgccg

SEQ ID NO: 3112238 - RNA, 12 nt, Mycobacterium bovis subsp bovis AF2122/97
ugauauccgcgg

SEQ ID NO: 3112239 - RNA, 14 nt, Mycobacterium bovis subsp bovis AF2122/97
ugaucaaaccggcg

SEQ ID NO: 3112240 - RNA, 20 nt, Mycobacterium bovis subsp bovis AF2122/97
ugaucaagaaggccagcgcg

SEQ ID NO: 3112241 - RNA, 18 nt, Mycobacterium bovis subsp bovis AF2122/97
ugaucaaggugucgacgg

SEQ ID NO: 3112242 - RNA, 16 nt, Mycobacterium bovis subsp bovis AF2122/97
ugaucacaccgagcgc

SEQ ID NO: 3112243 - RNA, 13 nt, Mycobacterium bovis subsp bovis AF2122/97
ugaucaccaaccc

SEQ ID NO: 3112244 - RNA, 14 nt, Mycobacterium bovis subsp bovis AF2122/97
ugaucacccgcauc

SEQ ID NO: 3112245 - RNA, 21 nt, Mycobacterium bovis subsp bovis AF2122/97
ugaucaccgggcccgacgcgu

SEQ ID NO: 3112246 - RNA, 14 nt, Mycobacterium bovis subsp bovis AF2122/97
ugaucaccgucgua

SEQ ID NO: 3112247 - RNA, 15 nt, Mycobacterium bovis subsp bovis AF2122/97
ugaucaccgugcggu

SEQ ID NO: 3112248 - RNA, 16 nt, Mycobacterium bovis subsp bovis AF2122/97
ugaucacucacccggg

SEQ ID NO: 3112249 - RNA, 17 nt, Mycobacterium bovis subsp bovis AF2122/97
ugaucacucacccgggc

SEQ ID NO: 3112250 - RNA, 14 nt, Mycobacterium bovis subsp bovis AF2122/97
ugaucaggccccac

SEQ ID NO: 3112251 - RNA, 18 nt, Mycobacterium bovis subsp bovis AF2122/97
ugaucaggccccacacga

SEQ ID NO: 3112252 - RNA, 19 nt, Mycobacterium bovis subsp bovis AF2122/97
ugaucaggccgaugcgggu

SEQ ID NO: 3112253 - RNA, 16 nt, Mycobacterium bovis subsp bovis AF2122/97
ugaucaucccggcgcg

SEQ ID NO: 3112254 - RNA, 17 nt, Mycobacterium bovis subsp bovis AF2122/97
ugaucaucccggcgcgu

SEQ ID NO: 3112255 - RNA, 18 nt, Mycobacterium bovis subsp bovis AF2122/97
ugauccacccgacgacgu

SEQ ID NO: 3112256 - RNA, 17 nt, Mycobacterium bovis subsp bovis AF2122/97
ugaucccagaucggcgu

SEQ ID NO: 3112257 - RNA, 19 nt, Mycobacterium bovis subsp bovis AF2122/97
ugauccccagcuccggguc

SEQ ID NO: 3112258 - RNA, 13 nt, Mycobacterium bovis subsp bovis AF2122/97
ugaucccgaaccg

SEQ ID NO: 3112259 - RNA, 17 nt, Mycobacterium bovis subsp bovis AF2122/97
ugaucccgaugcuggca

SEQ ID NO: 3112260 - RNA, 18 nt, Mycobacterium bovis subsp bovis AF2122/97
ugaucccgccaccgaaca

SEQ ID NO: 3112261 - RNA, 19 nt, Mycobacterium bovis subsp bovis AF2122/97
ugaucccggccaggccgac

SEQ ID NO: 3112262 - RNA, 19 nt, Mycobacterium bovis subsp bovis AF2122/97
ugaucccguagccgugcca

SEQ ID NO: 3112263 - RNA, 15 nt, Mycobacterium bovis subsp bovis AF2122/97
ugauccgcaccccau

SEQ ID NO: 3112264 - RNA, 16 nt, Mycobacterium bovis subsp bovis AF2122/97
ugauccgccgacagcc

SEQ ID NO: 3112265 - RNA, 18 nt, Mycobacterium bovis subsp bovis AF2122/97
ugauccgccgacagccca

SEQ ID NO: 3112266 - RNA, 19 nt, Mycobacterium bovis subsp bovis AF2122/97
ugauccgcgcaacuuccau

SEQ ID NO: 3112267 - RNA, 13 nt, Mycobacterium bovis subsp bovis AF2122/97
ugauccgcugggc

SEQ ID NO: 3112268 - RNA, 12 nt, Mycobacterium bovis subsp bovis AF2122/97
ugauccggccgg

SEQ ID NO: 3112269 - RNA, 16 nt, Mycobacterium bovis subsp bovis AF2122/97
ugauccgguggugggc

SEQ ID NO: 3112270 - RNA, 15 nt, Mycobacterium bovis subsp bovis AF2122/97
ugaucgaacuggggg

SEQ ID NO: 3112271 - RNA, 21 nt, Mycobacterium bovis subsp bovis AF2122/97
ugaucgaacugggggccggca

SEQ ID NO: 3112272 - RNA, 18 nt, Mycobacterium bovis subsp bovis AF2122/97
ugaucgaauacaccugcu

SEQ ID NO: 3112273 - RNA, 23 nt, Mycobacterium bovis subsp bovis AF2122/97
ugaucgacaccgagccacgaccc

SEQ ID NO: 3112274 - RNA, 14 nt, Mycobacterium bovis subsp bovis AF2122/97
ugaucgaccggaca

SEQ ID NO: 3112275 - RNA, 14 nt, Mycobacterium bovis subsp bovis AF2122/97
ugaucgacggccag

SEQ ID NO: 3112276 - RNA, 16 nt, Mycobacterium bovis subsp bovis AF2122/97
ugaucgacggccagcc

SEQ ID NO: 3112277 - RNA, 21 nt, Mycobacterium bovis subsp bovis AF2122/97
ugaucgacggccagcccagca

SEQ ID NO: 3112278 - RNA, 21 nt, Mycobacterium bovis subsp bovis AF2122/97
ugaucgagcagggugaccagg

SEQ ID NO: 3112279 - RNA, 20 nt, Mycobacterium bovis subsp bovis AF2122/97
ugaucgagcaguuccagcuc

SEQ ID NO: 3112280 - RNA, 16 nt, Mycobacterium bovis subsp bovis AF2122/97
ugaucgaucgcggcgc

SEQ ID NO: 3112281 - RNA, 12 nt, Mycobacterium bovis subsp bovis AF2122/97
ugaucgcaucga

SEQ ID NO: 3112282 - RNA, 11 nt, Mycobacterium bovis subsp bovis AF2122/97
ugaucgccacc

SEQ ID NO: 3112283 - RNA, 18 nt, Mycobacterium bovis subsp bovis AF2122/97
ugaucgccaccgguaccg

SEQ ID NO: 3112284 - RNA, 17 nt, Mycobacterium bovis subsp bovis AF2122/97
ugaucgccgaggccucg

SEQ ID NO: 3112285 - RNA, 23 nt, Mycobacterium bovis subsp bovis AF2122/97
ugaucgccggcuucgcccagagc

SEQ ID NO: 3112286 - RNA, 21 nt, Mycobacterium bovis subsp bovis AF2122/97
ugaucgcgauccacccggcau

SEQ ID NO: 3112287 - RNA, 16 nt, Mycobacterium bovis subsp bovis AF2122/97
ugaucgcgguccaaca

SEQ ID NO: 3112288 - RNA, 13 nt, Mycobacterium bovis subsp bovis AF2122/97
ugaucgcgguggc

SEQ ID NO: 3112289 - RNA, 12 nt, Mycobacterium bovis subsp bovis AF2122/97
ugaucggcgccc

SEQ ID NO: 3112290 - RNA, 22 nt, Mycobacterium bovis subsp bovis AF2122/97
ugaucggcggcaaccgccgcca

SEQ ID NO: 3112291 - RNA, 14 nt, Mycobacterium bovis subsp bovis AF2122/97
ugaucggugcccaa

SEQ ID NO: 3112292 - RNA, 15 nt, Mycobacterium bovis subsp bovis AF2122/97
ugaucggugcccaac

SEQ ID NO: 3112293 - RNA, 17 nt, Mycobacterium bovis subsp bovis AF2122/97
ugaucguccagcccaga

SEQ ID NO: 3112294 - RNA, 18 nt, Mycobacterium bovis subsp bovis AF2122/97
ugaucgugaacacgucgc

SEQ ID NO: 3112295 - RNA, 19 nt, Mycobacterium bovis subsp bovis AF2122/97
ugaucgugcuggcgacgua

SEQ ID NO: 3112296 - RNA, 20 nt, Mycobacterium bovis subsp bovis AF2122/97
ugaucuccacggcggugccg

SEQ ID NO: 3112297 - RNA, 13 nt, Mycobacterium bovis subsp bovis AF2122/97
ugaucucggcgag

SEQ ID NO: 3112298 - RNA, 14 nt, Mycobacterium bovis subsp bovis AF2122/97
ugaucucggcgagc

SEQ ID NO: 3112299 - RNA, 14 nt, Mycobacterium bovis subsp bovis AF2122/97
ugaucugagcgcgg

SEQ ID NO: 3112300 - RNA, 23 nt, Mycobacterium bovis subsp bovis AF2122/97
ugaucugcuugccaccgccgccg

SEQ ID NO: 3112301 - RNA, 16 nt, Mycobacterium bovis subsp bovis AF2122/97
ugaucuggcaacgcgu

SEQ ID NO: 3112302 - RNA, 22 nt, Mycobacterium bovis subsp bovis AF2122/97
ugaucuggcguucagcggccag

SEQ ID NO: 3112303 - RNA, 20 nt, Mycobacterium bovis subsp bovis AF2122/97
ugaucugggcugcggccgcg

SEQ ID NO: 3112304 - RNA, 16 nt, Mycobacterium bovis subsp bovis AF2122/97
ugaucugugccgcuag

SEQ ID NO: 3112305 - RNA, 15 nt, Mycobacterium bovis subsp bovis AF2122/97
ugaucuugaaaucgg

SEQ ID NO: 3112306 - RNA, 22 nt, Mycobacterium bovis subsp bovis AF2122/97
ugaucuugccacuccaggagcc

SEQ ID NO: 3112307 - RNA, 12 nt, Mycobacterium bovis subsp bovis AF2122/97
ugaucuuggccc

SEQ ID NO: 3112308 - RNA, 16 nt, Mycobacterium bovis subsp bovis AF2122/97
ugaucuuggcccgggc

SEQ ID NO: 3112309 - RNA, 15 nt, Mycobacterium bovis subsp bovis AF2122/97
ugaugaaacgccguc

SEQ ID NO: 3112310 - RNA, 17 nt, Mycobacterium bovis subsp bovis AF2122/97
ugaugaaacgccgucgc

SEQ ID NO: 3112311 - RNA, 19 nt, Mycobacterium bovis subsp bovis AF2122/97
ugaugaaacgcgccgucuc

SEQ ID NO: 3112312 - RNA, 16 nt, Mycobacterium bovis subsp bovis AF2122/97
ugaugaacagacgccc

SEQ ID NO: 3112313 - RNA, 20 nt, Mycobacterium bovis subsp bovis AF2122/97
ugaugaacgacauccggccg

SEQ ID NO: 3112314 - RNA, 22 nt, Mycobacterium bovis subsp bovis AF2122/97
ugaugaagaugauuucgccgag

SEQ ID NO: 3112315 - RNA, 16 nt, Mycobacterium bovis subsp bovis AF2122/97
ugaugaccgccaucgc

SEQ ID NO: 3112316 - RNA, 16 nt, Mycobacterium bovis subsp bovis AF2122/97
ugaugacguugcagcc

SEQ ID NO: 3112317 - RNA, 18 nt, Mycobacterium bovis subsp bovis AF2122/97
ugaugacguugcagccgg

SEQ ID NO: 3112318 - RNA, 21 nt, Mycobacterium bovis subsp bovis AF2122/97
ugaugacguugcagccggcau

SEQ ID NO: 3112319 - RNA, 21 nt, Mycobacterium bovis subsp bovis AF2122/97
ugaugacuugagcggcuuggg

SEQ ID NO: 3112320 - RNA, 19 nt, Mycobacterium bovis subsp bovis AF2122/97
ugaugaggaucgcguccgc

SEQ ID NO: 3112321 - RNA, 22 nt, Mycobacterium bovis subsp bovis AF2122/97
ugaugagggacgaacacgucua

SEQ ID NO: 3112322 - RNA, 17 nt, Mycobacterium bovis subsp bovis AF2122/97
ugaugagucaggcgccg

SEQ ID NO: 3112323 - RNA, 21 nt, Mycobacterium bovis subsp bovis AF2122/97
ugaugaguucgcgcaucaacg

SEQ ID NO: 3112324 - RNA, 14 nt, Mycobacterium bovis subsp bovis AF2122/97
ugaugaugaccaca

SEQ ID NO: 3112325 - RNA, 13 nt, Mycobacterium bovis subsp bovis AF2122/97
ugaugaugccggc

SEQ ID NO: 3112326 - RNA, 14 nt, Mycobacterium bovis subsp bovis AF2122/97
ugaugaugccggcg

SEQ ID NO: 3112327 - RNA, 17 nt, Mycobacterium bovis subsp bovis AF2122/97
ugaugcaacgccaaaau

SEQ ID NO: 3112328 - RNA, 19 nt, Mycobacterium bovis subsp bovis AF2122/97
ugaugcaacgccaaaaugg

SEQ ID NO: 3112329 - RNA, 23 nt, Mycobacterium bovis subsp bovis AF2122/97
ugaugcaacgccaaaauggugcc

SEQ ID NO: 3112330 - RNA, 21 nt, Mycobacterium bovis subsp bovis AF2122/97
ugaugcaagcgggcaugaucc

SEQ ID NO: 3112331 - RNA, 23 nt, Mycobacterium bovis subsp bovis AF2122/97
ugaugcagggcccgcaacaucgg

SEQ ID NO: 3112332 - RNA, 21 nt, Mycobacterium bovis subsp bovis AF2122/97
ugaugcagugauugagcagca

SEQ ID NO: 3112333 - RNA, 15 nt, Mycobacterium bovis subsp bovis AF2122/97
ugaugcccagcgccg

SEQ ID NO: 3112334 - RNA, 21 nt, Mycobacterium bovis subsp bovis AF2122/97
ugaugcccauccggccgucgg

SEQ ID NO: 3112335 - RNA, 15 nt, Mycobacterium bovis subsp bovis AF2122/97
ugaugccgaugucga

SEQ ID NO: 3112336 - RNA, 15 nt, Mycobacterium bovis subsp bovis AF2122/97
ugaugccgucgucgu

SEQ ID NO: 3112337 - RNA, 21 nt, Mycobacterium bovis subsp bovis AF2122/97
ugaugccuuccgacgaccagg

SEQ ID NO: 3112338 - RNA, 16 nt, Mycobacterium bovis subsp bovis AF2122/97
ugaugcgcucggccug

SEQ ID NO: 3112339 - RNA, 19 nt, Mycobacterium bovis subsp bovis AF2122/97
ugaugcgcugggccagggu

SEQ ID NO: 3112340 - RNA, 18 nt, Mycobacterium bovis subsp bovis AF2122/97
ugaugcggaugucgucga

SEQ ID NO: 3112341 - RNA, 16 nt, Mycobacterium bovis subsp bovis AF2122/97
ugaugcggccgcggau

SEQ ID NO: 3112342 - RNA, 14 nt, Mycobacterium bovis subsp bovis AF2122/97
ugaugcggcgcagc

SEQ ID NO: 3112343 - RNA, 15 nt, Mycobacterium bovis subsp bovis AF2122/97
ugaugcguucggccg

SEQ ID NO: 3112344 - RNA, 18 nt, Mycobacterium bovis subsp bovis AF2122/97
ugaugcguucggccgggc

SEQ ID NO: 3112345 - RNA, 21 nt, Mycobacterium bovis subsp bovis AF2122/97
ugaugcguugauacgcgucga

SEQ ID NO: 3112346 - RNA, 20 nt, Mycobacterium bovis subsp bovis AF2122/97
ugaugcucgacaaccacggc

SEQ ID NO: 3112347 - RNA, 21 nt, Mycobacterium bovis subsp bovis AF2122/97
ugaugcucgacaaccacggca

SEQ ID NO: 3112348 - RNA, 15 nt, Mycobacterium bovis subsp bovis AF2122/97
ugauggacaccagcc

SEQ ID NO: 3112349 - RNA, 16 nt, Mycobacterium bovis subsp bovis AF2122/97
ugauggagccggugac

SEQ ID NO: 3112350 - RNA, 18 nt, Mycobacterium bovis subsp bovis AF2122/97
ugauggccaucuggccgc

SEQ ID NO: 3112351 - RNA, 14 nt, Mycobacterium bovis subsp bovis AF2122/97
ugauggccgucagc

SEQ ID NO: 3112352 - RNA, 16 nt, Mycobacterium bovis subsp bovis AF2122/97
ugauggccgucagcca

SEQ ID NO: 3112353 - RNA, 12 nt, Mycobacterium bovis subsp bovis AF2122/97
ugauggccucgc

SEQ ID NO: 3112354 - RNA, 20 nt, Mycobacterium bovis subsp bovis AF2122/97
ugauggcgcgaucggugccg

SEQ ID NO: 3112355 - RNA, 22 nt, Mycobacterium bovis subsp bovis AF2122/97
ugauggcggcucguugcgggcg

SEQ ID NO: 3112356 - RNA, 22 nt, Mycobacterium bovis subsp bovis AF2122/97
ugauggcguauagcaugccgcg

SEQ ID NO: 3112357 - RNA, 15 nt, Mycobacterium bovis subsp bovis AF2122/97
ugaugggcagccgcc

SEQ ID NO: 3112358 - RNA, 20 nt, Mycobacterium bovis subsp bovis AF2122/97
ugauggucaaugccggccgc

SEQ ID NO: 3112359 - RNA, 21 nt, Mycobacterium bovis subsp bovis AF2122/97
ugauggucaaugccggccgcg

SEQ ID NO: 3112360 - RNA, 22 nt, Mycobacterium bovis subsp bovis AF2122/97
ugauggucaaugccggccgcgg

SEQ ID NO: 3112361 - RNA, 18 nt, Mycobacterium bovis subsp bovis AF2122/97
ugauggucaccgucugca

SEQ ID NO: 3112362 - RNA, 17 nt, Mycobacterium bovis subsp bovis AF2122/97
ugauggucacggcgucg

SEQ ID NO: 3112363 - RNA, 22 nt, Mycobacterium bovis subsp bovis AF2122/97
ugauggucacggcgucgacugg

SEQ ID NO: 3112364 - RNA, 14 nt, Mycobacterium bovis subsp bovis AF2122/97
ugaugguccgccag

SEQ ID NO: 3112365 - RNA, 16 nt, Mycobacterium bovis subsp bovis AF2122/97
ugauggugccgaaccg

SEQ ID NO: 3112366 - RNA, 19 nt, Mycobacterium bovis subsp bovis AF2122/97
ugauggugcugcggcgucc

SEQ ID NO: 3112367 - RNA, 20 nt, Mycobacterium bovis subsp bovis AF2122/97
ugauggugcugcggcguccg

SEQ ID NO: 3112368 - RNA, 16 nt, Mycobacterium bovis subsp bovis AF2122/97
ugauguaaccguagcc

SEQ ID NO: 3112369 - RNA, 21 nt, Mycobacterium bovis subsp bovis AF2122/97
ugauguagcggcguuccgggc

SEQ ID NO: 3112370 - RNA, 18 nt, Mycobacterium bovis subsp bovis AF2122/97
ugauguagggcugcuccu

SEQ ID NO: 3112371 - RNA, 19 nt, Mycobacterium bovis subsp bovis AF2122/97
ugauguagggcugcuccug

SEQ ID NO: 3112372 - RNA, 21 nt, Mycobacterium bovis subsp bovis AF2122/97
ugaugucaacgugucccaagc

SEQ ID NO: 3112373 - RNA, 15 nt, Mycobacterium bovis subsp bovis AF2122/97
ugauguccgcgacgg

SEQ ID NO: 3112374 - RNA, 13 nt, Mycobacterium bovis subsp bovis AF2122/97
ugaugucgccgau

SEQ ID NO: 3112375 - RNA, 13 nt, Mycobacterium bovis subsp bovis AF2122/97
ugaugucggccag

SEQ ID NO: 3112376 - RNA, 14 nt, Mycobacterium bovis subsp bovis AF2122/97
ugaugucggccgcg

SEQ ID NO: 3112377 - RNA, 21 nt, Mycobacterium bovis subsp bovis AF2122/97
ugaugucggccgcgggucccg

SEQ ID NO: 3112378 - RNA, 14 nt, Mycobacterium bovis subsp bovis AF2122/97
ugaugucggugcgu

SEQ ID NO: 3112379 - RNA, 13 nt, Mycobacterium bovis subsp bovis AF2122/97
ugaugucguuguc

SEQ ID NO: 3112380 - RNA, 18 nt, Mycobacterium bovis subsp bovis AF2122/97
ugaugucguuguccagcg

SEQ ID NO: 3112381 - RNA, 16 nt, Mycobacterium bovis subsp bovis AF2122/97
ugaugugaguccagcc

SEQ ID NO: 3112382 - RNA, 15 nt, Mycobacterium bovis subsp bovis AF2122/97
ugaugugcagcgagu

SEQ ID NO: 3112383 - RNA, 22 nt, Mycobacterium bovis subsp bovis AF2122/97
ugauguuuuccccgcccuugcc

SEQ ID NO: 3112384 - RNA, 14 nt, Mycobacterium bovis subsp bovis AF2122/97
ugauuccacugggc

SEQ ID NO: 3112385 - RNA, 12 nt, Mycobacterium bovis subsp bovis AF2122/97
ugauuccggguc

SEQ ID NO: 3112386 - RNA, 14 nt, Mycobacterium bovis subsp bovis AF2122/97
ugauucggccgccg

SEQ ID NO: 3112387 - RNA, 19 nt, Mycobacterium bovis subsp bovis AF2122/97
ugauucuaacggucagcuu

SEQ ID NO: 3112388 - RNA, 13 nt, Mycobacterium bovis subsp bovis AF2122/97
ugauugacugcuu

SEQ ID NO: 3112389 - RNA, 22 nt, Mycobacterium bovis subsp bovis AF2122/97
ugauugacugcuugguggucuu

SEQ ID NO: 3112390 - RNA, 19 nt, Mycobacterium bovis subsp bovis AF2122/97
ugauugcaagcgggcaccg

SEQ ID NO: 3112391 - RNA, 22 nt, Mycobacterium bovis subsp bovis AF2122/97
ugauugcggaacaccaccaggc

SEQ ID NO: 3112392 - RNA, 14 nt, Mycobacterium bovis subsp bovis AF2122/97
ugauugcggccgcc

SEQ ID NO: 3112393 - RNA, 17 nt, Mycobacterium bovis subsp bovis AF2122/97
ugauugcggccgccgag

SEQ ID NO: 3112394 - RNA, 21 nt, Mycobacterium bovis subsp bovis AF2122/97
ugauuucgcguaacuugccgc

SEQ ID NO: 3112395 - RNA, 14 nt, Mycobacterium bovis subsp bovis AF2122/97
ugauuucggcggcg

SEQ ID NO: 3112396 - RNA, 20 nt, Mycobacterium bovis subsp bovis AF2122/97
ugauuucggugacuccggcu

SEQ ID NO: 3112397 - RNA, 19 nt, Mycobacterium bovis subsp bovis AF2122/97
ugauuuuucgcagugacgu

SEQ ID NO: 3112398 - RNA, 18 nt, Mycobacterium bovis subsp bovis AF2122/97
ugcaaauuuguucuggug

SEQ ID NO: 3112399 - RNA, 12 nt, Mycobacterium bovis subsp bovis AF2122/97
ugcaacacaccg

SEQ ID NO: 3112400 - RNA, 16 nt, Mycobacterium bovis subsp bovis AF2122/97
ugcaacaccgcaccgg

SEQ ID NO: 3112401 - RNA, 16 nt, Mycobacterium bovis subsp bovis AF2122/97
ugcaacacgccggccc

SEQ ID NO: 3112402 - RNA, 21 nt, Mycobacterium bovis subsp bovis AF2122/97
ugcaacacgccggcccgguga

SEQ ID NO: 3112403 - RNA, 14 nt, Mycobacterium bovis subsp bovis AF2122/97
ugcaaccagcggca

SEQ ID NO: 3112404 - RNA, 13 nt, Mycobacterium bovis subsp bovis AF2122/97
ugcaaccauggcg

SEQ ID NO: 3112405 - RNA, 19 nt, Mycobacterium bovis subsp bovis AF2122/97
ugcaaccccaaguccagca

SEQ ID NO: 3112406 - RNA, 19 nt, Mycobacterium bovis subsp bovis AF2122/97
ugcaaccgccggugccgau

SEQ ID NO: 3112407 - RNA, 21 nt, Mycobacterium bovis subsp bovis AF2122/97
ugcaaccgugccgcaucaccc

SEQ ID NO: 3112408 - RNA, 15 nt, Mycobacterium bovis subsp bovis AF2122/97
ugcaacgccaaaaug

SEQ ID NO: 3112409 - RNA, 13 nt, Mycobacterium bovis subsp bovis AF2122/97
ugcaacgcgccuu

SEQ ID NO: 3112410 - RNA, 22 nt, Mycobacterium bovis subsp bovis AF2122/97
ugcaacggugaaucgaagcccg

SEQ ID NO: 3112411 - RNA, 19 nt, Mycobacterium bovis subsp bovis AF2122/97
ugcaacucgaauccggccc

SEQ ID NO: 3112412 - RNA, 11 nt, Mycobacterium bovis subsp bovis AF2122/97
ugcaacucggc

SEQ ID NO: 3112413 - RNA, 22 nt, Mycobacterium bovis subsp bovis AF2122/97
ugcaagacaaagccgucgacgc

SEQ ID NO: 3112414 - RNA, 17 nt, Mycobacterium bovis subsp bovis AF2122/97
ugcaagccgacaucggc

SEQ ID NO: 3112415 - RNA, 16 nt, Mycobacterium bovis subsp bovis AF2122/97
ugcaagcuaagcgccu

SEQ ID NO: 3112416 - RNA, 18 nt, Mycobacterium bovis subsp bovis AF2122/97
ugcaaugcuggcggcgcg

SEQ ID NO: 3112417 - RNA, 21 nt, Mycobacterium bovis subsp bovis AF2122/97
ugcaauugcgcggccauggca

SEQ ID NO: 3112418 - RNA, 18 nt, Mycobacterium bovis subsp bovis AF2122/97
ugcacaaccgcugcugcu

SEQ ID NO: 3112419 - RNA, 15 nt, Mycobacterium bovis subsp bovis AF2122/97
ugcacaacgcccacc

SEQ ID NO: 3112420 - RNA, 19 nt, Mycobacterium bovis subsp bovis AF2122/97
ugcacaaucgguugcaccc

SEQ ID NO: 3112421 - RNA, 21 nt, Mycobacterium bovis subsp bovis AF2122/97
ugcacacagaggucggucagc

SEQ ID NO: 3112422 - RNA, 13 nt, Mycobacterium bovis subsp bovis AF2122/97
ugcacacaggacu

SEQ ID NO: 3112423 - RNA, 12 nt, Mycobacterium bovis subsp bovis AF2122/97
ugcacaccaccg

SEQ ID NO: 3112424 - RNA, 17 nt, Mycobacterium bovis subsp bovis AF2122/97
ugcacaccaccgccgaa

SEQ ID NO: 3112425 - RNA, 13 nt, Mycobacterium bovis subsp bovis AF2122/97
ugcacaccggcac

SEQ ID NO: 3112426 - RNA, 17 nt, Mycobacterium bovis subsp bovis AF2122/97
ugcacacucaacccgcc

SEQ ID NO: 3112427 - RNA, 20 nt, Mycobacterium bovis subsp bovis AF2122/97
ugcacacucaacccgccguc

SEQ ID NO: 3112428 - RNA, 16 nt, Mycobacterium bovis subsp bovis AF2122/97
ugcacacugguggugc

SEQ ID NO: 3112429 - RNA, 21 nt, Mycobacterium bovis subsp bovis AF2122/97
ugcacagacacggcagcugca

SEQ ID NO: 3112430 - RNA, 17 nt, Mycobacterium bovis subsp bovis AF2122/97
ugcacagcagcgguuga

SEQ ID NO: 3112431 - RNA, 18 nt, Mycobacterium bovis subsp bovis AF2122/97
ugcacagcagugaacgua

SEQ ID NO: 3112432 - RNA, 17 nt, Mycobacterium bovis subsp bovis AF2122/97
ugcacaggauuggccgc

SEQ ID NO: 3112433 - RNA, 22 nt, Mycobacterium bovis subsp bovis AF2122/97
ugcacaggucagcgcugccacc

SEQ ID NO: 3112434 - RNA, 15 nt, Mycobacterium bovis subsp bovis AF2122/97
ugcacauucagcgcc

SEQ ID NO: 3112435 - RNA, 21 nt, Mycobacterium bovis subsp bovis AF2122/97
ugcaccacauuggcgaucagc

SEQ ID NO: 3112436 - RNA, 15 nt, Mycobacterium bovis subsp bovis AF2122/97
ugcaccacggcggcc

SEQ ID NO: 3112437 - RNA, 18 nt, Mycobacterium bovis subsp bovis AF2122/97
ugcaccagcgaccagguc

SEQ ID NO: 3112438 - RNA, 12 nt, Mycobacterium bovis subsp bovis AF2122/97
ugcaccagcuca

SEQ ID NO: 3112439 - RNA, 20 nt, Mycobacterium bovis subsp bovis AF2122/97
ugcaccagcucacccggagc

SEQ ID NO: 3112440 - RNA, 23 nt, Mycobacterium bovis subsp bovis AF2122/97
ugcaccagcucggugaucaccau

SEQ ID NO: 3112441 - RNA, 16 nt, Mycobacterium bovis subsp bovis AF2122/97
ugcaccauucgcaccg

SEQ ID NO: 3112442 - RNA, 19 nt, Mycobacterium bovis subsp bovis AF2122/97
ugcaccauucgcaccggcc

SEQ ID NO: 3112443 - RNA, 20 nt, Mycobacterium bovis subsp bovis AF2122/97
ugcacccaccccgaagaugc

SEQ ID NO: 3112444 - RNA, 14 nt, Mycobacterium bovis subsp bovis AF2122/97
ugcacccgcaccgg

SEQ ID NO: 3112445 - RNA, 16 nt, Mycobacterium bovis subsp bovis AF2122/97
ugcacccgcaccggug

SEQ ID NO: 3112446 - RNA, 15 nt, Mycobacterium bovis subsp bovis AF2122/97
ugcacccgccagggc

SEQ ID NO: 3112447 - RNA, 13 nt, Mycobacterium bovis subsp bovis AF2122/97
ugcacccgcgcgg

SEQ ID NO: 3112448 - RNA, 18 nt, Mycobacterium bovis subsp bovis AF2122/97
ugcacccggagaaucggu

SEQ ID NO: 3112449 - RNA, 20 nt, Mycobacterium bovis subsp bovis AF2122/97
ugcacccgggccgccucgau

SEQ ID NO: 3112450 - RNA, 16 nt, Mycobacterium bovis subsp bovis AF2122/97
ugcaccgaagauggcc

SEQ ID NO: 3112451 - RNA, 19 nt, Mycobacterium bovis subsp bovis AF2122/97
ugcaccgagaaagugcagu

SEQ ID NO: 3112452 - RNA, 20 nt, Mycobacterium bovis subsp bovis AF2122/97
ugcaccgcauuguugaagaa

SEQ ID NO: 3112453 - RNA, 16 nt, Mycobacterium bovis subsp bovis AF2122/97
ugcaccgccgccgccc

SEQ ID NO: 3112454 - RNA, 21 nt, Mycobacterium bovis subsp bovis AF2122/97
ugcaccggcuugggccaggcc

SEQ ID NO: 3112455 - RNA, 13 nt, Mycobacterium bovis subsp bovis AF2122/97
ugcaccgucagcc

SEQ ID NO: 3112456 - RNA, 15 nt, Mycobacterium bovis subsp bovis AF2122/97
ugcaccuccgacggc

SEQ ID NO: 3112457 - RNA, 16 nt, Mycobacterium bovis subsp bovis AF2122/97
ugcaccuccgacggcc

SEQ ID NO: 3112458 - RNA, 13 nt, Mycobacterium bovis subsp bovis AF2122/97
ugcaccucgcccu

SEQ ID NO: 3112459 - RNA, 16 nt, Mycobacterium bovis subsp bovis AF2122/97
ugcaccuucuccaccg

SEQ ID NO: 3112460 - RNA, 19 nt, Mycobacterium bovis subsp bovis AF2122/97
ugcacgacaucgucgcgac

SEQ ID NO: 3112461 - RNA, 19 nt, Mycobacterium bovis subsp bovis AF2122/97
ugcacgagcggacagggag

SEQ ID NO: 3112462 - RNA, 15 nt, Mycobacterium bovis subsp bovis AF2122/97
ugcacgcacagcccg

SEQ ID NO: 3112463 - RNA, 21 nt, Mycobacterium bovis subsp bovis AF2122/97
ugcacgcacagcccgaugccg

SEQ ID NO: 3112464 - RNA, 23 nt, Mycobacterium bovis subsp bovis AF2122/97
ugcacgcacagcccgaugccgug

SEQ ID NO: 3112465 - RNA, 14 nt, Mycobacterium bovis subsp bovis AF2122/97
ugcacgcccaggcg

SEQ ID NO: 3112466 - RNA, 16 nt, Mycobacterium bovis subsp bovis AF2122/97
ugcacgccggcgcugg

SEQ ID NO: 3112467 - RNA, 19 nt, Mycobacterium bovis subsp bovis AF2122/97
ugcacgccucaaaaaucgu

SEQ ID NO: 3112468 - RNA, 18 nt, Mycobacterium bovis subsp bovis AF2122/97
ugcacgcgauggccauca

SEQ ID NO: 3112469 - RNA, 19 nt, Mycobacterium bovis subsp bovis AF2122/97
ugcacgcggacaugacagc

SEQ ID NO: 3112470 - RNA, 20 nt, Mycobacterium bovis subsp bovis AF2122/97
ugcacgcgggcguuggccag

SEQ ID NO: 3112471 - RNA, 22 nt, Mycobacterium bovis subsp bovis AF2122/97
ugcacgcgggcguuggccagca

SEQ ID NO: 3112472 - RNA, 20 nt, Mycobacterium bovis subsp bovis AF2122/97
ugcacgcgggugccgacguc

SEQ ID NO: 3112473 - RNA, 15 nt, Mycobacterium bovis subsp bovis AF2122/97
ugcacgcucggcgcc

SEQ ID NO: 3112474 - RNA, 16 nt, Mycobacterium bovis subsp bovis AF2122/97
ugcacgcucggcgccg

SEQ ID NO: 3112475 - RNA, 20 nt, Mycobacterium bovis subsp bovis AF2122/97
ugcacgcucugcgccacagc

SEQ ID NO: 3112476 - RNA, 12 nt, Mycobacterium bovis subsp bovis AF2122/97
ugcacggccggg

SEQ ID NO: 3112477 - RNA, 22 nt, Mycobacterium bovis subsp bovis AF2122/97
ugcacggcuuuucgacgcugug

SEQ ID NO: 3112478 - RNA, 21 nt, Mycobacterium bovis subsp bovis AF2122/97
ugcacggucaacgaucccggg

SEQ ID NO: 3112479 - RNA, 16 nt, Mycobacterium bovis subsp bovis AF2122/97
ugcacggucaugccgc

SEQ ID NO: 3112480 - RNA, 14 nt, Mycobacterium bovis subsp bovis AF2122/97
ugcacggugcccag

SEQ ID NO: 3112481 - RNA, 15 nt, Mycobacterium bovis subsp bovis AF2122/97
ugcacggugcccagg

SEQ ID NO: 3112482 - RNA, 13 nt, Mycobacterium bovis subsp bovis AF2122/97
ugcacgucagcgg

SEQ ID NO: 3112483 - RNA, 23 nt, Mycobacterium bovis subsp bovis AF2122/97
ugcacgucaucggcuggccgcgc

SEQ ID NO: 3112484 - RNA, 12 nt, Mycobacterium bovis subsp bovis AF2122/97
ugcacgucggcg

SEQ ID NO: 3112485 - RNA, 14 nt, Mycobacterium bovis subsp bovis AF2122/97
ugcacgucggcggg

SEQ ID NO: 3112486 - RNA, 20 nt, Mycobacterium bovis subsp bovis AF2122/97
ugcacgucggcgggcgugug

SEQ ID NO: 3112487 - RNA, 20 nt, Mycobacterium bovis subsp bovis AF2122/97
ugcacguggccacggcauuc

SEQ ID NO: 3112488 - RNA, 14 nt, Mycobacterium bovis subsp bovis AF2122/97
ugcacucggcgccc

SEQ ID NO: 3112489 - RNA, 15 nt, Mycobacterium bovis subsp bovis AF2122/97
ugcacugaccgcggc

SEQ ID NO: 3112490 - RNA, 19 nt, Mycobacterium bovis subsp bovis AF2122/97
ugcacugcgaacccugcgc

SEQ ID NO: 3112491 - RNA, 15 nt, Mycobacterium bovis subsp bovis AF2122/97
ugcacugcugguuga

SEQ ID NO: 3112492 - RNA, 21 nt, Mycobacterium bovis subsp bovis AF2122/97
ugcacugcugguugaugaagg

SEQ ID NO: 3112493 - RNA, 15 nt, Mycobacterium bovis subsp bovis AF2122/97
ugcacuguggaagaa

SEQ ID NO: 3112494 - RNA, 14 nt, Mycobacterium bovis subsp bovis AF2122/97
ugcagaaacagccg

SEQ ID NO: 3112495 - RNA, 18 nt, Mycobacterium bovis subsp bovis AF2122/97
ugcagaauucggcgcgac

SEQ ID NO: 3112496 - RNA, 21 nt, Mycobacterium bovis subsp bovis AF2122/97
ugcagacaggcggcggccugg

SEQ ID NO: 3112497 - RNA, 20 nt, Mycobacterium bovis subsp bovis AF2122/97
ugcagacccgguaguccgcg

SEQ ID NO: 3112498 - RNA, 23 nt, Mycobacterium bovis subsp bovis AF2122/97
ugcagacccgguaguccgcgcuc

SEQ ID NO: 3112499 - RNA, 18 nt, Mycobacterium bovis subsp bovis AF2122/97
ugcagacccguucgccgu

SEQ ID NO: 3112500 - RNA, 13 nt, Mycobacterium bovis subsp bovis AF2122/97
ugcagaccgggug

SEQ ID NO: 3112501 - RNA, 14 nt, Mycobacterium bovis subsp bovis AF2122/97
ugcagaccgggugg

SEQ ID NO: 3112502 - RNA, 18 nt, Mycobacterium bovis subsp bovis AF2122/97
ugcagacggguggcccga

SEQ ID NO: 3112503 - RNA, 21 nt, Mycobacterium bovis subsp bovis AF2122/97
ugcagauaggacccagccagc

SEQ ID NO: 3112504 - RNA, 15 nt, Mycobacterium bovis subsp bovis AF2122/97
ugcagaucacgggug

SEQ ID NO: 3112505 - RNA, 19 nt, Mycobacterium bovis subsp bovis AF2122/97
ugcagaucgccccagccau

SEQ ID NO: 3112506 - RNA, 13 nt, Mycobacterium bovis subsp bovis AF2122/97
ugcagaucggccg

SEQ ID NO: 3112507 - RNA, 13 nt, Mycobacterium bovis subsp bovis AF2122/97
ugcagaucggcuc

SEQ ID NO: 3112508 - RNA, 21 nt, Mycobacterium bovis subsp bovis AF2122/97
ugcagaucguagugcgcgcca

SEQ ID NO: 3112509 - RNA, 18 nt, Mycobacterium bovis subsp bovis AF2122/97
ugcagcaauugcaccuuc

SEQ ID NO: 3112510 - RNA, 16 nt, Mycobacterium bovis subsp bovis AF2122/97
ugcagcacgauccagc

SEQ ID NO: 3112511 - RNA, 16 nt, Mycobacterium bovis subsp bovis AF2122/97
ugcagcacggcgccgc

SEQ ID NO: 3112512 - RNA, 21 nt, Mycobacterium bovis subsp bovis AF2122/97
ugcagcacuuccaagccgacc

SEQ ID NO: 3112513 - RNA, 18 nt, Mycobacterium bovis subsp bovis AF2122/97
ugcagcagcauccggccg

SEQ ID NO: 3112514 - RNA, 14 nt, Mycobacterium bovis subsp bovis AF2122/97
ugcagcagcgcagu

SEQ ID NO: 3112515 - RNA, 14 nt, Mycobacterium bovis subsp bovis AF2122/97
ugcagcagggcuuc

SEQ ID NO: 3112516 - RNA, 19 nt, Mycobacterium bovis subsp bovis AF2122/97
ugcagccauugacggucca

SEQ ID NO: 3112517 - RNA, 13 nt, Mycobacterium bovis subsp bovis AF2122/97
ugcagccccacuu

SEQ ID NO: 3112518 - RNA, 15 nt, Mycobacterium bovis subsp bovis AF2122/97
ugcagccccacuucg

SEQ ID NO: 3112519 - RNA, 14 nt, Mycobacterium bovis subsp bovis AF2122/97
ugcagcccgccgcu

SEQ ID NO: 3112520 - RNA, 22 nt, Mycobacterium bovis subsp bovis AF2122/97
ugcagcccgccggauccgccag

SEQ ID NO: 3112521 - RNA, 19 nt, Mycobacterium bovis subsp bovis AF2122/97
ugcagcccgggcagcacca

SEQ ID NO: 3112522 - RNA, 20 nt, Mycobacterium bovis subsp bovis AF2122/97
ugcagcccgggcagcaccag

SEQ ID NO: 3112523 - RNA, 14 nt, Mycobacterium bovis subsp bovis AF2122/97
ugcagcccugcgca

SEQ ID NO: 3112524 - RNA, 13 nt, Mycobacterium bovis subsp bovis AF2122/97
ugcagccgaccga

SEQ ID NO: 3112525 - RNA, 22 nt, Mycobacterium bovis subsp bovis AF2122/97
ugcagccgaccgaaucagcacg

SEQ ID NO: 3112526 - RNA, 20 nt, Mycobacterium bovis subsp bovis AF2122/97
ugcagccggcauagcggccc

SEQ ID NO: 3112527 - RNA, 12 nt, Mycobacterium bovis subsp bovis AF2122/97
ugcagccgggaa

SEQ ID NO: 3112528 - RNA, 19 nt, Mycobacterium bovis subsp bovis AF2122/97
ugcagccgggaaaucucgg

SEQ ID NO: 3112529 - RNA, 21 nt, Mycobacterium bovis subsp bovis AF2122/97
ugcagcgaaacaccggccagc

SEQ ID NO: 3112530 - RNA, 19 nt, Mycobacterium bovis subsp bovis AF2122/97
ugcagcgauaucacaacug

SEQ ID NO: 3112531 - RNA, 15 nt, Mycobacterium bovis subsp bovis AF2122/97
ugcagcgcacgcagc

SEQ ID NO: 3112532 - RNA, 21 nt, Mycobacterium bovis subsp bovis AF2122/97
ugcagcgcaggauucugcuga

SEQ ID NO: 3112533 - RNA, 16 nt, Mycobacterium bovis subsp bovis AF2122/97
ugcagcgccucgaccu

SEQ ID NO: 3112534 - RNA, 17 nt, Mycobacterium bovis subsp bovis AF2122/97
ugcagcgcguucggcac

SEQ ID NO: 3112535 - RNA, 18 nt, Mycobacterium bovis subsp bovis AF2122/97
ugcagcgcguucggcacc

SEQ ID NO: 3112536 - RNA, 16 nt, Mycobacterium bovis subsp bovis AF2122/97
ugcagcggcgccgcca

SEQ ID NO: 3112537 - RNA, 13 nt, Mycobacterium bovis subsp bovis AF2122/97
ugcagcggcuugc

SEQ ID NO: 3112538 - RNA, 14 nt, Mycobacterium bovis subsp bovis AF2122/97
ugcagcgggaucau

SEQ ID NO: 3112539 - RNA, 16 nt, Mycobacterium bovis subsp bovis AF2122/97
ugcagcggguugcggu

SEQ ID NO: 3112540 - RNA, 17 nt, Mycobacterium bovis subsp bovis AF2122/97
ugcagcgguccagacau

SEQ ID NO: 3112541 - RNA, 20 nt, Mycobacterium bovis subsp bovis AF2122/97
ugcagcgucaagggcugggu

SEQ ID NO: 3112542 - RNA, 21 nt, Mycobacterium bovis subsp bovis AF2122/97
ugcagcgucuccuugagcuuc

SEQ ID NO: 3112543 - RNA, 20 nt, Mycobacterium bovis subsp bovis AF2122/97
ugcagcuccccgccggaacu

SEQ ID NO: 3112544 - RNA, 15 nt, Mycobacterium bovis subsp bovis AF2122/97
ugcagcucgggcagg

SEQ ID NO: 3112545 - RNA, 14 nt, Mycobacterium bovis subsp bovis AF2122/97
ugcaggaacaccca

SEQ ID NO: 3112546 - RNA, 13 nt, Mycobacterium bovis subsp bovis AF2122/97
ugcaggaaggcuu

SEQ ID NO: 3112547 - RNA, 15 nt, Mycobacterium bovis subsp bovis AF2122/97
ugcaggaccagaacu

SEQ ID NO: 3112548 - RNA, 16 nt, Mycobacterium bovis subsp bovis AF2122/97
ugcaggaccagcaccg

SEQ ID NO: 3112549 - RNA, 19 nt, Mycobacterium bovis subsp bovis AF2122/97
ugcaggaucggcuugggaa

SEQ ID NO: 3112550 - RNA, 17 nt, Mycobacterium bovis subsp bovis AF2122/97
ugcaggcgcagcugggu

SEQ ID NO: 3112551 - RNA, 13 nt, Mycobacterium bovis subsp bovis AF2122/97
ugcaggcggccgc

SEQ ID NO: 3112552 - RNA, 22 nt, Mycobacterium bovis subsp bovis AF2122/97
ugcaggcggccuugccgggccg

SEQ ID NO: 3112553 - RNA, 19 nt, Mycobacterium bovis subsp bovis AF2122/97
ugcagggaauagcggcgcc

SEQ ID NO: 3112554 - RNA, 20 nt, Mycobacterium bovis subsp bovis AF2122/97
ugcagggaauagcggcgccc

SEQ ID NO: 3112555 - RNA, 19 nt, Mycobacterium bovis subsp bovis AF2122/97
ugcagggacccggcgccgu

SEQ ID NO: 3112556 - RNA, 18 nt, Mycobacterium bovis subsp bovis AF2122/97
ugcagggcauugcggccc

SEQ ID NO: 3112557 - RNA, 18 nt, Mycobacterium bovis subsp bovis AF2122/97
ugcagggccacuggccgg

SEQ ID NO: 3112558 - RNA, 13 nt, Mycobacterium bovis subsp bovis AF2122/97
ugcagggcccgca

SEQ ID NO: 3112559 - RNA, 18 nt, Mycobacterium bovis subsp bovis AF2122/97
ugcagggcccgcaacauc

SEQ ID NO: 3112560 - RNA, 21 nt, Mycobacterium bovis subsp bovis AF2122/97
ugcagggcccgcaacaucggg

SEQ ID NO: 3112561 - RNA, 15 nt, Mycobacterium bovis subsp bovis AF2122/97
ugcagggccuggcca

SEQ ID NO: 3112562 - RNA, 17 nt, Mycobacterium bovis subsp bovis AF2122/97
ugcagggccuggccaca

SEQ ID NO: 3112563 - RNA, 20 nt, Mycobacterium bovis subsp bovis AF2122/97
ugcagggcugcuacucugca

SEQ ID NO: 3112564 - RNA, 20 nt, Mycobacterium bovis subsp bovis AF2122/97
ugcagguagguauagccggu

SEQ ID NO: 3112565 - RNA, 20 nt, Mycobacterium bovis subsp bovis AF2122/97
ugcaggugaacaacagcgcu

SEQ ID NO: 3112566 - RNA, 17 nt, Mycobacterium bovis subsp bovis AF2122/97
ugcaggugaugagugcg

SEQ ID NO: 3112567 - RNA, 16 nt, Mycobacterium bovis subsp bovis AF2122/97
ugcaggugaugcaugc

SEQ ID NO: 3112568 - RNA, 15 nt, Mycobacterium bovis subsp bovis AF2122/97
ugcaggugcgggccg

SEQ ID NO: 3112569 - RNA, 16 nt, Mycobacterium bovis subsp bovis AF2122/97
ugcaggugcgggccgg

SEQ ID NO: 3112570 - RNA, 17 nt, Mycobacterium bovis subsp bovis AF2122/97
ugcagguggccgucgcc

SEQ ID NO: 3112571 - RNA, 16 nt, Mycobacterium bovis subsp bovis AF2122/97
ugcagguugccaagaa

SEQ ID NO: 3112572 - RNA, 19 nt, Mycobacterium bovis subsp bovis AF2122/97
ugcaguaacuucaccggcu

SEQ ID NO: 3112573 - RNA, 22 nt, Mycobacterium bovis subsp bovis AF2122/97
ugcaguacuagcagcgggcugc

SEQ ID NO: 3112574 - RNA, 20 nt, Mycobacterium bovis subsp bovis AF2122/97
ugcaguaucgaggccgacga

SEQ ID NO: 3112575 - RNA, 23 nt, Mycobacterium bovis subsp bovis AF2122/97
ugcagucgauuucggcggcgagg

SEQ ID NO: 3112576 - RNA, 19 nt, Mycobacterium bovis subsp bovis AF2122/97
ugcagucgcgaggugaagc

SEQ ID NO: 3112577 - RNA, 17 nt, Mycobacterium bovis subsp bovis AF2122/97
ugcagugaccucgucgg

SEQ ID NO: 3112578 - RNA, 23 nt, Mycobacterium bovis subsp bovis AF2122/97
ugcagugccguguccagcaugcc

SEQ ID NO: 3112579 - RNA, 13 nt, Mycobacterium bovis subsp bovis AF2122/97
ugcagugcgaccc

SEQ ID NO: 3112580 - RNA, 14 nt, Mycobacterium bovis subsp bovis AF2122/97
ugcagugcgccagc

SEQ ID NO: 3112581 - RNA, 14 nt, Mycobacterium bovis subsp bovis AF2122/97
ugcaguggcgacga

SEQ ID NO: 3112582 - RNA, 20 nt, Mycobacterium bovis subsp bovis AF2122/97
ugcaguguuuuugcagacuc

SEQ ID NO: 3112583 - RNA, 22 nt, Mycobacterium bovis subsp bovis AF2122/97
ugcaguguuuuugcagacucgg

SEQ ID NO: 3112584 - RNA, 21 nt, Mycobacterium bovis subsp bovis AF2122/97
ugcauagcaauccgcacagcg

SEQ ID NO: 3112585 - RNA, 20 nt, Mycobacterium bovis subsp bovis AF2122/97
ugcaucacaagggugcccgg

SEQ ID NO: 3112586 - RNA, 15 nt, Mycobacterium bovis subsp bovis AF2122/97
ugcaucagcacgucg

SEQ ID NO: 3112587 - RNA, 16 nt, Mycobacterium bovis subsp bovis AF2122/97
ugcaucagcacgucgc

SEQ ID NO: 3112588 - RNA, 16 nt, Mycobacterium bovis subsp bovis AF2122/97
ugcaucauggccguga

SEQ ID NO: 3112589 - RNA, 16 nt, Mycobacterium bovis subsp bovis AF2122/97
ugcauccagcugcugc

SEQ ID NO: 3112590 - RNA, 18 nt, Mycobacterium bovis subsp bovis AF2122/97
ugcauccauccugccuua

SEQ ID NO: 3112591 - RNA, 17 nt, Mycobacterium bovis subsp bovis AF2122/97
ugcauccuccucgucga

SEQ ID NO: 3112592 - RNA, 18 nt, Mycobacterium bovis subsp bovis AF2122/97
ugcauccuccucgucgac

SEQ ID NO: 3112593 - RNA, 14 nt, Mycobacterium bovis subsp bovis AF2122/97
ugcaucgccaccac

SEQ ID NO: 3112594 - RNA, 16 nt, Mycobacterium bovis subsp bovis AF2122/97
ugcaucgccaccaccg

SEQ ID NO: 3112595 - RNA, 14 nt, Mycobacterium bovis subsp bovis AF2122/97
ugcaucgcggcggc

SEQ ID NO: 3112596 - RNA, 11 nt, Mycobacterium bovis subsp bovis AF2122/97
ugcaucggcag

SEQ ID NO: 3112597 - RNA, 17 nt, Mycobacterium bovis subsp bovis AF2122/97
ugcaucggucagcgccg

SEQ ID NO: 3112598 - RNA, 18 nt, Mycobacterium bovis subsp bovis AF2122/97
ugcaucggugcagcccgc

SEQ ID NO: 3112599 - RNA, 20 nt, Mycobacterium bovis subsp bovis AF2122/97
ugcaugaacugcucgccgag

SEQ ID NO: 3112600 - RNA, 22 nt, Mycobacterium bovis subsp bovis AF2122/97
ugcaugcccagaaaaccgccgc

SEQ ID NO: 3112601 - RNA, 18 nt, Mycobacterium bovis subsp bovis AF2122/97
ugcaugccggcuagcucg

SEQ ID NO: 3112602 - RNA, 14 nt, Mycobacterium bovis subsp bovis AF2122/97
ugcaugccgggaag

SEQ ID NO: 3112603 - RNA, 20 nt, Mycobacterium bovis subsp bovis AF2122/97
ugcauggcuugcucugcgca

SEQ ID NO: 3112604 - RNA, 15 nt, Mycobacterium bovis subsp bovis AF2122/97
ugcaugguggcgccg

SEQ ID NO: 3112605 - RNA, 16 nt, Mycobacterium bovis subsp bovis AF2122/97
ugcaugguggcgccga

SEQ ID NO: 3112606 - RNA, 15 nt, Mycobacterium bovis subsp bovis AF2122/97
ugcaugucaaguucg

SEQ ID NO: 3112607 - RNA, 16 nt, Mycobacterium bovis subsp bovis AF2122/97
ugcauucccgccuucu

SEQ ID NO: 3112608 - RNA, 23 nt, Mycobacterium bovis subsp bovis AF2122/97
ugcauuggcggugcgcaccaccg

SEQ ID NO: 3112609 - RNA, 19 nt, Mycobacterium bovis subsp bovis AF2122/97
ugccaaaagggcggcagcg

SEQ ID NO: 3112610 - RNA, 22 nt, Mycobacterium bovis subsp bovis AF2122/97
ugccaaaagggcggcagcgagg

SEQ ID NO: 3112611 - RNA, 13 nt, Mycobacterium bovis subsp bovis AF2122/97
ugccaaacgccgc

SEQ ID NO: 3112612 - RNA, 23 nt, Mycobacterium bovis subsp bovis AF2122/97
ugccaaacgccgcccgccgguga

SEQ ID NO: 3112613 - RNA, 21 nt, Mycobacterium bovis subsp bovis AF2122/97
ugccaaacuaacggcagccac

SEQ ID NO: 3112614 - RNA, 22 nt, Mycobacterium bovis subsp bovis AF2122/97
ugccaacaaaggccggguggcc

SEQ ID NO: 3112615 - RNA, 19 nt, Mycobacterium bovis subsp bovis AF2122/97
ugccaacacauugccggcc

SEQ ID NO: 3112616 - RNA, 21 nt, Mycobacterium bovis subsp bovis AF2122/97
ugccaacaccggcgaucaccg

SEQ ID NO: 3112617 - RNA, 14 nt, Mycobacterium bovis subsp bovis AF2122/97
ugccaaccugggcc

SEQ ID NO: 3112618 - RNA, 23 nt, Mycobacterium bovis subsp bovis AF2122/97
ugccaacgaaccgcucagcgcag

SEQ ID NO: 3112619 - RNA, 21 nt, Mycobacterium bovis subsp bovis AF2122/97
ugccaacgacaggcgcccaca

SEQ ID NO: 3112620 - RNA, 23 nt, Mycobacterium bovis subsp bovis AF2122/97
ugccaacgcccguguugaagaag

SEQ ID NO: 3112621 - RNA, 19 nt, Mycobacterium bovis subsp bovis AF2122/97
ugccaagggccggaugggc

SEQ ID NO: 3112622 - RNA, 15 nt, Mycobacterium bovis subsp bovis AF2122/97
ugccaaucgccguca

SEQ ID NO: 3112623 - RNA, 21 nt, Mycobacterium bovis subsp bovis AF2122/97
ugccaaucgccgucagcaccg

SEQ ID NO: 3112624 - RNA, 14 nt, Mycobacterium bovis subsp bovis AF2122/97
ugccaauuccagcc

SEQ ID NO: 3112625 - RNA, 19 nt, Mycobacterium bovis subsp bovis AF2122/97
ugccacacacugccggaca

SEQ ID NO: 3112626 - RNA, 14 nt, Mycobacterium bovis subsp bovis AF2122/97
ugccacacaggcgu

SEQ ID NO: 3112627 - RNA, 12 nt, Mycobacterium bovis subsp bovis AF2122/97
ugccacagaccg

SEQ ID NO: 3112628 - RNA, 16 nt, Mycobacterium bovis subsp bovis AF2122/97
ugccacagaccgaaca

SEQ ID NO: 3112629 - RNA, 22 nt, Mycobacterium bovis subsp bovis AF2122/97
ugccacagaccgaacagcaccg

SEQ ID NO: 3112630 - RNA, 18 nt, Mycobacterium bovis subsp bovis AF2122/97
ugccacagcgacagcgug

SEQ ID NO: 3112631 - RNA, 16 nt, Mycobacterium bovis subsp bovis AF2122/97
ugccacagcucgccgu

SEQ ID NO: 3112632 - RNA, 18 nt, Mycobacterium bovis subsp bovis AF2122/97
ugccacaggcguuuccgc

SEQ ID NO: 3112633 - RNA, 20 nt, Mycobacterium bovis subsp bovis AF2122/97
ugccacaucccacgguggug

SEQ ID NO: 3112634 - RNA, 19 nt, Mycobacterium bovis subsp bovis AF2122/97
ugccaccaaguccaacgac

SEQ ID NO: 3112635 - RNA, 19 nt, Mycobacterium bovis subsp bovis AF2122/97
ugccaccacgcaugcgcgc

SEQ ID NO: 3112636 - RNA, 14 nt, Mycobacterium bovis subsp bovis AF2122/97
ugccaccacgcucc

SEQ ID NO: 3112637 - RNA, 15 nt, Mycobacterium bovis subsp bovis AF2122/97
ugccaccagaaacac

SEQ ID NO: 3112638 - RNA, 12 nt, Mycobacterium bovis subsp bovis AF2122/97
ugccaccagaca

SEQ ID NO: 3112639 - RNA, 20 nt, Mycobacterium bovis subsp bovis AF2122/97
ugccacccagaugcagcggu

SEQ ID NO: 3112640 - RNA, 15 nt, Mycobacterium bovis subsp bovis AF2122/97
ugccacccaucgcac

SEQ ID NO: 3112641 - RNA, 13 nt, Mycobacterium bovis subsp bovis AF2122/97
ugccacccuugcc

SEQ ID NO: 3112642 - RNA, 15 nt, Mycobacterium bovis subsp bovis AF2122/97
ugccacccuugccgc

SEQ ID NO: 3112643 - RNA, 12 nt, Mycobacterium bovis subsp bovis AF2122/97
ugccaccgagca

SEQ ID NO: 3112644 - RNA, 21 nt, Mycobacterium bovis subsp bovis AF2122/97
ugccaccgcgacggcaggcuc

SEQ ID NO: 3112645 - RNA, 13 nt, Mycobacterium bovis subsp bovis AF2122/97
ugccaccgcggcc

SEQ ID NO: 3112646 - RNA, 18 nt, Mycobacterium bovis subsp bovis AF2122/97
ugccaccgcggccgcggu

SEQ ID NO: 3112647 - RNA, 17 nt, Mycobacterium bovis subsp bovis AF2122/97
ugccaccgcugccggca

SEQ ID NO: 3112648 - RNA, 13 nt, Mycobacterium bovis subsp bovis AF2122/97
ugccaccggccgg

SEQ ID NO: 3112649 - RNA, 18 nt, Mycobacterium bovis subsp bovis AF2122/97
ugccaccguugccgccgu

SEQ ID NO: 3112650 - RNA, 15 nt, Mycobacterium bovis subsp bovis AF2122/97
ugccaccucggcgcg

SEQ ID NO: 3112651 - RNA, 18 nt, Mycobacterium bovis subsp bovis AF2122/97
ugccaccucuaccggugg

SEQ ID NO: 3112652 - RNA, 21 nt, Mycobacterium bovis subsp bovis AF2122/97
ugccaccuuggucuucgccgu

SEQ ID NO: 3112653 - RNA, 23 nt, Mycobacterium bovis subsp bovis AF2122/97
ugccacgaacgcuuccagcgugu

SEQ ID NO: 3112654 - RNA, 23 nt, Mycobacterium bovis subsp bovis AF2122/97
ugccacgacgaacaccagcgcgc

SEQ ID NO: 3112655 - RNA, 13 nt, Mycobacterium bovis subsp bovis AF2122/97
ugccacgccgccg

SEQ ID NO: 3112656 - RNA, 17 nt, Mycobacterium bovis subsp bovis AF2122/97
ugccacgccugagccac

SEQ ID NO: 3112657 - RNA, 23 nt, Mycobacterium bovis subsp bovis AF2122/97
ugccacgcguuccuccagcagcg

SEQ ID NO: 3112658 - RNA, 18 nt, Mycobacterium bovis subsp bovis AF2122/97
ugccacgcucggugcugc

SEQ ID NO: 3112659 - RNA, 21 nt, Mycobacterium bovis subsp bovis AF2122/97
ugccacgcucggugcugcgcc

SEQ ID NO: 3112660 - RNA, 13 nt, Mycobacterium bovis subsp bovis AF2122/97
ugccacggcgccu

SEQ ID NO: 3112661 - RNA, 21 nt, Mycobacterium bovis subsp bovis AF2122/97
ugccacggggcagguccgccc

SEQ ID NO: 3112662 - RNA, 21 nt, Mycobacterium bovis subsp bovis AF2122/97
ugccacggucauuggguguca

SEQ ID NO: 3112663 - RNA, 19 nt, Mycobacterium bovis subsp bovis AF2122/97
ugccacggugacccuggug

SEQ ID NO: 3112664 - RNA, 22 nt, Mycobacterium bovis subsp bovis AF2122/97
ugccacguucgcgggcgucccg

SEQ ID NO: 3112665 - RNA, 21 nt, Mycobacterium bovis subsp bovis AF2122/97
ugccacuccaggagccgagga

SEQ ID NO: 3112666 - RNA, 23 nt, Mycobacterium bovis subsp bovis AF2122/97
ugccacugccguugccgccggug

SEQ ID NO: 3112667 - RNA, 16 nt, Mycobacterium bovis subsp bovis AF2122/97
ugccacuuggacgaac

SEQ ID NO: 3112668 - RNA, 22 nt, Mycobacterium bovis subsp bovis AF2122/97
ugccacuuggacgaacacaccg

SEQ ID NO: 3112669 - RNA, 21 nt, Mycobacterium bovis subsp bovis AF2122/97
ugccagaacccggacagggug

SEQ ID NO: 3112670 - RNA, 15 nt, Mycobacterium bovis subsp bovis AF2122/97
ugccagaccagggca

SEQ ID NO: 3112671 - RNA, 21 nt, Mycobacterium bovis subsp bovis AF2122/97
ugccagaccagggcagcggcc

SEQ ID NO: 3112672 - RNA, 17 nt, Mycobacterium bovis subsp bovis AF2122/97
ugccagaucggucggcc

SEQ ID NO: 3112673 - RNA, 15 nt, Mycobacterium bovis subsp bovis AF2122/97
ugccagcaccacguc

SEQ ID NO: 3112674 - RNA, 18 nt, Mycobacterium bovis subsp bovis AF2122/97
ugccagcaccacgucgac

SEQ ID NO: 3112675 - RNA, 16 nt, Mycobacterium bovis subsp bovis AF2122/97
ugccagccauggccgc

SEQ ID NO: 3112676 - RNA, 21 nt, Mycobacterium bovis subsp bovis AF2122/97
ugccagccggucgaugccgau

SEQ ID NO: 3112677 - RNA, 21 nt, Mycobacterium bovis subsp bovis AF2122/97
ugccagccgucaccgcgaccc

SEQ ID NO: 3112678 - RNA, 21 nt, Mycobacterium bovis subsp bovis AF2122/97
ugccagccgucgucagguggc

SEQ ID NO: 3112679 - RNA, 13 nt, Mycobacterium bovis subsp bovis AF2122/97
ugccagccgugca

SEQ ID NO: 3112680 - RNA, 15 nt, Mycobacterium bovis subsp bovis AF2122/97
ugccagccgugcagg

SEQ ID NO: 3112681 - RNA, 23 nt, Mycobacterium bovis subsp bovis AF2122/97
ugccagccuuggacgugcgcgcc

SEQ ID NO: 3112682 - RNA, 14 nt, Mycobacterium bovis subsp bovis AF2122/97
ugccagcgccgccg

SEQ ID NO: 3112683 - RNA, 11 nt, Mycobacterium bovis subsp bovis AF2122/97
ugccagcggca

SEQ ID NO: 3112684 - RNA, 13 nt, Mycobacterium bovis subsp bovis AF2122/97
ugccagcggccgg

SEQ ID NO: 3112685 - RNA, 23 nt, Mycobacterium bovis subsp bovis AF2122/97
ugccagcggccgggcggccaggc

SEQ ID NO: 3112686 - RNA, 21 nt, Mycobacterium bovis subsp bovis AF2122/97
ugccagcguggugaagucggu

SEQ ID NO: 3112687 - RNA, 20 nt, Mycobacterium bovis subsp bovis AF2122/97
ugccagcuguugcggggugc

SEQ ID NO: 3112688 - RNA, 16 nt, Mycobacterium bovis subsp bovis AF2122/97
ugccaggaccgcgccg

SEQ ID NO: 3112689 - RNA, 20 nt, Mycobacterium bovis subsp bovis AF2122/97
ugccaggaucgcggcgccgu

SEQ ID NO: 3112690 - RNA, 15 nt, Mycobacterium bovis subsp bovis AF2122/97
ugccaggccgcugac

SEQ ID NO: 3112691 - RNA, 13 nt, Mycobacterium bovis subsp bovis AF2122/97
ugccagggcgggc

SEQ ID NO: 3112692 - RNA, 21 nt, Mycobacterium bovis subsp bovis AF2122/97
ugccagggcgggcgucgaggu

SEQ ID NO: 3112693 - RNA, 20 nt, Mycobacterium bovis subsp bovis AF2122/97
ugccagggugcgccgguccu

SEQ ID NO: 3112694 - RNA, 12 nt, Mycobacterium bovis subsp bovis AF2122/97
ugccaguccaaa

SEQ ID NO: 3112695 - RNA, 14 nt, Mycobacterium bovis subsp bovis AF2122/97
ugccagucgaucgc

SEQ ID NO: 3112696 - RNA, 15 nt, Mycobacterium bovis subsp bovis AF2122/97
ugccagucgaucgcg

SEQ ID NO: 3112697 - RNA, 16 nt, Mycobacterium bovis subsp bovis AF2122/97
ugccagugccagcguc

SEQ ID NO: 3112698 - RNA, 17 nt, Mycobacterium bovis subsp bovis AF2122/97
ugccagugccgcccacc

SEQ ID NO: 3112699 - RNA, 15 nt, Mycobacterium bovis subsp bovis AF2122/97
ugccauacagcaccc

SEQ ID NO: 3112700 - RNA, 16 nt, Mycobacterium bovis subsp bovis AF2122/97
ugccauaggacaggaa

SEQ ID NO: 3112701 - RNA, 16 nt, Mycobacterium bovis subsp bovis AF2122/97
ugccaucggcaccagc

SEQ ID NO: 3112702 - RNA, 20 nt, Mycobacterium bovis subsp bovis AF2122/97
ugccaucggcaccagcgcgc

SEQ ID NO: 3112703 - RNA, 24 nt, Mycobacterium bovis subsp bovis AF2122/97
ugccaucggcaccagcgcgcgccg

SEQ ID NO: 3112704 - RNA, 16 nt, Mycobacterium bovis subsp bovis AF2122/97
ugccaucgggcgcggu

SEQ ID NO: 3112705 - RNA, 19 nt, Mycobacterium bovis subsp bovis AF2122/97
ugccaucgggcgcgguaac

SEQ ID NO: 3112706 - RNA, 22 nt, Mycobacterium bovis subsp bovis AF2122/97
ugccaucgggcgcgguaaccac

SEQ ID NO: 3112707 - RNA, 20 nt, Mycobacterium bovis subsp bovis AF2122/97
ugccaucuggguccgucgag

SEQ ID NO: 3112708 - RNA, 17 nt, Mycobacterium bovis subsp bovis AF2122/97
ugccauggauguaggcu

SEQ ID NO: 3112709 - RNA, 13 nt, Mycobacterium bovis subsp bovis AF2122/97
ugccauggcccgu

SEQ ID NO: 3112710 - RNA, 20 nt, Mycobacterium bovis subsp bovis AF2122/97
ugccaugggcaauggugguu

SEQ ID NO: 3112711 - RNA, 24 nt, Mycobacterium bovis subsp bovis AF2122/97
ugccauuccagaucaacgcgucgc

SEQ ID NO: 3112712 - RNA, 23 nt, Mycobacterium bovis subsp bovis AF2122/97
ugcccaacccacucgcagcagca

SEQ ID NO: 3112713 - RNA, 15 nt, Mycobacterium bovis subsp bovis AF2122/97
ugcccaagcagucca

SEQ ID NO: 3112714 - RNA, 21 nt, Mycobacterium bovis subsp bovis AF2122/97
ugcccaagcccucgacgucca

SEQ ID NO: 3112715 - RNA, 18 nt, Mycobacterium bovis subsp bovis AF2122/97
ugcccaagcucagggugg

SEQ ID NO: 3112716 - RNA, 21 nt, Mycobacterium bovis subsp bovis AF2122/97
ugcccaauucgacugcaacuc

SEQ ID NO: 3112717 - RNA, 19 nt, Mycobacterium bovis subsp bovis AF2122/97
ugcccaccaucccgcucag

SEQ ID NO: 3112718 - RNA, 18 nt, Mycobacterium bovis subsp bovis AF2122/97
ugcccaccgccugggcgg

SEQ ID NO: 3112719 - RNA, 20 nt, Mycobacterium bovis subsp bovis AF2122/97
ugcccacggagggcaggaga

SEQ ID NO: 3112720 - RNA, 19 nt, Mycobacterium bovis subsp bovis AF2122/97
ugcccacggcgaccacgcc

SEQ ID NO: 3112721 - RNA, 19 nt, Mycobacterium bovis subsp bovis AF2122/97
ugcccacgggccggccgag

SEQ ID NO: 3112722 - RNA, 19 nt, Mycobacterium bovis subsp bovis AF2122/97
ugcccacguuggccaggcc

SEQ ID NO: 3112723 - RNA, 18 nt, Mycobacterium bovis subsp bovis AF2122/97
ugcccagaaaaccgccgc

SEQ ID NO: 3112724 - RNA, 13 nt, Mycobacterium bovis subsp bovis AF2122/97
ugcccagcaccac

SEQ ID NO: 3112725 - RNA, 20 nt, Mycobacterium bovis subsp bovis AF2122/97
ugcccagcaccaccgcggug

SEQ ID NO: 3112726 - RNA, 12 nt, Mycobacterium bovis subsp bovis AF2122/97
ugcccagcaccc

SEQ ID NO: 3112727 - RNA, 23 nt, Mycobacterium bovis subsp bovis AF2122/97
ugcccagcacccccugcaccguc

SEQ ID NO: 3112728 - RNA, 19 nt, Mycobacterium bovis subsp bovis AF2122/97
ugcccagcagaccaagucc

SEQ ID NO: 3112729 - RNA, 20 nt, Mycobacterium bovis subsp bovis AF2122/97
ugcccagcgaauccaggccg

SEQ ID NO: 3112730 - RNA, 19 nt, Mycobacterium bovis subsp bovis AF2122/97
ugcccagcgcacggaccau

SEQ ID NO: 3112731 - RNA, 15 nt, Mycobacterium bovis subsp bovis AF2122/97
ugcccagcgccgaau

SEQ ID NO: 3112732 - RNA, 21 nt, Mycobacterium bovis subsp bovis AF2122/97
ugcccagcgcuuugaugccga

SEQ ID NO: 3112733 - RNA, 23 nt, Mycobacterium bovis subsp bovis AF2122/97
ugcccaggaaggcgacgccgaaa

SEQ ID NO: 3112734 - RNA, 14 nt, Mycobacterium bovis subsp bovis AF2122/97
ugcccaggccaccg

SEQ ID NO: 3112735 - RNA, 18 nt, Mycobacterium bovis subsp bovis AF2122/97
ugcccaggccaccggcug

SEQ ID NO: 3112736 - RNA, 18 nt, Mycobacterium bovis subsp bovis AF2122/97
ugcccaggucuccaucaa

SEQ ID NO: 3112737 - RNA, 23 nt, Mycobacterium bovis subsp bovis AF2122/97
ugcccaggugcguccaggccagg

SEQ ID NO: 3112738 - RNA, 21 nt, Mycobacterium bovis subsp bovis AF2122/97
ugcccagguguguggcggcgu

SEQ ID NO: 3112739 - RNA, 13 nt, Mycobacterium bovis subsp bovis AF2122/97
ugcccaucaccag

SEQ ID NO: 3112740 - RNA, 16 nt, Mycobacterium bovis subsp bovis AF2122/97
ugcccaucacgcccca

SEQ ID NO: 3112741 - RNA, 17 nt, Mycobacterium bovis subsp bovis AF2122/97
ugcccaucccggccgag

SEQ ID NO: 3112742 - RNA, 14 nt, Mycobacterium bovis subsp bovis AF2122/97
ugcccauccggccg

SEQ ID NO: 3112743 - RNA, 20 nt, Mycobacterium bovis subsp bovis AF2122/97
ugcccauccggccgucgggc

SEQ ID NO: 3112744 - RNA, 16 nt, Mycobacterium bovis subsp bovis AF2122/97
ugcccaucggugaucg

SEQ ID NO: 3112745 - RNA, 14 nt, Mycobacterium bovis subsp bovis AF2122/97
ugcccaucuccaac

SEQ ID NO: 3112746 - RNA, 22 nt, Mycobacterium bovis subsp bovis AF2122/97
ugcccaugaugcucgaugauca

SEQ ID NO: 3112747 - RNA, 20 nt, Mycobacterium bovis subsp bovis AF2122/97
ugcccaugauggccgcggcu

SEQ ID NO: 3112748 - RNA, 20 nt, Mycobacterium bovis subsp bovis AF2122/97
ugcccaugauggucacggcg

SEQ ID NO: 3112749 - RNA, 18 nt, Mycobacterium bovis subsp bovis AF2122/97
ugcccaugcggcaggugc

SEQ ID NO: 3112750 - RNA, 12 nt, Mycobacterium bovis subsp bovis AF2122/97
ugccccaagcca

SEQ ID NO: 3112751 - RNA, 19 nt, Mycobacterium bovis subsp bovis AF2122/97
ugccccacccgcggcgccg

SEQ ID NO: 3112752 - RNA, 20 nt, Mycobacterium bovis subsp bovis AF2122/97
ugccccacccgcggcgccgu

SEQ ID NO: 3112753 - RNA, 17 nt, Mycobacterium bovis subsp bovis AF2122/97
ugccccagggcagugcg

SEQ ID NO: 3112754 - RNA, 23 nt, Mycobacterium bovis subsp bovis AF2122/97
ugccccaguccgaagcugcugcu

SEQ ID NO: 3112755 - RNA, 22 nt, Mycobacterium bovis subsp bovis AF2122/97
ugccccccagacaauccgccgc

SEQ ID NO: 3112756 - RNA, 14 nt, Mycobacterium bovis subsp bovis AF2122/97
ugcccccgccggcc

SEQ ID NO: 3112757 - RNA, 18 nt, Mycobacterium bovis subsp bovis AF2122/97
ugcccccgccggccgucg

SEQ ID NO: 3112758 - RNA, 16 nt, Mycobacterium bovis subsp bovis AF2122/97
ugcccccggcgcggcg

SEQ ID NO: 3112759 - RNA, 14 nt, Mycobacterium bovis subsp bovis AF2122/97
ugcccccggugccg

SEQ ID NO: 3112760 - RNA, 19 nt, Mycobacterium bovis subsp bovis AF2122/97
ugcccccguucuggaaccc

SEQ ID NO: 3112761 - RNA, 16 nt, Mycobacterium bovis subsp bovis AF2122/97
ugccccgaaccgcgcu

SEQ ID NO: 3112762 - RNA, 19 nt, Mycobacterium bovis subsp bovis AF2122/97
ugccccgaccgccguggcc

SEQ ID NO: 3112763 - RNA, 13 nt, Mycobacterium bovis subsp bovis AF2122/97
ugccccgaccgcg

SEQ ID NO: 3112764 - RNA, 14 nt, Mycobacterium bovis subsp bovis AF2122/97
ugccccgcagcacu

SEQ ID NO: 3112765 - RNA, 16 nt, Mycobacterium bovis subsp bovis AF2122/97
ugccccgcagcacucg

SEQ ID NO: 3112766 - RNA, 17 nt, Mycobacterium bovis subsp bovis AF2122/97
ugccccgcaucgcccaa

SEQ ID NO: 3112767 - RNA, 21 nt, Mycobacterium bovis subsp bovis AF2122/97
ugccccgccguaccgaagcgg

SEQ ID NO: 3112768 - RNA, 21 nt, Mycobacterium bovis subsp bovis AF2122/97
ugccccgccuuggccaccauc

SEQ ID NO: 3112769 - RNA, 17 nt, Mycobacterium bovis subsp bovis AF2122/97
ugccccgggcccagguu

SEQ ID NO: 3112770 - RNA, 20 nt, Mycobacterium bovis subsp bovis AF2122/97
ugccccgguugaucuugucc

SEQ ID NO: 3112771 - RNA, 18 nt, Mycobacterium bovis subsp bovis AF2122/97
ugccccguugagcagcac

SEQ ID NO: 3112772 - RNA, 21 nt, Mycobacterium bovis subsp bovis AF2122/97
ugccccuucaaagcggccucg

SEQ ID NO: 3112773 - RNA, 15 nt, Mycobacterium bovis subsp bovis AF2122/97
ugcccgaaccaccac

SEQ ID NO: 3112774 - RNA, 17 nt, Mycobacterium bovis subsp bovis AF2122/97
ugcccgaaccaccaccg

SEQ ID NO: 3112775 - RNA, 21 nt, Mycobacterium bovis subsp bovis AF2122/97
ugcccgaaccaccaccggcaa

SEQ ID NO: 3112776 - RNA, 23 nt, Mycobacterium bovis subsp bovis AF2122/97
ugcccgaaccaccaccggcaaca

SEQ ID NO: 3112777 - RNA, 21 nt, Mycobacterium bovis subsp bovis AF2122/97
ugcccgacacccgcauggcag

SEQ ID NO: 3112778 - RNA, 23 nt, Mycobacterium bovis subsp bovis AF2122/97
ugcccgacaccgccccgccgcga

SEQ ID NO: 3112779 - RNA, 20 nt, Mycobacterium bovis subsp bovis AF2122/97
ugcccgaccacaccgggaug

SEQ ID NO: 3112780 - RNA, 13 nt, Mycobacterium bovis subsp bovis AF2122/97
ugcccgacgacca

SEQ ID NO: 3112781 - RNA, 13 nt, Mycobacterium bovis subsp bovis AF2122/97
ugcccgacgaugc

SEQ ID NO: 3112782 - RNA, 14 nt, Mycobacterium bovis subsp bovis AF2122/97
ugcccgacucggcc

SEQ ID NO: 3112783 - RNA, 17 nt, Mycobacterium bovis subsp bovis AF2122/97
ugcccgacucggccgug

SEQ ID NO: 3112784 - RNA, 13 nt, Mycobacterium bovis subsp bovis AF2122/97
ugcccgacugaac

SEQ ID NO: 3112785 - RNA, 18 nt, Mycobacterium bovis subsp bovis AF2122/97
ugcccgagcccagccggg

SEQ ID NO: 3112786 - RNA, 21 nt, Mycobacterium bovis subsp bovis AF2122/97
ugcccgagcccagcgccucca

SEQ ID NO: 3112787 - RNA, 16 nt, Mycobacterium bovis subsp bovis AF2122/97
ugcccgauacccggug

SEQ ID NO: 3112788 - RNA, 22 nt, Mycobacterium bovis subsp bovis AF2122/97
ugcccgauacccggugauggug

SEQ ID NO: 3112789 - RNA, 15 nt, Mycobacterium bovis subsp bovis AF2122/97
ugcccgaucagccgu

SEQ ID NO: 3112790 - RNA, 23 nt, Mycobacterium bovis subsp bovis AF2122/97
ugcccgaucguaggacucggcgg

SEQ ID NO: 3112791 - RNA, 23 nt, Mycobacterium bovis subsp bovis AF2122/97
ugcccgaugguacccgcgccgcg

SEQ ID NO: 3112792 - RNA, 15 nt, Mycobacterium bovis subsp bovis AF2122/97
ugcccgcaacgccaa

SEQ ID NO: 3112793 - RNA, 22 nt, Mycobacterium bovis subsp bovis AF2122/97
ugcccgcaacgccaacacgcgu

SEQ ID NO: 3112794 - RNA, 16 nt, Mycobacterium bovis subsp bovis AF2122/97
ugcccgcaccacaccg

SEQ ID NO: 3112795 - RNA, 22 nt, Mycobacterium bovis subsp bovis AF2122/97
ugcccgcaccguagccgcugca

SEQ ID NO: 3112796 - RNA, 16 nt, Mycobacterium bovis subsp bovis AF2122/97
ugcccgcacugccgcc

SEQ ID NO: 3112797 - RNA, 14 nt, Mycobacterium bovis subsp bovis AF2122/97
ugcccgcauugcca

SEQ ID NO: 3112798 - RNA, 16 nt, Mycobacterium bovis subsp bovis AF2122/97
ugcccgcauugccaac

SEQ ID NO: 3112799 - RNA, 19 nt, Mycobacterium bovis subsp bovis AF2122/97
ugcccgcauugccaacgcc

SEQ ID NO: 3112800 - RNA, 16 nt, Mycobacterium bovis subsp bovis AF2122/97
ugcccgccaccggcgc

SEQ ID NO: 3112801 - RNA, 15 nt, Mycobacterium bovis subsp bovis AF2122/97
ugcccgccagcgccg

SEQ ID NO: 3112802 - RNA, 20 nt, Mycobacterium bovis subsp bovis AF2122/97
ugcccgccagcgccgccgcg

SEQ ID NO: 3112803 - RNA, 18 nt, Mycobacterium bovis subsp bovis AF2122/97
ugcccgccagucccccgc

SEQ ID NO: 3112804 - RNA, 13 nt, Mycobacterium bovis subsp bovis AF2122/97
ugcccgcccagcc

SEQ ID NO: 3112805 - RNA, 15 nt, Mycobacterium bovis subsp bovis AF2122/97
ugcccgccccgaccg

SEQ ID NO: 3112806 - RNA, 11 nt, Mycobacterium bovis subsp bovis AF2122/97
ugcccgccgac

SEQ ID NO: 3112807 - RNA, 12 nt, Mycobacterium bovis subsp bovis AF2122/97
ugcccgccgcgu

SEQ ID NO: 3112808 - RNA, 13 nt, Mycobacterium bovis subsp bovis AF2122/97
ugcccgccgcguc

SEQ ID NO: 3112809 - RNA, 12 nt, Mycobacterium bovis subsp bovis AF2122/97
ugcccgccggcc

SEQ ID NO: 3112810 - RNA, 18 nt, Mycobacterium bovis subsp bovis AF2122/97
ugcccgccguagaccagc

SEQ ID NO: 3112811 - RNA, 17 nt, Mycobacterium bovis subsp bovis AF2122/97
ugcccgccucgcagcga

SEQ ID NO: 3112812 - RNA, 14 nt, Mycobacterium bovis subsp bovis AF2122/97
ugcccgcgcggcca

SEQ ID NO: 3112813 - RNA, 13 nt, Mycobacterium bovis subsp bovis AF2122/97
ugcccgcgcggcg

SEQ ID NO: 3112814 - RNA, 13 nt, Mycobacterium bovis subsp bovis AF2122/97
ugcccgcggcgga

SEQ ID NO: 3112815 - RNA, 14 nt, Mycobacterium bovis subsp bovis AF2122/97
ugcccgcggugacg

SEQ ID NO: 3112816 - RNA, 19 nt, Mycobacterium bovis subsp bovis AF2122/97
ugcccgcgucuacgucguc

SEQ ID NO: 3112817 - RNA, 18 nt, Mycobacterium bovis subsp bovis AF2122/97
ugcccgcguugccaaagc

SEQ ID NO: 3112818 - RNA, 20 nt, Mycobacterium bovis subsp bovis AF2122/97
ugcccgcguuugcgaagccc

SEQ ID NO: 3112819 - RNA, 19 nt, Mycobacterium bovis subsp bovis AF2122/97
ugcccgcugaucagauccu

SEQ ID NO: 3112820 - RNA, 20 nt, Mycobacterium bovis subsp bovis AF2122/97
ugcccggacucuccccuggc

SEQ ID NO: 3112821 - RNA, 20 nt, Mycobacterium bovis subsp bovis AF2122/97
ugcccggauuggcgaugaug

SEQ ID NO: 3112822 - RNA, 16 nt, Mycobacterium bovis subsp bovis AF2122/97
ugcccggcaaccugga

SEQ ID NO: 3112823 - RNA, 23 nt, Mycobacterium bovis subsp bovis AF2122/97
ugcccggcaaccuggacuggguc

SEQ ID NO: 3112824 - RNA, 19 nt, Mycobacterium bovis subsp bovis AF2122/97
ugcccggccaaccaccaac

SEQ ID NO: 3112825 - RNA, 13 nt, Mycobacterium bovis subsp bovis AF2122/97
ugcccggccgcca

SEQ ID NO: 3112826 - RNA, 18 nt, Mycobacterium bovis subsp bovis AF2122/97
ugcccggcgcccggguag

SEQ ID NO: 3112827 - RNA, 21 nt, Mycobacterium bovis subsp bovis AF2122/97
ugcccggcuccuccccggccc

SEQ ID NO: 3112828 - RNA, 22 nt, Mycobacterium bovis subsp bovis AF2122/97
ugcccggcuccuccccggcccg

SEQ ID NO: 3112829 - RNA, 20 nt, Mycobacterium bovis subsp bovis AF2122/97
ugcccgggacaaguucggua

SEQ ID NO: 3112830 - RNA, 17 nt, Mycobacterium bovis subsp bovis AF2122/97
ugcccgggaccauagcc

SEQ ID NO: 3112831 - RNA, 18 nt, Mycobacterium bovis subsp bovis AF2122/97
ugcccgggaugacugggc

SEQ ID NO: 3112832 - RNA, 19 nt, Mycobacterium bovis subsp bovis AF2122/97
ugcccgggguccaucgggg

SEQ ID NO: 3112833 - RNA, 20 nt, Mycobacterium bovis subsp bovis AF2122/97
ugcccgggguccaucggggc

SEQ ID NO: 3112834 - RNA, 20 nt, Mycobacterium bovis subsp bovis AF2122/97
ugcccgggucggccggguug

SEQ ID NO: 3112835 - RNA, 16 nt, Mycobacterium bovis subsp bovis AF2122/97
ugcccguagacgccga

SEQ ID NO: 3112836 - RNA, 18 nt, Mycobacterium bovis subsp bovis AF2122/97
ugcccguauaaccggcca

SEQ ID NO: 3112837 - RNA, 19 nt, Mycobacterium bovis subsp bovis AF2122/97
ugcccguauaaccggccau

SEQ ID NO: 3112838 - RNA, 15 nt, Mycobacterium bovis subsp bovis AF2122/97
ugcccgucgucggca

SEQ ID NO: 3112839 - RNA, 20 nt, Mycobacterium bovis subsp bovis AF2122/97
ugcccgucucguugaccaac

SEQ ID NO: 3112840 - RNA, 18 nt, Mycobacterium bovis subsp bovis AF2122/97
ugcccguggugauggucg

SEQ ID NO: 3112841 - RNA, 19 nt, Mycobacterium bovis subsp bovis AF2122/97
ugcccguucaugcggcggc

SEQ ID NO: 3112842 - RNA, 16 nt, Mycobacterium bovis subsp bovis AF2122/97
ugcccguucugcccag

SEQ ID NO: 3112843 - RNA, 14 nt, Mycobacterium bovis subsp bovis AF2122/97
ugcccuagcccgau

SEQ ID NO: 3112844 - RNA, 13 nt, Mycobacterium bovis subsp bovis AF2122/97
ugcccucaacggc

SEQ ID NO: 3112845 - RNA, 14 nt, Mycobacterium bovis subsp bovis AF2122/97
ugcccucaacggcg

SEQ ID NO: 3112846 - RNA, 16 nt, Mycobacterium bovis subsp bovis AF2122/97
ugcccucaacggcggc

SEQ ID NO: 3112847 - RNA, 19 nt, Mycobacterium bovis subsp bovis AF2122/97
ugcccucaacgucccagcc

SEQ ID NO: 3112848 - RNA, 12 nt, Mycobacterium bovis subsp bovis AF2122/97
ugcccucggccg

SEQ ID NO: 3112849 - RNA, 16 nt, Mycobacterium bovis subsp bovis AF2122/97
ugcccugauugaagcc

SEQ ID NO: 3112850 - RNA, 14 nt, Mycobacterium bovis subsp bovis AF2122/97
ugcccugcccgaag

SEQ ID NO: 3112851 - RNA, 16 nt, Mycobacterium bovis subsp bovis AF2122/97
ugcccugccggcagcg

SEQ ID NO: 3112852 - RNA, 20 nt, Mycobacterium bovis subsp bovis AF2122/97
ugcccugcgcucgggcugcc

SEQ ID NO: 3112853 - RNA, 20 nt, Mycobacterium bovis subsp bovis AF2122/97
ugcccugggugauggccgcg

SEQ ID NO: 3112854 - RNA, 14 nt, Mycobacterium bovis subsp bovis AF2122/97
ugcccuucgucggc

SEQ ID NO: 3112855 - RNA, 19 nt, Mycobacterium bovis subsp bovis AF2122/97
ugcccuucgucggcaugac

SEQ ID NO: 3112856 - RNA, 16 nt, Mycobacterium bovis subsp bovis AF2122/97
ugcccuucugacuauc

SEQ ID NO: 3112857 - RNA, 19 nt, Mycobacterium bovis subsp bovis AF2122/97
ugcccuucuucgaccgcga

SEQ ID NO: 3112858 - RNA, 21 nt, Mycobacterium bovis subsp bovis AF2122/97
ugcccuugcggaagaagugcu

SEQ ID NO: 3112859 - RNA, 16 nt, Mycobacterium bovis subsp bovis AF2122/97
ugcccuuggccagcag

SEQ ID NO: 3112860 - RNA, 12 nt, Mycobacterium bovis subsp bovis AF2122/97
ugcccuugggac

SEQ ID NO: 3112861 - RNA, 20 nt, Mycobacterium bovis subsp bovis AF2122/97
ugccgaaaaucgcagccacg

SEQ ID NO: 3112862 - RNA, 22 nt, Mycobacterium bovis subsp bovis AF2122/97
ugccgaaacgccgaccgcgccg

SEQ ID NO: 3112863 - RNA, 23 nt, Mycobacterium bovis subsp bovis AF2122/97
ugccgaacagcgaaccgccggca

SEQ ID NO: 3112864 - RNA, 20 nt, Mycobacterium bovis subsp bovis AF2122/97
ugccgaacaguucggcgagc

SEQ ID NO: 3112865 - RNA, 18 nt, Mycobacterium bovis subsp bovis AF2122/97
ugccgaaccacgcgcccg

SEQ ID NO: 3112866 - RNA, 15 nt, Mycobacterium bovis subsp bovis AF2122/97
ugccgaaccgcgcgu

SEQ ID NO: 3112867 - RNA, 16 nt, Mycobacterium bovis subsp bovis AF2122/97
ugccgaaccgcgcgua

SEQ ID NO: 3112868 - RNA, 17 nt, Mycobacterium bovis subsp bovis AF2122/97
ugccgaaccgcugcggg

SEQ ID NO: 3112869 - RNA, 16 nt, Mycobacterium bovis subsp bovis AF2122/97
ugccgaacgccagacc

SEQ ID NO: 3112870 - RNA, 18 nt, Mycobacterium bovis subsp bovis AF2122/97
ugccgaacgucgcggcca

SEQ ID NO: 3112871 - RNA, 16 nt, Mycobacterium bovis subsp bovis AF2122/97
ugccgaacuccgcgga

SEQ ID NO: 3112872 - RNA, 18 nt, Mycobacterium bovis subsp bovis AF2122/97
ugccgaacuccgcggaac

SEQ ID NO: 3112873 - RNA, 17 nt, Mycobacterium bovis subsp bovis AF2122/97
ugccgaagaugaccgcu

SEQ ID NO: 3112874 - RNA, 22 nt, Mycobacterium bovis subsp bovis AF2122/97
ugccgaagcccccgacguugcu

SEQ ID NO: 3112875 - RNA, 13 nt, Mycobacterium bovis subsp bovis AF2122/97
ugccgaagccgga

SEQ ID NO: 3112876 - RNA, 18 nt, Mycobacterium bovis subsp bovis AF2122/97
ugccgaagcggccaccgc

SEQ ID NO: 3112877 - RNA, 21 nt, Mycobacterium bovis subsp bovis AF2122/97
ugccgaagcugcccaaccggu

SEQ ID NO: 3112878 - RNA, 22 nt, Mycobacterium bovis subsp bovis AF2122/97
ugccgaagcugcccaaccgguc

SEQ ID NO: 3112879 - RNA, 17 nt, Mycobacterium bovis subsp bovis AF2122/97
ugccgaaguugaagaag

SEQ ID NO: 3112880 - RNA, 18 nt, Mycobacterium bovis subsp bovis AF2122/97
ugccgaauaccgguggca

SEQ ID NO: 3112881 - RNA, 21 nt, Mycobacterium bovis subsp bovis AF2122/97
ugccgaauugggcgauuuugc

SEQ ID NO: 3112882 - RNA, 21 nt, Mycobacterium bovis subsp bovis AF2122/97
ugccgacaguuuaccgugccg

SEQ ID NO: 3112883 - RNA, 13 nt, Mycobacterium bovis subsp bovis AF2122/97
ugccgaccagcau

SEQ ID NO: 3112884 - RNA, 18 nt, Mycobacterium bovis subsp bovis AF2122/97
ugccgaccagcaucucgg

SEQ ID NO: 3112885 - RNA, 15 nt, Mycobacterium bovis subsp bovis AF2122/97
ugccgaccagcgcgc

SEQ ID NO: 3112886 - RNA, 17 nt, Mycobacterium bovis subsp bovis AF2122/97
ugccgaccaugcaagug

SEQ ID NO: 3112887 - RNA, 17 nt, Mycobacterium bovis subsp bovis AF2122/97
ugccgacccgccgcgcc

SEQ ID NO: 3112888 - RNA, 21 nt, Mycobacterium bovis subsp bovis AF2122/97
ugccgacccgccgcgcccggc

SEQ ID NO: 3112889 - RNA, 15 nt, Mycobacterium bovis subsp bovis AF2122/97
ugccgacccgucgga

SEQ ID NO: 3112890 - RNA, 21 nt, Mycobacterium bovis subsp bovis AF2122/97
ugccgaccggcacccgcggcg

SEQ ID NO: 3112891 - RNA, 23 nt, Mycobacterium bovis subsp bovis AF2122/97
ugccgaccgguuggguagcaccg

SEQ ID NO: 3112892 - RNA, 23 nt, Mycobacterium bovis subsp bovis AF2122/97
ugccgacgaacgaaccgccgccg

SEQ ID NO: 3112893 - RNA, 19 nt, Mycobacterium bovis subsp bovis AF2122/97
ugccgacgaggggcgcggg

SEQ ID NO: 3112894 - RNA, 15 nt, Mycobacterium bovis subsp bovis AF2122/97
ugccgacgccccgau

SEQ ID NO: 3112895 - RNA, 21 nt, Mycobacterium bovis subsp bovis AF2122/97
ugccgacgccccgaucggcca

SEQ ID NO: 3112896 - RNA, 15 nt, Mycobacterium bovis subsp bovis AF2122/97
ugccgacgcgcggcc

SEQ ID NO: 3112897 - RNA, 16 nt, Mycobacterium bovis subsp bovis AF2122/97
ugccgacgcgcggcca

SEQ ID NO: 3112898 - RNA, 17 nt, Mycobacterium bovis subsp bovis AF2122/97
ugccgacgcgcggccag

SEQ ID NO: 3112899 - RNA, 19 nt, Mycobacterium bovis subsp bovis AF2122/97
ugccgacgcucacgcugcu

SEQ ID NO: 3112900 - RNA, 17 nt, Mycobacterium bovis subsp bovis AF2122/97
ugccgacggcaucaacg

SEQ ID NO: 3112901 - RNA, 14 nt, Mycobacterium bovis subsp bovis AF2122/97
ugccgacucagguc

SEQ ID NO: 3112902 - RNA, 19 nt, Mycobacterium bovis subsp bovis AF2122/97
ugccgacucaggucggugc

SEQ ID NO: 3112903 - RNA, 14 nt, Mycobacterium bovis subsp bovis AF2122/97
ugccgacucaucgg

SEQ ID NO: 3112904 - RNA, 19 nt, Mycobacterium bovis subsp bovis AF2122/97
ugccgacucaucggccgcg

SEQ ID NO: 3112905 - RNA, 17 nt, Mycobacterium bovis subsp bovis AF2122/97
ugccgagaacaccggcc

SEQ ID NO: 3112906 - RNA, 19 nt, Mycobacterium bovis subsp bovis AF2122/97
ugccgagaagugggcggua

SEQ ID NO: 3112907 - RNA, 15 nt, Mycobacterium bovis subsp bovis AF2122/97
ugccgagaucccagc

SEQ ID NO: 3112908 - RNA, 15 nt, Mycobacterium bovis subsp bovis AF2122/97
ugccgagaugccggc

SEQ ID NO: 3112909 - RNA, 14 nt, Mycobacterium bovis subsp bovis AF2122/97
ugccgagcacgacg

SEQ ID NO: 3112910 - RNA, 23 nt, Mycobacterium bovis subsp bovis AF2122/97
ugccgagcacgacgacgucgggg

SEQ ID NO: 3112911 - RNA, 17 nt, Mycobacterium bovis subsp bovis AF2122/97
ugccgagcacucggcca

SEQ ID NO: 3112912 - RNA, 12 nt, Mycobacterium bovis subsp bovis AF2122/97
ugccgagcagac

SEQ ID NO: 3112913 - RNA, 22 nt, Mycobacterium bovis subsp bovis AF2122/97
ugccgagcagcuucucggcgag

SEQ ID NO: 3112914 - RNA, 17 nt, Mycobacterium bovis subsp bovis AF2122/97
ugccgagcgaccguccc

SEQ ID NO: 3112915 - RNA, 19 nt, Mycobacterium bovis subsp bovis AF2122/97
ugccgagcgugcgcuggug

SEQ ID NO: 3112916 - RNA, 21 nt, Mycobacterium bovis subsp bovis AF2122/97
ugccgagcgugcgcugguggc

SEQ ID NO: 3112917 - RNA, 15 nt, Mycobacterium bovis subsp bovis AF2122/97
ugccgagcuggcgac

SEQ ID NO: 3112918 - RNA, 18 nt, Mycobacterium bovis subsp bovis AF2122/97
ugccgagcuucagcgcgc

SEQ ID NO: 3112919 - RNA, 17 nt, Mycobacterium bovis subsp bovis AF2122/97
ugccgagcuugucgagc

SEQ ID NO: 3112920 - RNA, 17 nt, Mycobacterium bovis subsp bovis AF2122/97
ugccgagguugcggacg

SEQ ID NO: 3112921 - RNA, 16 nt, Mycobacterium bovis subsp bovis AF2122/97
ugccgauacagcacau

SEQ ID NO: 3112922 - RNA, 22 nt, Mycobacterium bovis subsp bovis AF2122/97
ugccgaucaaccccccgggccc

SEQ ID NO: 3112923 - RNA, 16 nt, Mycobacterium bovis subsp bovis AF2122/97
ugccgaucagcagugg

SEQ ID NO: 3112924 - RNA, 17 nt, Mycobacterium bovis subsp bovis AF2122/97
ugccgaucagcccggcc

SEQ ID NO: 3112925 - RNA, 16 nt, Mycobacterium bovis subsp bovis AF2122/97
ugccgauccccaggcc

SEQ ID NO: 3112926 - RNA, 13 nt, Mycobacterium bovis subsp bovis AF2122/97
ugccgaucccggc

SEQ ID NO: 3112927 - RNA, 17 nt, Mycobacterium bovis subsp bovis AF2122/97
ugccgaucccggcgagc

SEQ ID NO: 3112928 - RNA, 14 nt, Mycobacterium bovis subsp bovis AF2122/97
ugccgaucgaugcc

SEQ ID NO: 3112929 - RNA, 12 nt, Mycobacterium bovis subsp bovis AF2122/97
ugccgaucggcc

SEQ ID NO: 3112930 - RNA, 13 nt, Mycobacterium bovis subsp bovis AF2122/97
ugccgaucggcca

SEQ ID NO: 3112931 - RNA, 15 nt, Mycobacterium bovis subsp bovis AF2122/97
ugccgaucggccaac

SEQ ID NO: 3112932 - RNA, 20 nt, Mycobacterium bovis subsp bovis AF2122/97
ugccgaucggccaacagguc

SEQ ID NO: 3112933 - RNA, 21 nt, Mycobacterium bovis subsp bovis AF2122/97
ugccgaucggccugcagcgau

SEQ ID NO: 3112934 - RNA, 21 nt, Mycobacterium bovis subsp bovis AF2122/97
ugccgaucgggcucacucgcc

SEQ ID NO: 3112935 - RNA, 16 nt, Mycobacterium bovis subsp bovis AF2122/97
ugccgaucucgcccag

SEQ ID NO: 3112936 - RNA, 23 nt, Mycobacterium bovis subsp bovis AF2122/97
ugccgaugaccgccugcuggccg

SEQ ID NO: 3112937 - RNA, 19 nt, Mycobacterium bovis subsp bovis AF2122/97
ugccgaugacgauggccgc

SEQ ID NO: 3112938 - RNA, 23 nt, Mycobacterium bovis subsp bovis AF2122/97
ugccgaugacgauggccgccgcg

SEQ ID NO: 3112939 - RNA, 13 nt, Mycobacterium bovis subsp bovis AF2122/97
ugccgaugccggc

SEQ ID NO: 3112940 - RNA, 20 nt, Mycobacterium bovis subsp bovis AF2122/97
ugccgaugcgacgcagaccg

SEQ ID NO: 3112941 - RNA, 15 nt, Mycobacterium bovis subsp bovis AF2122/97
ugccgauggcggugg

SEQ ID NO: 3112942 - RNA, 16 nt, Mycobacterium bovis subsp bovis AF2122/97
ugccgauggcgguggc

SEQ ID NO: 3112943 - RNA, 16 nt, Mycobacterium bovis subsp bovis AF2122/97
ugccgauggugauggg

SEQ ID NO: 3112944 - RNA, 22 nt, Mycobacterium bovis subsp bovis AF2122/97
ugccgauggugaugggggagcc

SEQ ID NO: 3112945 - RNA, 15 nt, Mycobacterium bovis subsp bovis AF2122/97
ugccgaugucgaugc

SEQ ID NO: 3112946 - RNA, 15 nt, Mycobacterium bovis subsp bovis AF2122/97
ugccgcacccagacc

SEQ ID NO: 3112947 - RNA, 15 nt, Mycobacterium bovis subsp bovis AF2122/97
ugccgcacccccucc

SEQ ID NO: 3112948 - RNA, 18 nt, Mycobacterium bovis subsp bovis AF2122/97
ugccgcaccggugcucgu

SEQ ID NO: 3112949 - RNA, 21 nt, Mycobacterium bovis subsp bovis AF2122/97
ugccgcacgauggccgucgau

SEQ ID NO: 3112950 - RNA, 20 nt, Mycobacterium bovis subsp bovis AF2122/97
ugccgcacugggcgaugacg

SEQ ID NO: 3112951 - RNA, 17 nt, Mycobacterium bovis subsp bovis AF2122/97
ugccgcagacgcggcag

SEQ ID NO: 3112952 - RNA, 17 nt, Mycobacterium bovis subsp bovis AF2122/97
ugccgcagcauccccgc

SEQ ID NO: 3112953 - RNA, 13 nt, Mycobacterium bovis subsp bovis AF2122/97
ugccgcaucaccc

SEQ ID NO: 3112954 - RNA, 13 nt, Mycobacterium bovis subsp bovis AF2122/97
ugccgcaucggca

SEQ ID NO: 3112955 - RNA, 12 nt, Mycobacterium bovis subsp bovis AF2122/97
ugccgccaaccg

SEQ ID NO: 3112956 - RNA, 15 nt, Mycobacterium bovis subsp bovis AF2122/97
ugccgccacaaagaa

SEQ ID NO: 3112957 - RNA, 16 nt, Mycobacterium bovis subsp bovis AF2122/97
ugccgccaccaccggc

SEQ ID NO: 3112958 - RNA, 17 nt, Mycobacterium bovis subsp bovis AF2122/97
ugccgccaccaccggcg

SEQ ID NO: 3112959 - RNA, 12 nt, Mycobacterium bovis subsp bovis AF2122/97
ugccgccaccgc

SEQ ID NO: 3112960 - RNA, 16 nt, Mycobacterium bovis subsp bovis AF2122/97
ugccgccaccgccacc

SEQ ID NO: 3112961 - RNA, 23 nt, Mycobacterium bovis subsp bovis AF2122/97
ugccgccaccgccaccgcggccu

SEQ ID NO: 3112962 - RNA, 13 nt, Mycobacterium bovis subsp bovis AF2122/97
ugccgccaccggc

SEQ ID NO: 3112963 - RNA, 16 nt, Mycobacterium bovis subsp bovis AF2122/97
ugccgccaccggcguc

SEQ ID NO: 3112964 - RNA, 17 nt, Mycobacterium bovis subsp bovis AF2122/97
ugccgccacgggcggcc

SEQ ID NO: 3112965 - RNA, 20 nt, Mycobacterium bovis subsp bovis AF2122/97
ugccgccacgggcggccacc

SEQ ID NO: 3112966 - RNA, 19 nt, Mycobacterium bovis subsp bovis AF2122/97
ugccgccagccccagcguu

SEQ ID NO: 3112967 - RNA, 17 nt, Mycobacterium bovis subsp bovis AF2122/97
ugccgccaucgccgccg

SEQ ID NO: 3112968 - RNA, 20 nt, Mycobacterium bovis subsp bovis AF2122/97
ugccgccaucgccgccggug

SEQ ID NO: 3112969 - RNA, 19 nt, Mycobacterium bovis subsp bovis AF2122/97
ugccgccauuccagccggu

SEQ ID NO: 3112970 - RNA, 20 nt, Mycobacterium bovis subsp bovis AF2122/97
ugccgccauuccagccggug

SEQ ID NO: 3112971 - RNA, 20 nt, Mycobacterium bovis subsp bovis AF2122/97
ugccgccauugacgccguug

SEQ ID NO: 3112972 - RNA, 19 nt, Mycobacterium bovis subsp bovis AF2122/97
ugccgccauuggcaggcau

SEQ ID NO: 3112973 - RNA, 17 nt, Mycobacterium bovis subsp bovis AF2122/97
ugccgcccacgcugccc

SEQ ID NO: 3112974 - RNA, 18 nt, Mycobacterium bovis subsp bovis AF2122/97
ugccgcccacgcugccca

SEQ ID NO: 3112975 - RNA, 15 nt, Mycobacterium bovis subsp bovis AF2122/97
ugccgcccccggcac

SEQ ID NO: 3112976 - RNA, 17 nt, Mycobacterium bovis subsp bovis AF2122/97
ugccgcccgagccggug

SEQ ID NO: 3112977 - RNA, 15 nt, Mycobacterium bovis subsp bovis AF2122/97
ugccgcccgcgccgc

SEQ ID NO: 3112978 - RNA, 17 nt, Mycobacterium bovis subsp bovis AF2122/97
ugccgcccgcgccgccc

SEQ ID NO: 3112979 - RNA, 18 nt, Mycobacterium bovis subsp bovis AF2122/97
ugccgcccgcgccgccgc

SEQ ID NO: 3112980 - RNA, 19 nt, Mycobacterium bovis subsp bovis AF2122/97
ugccgcccgcgccgccgga

SEQ ID NO: 3112981 - RNA, 17 nt, Mycobacterium bovis subsp bovis AF2122/97
ugccgcccgcgccuccg

SEQ ID NO: 3112982 - RNA, 18 nt, Mycobacterium bovis subsp bovis AF2122/97
ugccgcccgcuccgccgu

SEQ ID NO: 3112983 - RNA, 22 nt, Mycobacterium bovis subsp bovis AF2122/97
ugccgcccgcuccgccgucgcc

SEQ ID NO: 3112984 - RNA, 20 nt, Mycobacterium bovis subsp bovis AF2122/97
ugccgcccucaccgccugug

SEQ ID NO: 3112985 - RNA, 18 nt, Mycobacterium bovis subsp bovis AF2122/97
ugccgcccuggacgucgg

SEQ ID NO: 3112986 - RNA, 19 nt, Mycobacterium bovis subsp bovis AF2122/97
ugccgcccuggacgucggc

SEQ ID NO: 3112987 - RNA, 23 nt, Mycobacterium bovis subsp bovis AF2122/97
ugccgcccuggacgucggcgaua

SEQ ID NO: 3112988 - RNA, 19 nt, Mycobacterium bovis subsp bovis AF2122/97
ugccgcccuugauguccgc

SEQ ID NO: 3112989 - RNA, 17 nt, Mycobacterium bovis subsp bovis AF2122/97
ugccgcccuugccgccc

SEQ ID NO: 3112990 - RNA, 22 nt, Mycobacterium bovis subsp bovis AF2122/97
ugccgcccuugccgcccgcucc

SEQ ID NO: 3112991 - RNA, 10 nt, Mycobacterium bovis subsp bovis AF2122/97
ugccgccgaa

SEQ ID NO: 3112992 - RNA, 21 nt, Mycobacterium bovis subsp bovis AF2122/97
ugccgccgaagaggagaacga

SEQ ID NO: 3112993 - RNA, 17 nt, Mycobacterium bovis subsp bovis AF2122/97
ugccgccgacaccaccg

SEQ ID NO: 3112994 - RNA, 20 nt, Mycobacterium bovis subsp bovis AF2122/97
ugccgccgacaccaccggcg

SEQ ID NO: 3112995 - RNA, 21 nt, Mycobacterium bovis subsp bovis AF2122/97
ugccgccgacaccaccggcgc

SEQ ID NO: 3112996 - RNA, 23 nt, Mycobacterium bovis subsp bovis AF2122/97
ugccgccgacaccaccggcgccg

SEQ ID NO: 3112997 - RNA, 17 nt, Mycobacterium bovis subsp bovis AF2122/97
ugccgccgacgccgccg

SEQ ID NO: 3112998 - RNA, 17 nt, Mycobacterium bovis subsp bovis AF2122/97
ugccgccgacgggaacc

SEQ ID NO: 3112999 - RNA, 14 nt, Mycobacterium bovis subsp bovis AF2122/97
ugccgccgagcugg

SEQ ID NO: 3113000 - RNA, 17 nt, Mycobacterium bovis subsp bovis AF2122/97
ugccgccgagcuggcgc

SEQ ID NO: 3113001 - RNA, 19 nt, Mycobacterium bovis subsp bovis AF2122/97
ugccgccgagggcgccggg

SEQ ID NO: 3113002 - RNA, 20 nt, Mycobacterium bovis subsp bovis AF2122/97
ugccgccgauaccgccggcc

SEQ ID NO: 3113003 - RNA, 15 nt, Mycobacterium bovis subsp bovis AF2122/97
ugccgccgcacaucu

SEQ ID NO: 3113004 - RNA, 15 nt, Mycobacterium bovis subsp bovis AF2122/97
ugccgccgccgagau

SEQ ID NO: 3113005 - RNA, 14 nt, Mycobacterium bovis subsp bovis AF2122/97
ugccgccgccggcg

SEQ ID NO: 3113006 - RNA, 14 nt, Mycobacterium bovis subsp bovis AF2122/97
ugccgccgccuccg

SEQ ID NO: 3113007 - RNA, 18 nt, Mycobacterium bovis subsp bovis AF2122/97
ugccgccgccuccgccga

SEQ ID NO: 3113008 - RNA, 19 nt, Mycobacterium bovis subsp bovis AF2122/97
ugccgccgccuccgccgag

SEQ ID NO: 3113009 - RNA, 14 nt, Mycobacterium bovis subsp bovis AF2122/97
ugccgccgcggcag

SEQ ID NO: 3113010 - RNA, 13 nt, Mycobacterium bovis subsp bovis AF2122/97
ugccgccgcggcc

SEQ ID NO: 3113011 - RNA, 16 nt, Mycobacterium bovis subsp bovis AF2122/97
ugccgccgcggccaca

SEQ ID NO: 3113012 - RNA, 19 nt, Mycobacterium bovis subsp bovis AF2122/97
ugccgccgcggccacaacc

SEQ ID NO: 3113013 - RNA, 16 nt, Mycobacterium bovis subsp bovis AF2122/97
ugccgccgcggccacc

SEQ ID NO: 3113014 - RNA, 18 nt, Mycobacterium bovis subsp bovis AF2122/97
ugccgccgcggccaccac

SEQ ID NO: 3113015 - RNA, 21 nt, Mycobacterium bovis subsp bovis AF2122/97
ugccgccgcggcgcccggcgg

SEQ ID NO: 3113016 - RNA, 22 nt, Mycobacterium bovis subsp bovis AF2122/97
ugccgccgcggcgcccggcgga

SEQ ID NO: 3113017 - RNA, 16 nt, Mycobacterium bovis subsp bovis AF2122/97
ugccgccggcaccgcc

SEQ ID NO: 3113018 - RNA, 21 nt, Mycobacterium bovis subsp bovis AF2122/97
ugccgccggcaccgccggugg

SEQ ID NO: 3113019 - RNA, 18 nt, Mycobacterium bovis subsp bovis AF2122/97
ugccgccggccccgccag

SEQ ID NO: 3113020 - RNA, 19 nt, Mycobacterium bovis subsp bovis AF2122/97
ugccgccggccccgccguc

SEQ ID NO: 3113021 - RNA, 22 nt, Mycobacterium bovis subsp bovis AF2122/97
ugccgccggccccgccgucacc

SEQ ID NO: 3113022 - RNA, 21 nt, Mycobacterium bovis subsp bovis AF2122/97
ugccgccggccccgccgucgc

SEQ ID NO: 3113023 - RNA, 14 nt, Mycobacterium bovis subsp bovis AF2122/97
ugccgccggcgcca

SEQ ID NO: 3113024 - RNA, 17 nt, Mycobacterium bovis subsp bovis AF2122/97
ugccgccggcgccaccc

SEQ ID NO: 3113025 - RNA, 19 nt, Mycobacterium bovis subsp bovis AF2122/97
ugccgccggcgccgccguu

SEQ ID NO: 3113026 - RNA, 16 nt, Mycobacterium bovis subsp bovis AF2122/97
ugccgccggcuccacc

SEQ ID NO: 3113027 - RNA, 17 nt, Mycobacterium bovis subsp bovis AF2122/97
ugccgccggcuccaccc

SEQ ID NO: 3113028 - RNA, 22 nt, Mycobacterium bovis subsp bovis AF2122/97
ugccgccgggugcaacggcguu

SEQ ID NO: 3113029 - RNA, 16 nt, Mycobacterium bovis subsp bovis AF2122/97
ugccgccggugccacc

SEQ ID NO: 3113030 - RNA, 17 nt, Mycobacterium bovis subsp bovis AF2122/97
ugccgccggugccaccc

SEQ ID NO: 3113031 - RNA, 17 nt, Mycobacterium bovis subsp bovis AF2122/97
ugccgccggugccgcca

SEQ ID NO: 3113032 - RNA, 18 nt, Mycobacterium bovis subsp bovis AF2122/97
ugccgccggugccgccau

SEQ ID NO: 3113033 - RNA, 19 nt, Mycobacterium bovis subsp bovis AF2122/97
ugccgccggugccgccauu

SEQ ID NO: 3113034 - RNA, 19 nt, Mycobacterium bovis subsp bovis AF2122/97
ugccgccggugccgccgau

SEQ ID NO: 3113035 - RNA, 23 nt, Mycobacterium bovis subsp bovis AF2122/97
ugccgccgguggugccggcgccg

SEQ ID NO: 3113036 - RNA, 18 nt, Mycobacterium bovis subsp bovis AF2122/97
ugccgccgguuccgccgg

SEQ ID NO: 3113037 - RNA, 19 nt, Mycobacterium bovis subsp bovis AF2122/97
ugccgccgucaccgccguu

SEQ ID NO: 3113038 - RNA, 15 nt, Mycobacterium bovis subsp bovis AF2122/97
ugccgccguccccgc

SEQ ID NO: 3113039 - RNA, 15 nt, Mycobacterium bovis subsp bovis AF2122/97
ugccgccgucgauga

SEQ ID NO: 3113040 - RNA, 21 nt, Mycobacterium bovis subsp bovis AF2122/97
ugccgccgucgccacgcccag

SEQ ID NO: 3113041 - RNA, 16 nt, Mycobacterium bovis subsp bovis AF2122/97
ugccgccgucgccgau

SEQ ID NO: 3113042 - RNA, 15 nt, Mycobacterium bovis subsp bovis AF2122/97
ugccgccgucgccgc

SEQ ID NO: 3113043 - RNA, 17 nt, Mycobacterium bovis subsp bovis AF2122/97
ugccgccgucgccgcca

SEQ ID NO: 3113044 - RNA, 19 nt, Mycobacterium bovis subsp bovis AF2122/97
ugccgccgucgccgccguc

SEQ ID NO: 3113045 - RNA, 19 nt, Mycobacterium bovis subsp bovis AF2122/97
ugccgccgucgccgccguu

SEQ ID NO: 3113046 - RNA, 20 nt, Mycobacterium bovis subsp bovis AF2122/97
ugccgccgucgccgccguug

SEQ ID NO: 3113047 - RNA, 15 nt, Mycobacterium bovis subsp bovis AF2122/97
ugccgccgucguugc

SEQ ID NO: 3113048 - RNA, 21 nt, Mycobacterium bovis subsp bovis AF2122/97
ugccgccgucguugcccgacc

SEQ ID NO: 3113049 - RNA, 22 nt, Mycobacterium bovis subsp bovis AF2122/97
ugccgccgucguugcccgaccc

SEQ ID NO: 3113050 - RNA, 15 nt, Mycobacterium bovis subsp bovis AF2122/97
ugccgccgugguugc

SEQ ID NO: 3113051 - RNA, 21 nt, Mycobacterium bovis subsp bovis AF2122/97
ugccgccguuaccgagcccga

SEQ ID NO: 3113052 - RNA, 18 nt, Mycobacterium bovis subsp bovis AF2122/97
ugccgccguuaccgccgc

SEQ ID NO: 3113053 - RNA, 19 nt, Mycobacterium bovis subsp bovis AF2122/97
ugccgccguuaccgccgcu

SEQ ID NO: 3113054 - RNA, 23 nt, Mycobacterium bovis subsp bovis AF2122/97
ugccgccguuaccgccgcugccg

SEQ ID NO: 3113055 - RNA, 16 nt, Mycobacterium bovis subsp bovis AF2122/97
ugccgccguucccacc

SEQ ID NO: 3113056 - RNA, 18 nt, Mycobacterium bovis subsp bovis AF2122/97
ugccgccguucccaccac

SEQ ID NO: 3113057 - RNA, 18 nt, Mycobacterium bovis subsp bovis AF2122/97
ugccgccguugaugaacg

SEQ ID NO: 3113058 - RNA, 17 nt, Mycobacterium bovis subsp bovis AF2122/97
ugccgccguugccgcca

SEQ ID NO: 3113059 - RNA, 18 nt, Mycobacterium bovis subsp bovis AF2122/97
ugccgccguugccgccau

SEQ ID NO: 3113060 - RNA, 19 nt, Mycobacterium bovis subsp bovis AF2122/97
ugccgccguugccgccauu

SEQ ID NO: 3113061 - RNA, 19 nt, Mycobacterium bovis subsp bovis AF2122/97
ugccgccguugccgccgaa

SEQ ID NO: 3113062 - RNA, 18 nt, Mycobacterium bovis subsp bovis AF2122/97
ugccgccguugccggcuu

SEQ ID NO: 3113063 - RNA, 21 nt, Mycobacterium bovis subsp bovis AF2122/97
ugccgccuccgccugccccac

SEQ ID NO: 3113064 - RNA, 18 nt, Mycobacterium bovis subsp bovis AF2122/97
ugccgccuccggugcaua

SEQ ID NO: 3113065 - RNA, 15 nt, Mycobacterium bovis subsp bovis AF2122/97
ugccgccugcgccgc

SEQ ID NO: 3113066 - RNA, 15 nt, Mycobacterium bovis subsp bovis AF2122/97
ugccgccugguaccg

SEQ ID NO: 3113067 - RNA, 18 nt, Mycobacterium bovis subsp bovis AF2122/97
ugccgccugucccgccgg

SEQ ID NO: 3113068 - RNA, 16 nt, Mycobacterium bovis subsp bovis AF2122/97
ugccgccuugcuugcg

SEQ ID NO: 3113069 - RNA, 22 nt, Mycobacterium bovis subsp bovis AF2122/97
ugccgccuuggucgcgucggcu

SEQ ID NO: 3113070 - RNA, 17 nt, Mycobacterium bovis subsp bovis AF2122/97
ugccgcgaaugaagccc

SEQ ID NO: 3113071 - RNA, 20 nt, Mycobacterium bovis subsp bovis AF2122/97
ugccgcgaucgggcccagca

SEQ ID NO: 3113072 - RNA, 14 nt, Mycobacterium bovis subsp bovis AF2122/97
ugccgcgcaccaac

SEQ ID NO: 3113073 - RNA, 17 nt, Mycobacterium bovis subsp bovis AF2122/97
ugccgcgcagcgcggcg

SEQ ID NO: 3113074 - RNA, 16 nt, Mycobacterium bovis subsp bovis AF2122/97
ugccgcgcagcugccg

SEQ ID NO: 3113075 - RNA, 21 nt, Mycobacterium bovis subsp bovis AF2122/97
ugccgcgcagcugccgcaccc

SEQ ID NO: 3113076 - RNA, 15 nt, Mycobacterium bovis subsp bovis AF2122/97
ugccgcgcggcgaga

SEQ ID NO: 3113077 - RNA, 13 nt, Mycobacterium bovis subsp bovis AF2122/97
ugccgcggccacc

SEQ ID NO: 3113078 - RNA, 17 nt, Mycobacterium bovis subsp bovis AF2122/97
ugccgcggccaccgccg

SEQ ID NO: 3113079 - RNA, 18 nt, Mycobacterium bovis subsp bovis AF2122/97
ugccgcggccaccgccgc

SEQ ID NO: 3113080 - RNA, 19 nt, Mycobacterium bovis subsp bovis AF2122/97
ugccgcggccaguacgucg

SEQ ID NO: 3113081 - RNA, 20 nt, Mycobacterium bovis subsp bovis AF2122/97
ugccgcggccaguacgucga

SEQ ID NO: 3113082 - RNA, 16 nt, Mycobacterium bovis subsp bovis AF2122/97
ugccgcggccggcgug

SEQ ID NO: 3113083 - RNA, 17 nt, Mycobacterium bovis subsp bovis AF2122/97
ugccgcggccggcgugc

SEQ ID NO: 3113084 - RNA, 23 nt, Mycobacterium bovis subsp bovis AF2122/97
ugccgcggccggcgugccagcac

SEQ ID NO: 3113085 - RNA, 20 nt, Mycobacterium bovis subsp bovis AF2122/97
ugccgcggcuaggccaagcc

SEQ ID NO: 3113086 - RNA, 19 nt, Mycobacterium bovis subsp bovis AF2122/97
ugccgcgguggaugcgaug

SEQ ID NO: 3113087 - RNA, 19 nt, Mycobacterium bovis subsp bovis AF2122/97
ugccgcgguugugcugggu

SEQ ID NO: 3113088 - RNA, 20 nt, Mycobacterium bovis subsp bovis AF2122/97
ugccgcgguugugcugggug

SEQ ID NO: 3113089 - RNA, 20 nt, Mycobacterium bovis subsp bovis AF2122/97
ugccgcguagaacccaggcc

SEQ ID NO: 3113090 - RNA, 19 nt, Mycobacterium bovis subsp bovis AF2122/97
ugccgcguagguggccagc

SEQ ID NO: 3113091 - RNA, 23 nt, Mycobacterium bovis subsp bovis AF2122/97
ugccgcguagguggccagcgcgg

SEQ ID NO: 3113092 - RNA, 19 nt, Mycobacterium bovis subsp bovis AF2122/97
ugccgcguugccgggguug

SEQ ID NO: 3113093 - RNA, 14 nt, Mycobacterium bovis subsp bovis AF2122/97
ugccgcucgccggu

SEQ ID NO: 3113094 - RNA, 19 nt, Mycobacterium bovis subsp bovis AF2122/97
ugccgcucggcaaccugcg

SEQ ID NO: 3113095 - RNA, 16 nt, Mycobacterium bovis subsp bovis AF2122/97
ugccgcucucggcgau

SEQ ID NO: 3113096 - RNA, 23 nt, Mycobacterium bovis subsp bovis AF2122/97
ugccgcugaagccaaaugcgcug

SEQ ID NO: 3113097 - RNA, 16 nt, Mycobacterium bovis subsp bovis AF2122/97
ugccgcugagcccugc

SEQ ID NO: 3113098 - RNA, 18 nt, Mycobacterium bovis subsp bovis AF2122/97
ugccgcugagcccugcgc

SEQ ID NO: 3113099 - RNA, 16 nt, Mycobacterium bovis subsp bovis AF2122/97
ugccgcugcauccgca

SEQ ID NO: 3113100 - RNA, 17 nt, Mycobacterium bovis subsp bovis AF2122/97
ugccgcugcauccgcag

SEQ ID NO: 3113101 - RNA, 18 nt, Mycobacterium bovis subsp bovis AF2122/97
ugccgcugcauccgcagc

SEQ ID NO: 3113102 - RNA, 21 nt, Mycobacterium bovis subsp bovis AF2122/97
ugccgcugccgaagcggccac

SEQ ID NO: 3113103 - RNA, 22 nt, Mycobacterium bovis subsp bovis AF2122/97
ugccgcugcgccgucgcagcca

SEQ ID NO: 3113104 - RNA, 13 nt, Mycobacterium bovis subsp bovis AF2122/97
ugccgcugguggc

SEQ ID NO: 3113105 - RNA, 15 nt, Mycobacterium bovis subsp bovis AF2122/97
ugccggaaacgccag

SEQ ID NO: 3113106 - RNA, 15 nt, Mycobacterium bovis subsp bovis AF2122/97
ugccggacaaccugg

SEQ ID NO: 3113107 - RNA, 16 nt, Mycobacterium bovis subsp bovis AF2122/97
ugccggacaaccuggg

SEQ ID NO: 3113108 - RNA, 23 nt, Mycobacterium bovis subsp bovis AF2122/97
ugccggacaaccuggggccacca

SEQ ID NO: 3113109 - RNA, 18 nt, Mycobacterium bovis subsp bovis AF2122/97
ugccggacagcucgcgcu

SEQ ID NO: 3113110 - RNA, 16 nt, Mycobacterium bovis subsp bovis AF2122/97
ugccggacgccaugcc

SEQ ID NO: 3113111 - RNA, 18 nt, Mycobacterium bovis subsp bovis AF2122/97
ugccggacgccaugcccg

SEQ ID NO: 3113112 - RNA, 21 nt, Mycobacterium bovis subsp bovis AF2122/97
ugccggacgccaugcccgcac

SEQ ID NO: 3113113 - RNA, 14 nt, Mycobacterium bovis subsp bovis AF2122/97
ugccggacugccgc

SEQ ID NO: 3113114 - RNA, 15 nt, Mycobacterium bovis subsp bovis AF2122/97
ugccggacugccgca

SEQ ID NO: 3113115 - RNA, 17 nt, Mycobacterium bovis subsp bovis AF2122/97
ugccggagacacccgcc

SEQ ID NO: 3113116 - RNA, 19 nt, Mycobacterium bovis subsp bovis AF2122/97
ugccggagacacccgccag

SEQ ID NO: 3113117 - RNA, 20 nt, Mycobacterium bovis subsp bovis AF2122/97
ugccggagacaccgcaacgc

SEQ ID NO: 3113118 - RNA, 13 nt, Mycobacterium bovis subsp bovis AF2122/97
ugccggagacguc

SEQ ID NO: 3113119 - RNA, 18 nt, Mycobacterium bovis subsp bovis AF2122/97
ugccggagacgucgccgc

SEQ ID NO: 3113120 - RNA, 19 nt, Mycobacterium bovis subsp bovis AF2122/97
ugccggaggaucgcugguu

SEQ ID NO: 3113121 - RNA, 22 nt, Mycobacterium bovis subsp bovis AF2122/97
ugccggaggaucgcugguuugc

SEQ ID NO: 3113122 - RNA, 18 nt, Mycobacterium bovis subsp bovis AF2122/97
ugccggaguugucgacgg

SEQ ID NO: 3113123 - RNA, 23 nt, Mycobacterium bovis subsp bovis AF2122/97
ugccggaguugucgacggccacc

SEQ ID NO: 3113124 - RNA, 23 nt, Mycobacterium bovis subsp bovis AF2122/97
ugccggcaaccugaauccagacc

SEQ ID NO: 3113125 - RNA, 13 nt, Mycobacterium bovis subsp bovis AF2122/97
ugccggcaccaac

SEQ ID NO: 3113126 - RNA, 18 nt, Mycobacterium bovis subsp bovis AF2122/97
ugccggcaccaaccaccg

SEQ ID NO: 3113127 - RNA, 17 nt, Mycobacterium bovis subsp bovis AF2122/97
ugccggcacgcaugccg

SEQ ID NO: 3113128 - RNA, 13 nt, Mycobacterium bovis subsp bovis AF2122/97
ugccggcagcgcc

SEQ ID NO: 3113129 - RNA, 18 nt, Mycobacterium bovis subsp bovis AF2122/97
ugccggcagcggcgcgcu

SEQ ID NO: 3113130 - RNA, 13 nt, Mycobacterium bovis subsp bovis AF2122/97
ugccggcagcggu

SEQ ID NO: 3113131 - RNA, 17 nt, Mycobacterium bovis subsp bovis AF2122/97
ugccggcagcgguggca

SEQ ID NO: 3113132 - RNA, 20 nt, Mycobacterium bovis subsp bovis AF2122/97
ugccggccaacuucugcacg

SEQ ID NO: 3113133 - RNA, 20 nt, Mycobacterium bovis subsp bovis AF2122/97
ugccggccaaggugguuguc

SEQ ID NO: 3113134 - RNA, 19 nt, Mycobacterium bovis subsp bovis AF2122/97
ugccggccaccagccuggc

SEQ ID NO: 3113135 - RNA, 18 nt, Mycobacterium bovis subsp bovis AF2122/97
ugccggccagacucgcgg

SEQ ID NO: 3113136 - RNA, 14 nt, Mycobacterium bovis subsp bovis AF2122/97
ugccggccaucgcc

SEQ ID NO: 3113137 - RNA, 13 nt, Mycobacterium bovis subsp bovis AF2122/97
ugccggccgcaca

SEQ ID NO: 3113138 - RNA, 15 nt, Mycobacterium bovis subsp bovis AF2122/97
ugccggccgcggggc

SEQ ID NO: 3113139 - RNA, 22 nt, Mycobacterium bovis subsp bovis AF2122/97
ugccggcgaaccccagcgcauc

SEQ ID NO: 3113140 - RNA, 15 nt, Mycobacterium bovis subsp bovis AF2122/97
ugccggcgaacucgc

SEQ ID NO: 3113141 - RNA, 21 nt, Mycobacterium bovis subsp bovis AF2122/97
ugccggcgaacucgcgccgag

SEQ ID NO: 3113142 - RNA, 17 nt, Mycobacterium bovis subsp bovis AF2122/97
ugccggcgaaggccagc

SEQ ID NO: 3113143 - RNA, 11 nt, Mycobacterium bovis subsp bovis AF2122/97
ugccggcgacc

SEQ ID NO: 3113144 - RNA, 23 nt, Mycobacterium bovis subsp bovis AF2122/97
ugccggcgacgcuaccgccggag

SEQ ID NO: 3113145 - RNA, 17 nt, Mycobacterium bovis subsp bovis AF2122/97
ugccggcgagcaggccg

SEQ ID NO: 3113146 - RNA, 16 nt, Mycobacterium bovis subsp bovis AF2122/97
ugccggcgagggccac

SEQ ID NO: 3113147 - RNA, 18 nt, Mycobacterium bovis subsp bovis AF2122/97
ugccggcgagggccacgg

SEQ ID NO: 3113148 - RNA, 18 nt, Mycobacterium bovis subsp bovis AF2122/97
ugccggcgagggcgcgga

SEQ ID NO: 3113149 - RNA, 17 nt, Mycobacterium bovis subsp bovis AF2122/97
ugccggcgcaccacacc

SEQ ID NO: 3113150 - RNA, 15 nt, Mycobacterium bovis subsp bovis AF2122/97
ugccggcgccacccc

SEQ ID NO: 3113151 - RNA, 14 nt, Mycobacterium bovis subsp bovis AF2122/97
ugccggcgccgcca

SEQ ID NO: 3113152 - RNA, 15 nt, Mycobacterium bovis subsp bovis AF2122/97
ugccggcgccgccag

SEQ ID NO: 3113153 - RNA, 18 nt, Mycobacterium bovis subsp bovis AF2122/97
ugccggcgccgcccuugc

SEQ ID NO: 3113154 - RNA, 19 nt, Mycobacterium bovis subsp bovis AF2122/97
ugccggcgccgcccuugcc

SEQ ID NO: 3113155 - RNA, 15 nt, Mycobacterium bovis subsp bovis AF2122/97
ugccggcgccuuggu

SEQ ID NO: 3113156 - RNA, 23 nt, Mycobacterium bovis subsp bovis AF2122/97
ugccggcgccuuggucgccgccu

SEQ ID NO: 3113157 - RNA, 12 nt, Mycobacterium bovis subsp bovis AF2122/97
ugccggcggaaa

SEQ ID NO: 3113158 - RNA, 19 nt, Mycobacterium bovis subsp bovis AF2122/97
ugccggcggaucugaucgg

SEQ ID NO: 3113159 - RNA, 22 nt, Mycobacterium bovis subsp bovis AF2122/97
ugccggcggaucugaucggcgc

SEQ ID NO: 3113160 - RNA, 16 nt, Mycobacterium bovis subsp bovis AF2122/97
ugccggcggcgacguc

SEQ ID NO: 3113161 - RNA, 18 nt, Mycobacterium bovis subsp bovis AF2122/97
ugccggcggugacggcgg

SEQ ID NO: 3113162 - RNA, 14 nt, Mycobacterium bovis subsp bovis AF2122/97
ugccggcgguggcc

SEQ ID NO: 3113163 - RNA, 17 nt, Mycobacterium bovis subsp bovis AF2122/97
ugccggcgguggccgac

SEQ ID NO: 3113164 - RNA, 22 nt, Mycobacterium bovis subsp bovis AF2122/97
ugccggcguaggcaggaucgcc

SEQ ID NO: 3113165 - RNA, 18 nt, Mycobacterium bovis subsp bovis AF2122/97
ugccggcgugcgcgagau

SEQ ID NO: 3113166 - RNA, 22 nt, Mycobacterium bovis subsp bovis AF2122/97
ugccggcgugcggcgaggacgc

SEQ ID NO: 3113167 - RNA, 20 nt, Mycobacterium bovis subsp bovis AF2122/97
ugccggcguugccgaaaccc

SEQ ID NO: 3113168 - RNA, 17 nt, Mycobacterium bovis subsp bovis AF2122/97
ugccggcguugccgccg

SEQ ID NO: 3113169 - RNA, 14 nt, Mycobacterium bovis subsp bovis AF2122/97
ugccggcuagcucg

SEQ ID NO: 3113170 - RNA, 14 nt, Mycobacterium bovis subsp bovis AF2122/97
ugccggcuucggcg

SEQ ID NO: 3113171 - RNA, 14 nt, Mycobacterium bovis subsp bovis AF2122/97
ugccgggaccggug

SEQ ID NO: 3113172 - RNA, 15 nt, Mycobacterium bovis subsp bovis AF2122/97
ugccgggaucgccgu

SEQ ID NO: 3113173 - RNA, 21 nt, Mycobacterium bovis subsp bovis AF2122/97
ugccgggaucgccguccagca

SEQ ID NO: 3113174 - RNA, 14 nt, Mycobacterium bovis subsp bovis AF2122/97
ugccgggaugccgc

SEQ ID NO: 3113175 - RNA, 18 nt, Mycobacterium bovis subsp bovis AF2122/97
ugccgggcaccaccacac

SEQ ID NO: 3113176 - RNA, 22 nt, Mycobacterium bovis subsp bovis AF2122/97
ugccgggcaccaccacaccgga

SEQ ID NO: 3113177 - RNA, 18 nt, Mycobacterium bovis subsp bovis AF2122/97
ugccgggccgccgagcgg

SEQ ID NO: 3113178 - RNA, 13 nt, Mycobacterium bovis subsp bovis AF2122/97
ugccgggccgcgc

SEQ ID NO: 3113179 - RNA, 14 nt, Mycobacterium bovis subsp bovis AF2122/97
ugccgggccgcgcg

SEQ ID NO: 3113180 - RNA, 23 nt, Mycobacterium bovis subsp bovis AF2122/97
ugccgggccgcgcgggccgccgc

SEQ ID NO: 3113181 - RNA, 15 nt, Mycobacterium bovis subsp bovis AF2122/97
ugccgggcgacgguu

SEQ ID NO: 3113182 - RNA, 20 nt, Mycobacterium bovis subsp bovis AF2122/97
ugccgggcgcuggacggcgg

SEQ ID NO: 3113183 - RNA, 17 nt, Mycobacterium bovis subsp bovis AF2122/97
ugccgggcugaggcggc

SEQ ID NO: 3113184 - RNA, 14 nt, Mycobacterium bovis subsp bovis AF2122/97
ugccggggccccau

SEQ ID NO: 3113185 - RNA, 16 nt, Mycobacterium bovis subsp bovis AF2122/97
ugccggggccccaugc

SEQ ID NO: 3113186 - RNA, 18 nt, Mycobacterium bovis subsp bovis AF2122/97
ugccgggggcccgaccug

SEQ ID NO: 3113187 - RNA, 21 nt, Mycobacterium bovis subsp bovis AF2122/97
ugccgggguggcgcgccaaca

SEQ ID NO: 3113188 - RNA, 15 nt, Mycobacterium bovis subsp bovis AF2122/97
ugccgggucaccgau

SEQ ID NO: 3113189 - RNA, 19 nt, Mycobacterium bovis subsp bovis AF2122/97
ugccgguaucccucaaggu

SEQ ID NO: 3113190 - RNA, 17 nt, Mycobacterium bovis subsp bovis AF2122/97
ugccgguaugcgccauc

SEQ ID NO: 3113191 - RNA, 17 nt, Mycobacterium bovis subsp bovis AF2122/97
ugccggucacgucgauc

SEQ ID NO: 3113192 - RNA, 20 nt, Mycobacterium bovis subsp bovis AF2122/97
ugccggucacgucgaucucc

SEQ ID NO: 3113193 - RNA, 24 nt, Mycobacterium bovis subsp bovis AF2122/97
ugccggucgagugccucgaccugg

SEQ ID NO: 3113194 - RNA, 13 nt, Mycobacterium bovis subsp bovis AF2122/97
ugccggucgaugu

SEQ ID NO: 3113195 - RNA, 15 nt, Mycobacterium bovis subsp bovis AF2122/97
ugccggucggcgucg

SEQ ID NO: 3113196 - RNA, 19 nt, Mycobacterium bovis subsp bovis AF2122/97
ugccggugauggccgacca

SEQ ID NO: 3113197 - RNA, 18 nt, Mycobacterium bovis subsp bovis AF2122/97
ugccggugcaggucgucc

SEQ ID NO: 3113198 - RNA, 14 nt, Mycobacterium bovis subsp bovis AF2122/97
ugccggugccgccg

SEQ ID NO: 3113199 - RNA, 18 nt, Mycobacterium bovis subsp bovis AF2122/97
ugccggugccgccgcggc

SEQ ID NO: 3113200 - RNA, 19 nt, Mycobacterium bovis subsp bovis AF2122/97
ugccggugccgccgcggcc

SEQ ID NO: 3113201 - RNA, 13 nt, Mycobacterium bovis subsp bovis AF2122/97
ugccggugcuccu

SEQ ID NO: 3113202 - RNA, 16 nt, Mycobacterium bovis subsp bovis AF2122/97
ugccggugcuccucgg

SEQ ID NO: 3113203 - RNA, 12 nt, Mycobacterium bovis subsp bovis AF2122/97
ugccggugcuga

SEQ ID NO: 3113204 - RNA, 20 nt, Mycobacterium bovis subsp bovis AF2122/97
ugccgguguaggccucggca

SEQ ID NO: 3113205 - RNA, 21 nt, Mycobacterium bovis subsp bovis AF2122/97
ugccgguguuguaggccgggc

SEQ ID NO: 3113206 - RNA, 23 nt, Mycobacterium bovis subsp bovis AF2122/97
ugccgguucgauggcaucggcca

SEQ ID NO: 3113207 - RNA, 14 nt, Mycobacterium bovis subsp bovis AF2122/97
ugccgguugccacc

SEQ ID NO: 3113208 - RNA, 23 nt, Mycobacterium bovis subsp bovis AF2122/97
ugccgguugccaccugugcgaac

SEQ ID NO: 3113209 - RNA, 16 nt, Mycobacterium bovis subsp bovis AF2122/97
ugccgguugcggcugc

SEQ ID NO: 3113210 - RNA, 14 nt, Mycobacterium bovis subsp bovis AF2122/97
ugccgguuuucggg

SEQ ID NO: 3113211 - RNA, 13 nt, Mycobacterium bovis subsp bovis AF2122/97
ugccguacagccc

SEQ ID NO: 3113212 - RNA, 18 nt, Mycobacterium bovis subsp bovis AF2122/97
ugccguagaagcgcucca

SEQ ID NO: 3113213 - RNA, 23 nt, Mycobacterium bovis subsp bovis AF2122/97
ugccguaguaaggagccgggccg

SEQ ID NO: 3113214 - RNA, 15 nt, Mycobacterium bovis subsp bovis AF2122/97
ugccguauccaggcg

SEQ ID NO: 3113215 - RNA, 19 nt, Mycobacterium bovis subsp bovis AF2122/97
ugccguauggcaucggccu

SEQ ID NO: 3113216 - RNA, 20 nt, Mycobacterium bovis subsp bovis AF2122/97
ugccgucaagauugaacgag

SEQ ID NO: 3113217 - RNA, 16 nt, Mycobacterium bovis subsp bovis AF2122/97
ugccgucagcggcggc

SEQ ID NO: 3113218 - RNA, 17 nt, Mycobacterium bovis subsp bovis AF2122/97
ugccgucagcggcggcc

SEQ ID NO: 3113219 - RNA, 12 nt, Mycobacterium bovis subsp bovis AF2122/97
ugccgucagcug

SEQ ID NO: 3113220 - RNA, 16 nt, Mycobacterium bovis subsp bovis AF2122/97
ugccguccggcgcugg

SEQ ID NO: 3113221 - RNA, 19 nt, Mycobacterium bovis subsp bovis AF2122/97
ugccgucgagcaacgugac

SEQ ID NO: 3113222 - RNA, 18 nt, Mycobacterium bovis subsp bovis AF2122/97
ugccgucgaguccaggcc

SEQ ID NO: 3113223 - RNA, 14 nt, Mycobacterium bovis subsp bovis AF2122/97
ugccgucgccgccc

SEQ ID NO: 3113224 - RNA, 19 nt, Mycobacterium bovis subsp bovis AF2122/97
ugccgucgccgcccuggcc

SEQ ID NO: 3113225 - RNA, 14 nt, Mycobacterium bovis subsp bovis AF2122/97
ugccgucgccggau

SEQ ID NO: 3113226 - RNA, 19 nt, Mycobacterium bovis subsp bovis AF2122/97
ugccgucgccuccagcagg

SEQ ID NO: 3113227 - RNA, 15 nt, Mycobacterium bovis subsp bovis AF2122/97
ugccgucgcugacgc

SEQ ID NO: 3113228 - RNA, 15 nt, Mycobacterium bovis subsp bovis AF2122/97
ugccgucgcugcccc

SEQ ID NO: 3113229 - RNA, 22 nt, Mycobacterium bovis subsp bovis AF2122/97
ugccgucggccucggcggucgc

SEQ ID NO: 3113230 - RNA, 21 nt, Mycobacterium bovis subsp bovis AF2122/97
ugccgucggcguacagcgccu

SEQ ID NO: 3113231 - RNA, 14 nt, Mycobacterium bovis subsp bovis AF2122/97
ugccgucggcgugc

SEQ ID NO: 3113232 - RNA, 17 nt, Mycobacterium bovis subsp bovis AF2122/97
ugccgucggugccgggg

SEQ ID NO: 3113233 - RNA, 21 nt, Mycobacterium bovis subsp bovis AF2122/97
ugccgucggugccggggcugc

SEQ ID NO: 3113234 - RNA, 15 nt, Mycobacterium bovis subsp bovis AF2122/97
ugccgucgucgccgu

SEQ ID NO: 3113235 - RNA, 13 nt, Mycobacterium bovis subsp bovis AF2122/97
ugccgucugcggu

SEQ ID NO: 3113236 - RNA, 21 nt, Mycobacterium bovis subsp bovis AF2122/97
ugccgugccgaaguggagccc

SEQ ID NO: 3113237 - RNA, 15 nt, Mycobacterium bovis subsp bovis AF2122/97
ugccgugccgggcca

SEQ ID NO: 3113238 - RNA, 19 nt, Mycobacterium bovis subsp bovis AF2122/97
ugccgugccggugugucca

SEQ ID NO: 3113239 - RNA, 23 nt, Mycobacterium bovis subsp bovis AF2122/97
ugccgugcugaacuccgccgcga

SEQ ID NO: 3113240 - RNA, 17 nt, Mycobacterium bovis subsp bovis AF2122/97
ugccgugcugggccgac

SEQ ID NO: 3113241 - RNA, 14 nt, Mycobacterium bovis subsp bovis AF2122/97
ugccguggccgcca

SEQ ID NO: 3113242 - RNA, 18 nt, Mycobacterium bovis subsp bovis AF2122/97
ugccgugguggacgaugc

SEQ ID NO: 3113243 - RNA, 16 nt, Mycobacterium bovis subsp bovis AF2122/97
ugccguguccagcaug

SEQ ID NO: 3113244 - RNA, 23 nt, Mycobacterium bovis subsp bovis AF2122/97
ugccgugugcuucgagcaccgac

SEQ ID NO: 3113245 - RNA, 15 nt, Mycobacterium bovis subsp bovis AF2122/97
ugccguuaccgccaa

SEQ ID NO: 3113246 - RNA, 23 nt, Mycobacterium bovis subsp bovis AF2122/97
ugccguucaugccauggauguag

SEQ ID NO: 3113247 - RNA, 19 nt, Mycobacterium bovis subsp bovis AF2122/97
ugccguuccagcaucggug

SEQ ID NO: 3113248 - RNA, 13 nt, Mycobacterium bovis subsp bovis AF2122/97
ugccguuccggcu

SEQ ID NO: 3113249 - RNA, 18 nt, Mycobacterium bovis subsp bovis AF2122/97
ugccguucggggcgcggu

SEQ ID NO: 3113250 - RNA, 21 nt, Mycobacterium bovis subsp bovis AF2122/97
ugccguucggggcgcgguacc

SEQ ID NO: 3113251 - RNA, 18 nt, Mycobacterium bovis subsp bovis AF2122/97
ugccguucucgucgagga

SEQ ID NO: 3113252 - RNA, 14 nt, Mycobacterium bovis subsp bovis AF2122/97
ugccguugccgccg

SEQ ID NO: 3113253 - RNA, 14 nt, Mycobacterium bovis subsp bovis AF2122/97
ugccguugcgaucg

SEQ ID NO: 3113254 - RNA, 14 nt, Mycobacterium bovis subsp bovis AF2122/97
ugccguuggagccg

SEQ ID NO: 3113255 - RNA, 22 nt, Mycobacterium bovis subsp bovis AF2122/97
ugccuacaccggcaagccacgc

SEQ ID NO: 3113256 - RNA, 19 nt, Mycobacterium bovis subsp bovis AF2122/97
ugccuaccgugcuggcacc

SEQ ID NO: 3113257 - RNA, 18 nt, Mycobacterium bovis subsp bovis AF2122/97
ugccuagccgcagccccg

SEQ ID NO: 3113258 - RNA, 13 nt, Mycobacterium bovis subsp bovis AF2122/97
ugccucaccaggu

SEQ ID NO: 3113259 - RNA, 16 nt, Mycobacterium bovis subsp bovis AF2122/97
ugccucaccgccgcua

SEQ ID NO: 3113260 - RNA, 12 nt, Mycobacterium bovis subsp bovis AF2122/97
ugccuccaucaa

SEQ ID NO: 3113261 - RNA, 14 nt, Mycobacterium bovis subsp bovis AF2122/97
ugccucccgcgccg

SEQ ID NO: 3113262 - RNA, 17 nt, Mycobacterium bovis subsp bovis AF2122/97
ugccucgauuguggcca

SEQ ID NO: 3113263 - RNA, 19 nt, Mycobacterium bovis subsp bovis AF2122/97
ugccucgcagccaacgcug

SEQ ID NO: 3113264 - RNA, 20 nt, Mycobacterium bovis subsp bovis AF2122/97
ugccucgcagccaacgcugu

SEQ ID NO: 3113265 - RNA, 21 nt, Mycobacterium bovis subsp bovis AF2122/97
ugccucgcgggaagucccgag

SEQ ID NO: 3113266 - RNA, 14 nt, Mycobacterium bovis subsp bovis AF2122/97
ugccucggcggccu

SEQ ID NO: 3113267 - RNA, 11 nt, Mycobacterium bovis subsp bovis AF2122/97
ugccucgucgc

SEQ ID NO: 3113268 - RNA, 15 nt, Mycobacterium bovis subsp bovis AF2122/97
ugccucucagcacgg

SEQ ID NO: 3113269 - RNA, 18 nt, Mycobacterium bovis subsp bovis AF2122/97
ugccucucuccgcgcucg

SEQ ID NO: 3113270 - RNA, 14 nt, Mycobacterium bovis subsp bovis AF2122/97
ugccugcagcuugg

SEQ ID NO: 3113271 - RNA, 11 nt, Mycobacterium bovis subsp bovis AF2122/97
ugccugccacc

SEQ ID NO: 3113272 - RNA, 16 nt, Mycobacterium bovis subsp bovis AF2122/97
ugccugcgcacgaccc

SEQ ID NO: 3113273 - RNA, 17 nt, Mycobacterium bovis subsp bovis AF2122/97
ugccugcgcgagugcca

SEQ ID NO: 3113274 - RNA, 21 nt, Mycobacterium bovis subsp bovis AF2122/97
ugccugcgcgagugccagucc

SEQ ID NO: 3113275 - RNA, 15 nt, Mycobacterium bovis subsp bovis AF2122/97
ugccugcuagcagca

SEQ ID NO: 3113276 - RNA, 22 nt, Mycobacterium bovis subsp bovis AF2122/97
ugccugcuggucggugaugguc

SEQ ID NO: 3113277 - RNA, 17 nt, Mycobacterium bovis subsp bovis AF2122/97
ugccuggaaucgcggag

SEQ ID NO: 3113278 - RNA, 12 nt, Mycobacterium bovis subsp bovis AF2122/97
ugccuggcccgu

SEQ ID NO: 3113279 - RNA, 14 nt, Mycobacterium bovis subsp bovis AF2122/97
ugccugggcggccg

SEQ ID NO: 3113280 - RNA, 18 nt, Mycobacterium bovis subsp bovis AF2122/97
ugccuggucgcggggccg

SEQ ID NO: 3113281 - RNA, 13 nt, Mycobacterium bovis subsp bovis AF2122/97
ugccuuagcccgg

SEQ ID NO: 3113282 - RNA, 14 nt, Mycobacterium bovis subsp bovis AF2122/97
ugccuuagcccggc

SEQ ID NO: 3113283 - RNA, 19 nt, Mycobacterium bovis subsp bovis AF2122/97
ugccuuaucgagauauugc

SEQ ID NO: 3113284 - RNA, 20 nt, Mycobacterium bovis subsp bovis AF2122/97
ugccuuaucgagauauugcg

SEQ ID NO: 3113285 - RNA, 21 nt, Mycobacterium bovis subsp bovis AF2122/97
ugccuuccucggcaagucgac

SEQ ID NO: 3113286 - RNA, 20 nt, Mycobacterium bovis subsp bovis AF2122/97
ugccuucguagcggccgcag

SEQ ID NO: 3113287 - RNA, 12 nt, Mycobacterium bovis subsp bovis AF2122/97
ugccuucuuugc

SEQ ID NO: 3113288 - RNA, 23 nt, Mycobacterium bovis subsp bovis AF2122/97
ugccuugaccgcggucuucuuca

SEQ ID NO: 3113289 - RNA, 13 nt, Mycobacterium bovis subsp bovis AF2122/97
ugccuugagcaaa

SEQ ID NO: 3113290 - RNA, 17 nt, Mycobacterium bovis subsp bovis AF2122/97
ugccuugaucugagcgc

SEQ ID NO: 3113291 - RNA, 14 nt, Mycobacterium bovis subsp bovis AF2122/97
ugccuuucggcaga

SEQ ID NO: 3113292 - RNA, 21 nt, Mycobacterium bovis subsp bovis AF2122/97
ugccuuugggcuguggccgcg

SEQ ID NO: 3113293 - RNA, 15 nt, Mycobacterium bovis subsp bovis AF2122/97
ugcgaaacaucucgg

SEQ ID NO: 3113294 - RNA, 17 nt, Mycobacterium bovis subsp bovis AF2122/97
ugcgaaacaucucggcg

SEQ ID NO: 3113295 - RNA, 18 nt, Mycobacterium bovis subsp bovis AF2122/97
ugcgaaacgaauccgcca

SEQ ID NO: 3113296 - RNA, 17 nt, Mycobacterium bovis subsp bovis AF2122/97
ugcgaacaaguggccag

SEQ ID NO: 3113297 - RNA, 19 nt, Mycobacterium bovis subsp bovis AF2122/97
ugcgaacagcgaagcaacg

SEQ ID NO: 3113298 - RNA, 16 nt, Mycobacterium bovis subsp bovis AF2122/97
ugcgaaccggccgucg

SEQ ID NO: 3113299 - RNA, 20 nt, Mycobacterium bovis subsp bovis AF2122/97
ugcgaacucaucgugguaac

SEQ ID NO: 3113300 - RNA, 18 nt, Mycobacterium bovis subsp bovis AF2122/97
ugcgaagaguccuuaaac

SEQ ID NO: 3113301 - RNA, 14 nt, Mycobacterium bovis subsp bovis AF2122/97
ugcgaagggcaccg

SEQ ID NO: 3113302 - RNA, 16 nt, Mycobacterium bovis subsp bovis AF2122/97
ugcgaauagccaccaa

SEQ ID NO: 3113303 - RNA, 17 nt, Mycobacterium bovis subsp bovis AF2122/97
ugcgaaucaucuuggug

SEQ ID NO: 3113304 - RNA, 22 nt, Mycobacterium bovis subsp bovis AF2122/97
ugcgaaucggcccgugccacag

SEQ ID NO: 3113305 - RNA, 15 nt, Mycobacterium bovis subsp bovis AF2122/97
ugcgaaucuccgcgc

SEQ ID NO: 3113306 - RNA, 13 nt, Mycobacterium bovis subsp bovis AF2122/97
ugcgacaagaccg

SEQ ID NO: 3113307 - RNA, 18 nt, Mycobacterium bovis subsp bovis AF2122/97
ugcgacaggacgucggcg

SEQ ID NO: 3113308 - RNA, 20 nt, Mycobacterium bovis subsp bovis AF2122/97
ugcgacaggacgucggcgaa

SEQ ID NO: 3113309 - RNA, 13 nt, Mycobacterium bovis subsp bovis AF2122/97
ugcgacaucgguc

SEQ ID NO: 3113310 - RNA, 23 nt, Mycobacterium bovis subsp bovis AF2122/97
ugcgacauuggucaccugcugca

SEQ ID NO: 3113311 - RNA, 18 nt, Mycobacterium bovis subsp bovis AF2122/97
ugcgaccacaucaugcca

SEQ ID NO: 3113312 - RNA, 20 nt, Mycobacterium bovis subsp bovis AF2122/97
ugcgaccacaucaugccagc

SEQ ID NO: 3113313 - RNA, 14 nt, Mycobacterium bovis subsp bovis AF2122/97
ugcgaccaggcgcg

SEQ ID NO: 3113314 - RNA, 19 nt, Mycobacterium bovis subsp bovis AF2122/97
ugcgaccauccgaguuguc

SEQ ID NO: 3113315 - RNA, 21 nt, Mycobacterium bovis subsp bovis AF2122/97
ugcgaccaucuuaacgucggc

SEQ ID NO: 3113316 - RNA, 15 nt, Mycobacterium bovis subsp bovis AF2122/97
ugcgaccccgccgag

SEQ ID NO: 3113317 - RNA, 14 nt, Mycobacterium bovis subsp bovis AF2122/97
ugcgaccccggcug

SEQ ID NO: 3113318 - RNA, 14 nt, Mycobacterium bovis subsp bovis AF2122/97
ugcgacccgcagac

SEQ ID NO: 3113319 - RNA, 22 nt, Mycobacterium bovis subsp bovis AF2122/97
ugcgacccgcagaccgccaccg

SEQ ID NO: 3113320 - RNA, 22 nt, Mycobacterium bovis subsp bovis AF2122/97
ugcgacccgggccgcggcggcc

SEQ ID NO: 3113321 - RNA, 18 nt, Mycobacterium bovis subsp bovis AF2122/97
ugcgaccgccggaccgcc

SEQ ID NO: 3113322 - RNA, 19 nt, Mycobacterium bovis subsp bovis AF2122/97
ugcgaccggcaacgcggcc

SEQ ID NO: 3113323 - RNA, 21 nt, Mycobacterium bovis subsp bovis AF2122/97
ugcgaccgucccggccucgau

SEQ ID NO: 3113324 - RNA, 15 nt, Mycobacterium bovis subsp bovis AF2122/97
ugcgacgaaccggau

SEQ ID NO: 3113325 - RNA, 20 nt, Mycobacterium bovis subsp bovis AF2122/97
ugcgacgaaccggaucaucg

SEQ ID NO: 3113326 - RNA, 21 nt, Mycobacterium bovis subsp bovis AF2122/97
ugcgacgaaccggaucaucgc

SEQ ID NO: 3113327 - RNA, 19 nt, Mycobacterium bovis subsp bovis AF2122/97
ugcgacgacgccaaugccg

SEQ ID NO: 3113328 - RNA, 17 nt, Mycobacterium bovis subsp bovis AF2122/97
ugcgacgacggcgccgu

SEQ ID NO: 3113329 - RNA, 14 nt, Mycobacterium bovis subsp bovis AF2122/97
ugcgacgauaucgg

SEQ ID NO: 3113330 - RNA, 14 nt, Mycobacterium bovis subsp bovis AF2122/97
ugcgacgaugccgc

SEQ ID NO: 3113331 - RNA, 16 nt, Mycobacterium bovis subsp bovis AF2122/97
ugcgacgcgaccgcga

SEQ ID NO: 3113332 - RNA, 22 nt, Mycobacterium bovis subsp bovis AF2122/97
ugcgacgcgaccgcgauggugg

SEQ ID NO: 3113333 - RNA, 18 nt, Mycobacterium bovis subsp bovis AF2122/97
ugcgacggccggcaagca

SEQ ID NO: 3113334 - RNA, 19 nt, Mycobacterium bovis subsp bovis AF2122/97
ugcgacguucuugggaccg

SEQ ID NO: 3113335 - RNA, 22 nt, Mycobacterium bovis subsp bovis AF2122/97
ugcgacuaagggcacuccaccg

SEQ ID NO: 3113336 - RNA, 17 nt, Mycobacterium bovis subsp bovis AF2122/97
ugcgacucugcgucugc

SEQ ID NO: 3113337 - RNA, 18 nt, Mycobacterium bovis subsp bovis AF2122/97
ugcgacucugcgucugcu

SEQ ID NO: 3113338 - RNA, 15 nt, Mycobacterium bovis subsp bovis AF2122/97
ugcgagaacgucgag

SEQ ID NO: 3113339 - RNA, 13 nt, Mycobacterium bovis subsp bovis AF2122/97
ugcgagagcaccg

SEQ ID NO: 3113340 - RNA, 19 nt, Mycobacterium bovis subsp bovis AF2122/97
ugcgagcacccguugaucg

SEQ ID NO: 3113341 - RNA, 16 nt, Mycobacterium bovis subsp bovis AF2122/97
ugcgagcgcagcgcau

SEQ ID NO: 3113342 - RNA, 19 nt, Mycobacterium bovis subsp bovis AF2122/97
ugcgagcgccggcuucggg

SEQ ID NO: 3113343 - RNA, 13 nt, Mycobacterium bovis subsp bovis AF2122/97
ugcgagcugcggg

SEQ ID NO: 3113344 - RNA, 14 nt, Mycobacterium bovis subsp bovis AF2122/97
ugcgaggaugcgca

SEQ ID NO: 3113345 - RNA, 22 nt, Mycobacterium bovis subsp bovis AF2122/97
ugcgaggaugcgcaacaccuca

SEQ ID NO: 3113346 - RNA, 13 nt, Mycobacterium bovis subsp bovis AF2122/97
ugcgaggccgcac

SEQ ID NO: 3113347 - RNA, 16 nt, Mycobacterium bovis subsp bovis AF2122/97
ugcgaggccgcacguc

SEQ ID NO: 3113348 - RNA, 20 nt, Mycobacterium bovis subsp bovis AF2122/97
ugcgaggccgcacgucgacc

SEQ ID NO: 3113349 - RNA, 18 nt, Mycobacterium bovis subsp bovis AF2122/97
ugcgagggcacgcgcaca

SEQ ID NO: 3113350 - RNA, 15 nt, Mycobacterium bovis subsp bovis AF2122/97
ugcgaggugccgggg

SEQ ID NO: 3113351 - RNA, 17 nt, Mycobacterium bovis subsp bovis AF2122/97
ugcgagguucagccuga

SEQ ID NO: 3113352 - RNA, 21 nt, Mycobacterium bovis subsp bovis AF2122/97
ugcgagguucagccugagcac

SEQ ID NO: 3113353 - RNA, 17 nt, Mycobacterium bovis subsp bovis AF2122/97
ugcgagucgucccaguc

SEQ ID NO: 3113354 - RNA, 16 nt, Mycobacterium bovis subsp bovis AF2122/97
ugcgagucgucgccaa

SEQ ID NO: 3113355 - RNA, 19 nt, Mycobacterium bovis subsp bovis AF2122/97
ugcgagugcggcacgaucg

SEQ ID NO: 3113356 - RNA, 16 nt, Mycobacterium bovis subsp bovis AF2122/97
ugcgaucaacccuacc

SEQ ID NO: 3113357 - RNA, 13 nt, Mycobacterium bovis subsp bovis AF2122/97
ugcgaucaguucg

SEQ ID NO: 3113358 - RNA, 15 nt, Mycobacterium bovis subsp bovis AF2122/97
ugcgauccagggccg

SEQ ID NO: 3113359 - RNA, 14 nt, Mycobacterium bovis subsp bovis AF2122/97
ugcgaucccacccu

SEQ ID NO: 3113360 - RNA, 15 nt, Mycobacterium bovis subsp bovis AF2122/97
ugcgaucccacccuc

SEQ ID NO: 3113361 - RNA, 22 nt, Mycobacterium bovis subsp bovis AF2122/97
ugcgaucccacccucgggucca

SEQ ID NO: 3113362 - RNA, 12 nt, Mycobacterium bovis subsp bovis AF2122/97
ugcgaucccgau

SEQ ID NO: 3113363 - RNA, 17 nt, Mycobacterium bovis subsp bovis AF2122/97
ugcgauccugaccagcc

SEQ ID NO: 3113364 - RNA, 13 nt, Mycobacterium bovis subsp bovis AF2122/97
ugcgaucgccgcu

SEQ ID NO: 3113365 - RNA, 15 nt, Mycobacterium bovis subsp bovis AF2122/97
ugcgaucgccgcuaa

SEQ ID NO: 3113366 - RNA, 12 nt, Mycobacterium bovis subsp bovis AF2122/97
ugcgaucggcac

SEQ ID NO: 3113367 - RNA, 22 nt, Mycobacterium bovis subsp bovis AF2122/97
ugcgaucggcacuagcgagccg

SEQ ID NO: 3113368 - RNA, 22 nt, Mycobacterium bovis subsp bovis AF2122/97
ugcgaucgucaacgacgacgac

SEQ ID NO: 3113369 - RNA, 18 nt, Mycobacterium bovis subsp bovis AF2122/97
ugcgaugauuucgucgau

SEQ ID NO: 3113370 - RNA, 20 nt, Mycobacterium bovis subsp bovis AF2122/97
ugcgaugcacaaccgcugcu

SEQ ID NO: 3113371 - RNA, 16 nt, Mycobacterium bovis subsp bovis AF2122/97
ugcgaugcgcgccgau

SEQ ID NO: 3113372 - RNA, 17 nt, Mycobacterium bovis subsp bovis AF2122/97
ugcgaugcugaucaccg

SEQ ID NO: 3113373 - RNA, 14 nt, Mycobacterium bovis subsp bovis AF2122/97
ugcgauggcccggg

SEQ ID NO: 3113374 - RNA, 12 nt, Mycobacterium bovis subsp bovis AF2122/97
ugcgauggccga

SEQ ID NO: 3113375 - RNA, 22 nt, Mycobacterium bovis subsp bovis AF2122/97
ugcgauucacacucgggcggcu

SEQ ID NO: 3113376 - RNA, 17 nt, Mycobacterium bovis subsp bovis AF2122/97
ugcgauuccgcgucugc

SEQ ID NO: 3113377 - RNA, 19 nt, Mycobacterium bovis subsp bovis AF2122/97
ugcgauuccgcgucugcuc

SEQ ID NO: 3113378 - RNA, 16 nt, Mycobacterium bovis subsp bovis AF2122/97
ugcgauucugcgucug

SEQ ID NO: 3113379 - RNA, 17 nt, Mycobacterium bovis subsp bovis AF2122/97
ugcgauucugcgucugc

SEQ ID NO: 3113380 - RNA, 20 nt, Mycobacterium bovis subsp bovis AF2122/97
ugcgauucugcgucugcucg

SEQ ID NO: 3113381 - RNA, 19 nt, Mycobacterium bovis subsp bovis AF2122/97
ugcgauucugugucugcuc

SEQ ID NO: 3113382 - RNA, 20 nt, Mycobacterium bovis subsp bovis AF2122/97
ugcgauucugugucugcucg

SEQ ID NO: 3113383 - RNA, 16 nt, Mycobacterium bovis subsp bovis AF2122/97
ugcgauugcgcacacc

SEQ ID NO: 3113384 - RNA, 19 nt, Mycobacterium bovis subsp bovis AF2122/97
ugcgauuuugugucugcuc

SEQ ID NO: 3113385 - RNA, 21 nt, Mycobacterium bovis subsp bovis AF2122/97
ugcgauuuugugucugcucgc

SEQ ID NO: 3113386 - RNA, 17 nt, Mycobacterium bovis subsp bovis AF2122/97
ugcgcaaauaggacugc

SEQ ID NO: 3113387 - RNA, 19 nt, Mycobacterium bovis subsp bovis AF2122/97
ugcgcaaauaggacugcgc

SEQ ID NO: 3113388 - RNA, 21 nt, Mycobacterium bovis subsp bovis AF2122/97
ugcgcaacaccgugcaccagc

SEQ ID NO: 3113389 - RNA, 22 nt, Mycobacterium bovis subsp bovis AF2122/97
ugcgcaacaccgugcaccagcu

SEQ ID NO: 3113390 - RNA, 18 nt, Mycobacterium bovis subsp bovis AF2122/97
ugcgcaacaccucaccgc

SEQ ID NO: 3113391 - RNA, 14 nt, Mycobacterium bovis subsp bovis AF2122/97
ugcgcaacccagcc

SEQ ID NO: 3113392 - RNA, 17 nt, Mycobacterium bovis subsp bovis AF2122/97
ugcgcaacccagccgcg

SEQ ID NO: 3113393 - RNA, 20 nt, Mycobacterium bovis subsp bovis AF2122/97
ugcgcaacccagccgcgcca

SEQ ID NO: 3113394 - RNA, 22 nt, Mycobacterium bovis subsp bovis AF2122/97
ugcgcaacccagccgcgccagc

SEQ ID NO: 3113395 - RNA, 13 nt, Mycobacterium bovis subsp bovis AF2122/97
ugcgcaaccgcgg

SEQ ID NO: 3113396 - RNA, 18 nt, Mycobacterium bovis subsp bovis AF2122/97
ugcgcaaccgcggccccg

SEQ ID NO: 3113397 - RNA, 16 nt, Mycobacterium bovis subsp bovis AF2122/97
ugcgcaacgcgucguc

SEQ ID NO: 3113398 - RNA, 20 nt, Mycobacterium bovis subsp bovis AF2122/97
ugcgcaacuucuucagcagc

SEQ ID NO: 3113399 - RNA, 21 nt, Mycobacterium bovis subsp bovis AF2122/97
ugcgcaacuucuucagcagcg

SEQ ID NO: 3113400 - RNA, 19 nt, Mycobacterium bovis subsp bovis AF2122/97
ugcgcaaggccgcguugcc

SEQ ID NO: 3113401 - RNA, 19 nt, Mycobacterium bovis subsp bovis AF2122/97
ugcgcaauagcgacagcag

SEQ ID NO: 3113402 - RNA, 19 nt, Mycobacterium bovis subsp bovis AF2122/97
ugcgcaaugccgacgccaa

SEQ ID NO: 3113403 - RNA, 14 nt, Mycobacterium bovis subsp bovis AF2122/97
ugcgcaccaaggcc

SEQ ID NO: 3113404 - RNA, 12 nt, Mycobacterium bovis subsp bovis AF2122/97
ugcgcaccaccg

SEQ ID NO: 3113405 - RNA, 15 nt, Mycobacterium bovis subsp bovis AF2122/97
ugcgcaccagcaccu

SEQ ID NO: 3113406 - RNA, 20 nt, Mycobacterium bovis subsp bovis AF2122/97
ugcgcaccagcggcugaccg

SEQ ID NO: 3113407 - RNA, 19 nt, Mycobacterium bovis subsp bovis AF2122/97
ugcgcaccaguccagcggg

SEQ ID NO: 3113408 - RNA, 14 nt, Mycobacterium bovis subsp bovis AF2122/97
ugcgcaccgccgcg

SEQ ID NO: 3113409 - RNA, 19 nt, Mycobacterium bovis subsp bovis AF2122/97
ugcgcaccggucaacgugg

SEQ ID NO: 3113410 - RNA, 19 nt, Mycobacterium bovis subsp bovis AF2122/97
ugcgcaccugggucgacga

SEQ ID NO: 3113411 - RNA, 21 nt, Mycobacterium bovis subsp bovis AF2122/97
ugcgcaccugggucgacgaga

SEQ ID NO: 3113412 - RNA, 20 nt, Mycobacterium bovis subsp bovis AF2122/97
ugcgcacgaccccucuuguc

SEQ ID NO: 3113413 - RNA, 23 nt, Mycobacterium bovis subsp bovis AF2122/97
ugcgcacgucgggcccgaugucg

SEQ ID NO: 3113414 - RNA, 21 nt, Mycobacterium bovis subsp bovis AF2122/97
ugcgcacucccggcucggcca

SEQ ID NO: 3113415 - RNA, 17 nt, Mycobacterium bovis subsp bovis AF2122/97
ugcgcacucuagccggg

SEQ ID NO: 3113416 - RNA, 22 nt, Mycobacterium bovis subsp bovis AF2122/97
ugcgcacugaggcucaggugcu

SEQ ID NO: 3113417 - RNA, 17 nt, Mycobacterium bovis subsp bovis AF2122/97
ugcgcagaacaccaccg

SEQ ID NO: 3113418 - RNA, 18 nt, Mycobacterium bovis subsp bovis AF2122/97
ugcgcagaacaccaccgc

SEQ ID NO: 3113419 - RNA, 20 nt, Mycobacterium bovis subsp bovis AF2122/97
ugcgcagaacaccaccgcca

SEQ ID NO: 3113420 - RNA, 16 nt, Mycobacterium bovis subsp bovis AF2122/97
ugcgcagauuugcucc

SEQ ID NO: 3113421 - RNA, 20 nt, Mycobacterium bovis subsp bovis AF2122/97
ugcgcagauuugcuccagcg

SEQ ID NO: 3113422 - RNA, 15 nt, Mycobacterium bovis subsp bovis AF2122/97
ugcgcagccaggugu

SEQ ID NO: 3113423 - RNA, 22 nt, Mycobacterium bovis subsp bovis AF2122/97
ugcgcagccaggugucgucgau

SEQ ID NO: 3113424 - RNA, 16 nt, Mycobacterium bovis subsp bovis AF2122/97
ugcgcagccgcagccg

SEQ ID NO: 3113425 - RNA, 12 nt, Mycobacterium bovis subsp bovis AF2122/97
ugcgcagcgcaa

SEQ ID NO: 3113426 - RNA, 20 nt, Mycobacterium bovis subsp bovis AF2122/97
ugcgcagcugcgggucgugc

SEQ ID NO: 3113427 - RNA, 15 nt, Mycobacterium bovis subsp bovis AF2122/97
ugcgcagggccugga

SEQ ID NO: 3113428 - RNA, 17 nt, Mycobacterium bovis subsp bovis AF2122/97
ugcgcagguacgccucg

SEQ ID NO: 3113429 - RNA, 17 nt, Mycobacterium bovis subsp bovis AF2122/97
ugcgcagugcaccgcgu

SEQ ID NO: 3113430 - RNA, 15 nt, Mycobacterium bovis subsp bovis AF2122/97
ugcgcaucgccacca

SEQ ID NO: 3113431 - RNA, 13 nt, Mycobacterium bovis subsp bovis AF2122/97
ugcgcaucgccga

SEQ ID NO: 3113432 - RNA, 14 nt, Mycobacterium bovis subsp bovis AF2122/97
ugcgcaucgccgac

SEQ ID NO: 3113433 - RNA, 21 nt, Mycobacterium bovis subsp bovis AF2122/97
ugcgcaucgguccaaagcacg

SEQ ID NO: 3113434 - RNA, 21 nt, Mycobacterium bovis subsp bovis AF2122/97
ugcgcauggacaacagcuugg

SEQ ID NO: 3113435 - RNA, 13 nt, Mycobacterium bovis subsp bovis AF2122/97
ugcgccacacccg

SEQ ID NO: 3113436 - RNA, 15 nt, Mycobacterium bovis subsp bovis AF2122/97
ugcgccacagcagcg

SEQ ID NO: 3113437 - RNA, 18 nt, Mycobacterium bovis subsp bovis AF2122/97
ugcgccacgccacuucuu

SEQ ID NO: 3113438 - RNA, 13 nt, Mycobacterium bovis subsp bovis AF2122/97
ugcgccacgucga

SEQ ID NO: 3113439 - RNA, 16 nt, Mycobacterium bovis subsp bovis AF2122/97
ugcgccacgucgacgg

SEQ ID NO: 3113440 - RNA, 15 nt, Mycobacterium bovis subsp bovis AF2122/97
ugcgccagaucaccg

SEQ ID NO: 3113441 - RNA, 20 nt, Mycobacterium bovis subsp bovis AF2122/97
ugcgccagaucaccgucgac

SEQ ID NO: 3113442 - RNA, 12 nt, Mycobacterium bovis subsp bovis AF2122/97
ugcgccagcgag

SEQ ID NO: 3113443 - RNA, 20 nt, Mycobacterium bovis subsp bovis AF2122/97
ugcgccagcgguggaccacc

SEQ ID NO: 3113444 - RNA, 18 nt, Mycobacterium bovis subsp bovis AF2122/97
ugcgccaguaggcuucga

SEQ ID NO: 3113445 - RNA, 23 nt, Mycobacterium bovis subsp bovis AF2122/97
ugcgccaguaggcuucgaccgug

SEQ ID NO: 3113446 - RNA, 19 nt, Mycobacterium bovis subsp bovis AF2122/97
ugcgccauaauauugccgc

SEQ ID NO: 3113447 - RNA, 22 nt, Mycobacterium bovis subsp bovis AF2122/97
ugcgccaucucgacggugaccg

SEQ ID NO: 3113448 - RNA, 17 nt, Mycobacterium bovis subsp bovis AF2122/97
ugcgccauugcgggaac

SEQ ID NO: 3113449 - RNA, 12 nt, Mycobacterium bovis subsp bovis AF2122/97
ugcgcccacccg

SEQ ID NO: 3113450 - RNA, 11 nt, Mycobacterium bovis subsp bovis AF2122/97
ugcgcccagca

SEQ ID NO: 3113451 - RNA, 13 nt, Mycobacterium bovis subsp bovis AF2122/97
ugcgcccagcacg

SEQ ID NO: 3113452 - RNA, 20 nt, Mycobacterium bovis subsp bovis AF2122/97
ugcgcccagcgacccggcca

SEQ ID NO: 3113453 - RNA, 22 nt, Mycobacterium bovis subsp bovis AF2122/97
ugcgcccagcgacccggccagc

SEQ ID NO: 3113454 - RNA, 16 nt, Mycobacterium bovis subsp bovis AF2122/97
ugcgcccaggugaucg

SEQ ID NO: 3113455 - RNA, 21 nt, Mycobacterium bovis subsp bovis AF2122/97
ugcgcccauagcugccggccc

SEQ ID NO: 3113456 - RNA, 23 nt, Mycobacterium bovis subsp bovis AF2122/97
ugcgcccgacggaguucgacguc

SEQ ID NO: 3113457 - RNA, 17 nt, Mycobacterium bovis subsp bovis AF2122/97
ugcgcccugagcagaug

SEQ ID NO: 3113458 - RNA, 20 nt, Mycobacterium bovis subsp bovis AF2122/97
ugcgccgaacgcuccaggcc

SEQ ID NO: 3113459 - RNA, 21 nt, Mycobacterium bovis subsp bovis AF2122/97
ugcgccgaaugccaccucgac

SEQ ID NO: 3113460 - RNA, 19 nt, Mycobacterium bovis subsp bovis AF2122/97
ugcgccgacccgcgcgccg

SEQ ID NO: 3113461 - RNA, 23 nt, Mycobacterium bovis subsp bovis AF2122/97
ugcgccgaccggccacgaccucg

SEQ ID NO: 3113462 - RNA, 22 nt, Mycobacterium bovis subsp bovis AF2122/97
ugcgccgagauccacgccagag

SEQ ID NO: 3113463 - RNA, 16 nt, Mycobacterium bovis subsp bovis AF2122/97
ugcgccgaggcauugc

SEQ ID NO: 3113464 - RNA, 17 nt, Mycobacterium bovis subsp bovis AF2122/97
ugcgccgaucccgccca

SEQ ID NO: 3113465 - RNA, 15 nt, Mycobacterium bovis subsp bovis AF2122/97
ugcgccgcacgccga

SEQ ID NO: 3113466 - RNA, 19 nt, Mycobacterium bovis subsp bovis AF2122/97
ugcgccgcacgccgaccgg

SEQ ID NO: 3113467 - RNA, 23 nt, Mycobacterium bovis subsp bovis AF2122/97
ugcgccgcacgccgaccggcccg

SEQ ID NO: 3113468 - RNA, 13 nt, Mycobacterium bovis subsp bovis AF2122/97
ugcgccgcagcga

SEQ ID NO: 3113469 - RNA, 14 nt, Mycobacterium bovis subsp bovis AF2122/97
ugcgccgcagcgau

SEQ ID NO: 3113470 - RNA, 12 nt, Mycobacterium bovis subsp bovis AF2122/97
ugcgccgcaugc

SEQ ID NO: 3113471 - RNA, 13 nt, Mycobacterium bovis subsp bovis AF2122/97
ugcgccgccaacu

SEQ ID NO: 3113472 - RNA, 14 nt, Mycobacterium bovis subsp bovis AF2122/97
ugcgccgccagcgc

SEQ ID NO: 3113473 - RNA, 19 nt, Mycobacterium bovis subsp bovis AF2122/97
ugcgccgccagcgccgccg

SEQ ID NO: 3113474 - RNA, 19 nt, Mycobacterium bovis subsp bovis AF2122/97
ugcgccgcccaugccucca

SEQ ID NO: 3113475 - RNA, 16 nt, Mycobacterium bovis subsp bovis AF2122/97
ugcgccgcccgcgcca

SEQ ID NO: 3113476 - RNA, 18 nt, Mycobacterium bovis subsp bovis AF2122/97
ugcgccgccggcggcggu

SEQ ID NO: 3113477 - RNA, 16 nt, Mycobacterium bovis subsp bovis AF2122/97
ugcgccgcgcgcggcg

SEQ ID NO: 3113478 - RNA, 14 nt, Mycobacterium bovis subsp bovis AF2122/97
ugcgccggaccagc

SEQ ID NO: 3113479 - RNA, 15 nt, Mycobacterium bovis subsp bovis AF2122/97
ugcgccggaccagcu

SEQ ID NO: 3113480 - RNA, 16 nt, Mycobacterium bovis subsp bovis AF2122/97
ugcgccggaugacacc

SEQ ID NO: 3113481 - RNA, 18 nt, Mycobacterium bovis subsp bovis AF2122/97
ugcgccggaugacaccga

SEQ ID NO: 3113482 - RNA, 22 nt, Mycobacterium bovis subsp bovis AF2122/97
ugcgccggcguuugggcaucau

SEQ ID NO: 3113483 - RNA, 15 nt, Mycobacterium bovis subsp bovis AF2122/97
ugcgccggcuggcgg

SEQ ID NO: 3113484 - RNA, 12 nt, Mycobacterium bovis subsp bovis AF2122/97
ugcgccgggcgu

SEQ ID NO: 3113485 - RNA, 20 nt, Mycobacterium bovis subsp bovis AF2122/97
ugcgccgggcguccgccggc

SEQ ID NO: 3113486 - RNA, 21 nt, Mycobacterium bovis subsp bovis AF2122/97
ugcgccgggugaggcggugac

SEQ ID NO: 3113487 - RNA, 21 nt, Mycobacterium bovis subsp bovis AF2122/97
ugcgccgguaacuguccgccc

SEQ ID NO: 3113488 - RNA, 15 nt, Mycobacterium bovis subsp bovis AF2122/97
ugcgccgguccucgu

SEQ ID NO: 3113489 - RNA, 19 nt, Mycobacterium bovis subsp bovis AF2122/97
ugcgccggugaggugaugc

SEQ ID NO: 3113490 - RNA, 11 nt, Mycobacterium bovis subsp bovis AF2122/97
ugcgccgucag

SEQ ID NO: 3113491 - RNA, 21 nt, Mycobacterium bovis subsp bovis AF2122/97
ugcgccguggcaucgccucca

SEQ ID NO: 3113492 - RNA, 20 nt, Mycobacterium bovis subsp bovis AF2122/97
ugcgccguucgcucccccgc

SEQ ID NO: 3113493 - RNA, 15 nt, Mycobacterium bovis subsp bovis AF2122/97
ugcgccguugccgcc

SEQ ID NO: 3113494 - RNA, 17 nt, Mycobacterium bovis subsp bovis AF2122/97
ugcgccguugccgccgu

SEQ ID NO: 3113495 - RNA, 18 nt, Mycobacterium bovis subsp bovis AF2122/97
ugcgccucggcggccagc

SEQ ID NO: 3113496 - RNA, 17 nt, Mycobacterium bovis subsp bovis AF2122/97
ugcgccucuuccuggcg

SEQ ID NO: 3113497 - RNA, 16 nt, Mycobacterium bovis subsp bovis AF2122/97
ugcgcgaagccaccag

SEQ ID NO: 3113498 - RNA, 16 nt, Mycobacterium bovis subsp bovis AF2122/97
ugcgcgaccacccgcc

SEQ ID NO: 3113499 - RNA, 19 nt, Mycobacterium bovis subsp bovis AF2122/97
ugcgcgacugauccucgau

SEQ ID NO: 3113500 - RNA, 15 nt, Mycobacterium bovis subsp bovis AF2122/97
ugcgcgaggggccgg

SEQ ID NO: 3113501 - RNA, 17 nt, Mycobacterium bovis subsp bovis AF2122/97
ugcgcgaguaagcgaac

SEQ ID NO: 3113502 - RNA, 18 nt, Mycobacterium bovis subsp bovis AF2122/97
ugcgcgagugccaguccg

SEQ ID NO: 3113503 - RNA, 16 nt, Mycobacterium bovis subsp bovis AF2122/97
ugcgcgauaggugcuc

SEQ ID NO: 3113504 - RNA, 22 nt, Mycobacterium bovis subsp bovis AF2122/97
ugcgcgaugcgauucugcgucu

SEQ ID NO: 3113505 - RNA, 19 nt, Mycobacterium bovis subsp bovis AF2122/97
ugcgcgcaggugcugggcg

SEQ ID NO: 3113506 - RNA, 13 nt, Mycobacterium bovis subsp bovis AF2122/97
ugcgcgccagaca

SEQ ID NO: 3113507 - RNA, 14 nt, Mycobacterium bovis subsp bovis AF2122/97
ugcgcgccagacac

SEQ ID NO: 3113508 - RNA, 13 nt, Mycobacterium bovis subsp bovis AF2122/97
ugcgcgccaggcu

SEQ ID NO: 3113509 - RNA, 14 nt, Mycobacterium bovis subsp bovis AF2122/97
ugcgcgccaggcuc

SEQ ID NO: 3113510 - RNA, 23 nt, Mycobacterium bovis subsp bovis AF2122/97
ugcgcgccauuggcgccgccgau

SEQ ID NO: 3113511 - RNA, 22 nt, Mycobacterium bovis subsp bovis AF2122/97
ugcgcgcccaccgggcggcggc

SEQ ID NO: 3113512 - RNA, 15 nt, Mycobacterium bovis subsp bovis AF2122/97
ugcgcgcccgggcgg

SEQ ID NO: 3113513 - RNA, 21 nt, Mycobacterium bovis subsp bovis AF2122/97
ugcgcgccgauaugcgugagc

SEQ ID NO: 3113514 - RNA, 19 nt, Mycobacterium bovis subsp bovis AF2122/97
ugcgcgccugcgccacccg

SEQ ID NO: 3113515 - RNA, 20 nt, Mycobacterium bovis subsp bovis AF2122/97
ugcgcgccugcgccacccgc

SEQ ID NO: 3113516 - RNA, 13 nt, Mycobacterium bovis subsp bovis AF2122/97
ugcgcgcgccggu

SEQ ID NO: 3113517 - RNA, 14 nt, Mycobacterium bovis subsp bovis AF2122/97
ugcgcgcggccgcg

SEQ ID NO: 3113518 - RNA, 15 nt, Mycobacterium bovis subsp bovis AF2122/97
ugcgcgcggcgcgau

SEQ ID NO: 3113519 - RNA, 20 nt, Mycobacterium bovis subsp bovis AF2122/97
ugcgcgcucggccagcauca

SEQ ID NO: 3113520 - RNA, 19 nt, Mycobacterium bovis subsp bovis AF2122/97
ugcgcggaguacuccagcc

SEQ ID NO: 3113521 - RNA, 20 nt, Mycobacterium bovis subsp bovis AF2122/97
ugcgcggaguacuccagccg

SEQ ID NO: 3113522 - RNA, 13 nt, Mycobacterium bovis subsp bovis AF2122/97
ugcgcggcauccc

SEQ ID NO: 3113523 - RNA, 15 nt, Mycobacterium bovis subsp bovis AF2122/97
ugcgcggcaucccgc

SEQ ID NO: 3113524 - RNA, 22 nt, Mycobacterium bovis subsp bovis AF2122/97
ugcgcggccaccucaucgccau

SEQ ID NO: 3113525 - RNA, 15 nt, Mycobacterium bovis subsp bovis AF2122/97
ugcgcggccauggca

SEQ ID NO: 3113526 - RNA, 21 nt, Mycobacterium bovis subsp bovis AF2122/97
ugcgcggccauggcagcgcgc

SEQ ID NO: 3113527 - RNA, 19 nt, Mycobacterium bovis subsp bovis AF2122/97
ugcgcggccggcacgaccg

SEQ ID NO: 3113528 - RNA, 17 nt, Mycobacterium bovis subsp bovis AF2122/97
ugcgcggcgucgucgau

SEQ ID NO: 3113529 - RNA, 19 nt, Mycobacterium bovis subsp bovis AF2122/97
ugcgcggcgucgucgauga

SEQ ID NO: 3113530 - RNA, 17 nt, Mycobacterium bovis subsp bovis AF2122/97
ugcgcggcgugcgcggu

SEQ ID NO: 3113531 - RNA, 16 nt, Mycobacterium bovis subsp bovis AF2122/97
ugcgcggcuugucgcg

SEQ ID NO: 3113532 - RNA, 19 nt, Mycobacterium bovis subsp bovis AF2122/97
ugcgcgggcaucgucgucg

SEQ ID NO: 3113533 - RNA, 18 nt, Mycobacterium bovis subsp bovis AF2122/97
ugcgcgggugguucaccu

SEQ ID NO: 3113534 - RNA, 17 nt, Mycobacterium bovis subsp bovis AF2122/97
ugcgcgguagcucgucg

SEQ ID NO: 3113535 - RNA, 16 nt, Mycobacterium bovis subsp bovis AF2122/97
ugcgcggucgcgcgau

SEQ ID NO: 3113536 - RNA, 22 nt, Mycobacterium bovis subsp bovis AF2122/97
ugcgcggugacgagccaccacc

SEQ ID NO: 3113537 - RNA, 19 nt, Mycobacterium bovis subsp bovis AF2122/97
ugcgcggugaugguuaccg

SEQ ID NO: 3113538 - RNA, 16 nt, Mycobacterium bovis subsp bovis AF2122/97
ugcgcggugccggccg

SEQ ID NO: 3113539 - RNA, 20 nt, Mycobacterium bovis subsp bovis AF2122/97
ugcgcgguugugacggugaa

SEQ ID NO: 3113540 - RNA, 15 nt, Mycobacterium bovis subsp bovis AF2122/97
ugcgcgucagccgca

SEQ ID NO: 3113541 - RNA, 16 nt, Mycobacterium bovis subsp bovis AF2122/97
ugcgcgucaggccagc

SEQ ID NO: 3113542 - RNA, 17 nt, Mycobacterium bovis subsp bovis AF2122/97
ugcgcgucaggccagcg

SEQ ID NO: 3113543 - RNA, 23 nt, Mycobacterium bovis subsp bovis AF2122/97
ugcgcgucaggccagcgcucacc

SEQ ID NO: 3113544 - RNA, 20 nt, Mycobacterium bovis subsp bovis AF2122/97
ugcgcguccccagcgccacc

SEQ ID NO: 3113545 - RNA, 19 nt, Mycobacterium bovis subsp bovis AF2122/97
ugcgcgucgagcagcacca

SEQ ID NO: 3113546 - RNA, 17 nt, Mycobacterium bovis subsp bovis AF2122/97
ugcgcgucgagcgaccc

SEQ ID NO: 3113547 - RNA, 15 nt, Mycobacterium bovis subsp bovis AF2122/97
ugcgcgucgcgcgcg

SEQ ID NO: 3113548 - RNA, 19 nt, Mycobacterium bovis subsp bovis AF2122/97
aacuacggcguccccgaca

SEQ ID NO: 3113549 - RNA, 22 nt, Mycobacterium bovis subsp bovis AF2122/97
aacuacucauccagaagccggc

SEQ ID NO: 3113550 - RNA, 16 nt, Mycobacterium bovis subsp bovis AF2122/97
aacuagguucagcgac

SEQ ID NO: 3113551 - RNA, 20 nt, Mycobacterium bovis subsp bovis AF2122/97
aacuaucgcaccuccggcgu

SEQ ID NO: 3113552 - RNA, 16 nt, Mycobacterium bovis subsp bovis AF2122/97
aacucaacgacaccau

SEQ ID NO: 3113553 - RNA, 16 nt, Mycobacterium bovis subsp bovis AF2122/97
aacucaccagcacccc

SEQ ID NO: 3113554 - RNA, 22 nt, Mycobacterium bovis subsp bovis AF2122/97
aacucacccgagccaucaccgc

SEQ ID NO: 3113555 - RNA, 21 nt, Mycobacterium bovis subsp bovis AF2122/97
aacucacgcaggaaaaccccg

SEQ ID NO: 3113556 - RNA, 16 nt, Mycobacterium bovis subsp bovis AF2122/97
aacucaugggccaacu

SEQ ID NO: 3113557 - RNA, 19 nt, Mycobacterium bovis subsp bovis AF2122/97
aacuccagcacccgcugca

SEQ ID NO: 3113558 - RNA, 19 nt, Mycobacterium bovis subsp bovis AF2122/97
aacucccagaacgccgucc

SEQ ID NO: 3113559 - RNA, 13 nt, Mycobacterium bovis subsp bovis AF2122/97
aacuccgcggcgc

SEQ ID NO: 3113560 - RNA, 16 nt, Mycobacterium bovis subsp bovis AF2122/97
aacuccugcagcccgg

SEQ ID NO: 3113561 - RNA, 18 nt, Mycobacterium bovis subsp bovis AF2122/97
aacuccuuaucgucgacg

SEQ ID NO: 3113562 - RNA, 22 nt, Mycobacterium bovis subsp bovis AF2122/97
aacucgaacugggucggcacgg

SEQ ID NO: 3113563 - RNA, 21 nt, Mycobacterium bovis subsp bovis AF2122/97
aacucgaagaccucgucgcgu

SEQ ID NO: 3113564 - RNA, 22 nt, Mycobacterium bovis subsp bovis AF2122/97
aacucgaagcgguguugccgga

SEQ ID NO: 3113565 - RNA, 20 nt, Mycobacterium bovis subsp bovis AF2122/97
aacucgagaguggccucguc

SEQ ID NO: 3113566 - RNA, 12 nt, Mycobacterium bovis subsp bovis AF2122/97
aacucgccgaaa

SEQ ID NO: 3113567 - RNA, 20 nt, Mycobacterium bovis subsp bovis AF2122/97
aacucgccgaaaucggccag

SEQ ID NO: 3113568 - RNA, 22 nt, Mycobacterium bovis subsp bovis AF2122/97
aacucgccgcuggcaaucccgc

SEQ ID NO: 3113569 - RNA, 15 nt, Mycobacterium bovis subsp bovis AF2122/97
aacucgcgcgucguc

SEQ ID NO: 3113570 - RNA, 20 nt, Mycobacterium bovis subsp bovis AF2122/97
aacucgcgcgucgucgcgcu

SEQ ID NO: 3113571 - RNA, 18 nt, Mycobacterium bovis subsp bovis AF2122/97
aacucggcauucaccgcg

SEQ ID NO: 3113572 - RNA, 15 nt, Mycobacterium bovis subsp bovis AF2122/97
aacucggccacggcg

SEQ ID NO: 3113573 - RNA, 18 nt, Mycobacterium bovis subsp bovis AF2122/97
aacucggccacggcgucg

SEQ ID NO: 3113574 - RNA, 15 nt, Mycobacterium bovis subsp bovis AF2122/97
aacucggcccgggug

SEQ ID NO: 3113575 - RNA, 21 nt, Mycobacterium bovis subsp bovis AF2122/97
aacucggcgaucucgucgcgg

SEQ ID NO: 3113576 - RNA, 22 nt, Mycobacterium bovis subsp bovis AF2122/97
aacucggcgaucucgucgcggu

SEQ ID NO: 3113577 - RNA, 13 nt, Mycobacterium bovis subsp bovis AF2122/97
aacucggcgucgu

SEQ ID NO: 3113578 - RNA, 15 nt, Mycobacterium bovis subsp bovis AF2122/97
aacucguccagcagu

SEQ ID NO: 3113579 - RNA, 17 nt, Mycobacterium bovis subsp bovis AF2122/97
aacucguccagcagugc

SEQ ID NO: 3113580 - RNA, 22 nt, Mycobacterium bovis subsp bovis AF2122/97
aacucuggauucuucagcgcgg

SEQ ID NO: 3113581 - RNA, 18 nt, Mycobacterium bovis subsp bovis AF2122/97
aacucuguggugucgauu

SEQ ID NO: 3113582 - RNA, 22 nt, Mycobacterium bovis subsp bovis AF2122/97
aacugacccccugacggcaucu

SEQ ID NO: 3113583 - RNA, 17 nt, Mycobacterium bovis subsp bovis AF2122/97
aacugacccgcauaccg

SEQ ID NO: 3113584 - RNA, 15 nt, Mycobacterium bovis subsp bovis AF2122/97
aacugcagcauggcc

SEQ ID NO: 3113585 - RNA, 14 nt, Mycobacterium bovis subsp bovis AF2122/97
aacugcccgcggcg

SEQ ID NO: 3113586 - RNA, 15 nt, Mycobacterium bovis subsp bovis AF2122/97
aacugcccgcggcgg

SEQ ID NO: 3113587 - RNA, 16 nt, Mycobacterium bovis subsp bovis AF2122/97
aacugcccgcggcgga

SEQ ID NO: 3113588 - RNA, 16 nt, Mycobacterium bovis subsp bovis AF2122/97
aacugcgaucggccgc

SEQ ID NO: 3113589 - RNA, 14 nt, Mycobacterium bovis subsp bovis AF2122/97
aacugcgccggugc

SEQ ID NO: 3113590 - RNA, 15 nt, Mycobacterium bovis subsp bovis AF2122/97
aacugcgccggugcc

SEQ ID NO: 3113591 - RNA, 20 nt, Mycobacterium bovis subsp bovis AF2122/97
aacugcgccggugccggcca

SEQ ID NO: 3113592 - RNA, 15 nt, Mycobacterium bovis subsp bovis AF2122/97
aacugcgccguucgc

SEQ ID NO: 3113593 - RNA, 18 nt, Mycobacterium bovis subsp bovis AF2122/97
aacugcgccguucgcucc

SEQ ID NO: 3113594 - RNA, 21 nt, Mycobacterium bovis subsp bovis AF2122/97
aacugcggcccaugaucucgg

SEQ ID NO: 3113595 - RNA, 15 nt, Mycobacterium bovis subsp bovis AF2122/97
aacugcucgccgagg

SEQ ID NO: 3113596 - RNA, 14 nt, Mycobacterium bovis subsp bovis AF2122/97
aacugcuggccgau

SEQ ID NO: 3113597 - RNA, 14 nt, Mycobacterium bovis subsp bovis AF2122/97
aacuggaccacagc

SEQ ID NO: 3113598 - RNA, 21 nt, Mycobacterium bovis subsp bovis AF2122/97
aacuggaccggugccagcagu

SEQ ID NO: 3113599 - RNA, 12 nt, Mycobacterium bovis subsp bovis AF2122/97
aacuggacuggg

SEQ ID NO: 3113600 - RNA, 13 nt, Mycobacterium bovis subsp bovis AF2122/97
aacugggacugca

SEQ ID NO: 3113601 - RNA, 21 nt, Mycobacterium bovis subsp bovis AF2122/97
aacugggcaccggcggucugc

SEQ ID NO: 3113602 - RNA, 20 nt, Mycobacterium bovis subsp bovis AF2122/97
aacugggccgagcgcgccgu

SEQ ID NO: 3113603 - RNA, 14 nt, Mycobacterium bovis subsp bovis AF2122/97
aacugggcggccug

SEQ ID NO: 3113604 - RNA, 18 nt, Mycobacterium bovis subsp bovis AF2122/97
aacugggcggccuggucg

SEQ ID NO: 3113605 - RNA, 14 nt, Mycobacterium bovis subsp bovis AF2122/97
aacuggucgacgcc

SEQ ID NO: 3113606 - RNA, 21 nt, Mycobacterium bovis subsp bovis AF2122/97
aacuggucgccaacgccagca

SEQ ID NO: 3113607 - RNA, 19 nt, Mycobacterium bovis subsp bovis AF2122/97
aacugguuggugacguaga

SEQ ID NO: 3113608 - RNA, 15 nt, Mycobacterium bovis subsp bovis AF2122/97
aacuguccggguggg

SEQ ID NO: 3113609 - RNA, 22 nt, Mycobacterium bovis subsp bovis AF2122/97
aacuucgacaacgcauccgaca

SEQ ID NO: 3113610 - RNA, 19 nt, Mycobacterium bovis subsp bovis AF2122/97
aacuucuucagcagcggcg

SEQ ID NO: 3113611 - RNA, 20 nt, Mycobacterium bovis subsp bovis AF2122/97
aacuugacgaacucgccguc

SEQ ID NO: 3113612 - RNA, 20 nt, Mycobacterium bovis subsp bovis AF2122/97
aacuugcggaccuggcggcg

SEQ ID NO: 3113613 - RNA, 21 nt, Mycobacterium bovis subsp bovis AF2122/97
aacuugcggaccuggcggcgg

SEQ ID NO: 3113614 - RNA, 13 nt, Mycobacterium bovis subsp bovis AF2122/97
aacuugcugacga

SEQ ID NO: 3113615 - RNA, 21 nt, Mycobacterium bovis subsp bovis AF2122/97
aacuuggcggccagccgcucc

SEQ ID NO: 3113616 - RNA, 14 nt, Mycobacterium bovis subsp bovis AF2122/97
aagaacaugcucac

SEQ ID NO: 3113617 - RNA, 21 nt, Mycobacterium bovis subsp bovis AF2122/97
aagaacaugcucacgaucacc

SEQ ID NO: 3113618 - RNA, 12 nt, Mycobacterium bovis subsp bovis AF2122/97
aagaaccggcau

SEQ ID NO: 3113619 - RNA, 19 nt, Mycobacterium bovis subsp bovis AF2122/97
aagaaccugagcaccaaga

SEQ ID NO: 3113620 - RNA, 12 nt, Mycobacterium bovis subsp bovis AF2122/97
aagaacucggcg

SEQ ID NO: 3113621 - RNA, 18 nt, Mycobacterium bovis subsp bovis AF2122/97
aagaagaacucggcgucg

SEQ ID NO: 3113622 - RNA, 17 nt, Mycobacterium bovis subsp bovis AF2122/97
aagaagagguuggcggc

SEQ ID NO: 3113623 - RNA, 20 nt, Mycobacterium bovis subsp bovis AF2122/97
aagaagaugaucgcgaacau

SEQ ID NO: 3113624 - RNA, 18 nt, Mycobacterium bovis subsp bovis AF2122/97
aagaagcccgaguuguuc

SEQ ID NO: 3113625 - RNA, 17 nt, Mycobacterium bovis subsp bovis AF2122/97
aagaaguggucggcccg

SEQ ID NO: 3113626 - RNA, 13 nt, Mycobacterium bovis subsp bovis AF2122/97
aagaauaugccga

SEQ ID NO: 3113627 - RNA, 16 nt, Mycobacterium bovis subsp bovis AF2122/97
aagaaugugggcgacg

SEQ ID NO: 3113628 - RNA, 14 nt, Mycobacterium bovis subsp bovis AF2122/97
aagacaacccgcuc

SEQ ID NO: 3113629 - RNA, 22 nt, Mycobacterium bovis subsp bovis AF2122/97
aagacaaguggugguaggccgg

SEQ ID NO: 3113630 - RNA, 15 nt, Mycobacterium bovis subsp bovis AF2122/97
aagacaccaggcccg

SEQ ID NO: 3113631 - RNA, 16 nt, Mycobacterium bovis subsp bovis AF2122/97
aagacaccggcgucga

SEQ ID NO: 3113632 - RNA, 14 nt, Mycobacterium bovis subsp bovis AF2122/97
aagaccaccgccca

SEQ ID NO: 3113633 - RNA, 14 nt, Mycobacterium bovis subsp bovis AF2122/97
aagaccccuaccgg

SEQ ID NO: 3113634 - RNA, 15 nt, Mycobacterium bovis subsp bovis AF2122/97
aagacccggcaccca

SEQ ID NO: 3113635 - RNA, 16 nt, Mycobacterium bovis subsp bovis AF2122/97
aagaccgacagcggca

SEQ ID NO: 3113636 - RNA, 17 nt, Mycobacterium bovis subsp bovis AF2122/97
aagaccgccuccaccgc

SEQ ID NO: 3113637 - RNA, 14 nt, Mycobacterium bovis subsp bovis AF2122/97
aagaccgcgccaac

SEQ ID NO: 3113638 - RNA, 20 nt, Mycobacterium bovis subsp bovis AF2122/97
aagaccgcgucggcggccag

SEQ ID NO: 3113639 - RNA, 20 nt, Mycobacterium bovis subsp bovis AF2122/97
aagaccguucguucccgcuc

SEQ ID NO: 3113640 - RNA, 22 nt, Mycobacterium bovis subsp bovis AF2122/97
aagaccucgucgcgucgccaga

SEQ ID NO: 3113641 - RNA, 15 nt, Mycobacterium bovis subsp bovis AF2122/97
aagaccuggccugcg

SEQ ID NO: 3113642 - RNA, 20 nt, Mycobacterium bovis subsp bovis AF2122/97
aagaccuggcggugccggcg

SEQ ID NO: 3113643 - RNA, 17 nt, Mycobacterium bovis subsp bovis AF2122/97
aagacgcccgaguuugc

SEQ ID NO: 3113644 - RNA, 15 nt, Mycobacterium bovis subsp bovis AF2122/97
aagacgcuguccagg

SEQ ID NO: 3113645 - RNA, 20 nt, Mycobacterium bovis subsp bovis AF2122/97
aagacgucggcguggucgcg

SEQ ID NO: 3113646 - RNA, 22 nt, Mycobacterium bovis subsp bovis AF2122/97
aagacgugccggcucaggugug

SEQ ID NO: 3113647 - RNA, 18 nt, Mycobacterium bovis subsp bovis AF2122/97
aagacguuggcgcgguug

SEQ ID NO: 3113648 - RNA, 13 nt, Mycobacterium bovis subsp bovis AF2122/97
aagacugcgccgc

SEQ ID NO: 3113649 - RNA, 18 nt, Mycobacterium bovis subsp bovis AF2122/97
aagacugcgccgccggcg

SEQ ID NO: 3113650 - RNA, 21 nt, Mycobacterium bovis subsp bovis AF2122/97
aagacugcgccgccggcgcgu

SEQ ID NO: 3113651 - RNA, 19 nt, Mycobacterium bovis subsp bovis AF2122/97
aagacuuagcgggugccag

SEQ ID NO: 3113652 - RNA, 20 nt, Mycobacterium bovis subsp bovis AF2122/97
aagacuuagcgggugccagc

SEQ ID NO: 3113653 - RNA, 11 nt, Mycobacterium bovis subsp bovis AF2122/97
aagagccgucc

SEQ ID NO: 3113654 - RNA, 19 nt, Mycobacterium bovis subsp bovis AF2122/97
aagagcggagccggcgcau

SEQ ID NO: 3113655 - RNA, 17 nt, Mycobacterium bovis subsp bovis AF2122/97
aagagcuccgucgcggc

SEQ ID NO: 3113656 - RNA, 15 nt, Mycobacterium bovis subsp bovis AF2122/97
aagaucagacccagc

SEQ ID NO: 3113657 - RNA, 21 nt, Mycobacterium bovis subsp bovis AF2122/97
aagaucagcaugguccacagc

SEQ ID NO: 3113658 - RNA, 18 nt, Mycobacterium bovis subsp bovis AF2122/97
aagaucagcggauccaga

SEQ ID NO: 3113659 - RNA, 18 nt, Mycobacterium bovis subsp bovis AF2122/97
aagaucgcgugccacagc

SEQ ID NO: 3113660 - RNA, 21 nt, Mycobacterium bovis subsp bovis AF2122/97
aagaucuucaccggccggugc

SEQ ID NO: 3113661 - RNA, 14 nt, Mycobacterium bovis subsp bovis AF2122/97
aagaucuucgccga

SEQ ID NO: 3113662 - RNA, 14 nt, Mycobacterium bovis subsp bovis AF2122/97
aagaugaccugauc

SEQ ID NO: 3113663 - RNA, 19 nt, Mycobacterium bovis subsp bovis AF2122/97
aagaugccugcuagcagca

SEQ ID NO: 3113664 - RNA, 16 nt, Mycobacterium bovis subsp bovis AF2122/97
aagaugucgucaccgu

SEQ ID NO: 3113665 - RNA, 19 nt, Mycobacterium bovis subsp bovis AF2122/97
aagauguugccgccgguca

SEQ ID NO: 3113666 - RNA, 19 nt, Mycobacterium bovis subsp bovis AF2122/97
aagauguugcgacggccgg

SEQ ID NO: 3113667 - RNA, 19 nt, Mycobacterium bovis subsp bovis AF2122/97
aagauuauggcgagcgcgc

SEQ ID NO: 3113668 - RNA, 13 nt, Mycobacterium bovis subsp bovis AF2122/97
aagcaagggcgau

SEQ ID NO: 3113669 - RNA, 19 nt, Mycobacterium bovis subsp bovis AF2122/97
aagcaagggcgauggucgg

SEQ ID NO: 3113670 - RNA, 20 nt, Mycobacterium bovis subsp bovis AF2122/97
aagcaaggguuugcgggcgu

SEQ ID NO: 3113671 - RNA, 11 nt, Mycobacterium bovis subsp bovis AF2122/97
aagcaauucca

SEQ ID NO: 3113672 - RNA, 16 nt, Mycobacterium bovis subsp bovis AF2122/97
aagcacaccgccagcg

SEQ ID NO: 3113673 - RNA, 16 nt, Mycobacterium bovis subsp bovis AF2122/97
aagcacacuggccaca

SEQ ID NO: 3113674 - RNA, 15 nt, Mycobacterium bovis subsp bovis AF2122/97
aagcacagcccggcg

SEQ ID NO: 3113675 - RNA, 16 nt, Mycobacterium bovis subsp bovis AF2122/97
aagcacagcccggcua

SEQ ID NO: 3113676 - RNA, 15 nt, Mycobacterium bovis subsp bovis AF2122/97
aagcaccagccagcc

SEQ ID NO: 3113677 - RNA, 17 nt, Mycobacterium bovis subsp bovis AF2122/97
aagcaccagccagccug

SEQ ID NO: 3113678 - RNA, 14 nt, Mycobacterium bovis subsp bovis AF2122/97
aagcaccgaugcug

SEQ ID NO: 3113679 - RNA, 21 nt, Mycobacterium bovis subsp bovis AF2122/97
aagcagaacaguaucgccgga

SEQ ID NO: 3113680 - RNA, 12 nt, Mycobacterium bovis subsp bovis AF2122/97
aagcagcagcgg

SEQ ID NO: 3113681 - RNA, 14 nt, Mycobacterium bovis subsp bovis AF2122/97
aagcagccagcaac

SEQ ID NO: 3113682 - RNA, 20 nt, Mycobacterium bovis subsp bovis AF2122/97
aagcaucgcguuguaggcuu

SEQ ID NO: 3113683 - RNA, 18 nt, Mycobacterium bovis subsp bovis AF2122/97
aagccacucgcgcacaua

SEQ ID NO: 3113684 - RNA, 20 nt, Mycobacterium bovis subsp bovis AF2122/97
aagccagaucgcuaggaccg

SEQ ID NO: 3113685 - RNA, 21 nt, Mycobacterium bovis subsp bovis AF2122/97
aagccagcaccuagucgcggc

SEQ ID NO: 3113686 - RNA, 15 nt, Mycobacterium bovis subsp bovis AF2122/97
aagccagcacugcca

SEQ ID NO: 3113687 - RNA, 16 nt, Mycobacterium bovis subsp bovis AF2122/97
aagccagcgcagccag

SEQ ID NO: 3113688 - RNA, 14 nt, Mycobacterium bovis subsp bovis AF2122/97
aagccaggcggcaa

SEQ ID NO: 3113689 - RNA, 20 nt, Mycobacterium bovis subsp bovis AF2122/97
aagcccagcgauucagccug

SEQ ID NO: 3113690 - RNA, 18 nt, Mycobacterium bovis subsp bovis AF2122/97
aagcccauccccgcucga

SEQ ID NO: 3113691 - RNA, 20 nt, Mycobacterium bovis subsp bovis AF2122/97
aagcccccgacacgccgugc

SEQ ID NO: 3113692 - RNA, 22 nt, Mycobacterium bovis subsp bovis AF2122/97
aagccccgcuccgcgccgcccc

SEQ ID NO: 3113693 - RNA, 13 nt, Mycobacterium bovis subsp bovis AF2122/97
aagcccgacuggu

SEQ ID NO: 3113694 - RNA, 18 nt, Mycobacterium bovis subsp bovis AF2122/97
aagcccgauucagcgccc

SEQ ID NO: 3113695 - RNA, 12 nt, Mycobacterium bovis subsp bovis AF2122/97
aagcccgccgga

SEQ ID NO: 3113696 - RNA, 22 nt, Mycobacterium bovis subsp bovis AF2122/97
aagcccgccggacccgccgggu

SEQ ID NO: 3113697 - RNA, 14 nt, Mycobacterium bovis subsp bovis AF2122/97
aagcccgucgcggc

SEQ ID NO: 3113698 - RNA, 19 nt, Mycobacterium bovis subsp bovis AF2122/97
aagcccgucgcggccggcg

SEQ ID NO: 3113699 - RNA, 21 nt, Mycobacterium bovis subsp bovis AF2122/97
aagcccgucgucgugcacgac

SEQ ID NO: 3113700 - RNA, 15 nt, Mycobacterium bovis subsp bovis AF2122/97
aagcccuggccagcg

SEQ ID NO: 3113701 - RNA, 23 nt, Mycobacterium bovis subsp bovis AF2122/97
aagccgaccggguugauggcgua

SEQ ID NO: 3113702 - RNA, 14 nt, Mycobacterium bovis subsp bovis AF2122/97
aagccgaccuucuc

SEQ ID NO: 3113703 - RNA, 14 nt, Mycobacterium bovis subsp bovis AF2122/97
aagccgacgaccag

SEQ ID NO: 3113704 - RNA, 12 nt, Mycobacterium bovis subsp bovis AF2122/97
aagccgacgauc

SEQ ID NO: 3113705 - RNA, 14 nt, Mycobacterium bovis subsp bovis AF2122/97
aagccgagcaucag

SEQ ID NO: 3113706 - RNA, 15 nt, Mycobacterium bovis subsp bovis AF2122/97
aagccgagcaucaga

SEQ ID NO: 3113707 - RNA, 16 nt, Mycobacterium bovis subsp bovis AF2122/97
aagccgagcaucagau

SEQ ID NO: 3113708 - RNA, 18 nt, Mycobacterium bovis subsp bovis AF2122/97
aagccgagcccgucgauc

SEQ ID NO: 3113709 - RNA, 14 nt, Mycobacterium bovis subsp bovis AF2122/97
aagccgcaccagau

SEQ ID NO: 3113710 - RNA, 18 nt, Mycobacterium bovis subsp bovis AF2122/97
aagccgcccgaguugugg

SEQ ID NO: 3113711 - RNA, 24 nt, Mycobacterium bovis subsp bovis AF2122/97
aagccgcgcaucugucgcgcggca

SEQ ID NO: 3113712 - RNA, 14 nt, Mycobacterium bovis subsp bovis AF2122/97
aagccgcgcugcga

SEQ ID NO: 3113713 - RNA, 11 nt, Mycobacterium bovis subsp bovis AF2122/97
aagccgcggcu

SEQ ID NO: 3113714 - RNA, 22 nt, Mycobacterium bovis subsp bovis AF2122/97
aagccgcggcuaggccagcacg

SEQ ID NO: 3113715 - RNA, 16 nt, Mycobacterium bovis subsp bovis AF2122/97
aagccgcgucgcgaug

SEQ ID NO: 3113716 - RNA, 20 nt, Mycobacterium bovis subsp bovis AF2122/97
aagccgcugauguacccggc

SEQ ID NO: 3113717 - RNA, 14 nt, Mycobacterium bovis subsp bovis AF2122/97
aagccggccgggaa

SEQ ID NO: 3113718 - RNA, 19 nt, Mycobacterium bovis subsp bovis AF2122/97
aagccggcgcccgccgcga

SEQ ID NO: 3113719 - RNA, 21 nt, Mycobacterium bovis subsp bovis AF2122/97
aagccggcgcccgccgcgaac

SEQ ID NO: 3113720 - RNA, 18 nt, Mycobacterium bovis subsp bovis AF2122/97
aagccggcgcggcggcgu

SEQ ID NO: 3113721 - RNA, 20 nt, Mycobacterium bovis subsp bovis AF2122/97
aagccggcgcggcggcgucg

SEQ ID NO: 3113722 - RNA, 23 nt, Mycobacterium bovis subsp bovis AF2122/97
aagccggcguuuaucagcaagag

SEQ ID NO: 3113723 - RNA, 21 nt, Mycobacterium bovis subsp bovis AF2122/97
aagccggcugcauccuccucg

SEQ ID NO: 3113724 - RNA, 21 nt, Mycobacterium bovis subsp bovis AF2122/97
aagccgggauugccgccaccu

SEQ ID NO: 3113725 - RNA, 15 nt, Mycobacterium bovis subsp bovis AF2122/97
aagccgggucucggu

SEQ ID NO: 3113726 - RNA, 16 nt, Mycobacterium bovis subsp bovis AF2122/97
aagccgggucuguugg

SEQ ID NO: 3113727 - RNA, 21 nt, Mycobacterium bovis subsp bovis AF2122/97
aagccgucgcgacgucggccg

SEQ ID NO: 3113728 - RNA, 21 nt, Mycobacterium bovis subsp bovis AF2122/97
aagccgugcaccagcgaccag

SEQ ID NO: 3113729 - RNA, 19 nt, Mycobacterium bovis subsp bovis AF2122/97
aagccgugcagcucgguca

SEQ ID NO: 3113730 - RNA, 13 nt, Mycobacterium bovis subsp bovis AF2122/97
aagccguggccgg

SEQ ID NO: 3113731 - RNA, 16 nt, Mycobacterium bovis subsp bovis AF2122/97
aagccguguucgaccg

SEQ ID NO: 3113732 - RNA, 22 nt, Mycobacterium bovis subsp bovis AF2122/97
aagccguucgcgucgccgauga

SEQ ID NO: 3113733 - RNA, 18 nt, Mycobacterium bovis subsp bovis AF2122/97
aagccguucugucccggc

SEQ ID NO: 3113734 - RNA, 22 nt, Mycobacterium bovis subsp bovis AF2122/97
aagccguugccgccacgggcgg

SEQ ID NO: 3113735 - RNA, 21 nt, Mycobacterium bovis subsp bovis AF2122/97
aagccuaguccuggcucggca

SEQ ID NO: 3113736 - RNA, 15 nt, Mycobacterium bovis subsp bovis AF2122/97
aagccucagccgcuc

SEQ ID NO: 3113737 - RNA, 17 nt, Mycobacterium bovis subsp bovis AF2122/97
aagccugcgggccggca

SEQ ID NO: 3113738 - RNA, 14 nt, Mycobacterium bovis subsp bovis AF2122/97
aagccuggaaaacc

SEQ ID NO: 3113739 - RNA, 20 nt, Mycobacterium bovis subsp bovis AF2122/97
aagccuuaccccgcagcuca

SEQ ID NO: 3113740 - RNA, 12 nt, Mycobacterium bovis subsp bovis AF2122/97
aagcgaccgacg

SEQ ID NO: 3113741 - RNA, 16 nt, Mycobacterium bovis subsp bovis AF2122/97
aagcgacucgccggcg

SEQ ID NO: 3113742 - RNA, 17 nt, Mycobacterium bovis subsp bovis AF2122/97
aagcgacucgccggcga

SEQ ID NO: 3113743 - RNA, 23 nt, Mycobacterium bovis subsp bovis AF2122/97
aagcgagcggucgacguguugga

SEQ ID NO: 3113744 - RNA, 16 nt, Mycobacterium bovis subsp bovis AF2122/97
aagcgagucgacgaac

SEQ ID NO: 3113745 - RNA, 14 nt, Mycobacterium bovis subsp bovis AF2122/97
aagcgauccggcug

SEQ ID NO: 3113746 - RNA, 13 nt, Mycobacterium bovis subsp bovis AF2122/97
aagcgaucgccgg

SEQ ID NO: 3113747 - RNA, 20 nt, Mycobacterium bovis subsp bovis AF2122/97
aagcgaucgccggccgcgug

SEQ ID NO: 3113748 - RNA, 14 nt, Mycobacterium bovis subsp bovis AF2122/97
aagcgauucccaac

SEQ ID NO: 3113749 - RNA, 23 nt, Mycobacterium bovis subsp bovis AF2122/97
aagcgauuuggcgucgccgaggu

SEQ ID NO: 3113750 - RNA, 17 nt, Mycobacterium bovis subsp bovis AF2122/97
aagcgccaaacccggcg

SEQ ID NO: 3113751 - RNA, 18 nt, Mycobacterium bovis subsp bovis AF2122/97
aagcgccgaaacagcacc

SEQ ID NO: 3113752 - RNA, 19 nt, Mycobacterium bovis subsp bovis AF2122/97
aagcgccgcgcuugcgauc

SEQ ID NO: 3113753 - RNA, 18 nt, Mycobacterium bovis subsp bovis AF2122/97
aagcgccgcuuggcgauc

SEQ ID NO: 3113754 - RNA, 13 nt, Mycobacterium bovis subsp bovis AF2122/97
aagcgccggccga

SEQ ID NO: 3113755 - RNA, 23 nt, Mycobacterium bovis subsp bovis AF2122/97
aagcgcgcgcgugaagaacacgu

SEQ ID NO: 3113756 - RNA, 15 nt, Mycobacterium bovis subsp bovis AF2122/97
aagcgcgguugcgcu

SEQ ID NO: 3113757 - RNA, 21 nt, Mycobacterium bovis subsp bovis AF2122/97
aagcgcgguuucggcgaugaa

SEQ ID NO: 3113758 - RNA, 16 nt, Mycobacterium bovis subsp bovis AF2122/97
aagcgcguuguugucg

SEQ ID NO: 3113759 - RNA, 19 nt, Mycobacterium bovis subsp bovis AF2122/97
aagcgcguuguugucgauc

SEQ ID NO: 3113760 - RNA, 23 nt, Mycobacterium bovis subsp bovis AF2122/97
aagcgcguuguugucgaucagaa

SEQ ID NO: 3113761 - RNA, 13 nt, Mycobacterium bovis subsp bovis AF2122/97
aagcggcccgcug

SEQ ID NO: 3113762 - RNA, 13 nt, Mycobacterium bovis subsp bovis AF2122/97
aagcggccucgac

SEQ ID NO: 3113763 - RNA, 22 nt, Mycobacterium bovis subsp bovis AF2122/97
aagcggcugcccgagaucgcgu

SEQ ID NO: 3113764 - RNA, 17 nt, Mycobacterium bovis subsp bovis AF2122/97
aagcgggauugccgaga

SEQ ID NO: 3113765 - RNA, 13 nt, Mycobacterium bovis subsp bovis AF2122/97
aagcgggcgucgc

SEQ ID NO: 3113766 - RNA, 23 nt, Mycobacterium bovis subsp bovis AF2122/97
aagcgguuauguauccgcgccgc

SEQ ID NO: 3113767 - RNA, 17 nt, Mycobacterium bovis subsp bovis AF2122/97
aagcgguugacccacag

SEQ ID NO: 3113768 - RNA, 18 nt, Mycobacterium bovis subsp bovis AF2122/97
aagcgguugacccacagc

SEQ ID NO: 3113769 - RNA, 17 nt, Mycobacterium bovis subsp bovis AF2122/97
aagcguacucgugauga

SEQ ID NO: 3113770 - RNA, 23 nt, Mycobacterium bovis subsp bovis AF2122/97
aagcgucuggucagccgcggcgg

SEQ ID NO: 3113771 - RNA, 22 nt, Mycobacterium bovis subsp bovis AF2122/97
aagcgugccugcaguucggcgu

SEQ ID NO: 3113772 - RNA, 14 nt, Mycobacterium bovis subsp bovis AF2122/97
aagcgugcgccgac

SEQ ID NO: 3113773 - RNA, 16 nt, Mycobacterium bovis subsp bovis AF2122/97
aagcgugcgccgacuu

SEQ ID NO: 3113774 - RNA, 18 nt, Mycobacterium bovis subsp bovis AF2122/97
aagcguugaccgcggucu

SEQ ID NO: 3113775 - RNA, 18 nt, Mycobacterium bovis subsp bovis AF2122/97
aagcuaaccgcuuggugu

SEQ ID NO: 3113776 - RNA, 15 nt, Mycobacterium bovis subsp bovis AF2122/97
aagcucaagggacac

SEQ ID NO: 3113777 - RNA, 22 nt, Mycobacterium bovis subsp bovis AF2122/97
aagcucaagggacacccgcuuu

SEQ ID NO: 3113778 - RNA, 15 nt, Mycobacterium bovis subsp bovis AF2122/97
aagcucacacuggcu

SEQ ID NO: 3113779 - RNA, 18 nt, Mycobacterium bovis subsp bovis AF2122/97
aagcucgcaaccgagaug

SEQ ID NO: 3113780 - RNA, 14 nt, Mycobacterium bovis subsp bovis AF2122/97
aagcucggccacca

SEQ ID NO: 3113781 - RNA, 20 nt, Mycobacterium bovis subsp bovis AF2122/97
aagcucguagagcaccgcau

SEQ ID NO: 3113782 - RNA, 18 nt, Mycobacterium bovis subsp bovis AF2122/97
aagcucugcgucgugccc

SEQ ID NO: 3113783 - RNA, 16 nt, Mycobacterium bovis subsp bovis AF2122/97
aagcugaccgccagcg

SEQ ID NO: 3113784 - RNA, 22 nt, Mycobacterium bovis subsp bovis AF2122/97
aagcugcucgucggcgccggcg

SEQ ID NO: 3113785 - RNA, 14 nt, Mycobacterium bovis subsp bovis AF2122/97
aagcugcugcugcu

SEQ ID NO: 3113786 - RNA, 21 nt, Mycobacterium bovis subsp bovis AF2122/97
aagcugugccuucgccucguu

SEQ ID NO: 3113787 - RNA, 16 nt, Mycobacterium bovis subsp bovis AF2122/97
aagcuugggcgaucgu

SEQ ID NO: 3113788 - RNA, 21 nt, Mycobacterium bovis subsp bovis AF2122/97
aaggaaaaugauagcggcgca

SEQ ID NO: 3113789 - RNA, 14 nt, Mycobacterium bovis subsp bovis AF2122/97
aaggaaccgggcaa

SEQ ID NO: 3113790 - RNA, 12 nt, Mycobacterium bovis subsp bovis AF2122/97
aaggacgcaccg

SEQ ID NO: 3113791 - RNA, 22 nt, Mycobacterium bovis subsp bovis AF2122/97
aaggacggcagccaccagcgac

SEQ ID NO: 3113792 - RNA, 21 nt, Mycobacterium bovis subsp bovis AF2122/97
aaggagccgggccguccgggu

SEQ ID NO: 3113793 - RNA, 10 nt, Mycobacterium bovis subsp bovis AF2122/97
aaggaucaac

SEQ ID NO: 3113794 - RNA, 15 nt, Mycobacterium bovis subsp bovis AF2122/97
aaggaucaacgugcg

SEQ ID NO: 3113795 - RNA, 17 nt, Mycobacterium bovis subsp bovis AF2122/97
aaggaucagcgcacugg

SEQ ID NO: 3113796 - RNA, 21 nt, Mycobacterium bovis subsp bovis AF2122/97
aaggaugcugucagacggcgu

SEQ ID NO: 3113797 - RNA, 22 nt, Mycobacterium bovis subsp bovis AF2122/97
aaggaugucggggcgaagcuug

SEQ ID NO: 3113798 - RNA, 17 nt, Mycobacterium bovis subsp bovis AF2122/97
aaggauugcggaaaccc

SEQ ID NO: 3113799 - RNA, 13 nt, Mycobacterium bovis subsp bovis AF2122/97
aaggcaaacacca

SEQ ID NO: 3113800 - RNA, 21 nt, Mycobacterium bovis subsp bovis AF2122/97
aaggcaaacaccagcccggcg

SEQ ID NO: 3113801 - RNA, 13 nt, Mycobacterium bovis subsp bovis AF2122/97
aaggcacgggugu

SEQ ID NO: 3113802 - RNA, 22 nt, Mycobacterium bovis subsp bovis AF2122/97
aaggcaggacugaacaguugca

SEQ ID NO: 3113803 - RNA, 18 nt, Mycobacterium bovis subsp bovis AF2122/97
aaggcauccaacgcggcg

SEQ ID NO: 3113804 - RNA, 16 nt, Mycobacterium bovis subsp bovis AF2122/97
aaggccaagcgccaac

SEQ ID NO: 3113805 - RNA, 22 nt, Mycobacterium bovis subsp bovis AF2122/97
aaggccacccgcgaagccgcca

SEQ ID NO: 3113806 - RNA, 13 nt, Mycobacterium bovis subsp bovis AF2122/97
aaggccagcacgg

SEQ ID NO: 3113807 - RNA, 13 nt, Mycobacterium bovis subsp bovis AF2122/97
aaggcccggcgcg

SEQ ID NO: 3113808 - RNA, 18 nt, Mycobacterium bovis subsp bovis AF2122/97
aaggcccguugucgaccg

SEQ ID NO: 3113809 - RNA, 15 nt, Mycobacterium bovis subsp bovis AF2122/97
aaggcccuggccgcg

SEQ ID NO: 3113810 - RNA, 19 nt, Mycobacterium bovis subsp bovis AF2122/97
aaggcccuggccgcgccgg

SEQ ID NO: 3113811 - RNA, 18 nt, Mycobacterium bovis subsp bovis AF2122/97
aaggccgauguacugugc

SEQ ID NO: 3113812 - RNA, 15 nt, Mycobacterium bovis subsp bovis AF2122/97
aaggccgcaccgcca

SEQ ID NO: 3113813 - RNA, 20 nt, Mycobacterium bovis subsp bovis AF2122/97
aaggccgccgccgucggcga

SEQ ID NO: 3113814 - RNA, 18 nt, Mycobacterium bovis subsp bovis AF2122/97
aaggccgcgcgcagggcg

SEQ ID NO: 3113815 - RNA, 20 nt, Mycobacterium bovis subsp bovis AF2122/97
aaggccgcguugccggucgc

SEQ ID NO: 3113816 - RNA, 23 nt, Mycobacterium bovis subsp bovis AF2122/97
aaggccgugaugccacggcgucg

SEQ ID NO: 3113817 - RNA, 15 nt, Mycobacterium bovis subsp bovis AF2122/97
aaggcgacgccgaaa

SEQ ID NO: 3113818 - RNA, 12 nt, Mycobacterium bovis subsp bovis AF2122/97
aaggcgccgaac

SEQ ID NO: 3113819 - RNA, 14 nt, Mycobacterium bovis subsp bovis AF2122/97
aaggcgccggucgc

SEQ ID NO: 3113820 - RNA, 12 nt, Mycobacterium bovis subsp bovis AF2122/97
aaggcgcgggcg

SEQ ID NO: 3113821 - RNA, 16 nt, Mycobacterium bovis subsp bovis AF2122/97
aaggcgcgggcgacgu

SEQ ID NO: 3113822 - RNA, 14 nt, Mycobacterium bovis subsp bovis AF2122/97
aaggcggccaggug

SEQ ID NO: 3113823 - RNA, 15 nt, Mycobacterium bovis subsp bovis AF2122/97
aaggcggucaccacc

SEQ ID NO: 3113824 - RNA, 22 nt, Mycobacterium bovis subsp bovis AF2122/97
aaggcgucgaacagugccucgc

SEQ ID NO: 3113825 - RNA, 20 nt, Mycobacterium bovis subsp bovis AF2122/97
aaggcguguagccugcggcg

SEQ ID NO: 3113826 - RNA, 18 nt, Mycobacterium bovis subsp bovis AF2122/97
aaggcguucgccggggcg

SEQ ID NO: 3113827 - RNA, 15 nt, Mycobacterium bovis subsp bovis AF2122/97
aaggcucaccaggcg

SEQ ID NO: 3113828 - RNA, 16 nt, Mycobacterium bovis subsp bovis AF2122/97
aaggcugugccggcca

SEQ ID NO: 3113829 - RNA, 14 nt, Mycobacterium bovis subsp bovis AF2122/97
aaggcuugugccag

SEQ ID NO: 3113830 - RNA, 20 nt, Mycobacterium bovis subsp bovis AF2122/97
aagggagaccgcggccggcc

SEQ ID NO: 3113831 - RNA, 15 nt, Mycobacterium bovis subsp bovis AF2122/97
aagggaguguuuggg

SEQ ID NO: 3113832 - RNA, 22 nt, Mycobacterium bovis subsp bovis AF2122/97
aagggauccgaagagccagcaa

SEQ ID NO: 3113833 - RNA, 14 nt, Mycobacterium bovis subsp bovis AF2122/97
aagggccgccucgc

SEQ ID NO: 3113834 - RNA, 22 nt, Mycobacterium bovis subsp bovis AF2122/97
aagggcugggucagguugucgg

SEQ ID NO: 3113835 - RNA, 17 nt, Mycobacterium bovis subsp bovis AF2122/97
aagggcuugucgccggc

SEQ ID NO: 3113836 - RNA, 19 nt, Mycobacterium bovis subsp bovis AF2122/97
aaggggcucagcgguggcg

SEQ ID NO: 3113837 - RNA, 21 nt, Mycobacterium bovis subsp bovis AF2122/97
aagggggucgagcgcuucguc

SEQ ID NO: 3113838 - RNA, 17 nt, Mycobacterium bovis subsp bovis AF2122/97
aaggggugugugcugcc

SEQ ID NO: 3113839 - RNA, 17 nt, Mycobacterium bovis subsp bovis AF2122/97
aagggucaucgccagcg

SEQ ID NO: 3113840 - RNA, 20 nt, Mycobacterium bovis subsp bovis AF2122/97
aagguccgugccgaugccgg

SEQ ID NO: 3113841 - RNA, 23 nt, Mycobacterium bovis subsp bovis AF2122/97
aagguccgugccgaugccggcga

SEQ ID NO: 3113842 - RNA, 22 nt, Mycobacterium bovis subsp bovis AF2122/97
aaggucgacggaaucgucggcg

SEQ ID NO: 3113843 - RNA, 14 nt, Mycobacterium bovis subsp bovis AF2122/97
aaggucgcggucga

SEQ ID NO: 3113844 - RNA, 19 nt, Mycobacterium bovis subsp bovis AF2122/97
aaggucgcugcuugcgggc

SEQ ID NO: 3113845 - RNA, 11 nt, Mycobacterium bovis subsp bovis AF2122/97
aaggucggcga

SEQ ID NO: 3113846 - RNA, 15 nt, Mycobacterium bovis subsp bovis AF2122/97
aaggucuccggcaag

SEQ ID NO: 3113847 - RNA, 21 nt, Mycobacterium bovis subsp bovis AF2122/97
aaggugacgacgagggcggga

SEQ ID NO: 3113848 - RNA, 13 nt, Mycobacterium bovis subsp bovis AF2122/97
aaggugcacugcc

SEQ ID NO: 3113849 - RNA, 12 nt, Mycobacterium bovis subsp bovis AF2122/97
aaggugccggcg

SEQ ID NO: 3113850 - RNA, 14 nt, Mycobacterium bovis subsp bovis AF2122/97
aaggugcgccgcca

SEQ ID NO: 3113851 - RNA, 12 nt, Mycobacterium bovis subsp bovis AF2122/97
aaggugcugcgc

SEQ ID NO: 3113852 - RNA, 13 nt, Mycobacterium bovis subsp bovis AF2122/97
aagguguccucca

SEQ ID NO: 3113853 - RNA, 19 nt, Mycobacterium bovis subsp bovis AF2122/97
aagguguccuccagcugcg

SEQ ID NO: 3113854 - RNA, 19 nt, Mycobacterium bovis subsp bovis AF2122/97
aaggugugcgucuccagcu

SEQ ID NO: 3113855 - RNA, 20 nt, Mycobacterium bovis subsp bovis AF2122/97
aagguguggugacagagcgg

SEQ ID NO: 3113856 - RNA, 22 nt, Mycobacterium bovis subsp bovis AF2122/97
aagguguggugacagagcgggu

SEQ ID NO: 3113857 - RNA, 15 nt, Mycobacterium bovis subsp bovis AF2122/97
aaguacuccauggca

SEQ ID NO: 3113858 - RNA, 14 nt, Mycobacterium bovis subsp bovis AF2122/97
aaguacuggccgcc

SEQ ID NO: 3113859 - RNA, 21 nt, Mycobacterium bovis subsp bovis AF2122/97
aaguacuggcguugccaccgg

SEQ ID NO: 3113860 - RNA, 19 nt, Mycobacterium bovis subsp bovis AF2122/97
aaguagccgaccggcagcg

SEQ ID NO: 3113861 - RNA, 19 nt, Mycobacterium bovis subsp bovis AF2122/97
aaguagccgacuaucggcc

SEQ ID NO: 3113862 - RNA, 13 nt, Mycobacterium bovis subsp bovis AF2122/97
aaguaggcggcga

SEQ ID NO: 3113863 - RNA, 19 nt, Mycobacterium bovis subsp bovis AF2122/97
aaguagguuuucggcggcu

SEQ ID NO: 3113864 - RNA, 16 nt, Mycobacterium bovis subsp bovis AF2122/97
aaguagucggcgccga

SEQ ID NO: 3113865 - RNA, 23 nt, Mycobacterium bovis subsp bovis AF2122/97
aaguccacgcaccacgagcagcc

SEQ ID NO: 3113866 - RNA, 11 nt, Mycobacterium bovis subsp bovis AF2122/97
aaguccagcag

SEQ ID NO: 3113867 - RNA, 23 nt, Mycobacterium bovis subsp bovis AF2122/97
aagucccgccguugccgccguca

SEQ ID NO: 3113868 - RNA, 21 nt, Mycobacterium bovis subsp bovis AF2122/97
aauccccugcgcugcagcuga

SEQ ID NO: 3113869 - RNA, 15 nt, Mycobacterium bovis subsp bovis AF2122/97
aaucccgcgcccggc

SEQ ID NO: 3113870 - RNA, 22 nt, Mycobacterium bovis subsp bovis AF2122/97
aaucccggccaggggcgcagcg

SEQ ID NO: 3113871 - RNA, 14 nt, Mycobacterium bovis subsp bovis AF2122/97
aauccgaacucgcg

SEQ ID NO: 3113872 - RNA, 16 nt, Mycobacterium bovis subsp bovis AF2122/97
aauccgacgucgacga

SEQ ID NO: 3113873 - RNA, 13 nt, Mycobacterium bovis subsp bovis AF2122/97
aauccgacgugga

SEQ ID NO: 3113874 - RNA, 13 nt, Mycobacterium bovis subsp bovis AF2122/97
aauccgagccgcg

SEQ ID NO: 3113875 - RNA, 16 nt, Mycobacterium bovis subsp bovis AF2122/97
aauccgcacagcgacg

SEQ ID NO: 3113876 - RNA, 17 nt, Mycobacterium bovis subsp bovis AF2122/97
aauccgcacagcgacga

SEQ ID NO: 3113877 - RNA, 16 nt, Mycobacterium bovis subsp bovis AF2122/97
aauccgcacagguccg

SEQ ID NO: 3113878 - RNA, 14 nt, Mycobacterium bovis subsp bovis AF2122/97
aauccgcucggucg

SEQ ID NO: 3113879 - RNA, 19 nt, Mycobacterium bovis subsp bovis AF2122/97
aauccggcauacaucgccu

SEQ ID NO: 3113880 - RNA, 15 nt, Mycobacterium bovis subsp bovis AF2122/97
aauccggccagaccc

SEQ ID NO: 3113881 - RNA, 15 nt, Mycobacterium bovis subsp bovis AF2122/97
aauccggucgaugac

SEQ ID NO: 3113882 - RNA, 22 nt, Mycobacterium bovis subsp bovis AF2122/97
aauccggucggcccacacuagg

SEQ ID NO: 3113883 - RNA, 14 nt, Mycobacterium bovis subsp bovis AF2122/97
aauccguccgacga

SEQ ID NO: 3113884 - RNA, 13 nt, Mycobacterium bovis subsp bovis AF2122/97
aauccgugcaggg

SEQ ID NO: 3113885 - RNA, 20 nt, Mycobacterium bovis subsp bovis AF2122/97
aauccgugccgaaaaucgca

SEQ ID NO: 3113886 - RNA, 17 nt, Mycobacterium bovis subsp bovis AF2122/97
aauccugccgcacgggc

SEQ ID NO: 3113887 - RNA, 18 nt, Mycobacterium bovis subsp bovis AF2122/97
aauccugguaggagaagc

SEQ ID NO: 3113888 - RNA, 14 nt, Mycobacterium bovis subsp bovis AF2122/97
aauccuucggcgug

SEQ ID NO: 3113889 - RNA, 19 nt, Mycobacterium bovis subsp bovis AF2122/97
aaucgaaaaggugcaccau

SEQ ID NO: 3113890 - RNA, 15 nt, Mycobacterium bovis subsp bovis AF2122/97
aaucgacaccgcccg

SEQ ID NO: 3113891 - RNA, 14 nt, Mycobacterium bovis subsp bovis AF2122/97
aaucgacagcagcg

SEQ ID NO: 3113892 - RNA, 18 nt, Mycobacterium bovis subsp bovis AF2122/97
aaucgaccgcccgccaac

SEQ ID NO: 3113893 - RNA, 13 nt, Mycobacterium bovis subsp bovis AF2122/97
aaucgacucagcc

SEQ ID NO: 3113894 - RNA, 15 nt, Mycobacterium bovis subsp bovis AF2122/97
aaucgacugaucgaa

SEQ ID NO: 3113895 - RNA, 18 nt, Mycobacterium bovis subsp bovis AF2122/97
aaucgcccucgucgcggg

SEQ ID NO: 3113896 - RNA, 19 nt, Mycobacterium bovis subsp bovis AF2122/97
aaucgcccucgucgcgggc

SEQ ID NO: 3113897 - RNA, 12 nt, Mycobacterium bovis subsp bovis AF2122/97
aaucgccgucag

SEQ ID NO: 3113898 - RNA, 19 nt, Mycobacterium bovis subsp bovis AF2122/97
aaucgccgucagcaccgcu

SEQ ID NO: 3113899 - RNA, 14 nt, Mycobacterium bovis subsp bovis AF2122/97
aaucgccugcgaca

SEQ ID NO: 3113900 - RNA, 13 nt, Mycobacterium bovis subsp bovis AF2122/97
aaucgcgucgaga

SEQ ID NO: 3113901 - RNA, 18 nt, Mycobacterium bovis subsp bovis AF2122/97
aaucgcgucgagagaacg

SEQ ID NO: 3113902 - RNA, 21 nt, Mycobacterium bovis subsp bovis AF2122/97
aaucgcucugugucgccgauc

SEQ ID NO: 3113903 - RNA, 23 nt, Mycobacterium bovis subsp bovis AF2122/97
aaucgcucugugucgccgaucac

SEQ ID NO: 3113904 - RNA, 22 nt, Mycobacterium bovis subsp bovis AF2122/97
aaucgcugaccgcguagaccag

SEQ ID NO: 3113905 - RNA, 17 nt, Mycobacterium bovis subsp bovis AF2122/97
aaucgcugccgccgauc

SEQ ID NO: 3113906 - RNA, 17 nt, Mycobacterium bovis subsp bovis AF2122/97
aaucggagccgucgagc

SEQ ID NO: 3113907 - RNA, 23 nt, Mycobacterium bovis subsp bovis AF2122/97
aaucggagucuucaacgucgaga

SEQ ID NO: 3113908 - RNA, 16 nt, Mycobacterium bovis subsp bovis AF2122/97
aaucggauagccgugc

SEQ ID NO: 3113909 - RNA, 12 nt, Mycobacterium bovis subsp bovis AF2122/97
aaucggcaccgu

SEQ ID NO: 3113910 - RNA, 18 nt, Mycobacterium bovis subsp bovis AF2122/97
aaucggcaggauucccuc

SEQ ID NO: 3113911 - RNA, 20 nt, Mycobacterium bovis subsp bovis AF2122/97
aaucggcaggauucccucga

SEQ ID NO: 3113912 - RNA, 14 nt, Mycobacterium bovis subsp bovis AF2122/97
aaucggcaucggcg

SEQ ID NO: 3113913 - RNA, 13 nt, Mycobacterium bovis subsp bovis AF2122/97
aaucggccaucau

SEQ ID NO: 3113914 - RNA, 13 nt, Mycobacterium bovis subsp bovis AF2122/97
aaucgguggucgu

SEQ ID NO: 3113915 - RNA, 15 nt, Mycobacterium bovis subsp bovis AF2122/97
aaucgguggugcggu

SEQ ID NO: 3113916 - RNA, 18 nt, Mycobacterium bovis subsp bovis AF2122/97
aaucgucaguaccgcacg

SEQ ID NO: 3113917 - RNA, 13 nt, Mycobacterium bovis subsp bovis AF2122/97
aaucgugcgggua

SEQ ID NO: 3113918 - RNA, 23 nt, Mycobacterium bovis subsp bovis AF2122/97
aaucgugcggguaauacggcgcc

SEQ ID NO: 3113919 - RNA, 21 nt, Mycobacterium bovis subsp bovis AF2122/97
aaucguguugucaggacaugc

SEQ ID NO: 3113920 - RNA, 12 nt, Mycobacterium bovis subsp bovis AF2122/97
aaucguuugugu

SEQ ID NO: 3113921 - RNA, 21 nt, Mycobacterium bovis subsp bovis AF2122/97
aaucuaauucgccucgccuga

SEQ ID NO: 3113922 - RNA, 21 nt, Mycobacterium bovis subsp bovis AF2122/97
aaucuccggcuggcccaccuc

SEQ ID NO: 3113923 - RNA, 14 nt, Mycobacterium bovis subsp bovis AF2122/97
aaucucgaucuugg

SEQ ID NO: 3113924 - RNA, 19 nt, Mycobacterium bovis subsp bovis AF2122/97
aaucucgcccccagugcac

SEQ ID NO: 3113925 - RNA, 17 nt, Mycobacterium bovis subsp bovis AF2122/97
aaucucgguggugcgcu

SEQ ID NO: 3113926 - RNA, 20 nt, Mycobacterium bovis subsp bovis AF2122/97
aaucucgguggugcgcucgc

SEQ ID NO: 3113927 - RNA, 22 nt, Mycobacterium bovis subsp bovis AF2122/97
aaucucguuccacugugcgagc

SEQ ID NO: 3113928 - RNA, 17 nt, Mycobacterium bovis subsp bovis AF2122/97
aaucuuugguagucugc

SEQ ID NO: 3113929 - RNA, 22 nt, Mycobacterium bovis subsp bovis AF2122/97
aaugacaucgucgccagggccg

SEQ ID NO: 3113930 - RNA, 17 nt, Mycobacterium bovis subsp bovis AF2122/97
aaugacccacacaccga

SEQ ID NO: 3113931 - RNA, 14 nt, Mycobacterium bovis subsp bovis AF2122/97
aaugaccugcagcg

SEQ ID NO: 3113932 - RNA, 16 nt, Mycobacterium bovis subsp bovis AF2122/97
aaugaccugcagcgca

SEQ ID NO: 3113933 - RNA, 18 nt, Mycobacterium bovis subsp bovis AF2122/97
aaugcaacuccucgaccg

SEQ ID NO: 3113934 - RNA, 20 nt, Mycobacterium bovis subsp bovis AF2122/97
aaugcaagaccguuacacca

SEQ ID NO: 3113935 - RNA, 18 nt, Mycobacterium bovis subsp bovis AF2122/97
aaugcaucgcggcggcgc

SEQ ID NO: 3113936 - RNA, 15 nt, Mycobacterium bovis subsp bovis AF2122/97
aaugccaccgcggcc

SEQ ID NO: 3113937 - RNA, 18 nt, Mycobacterium bovis subsp bovis AF2122/97
aaugccaccgcggccgcg

SEQ ID NO: 3113938 - RNA, 20 nt, Mycobacterium bovis subsp bovis AF2122/97
aaugccaccucgacgcaccu

SEQ ID NO: 3113939 - RNA, 22 nt, Mycobacterium bovis subsp bovis AF2122/97
aaugcccagguguguggcggcg

SEQ ID NO: 3113940 - RNA, 23 nt, Mycobacterium bovis subsp bovis AF2122/97
aaugccgacucaggucggugcgg

SEQ ID NO: 3113941 - RNA, 20 nt, Mycobacterium bovis subsp bovis AF2122/97
aaugccgcgugggcaugcgg

SEQ ID NO: 3113942 - RNA, 16 nt, Mycobacterium bovis subsp bovis AF2122/97
aaugccgcucucggcg

SEQ ID NO: 3113943 - RNA, 13 nt, Mycobacterium bovis subsp bovis AF2122/97
aaugccggccgcg

SEQ ID NO: 3113944 - RNA, 12 nt, Mycobacterium bovis subsp bovis AF2122/97
aaugccgguggu

SEQ ID NO: 3113945 - RNA, 14 nt, Mycobacterium bovis subsp bovis AF2122/97
aaugccugcugguc

SEQ ID NO: 3113946 - RNA, 12 nt, Mycobacterium bovis subsp bovis AF2122/97
aaugccuggccc

SEQ ID NO: 3113947 - RNA, 19 nt, Mycobacterium bovis subsp bovis AF2122/97
aaugccuggcccgucggcg

SEQ ID NO: 3113948 - RNA, 11 nt, Mycobacterium bovis subsp bovis AF2122/97
aaugcgagcgc

SEQ ID NO: 3113949 - RNA, 19 nt, Mycobacterium bovis subsp bovis AF2122/97
aaugcgcuggcgccgccgg

SEQ ID NO: 3113950 - RNA, 22 nt, Mycobacterium bovis subsp bovis AF2122/97
aaugcgcuggcgccgccggugc

SEQ ID NO: 3113951 - RNA, 18 nt, Mycobacterium bovis subsp bovis AF2122/97
aaugcgcuugaugccggc

SEQ ID NO: 3113952 - RNA, 15 nt, Mycobacterium bovis subsp bovis AF2122/97
aaugcugcugcagca

SEQ ID NO: 3113953 - RNA, 13 nt, Mycobacterium bovis subsp bovis AF2122/97
aaugcuggcggcg

SEQ ID NO: 3113954 - RNA, 17 nt, Mycobacterium bovis subsp bovis AF2122/97
aaugcuggggccugguc

SEQ ID NO: 3113955 - RNA, 15 nt, Mycobacterium bovis subsp bovis AF2122/97
acaaccgcugcugcu

SEQ ID NO: 3113956 - RNA, 16 nt, Mycobacterium bovis subsp bovis AF2122/97
acaaccgcugcugcug

SEQ ID NO: 3113957 - RNA, 19 nt, Mycobacterium bovis subsp bovis AF2122/97
acaaccgcugcugcugccc

SEQ ID NO: 3113958 - RNA, 22 nt, Mycobacterium bovis subsp bovis AF2122/97
acaaccgguccugggauccggc

SEQ ID NO: 3113959 - RNA, 18 nt, Mycobacterium bovis subsp bovis AF2122/97
acaaccgugagcaccagc

SEQ ID NO: 3113960 - RNA, 19 nt, Mycobacterium bovis subsp bovis AF2122/97
acaaccgugagcaccagca

SEQ ID NO: 3113961 - RNA, 22 nt, Mycobacterium bovis subsp bovis AF2122/97
acaaccgugagcaccagcagca

SEQ ID NO: 3113962 - RNA, 23 nt, Mycobacterium bovis subsp bovis AF2122/97
acaaccgugagcaccagcagcac

SEQ ID NO: 3113963 - RNA, 17 nt, Mycobacterium bovis subsp bovis AF2122/97
acaaccuggggccacca

SEQ ID NO: 3113964 - RNA, 15 nt, Mycobacterium bovis subsp bovis AF2122/97
acaacgacgucgccg

SEQ ID NO: 3113965 - RNA, 20 nt, Mycobacterium bovis subsp bovis AF2122/97
acaacgcaauauccuccagc

SEQ ID NO: 3113966 - RNA, 17 nt, Mycobacterium bovis subsp bovis AF2122/97
acaacgcccaccacgcg

SEQ ID NO: 3113967 - RNA, 13 nt, Mycobacterium bovis subsp bovis AF2122/97
acaacgccgcgac

SEQ ID NO: 3113968 - RNA, 15 nt, Mycobacterium bovis subsp bovis AF2122/97
acaacgccgcgacgu

SEQ ID NO: 3113969 - RNA, 22 nt, Mycobacterium bovis subsp bovis AF2122/97
acaacgccgucgauguggcgcu

SEQ ID NO: 3113970 - RNA, 16 nt, Mycobacterium bovis subsp bovis AF2122/97
acaacgccucgccauc

SEQ ID NO: 3113971 - RNA, 16 nt, Mycobacterium bovis subsp bovis AF2122/97
acaacgcgacgccgcu

SEQ ID NO: 3113972 - RNA, 17 nt, Mycobacterium bovis subsp bovis AF2122/97
acaacgcgcaaccagcc

SEQ ID NO: 3113973 - RNA, 20 nt, Mycobacterium bovis subsp bovis AF2122/97
acaacggccacaugccacag

SEQ ID NO: 3113974 - RNA, 14 nt, Mycobacterium bovis subsp bovis AF2122/97
acaacggcgcggca

SEQ ID NO: 3113975 - RNA, 16 nt, Mycobacterium bovis subsp bovis AF2122/97
acaacgggauccgcgc

SEQ ID NO: 3113976 - RNA, 19 nt, Mycobacterium bovis subsp bovis AF2122/97
acaacgggauccgcgcgcu

SEQ ID NO: 3113977 - RNA, 21 nt, Mycobacterium bovis subsp bovis AF2122/97
acaacgggccuucagcucacc

SEQ ID NO: 3113978 - RNA, 16 nt, Mycobacterium bovis subsp bovis AF2122/97
acaacgucgccgcggc

SEQ ID NO: 3113979 - RNA, 17 nt, Mycobacterium bovis subsp bovis AF2122/97
acaacgucgccgcggcg

SEQ ID NO: 3113980 - RNA, 20 nt, Mycobacterium bovis subsp bovis AF2122/97
acaacgucgccgcggcggca

SEQ ID NO: 3113981 - RNA, 22 nt, Mycobacterium bovis subsp bovis AF2122/97
acaacuaucgucgugucgccgc

SEQ ID NO: 3113982 - RNA, 13 nt, Mycobacterium bovis subsp bovis AF2122/97
acaacuccagcag

SEQ ID NO: 3113983 - RNA, 22 nt, Mycobacterium bovis subsp bovis AF2122/97
acaacucgcgaagcaucgcguu

SEQ ID NO: 3113984 - RNA, 22 nt, Mycobacterium bovis subsp bovis AF2122/97
acaacucuucggcggacaggcc

SEQ ID NO: 3113985 - RNA, 17 nt, Mycobacterium bovis subsp bovis AF2122/97
acaacuggugggccauc

SEQ ID NO: 3113986 - RNA, 22 nt, Mycobacterium bovis subsp bovis AF2122/97
acaacuggugggccaucgucag

SEQ ID NO: 3113987 - RNA, 16 nt, Mycobacterium bovis subsp bovis AF2122/97
acaacuguccugccag

SEQ ID NO: 3113988 - RNA, 15 nt, Mycobacterium bovis subsp bovis AF2122/97
acaagaauggccgcc

SEQ ID NO: 3113989 - RNA, 22 nt, Mycobacterium bovis subsp bovis AF2122/97
acaagaccggcgggcagauggu

SEQ ID NO: 3113990 - RNA, 22 nt, Mycobacterium bovis subsp bovis AF2122/97
acaagaucagacccagcgcggc

SEQ ID NO: 3113991 - RNA, 22 nt, Mycobacterium bovis subsp bovis AF2122/97
acaagauucgcucaccaccgac

SEQ ID NO: 3113992 - RNA, 15 nt, Mycobacterium bovis subsp bovis AF2122/97
acaagccugccggcu

SEQ ID NO: 3113993 - RNA, 14 nt, Mycobacterium bovis subsp bovis AF2122/97
acaagcugacacga

SEQ ID NO: 3113994 - RNA, 22 nt, Mycobacterium bovis subsp bovis AF2122/97
acaaggcaaaggaugaugaaca

SEQ ID NO: 3113995 - RNA, 15 nt, Mycobacterium bovis subsp bovis AF2122/97
acaaggccaagcgcc

SEQ ID NO: 3113996 - RNA, 18 nt, Mycobacterium bovis subsp bovis AF2122/97
acaaggccaagcgccaac

SEQ ID NO: 3113997 - RNA, 17 nt, Mycobacterium bovis subsp bovis AF2122/97
acaaggggcagcacguc

SEQ ID NO: 3113998 - RNA, 12 nt, Mycobacterium bovis subsp bovis AF2122/97
acaagguguggu

SEQ ID NO: 3113999 - RNA, 16 nt, Mycobacterium bovis subsp bovis AF2122/97
acaaguaccgcaucga

SEQ ID NO: 3114000 - RNA, 22 nt, Mycobacterium bovis subsp bovis AF2122/97
acaagucaagauugaccgcggc

SEQ ID NO: 3114001 - RNA, 21 nt, Mycobacterium bovis subsp bovis AF2122/97
acaagucgaccaugagccggc

SEQ ID NO: 3114002 - RNA, 20 nt, Mycobacterium bovis subsp bovis AF2122/97
acaagugcccggccaaccac

SEQ ID NO: 3114003 - RNA, 14 nt, Mycobacterium bovis subsp bovis AF2122/97
acaagugccggcgc

SEQ ID NO: 3114004 - RNA, 15 nt, Mycobacterium bovis subsp bovis AF2122/97
acaaguuuauggucu

SEQ ID NO: 3114005 - RNA, 16 nt, Mycobacterium bovis subsp bovis AF2122/97
acaauaggcuccagcg

SEQ ID NO: 3114006 - RNA, 17 nt, Mycobacterium bovis subsp bovis AF2122/97
acaauaggcuccagcgc

SEQ ID NO: 3114007 - RNA, 13 nt, Mycobacterium bovis subsp bovis AF2122/97
acaaucaccgccg

SEQ ID NO: 3114008 - RNA, 16 nt, Mycobacterium bovis subsp bovis AF2122/97
acaaucaccgccgcga

SEQ ID NO: 3114009 - RNA, 18 nt, Mycobacterium bovis subsp bovis AF2122/97
acaaucaccgccgcgacc

SEQ ID NO: 3114010 - RNA, 20 nt, Mycobacterium bovis subsp bovis AF2122/97
acaauccacgucgcggcguu

SEQ ID NO: 3114011 - RNA, 16 nt, Mycobacterium bovis subsp bovis AF2122/97
acaaucucggccgcau

SEQ ID NO: 3114012 - RNA, 13 nt, Mycobacterium bovis subsp bovis AF2122/97
acaaugucggcga

SEQ ID NO: 3114013 - RNA, 20 nt, Mycobacterium bovis subsp bovis AF2122/97
acaauucacgcaccacaaac

SEQ ID NO: 3114014 - RNA, 13 nt, Mycobacterium bovis subsp bovis AF2122/97
acacaccgagcgc

SEQ ID NO: 3114015 - RNA, 19 nt, Mycobacterium bovis subsp bovis AF2122/97
acacaccgcauaaggccca

SEQ ID NO: 3114016 - RNA, 17 nt, Mycobacterium bovis subsp bovis AF2122/97
acacaccguaccgacga

SEQ ID NO: 3114017 - RNA, 14 nt, Mycobacterium bovis subsp bovis AF2122/97
acacagcaugguua

SEQ ID NO: 3114018 - RNA, 12 nt, Mycobacterium bovis subsp bovis AF2122/97
acacagccgcgc

SEQ ID NO: 3114019 - RNA, 14 nt, Mycobacterium bovis subsp bovis AF2122/97
acacagccgguggc

SEQ ID NO: 3114020 - RNA, 18 nt, Mycobacterium bovis subsp bovis AF2122/97
acacagccgucgcaccag

SEQ ID NO: 3114021 - RNA, 19 nt, Mycobacterium bovis subsp bovis AF2122/97
acacagccgucgcaccaga

SEQ ID NO: 3114022 - RNA, 22 nt, Mycobacterium bovis subsp bovis AF2122/97
acacagcggcgggucccgccac

SEQ ID NO: 3114023 - RNA, 22 nt, Mycobacterium bovis subsp bovis AF2122/97
acacaggacuuguccaucacau

SEQ ID NO: 3114024 - RNA, 16 nt, Mycobacterium bovis subsp bovis AF2122/97
acacagucacggaccg

SEQ ID NO: 3114025 - RNA, 14 nt, Mycobacterium bovis subsp bovis AF2122/97
acacagucggugca

SEQ ID NO: 3114026 - RNA, 20 nt, Mycobacterium bovis subsp bovis AF2122/97
acacaucgucacugccaccu

SEQ ID NO: 3114027 - RNA, 13 nt, Mycobacterium bovis subsp bovis AF2122/97
acacauugaccag

SEQ ID NO: 3114028 - RNA, 14 nt, Mycobacterium bovis subsp bovis AF2122/97
acacauugaccagg

SEQ ID NO: 3114029 - RNA, 21 nt, Mycobacterium bovis subsp bovis AF2122/97
acacauuucuuugggcggccc

SEQ ID NO: 3114030 - RNA, 22 nt, Mycobacterium bovis subsp bovis AF2122/97
acacauuucuuugggcggccca

SEQ ID NO: 3114031 - RNA, 14 nt, Mycobacterium bovis subsp bovis AF2122/97
acaccaacccaccc

SEQ ID NO: 3114032 - RNA, 16 nt, Mycobacterium bovis subsp bovis AF2122/97
acaccaccagcacgcu

SEQ ID NO: 3114033 - RNA, 14 nt, Mycobacterium bovis subsp bovis AF2122/97
acaccaccauuccc

SEQ ID NO: 3114034 - RNA, 13 nt, Mycobacterium bovis subsp bovis AF2122/97
acaccaccgccag

SEQ ID NO: 3114035 - RNA, 14 nt, Mycobacterium bovis subsp bovis AF2122/97
acaccaccgccaga

SEQ ID NO: 3114036 - RNA, 15 nt, Mycobacterium bovis subsp bovis AF2122/97
acaccaccgcccgca

SEQ ID NO: 3114037 - RNA, 21 nt, Mycobacterium bovis subsp bovis AF2122/97
acaccacgagcguagcgaccu

SEQ ID NO: 3114038 - RNA, 19 nt, Mycobacterium bovis subsp bovis AF2122/97
acaccacgauggcggccac

SEQ ID NO: 3114039 - RNA, 22 nt, Mycobacterium bovis subsp bovis AF2122/97
acaccacgauggcggccaccgu

SEQ ID NO: 3114040 - RNA, 21 nt, Mycobacterium bovis subsp bovis AF2122/97
acaccacgcuuaacagcgggu

SEQ ID NO: 3114041 - RNA, 22 nt, Mycobacterium bovis subsp bovis AF2122/97
acaccggggacgucgacuucgc

SEQ ID NO: 3114042 - RNA, 14 nt, Mycobacterium bovis subsp bovis AF2122/97
acaccggggcggcc

SEQ ID NO: 3114043 - RNA, 23 nt, Mycobacterium bovis subsp bovis AF2122/97
acaccgguaacgccaacaccggc

SEQ ID NO: 3114044 - RNA, 18 nt, Mycobacterium bovis subsp bovis AF2122/97
acaccggugcgaccaaca

SEQ ID NO: 3114045 - RNA, 17 nt, Mycobacterium bovis subsp bovis AF2122/97
acaccgguggacccggc

SEQ ID NO: 3114046 - RNA, 18 nt, Mycobacterium bovis subsp bovis AF2122/97
acaccgguggacccggcg

SEQ ID NO: 3114047 - RNA, 16 nt, Mycobacterium bovis subsp bovis AF2122/97
acaccgguggcuucaa

SEQ ID NO: 3114048 - RNA, 18 nt, Mycobacterium bovis subsp bovis AF2122/97
acaccggugucggccagc

SEQ ID NO: 3114049 - RNA, 20 nt, Mycobacterium bovis subsp bovis AF2122/97
acaccggugucggccagcaa

SEQ ID NO: 3114050 - RNA, 22 nt, Mycobacterium bovis subsp bovis AF2122/97
acaccggugucggccagcaacu

SEQ ID NO: 3114051 - RNA, 15 nt, Mycobacterium bovis subsp bovis AF2122/97
acaccguaccgacga

SEQ ID NO: 3114052 - RNA, 13 nt, Mycobacterium bovis subsp bovis AF2122/97
acaccgucacgcc

SEQ ID NO: 3114053 - RNA, 16 nt, Mycobacterium bovis subsp bovis AF2122/97
acaccguccgucggcg

SEQ ID NO: 3114054 - RNA, 18 nt, Mycobacterium bovis subsp bovis AF2122/97
acaccguccgucggcgcu

SEQ ID NO: 3114055 - RNA, 19 nt, Mycobacterium bovis subsp bovis AF2122/97
acaccguccgucggcgcuc

SEQ ID NO: 3114056 - RNA, 16 nt, Mycobacterium bovis subsp bovis AF2122/97
acaccgucggcagcag

SEQ ID NO: 3114057 - RNA, 18 nt, Mycobacterium bovis subsp bovis AF2122/97
acaccgucggcagcagcg

SEQ ID NO: 3114058 - RNA, 18 nt, Mycobacterium bovis subsp bovis AF2122/97
acaccgugaccagccggu

SEQ ID NO: 3114059 - RNA, 19 nt, Mycobacterium bovis subsp bovis AF2122/97
acaccgugaccgccgcgcc

SEQ ID NO: 3114060 - RNA, 18 nt, Mycobacterium bovis subsp bovis AF2122/97
acaccgugcaccagcuca

SEQ ID NO: 3114061 - RNA, 16 nt, Mycobacterium bovis subsp bovis AF2122/97
acaccgugcgccgaau

SEQ ID NO: 3114062 - RNA, 13 nt, Mycobacterium bovis subsp bovis AF2122/97
acaccgugucgcc

SEQ ID NO: 3114063 - RNA, 14 nt, Mycobacterium bovis subsp bovis AF2122/97
acaccgugucgccg

SEQ ID NO: 3114064 - RNA, 18 nt, Mycobacterium bovis subsp bovis AF2122/97
acaccgugucgccggcga

SEQ ID NO: 3114065 - RNA, 14 nt, Mycobacterium bovis subsp bovis AF2122/97
acaccguguugcug

SEQ ID NO: 3114066 - RNA, 17 nt, Mycobacterium bovis subsp bovis AF2122/97
acaccuaugggaccggc

SEQ ID NO: 3114067 - RNA, 19 nt, Mycobacterium bovis subsp bovis AF2122/97
acaccuccgucagcgccgc

SEQ ID NO: 3114068 - RNA, 13 nt, Mycobacterium bovis subsp bovis AF2122/97
acaccuccucgag

SEQ ID NO: 3114069 - RNA, 13 nt, Mycobacterium bovis subsp bovis AF2122/97
acaccuccugccu

SEQ ID NO: 3114070 - RNA, 15 nt, Mycobacterium bovis subsp bovis AF2122/97
acaccuccugccuuu

SEQ ID NO: 3114071 - RNA, 19 nt, Mycobacterium bovis subsp bovis AF2122/97
acaccucgaaggcacugcg

SEQ ID NO: 3114072 - RNA, 17 nt, Mycobacterium bovis subsp bovis AF2122/97
acaccucgagcgcggcg

SEQ ID NO: 3114073 - RNA, 23 nt, Mycobacterium bovis subsp bovis AF2122/97
acaccuguaguucgaugacugaa

SEQ ID NO: 3114074 - RNA, 16 nt, Mycobacterium bovis subsp bovis AF2122/97
acaccuuggccgccgg

SEQ ID NO: 3114075 - RNA, 20 nt, Mycobacterium bovis subsp bovis AF2122/97
acaccuuggccgccggccgc

SEQ ID NO: 3114076 - RNA, 14 nt, Mycobacterium bovis subsp bovis AF2122/97
acaccuugggcagc

SEQ ID NO: 3114077 - RNA, 23 nt, Mycobacterium bovis subsp bovis AF2122/97
acaccuuguggacccgccagggc

SEQ ID NO: 3114078 - RNA, 22 nt, Mycobacterium bovis subsp bovis AF2122/97
acacgaagucgaacggcuuggc

SEQ ID NO: 3114079 - RNA, 17 nt, Mycobacterium bovis subsp bovis AF2122/97
acacgaauccggccacu

SEQ ID NO: 3114080 - RNA, 18 nt, Mycobacterium bovis subsp bovis AF2122/97
acacgaauccggccacuc

SEQ ID NO: 3114081 - RNA, 18 nt, Mycobacterium bovis subsp bovis AF2122/97
acacgacugucccgcgca

SEQ ID NO: 3114082 - RNA, 16 nt, Mycobacterium bovis subsp bovis AF2122/97
acacgagucgccagac

SEQ ID NO: 3114083 - RNA, 20 nt, Mycobacterium bovis subsp bovis AF2122/97
acacgagucgccagaccgca

SEQ ID NO: 3114084 - RNA, 15 nt, Mycobacterium bovis subsp bovis AF2122/97
acacgauaucgggcu

SEQ ID NO: 3114085 - RNA, 23 nt, Mycobacterium bovis subsp bovis AF2122/97
acacgauaucgggcucagcggcg

SEQ ID NO: 3114086 - RNA, 13 nt, Mycobacterium bovis subsp bovis AF2122/97
acacgccagccgg

SEQ ID NO: 3114087 - RNA, 12 nt, Mycobacterium bovis subsp bovis AF2122/97
acacgccaggug

SEQ ID NO: 3114088 - RNA, 20 nt, Mycobacterium bovis subsp bovis AF2122/97
acacgcccuaacccugcccu

SEQ ID NO: 3114089 - RNA, 15 nt, Mycobacterium bovis subsp bovis AF2122/97
acacgcccucgacgc

SEQ ID NO: 3114090 - RNA, 20 nt, Mycobacterium bovis subsp bovis AF2122/97
acacgcccucgacgccgcgc

SEQ ID NO: 3114091 - RNA, 21 nt, Mycobacterium bovis subsp bovis AF2122/97
acacgcccucgacgccgcgca

SEQ ID NO: 3114092 - RNA, 18 nt, Mycobacterium bovis subsp bovis AF2122/97
acacgccgaacgugcaac

SEQ ID NO: 3114093 - RNA, 21 nt, Mycobacterium bovis subsp bovis AF2122/97
acacgccgaggucuccggugc

SEQ ID NO: 3114094 - RNA, 18 nt, Mycobacterium bovis subsp bovis AF2122/97
acacgccgccggugucgg

SEQ ID NO: 3114095 - RNA, 13 nt, Mycobacterium bovis subsp bovis AF2122/97
acacgccggcccg

SEQ ID NO: 3114096 - RNA, 17 nt, Mycobacterium bovis subsp bovis AF2122/97
acacgccgugcgugcgg

SEQ ID NO: 3114097 - RNA, 20 nt, Mycobacterium bovis subsp bovis AF2122/97
acacgcggucccacucgucg

SEQ ID NO: 3114098 - RNA, 18 nt, Mycobacterium bovis subsp bovis AF2122/97
acacggauacccuuugca

SEQ ID NO: 3114099 - RNA, 14 nt, Mycobacterium bovis subsp bovis AF2122/97
acacggcagcugca

SEQ ID NO: 3114100 - RNA, 19 nt, Mycobacterium bovis subsp bovis AF2122/97
acacggcgacauacccgau

SEQ ID NO: 3114101 - RNA, 17 nt, Mycobacterium bovis subsp bovis AF2122/97
acacggcggcccgcucg

SEQ ID NO: 3114102 - RNA, 23 nt, Mycobacterium bovis subsp bovis AF2122/97
acacggcgucuuccucggccacc

SEQ ID NO: 3114103 - RNA, 17 nt, Mycobacterium bovis subsp bovis AF2122/97
acacgggaagccgcgcc

SEQ ID NO: 3114104 - RNA, 19 nt, Mycobacterium bovis subsp bovis AF2122/97
acacggggccgccagcugc

SEQ ID NO: 3114105 - RNA, 21 nt, Mycobacterium bovis subsp bovis AF2122/97
acacggucaccggcacgucgc

SEQ ID NO: 3114106 - RNA, 14 nt, Mycobacterium bovis subsp bovis AF2122/97
acacguaccggucc

SEQ ID NO: 3114107 - RNA, 13 nt, Mycobacterium bovis subsp bovis AF2122/97
acacguccagugg

SEQ ID NO: 3114108 - RNA, 17 nt, Mycobacterium bovis subsp bovis AF2122/97
acacguccaguggcagc

SEQ ID NO: 3114109 - RNA, 19 nt, Mycobacterium bovis subsp bovis AF2122/97
acacguccgcgcaccgcag

SEQ ID NO: 3114110 - RNA, 13 nt, Mycobacterium bovis subsp bovis AF2122/97
acacgucgagcag

SEQ ID NO: 3114111 - RNA, 20 nt, Mycobacterium bovis subsp bovis AF2122/97
acacgucgcgguaggcggga

SEQ ID NO: 3114112 - RNA, 14 nt, Mycobacterium bovis subsp bovis AF2122/97
acacgugggugauc

SEQ ID NO: 3114113 - RNA, 20 nt, Mycobacterium bovis subsp bovis AF2122/97
acacguucucaccaccagag

SEQ ID NO: 3114114 - RNA, 20 nt, Mycobacterium bovis subsp bovis AF2122/97
acacuagcccgguaucgucc

SEQ ID NO: 3114115 - RNA, 15 nt, Mycobacterium bovis subsp bovis AF2122/97
acacucccauccgcc

SEQ ID NO: 3114116 - RNA, 17 nt, Mycobacterium bovis subsp bovis AF2122/97
acacuccugcacacagg

SEQ ID NO: 3114117 - RNA, 17 nt, Mycobacterium bovis subsp bovis AF2122/97
acacucgaagucgccca

SEQ ID NO: 3114118 - RNA, 13 nt, Mycobacterium bovis subsp bovis AF2122/97
acacugcugcggc

SEQ ID NO: 3114119 - RNA, 23 nt, Mycobacterium bovis subsp bovis AF2122/97
acacuggucgcggcgcuggcugc

SEQ ID NO: 3114120 - RNA, 20 nt, Mycobacterium bovis subsp bovis AF2122/97
acagacaggauugccgagcg

SEQ ID NO: 3114121 - RNA, 15 nt, Mycobacterium bovis subsp bovis AF2122/97
acagaccgaacagca

SEQ ID NO: 3114122 - RNA, 17 nt, Mycobacterium bovis subsp bovis AF2122/97
acagaccgggcaccaga

SEQ ID NO: 3114123 - RNA, 17 nt, Mycobacterium bovis subsp bovis AF2122/97
acagaccgggcccggcg

SEQ ID NO: 3114124 - RNA, 15 nt, Mycobacterium bovis subsp bovis AF2122/97
acagaccuagcaccg

SEQ ID NO: 3114125 - RNA, 16 nt, Mycobacterium bovis subsp bovis AF2122/97
acagaccuagcaccgc

SEQ ID NO: 3114126 - RNA, 18 nt, Mycobacterium bovis subsp bovis AF2122/97
acagacggcucagcgugc

SEQ ID NO: 3114127 - RNA, 16 nt, Mycobacterium bovis subsp bovis AF2122/97
acagacggggucgccc

SEQ ID NO: 3114128 - RNA, 22 nt, Mycobacterium bovis subsp bovis AF2122/97
acagcucgcgcucgcucacgcc

SEQ ID NO: 3114129 - RNA, 14 nt, Mycobacterium bovis subsp bovis AF2122/97
acagcugacgagcc

SEQ ID NO: 3114130 - RNA, 14 nt, Mycobacterium bovis subsp bovis AF2122/97
acagcugaucccag

SEQ ID NO: 3114131 - RNA, 16 nt, Mycobacterium bovis subsp bovis AF2122/97
acagcugcacacagag

SEQ ID NO: 3114132 - RNA, 14 nt, Mycobacterium bovis subsp bovis AF2122/97
acagcugcccgcca

SEQ ID NO: 3114133 - RNA, 16 nt, Mycobacterium bovis subsp bovis AF2122/97
acagcugcccgccagc

SEQ ID NO: 3114134 - RNA, 13 nt, Mycobacterium bovis subsp bovis AF2122/97
acagcuggcggca

SEQ ID NO: 3114135 - RNA, 15 nt, Mycobacterium bovis subsp bovis AF2122/97
acagcuguugauuga

SEQ ID NO: 3114136 - RNA, 22 nt, Mycobacterium bovis subsp bovis AF2122/97
acaggaagucgcggacgucgcc

SEQ ID NO: 3114137 - RNA, 13 nt, Mycobacterium bovis subsp bovis AF2122/97
acaggaccgggau

SEQ ID NO: 3114138 - RNA, 20 nt, Mycobacterium bovis subsp bovis AF2122/97
acaggaccggugggucugcu

SEQ ID NO: 3114139 - RNA, 13 nt, Mycobacterium bovis subsp bovis AF2122/97
acaggacgucggc

SEQ ID NO: 3114140 - RNA, 19 nt, Mycobacterium bovis subsp bovis AF2122/97
acaggagacgguacgccag

SEQ ID NO: 3114141 - RNA, 22 nt, Mycobacterium bovis subsp bovis AF2122/97
acaggaucagcgacuugcuggc

SEQ ID NO: 3114142 - RNA, 18 nt, Mycobacterium bovis subsp bovis AF2122/97
acaggcaucggaggaacc

SEQ ID NO: 3114143 - RNA, 20 nt, Mycobacterium bovis subsp bovis AF2122/97
acaggcauuuucacugugcc

SEQ ID NO: 3114144 - RNA, 17 nt, Mycobacterium bovis subsp bovis AF2122/97
acaggcccgccagcagg

SEQ ID NO: 3114145 - RNA, 15 nt, Mycobacterium bovis subsp bovis AF2122/97
acaggcccggcaccg

SEQ ID NO: 3114146 - RNA, 15 nt, Mycobacterium bovis subsp bovis AF2122/97
acaggcccgguggcg

SEQ ID NO: 3114147 - RNA, 20 nt, Mycobacterium bovis subsp bovis AF2122/97
acaggccgaagcucacacug

SEQ ID NO: 3114148 - RNA, 21 nt, Mycobacterium bovis subsp bovis AF2122/97
acaggccgagcagauacuugu

SEQ ID NO: 3114149 - RNA, 15 nt, Mycobacterium bovis subsp bovis AF2122/97
acaggccgccaccgu

SEQ ID NO: 3114150 - RNA, 14 nt, Mycobacterium bovis subsp bovis AF2122/97
acaggccggccacc

SEQ ID NO: 3114151 - RNA, 21 nt, Mycobacterium bovis subsp bovis AF2122/97
acaggccggccaccaccgcgc

SEQ ID NO: 3114152 - RNA, 24 nt, Mycobacterium bovis subsp bovis AF2122/97
acaggccggccaccaccgcgccgu

SEQ ID NO: 3114153 - RNA, 14 nt, Mycobacterium bovis subsp bovis AF2122/97
acaggccggcucgc

SEQ ID NO: 3114154 - RNA, 22 nt, Mycobacterium bovis subsp bovis AF2122/97
acaggcgcagcgucucgugaac

SEQ ID NO: 3114155 - RNA, 18 nt, Mycobacterium bovis subsp bovis AF2122/97
acaggcggccagcaucgc

SEQ ID NO: 3114156 - RNA, 17 nt, Mycobacterium bovis subsp bovis AF2122/97
acaggcguccaucgcca

SEQ ID NO: 3114157 - RNA, 20 nt, Mycobacterium bovis subsp bovis AF2122/97
acaggcguccaucgccaccg

SEQ ID NO: 3114158 - RNA, 16 nt, Mycobacterium bovis subsp bovis AF2122/97
acaggcugaagacgaa

SEQ ID NO: 3114159 - RNA, 20 nt, Mycobacterium bovis subsp bovis AF2122/97
acaggcugccauuccagauc

SEQ ID NO: 3114160 - RNA, 20 nt, Mycobacterium bovis subsp bovis AF2122/97
acaggcuugacugcacacca

SEQ ID NO: 3114161 - RNA, 21 nt, Mycobacterium bovis subsp bovis AF2122/97
acaggcuugacugcacaccac

SEQ ID NO: 3114162 - RNA, 23 nt, Mycobacterium bovis subsp bovis AF2122/97
acaggcuugacugcacaccaccg

SEQ ID NO: 3114163 - RNA, 14 nt, Mycobacterium bovis subsp bovis AF2122/97
acagggaggucgcc

SEQ ID NO: 3114164 - RNA, 16 nt, Mycobacterium bovis subsp bovis AF2122/97
acagggccuugaucgg

SEQ ID NO: 3114165 - RNA, 18 nt, Mycobacterium bovis subsp bovis AF2122/97
acagggcggcaacggcgg

SEQ ID NO: 3114166 - RNA, 16 nt, Mycobacterium bovis subsp bovis AF2122/97
acaggggccagcgcgc

SEQ ID NO: 3114167 - RNA, 21 nt, Mycobacterium bovis subsp bovis AF2122/97
acagguaagcagccagcaaca

SEQ ID NO: 3114168 - RNA, 21 nt, Mycobacterium bovis subsp bovis AF2122/97
acagguaggguucuucgacgc

SEQ ID NO: 3114169 - RNA, 15 nt, Mycobacterium bovis subsp bovis AF2122/97
acagguagucgccgg

SEQ ID NO: 3114170 - RNA, 12 nt, Mycobacterium bovis subsp bovis AF2122/97
acaggucagcgc

SEQ ID NO: 3114171 - RNA, 14 nt, Mycobacterium bovis subsp bovis AF2122/97
acaggucagcgcug

SEQ ID NO: 3114172 - RNA, 13 nt, Mycobacterium bovis subsp bovis AF2122/97
acaggucgaaugg

SEQ ID NO: 3114173 - RNA, 18 nt, Mycobacterium bovis subsp bovis AF2122/97
acaggucgcccaacaccg

SEQ ID NO: 3114174 - RNA, 19 nt, Mycobacterium bovis subsp bovis AF2122/97
acaggucgccggggccgcu

SEQ ID NO: 3114175 - RNA, 13 nt, Mycobacterium bovis subsp bovis AF2122/97
acaggucggccca

SEQ ID NO: 3114176 - RNA, 22 nt, Mycobacterium bovis subsp bovis AF2122/97
acaggugcaggucgugcuccca

SEQ ID NO: 3114177 - RNA, 15 nt, Mycobacterium bovis subsp bovis AF2122/97
acaggugccaaacgc

SEQ ID NO: 3114178 - RNA, 14 nt, Mycobacterium bovis subsp bovis AF2122/97
acaggugccagacc

SEQ ID NO: 3114179 - RNA, 19 nt, Mycobacterium bovis subsp bovis AF2122/97
acaguaggccuccgcugcc

SEQ ID NO: 3114180 - RNA, 12 nt, Mycobacterium bovis subsp bovis AF2122/97
acaguccgcgcc

SEQ ID NO: 3114181 - RNA, 20 nt, Mycobacterium bovis subsp bovis AF2122/97
acagucgaccggacacuccu

SEQ ID NO: 3114182 - RNA, 19 nt, Mycobacterium bovis subsp bovis AF2122/97
acagucgcagcacggcuuc

SEQ ID NO: 3114183 - RNA, 12 nt, Mycobacterium bovis subsp bovis AF2122/97
acagucgcagcc

SEQ ID NO: 3114184 - RNA, 21 nt, Mycobacterium bovis subsp bovis AF2122/97
acagucgcagucgcuaagacu

SEQ ID NO: 3114185 - RNA, 23 nt, Mycobacterium bovis subsp bovis AF2122/97
acagucggugcagcgcacgcagc

SEQ ID NO: 3114186 - RNA, 13 nt, Mycobacterium bovis subsp bovis AF2122/97
acagugccucgcg

SEQ ID NO: 3114187 - RNA, 11 nt, Mycobacterium bovis subsp bovis AF2122/97
acaguggcgcg

SEQ ID NO: 3114188 - RNA, 20 nt, Mycobacterium bovis subsp bovis AF2122/97
acaguggggguccggcggcc

SEQ ID NO: 3114189 - RNA, 16 nt, Mycobacterium bovis subsp bovis AF2122/97
acaguggugggcguga

SEQ ID NO: 3114190 - RNA, 17 nt, Mycobacterium bovis subsp bovis AF2122/97
acagugguuagucggcc

SEQ ID NO: 3114191 - RNA, 21 nt, Mycobacterium bovis subsp bovis AF2122/97
acagugucgauagcccgccac

SEQ ID NO: 3114192 - RNA, 14 nt, Mycobacterium bovis subsp bovis AF2122/97
acagugucugccau

SEQ ID NO: 3114193 - RNA, 19 nt, Mycobacterium bovis subsp bovis AF2122/97
acagugugaagaccaccgc

SEQ ID NO: 3114194 - RNA, 17 nt, Mycobacterium bovis subsp bovis AF2122/97
acaguuaucagccgcgc

SEQ ID NO: 3114195 - RNA, 18 nt, Mycobacterium bovis subsp bovis AF2122/97
acaguucggcgagcacau

SEQ ID NO: 3114196 - RNA, 20 nt, Mycobacterium bovis subsp bovis AF2122/97
acaguugcccgacgccgguc

SEQ ID NO: 3114197 - RNA, 15 nt, Mycobacterium bovis subsp bovis AF2122/97
acaguuuucaccgcg

SEQ ID NO: 3114198 - RNA, 21 nt, Mycobacterium bovis subsp bovis AF2122/97
acauaccccgaacauugcgcc

SEQ ID NO: 3114199 - RNA, 16 nt, Mycobacterium bovis subsp bovis AF2122/97
acauacgaaacaugcg

SEQ ID NO: 3114200 - RNA, 17 nt, Mycobacterium bovis subsp bovis AF2122/97
acauagccggucauuuc

SEQ ID NO: 3114201 - RNA, 19 nt, Mycobacterium bovis subsp bovis AF2122/97
acauagcgauucgcgcugc

SEQ ID NO: 3114202 - RNA, 13 nt, Mycobacterium bovis subsp bovis AF2122/97
acauaggcgaucg

SEQ ID NO: 3114203 - RNA, 17 nt, Mycobacterium bovis subsp bovis AF2122/97
acauaggucacaaacgg

SEQ ID NO: 3114204 - RNA, 16 nt, Mycobacterium bovis subsp bovis AF2122/97
acaucaaagucggcgu

SEQ ID NO: 3114205 - RNA, 20 nt, Mycobacterium bovis subsp bovis AF2122/97
acaucaaagucggcgucacg

SEQ ID NO: 3114206 - RNA, 15 nt, Mycobacterium bovis subsp bovis AF2122/97
acaucaacuugccgc

SEQ ID NO: 3114207 - RNA, 15 nt, Mycobacterium bovis subsp bovis AF2122/97
acaucaccaccgacc

SEQ ID NO: 3114208 - RNA, 13 nt, Mycobacterium bovis subsp bovis AF2122/97
acaucaccacgau

SEQ ID NO: 3114209 - RNA, 17 nt, Mycobacterium bovis subsp bovis AF2122/97
acaucaccgaacggcga

SEQ ID NO: 3114210 - RNA, 15 nt, Mycobacterium bovis subsp bovis AF2122/97
acaucaccggcaugc

SEQ ID NO: 3114211 - RNA, 12 nt, Mycobacterium bovis subsp bovis AF2122/97
acaucacucgcg

SEQ ID NO: 3114212 - RNA, 15 nt, Mycobacterium bovis subsp bovis AF2122/97
acaucaggucggcga

SEQ ID NO: 3114213 - RNA, 18 nt, Mycobacterium bovis subsp bovis AF2122/97
acaucagugcgccggcga

SEQ ID NO: 3114214 - RNA, 20 nt, Mycobacterium bovis subsp bovis AF2122/97
acaucaugccagccgucacc

SEQ ID NO: 3114215 - RNA, 21 nt, Mycobacterium bovis subsp bovis AF2122/97
acauuggcgaucagcagccgc

SEQ ID NO: 3114216 - RNA, 16 nt, Mycobacterium bovis subsp bovis AF2122/97
acauuggcuccgaaca

SEQ ID NO: 3114217 - RNA, 19 nt, Mycobacterium bovis subsp bovis AF2122/97
acauugguaucugucggga

SEQ ID NO: 3114218 - RNA, 13 nt, Mycobacterium bovis subsp bovis AF2122/97
acauugugcucgc

SEQ ID NO: 3114219 - RNA, 21 nt, Mycobacterium bovis subsp bovis AF2122/97
acauuucccagucauccaacg

SEQ ID NO: 3114220 - RNA, 23 nt, Mycobacterium bovis subsp bovis AF2122/97
acauuucuuugggcggcccaccg

SEQ ID NO: 3114221 - RNA, 22 nt, Mycobacterium bovis subsp bovis AF2122/97
acauuuuuguuguuauuuuugg

SEQ ID NO: 3114222 - RNA, 20 nt, Mycobacterium bovis subsp bovis AF2122/97
accaaaccgcuguaaccggu

SEQ ID NO: 3114223 - RNA, 16 nt, Mycobacterium bovis subsp bovis AF2122/97
accaaaccgucaacuu

SEQ ID NO: 3114224 - RNA, 13 nt, Mycobacterium bovis subsp bovis AF2122/97
accaaacgcugcu

SEQ ID NO: 3114225 - RNA, 16 nt, Mycobacterium bovis subsp bovis AF2122/97
accaaacggauugcuc

SEQ ID NO: 3114226 - RNA, 18 nt, Mycobacterium bovis subsp bovis AF2122/97
accaaagcgacgagcagc

SEQ ID NO: 3114227 - RNA, 20 nt, Mycobacterium bovis subsp bovis AF2122/97
accaaauccgcaaggaccug

SEQ ID NO: 3114228 - RNA, 17 nt, Mycobacterium bovis subsp bovis AF2122/97
accaacaccgcccgcaa

SEQ ID NO: 3114229 - RNA, 14 nt, Mycobacterium bovis subsp bovis AF2122/97
accaacaccgcggc

SEQ ID NO: 3114230 - RNA, 11 nt, Mycobacterium bovis subsp bovis AF2122/97
accaacaccgg

SEQ ID NO: 3114231 - RNA, 18 nt, Mycobacterium bovis subsp bovis AF2122/97
accaacaggauggugcgg

SEQ ID NO: 3114232 - RNA, 17 nt, Mycobacterium bovis subsp bovis AF2122/97
accaacauacagcaauc

SEQ ID NO: 3114233 - RNA, 17 nt, Mycobacterium bovis subsp bovis AF2122/97
accaacccaccccccag

SEQ ID NO: 3114234 - RNA, 24 nt, Mycobacterium bovis subsp bovis AF2122/97
accaacccucgccggucagcgugc

SEQ ID NO: 3114235 - RNA, 21 nt, Mycobacterium bovis subsp bovis AF2122/97
accaaccgggacaaccccuug

SEQ ID NO: 3114236 - RNA, 16 nt, Mycobacterium bovis subsp bovis AF2122/97
accaaccucaucgcgg

SEQ ID NO: 3114237 - RNA, 17 nt, Mycobacterium bovis subsp bovis AF2122/97
accaaccucaucgcggu

SEQ ID NO: 3114238 - RNA, 21 nt, Mycobacterium bovis subsp bovis AF2122/97
accaaccucggaucgccaggc

SEQ ID NO: 3114239 - RNA, 14 nt, Mycobacterium bovis subsp bovis AF2122/97
accaacgacagcga

SEQ ID NO: 3114240 - RNA, 16 nt, Mycobacterium bovis subsp bovis AF2122/97
accaacgcaacacggg

SEQ ID NO: 3114241 - RNA, 13 nt, Mycobacterium bovis subsp bovis AF2122/97
accaacgcgggaa

SEQ ID NO: 3114242 - RNA, 21 nt, Mycobacterium bovis subsp bovis AF2122/97
accaacgcgggaacgaugccg

SEQ ID NO: 3114243 - RNA, 22 nt, Mycobacterium bovis subsp bovis AF2122/97
accaacgcgggaacgaugccgc

SEQ ID NO: 3114244 - RNA, 16 nt, Mycobacterium bovis subsp bovis AF2122/97
accaacgcuucugccu

SEQ ID NO: 3114245 - RNA, 15 nt, Mycobacterium bovis subsp bovis AF2122/97
accaacgucgcuccg

SEQ ID NO: 3114246 - RNA, 23 nt, Mycobacterium bovis subsp bovis AF2122/97
accaacucucgcgggauggacag

SEQ ID NO: 3114247 - RNA, 16 nt, Mycobacterium bovis subsp bovis AF2122/97
accaagacaccggccu

SEQ ID NO: 3114248 - RNA, 13 nt, Mycobacterium bovis subsp bovis AF2122/97
accaagcgcgcca

SEQ ID NO: 3114249 - RNA, 17 nt, Mycobacterium bovis subsp bovis AF2122/97
accaagcucggccagca

SEQ ID NO: 3114250 - RNA, 18 nt, Mycobacterium bovis subsp bovis AF2122/97
accaagcucggccagcac

SEQ ID NO: 3114251 - RNA, 18 nt, Mycobacterium bovis subsp bovis AF2122/97
accaaggacgaacgcgcc

SEQ ID NO: 3114252 - RNA, 22 nt, Mycobacterium bovis subsp bovis AF2122/97
accaaggccgccugcaacaucc

SEQ ID NO: 3114253 - RNA, 23 nt, Mycobacterium bovis subsp bovis AF2122/97
accaagggauccgaagagccagc

SEQ ID NO: 3114254 - RNA, 21 nt, Mycobacterium bovis subsp bovis AF2122/97
accaaggugagcagcaagacc

SEQ ID NO: 3114255 - RNA, 22 nt, Mycobacterium bovis subsp bovis AF2122/97
accaaggugagcagcaagaccg

SEQ ID NO: 3114256 - RNA, 18 nt, Mycobacterium bovis subsp bovis AF2122/97
accaagguguccagcacc

SEQ ID NO: 3114257 - RNA, 21 nt, Mycobacterium bovis subsp bovis AF2122/97
accaagucaugcccacgcugc

SEQ ID NO: 3114258 - RNA, 15 nt, Mycobacterium bovis subsp bovis AF2122/97
accaagugucgccgc

SEQ ID NO: 3114259 - RNA, 21 nt, Mycobacterium bovis subsp bovis AF2122/97
accaaguugaccuucaccugg

SEQ ID NO: 3114260 - RNA, 15 nt, Mycobacterium bovis subsp bovis AF2122/97
accaauaugcccggg

SEQ ID NO: 3114261 - RNA, 12 nt, Mycobacterium bovis subsp bovis AF2122/97
accaauccacug

SEQ ID NO: 3114262 - RNA, 17 nt, Mycobacterium bovis subsp bovis AF2122/97
accaauccaggccaccc

SEQ ID NO: 3114263 - RNA, 17 nt, Mycobacterium bovis subsp bovis AF2122/97
accaaucgcacgccagc

SEQ ID NO: 3114264 - RNA, 15 nt, Mycobacterium bovis subsp bovis AF2122/97
accaaugaccgccag

SEQ ID NO: 3114265 - RNA, 19 nt, Mycobacterium bovis subsp bovis AF2122/97
accaaugaccgccagcagc

SEQ ID NO: 3114266 - RNA, 18 nt, Mycobacterium bovis subsp bovis AF2122/97
accaaugcgucgaugcgc

SEQ ID NO: 3114267 - RNA, 22 nt, Mycobacterium bovis subsp bovis AF2122/97
accaaugcgucgaugcgcugcu

SEQ ID NO: 3114268 - RNA, 19 nt, Mycobacterium bovis subsp bovis AF2122/97
accaaugcguugacgucga

SEQ ID NO: 3114269 - RNA, 22 nt, Mycobacterium bovis subsp bovis AF2122/97
accaaugcuccugguggcagaa

SEQ ID NO: 3114270 - RNA, 16 nt, Mycobacterium bovis subsp bovis AF2122/97
accaaugucagugccc

SEQ ID NO: 3114271 - RNA, 19 nt, Mycobacterium bovis subsp bovis AF2122/97
accaaugucagugccccgc

SEQ ID NO: 3114272 - RNA, 18 nt, Mycobacterium bovis subsp bovis AF2122/97
accaauucccgcgcggcg

SEQ ID NO: 3114273 - RNA, 17 nt, Mycobacterium bovis subsp bovis AF2122/97
accaauugcccuuuccc

SEQ ID NO: 3114274 - RNA, 16 nt, Mycobacterium bovis subsp bovis AF2122/97
accaauuggucgaguc

SEQ ID NO: 3114275 - RNA, 16 nt, Mycobacterium bovis subsp bovis AF2122/97
accacaaccgugagca

SEQ ID NO: 3114276 - RNA, 22 nt, Mycobacterium bovis subsp bovis AF2122/97
accacaaccgugagcaccagca

SEQ ID NO: 3114277 - RNA, 13 nt, Mycobacterium bovis subsp bovis AF2122/97
accacaacgccag

SEQ ID NO: 3114278 - RNA, 14 nt, Mycobacterium bovis subsp bovis AF2122/97
accacaauccacgc

SEQ ID NO: 3114279 - RNA, 18 nt, Mycobacterium bovis subsp bovis AF2122/97
accacaccgugaccagcc

SEQ ID NO: 3114280 - RNA, 12 nt, Mycobacterium bovis subsp bovis AF2122/97
accacaccuucg

SEQ ID NO: 3114281 - RNA, 13 nt, Mycobacterium bovis subsp bovis AF2122/97
accacacuggcag

SEQ ID NO: 3114282 - RNA, 16 nt, Mycobacterium bovis subsp bovis AF2122/97
accacaucaugccagc

SEQ ID NO: 3114283 - RNA, 24 nt, Mycobacterium bovis subsp bovis AF2122/97
accacaucggugccacguucgcgg

SEQ ID NO: 3114284 - RNA, 21 nt, Mycobacterium bovis subsp bovis AF2122/97
accacaucgguguggcccaac

SEQ ID NO: 3114285 - RNA, 20 nt, Mycobacterium bovis subsp bovis AF2122/97
accacaugcgagucgcacuc

SEQ ID NO: 3114286 - RNA, 22 nt, Mycobacterium bovis subsp bovis AF2122/97
accacauuggcgaucagcagcc

SEQ ID NO: 3114287 - RNA, 21 nt, Mycobacterium bovis subsp bovis AF2122/97
accaccaagcucggccagcac

SEQ ID NO: 3114288 - RNA, 22 nt, Mycobacterium bovis subsp bovis AF2122/97
accaccaagcucggccagcacg

SEQ ID NO: 3114289 - RNA, 13 nt, Mycobacterium bovis subsp bovis AF2122/97
accaccacccgga

SEQ ID NO: 3114290 - RNA, 14 nt, Mycobacterium bovis subsp bovis AF2122/97
accaccaccgccgc

SEQ ID NO: 3114291 - RNA, 15 nt, Mycobacterium bovis subsp bovis AF2122/97
accaccaccgccgcc

SEQ ID NO: 3114292 - RNA, 16 nt, Mycobacterium bovis subsp bovis AF2122/97
accaccaccgccgccg

SEQ ID NO: 3114293 - RNA, 15 nt, Mycobacterium bovis subsp bovis AF2122/97
accaccaccggcaac

SEQ ID NO: 3114294 - RNA, 14 nt, Mycobacterium bovis subsp bovis AF2122/97
accaccacggccag

SEQ ID NO: 3114295 - RNA, 18 nt, Mycobacterium bovis subsp bovis AF2122/97
accaccacuaggucgccg

SEQ ID NO: 3114296 - RNA, 22 nt, Mycobacterium bovis subsp bovis AF2122/97
accaccacuaggucgccggcca

SEQ ID NO: 3114297 - RNA, 21 nt, Mycobacterium bovis subsp bovis AF2122/97
accaccacuucggcgccgcgc

SEQ ID NO: 3114298 - RNA, 22 nt, Mycobacterium bovis subsp bovis AF2122/97
accaccacuucggcgccgcgcc

SEQ ID NO: 3114299 - RNA, 14 nt, Mycobacterium bovis subsp bovis AF2122/97
accaccagcacggc

SEQ ID NO: 3114300 - RNA, 13 nt, Mycobacterium bovis subsp bovis AF2122/97
accaccagcgcuc

SEQ ID NO: 3114301 - RNA, 19 nt, Mycobacterium bovis subsp bovis AF2122/97
accacgaggcuugcggcac

SEQ ID NO: 3114302 - RNA, 19 nt, Mycobacterium bovis subsp bovis AF2122/97
accacgaucaacucgugcg

SEQ ID NO: 3114303 - RNA, 17 nt, Mycobacterium bovis subsp bovis AF2122/97
accacgaucgcgagccc

SEQ ID NO: 3114304 - RNA, 23 nt, Mycobacterium bovis subsp bovis AF2122/97
accacgaucgcgagcccauggac

SEQ ID NO: 3114305 - RNA, 23 nt, Mycobacterium bovis subsp bovis AF2122/97
accacgaugaucuugccgcggcg

SEQ ID NO: 3114306 - RNA, 12 nt, Mycobacterium bovis subsp bovis AF2122/97
accacgcaccgc

SEQ ID NO: 3114307 - RNA, 23 nt, Mycobacterium bovis subsp bovis AF2122/97
accacgcccgacgaggaugucga

SEQ ID NO: 3114308 - RNA, 14 nt, Mycobacterium bovis subsp bovis AF2122/97
accacgccgacgug

SEQ ID NO: 3114309 - RNA, 23 nt, Mycobacterium bovis subsp bovis AF2122/97
accacgcgagggcauccgagcgg

SEQ ID NO: 3114310 - RNA, 16 nt, Mycobacterium bovis subsp bovis AF2122/97
accacgcgcccgcacc

SEQ ID NO: 3114311 - RNA, 17 nt, Mycobacterium bovis subsp bovis AF2122/97
accacgcgcccgcacca

SEQ ID NO: 3114312 - RNA, 18 nt, Mycobacterium bovis subsp bovis AF2122/97
accacgcgcgucggugug

SEQ ID NO: 3114313 - RNA, 22 nt, Mycobacterium bovis subsp bovis AF2122/97
accacgcgcguuuagucuccgg

SEQ ID NO: 3114314 - RNA, 21 nt, Mycobacterium bovis subsp bovis AF2122/97
accacgcguuucgaaccgcac

SEQ ID NO: 3114315 - RNA, 16 nt, Mycobacterium bovis subsp bovis AF2122/97
accacgcuccccagcg

SEQ ID NO: 3114316 - RNA, 17 nt, Mycobacterium bovis subsp bovis AF2122/97
accacgcuuaacagcgg

SEQ ID NO: 3114317 - RNA, 18 nt, Mycobacterium bovis subsp bovis AF2122/97
accacggaggguugccgc

SEQ ID NO: 3114318 - RNA, 21 nt, Mycobacterium bovis subsp bovis AF2122/97
accacggaggguugccgccga

SEQ ID NO: 3114319 - RNA, 15 nt, Mycobacterium bovis subsp bovis AF2122/97
accacggcagccaac

SEQ ID NO: 3114320 - RNA, 21 nt, Mycobacterium bovis subsp bovis AF2122/97
accacggcagccaaccggcgc

SEQ ID NO: 3114321 - RNA, 22 nt, Mycobacterium bovis subsp bovis AF2122/97
accacggcagccaaccggcgca

SEQ ID NO: 3114322 - RNA, 13 nt, Mycobacterium bovis subsp bovis AF2122/97
accacggcgcagu

SEQ ID NO: 3114323 - RNA, 19 nt, Mycobacterium bovis subsp bovis AF2122/97
accacggcgcgcgcgccgg

SEQ ID NO: 3114324 - RNA, 20 nt, Mycobacterium bovis subsp bovis AF2122/97
accacggcggcaucaccugg

SEQ ID NO: 3114325 - RNA, 15 nt, Mycobacterium bovis subsp bovis AF2122/97
accacggcggccacc

SEQ ID NO: 3114326 - RNA, 23 nt, Mycobacterium bovis subsp bovis AF2122/97
accacggcggcggcguagcagaa

SEQ ID NO: 3114327 - RNA, 15 nt, Mycobacterium bovis subsp bovis AF2122/97
accacggcguugccg

SEQ ID NO: 3114328 - RNA, 16 nt, Mycobacterium bovis subsp bovis AF2122/97
accacggcguugccgc

SEQ ID NO: 3114329 - RNA, 19 nt, Mycobacterium bovis subsp bovis AF2122/97
accacggcguugccgccgg

SEQ ID NO: 3114330 - RNA, 22 nt, Mycobacterium bovis subsp bovis AF2122/97
accacggcguugccgccggcuc

SEQ ID NO: 3114331 - RNA, 22 nt, Mycobacterium bovis subsp bovis AF2122/97
accacgguagacaagucggcgc

SEQ ID NO: 3114332 - RNA, 17 nt, Mycobacterium bovis subsp bovis AF2122/97
accacggucaagccggc

SEQ ID NO: 3114333 - RNA, 18 nt, Mycobacterium bovis subsp bovis AF2122/97
accacggucaagccggcg

SEQ ID NO: 3114334 - RNA, 16 nt, Mycobacterium bovis subsp bovis AF2122/97
accacggucagcacgc

SEQ ID NO: 3114335 - RNA, 21 nt, Mycobacterium bovis subsp bovis AF2122/97
accacggucugccacgaggca

SEQ ID NO: 3114336 - RNA, 16 nt, Mycobacterium bovis subsp bovis AF2122/97
accacggugaguuggc

SEQ ID NO: 3114337 - RNA, 23 nt, Mycobacterium bovis subsp bovis AF2122/97
accacgguuggccaccagcuggc

SEQ ID NO: 3114338 - RNA, 20 nt, Mycobacterium bovis subsp bovis AF2122/97
accacgucgagguccaccac

SEQ ID NO: 3114339 - RNA, 13 nt, Mycobacterium bovis subsp bovis AF2122/97
accacgucgucgg

SEQ ID NO: 3114340 - RNA, 23 nt, Mycobacterium bovis subsp bovis AF2122/97
accacgugcgagggcacggcggu

SEQ ID NO: 3114341 - RNA, 22 nt, Mycobacterium bovis subsp bovis AF2122/97
accacguggcccuccucgguga

SEQ ID NO: 3114342 - RNA, 14 nt, Mycobacterium bovis subsp bovis AF2122/97
accacuagcggcuc

SEQ ID NO: 3114343 - RNA, 19 nt, Mycobacterium bovis subsp bovis AF2122/97
accacuagcggcucaccgc

SEQ ID NO: 3114344 - RNA, 20 nt, Mycobacterium bovis subsp bovis AF2122/97
accacuagcggcucaccgcg

SEQ ID NO: 3114345 - RNA, 21 nt, Mycobacterium bovis subsp bovis AF2122/97
accacuagcggcucaccgcgc

SEQ ID NO: 3114346 - RNA, 16 nt, Mycobacterium bovis subsp bovis AF2122/97
accacuaggucgccgg

SEQ ID NO: 3114347 - RNA, 18 nt, Mycobacterium bovis subsp bovis AF2122/97
accacuaggucgccggcc

SEQ ID NO: 3114348 - RNA, 13 nt, Mycobacterium bovis subsp bovis AF2122/97
accacucgagcgc

SEQ ID NO: 3114349 - RNA, 14 nt, Mycobacterium bovis subsp bovis AF2122/97
accacucgccggcg

SEQ ID NO: 3114350 - RNA, 15 nt, Mycobacterium bovis subsp bovis AF2122/97
accacucgccggcgg

SEQ ID NO: 3114351 - RNA, 18 nt, Mycobacterium bovis subsp bovis AF2122/97
accacucggucguugccg

SEQ ID NO: 3114352 - RNA, 22 nt, Mycobacterium bovis subsp bovis AF2122/97
accacugcaugaacugcucgcc

SEQ ID NO: 3114353 - RNA, 19 nt, Mycobacterium bovis subsp bovis AF2122/97
accacugcgcccgccacgu

SEQ ID NO: 3114354 - RNA, 18 nt, Mycobacterium bovis subsp bovis AF2122/97
accacugugacacccgag

SEQ ID NO: 3114355 - RNA, 18 nt, Mycobacterium bovis subsp bovis AF2122/97
accacuguuacggccaca

SEQ ID NO: 3114356 - RNA, 23 nt, Mycobacterium bovis subsp bovis AF2122/97
accacuguuacggccacaccguc

SEQ ID NO: 3114357 - RNA, 18 nt, Mycobacterium bovis subsp bovis AF2122/97
accacuguuggugccgcc

SEQ ID NO: 3114358 - RNA, 19 nt, Mycobacterium bovis subsp bovis AF2122/97
accacuguuggugccgcca

SEQ ID NO: 3114359 - RNA, 23 nt, Mycobacterium bovis subsp bovis AF2122/97
accacuguuggugccgccaccac

SEQ ID NO: 3114360 - RNA, 19 nt, Mycobacterium bovis subsp bovis AF2122/97
accacuguuucugagcgcg

SEQ ID NO: 3114361 - RNA, 14 nt, Mycobacterium bovis subsp bovis AF2122/97
accacuucggcgcc

SEQ ID NO: 3114362 - RNA, 13 nt, Mycobacterium bovis subsp bovis AF2122/97
accacuucggcgu

SEQ ID NO: 3114363 - RNA, 18 nt, Mycobacterium bovis subsp bovis AF2122/97
accacuuuccggccgaug

SEQ ID NO: 3114364 - RNA, 15 nt, Mycobacterium bovis subsp bovis AF2122/97
accagaaacaccgac

SEQ ID NO: 3114365 - RNA, 12 nt, Mycobacterium bovis subsp bovis AF2122/97
accagaaccagc

SEQ ID NO: 3114366 - RNA, 17 nt, Mycobacterium bovis subsp bovis AF2122/97
accagaaccuggagccg

SEQ ID NO: 3114367 - RNA, 14 nt, Mycobacterium bovis subsp bovis AF2122/97
accagaacgacgcc

SEQ ID NO: 3114368 - RNA, 23 nt, Mycobacterium bovis subsp bovis AF2122/97
accagaacgacgccgcggucgug

SEQ ID NO: 3114369 - RNA, 13 nt, Mycobacterium bovis subsp bovis AF2122/97
accagaagcagug

SEQ ID NO: 3114370 - RNA, 20 nt, Mycobacterium bovis subsp bovis AF2122/97
accagacacuggccgucggc

SEQ ID NO: 3114371 - RNA, 22 nt, Mycobacterium bovis subsp bovis AF2122/97
accagacacuggccgucggcgu

SEQ ID NO: 3114372 - RNA, 13 nt, Mycobacterium bovis subsp bovis AF2122/97
accagacugcagu

SEQ ID NO: 3114373 - RNA, 22 nt, Mycobacterium bovis subsp bovis AF2122/97
accagagcacgggcucgcugca

SEQ ID NO: 3114374 - RNA, 18 nt, Mycobacterium bovis subsp bovis AF2122/97
accagagcgucgaacacg

SEQ ID NO: 3114375 - RNA, 24 nt, Mycobacterium bovis subsp bovis AF2122/97
accagaggcgugucgacuccgauc

SEQ ID NO: 3114376 - RNA, 20 nt, Mycobacterium bovis subsp bovis AF2122/97
accagaucaacaucaucacu

SEQ ID NO: 3114377 - RNA, 22 nt, Mycobacterium bovis subsp bovis AF2122/97
accagaucaacaucaucacugu

SEQ ID NO: 3114378 - RNA, 18 nt, Mycobacterium bovis subsp bovis AF2122/97
accagaucgacgcauucc

SEQ ID NO: 3114379 - RNA, 19 nt, Mycobacterium bovis subsp bovis AF2122/97
accagaucgacgcauuccu

SEQ ID NO: 3114380 - RNA, 16 nt, Mycobacterium bovis subsp bovis AF2122/97
accagaucgucgggca

SEQ ID NO: 3114381 - RNA, 17 nt, Mycobacterium bovis subsp bovis AF2122/97
accagaucgucgggcac

SEQ ID NO: 3114382 - RNA, 14 nt, Mycobacterium bovis subsp bovis AF2122/97
accagaugcaccuc

SEQ ID NO: 3114383 - RNA, 17 nt, Mycobacterium bovis subsp bovis AF2122/97
accagaugcaccucgcc

SEQ ID NO: 3114384 - RNA, 22 nt, Mycobacterium bovis subsp bovis AF2122/97
accagaugcaccucgcccugca

SEQ ID NO: 3114385 - RNA, 20 nt, Mycobacterium bovis subsp bovis AF2122/97
accagauugccgagcccagg

SEQ ID NO: 3114386 - RNA, 15 nt, Mycobacterium bovis subsp bovis AF2122/97
accagcaacagcccg

SEQ ID NO: 3114387 - RNA, 20 nt, Mycobacterium bovis subsp bovis AF2122/97
accagcguggggccgccacc

SEQ ID NO: 3114388 - RNA, 20 nt, Mycobacterium bovis subsp bovis AF2122/97
accagcguguagcgaugccg

SEQ ID NO: 3114389 - RNA, 17 nt, Mycobacterium bovis subsp bovis AF2122/97
accagcguuugaacgca

SEQ ID NO: 3114390 - RNA, 14 nt, Mycobacterium bovis subsp bovis AF2122/97
accagcucacccgg

SEQ ID NO: 3114391 - RNA, 17 nt, Mycobacterium bovis subsp bovis AF2122/97
accagcucacccugcuc

SEQ ID NO: 3114392 - RNA, 21 nt, Mycobacterium bovis subsp bovis AF2122/97
accagcuccucgugcucggcc

SEQ ID NO: 3114393 - RNA, 22 nt, Mycobacterium bovis subsp bovis AF2122/97
accagcuccucgugcucggcca

SEQ ID NO: 3114394 - RNA, 13 nt, Mycobacterium bovis subsp bovis AF2122/97
accagcuccugca

SEQ ID NO: 3114395 - RNA, 21 nt, Mycobacterium bovis subsp bovis AF2122/97
accagcugagccgucggcgcc

SEQ ID NO: 3114396 - RNA, 19 nt, Mycobacterium bovis subsp bovis AF2122/97
accagcugcgagucgucgc

SEQ ID NO: 3114397 - RNA, 20 nt, Mycobacterium bovis subsp bovis AF2122/97
accagcuguccucgcgggcu

SEQ ID NO: 3114398 - RNA, 14 nt, Mycobacterium bovis subsp bovis AF2122/97
accagcugucgggc

SEQ ID NO: 3114399 - RNA, 21 nt, Mycobacterium bovis subsp bovis AF2122/97
accaggaaugucuccaguagc

SEQ ID NO: 3114400 - RNA, 22 nt, Mycobacterium bovis subsp bovis AF2122/97
accaggaccggcugcaggugcu

SEQ ID NO: 3114401 - RNA, 16 nt, Mycobacterium bovis subsp bovis AF2122/97
accaggacguggucgg

SEQ ID NO: 3114402 - RNA, 18 nt, Mycobacterium bovis subsp bovis AF2122/97
accaggacguggucggga

SEQ ID NO: 3114403 - RNA, 23 nt, Mycobacterium bovis subsp bovis AF2122/97
accaggauuaagguguggucggc

SEQ ID NO: 3114404 - RNA, 20 nt, Mycobacterium bovis subsp bovis AF2122/97
accaggccaacggcgcugcc

SEQ ID NO: 3114405 - RNA, 23 nt, Mycobacterium bovis subsp bovis AF2122/97
accaggccacugccgaccagcgc

SEQ ID NO: 3114406 - RNA, 14 nt, Mycobacterium bovis subsp bovis AF2122/97
accaggccgagccg

SEQ ID NO: 3114407 - RNA, 17 nt, Mycobacterium bovis subsp bovis AF2122/97
accaggccgagccgccc

SEQ ID NO: 3114408 - RNA, 13 nt, Mycobacterium bovis subsp bovis AF2122/97
accaggccgagcu

SEQ ID NO: 3114409 - RNA, 15 nt, Mycobacterium bovis subsp bovis AF2122/97
accaggccgagcucg

SEQ ID NO: 3114410 - RNA, 13 nt, Mycobacterium bovis subsp bovis AF2122/97
accaggccgcgac

SEQ ID NO: 3114411 - RNA, 14 nt, Mycobacterium bovis subsp bovis AF2122/97
accaggccggugac

SEQ ID NO: 3114412 - RNA, 15 nt, Mycobacterium bovis subsp bovis AF2122/97
accaggccggugacg

SEQ ID NO: 3114413 - RNA, 16 nt, Mycobacterium bovis subsp bovis AF2122/97
accaggccguccucgg

SEQ ID NO: 3114414 - RNA, 13 nt, Mycobacterium bovis subsp bovis AF2122/97
accaggcgagccg

SEQ ID NO: 3114415 - RNA, 20 nt, Mycobacterium bovis subsp bovis AF2122/97
accaggcgagccggcgcgca

SEQ ID NO: 3114416 - RNA, 15 nt, Mycobacterium bovis subsp bovis AF2122/97
accaggcggacgccg

SEQ ID NO: 3114417 - RNA, 16 nt, Mycobacterium bovis subsp bovis AF2122/97
accaggcggccgcguc

SEQ ID NO: 3114418 - RNA, 22 nt, Mycobacterium bovis subsp bovis AF2122/97
accaggcggcgcgggucggcga

SEQ ID NO: 3114419 - RNA, 16 nt, Mycobacterium bovis subsp bovis AF2122/97
accaggcggucagguc

SEQ ID NO: 3114420 - RNA, 21 nt, Mycobacterium bovis subsp bovis AF2122/97
accaggcuaauagcucgccgg

SEQ ID NO: 3114421 - RNA, 23 nt, Mycobacterium bovis subsp bovis AF2122/97
accaggcuccggccggccagcac

SEQ ID NO: 3114422 - RNA, 21 nt, Mycobacterium bovis subsp bovis AF2122/97
accaggcugcagucgagcauc

SEQ ID NO: 3114423 - RNA, 20 nt, Mycobacterium bovis subsp bovis AF2122/97
accagggcacguucggcgca

SEQ ID NO: 3114424 - RNA, 14 nt, Mycobacterium bovis subsp bovis AF2122/97
accagggcagcggc

SEQ ID NO: 3114425 - RNA, 12 nt, Mycobacterium bovis subsp bovis AF2122/97
accagggccacc

SEQ ID NO: 3114426 - RNA, 17 nt, Mycobacterium bovis subsp bovis AF2122/97
accagggccgccgcugc

SEQ ID NO: 3114427 - RNA, 19 nt, Mycobacterium bovis subsp bovis AF2122/97
accagggccuccacccgcc

SEQ ID NO: 3114428 - RNA, 12 nt, Mycobacterium bovis subsp bovis AF2122/97
accagggccucg

SEQ ID NO: 3114429 - RNA, 18 nt, Mycobacterium bovis subsp bovis AF2122/97
accagggccucgaccgcc

SEQ ID NO: 3114430 - RNA, 16 nt, Mycobacterium bovis subsp bovis AF2122/97
accagggcgcaacgga

SEQ ID NO: 3114431 - RNA, 18 nt, Mycobacterium bovis subsp bovis AF2122/97
accaggggaccgcggcgc

SEQ ID NO: 3114432 - RNA, 14 nt, Mycobacterium bovis subsp bovis AF2122/97
accagggucugcuc

SEQ ID NO: 3114433 - RNA, 15 nt, Mycobacterium bovis subsp bovis AF2122/97
accagggugccggcg

SEQ ID NO: 3114434 - RNA, 16 nt, Mycobacterium bovis subsp bovis AF2122/97
accagggugccggcgg

SEQ ID NO: 3114435 - RNA, 16 nt, Mycobacterium bovis subsp bovis AF2122/97
accagguaaucaccug

SEQ ID NO: 3114436 - RNA, 17 nt, Mycobacterium bovis subsp bovis AF2122/97
accaggucauugccggc

SEQ ID NO: 3114437 - RNA, 19 nt, Mycobacterium bovis subsp bovis AF2122/97
accagguccaccccgccga

SEQ ID NO: 3114438 - RNA, 20 nt, Mycobacterium bovis subsp bovis AF2122/97
accagguccaccccgccgau

SEQ ID NO: 3114439 - RNA, 18 nt, Mycobacterium bovis subsp bovis AF2122/97
accaggucgccagcucgg

SEQ ID NO: 3114440 - RNA, 14 nt, Mycobacterium bovis subsp bovis AF2122/97
accaggucuucgac

SEQ ID NO: 3114441 - RNA, 18 nt, Mycobacterium bovis subsp bovis AF2122/97
accaggucuucgaccacg

SEQ ID NO: 3114442 - RNA, 16 nt, Mycobacterium bovis subsp bovis AF2122/97
accaggugccaggaug

SEQ ID NO: 3114443 - RNA, 14 nt, Mycobacterium bovis subsp bovis AF2122/97
accaggugcccgcc

SEQ ID NO: 3114444 - RNA, 16 nt, Mycobacterium bovis subsp bovis AF2122/97
accaggugcccgcccc

SEQ ID NO: 3114445 - RNA, 12 nt, Mycobacterium bovis subsp bovis AF2122/97
accaggugcgca

SEQ ID NO: 3114446 - RNA, 15 nt, Mycobacterium bovis subsp bovis AF2122/97
accagguggaccggc

SEQ ID NO: 3114447 - RNA, 22 nt, Mycobacterium bovis subsp bovis AF2122/97
accagguggaccggccuggcuc

SEQ ID NO: 3114448 - RNA, 15 nt, Mycobacterium bovis subsp bovis AF2122/97
accagguggccaggc

SEQ ID NO: 3114449 - RNA, 18 nt, Mycobacterium bovis subsp bovis AF2122/97
accagguggccaggccgu

SEQ ID NO: 3114450 - RNA, 15 nt, Mycobacterium bovis subsp bovis AF2122/97
accagguugccgagg

SEQ ID NO: 3114451 - RNA, 20 nt, Mycobacterium bovis subsp bovis AF2122/97
accaguaauacugccguucg

SEQ ID NO: 3114452 - RNA, 16 nt, Mycobacterium bovis subsp bovis AF2122/97
accaguaccaccggca

SEQ ID NO: 3114453 - RNA, 13 nt, Mycobacterium bovis subsp bovis AF2122/97
accaguccagcgg

SEQ ID NO: 3114454 - RNA, 21 nt, Mycobacterium bovis subsp bovis AF2122/97
accaguccucgggcaggcggc

SEQ ID NO: 3114455 - RNA, 16 nt, Mycobacterium bovis subsp bovis AF2122/97
accagucgucgcgcuc

SEQ ID NO: 3114456 - RNA, 15 nt, Mycobacterium bovis subsp bovis AF2122/97
accagugcagcucga

SEQ ID NO: 3114457 - RNA, 17 nt, Mycobacterium bovis subsp bovis AF2122/97
accagugccccgccgag

SEQ ID NO: 3114458 - RNA, 19 nt, Mycobacterium bovis subsp bovis AF2122/97
accagugcgguggcaggug

SEQ ID NO: 3114459 - RNA, 22 nt, Mycobacterium bovis subsp bovis AF2122/97
accaguguggcgaugaccacgc

SEQ ID NO: 3114460 - RNA, 15 nt, Mycobacterium bovis subsp bovis AF2122/97
accauaaaccgcugc

SEQ ID NO: 3114461 - RNA, 21 nt, Mycobacterium bovis subsp bovis AF2122/97
accauacuaauggcgccaccg

SEQ ID NO: 3114462 - RNA, 22 nt, Mycobacterium bovis subsp bovis AF2122/97
accauacuaauggcgccaccgg

SEQ ID NO: 3114463 - RNA, 23 nt, Mycobacterium bovis subsp bovis AF2122/97
accauagccugcgccgacccgcg

SEQ ID NO: 3114464 - RNA, 17 nt, Mycobacterium bovis subsp bovis AF2122/97
accauagucgccgucgu

SEQ ID NO: 3114465 - RNA, 14 nt, Mycobacterium bovis subsp bovis AF2122/97
accaucaccacggc

SEQ ID NO: 3114466 - RNA, 15 nt, Mycobacterium bovis subsp bovis AF2122/97
accaucaccacggcc

SEQ ID NO: 3114467 - RNA, 17 nt, Mycobacterium bovis subsp bovis AF2122/97
accaucaccacggccgc

SEQ ID NO: 3114468 - RNA, 12 nt, Mycobacterium bovis subsp bovis AF2122/97
accaucaccgcg

SEQ ID NO: 3114469 - RNA, 15 nt, Mycobacterium bovis subsp bovis AF2122/97
accaucaccgcgcca

SEQ ID NO: 3114470 - RNA, 17 nt, Mycobacterium bovis subsp bovis AF2122/97
accaucaccgcgccagc

SEQ ID NO: 3114471 - RNA, 20 nt, Mycobacterium bovis subsp bovis AF2122/97
accaucaccgcgccagccuc

SEQ ID NO: 3114472 - RNA, 22 nt, Mycobacterium bovis subsp bovis AF2122/97
accaucacgcccuguucuccgu

SEQ ID NO: 3114473 - RNA, 20 nt, Mycobacterium bovis subsp bovis AF2122/97
accauccccggcaacaaagg

SEQ ID NO: 3114474 - RNA, 16 nt, Mycobacterium bovis subsp bovis AF2122/97
acccagccagcagcgg

SEQ ID NO: 3114475 - RNA, 18 nt, Mycobacterium bovis subsp bovis AF2122/97
acccagccagcagcggcg

SEQ ID NO: 3114476 - RNA, 19 nt, Mycobacterium bovis subsp bovis AF2122/97
acccagccagcagcggcga

SEQ ID NO: 3114477 - RNA, 16 nt, Mycobacterium bovis subsp bovis AF2122/97
acccagccgcgccagc

SEQ ID NO: 3114478 - RNA, 19 nt, Mycobacterium bovis subsp bovis AF2122/97
acccagccgcgccagcucc

SEQ ID NO: 3114479 - RNA, 20 nt, Mycobacterium bovis subsp bovis AF2122/97
acccagccggccugucccgc

SEQ ID NO: 3114480 - RNA, 17 nt, Mycobacterium bovis subsp bovis AF2122/97
acccagcgacgcggcca

SEQ ID NO: 3114481 - RNA, 14 nt, Mycobacterium bovis subsp bovis AF2122/97
acccagcgcagcag

SEQ ID NO: 3114482 - RNA, 15 nt, Mycobacterium bovis subsp bovis AF2122/97
acccagcgcagcagc

SEQ ID NO: 3114483 - RNA, 16 nt, Mycobacterium bovis subsp bovis AF2122/97
acccagcgcagcagcg

SEQ ID NO: 3114484 - RNA, 19 nt, Mycobacterium bovis subsp bovis AF2122/97
acccagcgcagcagcggca

SEQ ID NO: 3114485 - RNA, 22 nt, Mycobacterium bovis subsp bovis AF2122/97
acccagcgccgacccaacccga

SEQ ID NO: 3114486 - RNA, 19 nt, Mycobacterium bovis subsp bovis AF2122/97
acccagcgcgcugggaagc

SEQ ID NO: 3114487 - RNA, 20 nt, Mycobacterium bovis subsp bovis AF2122/97
acccagcggagccacucggc

SEQ ID NO: 3114488 - RNA, 14 nt, Mycobacterium bovis subsp bovis AF2122/97
acccagcggcgcca

SEQ ID NO: 3114489 - RNA, 21 nt, Mycobacterium bovis subsp bovis AF2122/97
acccagcgguaucccccagcc

SEQ ID NO: 3114490 - RNA, 22 nt, Mycobacterium bovis subsp bovis AF2122/97
acccagcgguaucccccagccg

SEQ ID NO: 3114491 - RNA, 23 nt, Mycobacterium bovis subsp bovis AF2122/97
acccagcgguaucccccagccgc

SEQ ID NO: 3114492 - RNA, 19 nt, Mycobacterium bovis subsp bovis AF2122/97
acccagcgugcccgccacc

SEQ ID NO: 3114493 - RNA, 16 nt, Mycobacterium bovis subsp bovis AF2122/97
acccagcucgcgcacc

SEQ ID NO: 3114494 - RNA, 22 nt, Mycobacterium bovis subsp bovis AF2122/97
acccagcucgcgcacccagccc

SEQ ID NO: 3114495 - RNA, 17 nt, Mycobacterium bovis subsp bovis AF2122/97
acccaggaucagcccgg

SEQ ID NO: 3114496 - RNA, 19 nt, Mycobacterium bovis subsp bovis AF2122/97
acccaggcgccgaugucgu

SEQ ID NO: 3114497 - RNA, 22 nt, Mycobacterium bovis subsp bovis AF2122/97
acccagucccaacacggcgaca

SEQ ID NO: 3114498 - RNA, 14 nt, Mycobacterium bovis subsp bovis AF2122/97
acccagucggcgcc

SEQ ID NO: 3114499 - RNA, 15 nt, Mycobacterium bovis subsp bovis AF2122/97
acccagugccacgcc

SEQ ID NO: 3114500 - RNA, 16 nt, Mycobacterium bovis subsp bovis AF2122/97
acccagugccacgccu

SEQ ID NO: 3114501 - RNA, 17 nt, Mycobacterium bovis subsp bovis AF2122/97
acccagugccacgccug

SEQ ID NO: 3114502 - RNA, 16 nt, Mycobacterium bovis subsp bovis AF2122/97
acccaguuccacccgg

SEQ ID NO: 3114503 - RNA, 22 nt, Mycobacterium bovis subsp bovis AF2122/97
acccaguuccacccggugccgc

SEQ ID NO: 3114504 - RNA, 17 nt, Mycobacterium bovis subsp bovis AF2122/97
acccaguuucggcgucg

SEQ ID NO: 3114505 - RNA, 13 nt, Mycobacterium bovis subsp bovis AF2122/97
acccaucaccagc

SEQ ID NO: 3114506 - RNA, 15 nt, Mycobacterium bovis subsp bovis AF2122/97
acccaucaccagcgg

SEQ ID NO: 3114507 - RNA, 16 nt, Mycobacterium bovis subsp bovis AF2122/97
acccaucaccagcggc

SEQ ID NO: 3114508 - RNA, 15 nt, Mycobacterium bovis subsp bovis AF2122/97
acccaucaccgccag

SEQ ID NO: 3114509 - RNA, 16 nt, Mycobacterium bovis subsp bovis AF2122/97
acccaucaccgccagc

SEQ ID NO: 3114510 - RNA, 17 nt, Mycobacterium bovis subsp bovis AF2122/97
acccaucaccgccagcc

SEQ ID NO: 3114511 - RNA, 13 nt, Mycobacterium bovis subsp bovis AF2122/97
acccaucaucgcc

SEQ ID NO: 3114512 - RNA, 16 nt, Mycobacterium bovis subsp bovis AF2122/97
acccaucccguucagc

SEQ ID NO: 3114513 - RNA, 21 nt, Mycobacterium bovis subsp bovis AF2122/97
acccaucccguucagcgacca

SEQ ID NO: 3114514 - RNA, 15 nt, Mycobacterium bovis subsp bovis AF2122/97
acccaucgccagcau

SEQ ID NO: 3114515 - RNA, 17 nt, Mycobacterium bovis subsp bovis AF2122/97
acccaucgucgagccgc

SEQ ID NO: 3114516 - RNA, 19 nt, Mycobacterium bovis subsp bovis AF2122/97
acccaucgucgagccgcca

SEQ ID NO: 3114517 - RNA, 23 nt, Mycobacterium bovis subsp bovis AF2122/97
acccaucgucgagccgccagauu

SEQ ID NO: 3114518 - RNA, 23 nt, Mycobacterium bovis subsp bovis AF2122/97
acccaugccgaauaccgguggca

SEQ ID NO: 3114519 - RNA, 18 nt, Mycobacterium bovis subsp bovis AF2122/97
acccauggccucccacuc

SEQ ID NO: 3114520 - RNA, 20 nt, Mycobacterium bovis subsp bovis AF2122/97
acccauggccucccacucac

SEQ ID NO: 3114521 - RNA, 15 nt, Mycobacterium bovis subsp bovis AF2122/97
acccaugucggcgcg

SEQ ID NO: 3114522 - RNA, 15 nt, Mycobacterium bovis subsp bovis AF2122/97
acccauucggcggcg

SEQ ID NO: 3114523 - RNA, 18 nt, Mycobacterium bovis subsp bovis AF2122/97
acccauucucggccggcg

SEQ ID NO: 3114524 - RNA, 20 nt, Mycobacterium bovis subsp bovis AF2122/97
acccauucucggccggcggc

SEQ ID NO: 3114525 - RNA, 22 nt, Mycobacterium bovis subsp bovis AF2122/97
acccauuggaccgagacuugcu

SEQ ID NO: 3114526 - RNA, 16 nt, Mycobacterium bovis subsp bovis AF2122/97
accccaaaaccgccgg

SEQ ID NO: 3114527 - RNA, 18 nt, Mycobacterium bovis subsp bovis AF2122/97
accccaaaaccgccgguu

SEQ ID NO: 3114528 - RNA, 15 nt, Mycobacterium bovis subsp bovis AF2122/97
accccaacaucccgg

SEQ ID NO: 3114529 - RNA, 16 nt, Mycobacterium bovis subsp bovis AF2122/97
accccaaguccagcag

SEQ ID NO: 3114530 - RNA, 18 nt, Mycobacterium bovis subsp bovis AF2122/97
accccaaucgaccgcccg

SEQ ID NO: 3114531 - RNA, 20 nt, Mycobacterium bovis subsp bovis AF2122/97
accccaaucgaccgcccgcc

SEQ ID NO: 3114532 - RNA, 13 nt, Mycobacterium bovis subsp bovis AF2122/97
accccacacccgg

SEQ ID NO: 3114533 - RNA, 14 nt, Mycobacterium bovis subsp bovis AF2122/97
accccacacgccga

SEQ ID NO: 3114534 - RNA, 13 nt, Mycobacterium bovis subsp bovis AF2122/97
accccacggccag

SEQ ID NO: 3114535 - RNA, 18 nt, Mycobacterium bovis subsp bovis AF2122/97
accccagccggcagcagc

SEQ ID NO: 3114536 - RNA, 19 nt, Mycobacterium bovis subsp bovis AF2122/97
accccagccggcagcagcg

SEQ ID NO: 3114537 - RNA, 21 nt, Mycobacterium bovis subsp bovis AF2122/97
accccagccggcagcagcggg

SEQ ID NO: 3114538 - RNA, 16 nt, Mycobacterium bovis subsp bovis AF2122/97
accccagcggccaccg

SEQ ID NO: 3114539 - RNA, 12 nt, Mycobacterium bovis subsp bovis AF2122/97
accccagcuugg

SEQ ID NO: 3114540 - RNA, 21 nt, Mycobacterium bovis subsp bovis AF2122/97
accccagcuuggcgucgaugc

SEQ ID NO: 3114541 - RNA, 17 nt, Mycobacterium bovis subsp bovis AF2122/97
accccaggcgcucauca

SEQ ID NO: 3114542 - RNA, 22 nt, Mycobacterium bovis subsp bovis AF2122/97
accccaggcgcucaucacccag

SEQ ID NO: 3114543 - RNA, 17 nt, Mycobacterium bovis subsp bovis AF2122/97
accccagggagugccgc

SEQ ID NO: 3114544 - RNA, 15 nt, Mycobacterium bovis subsp bovis AF2122/97
accccauacucggcg

SEQ ID NO: 3114545 - RNA, 18 nt, Mycobacterium bovis subsp bovis AF2122/97
accccauacucggcggcu

SEQ ID NO: 3114546 - RNA, 21 nt, Mycobacterium bovis subsp bovis AF2122/97
accccaucagaaugccuggcc

SEQ ID NO: 3114547 - RNA, 23 nt, Mycobacterium bovis subsp bovis AF2122/97
accccaucagaaugccuggcccg

SEQ ID NO: 3114548 - RNA, 21 nt, Mycobacterium bovis subsp bovis AF2122/97
accccaugaccgggaggcggc

SEQ ID NO: 3114549 - RNA, 14 nt, Mycobacterium bovis subsp bovis AF2122/97
accccauggccagc

SEQ ID NO: 3114550 - RNA, 17 nt, Mycobacterium bovis subsp bovis AF2122/97
accccauggccagcgcu

SEQ ID NO: 3114551 - RNA, 19 nt, Mycobacterium bovis subsp bovis AF2122/97
accccauggccagcgcuuc

SEQ ID NO: 3114552 - RNA, 18 nt, Mycobacterium bovis subsp bovis AF2122/97
acccccagcacccggcuu

SEQ ID NO: 3114553 - RNA, 18 nt, Mycobacterium bovis subsp bovis AF2122/97
acccccagcugcagggcg

SEQ ID NO: 3114554 - RNA, 18 nt, Mycobacterium bovis subsp bovis AF2122/97
accccccagcgacggcaa

SEQ ID NO: 3114555 - RNA, 15 nt, Mycobacterium bovis subsp bovis AF2122/97
accccccagcgccgc

SEQ ID NO: 3114556 - RNA, 17 nt, Mycobacterium bovis subsp bovis AF2122/97
accccccagcgccgccg

SEQ ID NO: 3114557 - RNA, 21 nt, Mycobacterium bovis subsp bovis AF2122/97
acccccccccccacccaccac

SEQ ID NO: 3114558 - RNA, 19 nt, Mycobacterium bovis subsp bovis AF2122/97
acccccccgugcggugucg

SEQ ID NO: 3114559 - RNA, 14 nt, Mycobacterium bovis subsp bovis AF2122/97
accccccgaccccg

SEQ ID NO: 3114560 - RNA, 19 nt, Mycobacterium bovis subsp bovis AF2122/97
accccuucgccagcgccac

SEQ ID NO: 3114561 - RNA, 22 nt, Mycobacterium bovis subsp bovis AF2122/97
accccuuggacugucccaccag

SEQ ID NO: 3114562 - RNA, 23 nt, Mycobacterium bovis subsp bovis AF2122/97
accccuuggacugucccaccagg

SEQ ID NO: 3114563 - RNA, 20 nt, Mycobacterium bovis subsp bovis AF2122/97
acccgaaaacugacccccug

SEQ ID NO: 3114564 - RNA, 13 nt, Mycobacterium bovis subsp bovis AF2122/97
acccgaaacaccg

SEQ ID NO: 3114565 - RNA, 14 nt, Mycobacterium bovis subsp bovis AF2122/97
acccgaacaacgcc

SEQ ID NO: 3114566 - RNA, 14 nt, Mycobacterium bovis subsp bovis AF2122/97
acccgaaucccaca

SEQ ID NO: 3114567 - RNA, 21 nt, Mycobacterium bovis subsp bovis AF2122/97
acccgaaucccacagcaggag

SEQ ID NO: 3114568 - RNA, 16 nt, Mycobacterium bovis subsp bovis AF2122/97
acccgacaacgcuggg

SEQ ID NO: 3114569 - RNA, 19 nt, Mycobacterium bovis subsp bovis AF2122/97
acccgacaauggcgccagc

SEQ ID NO: 3114570 - RNA, 22 nt, Mycobacterium bovis subsp bovis AF2122/97
acccgacaauggcgccagccga

SEQ ID NO: 3114571 - RNA, 17 nt, Mycobacterium bovis subsp bovis AF2122/97
acccgacacggcucgcc

SEQ ID NO: 3114572 - RNA, 21 nt, Mycobacterium bovis subsp bovis AF2122/97
acccgacacggcucgccggcu

SEQ ID NO: 3114573 - RNA, 17 nt, Mycobacterium bovis subsp bovis AF2122/97
acccgacaugguccgac

SEQ ID NO: 3114574 - RNA, 12 nt, Mycobacterium bovis subsp bovis AF2122/97
acccgacccgau

SEQ ID NO: 3114575 - RNA, 17 nt, Mycobacterium bovis subsp bovis AF2122/97
acccgacgccacgcguc

SEQ ID NO: 3114576 - RNA, 16 nt, Mycobacterium bovis subsp bovis AF2122/97
acccgagaacgcccga

SEQ ID NO: 3114577 - RNA, 19 nt, Mycobacterium bovis subsp bovis AF2122/97
acccgagcgcucgaucacg

SEQ ID NO: 3114578 - RNA, 19 nt, Mycobacterium bovis subsp bovis AF2122/97
acccgagcguccggugguc

SEQ ID NO: 3114579 - RNA, 18 nt, Mycobacterium bovis subsp bovis AF2122/97
acccgagggccugacgcg

SEQ ID NO: 3114580 - RNA, 23 nt, Mycobacterium bovis subsp bovis AF2122/97
acccgaucagguacgccaggugc

SEQ ID NO: 3114581 - RNA, 13 nt, Mycobacterium bovis subsp bovis AF2122/97
acccgaucgcgcc

SEQ ID NO: 3114582 - RNA, 16 nt, Mycobacterium bovis subsp bovis AF2122/97
acccgaugacccacug

SEQ ID NO: 3114583 - RNA, 15 nt, Mycobacterium bovis subsp bovis AF2122/97
acccgcaacuacggc

SEQ ID NO: 3114584 - RNA, 12 nt, Mycobacterium bovis subsp bovis AF2122/97
acccgcaaugcg

SEQ ID NO: 3114585 - RNA, 17 nt, Mycobacterium bovis subsp bovis AF2122/97
acccgcaccccggccgc

SEQ ID NO: 3114586 - RNA, 16 nt, Mycobacterium bovis subsp bovis AF2122/97
acccgcaccgccggca

SEQ ID NO: 3114587 - RNA, 13 nt, Mycobacterium bovis subsp bovis AF2122/97
acccgcaccggau

SEQ ID NO: 3114588 - RNA, 20 nt, Mycobacterium bovis subsp bovis AF2122/97
acccgcaccggggugugcgg

SEQ ID NO: 3114589 - RNA, 12 nt, Mycobacterium bovis subsp bovis AF2122/97
acccgcaccggu

SEQ ID NO: 3114590 - RNA, 16 nt, Mycobacterium bovis subsp bovis AF2122/97
acccgcaccggugacg

SEQ ID NO: 3114591 - RNA, 23 nt, Mycobacterium bovis subsp bovis AF2122/97
acccgcaccggugacgcacagca

SEQ ID NO: 3114592 - RNA, 16 nt, Mycobacterium bovis subsp bovis AF2122/97
acccgcaccucaccgg

SEQ ID NO: 3114593 - RNA, 21 nt, Mycobacterium bovis subsp bovis AF2122/97
acccgcacguagaaguaggcg

SEQ ID NO: 3114594 - RNA, 11 nt, Mycobacterium bovis subsp bovis AF2122/97
acccgcagacc

SEQ ID NO: 3114595 - RNA, 15 nt, Mycobacterium bovis subsp bovis AF2122/97
acccgcagaccgcca

SEQ ID NO: 3114596 - RNA, 14 nt, Mycobacterium bovis subsp bovis AF2122/97
acccgcagaccggu

SEQ ID NO: 3114597 - RNA, 13 nt, Mycobacterium bovis subsp bovis AF2122/97
acccgcagcugcg

SEQ ID NO: 3114598 - RNA, 15 nt, Mycobacterium bovis subsp bovis AF2122/97
acccgcagcugcgga

SEQ ID NO: 3114599 - RNA, 14 nt, Mycobacterium bovis subsp bovis AF2122/97
acccgcagcugugg

SEQ ID NO: 3114600 - RNA, 20 nt, Mycobacterium bovis subsp bovis AF2122/97
acccgcaggucgaucugcgc

SEQ ID NO: 3114601 - RNA, 19 nt, Mycobacterium bovis subsp bovis AF2122/97
acccgcaggucgcaccaca

SEQ ID NO: 3114602 - RNA, 21 nt, Mycobacterium bovis subsp bovis AF2122/97
acccgcauaccguucacccag

SEQ ID NO: 3114603 - RNA, 18 nt, Mycobacterium bovis subsp bovis AF2122/97
acccgcauccacgucgcc

SEQ ID NO: 3114604 - RNA, 16 nt, Mycobacterium bovis subsp bovis AF2122/97
acccgcaugacgccgg

SEQ ID NO: 3114605 - RNA, 21 nt, Mycobacterium bovis subsp bovis AF2122/97
acccgcauggacgcgaugacc

SEQ ID NO: 3114606 - RNA, 21 nt, Mycobacterium bovis subsp bovis AF2122/97
acccgcauggcagcggcggua

SEQ ID NO: 3114607 - RNA, 14 nt, Mycobacterium bovis subsp bovis AF2122/97
acccgccaccgcga

SEQ ID NO: 3114608 - RNA, 20 nt, Mycobacterium bovis subsp bovis AF2122/97
acccgccacguacuccaccg

SEQ ID NO: 3114609 - RNA, 13 nt, Mycobacterium bovis subsp bovis AF2122/97
acccgccagggcg

SEQ ID NO: 3114610 - RNA, 16 nt, Mycobacterium bovis subsp bovis AF2122/97
acccgccagggcggca

SEQ ID NO: 3114611 - RNA, 15 nt, Mycobacterium bovis subsp bovis AF2122/97
acccgcccacggcac

SEQ ID NO: 3114612 - RNA, 16 nt, Mycobacterium bovis subsp bovis AF2122/97
acccgcccacggcacc

SEQ ID NO: 3114613 - RNA, 22 nt, Mycobacterium bovis subsp bovis AF2122/97
acccgcccggaacggguuggcg

SEQ ID NO: 3114614 - RNA, 22 nt, Mycobacterium bovis subsp bovis AF2122/97
acccgcccuugccgccgagggc

SEQ ID NO: 3114615 - RNA, 20 nt, Mycobacterium bovis subsp bovis AF2122/97
acccgccgacgccgccggcc

SEQ ID NO: 3114616 - RNA, 19 nt, Mycobacterium bovis subsp bovis AF2122/97
acccgccgaugcugccgcc

SEQ ID NO: 3114617 - RNA, 21 nt, Mycobacterium bovis subsp bovis AF2122/97
acccgccgaugcugccgccgc

SEQ ID NO: 3114618 - RNA, 14 nt, Mycobacterium bovis subsp bovis AF2122/97
acccgccgccccac

SEQ ID NO: 3114619 - RNA, 19 nt, Mycobacterium bovis subsp bovis AF2122/97
acccgccgccgcccgggcg

SEQ ID NO: 3114620 - RNA, 22 nt, Mycobacterium bovis subsp bovis AF2122/97
acccgccgcgaugacggugccg

SEQ ID NO: 3114621 - RNA, 18 nt, Mycobacterium bovis subsp bovis AF2122/97
acccgccgcgcccggcgc

SEQ ID NO: 3114622 - RNA, 19 nt, Mycobacterium bovis subsp bovis AF2122/97
acccgccggauucgcccgg

SEQ ID NO: 3114623 - RNA, 19 nt, Mycobacterium bovis subsp bovis AF2122/97
acccgccggcgacugcagc

SEQ ID NO: 3114624 - RNA, 18 nt, Mycobacterium bovis subsp bovis AF2122/97
acccgccggguccgccgg

SEQ ID NO: 3114625 - RNA, 23 nt, Mycobacterium bovis subsp bovis AF2122/97
acccgccgugaguagguccacgu

SEQ ID NO: 3114626 - RNA, 19 nt, Mycobacterium bovis subsp bovis AF2122/97
acccgccguugccaccggu

SEQ ID NO: 3114627 - RNA, 20 nt, Mycobacterium bovis subsp bovis AF2122/97
acccgccuaaagcgugucgc

SEQ ID NO: 3114628 - RNA, 21 nt, Mycobacterium bovis subsp bovis AF2122/97
acccgccuaaagcgugucgcc

SEQ ID NO: 3114629 - RNA, 16 nt, Mycobacterium bovis subsp bovis AF2122/97
acccgccucaucuccu

SEQ ID NO: 3114630 - RNA, 15 nt, Mycobacterium bovis subsp bovis AF2122/97
acccgccucgggccg

SEQ ID NO: 3114631 - RNA, 17 nt, Mycobacterium bovis subsp bovis AF2122/97
acccgccucgggccggc

SEQ ID NO: 3114632 - RNA, 18 nt, Mycobacterium bovis subsp bovis AF2122/97
acccgccucgggccggcg

SEQ ID NO: 3114633 - RNA, 13 nt, Mycobacterium bovis subsp bovis AF2122/97
acccgcgaacgcg

SEQ ID NO: 3114634 - RNA, 18 nt, Mycobacterium bovis subsp bovis AF2122/97
acccgcgaacgcgacagc

SEQ ID NO: 3114635 - RNA, 18 nt, Mycobacterium bovis subsp bovis AF2122/97
acccgcgagaucgggccg

SEQ ID NO: 3114636 - RNA, 21 nt, Mycobacterium bovis subsp bovis AF2122/97
acccgcgagaucgggccggcc

SEQ ID NO: 3114637 - RNA, 20 nt, Mycobacterium bovis subsp bovis AF2122/97
acccgcgagguugaccacca

SEQ ID NO: 3114638 - RNA, 13 nt, Mycobacterium bovis subsp bovis AF2122/97
acccgcgccgccc

SEQ ID NO: 3114639 - RNA, 14 nt, Mycobacterium bovis subsp bovis AF2122/97
acccgcgccgcccg

SEQ ID NO: 3114640 - RNA, 15 nt, Mycobacterium bovis subsp bovis AF2122/97
acccgcgccgcccgc

SEQ ID NO: 3114641 - RNA, 16 nt, Mycobacterium bovis subsp bovis AF2122/97
acccgcgccggccgcu

SEQ ID NO: 3114642 - RNA, 16 nt, Mycobacterium bovis subsp bovis AF2122/97
acccgcgcgacgccgu

SEQ ID NO: 3114643 - RNA, 21 nt, Mycobacterium bovis subsp bovis AF2122/97
acccgcgcgagcagcuacagc

SEQ ID NO: 3114644 - RNA, 13 nt, Mycobacterium bovis subsp bovis AF2122/97
acccgcgcgaugc

SEQ ID NO: 3114645 - RNA, 22 nt, Mycobacterium bovis subsp bovis AF2122/97
acccgcgcgucgcccagugcgc

SEQ ID NO: 3114646 - RNA, 14 nt, Mycobacterium bovis subsp bovis AF2122/97
acccgggccgcggc

SEQ ID NO: 3114647 - RNA, 18 nt, Mycobacterium bovis subsp bovis AF2122/97
acccgggccgcggcggcc

SEQ ID NO: 3114648 - RNA, 20 nt, Mycobacterium bovis subsp bovis AF2122/97
acccgggccggucggugagc

SEQ ID NO: 3114649 - RNA, 13 nt, Mycobacterium bovis subsp bovis AF2122/97
acccgggccucgg

SEQ ID NO: 3114650 - RNA, 14 nt, Mycobacterium bovis subsp bovis AF2122/97
acccgggccucggc

SEQ ID NO: 3114651 - RNA, 17 nt, Mycobacterium bovis subsp bovis AF2122/97
acccgggccucggcgcc

SEQ ID NO: 3114652 - RNA, 22 nt, Mycobacterium bovis subsp bovis AF2122/97
acccgggccucggcgccgucgg

SEQ ID NO: 3114653 - RNA, 21 nt, Mycobacterium bovis subsp bovis AF2122/97
acccgggccugggacggcggc

SEQ ID NO: 3114654 - RNA, 22 nt, Mycobacterium bovis subsp bovis AF2122/97
acccgggccugggacggcggca

SEQ ID NO: 3114655 - RNA, 15 nt, Mycobacterium bovis subsp bovis AF2122/97
acccgggcgagcgcg

SEQ ID NO: 3114656 - RNA, 14 nt, Mycobacterium bovis subsp bovis AF2122/97
acccgggcggcggc

SEQ ID NO: 3114657 - RNA, 15 nt, Mycobacterium bovis subsp bovis AF2122/97
acccgggcggcggcg

SEQ ID NO: 3114658 - RNA, 20 nt, Mycobacterium bovis subsp bovis AF2122/97
acccgggcgugggugucggc

SEQ ID NO: 3114659 - RNA, 22 nt, Mycobacterium bovis subsp bovis AF2122/97
acccgggcgugggugucggcga

SEQ ID NO: 3114660 - RNA, 21 nt, Mycobacterium bovis subsp bovis AF2122/97
acccgggcugcuugcgcccgg

SEQ ID NO: 3114661 - RNA, 16 nt, Mycobacterium bovis subsp bovis AF2122/97
acccggggacgcccgu

SEQ ID NO: 3114662 - RNA, 14 nt, Mycobacterium bovis subsp bovis AF2122/97
acccggggugcccg

SEQ ID NO: 3114663 - RNA, 20 nt, Mycobacterium bovis subsp bovis AF2122/97
acccggguagacaccgcgau

SEQ ID NO: 3114664 - RNA, 23 nt, Mycobacterium bovis subsp bovis AF2122/97
acccgguaccucaacaccaggcc

SEQ ID NO: 3114665 - RNA, 14 nt, Mycobacterium bovis subsp bovis AF2122/97
acccgguaguccgc

SEQ ID NO: 3114666 - RNA, 22 nt, Mycobacterium bovis subsp bovis AF2122/97
acccggucaaagaugucgcugg

SEQ ID NO: 3114667 - RNA, 13 nt, Mycobacterium bovis subsp bovis AF2122/97
acccgguccggcc

SEQ ID NO: 3114668 - RNA, 16 nt, Mycobacterium bovis subsp bovis AF2122/97
acccgguccugcucgc

SEQ ID NO: 3114669 - RNA, 20 nt, Mycobacterium bovis subsp bovis AF2122/97
acccgguccugcucgcacag

SEQ ID NO: 3114670 - RNA, 22 nt, Mycobacterium bovis subsp bovis AF2122/97
acccggucgacgggucggcgcc

SEQ ID NO: 3114671 - RNA, 12 nt, Mycobacterium bovis subsp bovis AF2122/97
acccggucgagc

SEQ ID NO: 3114672 - RNA, 14 nt, Mycobacterium bovis subsp bovis AF2122/97
acccggucgccggg

SEQ ID NO: 3114673 - RNA, 21 nt, Mycobacterium bovis subsp bovis AF2122/97
acccggucgccggucaucgcc

SEQ ID NO: 3114674 - RNA, 13 nt, Mycobacterium bovis subsp bovis AF2122/97
acccggucggcca

SEQ ID NO: 3114675 - RNA, 14 nt, Mycobacterium bovis subsp bovis AF2122/97
acccggucggccau

SEQ ID NO: 3114676 - RNA, 18 nt, Mycobacterium bovis subsp bovis AF2122/97
acccggugaccagcaacc

SEQ ID NO: 3114677 - RNA, 15 nt, Mycobacterium bovis subsp bovis AF2122/97
acccggugacccgcu

SEQ ID NO: 3114678 - RNA, 17 nt, Mycobacterium bovis subsp bovis AF2122/97
acccggugagaagaagc

SEQ ID NO: 3114679 - RNA, 18 nt, Mycobacterium bovis subsp bovis AF2122/97
acccggugagaagaagcc

SEQ ID NO: 3114680 - RNA, 16 nt, Mycobacterium bovis subsp bovis AF2122/97
acccggugaugguggc

SEQ ID NO: 3114681 - RNA, 12 nt, Mycobacterium bovis subsp bovis AF2122/97
acccggugccgc

SEQ ID NO: 3114682 - RNA, 11 nt, Mycobacterium bovis subsp bovis AF2122/97
acccgguggcg

SEQ ID NO: 3114683 - RNA, 19 nt, Mycobacterium bovis subsp bovis AF2122/97
acccgguggcugaucaccg

SEQ ID NO: 3114684 - RNA, 21 nt, Mycobacterium bovis subsp bovis AF2122/97
acccgguuauggcaagccguu

SEQ ID NO: 3114685 - RNA, 13 nt, Mycobacterium bovis subsp bovis AF2122/97
acccguaccagcc

SEQ ID NO: 3114686 - RNA, 14 nt, Mycobacterium bovis subsp bovis AF2122/97
acccguaccagccc

SEQ ID NO: 3114687 - RNA, 13 nt, Mycobacterium bovis subsp bovis AF2122/97
acccguacccacg

SEQ ID NO: 3114688 - RNA, 17 nt, Mycobacterium bovis subsp bovis AF2122/97
acccguaggguggccga

SEQ ID NO: 3114689 - RNA, 19 nt, Mycobacterium bovis subsp bovis AF2122/97
acccguaggguggccgacg

SEQ ID NO: 3114690 - RNA, 23 nt, Mycobacterium bovis subsp bovis AF2122/97
acccguauugccaaagcccgaca

SEQ ID NO: 3114691 - RNA, 14 nt, Mycobacterium bovis subsp bovis AF2122/97
acccgucaccgccg

SEQ ID NO: 3114692 - RNA, 17 nt, Mycobacterium bovis subsp bovis AF2122/97
acccgucaugcccaccg

SEQ ID NO: 3114693 - RNA, 19 nt, Mycobacterium bovis subsp bovis AF2122/97
acccguccaacuacgccag

SEQ ID NO: 3114694 - RNA, 23 nt, Mycobacterium bovis subsp bovis AF2122/97
acccguccgccgcagacgccgac

SEQ ID NO: 3114695 - RNA, 14 nt, Mycobacterium bovis subsp bovis AF2122/97
acccguccggccgg

SEQ ID NO: 3114696 - RNA, 15 nt, Mycobacterium bovis subsp bovis AF2122/97
acccgucgaacgcgc

SEQ ID NO: 3114697 - RNA, 16 nt, Mycobacterium bovis subsp bovis AF2122/97
acccgucgagcagcau

SEQ ID NO: 3114698 - RNA, 16 nt, Mycobacterium bovis subsp bovis AF2122/97
acccgucggcccgcuc

SEQ ID NO: 3114699 - RNA, 18 nt, Mycobacterium bovis subsp bovis AF2122/97
acccgucggcguggcugc

SEQ ID NO: 3114700 - RNA, 17 nt, Mycobacterium bovis subsp bovis AF2122/97
acccgucgggugcugau

SEQ ID NO: 3114701 - RNA, 19 nt, Mycobacterium bovis subsp bovis AF2122/97
acccgugcacgaucgcggu

SEQ ID NO: 3114702 - RNA, 23 nt, Mycobacterium bovis subsp bovis AF2122/97
acccgugcacgaucgcggugacc

SEQ ID NO: 3114703 - RNA, 16 nt, Mycobacterium bovis subsp bovis AF2122/97
acccguguggcacgug

SEQ ID NO: 3114704 - RNA, 21 nt, Mycobacterium bovis subsp bovis AF2122/97
acccguguucgccacacccgu

SEQ ID NO: 3114705 - RNA, 20 nt, Mycobacterium bovis subsp bovis AF2122/97
acccguguugagggugcccg

SEQ ID NO: 3114706 - RNA, 22 nt, Mycobacterium bovis subsp bovis AF2122/97
acccguguugagggugcccgag

SEQ ID NO: 3114707 - RNA, 16 nt, Mycobacterium bovis subsp bovis AF2122/97
acccguuaugcgccgc

SEQ ID NO: 3114708 - RNA, 14 nt, Mycobacterium bovis subsp bovis AF2122/97
acccguuccacgcc

SEQ ID NO: 3114709 - RNA, 17 nt, Mycobacterium bovis subsp bovis AF2122/97
acccguuccacgccggc

SEQ ID NO: 3114710 - RNA, 15 nt, Mycobacterium bovis subsp bovis AF2122/97
acccguucggcugcg

SEQ ID NO: 3114711 - RNA, 13 nt, Mycobacterium bovis subsp bovis AF2122/97
acccguucucggu

SEQ ID NO: 3114712 - RNA, 13 nt, Mycobacterium bovis subsp bovis AF2122/97
acccguucuucgc

SEQ ID NO: 3114713 - RNA, 14 nt, Mycobacterium bovis subsp bovis AF2122/97
acccguugaacucg

SEQ ID NO: 3114714 - RNA, 22 nt, Mycobacterium bovis subsp bovis AF2122/97
acccguugagcauaugacgucg

SEQ ID NO: 3114715 - RNA, 20 nt, Mycobacterium bovis subsp bovis AF2122/97
acccguugaucgcggacacu

SEQ ID NO: 3114716 - RNA, 19 nt, Mycobacterium bovis subsp bovis AF2122/97
acccguugcucccacggca

SEQ ID NO: 3114717 - RNA, 22 nt, Mycobacterium bovis subsp bovis AF2122/97
acccguuggauguuuuccgguc

SEQ ID NO: 3114718 - RNA, 19 nt, Mycobacterium bovis subsp bovis AF2122/97
acccguuuugggugaucgc

SEQ ID NO: 3114719 - RNA, 17 nt, Mycobacterium bovis subsp bovis AF2122/97
acccuaaaccagccacc

SEQ ID NO: 3114720 - RNA, 22 nt, Mycobacterium bovis subsp bovis AF2122/97
acccuagauaugcacccgcacc

SEQ ID NO: 3114721 - RNA, 20 nt, Mycobacterium bovis subsp bovis AF2122/97
acccuagggcggugccgccg

SEQ ID NO: 3114722 - RNA, 18 nt, Mycobacterium bovis subsp bovis AF2122/97
acccuauuggucggucgc

SEQ ID NO: 3114723 - RNA, 13 nt, Mycobacterium bovis subsp bovis AF2122/97
acccucagccgcg

SEQ ID NO: 3114724 - RNA, 20 nt, Mycobacterium bovis subsp bovis AF2122/97
acccucagccgcgccggguc

SEQ ID NO: 3114725 - RNA, 17 nt, Mycobacterium bovis subsp bovis AF2122/97
acccuccacagcggcca

SEQ ID NO: 3114726 - RNA, 11 nt, Mycobacterium bovis subsp bovis AF2122/97
acccuccagca

SEQ ID NO: 3114727 - RNA, 13 nt, Mycobacterium bovis subsp bovis AF2122/97
acccuccagcacg

SEQ ID NO: 3114728 - RNA, 12 nt, Mycobacterium bovis subsp bovis AF2122/97
acccuccgccgg

SEQ ID NO: 3114729 - RNA, 16 nt, Mycobacterium bovis subsp bovis AF2122/97
acccucgccggucagc

SEQ ID NO: 3114730 - RNA, 22 nt, Mycobacterium bovis subsp bovis AF2122/97
acccucgcguagggccagcgcc

SEQ ID NO: 3114731 - RNA, 23 nt, Mycobacterium bovis subsp bovis AF2122/97
acccucgcguagggccagcgccu

SEQ ID NO: 3114732 - RNA, 18 nt, Mycobacterium bovis subsp bovis AF2122/97
acccucgggcgucacggu

SEQ ID NO: 3114733 - RNA, 21 nt, Mycobacterium bovis subsp bovis AF2122/97
acccucgggcgucacggugcg

SEQ ID NO: 3114734 - RNA, 20 nt, Mycobacterium bovis subsp bovis AF2122/97
acccucggguccaaccacga

SEQ ID NO: 3114735 - RNA, 16 nt, Mycobacterium bovis subsp bovis AF2122/97
acccucgggucgucgc

SEQ ID NO: 3114736 - RNA, 14 nt, Mycobacterium bovis subsp bovis AF2122/97
acccugaugaucgu

SEQ ID NO: 3114737 - RNA, 19 nt, Mycobacterium bovis subsp bovis AF2122/97
acccugaugugaguccagc

SEQ ID NO: 3114738 - RNA, 21 nt, Mycobacterium bovis subsp bovis AF2122/97
acccugcacugcgcgugcucg

SEQ ID NO: 3114739 - RNA, 13 nt, Mycobacterium bovis subsp bovis AF2122/97
acccugcccggcc

SEQ ID NO: 3114740 - RNA, 16 nt, Mycobacterium bovis subsp bovis AF2122/97
acccugcccggcccgc

SEQ ID NO: 3114741 - RNA, 20 nt, Mycobacterium bovis subsp bovis AF2122/97
acccugcgaauagccaccaa

SEQ ID NO: 3114742 - RNA, 14 nt, Mycobacterium bovis subsp bovis AF2122/97
acccugcgccgcca

SEQ ID NO: 3114743 - RNA, 20 nt, Mycobacterium bovis subsp bovis AF2122/97
acccugcgcguugaccgaac

SEQ ID NO: 3114744 - RNA, 14 nt, Mycobacterium bovis subsp bovis AF2122/97
acccugcggcgucg

SEQ ID NO: 3114745 - RNA, 15 nt, Mycobacterium bovis subsp bovis AF2122/97
acccugcggugcagg

SEQ ID NO: 3114746 - RNA, 17 nt, Mycobacterium bovis subsp bovis AF2122/97
acccuggcggaacagcu

SEQ ID NO: 3114747 - RNA, 19 nt, Mycobacterium bovis subsp bovis AF2122/97
acccugggugccggcagcg

SEQ ID NO: 3114748 - RNA, 24 nt, Mycobacterium bovis subsp bovis AF2122/97
acccuggucgaaacgguacgccgc

SEQ ID NO: 3114749 - RNA, 20 nt, Mycobacterium bovis subsp bovis AF2122/97
acccugguggucagucacca

SEQ ID NO: 3114750 - RNA, 19 nt, Mycobacterium bovis subsp bovis AF2122/97
acccugucgcgcaccggau

SEQ ID NO: 3114751 - RNA, 22 nt, Mycobacterium bovis subsp bovis AF2122/97
acccuguuguugccccggucgg

SEQ ID NO: 3114752 - RNA, 24 nt, Mycobacterium bovis subsp bovis AF2122/97
acccuguuguugccccggucggcg

SEQ ID NO: 3114753 - RNA, 22 nt, Mycobacterium bovis subsp bovis AF2122/97
acccuucgccgggcaacgcgaa

SEQ ID NO: 3114754 - RNA, 21 nt, Mycobacterium bovis subsp bovis AF2122/97
acccuucgggcuggucgguca

SEQ ID NO: 3114755 - RNA, 20 nt, Mycobacterium bovis subsp bovis AF2122/97
acccuugccgauuccggcgu

SEQ ID NO: 3114756 - RNA, 14 nt, Mycobacterium bovis subsp bovis AF2122/97
acccuugccgccgg

SEQ ID NO: 3114757 - RNA, 18 nt, Mycobacterium bovis subsp bovis AF2122/97
acccuuugcacgguggca

SEQ ID NO: 3114758 - RNA, 22 nt, Mycobacterium bovis subsp bovis AF2122/97
accgaaaagccguucgcgucgc

SEQ ID NO: 3114759 - RNA, 20 nt, Mycobacterium bovis subsp bovis AF2122/97
accgaaaccaugccgccgaa

SEQ ID NO: 3114760 - RNA, 20 nt, Mycobacterium bovis subsp bovis AF2122/97
accgaaaccggucagcacau

SEQ ID NO: 3114761 - RNA, 15 nt, Mycobacterium bovis subsp bovis AF2122/97
accgaaagccgcacc

SEQ ID NO: 3114762 - RNA, 16 nt, Mycobacterium bovis subsp bovis AF2122/97
accgaaauggucguuc

SEQ ID NO: 3114763 - RNA, 16 nt, Mycobacterium bovis subsp bovis AF2122/97
accgaacacgagcuca

SEQ ID NO: 3114764 - RNA, 14 nt, Mycobacterium bovis subsp bovis AF2122/97
accgaacccgccac

SEQ ID NO: 3114765 - RNA, 23 nt, Mycobacterium bovis subsp bovis AF2122/97
accgaaccgcguuaugccaggcg

SEQ ID NO: 3114766 - RNA, 23 nt, Mycobacterium bovis subsp bovis AF2122/97
accgaaccgguguagcagcgcca

SEQ ID NO: 3114767 - RNA, 19 nt, Mycobacterium bovis subsp bovis AF2122/97
accgaaccgucagcggcaa

SEQ ID NO: 3114768 - RNA, 14 nt, Mycobacterium bovis subsp bovis AF2122/97
accgaaccuggucu

SEQ ID NO: 3114769 - RNA, 17 nt, Mycobacterium bovis subsp bovis AF2122/97
accgaacgcaccgaaac

SEQ ID NO: 3114770 - RNA, 15 nt, Mycobacterium bovis subsp bovis AF2122/97
accgaacgcggccac

SEQ ID NO: 3114771 - RNA, 19 nt, Mycobacterium bovis subsp bovis AF2122/97
accgaacgcggccaccgac

SEQ ID NO: 3114772 - RNA, 23 nt, Mycobacterium bovis subsp bovis AF2122/97
accgaacgcggccaccgaccgca

SEQ ID NO: 3114773 - RNA, 22 nt, Mycobacterium bovis subsp bovis AF2122/97
accgaagaacaguugcccgacg

SEQ ID NO: 3114774 - RNA, 12 nt, Mycobacterium bovis subsp bovis AF2122/97
accgaagaagcc

SEQ ID NO: 3114775 - RNA, 20 nt, Mycobacterium bovis subsp bovis AF2122/97
accgaagagcuccgucgcgg

SEQ ID NO: 3114776 - RNA, 23 nt, Mycobacterium bovis subsp bovis AF2122/97
accgaagauggccagcgcggcgu

SEQ ID NO: 3114777 - RNA, 16 nt, Mycobacterium bovis subsp bovis AF2122/97
accgaagccgccgggu

SEQ ID NO: 3114778 - RNA, 18 nt, Mycobacterium bovis subsp bovis AF2122/97
accgaagcgaacggcaca

SEQ ID NO: 3114779 - RNA, 15 nt, Mycobacterium bovis subsp bovis AF2122/97
accgaauaccgccgc

SEQ ID NO: 3114780 - RNA, 19 nt, Mycobacterium bovis subsp bovis AF2122/97
accgaaucagcacggugug

SEQ ID NO: 3114781 - RNA, 17 nt, Mycobacterium bovis subsp bovis AF2122/97
accgaauggccgccgca

SEQ ID NO: 3114782 - RNA, 16 nt, Mycobacterium bovis subsp bovis AF2122/97
accgaauuacgcaccg

SEQ ID NO: 3114783 - RNA, 14 nt, Mycobacterium bovis subsp bovis AF2122/97
accgaauugaacug

SEQ ID NO: 3114784 - RNA, 15 nt, Mycobacterium bovis subsp bovis AF2122/97
accgaauugaacuga

SEQ ID NO: 3114785 - RNA, 14 nt, Mycobacterium bovis subsp bovis AF2122/97
accgacaccaccag

SEQ ID NO: 3114786 - RNA, 15 nt, Mycobacterium bovis subsp bovis AF2122/97
accgacaccgugccg

SEQ ID NO: 3114787 - RNA, 18 nt, Mycobacterium bovis subsp bovis AF2122/97
accgacaccguguugcug

SEQ ID NO: 3114788 - RNA, 21 nt, Mycobacterium bovis subsp bovis AF2122/97
accgacaccguguugcugaac

SEQ ID NO: 3114789 - RNA, 20 nt, Mycobacterium bovis subsp bovis AF2122/97
accgacaccguguugcugcc

SEQ ID NO: 3114790 - RNA, 14 nt, Mycobacterium bovis subsp bovis AF2122/97
accgacagcaccca

SEQ ID NO: 3114791 - RNA, 15 nt, Mycobacterium bovis subsp bovis AF2122/97
accgacagcacccgg

SEQ ID NO: 3114792 - RNA, 20 nt, Mycobacterium bovis subsp bovis AF2122/97
accgacagcacccggccacc

SEQ ID NO: 3114793 - RNA, 22 nt, Mycobacterium bovis subsp bovis AF2122/97
accgacagcacccggccaccgg

SEQ ID NO: 3114794 - RNA, 22 nt, Mycobacterium bovis subsp bovis AF2122/97
accgacagccccaucaccaccg

SEQ ID NO: 3114795 - RNA, 16 nt, Mycobacterium bovis subsp bovis AF2122/97
accgacagcggcaccg

SEQ ID NO: 3114796 - RNA, 14 nt, Mycobacterium bovis subsp bovis AF2122/97
accgacaucccaac

SEQ ID NO: 3114797 - RNA, 19 nt, Mycobacterium bovis subsp bovis AF2122/97
accgacaucgucauccagg

SEQ ID NO: 3114798 - RNA, 22 nt, Mycobacterium bovis subsp bovis AF2122/97
accgacauguguggcagcccca

SEQ ID NO: 3114799 - RNA, 17 nt, Mycobacterium bovis subsp bovis AF2122/97
accgacauuggugugga

SEQ ID NO: 3114800 - RNA, 15 nt, Mycobacterium bovis subsp bovis AF2122/97
accgaccagccgugg

SEQ ID NO: 3114801 - RNA, 18 nt, Mycobacterium bovis subsp bovis AF2122/97
accgaccagggccgccgc

SEQ ID NO: 3114802 - RNA, 21 nt, Mycobacterium bovis subsp bovis AF2122/97
accgaccccggaacgacccca

SEQ ID NO: 3114803 - RNA, 14 nt, Mycobacterium bovis subsp bovis AF2122/97
accgacccgcugcc

SEQ ID NO: 3114804 - RNA, 18 nt, Mycobacterium bovis subsp bovis AF2122/97
accgacccgcugccaccc

SEQ ID NO: 3114805 - RNA, 19 nt, Mycobacterium bovis subsp bovis AF2122/97
accgacccgcugccaccca

SEQ ID NO: 3114806 - RNA, 14 nt, Mycobacterium bovis subsp bovis AF2122/97
accgacccggccgc

SEQ ID NO: 3114807 - RNA, 19 nt, Mycobacterium bovis subsp bovis AF2122/97
accgacccggccgcugacg

SEQ ID NO: 3114808 - RNA, 18 nt, Mycobacterium bovis subsp bovis AF2122/97
accgaccgcaccgugccg

SEQ ID NO: 3114809 - RNA, 21 nt, Mycobacterium bovis subsp bovis AF2122/97
accgaccuaccgucgaccacu

SEQ ID NO: 3114810 - RNA, 20 nt, Mycobacterium bovis subsp bovis AF2122/97
accgaccuacugcggucgcc

SEQ ID NO: 3114811 - RNA, 15 nt, Mycobacterium bovis subsp bovis AF2122/97
accgaccuggacgcg

SEQ ID NO: 3114812 - RNA, 11 nt, Mycobacterium bovis subsp bovis AF2122/97
accgacgagga

SEQ ID NO: 3114813 - RNA, 23 nt, Mycobacterium bovis subsp bovis AF2122/97
accgacgaggacgucaccgucag

SEQ ID NO: 3114814 - RNA, 14 nt, Mycobacterium bovis subsp bovis AF2122/97
accgacgaucaacg

SEQ ID NO: 3114815 - RNA, 22 nt, Mycobacterium bovis subsp bovis AF2122/97
accgacgaucaacggaacaucg

SEQ ID NO: 3114816 - RNA, 13 nt, Mycobacterium bovis subsp bovis AF2122/97
accgacgcaccuc

SEQ ID NO: 3114817 - RNA, 20 nt, Mycobacterium bovis subsp bovis AF2122/97
accgacgcaccucgguggcu

SEQ ID NO: 3114818 - RNA, 15 nt, Mycobacterium bovis subsp bovis AF2122/97
accgacgccauuggc

SEQ ID NO: 3114819 - RNA, 13 nt, Mycobacterium bovis subsp bovis AF2122/97
accgacgccgcca

SEQ ID NO: 3114820 - RNA, 21 nt, Mycobacterium bovis subsp bovis AF2122/97
accgacgccgccagguccgcc

SEQ ID NO: 3114821 - RNA, 23 nt, Mycobacterium bovis subsp bovis AF2122/97
accgacgccgccagguccgccgg

SEQ ID NO: 3114822 - RNA, 14 nt, Mycobacterium bovis subsp bovis AF2122/97
accgacgccggugu

SEQ ID NO: 3114823 - RNA, 16 nt, Mycobacterium bovis subsp bovis AF2122/97
accgacgccggugucg

SEQ ID NO: 3114824 - RNA, 19 nt, Mycobacterium bovis subsp bovis AF2122/97
accgacgccgucgagcacg

SEQ ID NO: 3114825 - RNA, 14 nt, Mycobacterium bovis subsp bovis AF2122/97
accgacgcgaacgc

SEQ ID NO: 3114826 - RNA, 14 nt, Mycobacterium bovis subsp bovis AF2122/97
accgacgcgggccg

SEQ ID NO: 3114827 - RNA, 21 nt, Mycobacterium bovis subsp bovis AF2122/97
accgacgcguccggugcacca

SEQ ID NO: 3114828 - RNA, 21 nt, Mycobacterium bovis subsp bovis AF2122/97
accgacggacuucccgcgcga

SEQ ID NO: 3114829 - RNA, 12 nt, Mycobacterium bovis subsp bovis AF2122/97
accgacggccag

SEQ ID NO: 3114830 - RNA, 14 nt, Mycobacterium bovis subsp bovis AF2122/97
accgacggccagca

SEQ ID NO: 3114831 - RNA, 15 nt, Mycobacterium bovis subsp bovis AF2122/97
accgacgggucgcgg

SEQ ID NO: 3114832 - RNA, 16 nt, Mycobacterium bovis subsp bovis AF2122/97
accgacgguaggcccg

SEQ ID NO: 3114833 - RNA, 13 nt, Mycobacterium bovis subsp bovis AF2122/97
accgacgucgcca

SEQ ID NO: 3114834 - RNA, 20 nt, Mycobacterium bovis subsp bovis AF2122/97
accgacguuccccuucagca

SEQ ID NO: 3114835 - RNA, 21 nt, Mycobacterium bovis subsp bovis AF2122/97
accgacuccugugcggagccg

SEQ ID NO: 3114836 - RNA, 24 nt, Mycobacterium bovis subsp bovis AF2122/97
accgacuccugugcggagccgcca

SEQ ID NO: 3114837 - RNA, 22 nt, Mycobacterium bovis subsp bovis AF2122/97
accgacugcacauaguccgagc

SEQ ID NO: 3114838 - RNA, 22 nt, Mycobacterium bovis subsp bovis AF2122/97
accgacugcggguucgccgaua

SEQ ID NO: 3114839 - RNA, 18 nt, Mycobacterium bovis subsp bovis AF2122/97
accgacugcugucaccgc

SEQ ID NO: 3114840 - RNA, 17 nt, Mycobacterium bovis subsp bovis AF2122/97
accgacuugguugccgc

SEQ ID NO: 3114841 - RNA, 17 nt, Mycobacterium bovis subsp bovis AF2122/97
accgagaacugcucgau

SEQ ID NO: 3114842 - RNA, 20 nt, Mycobacterium bovis subsp bovis AF2122/97
accgagaacugcucgauccg

SEQ ID NO: 3114843 - RNA, 17 nt, Mycobacterium bovis subsp bovis AF2122/97
accgagacuugcuggcc

SEQ ID NO: 3114844 - RNA, 15 nt, Mycobacterium bovis subsp bovis AF2122/97
accgagaucaccgcc

SEQ ID NO: 3114845 - RNA, 17 nt, Mycobacterium bovis subsp bovis AF2122/97
accgagaucaccgccac

SEQ ID NO: 3114846 - RNA, 18 nt, Mycobacterium bovis subsp bovis AF2122/97
accgagaucaccgccacc

SEQ ID NO: 3114847 - RNA, 18 nt, Mycobacterium bovis subsp bovis AF2122/97
accgagaucaugccggcg

SEQ ID NO: 3114848 - RNA, 21 nt, Mycobacterium bovis subsp bovis AF2122/97
accgagaugcggaccacaccg

SEQ ID NO: 3114849 - RNA, 12 nt, Mycobacterium bovis subsp bovis AF2122/97
accgagcagcag

SEQ ID NO: 3114850 - RNA, 21 nt, Mycobacterium bovis subsp bovis AF2122/97
accgagcccgaucgcggcccg

SEQ ID NO: 3114851 - RNA, 20 nt, Mycobacterium bovis subsp bovis AF2122/97
accgagcccuccagggcccu

SEQ ID NO: 3114852 - RNA, 23 nt, Mycobacterium bovis subsp bovis AF2122/97
accgagcccuccagggcccugcu

SEQ ID NO: 3114853 - RNA, 17 nt, Mycobacterium bovis subsp bovis AF2122/97
accgagccgcgaugcgc

SEQ ID NO: 3114854 - RNA, 18 nt, Mycobacterium bovis subsp bovis AF2122/97
accgagcgcaaucgacca

SEQ ID NO: 3114855 - RNA, 22 nt, Mycobacterium bovis subsp bovis AF2122/97
accgagcgcaaucgaccacgac

SEQ ID NO: 3114856 - RNA, 17 nt, Mycobacterium bovis subsp bovis AF2122/97
accgagcugacgccgag

SEQ ID NO: 3114857 - RNA, 18 nt, Mycobacterium bovis subsp bovis AF2122/97
accgagcugacgccgagc

SEQ ID NO: 3114858 - RNA, 17 nt, Mycobacterium bovis subsp bovis AF2122/97
accgagcugagcggcca

SEQ ID NO: 3114859 - RNA, 16 nt, Mycobacterium bovis subsp bovis AF2122/97
accgagcugauccggg

SEQ ID NO: 3114860 - RNA, 21 nt, Mycobacterium bovis subsp bovis AF2122/97
accgaggaacuugcauccggc

SEQ ID NO: 3114861 - RNA, 13 nt, Mycobacterium bovis subsp bovis AF2122/97
accgaggaucucg

SEQ ID NO: 3114862 - RNA, 19 nt, Mycobacterium bovis subsp bovis AF2122/97
accgaggaucucgcggucc

SEQ ID NO: 3114863 - RNA, 15 nt, Mycobacterium bovis subsp bovis AF2122/97
accgaggccgccgag

SEQ ID NO: 3114864 - RNA, 19 nt, Mycobacterium bovis subsp bovis AF2122/97
accgaggccugacugaauu

SEQ ID NO: 3114865 - RNA, 18 nt, Mycobacterium bovis subsp bovis AF2122/97
accgagggauggccguug

SEQ ID NO: 3114866 - RNA, 21 nt, Mycobacterium bovis subsp bovis AF2122/97
accgagggcaaggacaagccg

SEQ ID NO: 3114867 - RNA, 16 nt, Mycobacterium bovis subsp bovis AF2122/97
accgagggccgucaca

SEQ ID NO: 3114868 - RNA, 22 nt, Mycobacterium bovis subsp bovis AF2122/97
accgagggucgggcauuccggu

SEQ ID NO: 3114869 - RNA, 14 nt, Mycobacterium bovis subsp bovis AF2122/97
accgaggucggcca

SEQ ID NO: 3114870 - RNA, 17 nt, Mycobacterium bovis subsp bovis AF2122/97
accgaggucggccagca

SEQ ID NO: 3114871 - RNA, 18 nt, Mycobacterium bovis subsp bovis AF2122/97
accgaggugccgcgcagc

SEQ ID NO: 3114872 - RNA, 13 nt, Mycobacterium bovis subsp bovis AF2122/97
accgaguaccgau

SEQ ID NO: 3114873 - RNA, 22 nt, Mycobacterium bovis subsp bovis AF2122/97
accgaguagaagauggcaccgc

SEQ ID NO: 3114874 - RNA, 17 nt, Mycobacterium bovis subsp bovis AF2122/97
accgagucgacggccag

SEQ ID NO: 3114875 - RNA, 23 nt, Mycobacterium bovis subsp bovis AF2122/97
accgagucgacggccagugcgca

SEQ ID NO: 3114876 - RNA, 13 nt, Mycobacterium bovis subsp bovis AF2122/97
accgagucgauca

SEQ ID NO: 3114877 - RNA, 15 nt, Mycobacterium bovis subsp bovis AF2122/97
accgagucgaucacg

SEQ ID NO: 3114878 - RNA, 14 nt, Mycobacterium bovis subsp bovis AF2122/97
accgaguuccucug

SEQ ID NO: 3114879 - RNA, 17 nt, Mycobacterium bovis subsp bovis AF2122/97
accgaguuccucugcga

SEQ ID NO: 3114880 - RNA, 20 nt, Mycobacterium bovis subsp bovis AF2122/97
accgauaaguucggcuggcg

SEQ ID NO: 3114881 - RNA, 21 nt, Mycobacterium bovis subsp bovis AF2122/97
accgauaaguucggcuggcgu

SEQ ID NO: 3114882 - RNA, 15 nt, Mycobacterium bovis subsp bovis AF2122/97
accgauacaccgacg

SEQ ID NO: 3114883 - RNA, 17 nt, Mycobacterium bovis subsp bovis AF2122/97
accgauacaccgacggg

SEQ ID NO: 3114884 - RNA, 17 nt, Mycobacterium bovis subsp bovis AF2122/97
accgauagccugcggcg

SEQ ID NO: 3114885 - RNA, 22 nt, Mycobacterium bovis subsp bovis AF2122/97
accgauauggccggguccagcc

SEQ ID NO: 3114886 - RNA, 15 nt, Mycobacterium bovis subsp bovis AF2122/97
accgaucaauccgcc

SEQ ID NO: 3114887 - RNA, 19 nt, Mycobacterium bovis subsp bovis AF2122/97
accgaucagcagggcggcg

SEQ ID NO: 3114888 - RNA, 20 nt, Mycobacterium bovis subsp bovis AF2122/97
accgaucagcagggcggcgu

SEQ ID NO: 3114889 - RNA, 16 nt, Mycobacterium bovis subsp bovis AF2122/97
accgaucccgcggccg

SEQ ID NO: 3114890 - RNA, 19 nt, Mycobacterium bovis subsp bovis AF2122/97
accgaucccgcggccgggc

SEQ ID NO: 3114891 - RNA, 16 nt, Mycobacterium bovis subsp bovis AF2122/97
accgaucgaacagugc

SEQ ID NO: 3114892 - RNA, 23 nt, Mycobacterium bovis subsp bovis AF2122/97
accgaucggcaaaccgucggagg

SEQ ID NO: 3114893 - RNA, 13 nt, Mycobacterium bovis subsp bovis AF2122/97
accgaucggcgcg

SEQ ID NO: 3114894 - RNA, 14 nt, Mycobacterium bovis subsp bovis AF2122/97
accgaucggugccg

SEQ ID NO: 3114895 - RNA, 15 nt, Mycobacterium bovis subsp bovis AF2122/97
accgaucggugccgg

SEQ ID NO: 3114896 - RNA, 18 nt, Mycobacterium bovis subsp bovis AF2122/97
accgaucggugccggccu

SEQ ID NO: 3114897 - RNA, 20 nt, Mycobacterium bovis subsp bovis AF2122/97
accgaucuuggccaccgccg

SEQ ID NO: 3114898 - RNA, 18 nt, Mycobacterium bovis subsp bovis AF2122/97
accgaugaaccaggcggc

SEQ ID NO: 3114899 - RNA, 20 nt, Mycobacterium bovis subsp bovis AF2122/97
accgaugacgaucggcggcg

SEQ ID NO: 3114900 - RNA, 18 nt, Mycobacterium bovis subsp bovis AF2122/97
accgaugaucucacccag

SEQ ID NO: 3114901 - RNA, 23 nt, Mycobacterium bovis subsp bovis AF2122/97
accgaugcgccggaccagcuccu

SEQ ID NO: 3114902 - RNA, 18 nt, Mycobacterium bovis subsp bovis AF2122/97
accgaugcugacgaugcg

SEQ ID NO: 3114903 - RNA, 17 nt, Mycobacterium bovis subsp bovis AF2122/97
accgauggcaucucgau

SEQ ID NO: 3114904 - RNA, 14 nt, Mycobacterium bovis subsp bovis AF2122/97
accgauggcgcacc

SEQ ID NO: 3114905 - RNA, 17 nt, Mycobacterium bovis subsp bovis AF2122/97
accgcccuugccgccgg

SEQ ID NO: 3114906 - RNA, 19 nt, Mycobacterium bovis subsp bovis AF2122/97
accgcccuugccgccggcc

SEQ ID NO: 3114907 - RNA, 20 nt, Mycobacterium bovis subsp bovis AF2122/97
accgcccuugccgccggccc

SEQ ID NO: 3114908 - RNA, 21 nt, Mycobacterium bovis subsp bovis AF2122/97
accgcccuugccgccggcccc

SEQ ID NO: 3114909 - RNA, 15 nt, Mycobacterium bovis subsp bovis AF2122/97
accgccgacgccguu

SEQ ID NO: 3114910 - RNA, 18 nt, Mycobacterium bovis subsp bovis AF2122/97
accgccgacgccguugcc

SEQ ID NO: 3114911 - RNA, 20 nt, Mycobacterium bovis subsp bovis AF2122/97
accgccgacgccguugccca

SEQ ID NO: 3114912 - RNA, 15 nt, Mycobacterium bovis subsp bovis AF2122/97
accgccgacggcgcc

SEQ ID NO: 3114913 - RNA, 19 nt, Mycobacterium bovis subsp bovis AF2122/97
accgccgacggcgccccgc

SEQ ID NO: 3114914 - RNA, 14 nt, Mycobacterium bovis subsp bovis AF2122/97
accgccgagcgggu

SEQ ID NO: 3114915 - RNA, 22 nt, Mycobacterium bovis subsp bovis AF2122/97
accgccgauacuucaucggcac

SEQ ID NO: 3114916 - RNA, 15 nt, Mycobacterium bovis subsp bovis AF2122/97
accgccgaucggcca

SEQ ID NO: 3114917 - RNA, 22 nt, Mycobacterium bovis subsp bovis AF2122/97
accgccgaucggccacagugca

SEQ ID NO: 3114918 - RNA, 12 nt, Mycobacterium bovis subsp bovis AF2122/97
accgccgccacc

SEQ ID NO: 3114919 - RNA, 20 nt, Mycobacterium bovis subsp bovis AF2122/97
accgccgccaccaccgcugc

SEQ ID NO: 3114920 - RNA, 18 nt, Mycobacterium bovis subsp bovis AF2122/97
accgccgcccccgccggc

SEQ ID NO: 3114921 - RNA, 19 nt, Mycobacterium bovis subsp bovis AF2122/97
accgccgcccccgccggcc

SEQ ID NO: 3114922 - RNA, 11 nt, Mycobacterium bovis subsp bovis AF2122/97
accgccgccga

SEQ ID NO: 3114923 - RNA, 12 nt, Mycobacterium bovis subsp bovis AF2122/97
accgccgccgaa

SEQ ID NO: 3114924 - RNA, 13 nt, Mycobacterium bovis subsp bovis AF2122/97
accgccgccgaca

SEQ ID NO: 3114925 - RNA, 14 nt, Mycobacterium bovis subsp bovis AF2122/97
accgccgccgacaa

SEQ ID NO: 3114926 - RNA, 22 nt, Mycobacterium bovis subsp bovis AF2122/97
accgccgccgacaaucaccaac

SEQ ID NO: 3114927 - RNA, 14 nt, Mycobacterium bovis subsp bovis AF2122/97
accgccgccgccac

SEQ ID NO: 3114928 - RNA, 16 nt, Mycobacterium bovis subsp bovis AF2122/97
accgccgccgccaccg

SEQ ID NO: 3114929 - RNA, 23 nt, Mycobacterium bovis subsp bovis AF2122/97
accgccgccgccaccggcgccgc

SEQ ID NO: 3114930 - RNA, 13 nt, Mycobacterium bovis subsp bovis AF2122/97
accgccgccgccc

SEQ ID NO: 3114931 - RNA, 17 nt, Mycobacterium bovis subsp bovis AF2122/97
accgccgccgccgacgc

SEQ ID NO: 3114932 - RNA, 18 nt, Mycobacterium bovis subsp bovis AF2122/97
accgccgccgccgacgcc

SEQ ID NO: 3114933 - RNA, 21 nt, Mycobacterium bovis subsp bovis AF2122/97
accgccgccgccgacgccgcc

SEQ ID NO: 3114934 - RNA, 11 nt, Mycobacterium bovis subsp bovis AF2122/97
accgccgccgg

SEQ ID NO: 3114935 - RNA, 13 nt, Mycobacterium bovis subsp bovis AF2122/97
accgccgccggca

SEQ ID NO: 3114936 - RNA, 17 nt, Mycobacterium bovis subsp bovis AF2122/97
accgccgccggcaccgc

SEQ ID NO: 3114937 - RNA, 18 nt, Mycobacterium bovis subsp bovis AF2122/97
accgccgccggcaccgcc

SEQ ID NO: 3114938 - RNA, 17 nt, Mycobacterium bovis subsp bovis AF2122/97
accgccgccugcccggc

SEQ ID NO: 3114939 - RNA, 14 nt, Mycobacterium bovis subsp bovis AF2122/97
accgccgcgaccgc

SEQ ID NO: 3114940 - RNA, 18 nt, Mycobacterium bovis subsp bovis AF2122/97
accgccgcgaccgccucg

SEQ ID NO: 3114941 - RNA, 20 nt, Mycobacterium bovis subsp bovis AF2122/97
accgccgcgaccgccucgcc

SEQ ID NO: 3114942 - RNA, 15 nt, Mycobacterium bovis subsp bovis AF2122/97
accgccgcgcagccg

SEQ ID NO: 3114943 - RNA, 18 nt, Mycobacterium bovis subsp bovis AF2122/97
accgccgcgcagccgcuc

SEQ ID NO: 3114944 - RNA, 16 nt, Mycobacterium bovis subsp bovis AF2122/97
accgccgcgccggcgg

SEQ ID NO: 3114945 - RNA, 17 nt, Mycobacterium bovis subsp bovis AF2122/97
accgccgcgccggcggc

SEQ ID NO: 3114946 - RNA, 23 nt, Mycobacterium bovis subsp bovis AF2122/97
accgccgcgccggcggccaccuc

SEQ ID NO: 3114947 - RNA, 14 nt, Mycobacterium bovis subsp bovis AF2122/97
accgccgcgcggau

SEQ ID NO: 3114948 - RNA, 24 nt, Mycobacterium bovis subsp bovis AF2122/97
accgccgcggccgccguccccgcc

SEQ ID NO: 3114949 - RNA, 16 nt, Mycobacterium bovis subsp bovis AF2122/97
accgccgcgucgagca

SEQ ID NO: 3114950 - RNA, 19 nt, Mycobacterium bovis subsp bovis AF2122/97
accgccgcgucgagcaccu

SEQ ID NO: 3114951 - RNA, 15 nt, Mycobacterium bovis subsp bovis AF2122/97
accgccgcuacccca

SEQ ID NO: 3114952 - RNA, 21 nt, Mycobacterium bovis subsp bovis AF2122/97
accgccgcuaccccagccggc

SEQ ID NO: 3114953 - RNA, 14 nt, Mycobacterium bovis subsp bovis AF2122/97
accgccgcuaccgc

SEQ ID NO: 3114954 - RNA, 12 nt, Mycobacterium bovis subsp bovis AF2122/97
accgccgcugcc

SEQ ID NO: 3114955 - RNA, 13 nt, Mycobacterium bovis subsp bovis AF2122/97
accgccgcugccg

SEQ ID NO: 3114956 - RNA, 15 nt, Mycobacterium bovis subsp bovis AF2122/97
accgccgcugccgau

SEQ ID NO: 3114957 - RNA, 21 nt, Mycobacterium bovis subsp bovis AF2122/97
accgccgcugccgguggcggc

SEQ ID NO: 3114958 - RNA, 14 nt, Mycobacterium bovis subsp bovis AF2122/97
accgccggaccgcc

SEQ ID NO: 3114959 - RNA, 12 nt, Mycobacterium bovis subsp bovis AF2122/97
accgccggcacc

SEQ ID NO: 3114960 - RNA, 15 nt, Mycobacterium bovis subsp bovis AF2122/97
accgccggcaccgcc

SEQ ID NO: 3114961 - RNA, 16 nt, Mycobacterium bovis subsp bovis AF2122/97
accgccggcaccgcca

SEQ ID NO: 3114962 - RNA, 16 nt, Mycobacterium bovis subsp bovis AF2122/97
accgccggcaccgccg

SEQ ID NO: 3114963 - RNA, 18 nt, Mycobacterium bovis subsp bovis AF2122/97
accgccggcaccgccgcc

SEQ ID NO: 3114964 - RNA, 21 nt, Mycobacterium bovis subsp bovis AF2122/97
accgccggcaccgccgccccc

SEQ ID NO: 3114965 - RNA, 16 nt, Mycobacterium bovis subsp bovis AF2122/97
accgccggccccaccg

SEQ ID NO: 3114966 - RNA, 12 nt, Mycobacterium bovis subsp bovis AF2122/97
accgccggcccg

SEQ ID NO: 3114967 - RNA, 13 nt, Mycobacterium bovis subsp bovis AF2122/97
accgccggcgacg

SEQ ID NO: 3114968 - RNA, 14 nt, Mycobacterium bovis subsp bovis AF2122/97
accgccggcgccac

SEQ ID NO: 3114969 - RNA, 21 nt, Mycobacterium bovis subsp bovis AF2122/97
accgccggcgccaccgucgcc

SEQ ID NO: 3114970 - RNA, 20 nt, Mycobacterium bovis subsp bovis AF2122/97
accgccggcgcccaggccga

SEQ ID NO: 3114971 - RNA, 14 nt, Mycobacterium bovis subsp bovis AF2122/97
accgccggcgccgg

SEQ ID NO: 3114972 - RNA, 17 nt, Mycobacterium bovis subsp bovis AF2122/97
accgccggcgccggugc

SEQ ID NO: 3114973 - RNA, 18 nt, Mycobacterium bovis subsp bovis AF2122/97
accgccggcgccggugcc

SEQ ID NO: 3114974 - RNA, 20 nt, Mycobacterium bovis subsp bovis AF2122/97
accgccggcgccggugccgc

SEQ ID NO: 3114975 - RNA, 13 nt, Mycobacterium bovis subsp bovis AF2122/97
accgccggcggcg

SEQ ID NO: 3114976 - RNA, 15 nt, Mycobacterium bovis subsp bovis AF2122/97
accgccggcggcggc

SEQ ID NO: 3114977 - RNA, 16 nt, Mycobacterium bovis subsp bovis AF2122/97
accgccggcggcggcc

SEQ ID NO: 3114978 - RNA, 18 nt, Mycobacterium bovis subsp bovis AF2122/97
accgccggcuccgccguu

SEQ ID NO: 3114979 - RNA, 21 nt, Mycobacterium bovis subsp bovis AF2122/97
accgccggcuccgccguugcc

SEQ ID NO: 3114980 - RNA, 23 nt, Mycobacterium bovis subsp bovis AF2122/97
accgccggcuccgccguugccgc

SEQ ID NO: 3114981 - RNA, 15 nt, Mycobacterium bovis subsp bovis AF2122/97
accgccgggaagccg

SEQ ID NO: 3114982 - RNA, 22 nt, Mycobacterium bovis subsp bovis AF2122/97
accgccgggauaucgucgacgc

SEQ ID NO: 3114983 - RNA, 19 nt, Mycobacterium bovis subsp bovis AF2122/97
accgccggggugugcagcg

SEQ ID NO: 3114984 - RNA, 13 nt, Mycobacterium bovis subsp bovis AF2122/97
accgccggugccg

SEQ ID NO: 3114985 - RNA, 15 nt, Mycobacterium bovis subsp bovis AF2122/97
accgccggugccgcc

SEQ ID NO: 3114986 - RNA, 16 nt, Mycobacterium bovis subsp bovis AF2122/97
accgccggugccgcca

SEQ ID NO: 3114987 - RNA, 20 nt, Mycobacterium bovis subsp bovis AF2122/97
accgccggugccgccaucgc

SEQ ID NO: 3114988 - RNA, 15 nt, Mycobacterium bovis subsp bovis AF2122/97
accgccggugcggcc

SEQ ID NO: 3114989 - RNA, 13 nt, Mycobacterium bovis subsp bovis AF2122/97
accgccggugcug

SEQ ID NO: 3114990 - RNA, 13 nt, Mycobacterium bovis subsp bovis AF2122/97
accgccgguggcg

SEQ ID NO: 3114991 - RNA, 19 nt, Mycobacterium bovis subsp bovis AF2122/97
accgccgguggcgccgggg

SEQ ID NO: 3114992 - RNA, 18 nt, Mycobacterium bovis subsp bovis AF2122/97
accgcgccgucgucgcgc

SEQ ID NO: 3114993 - RNA, 20 nt, Mycobacterium bovis subsp bovis AF2122/97
accgcgccgucgucgcgcag

SEQ ID NO: 3114994 - RNA, 14 nt, Mycobacterium bovis subsp bovis AF2122/97
accgcgccguggac

SEQ ID NO: 3114995 - RNA, 22 nt, Mycobacterium bovis subsp bovis AF2122/97
accgcgccuggagcgaucuccg

SEQ ID NO: 3114996 - RNA, 16 nt, Mycobacterium bovis subsp bovis AF2122/97
accgcgcgcucgccca

SEQ ID NO: 3114997 - RNA, 17 nt, Mycobacterium bovis subsp bovis AF2122/97
accgcgcgcucgcccag

SEQ ID NO: 3114998 - RNA, 17 nt, Mycobacterium bovis subsp bovis AF2122/97
accgcgcggaucucacc

SEQ ID NO: 3114999 - RNA, 15 nt, Mycobacterium bovis subsp bovis AF2122/97
accgcgcggcccgcc

SEQ ID NO: 3115000 - RNA, 17 nt, Mycobacterium bovis subsp bovis AF2122/97
accgcgcguugaagucg

SEQ ID NO: 3115001 - RNA, 20 nt, Mycobacterium bovis subsp bovis AF2122/97
accgcgcguugaagucgccg

SEQ ID NO: 3115002 - RNA, 18 nt, Mycobacterium bovis subsp bovis AF2122/97
accgcgcguuguggcgau

SEQ ID NO: 3115003 - RNA, 16 nt, Mycobacterium bovis subsp bovis AF2122/97
accgcgcucccggcgu

SEQ ID NO: 3115004 - RNA, 22 nt, Mycobacterium bovis subsp bovis AF2122/97
accgcgcuggucagccgugccg

SEQ ID NO: 3115005 - RNA, 17 nt, Mycobacterium bovis subsp bovis AF2122/97
accgcgcuuggagcggg

SEQ ID NO: 3115006 - RNA, 17 nt, Mycobacterium bovis subsp bovis AF2122/97
accgcggaaggccagcu

SEQ ID NO: 3115007 - RNA, 19 nt, Mycobacterium bovis subsp bovis AF2122/97
accgcggaaggccagcucu

SEQ ID NO: 3115008 - RNA, 10 nt, Mycobacterium bovis subsp bovis AF2122/97
accgcggaca

SEQ ID NO: 3115009 - RNA, 13 nt, Mycobacterium bovis subsp bovis AF2122/97
accgcggacacga

SEQ ID NO: 3115010 - RNA, 18 nt, Mycobacterium bovis subsp bovis AF2122/97
accgcggacacgaucgcg

SEQ ID NO: 3115011 - RNA, 14 nt, Mycobacterium bovis subsp bovis AF2122/97
accgcggacccgca

SEQ ID NO: 3115012 - RNA, 15 nt, Mycobacterium bovis subsp bovis AF2122/97
accgcggacccgcag

SEQ ID NO: 3115013 - RNA, 19 nt, Mycobacterium bovis subsp bovis AF2122/97
accgcggacccgcagcugc

SEQ ID NO: 3115014 - RNA, 20 nt, Mycobacterium bovis subsp bovis AF2122/97
accgcggacccgcagcugcg

SEQ ID NO: 3115015 - RNA, 16 nt, Mycobacterium bovis subsp bovis AF2122/97
accgcggauaggccgc

SEQ ID NO: 3115016 - RNA, 23 nt, Mycobacterium bovis subsp bovis AF2122/97
accgcggauaggccgcgcggcgg

SEQ ID NO: 3115017 - RNA, 14 nt, Mycobacterium bovis subsp bovis AF2122/97
accgcggaucgacc

SEQ ID NO: 3115018 - RNA, 15 nt, Mycobacterium bovis subsp bovis AF2122/97
accgcggauuccggc

SEQ ID NO: 3115019 - RNA, 20 nt, Mycobacterium bovis subsp bovis AF2122/97
accgcggcaagaguugccgg

SEQ ID NO: 3115020 - RNA, 20 nt, Mycobacterium bovis subsp bovis AF2122/97
accgcggcaugugacaucgg

SEQ ID NO: 3115021 - RNA, 14 nt, Mycobacterium bovis subsp bovis AF2122/97
accgcggccccgac

SEQ ID NO: 3115022 - RNA, 13 nt, Mycobacterium bovis subsp bovis AF2122/97
accgcggccccgc

SEQ ID NO: 3115023 - RNA, 22 nt, Mycobacterium bovis subsp bovis AF2122/97
accgcggccccgccguugccgc

SEQ ID NO: 3115024 - RNA, 22 nt, Mycobacterium bovis subsp bovis AF2122/97
accgcggcccggacgucggcgg

SEQ ID NO: 3115025 - RNA, 14 nt, Mycobacterium bovis subsp bovis AF2122/97
accgcggccgcggu

SEQ ID NO: 3115026 - RNA, 12 nt, Mycobacterium bovis subsp bovis AF2122/97
accgcggccggc

SEQ ID NO: 3115027 - RNA, 13 nt, Mycobacterium bovis subsp bovis AF2122/97
accgcggccggcc

SEQ ID NO: 3115028 - RNA, 16 nt, Mycobacterium bovis subsp bovis AF2122/97
accgcggccggccguc

SEQ ID NO: 3115029 - RNA, 16 nt, Mycobacterium bovis subsp bovis AF2122/97
accgcggccggguggc

SEQ ID NO: 3115030 - RNA, 17 nt, Mycobacterium bovis subsp bovis AF2122/97
accgcggccggguggcc

SEQ ID NO: 3115031 - RNA, 14 nt, Mycobacterium bovis subsp bovis AF2122/97
accgcggccuuggc

SEQ ID NO: 3115032 - RNA, 15 nt, Mycobacterium bovis subsp bovis AF2122/97
accgcggcgaucugc

SEQ ID NO: 3115033 - RNA, 18 nt, Mycobacterium bovis subsp bovis AF2122/97
accgcggcgaucugcgac

SEQ ID NO: 3115034 - RNA, 19 nt, Mycobacterium bovis subsp bovis AF2122/97
accgcggcgaucugcgaca

SEQ ID NO: 3115035 - RNA, 20 nt, Mycobacterium bovis subsp bovis AF2122/97
accgcggcgcguccgggcuc

SEQ ID NO: 3115036 - RNA, 13 nt, Mycobacterium bovis subsp bovis AF2122/97
accgcggcggccg

SEQ ID NO: 3115037 - RNA, 14 nt, Mycobacterium bovis subsp bovis AF2122/97
accgcggcggcgcg

SEQ ID NO: 3115038 - RNA, 20 nt, Mycobacterium bovis subsp bovis AF2122/97
accgcggcggcgcguggugc

SEQ ID NO: 3115039 - RNA, 21 nt, Mycobacterium bovis subsp bovis AF2122/97
accgcggcugcuccgucgccg

SEQ ID NO: 3115040 - RNA, 17 nt, Mycobacterium bovis subsp bovis AF2122/97
accgcggcugucacgcc

SEQ ID NO: 3115041 - RNA, 18 nt, Mycobacterium bovis subsp bovis AF2122/97
accgcggcugucacgccu

SEQ ID NO: 3115042 - RNA, 22 nt, Mycobacterium bovis subsp bovis AF2122/97
accgcggcugucacgccugcca

SEQ ID NO: 3115043 - RNA, 12 nt, Mycobacterium bovis subsp bovis AF2122/97
accgcgggcaua

SEQ ID NO: 3115044 - RNA, 14 nt, Mycobacterium bovis subsp bovis AF2122/97
accgcgggccgacg

SEQ ID NO: 3115045 - RNA, 14 nt, Mycobacterium bovis subsp bovis AF2122/97
accgcgggccgcca

SEQ ID NO: 3115046 - RNA, 20 nt, Mycobacterium bovis subsp bovis AF2122/97
accgcgggccgccaucucgu

SEQ ID NO: 3115047 - RNA, 18 nt, Mycobacterium bovis subsp bovis AF2122/97
accgcgggcggcaucgcc

SEQ ID NO: 3115048 - RNA, 19 nt, Mycobacterium bovis subsp bovis AF2122/97
accgcgggcggcaucgccg

SEQ ID NO: 3115049 - RNA, 23 nt, Mycobacterium bovis subsp bovis AF2122/97
accgcggggaugguguggucgau

SEQ ID NO: 3115050 - RNA, 19 nt, Mycobacterium bovis subsp bovis AF2122/97
accgcggggcagcgggccg

SEQ ID NO: 3115051 - RNA, 21 nt, Mycobacterium bovis subsp bovis AF2122/97
accgcggggcagcgggccgcc

SEQ ID NO: 3115052 - RNA, 15 nt, Mycobacterium bovis subsp bovis AF2122/97
accgcggguggaugu

SEQ ID NO: 3115053 - RNA, 15 nt, Mycobacterium bovis subsp bovis AF2122/97
accgcgguacgccgg

SEQ ID NO: 3115054 - RNA, 18 nt, Mycobacterium bovis subsp bovis AF2122/97
accgcgguacgccggucg

SEQ ID NO: 3115055 - RNA, 19 nt, Mycobacterium bovis subsp bovis AF2122/97
accgcgguacgccggucgg

SEQ ID NO: 3115056 - RNA, 12 nt, Mycobacterium bovis subsp bovis AF2122/97
accgcggucagc

SEQ ID NO: 3115057 - RNA, 23 nt, Mycobacterium bovis subsp bovis AF2122/97
accgcggucauggcgacggucgu

SEQ ID NO: 3115058 - RNA, 13 nt, Mycobacterium bovis subsp bovis AF2122/97
accgcggucgcca

SEQ ID NO: 3115059 - RNA, 22 nt, Mycobacterium bovis subsp bovis AF2122/97
accgcggucgccaagaucgggu

SEQ ID NO: 3115060 - RNA, 19 nt, Mycobacterium bovis subsp bovis AF2122/97
accgcggucugcgcgucgc

SEQ ID NO: 3115061 - RNA, 21 nt, Mycobacterium bovis subsp bovis AF2122/97
accgcggucugcgcgucgcgu

SEQ ID NO: 3115062 - RNA, 23 nt, Mycobacterium bovis subsp bovis AF2122/97
accgcggucugcgcgucgcgugg

SEQ ID NO: 3115063 - RNA, 16 nt, Mycobacterium bovis subsp bovis AF2122/97
accgcggucuucuuca

SEQ ID NO: 3115064 - RNA, 18 nt, Mycobacterium bovis subsp bovis AF2122/97
accgcggucuucuucacc

SEQ ID NO: 3115065 - RNA, 18 nt, Mycobacterium bovis subsp bovis AF2122/97
accgcggugacccggaag

SEQ ID NO: 3115066 - RNA, 20 nt, Mycobacterium bovis subsp bovis AF2122/97
accgcggugacucggccucc

SEQ ID NO: 3115067 - RNA, 18 nt, Mycobacterium bovis subsp bovis AF2122/97
accgcggugaguucgccg

SEQ ID NO: 3115068 - RNA, 12 nt, Mycobacterium bovis subsp bovis AF2122/97
accgcgguggcc

SEQ ID NO: 3115069 - RNA, 23 nt, Mycobacterium bovis subsp bovis AF2122/97
accgcgguggccagaucgaacgc

SEQ ID NO: 3115070 - RNA, 19 nt, Mycobacterium bovis subsp bovis AF2122/97
accgcgguggggucgacgc

SEQ ID NO: 3115071 - RNA, 20 nt, Mycobacterium bovis subsp bovis AF2122/97
accgcgguggggucgacgca

SEQ ID NO: 3115072 - RNA, 21 nt, Mycobacterium bovis subsp bovis AF2122/97
accgcguacaggccggccacc

SEQ ID NO: 3115073 - RNA, 22 nt, Mycobacterium bovis subsp bovis AF2122/97
accgcguagaccagugaccgca

SEQ ID NO: 3115074 - RNA, 16 nt, Mycobacterium bovis subsp bovis AF2122/97
accgcgucaucaccgg

SEQ ID NO: 3115075 - RNA, 17 nt, Mycobacterium bovis subsp bovis AF2122/97
accgcgucaucaccggu

SEQ ID NO: 3115076 - RNA, 12 nt, Mycobacterium bovis subsp bovis AF2122/97
accgcgucgcgg

SEQ ID NO: 3115077 - RNA, 13 nt, Mycobacterium bovis subsp bovis AF2122/97
accgcgucgcggg

SEQ ID NO: 3115078 - RNA, 15 nt, Mycobacterium bovis subsp bovis AF2122/97
accgcgucggcggcc

SEQ ID NO: 3115079 - RNA, 13 nt, Mycobacterium bovis subsp bovis AF2122/97
accggcacccgca

SEQ ID NO: 3115080 - RNA, 17 nt, Mycobacterium bovis subsp bovis AF2122/97
accggcacccgcacggc

SEQ ID NO: 3115081 - RNA, 13 nt, Mycobacterium bovis subsp bovis AF2122/97
accggcacccgcg

SEQ ID NO: 3115082 - RNA, 17 nt, Mycobacterium bovis subsp bovis AF2122/97
accggcacccgcggcga

SEQ ID NO: 3115083 - RNA, 19 nt, Mycobacterium bovis subsp bovis AF2122/97
accggcacccgcggcgaac

SEQ ID NO: 3115084 - RNA, 13 nt, Mycobacterium bovis subsp bovis AF2122/97
accggcacccgcu

SEQ ID NO: 3115085 - RNA, 23 nt, Mycobacterium bovis subsp bovis AF2122/97
accggcacccgcuggcgguaagc

SEQ ID NO: 3115086 - RNA, 15 nt, Mycobacterium bovis subsp bovis AF2122/97
accggcaccgcugcc

SEQ ID NO: 3115087 - RNA, 15 nt, Mycobacterium bovis subsp bovis AF2122/97
accggcacgccggcg

SEQ ID NO: 3115088 - RNA, 17 nt, Mycobacterium bovis subsp bovis AF2122/97
accggcacgccggcggc

SEQ ID NO: 3115089 - RNA, 19 nt, Mycobacterium bovis subsp bovis AF2122/97
accggcacgccggcggcgg

SEQ ID NO: 3115090 - RNA, 17 nt, Mycobacterium bovis subsp bovis AF2122/97
accggcacugcccagca

SEQ ID NO: 3115091 - RNA, 13 nt, Mycobacterium bovis subsp bovis AF2122/97
accggcagcugcu

SEQ ID NO: 3115092 - RNA, 14 nt, Mycobacterium bovis subsp bovis AF2122/97
accggcagcugcuc

SEQ ID NO: 3115093 - RNA, 18 nt, Mycobacterium bovis subsp bovis AF2122/97
accggcaggccggcgucg

SEQ ID NO: 3115094 - RNA, 16 nt, Mycobacterium bovis subsp bovis AF2122/97
accggcauacagccgg

SEQ ID NO: 3115095 - RNA, 17 nt, Mycobacterium bovis subsp bovis AF2122/97
accggcauacagccggc

SEQ ID NO: 3115096 - RNA, 14 nt, Mycobacterium bovis subsp bovis AF2122/97
accggcaucgauca

SEQ ID NO: 3115097 - RNA, 13 nt, Mycobacterium bovis subsp bovis AF2122/97
accggcaucgcga

SEQ ID NO: 3115098 - RNA, 18 nt, Mycobacterium bovis subsp bovis AF2122/97
accggcaugccgccaugc

SEQ ID NO: 3115099 - RNA, 21 nt, Mycobacterium bovis subsp bovis AF2122/97
accggcaugcgugccggcagc

SEQ ID NO: 3115100 - RNA, 14 nt, Mycobacterium bovis subsp bovis AF2122/97
accggccaacgccg

SEQ ID NO: 3115101 - RNA, 18 nt, Mycobacterium bovis subsp bovis AF2122/97
accggccaacgccgccgc

SEQ ID NO: 3115102 - RNA, 12 nt, Mycobacterium bovis subsp bovis AF2122/97
accggccaccag

SEQ ID NO: 3115103 - RNA, 11 nt, Mycobacterium bovis subsp bovis AF2122/97
accggccagcc

SEQ ID NO: 3115104 - RNA, 12 nt, Mycobacterium bovis subsp bovis AF2122/97
accggccagccg

SEQ ID NO: 3115105 - RNA, 16 nt, Mycobacterium bovis subsp bovis AF2122/97
accggccagcggcccg

SEQ ID NO: 3115106 - RNA, 20 nt, Mycobacterium bovis subsp bovis AF2122/97
accggccagcggcccgucac

SEQ ID NO: 3115107 - RNA, 23 nt, Mycobacterium bovis subsp bovis AF2122/97
accggccagcggcccgucaccgc

SEQ ID NO: 3115108 - RNA, 16 nt, Mycobacterium bovis subsp bovis AF2122/97
accggccaggccggcg

SEQ ID NO: 3115109 - RNA, 17 nt, Mycobacterium bovis subsp bovis AF2122/97
accggccaguccgggga

SEQ ID NO: 3115110 - RNA, 13 nt, Mycobacterium bovis subsp bovis AF2122/97
accggccaguggg

SEQ ID NO: 3115111 - RNA, 20 nt, Mycobacterium bovis subsp bovis AF2122/97
accggccaucgaccguccgg

SEQ ID NO: 3115112 - RNA, 23 nt, Mycobacterium bovis subsp bovis AF2122/97
accggccaucgaccguccggguc

SEQ ID NO: 3115113 - RNA, 15 nt, Mycobacterium bovis subsp bovis AF2122/97
accggcccaccgacg

SEQ ID NO: 3115114 - RNA, 23 nt, Mycobacterium bovis subsp bovis AF2122/97
accggcccagaucgguugaucgg

SEQ ID NO: 3115115 - RNA, 16 nt, Mycobacterium bovis subsp bovis AF2122/97
accggcccagugggac

SEQ ID NO: 3115116 - RNA, 16 nt, Mycobacterium bovis subsp bovis AF2122/97
accggccccaccggca

SEQ ID NO: 3115117 - RNA, 19 nt, Mycobacterium bovis subsp bovis AF2122/97
accggcccgcagcagcauc

SEQ ID NO: 3115118 - RNA, 17 nt, Mycobacterium bovis subsp bovis AF2122/97
accggcccgcauccgca

SEQ ID NO: 3115119 - RNA, 14 nt, Mycobacterium bovis subsp bovis AF2122/97
accggccgaaggcg

SEQ ID NO: 3115120 - RNA, 14 nt, Mycobacterium bovis subsp bovis AF2122/97
accggccgacgaac

SEQ ID NO: 3115121 - RNA, 19 nt, Mycobacterium bovis subsp bovis AF2122/97
accggccgacgaacagcgg

SEQ ID NO: 3115122 - RNA, 16 nt, Mycobacterium bovis subsp bovis AF2122/97
accggccgacgcuggc

SEQ ID NO: 3115123 - RNA, 13 nt, Mycobacterium bovis subsp bovis AF2122/97
accggccgcgacg

SEQ ID NO: 3115124 - RNA, 13 nt, Mycobacterium bovis subsp bovis AF2122/97
accggccgcggcg

SEQ ID NO: 3115125 - RNA, 21 nt, Mycobacterium bovis subsp bovis AF2122/97
accggccgcuauggcccgggc

SEQ ID NO: 3115126 - RNA, 14 nt, Mycobacterium bovis subsp bovis AF2122/97
accggccggccgcg

SEQ ID NO: 3115127 - RNA, 17 nt, Mycobacterium bovis subsp bovis AF2122/97
accggccgggugaacca

SEQ ID NO: 3115128 - RNA, 19 nt, Mycobacterium bovis subsp bovis AF2122/97
accggccgggugaaccaau

SEQ ID NO: 3115129 - RNA, 14 nt, Mycobacterium bovis subsp bovis AF2122/97
accggccggugcca

SEQ ID NO: 3115130 - RNA, 19 nt, Mycobacterium bovis subsp bovis AF2122/97
accggccggugcccgggcg

SEQ ID NO: 3115131 - RNA, 23 nt, Mycobacterium bovis subsp bovis AF2122/97
accggccgguggguagccagcgc

SEQ ID NO: 3115132 - RNA, 14 nt, Mycobacterium bovis subsp bovis AF2122/97
accggccgucgacg

SEQ ID NO: 3115133 - RNA, 16 nt, Mycobacterium bovis subsp bovis AF2122/97
accggccgucgacgca

SEQ ID NO: 3115134 - RNA, 23 nt, Mycobacterium bovis subsp bovis AF2122/97
accggccgucgacgcauggguca

SEQ ID NO: 3115135 - RNA, 15 nt, Mycobacterium bovis subsp bovis AF2122/97
accggccgugccgcc

SEQ ID NO: 3115136 - RNA, 18 nt, Mycobacterium bovis subsp bovis AF2122/97
accggccgugccgccgac

SEQ ID NO: 3115137 - RNA, 19 nt, Mycobacterium bovis subsp bovis AF2122/97
accggccgugccgccgaca

SEQ ID NO: 3115138 - RNA, 23 nt, Mycobacterium bovis subsp bovis AF2122/97
accggccgugccgccgacaccac

SEQ ID NO: 3115139 - RNA, 21 nt, Mycobacterium bovis subsp bovis AF2122/97
accggccugcgcgaccgacca

SEQ ID NO: 3115140 - RNA, 19 nt, Mycobacterium bovis subsp bovis AF2122/97
accggccuuauucacccgg

SEQ ID NO: 3115141 - RNA, 12 nt, Mycobacterium bovis subsp bovis AF2122/97
accggccuucaa

SEQ ID NO: 3115142 - RNA, 14 nt, Mycobacterium bovis subsp bovis AF2122/97
accggcgacgccgg

SEQ ID NO: 3115143 - RNA, 15 nt, Mycobacterium bovis subsp bovis AF2122/97
accggcgaucaccgu

SEQ ID NO: 3115144 - RNA, 20 nt, Mycobacterium bovis subsp bovis AF2122/97
accggcgaucguguccaccg

SEQ ID NO: 3115145 - RNA, 18 nt, Mycobacterium bovis subsp bovis AF2122/97
accggcgcaccgucgcgg

SEQ ID NO: 3115146 - RNA, 10 nt, Mycobacterium bovis subsp bovis AF2122/97
accggcgcca

SEQ ID NO: 3115147 - RNA, 19 nt, Mycobacterium bovis subsp bovis AF2122/97
accggcgccaccggcgccg

SEQ ID NO: 3115148 - RNA, 21 nt, Mycobacterium bovis subsp bovis AF2122/97
accggcgcccagcgccucgau

SEQ ID NO: 3115149 - RNA, 22 nt, Mycobacterium bovis subsp bovis AF2122/97
accggcgcccucaugucgggca

SEQ ID NO: 3115150 - RNA, 13 nt, Mycobacterium bovis subsp bovis AF2122/97
accggcgccgccg

SEQ ID NO: 3115151 - RNA, 14 nt, Mycobacterium bovis subsp bovis AF2122/97
accggcgccgccgg

SEQ ID NO: 3115152 - RNA, 16 nt, Mycobacterium bovis subsp bovis AF2122/97
accggcgccgccggca

SEQ ID NO: 3115153 - RNA, 22 nt, Mycobacterium bovis subsp bovis AF2122/97
accggcgccgccggcacccgcc

SEQ ID NO: 3115154 - RNA, 18 nt, Mycobacterium bovis subsp bovis AF2122/97
accggcgccgccgucgcc

SEQ ID NO: 3115155 - RNA, 16 nt, Mycobacterium bovis subsp bovis AF2122/97
accggcgccgccguug

SEQ ID NO: 3115156 - RNA, 12 nt, Mycobacterium bovis subsp bovis AF2122/97
accggcgccgcg

SEQ ID NO: 3115157 - RNA, 14 nt, Mycobacterium bovis subsp bovis AF2122/97
accggcgccgcgcg

SEQ ID NO: 3115158 - RNA, 16 nt, Mycobacterium bovis subsp bovis AF2122/97
accggcgccggaguug

SEQ ID NO: 3115159 - RNA, 14 nt, Mycobacterium bovis subsp bovis AF2122/97
accggcgccucauc

SEQ ID NO: 3115160 - RNA, 23 nt, Mycobacterium bovis subsp bovis AF2122/97
accggcgccucaucggacagcgc

SEQ ID NO: 3115161 - RNA, 14 nt, Mycobacterium bovis subsp bovis AF2122/97
accggcgccuccgg

SEQ ID NO: 3115162 - RNA, 15 nt, Mycobacterium bovis subsp bovis AF2122/97
accggcgccuccggc

SEQ ID NO: 3115163 - RNA, 23 nt, Mycobacterium bovis subsp bovis AF2122/97
accggcgccuccggcaccuccag

SEQ ID NO: 3115164 - RNA, 15 nt, Mycobacterium bovis subsp bovis AF2122/97
accggcgcgaccgcg

SEQ ID NO: 3115165 - RNA, 16 nt, Mycobacterium bovis subsp bovis AF2122/97
accggcgcgaccgcgg

SEQ ID NO: 3115166 - RNA, 22 nt, Mycobacterium bovis subsp bovis AF2122/97
accgggcaaaucaagcacagcc

SEQ ID NO: 3115167 - RNA, 16 nt, Mycobacterium bovis subsp bovis AF2122/97
accgggcaacggcggg

SEQ ID NO: 3115168 - RNA, 20 nt, Mycobacterium bovis subsp bovis AF2122/97
accgggcaacggcggggccg

SEQ ID NO: 3115169 - RNA, 14 nt, Mycobacterium bovis subsp bovis AF2122/97
accgggcaccagaa

SEQ ID NO: 3115170 - RNA, 17 nt, Mycobacterium bovis subsp bovis AF2122/97
accgggcaccagucgcc

SEQ ID NO: 3115171 - RNA, 18 nt, Mycobacterium bovis subsp bovis AF2122/97
accgggcaccagucgccc

SEQ ID NO: 3115172 - RNA, 15 nt, Mycobacterium bovis subsp bovis AF2122/97
accgggcccgacgac

SEQ ID NO: 3115173 - RNA, 15 nt, Mycobacterium bovis subsp bovis AF2122/97
accgggcccgacgcg

SEQ ID NO: 3115174 - RNA, 14 nt, Mycobacterium bovis subsp bovis AF2122/97
accgggcccgccgg

SEQ ID NO: 3115175 - RNA, 21 nt, Mycobacterium bovis subsp bovis AF2122/97
accgggcccgccggccccgcc

SEQ ID NO: 3115176 - RNA, 17 nt, Mycobacterium bovis subsp bovis AF2122/97
accgggcgagucccggc

SEQ ID NO: 3115177 - RNA, 14 nt, Mycobacterium bovis subsp bovis AF2122/97
accgggcggcggcg

SEQ ID NO: 3115178 - RNA, 23 nt, Mycobacterium bovis subsp bovis AF2122/97
accgggcggcguuugagaacaac

SEQ ID NO: 3115179 - RNA, 13 nt, Mycobacterium bovis subsp bovis AF2122/97
accgggcgugcca

SEQ ID NO: 3115180 - RNA, 21 nt, Mycobacterium bovis subsp bovis AF2122/97
accgggcgugcggcggcccau

SEQ ID NO: 3115181 - RNA, 12 nt, Mycobacterium bovis subsp bovis AF2122/97
accgggcucugg

SEQ ID NO: 3115182 - RNA, 14 nt, Mycobacterium bovis subsp bovis AF2122/97
accggggccgucgg

SEQ ID NO: 3115183 - RNA, 16 nt, Mycobacterium bovis subsp bovis AF2122/97
accggggcgcccggcc

SEQ ID NO: 3115184 - RNA, 20 nt, Mycobacterium bovis subsp bovis AF2122/97
accggggcgcccggccaggu

SEQ ID NO: 3115185 - RNA, 17 nt, Mycobacterium bovis subsp bovis AF2122/97
accggggcuuggguuga

SEQ ID NO: 3115186 - RNA, 18 nt, Mycobacterium bovis subsp bovis AF2122/97
accgggggaagcgguagc

SEQ ID NO: 3115187 - RNA, 22 nt, Mycobacterium bovis subsp bovis AF2122/97
accggggucaccuuggccgggu

SEQ ID NO: 3115188 - RNA, 19 nt, Mycobacterium bovis subsp bovis AF2122/97
accgggucaacgccaucac

SEQ ID NO: 3115189 - RNA, 15 nt, Mycobacterium bovis subsp bovis AF2122/97
accgggucacuccgg

SEQ ID NO: 3115190 - RNA, 21 nt, Mycobacterium bovis subsp bovis AF2122/97
accggguccggcguacgccgu

SEQ ID NO: 3115191 - RNA, 15 nt, Mycobacterium bovis subsp bovis AF2122/97
accgggucgaugacg

SEQ ID NO: 3115192 - RNA, 19 nt, Mycobacterium bovis subsp bovis AF2122/97
accgggucgaugacgccgu

SEQ ID NO: 3115193 - RNA, 20 nt, Mycobacterium bovis subsp bovis AF2122/97
accgggucgaugacgccguc

SEQ ID NO: 3115194 - RNA, 14 nt, Mycobacterium bovis subsp bovis AF2122/97
accgggucgcaacc

SEQ ID NO: 3115195 - RNA, 13 nt, Mycobacterium bovis subsp bovis AF2122/97
accgggucgccga

SEQ ID NO: 3115196 - RNA, 19 nt, Mycobacterium bovis subsp bovis AF2122/97
accgggucgggcaccgcgc

SEQ ID NO: 3115197 - RNA, 20 nt, Mycobacterium bovis subsp bovis AF2122/97
accgggucgggcaccgcgcg

SEQ ID NO: 3115198 - RNA, 14 nt, Mycobacterium bovis subsp bovis AF2122/97
accgggugcaggug

SEQ ID NO: 3115199 - RNA, 16 nt, Mycobacterium bovis subsp bovis AF2122/97
accgggugggucguuc

SEQ ID NO: 3115200 - RNA, 23 nt, Mycobacterium bovis subsp bovis AF2122/97
accgggugggucguucaccgauc

SEQ ID NO: 3115201 - RNA, 12 nt, Mycobacterium bovis subsp bovis AF2122/97
accgggugugcg

SEQ ID NO: 3115202 - RNA, 19 nt, Mycobacterium bovis subsp bovis AF2122/97
accgggugugcgucgaggu

SEQ ID NO: 3115203 - RNA, 19 nt, Mycobacterium bovis subsp bovis AF2122/97
accggguguggucgguggc

SEQ ID NO: 3115204 - RNA, 18 nt, Mycobacterium bovis subsp bovis AF2122/97
accggguugagccgccgc

SEQ ID NO: 3115205 - RNA, 15 nt, Mycobacterium bovis subsp bovis AF2122/97
accgguaacgccaac

SEQ ID NO: 3115206 - RNA, 17 nt, Mycobacterium bovis subsp bovis AF2122/97
accgguaacgccaacac

SEQ ID NO: 3115207 - RNA, 19 nt, Mycobacterium bovis subsp bovis AF2122/97
accgguaacgccaacaccg

SEQ ID NO: 3115208 - RNA, 21 nt, Mycobacterium bovis subsp bovis AF2122/97
accgguaacgccaacaccggc

SEQ ID NO: 3115209 - RNA, 14 nt, Mycobacterium bovis subsp bovis AF2122/97
accgguacaacccc

SEQ ID NO: 3115210 - RNA, 16 nt, Mycobacterium bovis subsp bovis AF2122/97
accgguaccgccggcu

SEQ ID NO: 3115211 - RNA, 13 nt, Mycobacterium bovis subsp bovis AF2122/97
accgguaccggcg

SEQ ID NO: 3115212 - RNA, 14 nt, Mycobacterium bovis subsp bovis AF2122/97
accgguaccggcga

SEQ ID NO: 3115213 - RNA, 19 nt, Mycobacterium bovis subsp bovis AF2122/97
accgguaccggcgacgaau

SEQ ID NO: 3115214 - RNA, 20 nt, Mycobacterium bovis subsp bovis AF2122/97
accgguaccugacagcucac

SEQ ID NO: 3115215 - RNA, 17 nt, Mycobacterium bovis subsp bovis AF2122/97
accgguaggcaccgauc

SEQ ID NO: 3115216 - RNA, 16 nt, Mycobacterium bovis subsp bovis AF2122/97
accgguauagccaagu

SEQ ID NO: 3115217 - RNA, 15 nt, Mycobacterium bovis subsp bovis AF2122/97
accgguaucgccaaa

SEQ ID NO: 3115218 - RNA, 13 nt, Mycobacterium bovis subsp bovis AF2122/97
accgguaucgccg

SEQ ID NO: 3115219 - RNA, 14 nt, Mycobacterium bovis subsp bovis AF2122/97
accgguaucgccgc

SEQ ID NO: 3115220 - RNA, 16 nt, Mycobacterium bovis subsp bovis AF2122/97
accgguauguucggca

SEQ ID NO: 3115221 - RNA, 18 nt, Mycobacterium bovis subsp bovis AF2122/97
accggucaaacgcgcgcg

SEQ ID NO: 3115222 - RNA, 22 nt, Mycobacterium bovis subsp bovis AF2122/97
accggucaaacgcgcgcgccau

SEQ ID NO: 3115223 - RNA, 13 nt, Mycobacterium bovis subsp bovis AF2122/97
accggucaacgug

SEQ ID NO: 3115224 - RNA, 13 nt, Mycobacterium bovis subsp bovis AF2122/97
accggucacccgu

SEQ ID NO: 3115225 - RNA, 14 nt, Mycobacterium bovis subsp bovis AF2122/97
accggucaccgcgc

SEQ ID NO: 3115226 - RNA, 15 nt, Mycobacterium bovis subsp bovis AF2122/97
accggucagcaccuc

SEQ ID NO: 3115227 - RNA, 19 nt, Mycobacterium bovis subsp bovis AF2122/97
accggucagcaccuccacc

SEQ ID NO: 3115228 - RNA, 23 nt, Mycobacterium bovis subsp bovis AF2122/97
accggucagcaccuccaccgcgc

SEQ ID NO: 3115229 - RNA, 20 nt, Mycobacterium bovis subsp bovis AF2122/97
accggucccugcgccgucaa

SEQ ID NO: 3115230 - RNA, 16 nt, Mycobacterium bovis subsp bovis AF2122/97
accgguccgucaccac

SEQ ID NO: 3115231 - RNA, 19 nt, Mycobacterium bovis subsp bovis AF2122/97
accgguccugggauccggc

SEQ ID NO: 3115232 - RNA, 15 nt, Mycobacterium bovis subsp bovis AF2122/97
accggucgcagugca

SEQ ID NO: 3115233 - RNA, 18 nt, Mycobacterium bovis subsp bovis AF2122/97
accggucgcagugcaccc

SEQ ID NO: 3115234 - RNA, 12 nt, Mycobacterium bovis subsp bovis AF2122/97
accggucggcca

SEQ ID NO: 3115235 - RNA, 22 nt, Mycobacterium bovis subsp bovis AF2122/97
accggucgucugucucggugcc

SEQ ID NO: 3115236 - RNA, 23 nt, Mycobacterium bovis subsp bovis AF2122/97
accggucgucugucucggugccu

SEQ ID NO: 3115237 - RNA, 13 nt, Mycobacterium bovis subsp bovis AF2122/97
accggucugaucg

SEQ ID NO: 3115238 - RNA, 14 nt, Mycobacterium bovis subsp bovis AF2122/97
accggugacgcaca

SEQ ID NO: 3115239 - RNA, 15 nt, Mycobacterium bovis subsp bovis AF2122/97
accggugacgcacag

SEQ ID NO: 3115240 - RNA, 21 nt, Mycobacterium bovis subsp bovis AF2122/97
accggugacgcacagcagcac

SEQ ID NO: 3115241 - RNA, 14 nt, Mycobacterium bovis subsp bovis AF2122/97
accggugaggcguu

SEQ ID NO: 3115242 - RNA, 18 nt, Mycobacterium bovis subsp bovis AF2122/97
accggugauggugaccag

SEQ ID NO: 3115243 - RNA, 22 nt, Mycobacterium bovis subsp bovis AF2122/97
accggugauggugaccagcagg

SEQ ID NO: 3115244 - RNA, 14 nt, Mycobacterium bovis subsp bovis AF2122/97
accggugccagcag

SEQ ID NO: 3115245 - RNA, 12 nt, Mycobacterium bovis subsp bovis AF2122/97
accggugccgcc

SEQ ID NO: 3115246 - RNA, 16 nt, Mycobacterium bovis subsp bovis AF2122/97
accggugccgcccgcg

SEQ ID NO: 3115247 - RNA, 23 nt, Mycobacterium bovis subsp bovis AF2122/97
accggugccgcccgcgccgccgc

SEQ ID NO: 3115248 - RNA, 12 nt, Mycobacterium bovis subsp bovis AF2122/97
accggugccggc

SEQ ID NO: 3115249 - RNA, 14 nt, Mycobacterium bovis subsp bovis AF2122/97
accggugccggcga

SEQ ID NO: 3115250 - RNA, 16 nt, Mycobacterium bovis subsp bovis AF2122/97
accggugccugcaacg

SEQ ID NO: 3115251 - RNA, 13 nt, Mycobacterium bovis subsp bovis AF2122/97
accggugcgcauc

SEQ ID NO: 3115252 - RNA, 21 nt, Mycobacterium bovis subsp bovis AF2122/97
accggugcgcauccgucguac

SEQ ID NO: 3115253 - RNA, 14 nt, Mycobacterium bovis subsp bovis AF2122/97
accgucgucaccgc

SEQ ID NO: 3115254 - RNA, 16 nt, Mycobacterium bovis subsp bovis AF2122/97
accgucgucaccgcga

SEQ ID NO: 3115255 - RNA, 18 nt, Mycobacterium bovis subsp bovis AF2122/97
accgucgucgugcaggcg

SEQ ID NO: 3115256 - RNA, 20 nt, Mycobacterium bovis subsp bovis AF2122/97
accgucgucguuucgccagc

SEQ ID NO: 3115257 - RNA, 15 nt, Mycobacterium bovis subsp bovis AF2122/97
accgucguggcggug

SEQ ID NO: 3115258 - RNA, 14 nt, Mycobacterium bovis subsp bovis AF2122/97
accgucucgcaccg

SEQ ID NO: 3115259 - RNA, 15 nt, Mycobacterium bovis subsp bovis AF2122/97
accgucucgcaccgc

SEQ ID NO: 3115260 - RNA, 16 nt, Mycobacterium bovis subsp bovis AF2122/97
accgucucgcaccgcg

SEQ ID NO: 3115261 - RNA, 13 nt, Mycobacterium bovis subsp bovis AF2122/97
accgucucgcccc

SEQ ID NO: 3115262 - RNA, 20 nt, Mycobacterium bovis subsp bovis AF2122/97
accgucucggcgaccgacgc

SEQ ID NO: 3115263 - RNA, 19 nt, Mycobacterium bovis subsp bovis AF2122/97
accgucugcaccggcaggc

SEQ ID NO: 3115264 - RNA, 20 nt, Mycobacterium bovis subsp bovis AF2122/97
accgucugcgacccgggccg

SEQ ID NO: 3115265 - RNA, 20 nt, Mycobacterium bovis subsp bovis AF2122/97
accgucugcggaccggcgcg

SEQ ID NO: 3115266 - RNA, 15 nt, Mycobacterium bovis subsp bovis AF2122/97
accgucuggccguug

SEQ ID NO: 3115267 - RNA, 16 nt, Mycobacterium bovis subsp bovis AF2122/97
accgugaaccgcccgc

SEQ ID NO: 3115268 - RNA, 15 nt, Mycobacterium bovis subsp bovis AF2122/97
accgugaacucgcgc

SEQ ID NO: 3115269 - RNA, 21 nt, Mycobacterium bovis subsp bovis AF2122/97
accgugacagcggcauugcca

SEQ ID NO: 3115270 - RNA, 19 nt, Mycobacterium bovis subsp bovis AF2122/97
accgugaccgccgcgccgg

SEQ ID NO: 3115271 - RNA, 23 nt, Mycobacterium bovis subsp bovis AF2122/97
accgugauggcguuugccggccg

SEQ ID NO: 3115272 - RNA, 15 nt, Mycobacterium bovis subsp bovis AF2122/97
accgugcaccagcuc

SEQ ID NO: 3115273 - RNA, 14 nt, Mycobacterium bovis subsp bovis AF2122/97
accgugcacgucag

SEQ ID NO: 3115274 - RNA, 18 nt, Mycobacterium bovis subsp bovis AF2122/97
accgugccgacgccccga

SEQ ID NO: 3115275 - RNA, 13 nt, Mycobacterium bovis subsp bovis AF2122/97
accgugccgggcg

SEQ ID NO: 3115276 - RNA, 16 nt, Mycobacterium bovis subsp bovis AF2122/97
accgugcggaucgcgc

SEQ ID NO: 3115277 - RNA, 21 nt, Mycobacterium bovis subsp bovis AF2122/97
accgugcggaucgcgcugcgg

SEQ ID NO: 3115278 - RNA, 19 nt, Mycobacterium bovis subsp bovis AF2122/97
accgugcggggggcagcuc

SEQ ID NO: 3115279 - RNA, 20 nt, Mycobacterium bovis subsp bovis AF2122/97
accguggaagauguugccgc

SEQ ID NO: 3115280 - RNA, 22 nt, Mycobacterium bovis subsp bovis AF2122/97
accguggaagauguugccgccg

SEQ ID NO: 3115281 - RNA, 13 nt, Mycobacterium bovis subsp bovis AF2122/97
accguggcagcug

SEQ ID NO: 3115282 - RNA, 17 nt, Mycobacterium bovis subsp bovis AF2122/97
accguggcgccggucgc

SEQ ID NO: 3115283 - RNA, 18 nt, Mycobacterium bovis subsp bovis AF2122/97
accguggcgccggucgcc

SEQ ID NO: 3115284 - RNA, 14 nt, Mycobacterium bovis subsp bovis AF2122/97
accguggcggccuc

SEQ ID NO: 3115285 - RNA, 23 nt, Mycobacterium bovis subsp bovis AF2122/97
accguggcggccuccuccccgac

SEQ ID NO: 3115286 - RNA, 19 nt, Mycobacterium bovis subsp bovis AF2122/97
accguggcggggaaaccgg

SEQ ID NO: 3115287 - RNA, 20 nt, Mycobacterium bovis subsp bovis AF2122/97
accgugggccugcccggcgc

SEQ ID NO: 3115288 - RNA, 19 nt, Mycobacterium bovis subsp bovis AF2122/97
accgugggcgacggcggcg

SEQ ID NO: 3115289 - RNA, 14 nt, Mycobacterium bovis subsp bovis AF2122/97
accguggucggagg

SEQ ID NO: 3115290 - RNA, 16 nt, Mycobacterium bovis subsp bovis AF2122/97
accguggucggaggug

SEQ ID NO: 3115291 - RNA, 24 nt, Mycobacterium bovis subsp bovis AF2122/97
accgugguggacgaccgcgcggca

SEQ ID NO: 3115292 - RNA, 12 nt, Mycobacterium bovis subsp bovis AF2122/97
accgugucaccg

SEQ ID NO: 3115293 - RNA, 13 nt, Mycobacterium bovis subsp bovis AF2122/97
accgugucaccgc

SEQ ID NO: 3115294 - RNA, 20 nt, Mycobacterium bovis subsp bovis AF2122/97
accgugucacgcgaccaccg

SEQ ID NO: 3115295 - RNA, 21 nt, Mycobacterium bovis subsp bovis AF2122/97
accgugucgccggcgaaguug

SEQ ID NO: 3115296 - RNA, 16 nt, Mycobacterium bovis subsp bovis AF2122/97
accgugucuacgccgg

SEQ ID NO: 3115297 - RNA, 18 nt, Mycobacterium bovis subsp bovis AF2122/97
accguguggccguuggcc

SEQ ID NO: 3115298 - RNA, 19 nt, Mycobacterium bovis subsp bovis AF2122/97
accgugugggccccgccga

SEQ ID NO: 3115299 - RNA, 20 nt, Mycobacterium bovis subsp bovis AF2122/97
accgugugggccccgccgau

SEQ ID NO: 3115300 - RNA, 22 nt, Mycobacterium bovis subsp bovis AF2122/97
accguguugcugaacugguugg

SEQ ID NO: 3115301 - RNA, 16 nt, Mycobacterium bovis subsp bovis AF2122/97
accguguugcugucga

SEQ ID NO: 3115302 - RNA, 21 nt, Mycobacterium bovis subsp bovis AF2122/97
accguguugcugucgaaguug

SEQ ID NO: 3115303 - RNA, 14 nt, Mycobacterium bovis subsp bovis AF2122/97
accguuaccgccgu

SEQ ID NO: 3115304 - RNA, 15 nt, Mycobacterium bovis subsp bovis AF2122/97
accguucacccagcg

SEQ ID NO: 3115305 - RNA, 16 nt, Mycobacterium bovis subsp bovis AF2122/97
accguucacccagcgg

SEQ ID NO: 3115306 - RNA, 21 nt, Mycobacterium bovis subsp bovis AF2122/97
accguucgcucagggugucga

SEQ ID NO: 3115307 - RNA, 14 nt, Mycobacterium bovis subsp bovis AF2122/97
accguucggcgaca

SEQ ID NO: 3115308 - RNA, 22 nt, Mycobacterium bovis subsp bovis AF2122/97
accguucggcgacagcgcggcg

SEQ ID NO: 3115309 - RNA, 14 nt, Mycobacterium bovis subsp bovis AF2122/97
accguugaccucuu

SEQ ID NO: 3115310 - RNA, 20 nt, Mycobacterium bovis subsp bovis AF2122/97
accguugaccucuucgggca

SEQ ID NO: 3115311 - RNA, 14 nt, Mycobacterium bovis subsp bovis AF2122/97
accguugccgaacc

SEQ ID NO: 3115312 - RNA, 21 nt, Mycobacterium bovis subsp bovis AF2122/97
accguugccgaaccacgcgcc

SEQ ID NO: 3115313 - RNA, 14 nt, Mycobacterium bovis subsp bovis AF2122/97
accguugccgccgu

SEQ ID NO: 3115314 - RNA, 21 nt, Mycobacterium bovis subsp bovis AF2122/97
accguugccgccguugccggc

SEQ ID NO: 3115315 - RNA, 13 nt, Mycobacterium bovis subsp bovis AF2122/97
accguugccgucg

SEQ ID NO: 3115316 - RNA, 20 nt, Mycobacterium bovis subsp bovis AF2122/97
accguugcgaagaagaaggc

SEQ ID NO: 3115317 - RNA, 14 nt, Mycobacterium bovis subsp bovis AF2122/97
accguuggccgcgc

SEQ ID NO: 3115318 - RNA, 19 nt, Mycobacterium bovis subsp bovis AF2122/97
accguuguaccccagcauc

SEQ ID NO: 3115319 - RNA, 23 nt, Mycobacterium bovis subsp bovis AF2122/97
accguuguucccauagccagccg

SEQ ID NO: 3115320 - RNA, 21 nt, Mycobacterium bovis subsp bovis AF2122/97
accguuguugaggaugccgga

SEQ ID NO: 3115321 - RNA, 19 nt, Mycobacterium bovis subsp bovis AF2122/97
accguuucgaucucgagca

SEQ ID NO: 3115322 - RNA, 14 nt, Mycobacterium bovis subsp bovis AF2122/97
accguuugacgcgc

SEQ ID NO: 3115323 - RNA, 17 nt, Mycobacterium bovis subsp bovis AF2122/97
accguuugagcggccac

SEQ ID NO: 3115324 - RNA, 19 nt, Mycobacterium bovis subsp bovis AF2122/97
accguuugagcggccaccg

SEQ ID NO: 3115325 - RNA, 18 nt, Mycobacterium bovis subsp bovis AF2122/97
accguuugcgcaccgguc

SEQ ID NO: 3115326 - RNA, 19 nt, Mycobacterium bovis subsp bovis AF2122/97
accguuugggcgccggugu

SEQ ID NO: 3115327 - RNA, 14 nt, Mycobacterium bovis subsp bovis AF2122/97
accuaacccgcacc

SEQ ID NO: 3115328 - RNA, 13 nt, Mycobacterium bovis subsp bovis AF2122/97
accuacccugcgc

SEQ ID NO: 3115329 - RNA, 22 nt, Mycobacterium bovis subsp bovis AF2122/97
accuaccgagaucaccgccacc

SEQ ID NO: 3115330 - RNA, 23 nt, Mycobacterium bovis subsp bovis AF2122/97
accuaccgagaucaccgccacca

SEQ ID NO: 3115331 - RNA, 22 nt, Mycobacterium bovis subsp bovis AF2122/97
accuacgaagcguugaccgcgg

SEQ ID NO: 3115332 - RNA, 17 nt, Mycobacterium bovis subsp bovis AF2122/97
accuagcaccgcgccga

SEQ ID NO: 3115333 - RNA, 18 nt, Mycobacterium bovis subsp bovis AF2122/97
accuagcagggugccggc

SEQ ID NO: 3115334 - RNA, 13 nt, Mycobacterium bovis subsp bovis AF2122/97
accuaugauucag

SEQ ID NO: 3115335 - RNA, 16 nt, Mycobacterium bovis subsp bovis AF2122/97
accuaugggaccggca

SEQ ID NO: 3115336 - RNA, 14 nt, Mycobacterium bovis subsp bovis AF2122/97
accuauuugcgacc

SEQ ID NO: 3115337 - RNA, 22 nt, Mycobacterium bovis subsp bovis AF2122/97
accuauuugcgaccccgccgag

SEQ ID NO: 3115338 - RNA, 16 nt, Mycobacterium bovis subsp bovis AF2122/97
accucaacaccaggcc

SEQ ID NO: 3115339 - RNA, 19 nt, Mycobacterium bovis subsp bovis AF2122/97
accucgugguucugcaggu

SEQ ID NO: 3115340 - RNA, 16 nt, Mycobacterium bovis subsp bovis AF2122/97
accucguguccgggga

SEQ ID NO: 3115341 - RNA, 15 nt, Mycobacterium bovis subsp bovis AF2122/97
accucguugcugccg

SEQ ID NO: 3115342 - RNA, 17 nt, Mycobacterium bovis subsp bovis AF2122/97
accucguugcugccggc

SEQ ID NO: 3115343 - RNA, 23 nt, Mycobacterium bovis subsp bovis AF2122/97
accucuaccggugguagcggcgg

SEQ ID NO: 3115344 - RNA, 15 nt, Mycobacterium bovis subsp bovis AF2122/97
accucugcguccagc

SEQ ID NO: 3115345 - RNA, 16 nt, Mycobacterium bovis subsp bovis AF2122/97
accucugcugagcugc

SEQ ID NO: 3115346 - RNA, 20 nt, Mycobacterium bovis subsp bovis AF2122/97
accucugcugagcugcucgc

SEQ ID NO: 3115347 - RNA, 14 nt, Mycobacterium bovis subsp bovis AF2122/97
accucuggcggcgg

SEQ ID NO: 3115348 - RNA, 15 nt, Mycobacterium bovis subsp bovis AF2122/97
accugaagccagcgc

SEQ ID NO: 3115349 - RNA, 14 nt, Mycobacterium bovis subsp bovis AF2122/97
accugaagccgcgc

SEQ ID NO: 3115350 - RNA, 15 nt, Mycobacterium bovis subsp bovis AF2122/97
accugaagccgcgcu

SEQ ID NO: 3115351 - RNA, 21 nt, Mycobacterium bovis subsp bovis AF2122/97
accugacacgcccgcgagcug

SEQ ID NO: 3115352 - RNA, 20 nt, Mycobacterium bovis subsp bovis AF2122/97
accugaccgguggccaucgc

SEQ ID NO: 3115353 - RNA, 19 nt, Mycobacterium bovis subsp bovis AF2122/97
accugacgcucggucgcca

SEQ ID NO: 3115354 - RNA, 22 nt, Mycobacterium bovis subsp bovis AF2122/97
accugacgcucggucgccaccg

SEQ ID NO: 3115355 - RNA, 22 nt, Mycobacterium bovis subsp bovis AF2122/97
accugacggaaguacuccaugg

SEQ ID NO: 3115356 - RNA, 19 nt, Mycobacterium bovis subsp bovis AF2122/97
accugagcaucuccucgcc

SEQ ID NO: 3115357 - RNA, 18 nt, Mycobacterium bovis subsp bovis AF2122/97
accugagcgcgcgcggug

SEQ ID NO: 3115358 - RNA, 17 nt, Mycobacterium bovis subsp bovis AF2122/97
accugaguccggcacgc

SEQ ID NO: 3115359 - RNA, 15 nt, Mycobacterium bovis subsp bovis AF2122/97
accugcaugcccaga

SEQ ID NO: 3115360 - RNA, 22 nt, Mycobacterium bovis subsp bovis AF2122/97
accugccgacucaucggccgcg

SEQ ID NO: 3115361 - RNA, 16 nt, Mycobacterium bovis subsp bovis AF2122/97
accugccggaccgcgg

SEQ ID NO: 3115362 - RNA, 16 nt, Mycobacterium bovis subsp bovis AF2122/97
accugccgggccacgg

SEQ ID NO: 3115363 - RNA, 13 nt, Mycobacterium bovis subsp bovis AF2122/97
accugccguuccg

SEQ ID NO: 3115364 - RNA, 18 nt, Mycobacterium bovis subsp bovis AF2122/97
accugcgaccaggcgcgg

SEQ ID NO: 3115365 - RNA, 13 nt, Mycobacterium bovis subsp bovis AF2122/97
accugcgagaucg

SEQ ID NO: 3115366 - RNA, 17 nt, Mycobacterium bovis subsp bovis AF2122/97
accugcgcgcggccgcg

SEQ ID NO: 3115367 - RNA, 19 nt, Mycobacterium bovis subsp bovis AF2122/97
accugcgcgcggccgcgcu

SEQ ID NO: 3115368 - RNA, 14 nt, Mycobacterium bovis subsp bovis AF2122/97
accugcgcggcgau

SEQ ID NO: 3115369 - RNA, 23 nt, Mycobacterium bovis subsp bovis AF2122/97
accugcgggaucgccgagaccgc

SEQ ID NO: 3115370 - RNA, 17 nt, Mycobacterium bovis subsp bovis AF2122/97
accugcgggcccacgcc

SEQ ID NO: 3115371 - RNA, 19 nt, Mycobacterium bovis subsp bovis AF2122/97
accugcucauccaccucga

SEQ ID NO: 3115372 - RNA, 19 nt, Mycobacterium bovis subsp bovis AF2122/97
accugcuccgcugucaccc

SEQ ID NO: 3115373 - RNA, 15 nt, Mycobacterium bovis subsp bovis AF2122/97
accugcucgauacgg

SEQ ID NO: 3115374 - RNA, 16 nt, Mycobacterium bovis subsp bovis AF2122/97
accugcucgauacggc

SEQ ID NO: 3115375 - RNA, 17 nt, Mycobacterium bovis subsp bovis AF2122/97
accugcucggcgcgccg

SEQ ID NO: 3115376 - RNA, 14 nt, Mycobacterium bovis subsp bovis AF2122/97
accugcucgggcgu

SEQ ID NO: 3115377 - RNA, 16 nt, Mycobacterium bovis subsp bovis AF2122/97
accugcucgggcguga

SEQ ID NO: 3115378 - RNA, 22 nt, Mycobacterium bovis subsp bovis AF2122/97
accugcucgggcgugaucccgc

SEQ ID NO: 3115379 - RNA, 16 nt, Mycobacterium bovis subsp bovis AF2122/97
accugcugcaccguca

SEQ ID NO: 3115380 - RNA, 23 nt, Mycobacterium bovis subsp bovis AF2122/97
accugcugggagggaccacccgg

SEQ ID NO: 3115381 - RNA, 15 nt, Mycobacterium bovis subsp bovis AF2122/97
accugcuggggcauc

SEQ ID NO: 3115382 - RNA, 20 nt, Mycobacterium bovis subsp bovis AF2122/97
accuggaacugcaugguggc

SEQ ID NO: 3115383 - RNA, 15 nt, Mycobacterium bovis subsp bovis AF2122/97
accuggaucagggcu

SEQ ID NO: 3115384 - RNA, 16 nt, Mycobacterium bovis subsp bovis AF2122/97
accuggaucagggcuu

SEQ ID NO: 3115385 - RNA, 12 nt, Mycobacterium bovis subsp bovis AF2122/97
accuggccacgg

SEQ ID NO: 3115386 - RNA, 18 nt, Mycobacterium bovis subsp bovis AF2122/97
accuggcccgccacgaug

SEQ ID NO: 3115387 - RNA, 21 nt, Mycobacterium bovis subsp bovis AF2122/97
accuggccgcccgcuccaaca

SEQ ID NO: 3115388 - RNA, 20 nt, Mycobacterium bovis subsp bovis AF2122/97
accuggccgcccgcugcggc

SEQ ID NO: 3115389 - RNA, 21 nt, Mycobacterium bovis subsp bovis AF2122/97
accuggccugcggcaggugcg

SEQ ID NO: 3115390 - RNA, 22 nt, Mycobacterium bovis subsp bovis AF2122/97
accuggccugcggcaggugcgg

SEQ ID NO: 3115391 - RNA, 19 nt, Mycobacterium bovis subsp bovis AF2122/97
accuggcgauaaccgacga

SEQ ID NO: 3115392 - RNA, 23 nt, Mycobacterium bovis subsp bovis AF2122/97
accuggcggucccgcauauccgc

SEQ ID NO: 3115393 - RNA, 14 nt, Mycobacterium bovis subsp bovis AF2122/97
accuggcggugccg

SEQ ID NO: 3115394 - RNA, 16 nt, Mycobacterium bovis subsp bovis AF2122/97
accuggcgugucgccg

SEQ ID NO: 3115395 - RNA, 17 nt, Mycobacterium bovis subsp bovis AF2122/97
accuggcgugucgccgc

SEQ ID NO: 3115396 - RNA, 19 nt, Mycobacterium bovis subsp bovis AF2122/97
accuggcgugucgccgcca

SEQ ID NO: 3115397 - RNA, 15 nt, Mycobacterium bovis subsp bovis AF2122/97
accuggcuaucgcag

SEQ ID NO: 3115398 - RNA, 16 nt, Mycobacterium bovis subsp bovis AF2122/97
accuggcucaucgaug

SEQ ID NO: 3115399 - RNA, 16 nt, Mycobacterium bovis subsp bovis AF2122/97
accugggacaggacga

SEQ ID NO: 3115400 - RNA, 20 nt, Mycobacterium bovis subsp bovis AF2122/97
accugggccagcagccguuc

SEQ ID NO: 3115401 - RNA, 14 nt, Mycobacterium bovis subsp bovis AF2122/97
accugggccaucac

SEQ ID NO: 3115402 - RNA, 18 nt, Mycobacterium bovis subsp bovis AF2122/97
accugggccaucacgguc

SEQ ID NO: 3115403 - RNA, 20 nt, Mycobacterium bovis subsp bovis AF2122/97
accugggcgacuaccggcuc

SEQ ID NO: 3115404 - RNA, 14 nt, Mycobacterium bovis subsp bovis AF2122/97
accugggcggcgcg

SEQ ID NO: 3115405 - RNA, 15 nt, Mycobacterium bovis subsp bovis AF2122/97
accugggcggcgcga

SEQ ID NO: 3115406 - RNA, 19 nt, Mycobacterium bovis subsp bovis AF2122/97
accugggcugccggccaga

SEQ ID NO: 3115407 - RNA, 13 nt, Mycobacterium bovis subsp bovis AF2122/97
accuggggccacc

SEQ ID NO: 3115408 - RNA, 13 nt, Mycobacterium bovis subsp bovis AF2122/97
accuggggccgca

SEQ ID NO: 3115409 - RNA, 14 nt, Mycobacterium bovis subsp bovis AF2122/97
accuggggccgcac

SEQ ID NO: 3115410 - RNA, 22 nt, Mycobacterium bovis subsp bovis AF2122/97
accugggguguagccagcggcu

SEQ ID NO: 3115411 - RNA, 20 nt, Mycobacterium bovis subsp bovis AF2122/97
accuggguuugcacggcgcg

SEQ ID NO: 3115412 - RNA, 21 nt, Mycobacterium bovis subsp bovis AF2122/97
accuggguuugcacggcgcgc

SEQ ID NO: 3115413 - RNA, 22 nt, Mycobacterium bovis subsp bovis AF2122/97
accuggguuugcacggcgcgcc

SEQ ID NO: 3115414 - RNA, 13 nt, Mycobacterium bovis subsp bovis AF2122/97
accuggucgcguc

SEQ ID NO: 3115415 - RNA, 14 nt, Mycobacterium bovis subsp bovis AF2122/97
accuggugcaaccg

SEQ ID NO: 3115416 - RNA, 14 nt, Mycobacterium bovis subsp bovis AF2122/97
accugguucccgac

SEQ ID NO: 3115417 - RNA, 18 nt, Mycobacterium bovis subsp bovis AF2122/97
accugguuuacccgcaug

SEQ ID NO: 3115418 - RNA, 17 nt, Mycobacterium bovis subsp bovis AF2122/97
accuguaccgccacggc

SEQ ID NO: 3115419 - RNA, 22 nt, Mycobacterium bovis subsp bovis AF2122/97
accuguagaucagcagcggcga

SEQ ID NO: 3115420 - RNA, 19 nt, Mycobacterium bovis subsp bovis AF2122/97
accugucaacauuucugag

SEQ ID NO: 3115421 - RNA, 20 nt, Mycobacterium bovis subsp bovis AF2122/97
accugucgguaccgcccagu

SEQ ID NO: 3115422 - RNA, 14 nt, Mycobacterium bovis subsp bovis AF2122/97
accugugcggccga

SEQ ID NO: 3115423 - RNA, 18 nt, Mycobacterium bovis subsp bovis AF2122/97
accuguugacacaacgac

SEQ ID NO: 3115424 - RNA, 18 nt, Mycobacterium bovis subsp bovis AF2122/97
accuguuggcaugccgcc

SEQ ID NO: 3115425 - RNA, 18 nt, Mycobacterium bovis subsp bovis AF2122/97
acgacaucugcccagcgg

SEQ ID NO: 3115426 - RNA, 20 nt, Mycobacterium bovis subsp bovis AF2122/97
acgacaugaccgacaggugc

SEQ ID NO: 3115427 - RNA, 17 nt, Mycobacterium bovis subsp bovis AF2122/97
acgacaugagcgccacg

SEQ ID NO: 3115428 - RNA, 16 nt, Mycobacterium bovis subsp bovis AF2122/97
acgacaugggcaggcc

SEQ ID NO: 3115429 - RNA, 18 nt, Mycobacterium bovis subsp bovis AF2122/97
acgacaugggcaggccgc

SEQ ID NO: 3115430 - RNA, 20 nt, Mycobacterium bovis subsp bovis AF2122/97
acgacaugggcaggccgcgu

SEQ ID NO: 3115431 - RNA, 16 nt, Mycobacterium bovis subsp bovis AF2122/97
acgacauugccacggc

SEQ ID NO: 3115432 - RNA, 11 nt, Mycobacterium bovis subsp bovis AF2122/97
acgacauuggu

SEQ ID NO: 3115433 - RNA, 19 nt, Mycobacterium bovis subsp bovis AF2122/97
acgacauuggugcugacau

SEQ ID NO: 3115434 - RNA, 15 nt, Mycobacterium bovis subsp bovis AF2122/97
acgaccaauagcacg

SEQ ID NO: 3115435 - RNA, 14 nt, Mycobacterium bovis subsp bovis AF2122/97
acgaccacaccacg

SEQ ID NO: 3115436 - RNA, 13 nt, Mycobacterium bovis subsp bovis AF2122/97
acgaccaccacca

SEQ ID NO: 3115437 - RNA, 22 nt, Mycobacterium bovis subsp bovis AF2122/97
acgaccaccuucugacgcggcc

SEQ ID NO: 3115438 - RNA, 14 nt, Mycobacterium bovis subsp bovis AF2122/97
acgaccagccccgc

SEQ ID NO: 3115439 - RNA, 20 nt, Mycobacterium bovis subsp bovis AF2122/97
acgaccagcugagcuggcag

SEQ ID NO: 3115440 - RNA, 23 nt, Mycobacterium bovis subsp bovis AF2122/97
acgaccagcugagcuggcagcuc

SEQ ID NO: 3115441 - RNA, 17 nt, Mycobacterium bovis subsp bovis AF2122/97
acgacccaagucgccga

SEQ ID NO: 3115442 - RNA, 23 nt, Mycobacterium bovis subsp bovis AF2122/97
acgaccccacccuaaucguuccg

SEQ ID NO: 3115443 - RNA, 13 nt, Mycobacterium bovis subsp bovis AF2122/97
acgaccccggcgg

SEQ ID NO: 3115444 - RNA, 17 nt, Mycobacterium bovis subsp bovis AF2122/97
acgacccgaagccgacc

SEQ ID NO: 3115445 - RNA, 17 nt, Mycobacterium bovis subsp bovis AF2122/97
acgacccgacguagccg

SEQ ID NO: 3115446 - RNA, 13 nt, Mycobacterium bovis subsp bovis AF2122/97
acgacccgccgcc

SEQ ID NO: 3115447 - RNA, 21 nt, Mycobacterium bovis subsp bovis AF2122/97
acgacccgcuggucgaugccu

SEQ ID NO: 3115448 - RNA, 20 nt, Mycobacterium bovis subsp bovis AF2122/97
acgacccgggaaggaaccgg

SEQ ID NO: 3115449 - RNA, 12 nt, Mycobacterium bovis subsp bovis AF2122/97
acgacccgggcc

SEQ ID NO: 3115450 - RNA, 17 nt, Mycobacterium bovis subsp bovis AF2122/97
acgacccgggucggcac

SEQ ID NO: 3115451 - RNA, 13 nt, Mycobacterium bovis subsp bovis AF2122/97
acgacccuccgca

SEQ ID NO: 3115452 - RNA, 14 nt, Mycobacterium bovis subsp bovis AF2122/97
acgaccgcgacaac

SEQ ID NO: 3115453 - RNA, 13 nt, Mycobacterium bovis subsp bovis AF2122/97
acgaccggccaac

SEQ ID NO: 3115454 - RNA, 20 nt, Mycobacterium bovis subsp bovis AF2122/97
acgaccggccaacgccgccg

SEQ ID NO: 3115455 - RNA, 22 nt, Mycobacterium bovis subsp bovis AF2122/97
acgaccggccaacgccgccgca

SEQ ID NO: 3115456 - RNA, 16 nt, Mycobacterium bovis subsp bovis AF2122/97
acgaccgucgcgcugc

SEQ ID NO: 3115457 - RNA, 22 nt, Mycobacterium bovis subsp bovis AF2122/97
acgaccgucgcgcugccggccg

SEQ ID NO: 3115458 - RNA, 23 nt, Mycobacterium bovis subsp bovis AF2122/97
acgaccgucgcgcugccggccgc

SEQ ID NO: 3115459 - RNA, 18 nt, Mycobacterium bovis subsp bovis AF2122/97
acgaccgucggcuccagg

SEQ ID NO: 3115460 - RNA, 16 nt, Mycobacterium bovis subsp bovis AF2122/97
acgaccgugcugggcg

SEQ ID NO: 3115461 - RNA, 23 nt, Mycobacterium bovis subsp bovis AF2122/97
acgaccgugcugggcgccgcgcu

SEQ ID NO: 3115462 - RNA, 17 nt, Mycobacterium bovis subsp bovis AF2122/97
acgaccucuugggcacu

SEQ ID NO: 3115463 - RNA, 19 nt, Mycobacterium bovis subsp bovis AF2122/97
acgaccugcucauccaccu

SEQ ID NO: 3115464 - RNA, 18 nt, Mycobacterium bovis subsp bovis AF2122/97
acgacgaacaccagcgcg

SEQ ID NO: 3115465 - RNA, 18 nt, Mycobacterium bovis subsp bovis AF2122/97
acgacgacaaccggccag

SEQ ID NO: 3115466 - RNA, 20 nt, Mycobacterium bovis subsp bovis AF2122/97
acgacgacaagugcccggcc

SEQ ID NO: 3115467 - RNA, 20 nt, Mycobacterium bovis subsp bovis AF2122/97
acgacgagggccagcagccg

SEQ ID NO: 3115468 - RNA, 22 nt, Mycobacterium bovis subsp bovis AF2122/97
acgacgaucaagccuucgucga

SEQ ID NO: 3115469 - RNA, 21 nt, Mycobacterium bovis subsp bovis AF2122/97
acgacgaucgcgucgggcucg

SEQ ID NO: 3115470 - RNA, 16 nt, Mycobacterium bovis subsp bovis AF2122/97
acgacgaugaugccgu

SEQ ID NO: 3115471 - RNA, 14 nt, Mycobacterium bovis subsp bovis AF2122/97
acgacgcaggaggu

SEQ ID NO: 3115472 - RNA, 14 nt, Mycobacterium bovis subsp bovis AF2122/97
acgacgccaccgcg

SEQ ID NO: 3115473 - RNA, 16 nt, Mycobacterium bovis subsp bovis AF2122/97
acgacgccaccgcgac

SEQ ID NO: 3115474 - RNA, 12 nt, Mycobacterium bovis subsp bovis AF2122/97
acgacgccaccu

SEQ ID NO: 3115475 - RNA, 19 nt, Mycobacterium bovis subsp bovis AF2122/97
acgacgccaccugacgugc

SEQ ID NO: 3115476 - RNA, 14 nt, Mycobacterium bovis subsp bovis AF2122/97
acgacgccgacgau

SEQ ID NO: 3115477 - RNA, 16 nt, Mycobacterium bovis subsp bovis AF2122/97
acgacgccgacgauga

SEQ ID NO: 3115478 - RNA, 13 nt, Mycobacterium bovis subsp bovis AF2122/97
acgacgccgcggu

SEQ ID NO: 3115479 - RNA, 12 nt, Mycobacterium bovis subsp bovis AF2122/97
acgacgccggcc

SEQ ID NO: 3115480 - RNA, 23 nt, Mycobacterium bovis subsp bovis AF2122/97
acgacgccggccuggccgccaga

SEQ ID NO: 3115481 - RNA, 15 nt, Mycobacterium bovis subsp bovis AF2122/97
acgacgccgucggac

SEQ ID NO: 3115482 - RNA, 18 nt, Mycobacterium bovis subsp bovis AF2122/97
acgacgccgucggacacc

SEQ ID NO: 3115483 - RNA, 21 nt, Mycobacterium bovis subsp bovis AF2122/97
acgacgccgucggacaccgca

SEQ ID NO: 3115484 - RNA, 18 nt, Mycobacterium bovis subsp bovis AF2122/97
acgacgcgacacgccggc

SEQ ID NO: 3115485 - RNA, 21 nt, Mycobacterium bovis subsp bovis AF2122/97
acgacggcaccgaugcacucc

SEQ ID NO: 3115486 - RNA, 13 nt, Mycobacterium bovis subsp bovis AF2122/97
acgacggccgaca

SEQ ID NO: 3115487 - RNA, 15 nt, Mycobacterium bovis subsp bovis AF2122/97
acgacggcgccgucg

SEQ ID NO: 3115488 - RNA, 13 nt, Mycobacterium bovis subsp bovis AF2122/97
acgacggcugacc

SEQ ID NO: 3115489 - RNA, 22 nt, Mycobacterium bovis subsp bovis AF2122/97
acgacgggaaccagcggucggc

SEQ ID NO: 3115490 - RNA, 21 nt, Mycobacterium bovis subsp bovis AF2122/97
acgacggguuggcgucgcuac

SEQ ID NO: 3115491 - RNA, 22 nt, Mycobacterium bovis subsp bovis AF2122/97
acgacgguuccgccaccggaca

SEQ ID NO: 3115492 - RNA, 21 nt, Mycobacterium bovis subsp bovis AF2122/97
acgacguagaugguggucacc

SEQ ID NO: 3115493 - RNA, 18 nt, Mycobacterium bovis subsp bovis AF2122/97
acgacgucaaucucgguc

SEQ ID NO: 3115494 - RNA, 20 nt, Mycobacterium bovis subsp bovis AF2122/97
acgacgucaaucucggucgg

SEQ ID NO: 3115495 - RNA, 16 nt, Mycobacterium bovis subsp bovis AF2122/97
acgacgucgccgccgc

SEQ ID NO: 3115496 - RNA, 20 nt, Mycobacterium bovis subsp bovis AF2122/97
acgacgucgccgccgcgggc

SEQ ID NO: 3115497 - RNA, 13 nt, Mycobacterium bovis subsp bovis AF2122/97
acgacgucggccg

SEQ ID NO: 3115498 - RNA, 15 nt, Mycobacterium bovis subsp bovis AF2122/97
acgacgucggccgca

SEQ ID NO: 3115499 - RNA, 22 nt, Mycobacterium bovis subsp bovis AF2122/97
acgacgucggccgcaucgccca

SEQ ID NO: 3115500 - RNA, 19 nt, Mycobacterium bovis subsp bovis AF2122/97
acgacguggcugcguucgc

SEQ ID NO: 3115501 - RNA, 16 nt, Mycobacterium bovis subsp bovis AF2122/97
acgacguucgacgaca

SEQ ID NO: 3115502 - RNA, 18 nt, Mycobacterium bovis subsp bovis AF2122/97
acgacucacccacccgca

SEQ ID NO: 3115503 - RNA, 23 nt, Mycobacterium bovis subsp bovis AF2122/97
acgacucccccggcuccgcaacc

SEQ ID NO: 3115504 - RNA, 16 nt, Mycobacterium bovis subsp bovis AF2122/97
acgacuccggcaagca

SEQ ID NO: 3115505 - RNA, 20 nt, Mycobacterium bovis subsp bovis AF2122/97
acgacuccggcaagcacacc

SEQ ID NO: 3115506 - RNA, 22 nt, Mycobacterium bovis subsp bovis AF2122/97
acgacuccggcaagcacaccgc

SEQ ID NO: 3115507 - RNA, 17 nt, Mycobacterium bovis subsp bovis AF2122/97
acgacucgcgguggccg

SEQ ID NO: 3115508 - RNA, 18 nt, Mycobacterium bovis subsp bovis AF2122/97
acgacugacaacggccac

SEQ ID NO: 3115509 - RNA, 19 nt, Mycobacterium bovis subsp bovis AF2122/97
acgacugaucaagugccag

SEQ ID NO: 3115510 - RNA, 14 nt, Mycobacterium bovis subsp bovis AF2122/97
acgacugggcgccc

SEQ ID NO: 3115511 - RNA, 18 nt, Mycobacterium bovis subsp bovis AF2122/97
acgaucgcgcuggcgccc

SEQ ID NO: 3115512 - RNA, 15 nt, Mycobacterium bovis subsp bovis AF2122/97
acgaucgcggcgggc

SEQ ID NO: 3115513 - RNA, 18 nt, Mycobacterium bovis subsp bovis AF2122/97
acgaucgcggcgggcccg

SEQ ID NO: 3115514 - RNA, 15 nt, Mycobacterium bovis subsp bovis AF2122/97
acgaucgcggugacc

SEQ ID NO: 3115515 - RNA, 13 nt, Mycobacterium bovis subsp bovis AF2122/97
acgaucgcguccg

SEQ ID NO: 3115516 - RNA, 15 nt, Mycobacterium bovis subsp bovis AF2122/97
acgaucgcgucgggc

SEQ ID NO: 3115517 - RNA, 21 nt, Mycobacterium bovis subsp bovis AF2122/97
acgaucgcgucgggcucggcg

SEQ ID NO: 3115518 - RNA, 14 nt, Mycobacterium bovis subsp bovis AF2122/97
acgaucggcggcgc

SEQ ID NO: 3115519 - RNA, 17 nt, Mycobacterium bovis subsp bovis AF2122/97
acgaucggcggcgcgcc

SEQ ID NO: 3115520 - RNA, 15 nt, Mycobacterium bovis subsp bovis AF2122/97
acgaucgucgcggcc

SEQ ID NO: 3115521 - RNA, 21 nt, Mycobacterium bovis subsp bovis AF2122/97
acgaucgugagacgccgucga

SEQ ID NO: 3115522 - RNA, 24 nt, Mycobacterium bovis subsp bovis AF2122/97
acgaucgugagacgccgucgacgu

SEQ ID NO: 3115523 - RNA, 15 nt, Mycobacterium bovis subsp bovis AF2122/97
acgaucgugccggga

SEQ ID NO: 3115524 - RNA, 15 nt, Mycobacterium bovis subsp bovis AF2122/97
acgaucgugcgaucg

SEQ ID NO: 3115525 - RNA, 20 nt, Mycobacterium bovis subsp bovis AF2122/97
acgaucuccgccaaccgggu

SEQ ID NO: 3115526 - RNA, 17 nt, Mycobacterium bovis subsp bovis AF2122/97
acgaucucgccgccagc

SEQ ID NO: 3115527 - RNA, 19 nt, Mycobacterium bovis subsp bovis AF2122/97
acgaucucgccgccagcgc

SEQ ID NO: 3115528 - RNA, 15 nt, Mycobacterium bovis subsp bovis AF2122/97
acgaucucggcggcc

SEQ ID NO: 3115529 - RNA, 16 nt, Mycobacterium bovis subsp bovis AF2122/97
acgaucucggcggccg

SEQ ID NO: 3115530 - RNA, 17 nt, Mycobacterium bovis subsp bovis AF2122/97
acgaucucggcggccgc

SEQ ID NO: 3115531 - RNA, 21 nt, Mycobacterium bovis subsp bovis AF2122/97
acgaucucguggaucugccuc

SEQ ID NO: 3115532 - RNA, 22 nt, Mycobacterium bovis subsp bovis AF2122/97
acgaucugcaggcccaggcugu

SEQ ID NO: 3115533 - RNA, 22 nt, Mycobacterium bovis subsp bovis AF2122/97
acgaugacagacaucgcgacga

SEQ ID NO: 3115534 - RNA, 18 nt, Mycobacterium bovis subsp bovis AF2122/97
acgaugaccaugaugacc

SEQ ID NO: 3115535 - RNA, 17 nt, Mycobacterium bovis subsp bovis AF2122/97
acgaugacggugggguc

SEQ ID NO: 3115536 - RNA, 14 nt, Mycobacterium bovis subsp bovis AF2122/97
acgaugacgucgac

SEQ ID NO: 3115537 - RNA, 21 nt, Mycobacterium bovis subsp bovis AF2122/97
acgaugacguugacgucgguc

SEQ ID NO: 3115538 - RNA, 22 nt, Mycobacterium bovis subsp bovis AF2122/97
acgaugaucagggucagcgccg

SEQ ID NO: 3115539 - RNA, 19 nt, Mycobacterium bovis subsp bovis AF2122/97
acgaugaucuugccgcggc

SEQ ID NO: 3115540 - RNA, 13 nt, Mycobacterium bovis subsp bovis AF2122/97
acgaugcccuucu

SEQ ID NO: 3115541 - RNA, 13 nt, Mycobacterium bovis subsp bovis AF2122/97
acgaugccgccgg

SEQ ID NO: 3115542 - RNA, 15 nt, Mycobacterium bovis subsp bovis AF2122/97
acgaugccucggcgg

SEQ ID NO: 3115543 - RNA, 18 nt, Mycobacterium bovis subsp bovis AF2122/97
acgaugccucggcggccu

SEQ ID NO: 3115544 - RNA, 16 nt, Mycobacterium bovis subsp bovis AF2122/97
acgauggccgccgcga

SEQ ID NO: 3115545 - RNA, 13 nt, Mycobacterium bovis subsp bovis AF2122/97
acgauggccgucg

SEQ ID NO: 3115546 - RNA, 14 nt, Mycobacterium bovis subsp bovis AF2122/97
acgauggcgaugag

SEQ ID NO: 3115547 - RNA, 16 nt, Mycobacterium bovis subsp bovis AF2122/97
acgauggcgaugaggu

SEQ ID NO: 3115548 - RNA, 13 nt, Mycobacterium bovis subsp bovis AF2122/97
acgauggcggcca

SEQ ID NO: 3115549 - RNA, 19 nt, Mycobacterium bovis subsp bovis AF2122/97
acgauggcgucggccagga

SEQ ID NO: 3115550 - RNA, 21 nt, Mycobacterium bovis subsp bovis AF2122/97
acgauggcucucacgagcggc

SEQ ID NO: 3115551 - RNA, 19 nt, Mycobacterium bovis subsp bovis AF2122/97
acgaugguguacugcugcu

SEQ ID NO: 3115552 - RNA, 15 nt, Mycobacterium bovis subsp bovis AF2122/97
acgaugucacccucc

SEQ ID NO: 3115553 - RNA, 14 nt, Mycobacterium bovis subsp bovis AF2122/97
acgauguccucgau

SEQ ID NO: 3115554 - RNA, 15 nt, Mycobacterium bovis subsp bovis AF2122/97
acgauguccucgaug

SEQ ID NO: 3115555 - RNA, 16 nt, Mycobacterium bovis subsp bovis AF2122/97
acgauguccuggaagc

SEQ ID NO: 3115556 - RNA, 12 nt, Mycobacterium bovis subsp bovis AF2122/97
acgaugucgaug

SEQ ID NO: 3115557 - RNA, 17 nt, Mycobacterium bovis subsp bovis AF2122/97
acgaugucgaugccgug

SEQ ID NO: 3115558 - RNA, 16 nt, Mycobacterium bovis subsp bovis AF2122/97
acgaugucgucgauga

SEQ ID NO: 3115559 - RNA, 13 nt, Mycobacterium bovis subsp bovis AF2122/97
acgauuaccagcg

SEQ ID NO: 3115560 - RNA, 15 nt, Mycobacterium bovis subsp bovis AF2122/97
acgauucccgcggac

SEQ ID NO: 3115561 - RNA, 18 nt, Mycobacterium bovis subsp bovis AF2122/97
acgauucccgcggacagc

SEQ ID NO: 3115562 - RNA, 20 nt, Mycobacterium bovis subsp bovis AF2122/97
acgauugcugcggcuuucag

SEQ ID NO: 3115563 - RNA, 13 nt, Mycobacterium bovis subsp bovis AF2122/97
acgauuucggccc

SEQ ID NO: 3115564 - RNA, 23 nt, Mycobacterium bovis subsp bovis AF2122/97
acgauuugguagcggaucgcggu

SEQ ID NO: 3115565 - RNA, 13 nt, Mycobacterium bovis subsp bovis AF2122/97
acgcaaaagaacc

SEQ ID NO: 3115566 - RNA, 22 nt, Mycobacterium bovis subsp bovis AF2122/97
acgcaaaagcccccuaaaccgg

SEQ ID NO: 3115567 - RNA, 16 nt, Mycobacterium bovis subsp bovis AF2122/97
acgcaaaaucgcccaa

SEQ ID NO: 3115568 - RNA, 16 nt, Mycobacterium bovis subsp bovis AF2122/97
acgcaaaaucgcccau

SEQ ID NO: 3115569 - RNA, 19 nt, Mycobacterium bovis subsp bovis AF2122/97
acgcaaaaucgcccauuuc

SEQ ID NO: 3115570 - RNA, 14 nt, Mycobacterium bovis subsp bovis AF2122/97
acgcaacaccgcca

SEQ ID NO: 3115571 - RNA, 12 nt, Mycobacterium bovis subsp bovis AF2122/97
acgcaacaucgg

SEQ ID NO: 3115572 - RNA, 13 nt, Mycobacterium bovis subsp bovis AF2122/97
acgcaacaucgga

SEQ ID NO: 3115573 - RNA, 13 nt, Mycobacterium bovis subsp bovis AF2122/97
acgcaaccaaccg

SEQ ID NO: 3115574 - RNA, 16 nt, Mycobacterium bovis subsp bovis AF2122/97
acgcaacgccgauggc

SEQ ID NO: 3115575 - RNA, 17 nt, Mycobacterium bovis subsp bovis AF2122/97
acgcaacggugaucagc

SEQ ID NO: 3115576 - RNA, 18 nt, Mycobacterium bovis subsp bovis AF2122/97
acgcaagcaaauucuggu

SEQ ID NO: 3115577 - RNA, 12 nt, Mycobacterium bovis subsp bovis AF2122/97
acgcaagcagcg

SEQ ID NO: 3115578 - RNA, 21 nt, Mycobacterium bovis subsp bovis AF2122/97
acgcaagggaauccgaacucg

SEQ ID NO: 3115579 - RNA, 22 nt, Mycobacterium bovis subsp bovis AF2122/97
acgcacaauacggucagcagac

SEQ ID NO: 3115580 - RNA, 21 nt, Mycobacterium bovis subsp bovis AF2122/97
acgcacacaccguaccgacga

SEQ ID NO: 3115581 - RNA, 18 nt, Mycobacterium bovis subsp bovis AF2122/97
acgcacagcccgaugccg

SEQ ID NO: 3115582 - RNA, 15 nt, Mycobacterium bovis subsp bovis AF2122/97
acgcaccacaaucca

SEQ ID NO: 3115583 - RNA, 16 nt, Mycobacterium bovis subsp bovis AF2122/97
acgcaccacgagcagc

SEQ ID NO: 3115584 - RNA, 17 nt, Mycobacterium bovis subsp bovis AF2122/97
acgcaccacgagcagcc

SEQ ID NO: 3115585 - RNA, 18 nt, Mycobacterium bovis subsp bovis AF2122/97
acgcaccacgagcagccg

SEQ ID NO: 3115586 - RNA, 12 nt, Mycobacterium bovis subsp bovis AF2122/97
acgcacccgaau

SEQ ID NO: 3115587 - RNA, 13 nt, Mycobacterium bovis subsp bovis AF2122/97
acgcacccggcaa

SEQ ID NO: 3115588 - RNA, 17 nt, Mycobacterium bovis subsp bovis AF2122/97
acgcaccgaaacgccga

SEQ ID NO: 3115589 - RNA, 17 nt, Mycobacterium bovis subsp bovis AF2122/97
acgcaccgaggccgccg

SEQ ID NO: 3115590 - RNA, 20 nt, Mycobacterium bovis subsp bovis AF2122/97
acgcaccgaugccuugaccg

SEQ ID NO: 3115591 - RNA, 16 nt, Mycobacterium bovis subsp bovis AF2122/97
acgcaccgccccgccg

SEQ ID NO: 3115592 - RNA, 11 nt, Mycobacterium bovis subsp bovis AF2122/97
acgcaccgcgg

SEQ ID NO: 3115593 - RNA, 14 nt, Mycobacterium bovis subsp bovis AF2122/97
acgcaccgguaccg

SEQ ID NO: 3115594 - RNA, 19 nt, Mycobacterium bovis subsp bovis AF2122/97
acgcaccgguaccgacggg

SEQ ID NO: 3115595 - RNA, 23 nt, Mycobacterium bovis subsp bovis AF2122/97
acgcaccuauggucaaccgcgcc

SEQ ID NO: 3115596 - RNA, 21 nt, Mycobacterium bovis subsp bovis AF2122/97
acgcaccucgguggcugccac

SEQ ID NO: 3115597 - RNA, 21 nt, Mycobacterium bovis subsp bovis AF2122/97
acgcacgacugugcgccgcag

SEQ ID NO: 3115598 - RNA, 16 nt, Mycobacterium bovis subsp bovis AF2122/97
acgccaggugcagcac

SEQ ID NO: 3115599 - RNA, 21 nt, Mycobacterium bovis subsp bovis AF2122/97
acgccaggugcagcaccagcc

SEQ ID NO: 3115600 - RNA, 20 nt, Mycobacterium bovis subsp bovis AF2122/97
acgccagucccacugggccg

SEQ ID NO: 3115601 - RNA, 19 nt, Mycobacterium bovis subsp bovis AF2122/97
acgccagucccggcgcaca

SEQ ID NO: 3115602 - RNA, 21 nt, Mycobacterium bovis subsp bovis AF2122/97
acgccagugaacgcgcgugca

SEQ ID NO: 3115603 - RNA, 23 nt, Mycobacterium bovis subsp bovis AF2122/97
acgccagugaacgcgcgugcagc

SEQ ID NO: 3115604 - RNA, 16 nt, Mycobacterium bovis subsp bovis AF2122/97
acgccauacgucgccu

SEQ ID NO: 3115605 - RNA, 15 nt, Mycobacterium bovis subsp bovis AF2122/97
acgccaucaccccgg

SEQ ID NO: 3115606 - RNA, 21 nt, Mycobacterium bovis subsp bovis AF2122/97
acgccaucgaucgagcaggcc

SEQ ID NO: 3115607 - RNA, 21 nt, Mycobacterium bovis subsp bovis AF2122/97
acgccaucuucgggccgacgg

SEQ ID NO: 3115608 - RNA, 14 nt, Mycobacterium bovis subsp bovis AF2122/97
acgccaugccggga

SEQ ID NO: 3115609 - RNA, 17 nt, Mycobacterium bovis subsp bovis AF2122/97
acgccaugucgaugucc

SEQ ID NO: 3115610 - RNA, 17 nt, Mycobacterium bovis subsp bovis AF2122/97
acgccauucaucggcau

SEQ ID NO: 3115611 - RNA, 20 nt, Mycobacterium bovis subsp bovis AF2122/97
acgccauuguugggccgcca

SEQ ID NO: 3115612 - RNA, 21 nt, Mycobacterium bovis subsp bovis AF2122/97
acgcccaauguccaggcgcgc

SEQ ID NO: 3115613 - RNA, 15 nt, Mycobacterium bovis subsp bovis AF2122/97
acgcccacaaugacu

SEQ ID NO: 3115614 - RNA, 19 nt, Mycobacterium bovis subsp bovis AF2122/97
acgcccacaaugacucggc

SEQ ID NO: 3115615 - RNA, 12 nt, Mycobacterium bovis subsp bovis AF2122/97
acgcccaccacg

SEQ ID NO: 3115616 - RNA, 14 nt, Mycobacterium bovis subsp bovis AF2122/97
acgcccaccacgcg

SEQ ID NO: 3115617 - RNA, 18 nt, Mycobacterium bovis subsp bovis AF2122/97
acgcccaccacgcgacgc

SEQ ID NO: 3115618 - RNA, 23 nt, Mycobacterium bovis subsp bovis AF2122/97
acgcccaccacgcgacgcggggc

SEQ ID NO: 3115619 - RNA, 13 nt, Mycobacterium bovis subsp bovis AF2122/97
acgcccaccgaca

SEQ ID NO: 3115620 - RNA, 17 nt, Mycobacterium bovis subsp bovis AF2122/97
acgcccacuccagcagc

SEQ ID NO: 3115621 - RNA, 22 nt, Mycobacterium bovis subsp bovis AF2122/97
acgcccagcgcccgcgcggcca

SEQ ID NO: 3115622 - RNA, 16 nt, Mycobacterium bovis subsp bovis AF2122/97
acgcccaggcgaccgc

SEQ ID NO: 3115623 - RNA, 14 nt, Mycobacterium bovis subsp bovis AF2122/97
acgccccacugccg

SEQ ID NO: 3115624 - RNA, 14 nt, Mycobacterium bovis subsp bovis AF2122/97
acgccccgccacaa

SEQ ID NO: 3115625 - RNA, 18 nt, Mycobacterium bovis subsp bovis AF2122/97
acgccccggcgcggccag

SEQ ID NO: 3115626 - RNA, 23 nt, Mycobacterium bovis subsp bovis AF2122/97
acgcccgaagaaugggauggcac

SEQ ID NO: 3115627 - RNA, 19 nt, Mycobacterium bovis subsp bovis AF2122/97
acgcccgacgccagcugcc

SEQ ID NO: 3115628 - RNA, 22 nt, Mycobacterium bovis subsp bovis AF2122/97
acgcccgaguuaaacgcagcgg

SEQ ID NO: 3115629 - RNA, 18 nt, Mycobacterium bovis subsp bovis AF2122/97
acgcccgaguugaagaau

SEQ ID NO: 3115630 - RNA, 17 nt, Mycobacterium bovis subsp bovis AF2122/97
acgcccgcacucggcgg

SEQ ID NO: 3115631 - RNA, 18 nt, Mycobacterium bovis subsp bovis AF2122/97
acgcccgcacucggcggu

SEQ ID NO: 3115632 - RNA, 13 nt, Mycobacterium bovis subsp bovis AF2122/97
acgcccgcaucgc

SEQ ID NO: 3115633 - RNA, 14 nt, Mycobacterium bovis subsp bovis AF2122/97
acgcccgcaucgcc

SEQ ID NO: 3115634 - RNA, 16 nt, Mycobacterium bovis subsp bovis AF2122/97
acgcccgcaucgccuc

SEQ ID NO: 3115635 - RNA, 12 nt, Mycobacterium bovis subsp bovis AF2122/97
acgcccgcccgc

SEQ ID NO: 3115636 - RNA, 12 nt, Mycobacterium bovis subsp bovis AF2122/97
acgcccgcgaac

SEQ ID NO: 3115637 - RNA, 22 nt, Mycobacterium bovis subsp bovis AF2122/97
acgcccgcucggagaucgccac

SEQ ID NO: 3115638 - RNA, 23 nt, Mycobacterium bovis subsp bovis AF2122/97
acgcccgcucggagaucgccacu

SEQ ID NO: 3115639 - RNA, 11 nt, Mycobacterium bovis subsp bovis AF2122/97
acgcccggcac

SEQ ID NO: 3115640 - RNA, 16 nt, Mycobacterium bovis subsp bovis AF2122/97
acgcccggcacacggc

SEQ ID NO: 3115641 - RNA, 12 nt, Mycobacterium bovis subsp bovis AF2122/97
acgcccggcacc

SEQ ID NO: 3115642 - RNA, 14 nt, Mycobacterium bovis subsp bovis AF2122/97
acgcccggcacccc

SEQ ID NO: 3115643 - RNA, 19 nt, Mycobacterium bovis subsp bovis AF2122/97
acgcccggccccgcggcca

SEQ ID NO: 3115644 - RNA, 21 nt, Mycobacterium bovis subsp bovis AF2122/97
acgcccggccccgcggccagc

SEQ ID NO: 3115645 - RNA, 23 nt, Mycobacterium bovis subsp bovis AF2122/97
acgcccggcgcaccaucgcggcc

SEQ ID NO: 3115646 - RNA, 17 nt, Mycobacterium bovis subsp bovis AF2122/97
acgcccgugcggcucgc

SEQ ID NO: 3115647 - RNA, 18 nt, Mycobacterium bovis subsp bovis AF2122/97
acgcccgugcggcucgcc

SEQ ID NO: 3115648 - RNA, 20 nt, Mycobacterium bovis subsp bovis AF2122/97
acgcccgugcggcucgccgg

SEQ ID NO: 3115649 - RNA, 21 nt, Mycobacterium bovis subsp bovis AF2122/97
acgcccgugcggcucgccggc

SEQ ID NO: 3115650 - RNA, 22 nt, Mycobacterium bovis subsp bovis AF2122/97
acgcccgugcggcucgccggcg

SEQ ID NO: 3115651 - RNA, 14 nt, Mycobacterium bovis subsp bovis AF2122/97
acgcccguguugaa

SEQ ID NO: 3115652 - RNA, 18 nt, Mycobacterium bovis subsp bovis AF2122/97
acgcccguguugaagaag

SEQ ID NO: 3115653 - RNA, 16 nt, Mycobacterium bovis subsp bovis AF2122/97
acgcccucgacgccgc

SEQ ID NO: 3115654 - RNA, 21 nt, Mycobacterium bovis subsp bovis AF2122/97
acgcccucgacgcgcucgggc

SEQ ID NO: 3115655 - RNA, 19 nt, Mycobacterium bovis subsp bovis AF2122/97
acgcccucggcgaccuggc

SEQ ID NO: 3115656 - RNA, 17 nt, Mycobacterium bovis subsp bovis AF2122/97
acgcccuggaaugccgc

SEQ ID NO: 3115657 - RNA, 19 nt, Mycobacterium bovis subsp bovis AF2122/97
acgcccuggaaugccgcca

SEQ ID NO: 3115658 - RNA, 22 nt, Mycobacterium bovis subsp bovis AF2122/97
acgcccuggaaugccgccacaa

SEQ ID NO: 3115659 - RNA, 15 nt, Mycobacterium bovis subsp bovis AF2122/97
acgccgaaaaugccg

SEQ ID NO: 3115660 - RNA, 22 nt, Mycobacterium bovis subsp bovis AF2122/97
acgccgaaaaugccgcccagcg

SEQ ID NO: 3115661 - RNA, 17 nt, Mycobacterium bovis subsp bovis AF2122/97
acgccgaacaccgccgc

SEQ ID NO: 3115662 - RNA, 19 nt, Mycobacterium bovis subsp bovis AF2122/97
acgccgaacgugcaaccac

SEQ ID NO: 3115663 - RNA, 16 nt, Mycobacterium bovis subsp bovis AF2122/97
acgccgaacgugcggu

SEQ ID NO: 3115664 - RNA, 19 nt, Mycobacterium bovis subsp bovis AF2122/97
acgccgaacgugcgguggc

SEQ ID NO: 3115665 - RNA, 18 nt, Mycobacterium bovis subsp bovis AF2122/97
acgccgaauacggcugcc

SEQ ID NO: 3115666 - RNA, 18 nt, Mycobacterium bovis subsp bovis AF2122/97
acgccgaccacccggaug

SEQ ID NO: 3115667 - RNA, 14 nt, Mycobacterium bovis subsp bovis AF2122/97
acgccgaccagcac

SEQ ID NO: 3115668 - RNA, 19 nt, Mycobacterium bovis subsp bovis AF2122/97
acgccgaccagcacccgcu

SEQ ID NO: 3115669 - RNA, 18 nt, Mycobacterium bovis subsp bovis AF2122/97
acgccgaccaucucaccg

SEQ ID NO: 3115670 - RNA, 13 nt, Mycobacterium bovis subsp bovis AF2122/97
acgccgaccgcgc

SEQ ID NO: 3115671 - RNA, 14 nt, Mycobacterium bovis subsp bovis AF2122/97
acgccgaccgcgcc

SEQ ID NO: 3115672 - RNA, 16 nt, Mycobacterium bovis subsp bovis AF2122/97
acgccgaccgcgccgc

SEQ ID NO: 3115673 - RNA, 19 nt, Mycobacterium bovis subsp bovis AF2122/97
acgccgaccgcgccgcauc

SEQ ID NO: 3115674 - RNA, 16 nt, Mycobacterium bovis subsp bovis AF2122/97
acgccgaccggcccgc

SEQ ID NO: 3115675 - RNA, 17 nt, Mycobacterium bovis subsp bovis AF2122/97
acgccgaccggcccgca

SEQ ID NO: 3115676 - RNA, 18 nt, Mycobacterium bovis subsp bovis AF2122/97
acgccgaccuucggcccg

SEQ ID NO: 3115677 - RNA, 19 nt, Mycobacterium bovis subsp bovis AF2122/97
acgccgaccuucggcccgc

SEQ ID NO: 3115678 - RNA, 23 nt, Mycobacterium bovis subsp bovis AF2122/97
acgccgacgaugacgcgcgaaac

SEQ ID NO: 3115679 - RNA, 15 nt, Mycobacterium bovis subsp bovis AF2122/97
acgccgacuccgcgu

SEQ ID NO: 3115680 - RNA, 15 nt, Mycobacterium bovis subsp bovis AF2122/97
acgccgagaccgccg

SEQ ID NO: 3115681 - RNA, 18 nt, Mycobacterium bovis subsp bovis AF2122/97
acgccgagaugcugcacc

SEQ ID NO: 3115682 - RNA, 19 nt, Mycobacterium bovis subsp bovis AF2122/97
acgccgagaugcugcaccc

SEQ ID NO: 3115683 - RNA, 14 nt, Mycobacterium bovis subsp bovis AF2122/97
acgccgagcacuga

SEQ ID NO: 3115684 - RNA, 15 nt, Mycobacterium bovis subsp bovis AF2122/97
acgccgucgacgucg

SEQ ID NO: 3115685 - RNA, 12 nt, Mycobacterium bovis subsp bovis AF2122/97
acgccgucgagc

SEQ ID NO: 3115686 - RNA, 14 nt, Mycobacterium bovis subsp bovis AF2122/97
acgccgucgagcau

SEQ ID NO: 3115687 - RNA, 22 nt, Mycobacterium bovis subsp bovis AF2122/97
acgccgucgagcauccacccau

SEQ ID NO: 3115688 - RNA, 13 nt, Mycobacterium bovis subsp bovis AF2122/97
acgccgucgaugu

SEQ ID NO: 3115689 - RNA, 18 nt, Mycobacterium bovis subsp bovis AF2122/97
acgccgucgauguggcgc

SEQ ID NO: 3115690 - RNA, 12 nt, Mycobacterium bovis subsp bovis AF2122/97
acgccgucgccu

SEQ ID NO: 3115691 - RNA, 17 nt, Mycobacterium bovis subsp bovis AF2122/97
acgccgucggcgccggc

SEQ ID NO: 3115692 - RNA, 16 nt, Mycobacterium bovis subsp bovis AF2122/97
acgccgucggcgcgca

SEQ ID NO: 3115693 - RNA, 18 nt, Mycobacterium bovis subsp bovis AF2122/97
acgccgucggcgcgcacc

SEQ ID NO: 3115694 - RNA, 16 nt, Mycobacterium bovis subsp bovis AF2122/97
acgccgucugacagca

SEQ ID NO: 3115695 - RNA, 16 nt, Mycobacterium bovis subsp bovis AF2122/97
acgccguggcccgcuc

SEQ ID NO: 3115696 - RNA, 17 nt, Mycobacterium bovis subsp bovis AF2122/97
acgccguggcccgcucc

SEQ ID NO: 3115697 - RNA, 16 nt, Mycobacterium bovis subsp bovis AF2122/97
acgccguugccaccgu

SEQ ID NO: 3115698 - RNA, 13 nt, Mycobacterium bovis subsp bovis AF2122/97
acgccguugccgc

SEQ ID NO: 3115699 - RNA, 17 nt, Mycobacterium bovis subsp bovis AF2122/97
acgccguugccgccguu

SEQ ID NO: 3115700 - RNA, 20 nt, Mycobacterium bovis subsp bovis AF2122/97
acgccguugccgccguugcc

SEQ ID NO: 3115701 - RNA, 16 nt, Mycobacterium bovis subsp bovis AF2122/97
acgccucaccgacguc

SEQ ID NO: 3115702 - RNA, 17 nt, Mycobacterium bovis subsp bovis AF2122/97
acgccucaccgacgucg

SEQ ID NO: 3115703 - RNA, 21 nt, Mycobacterium bovis subsp bovis AF2122/97
acgccucaccgacgucgccaa

SEQ ID NO: 3115704 - RNA, 18 nt, Mycobacterium bovis subsp bovis AF2122/97
acgccucgacacccagcc

SEQ ID NO: 3115705 - RNA, 12 nt, Mycobacterium bovis subsp bovis AF2122/97
acgccucgagca

SEQ ID NO: 3115706 - RNA, 15 nt, Mycobacterium bovis subsp bovis AF2122/97
acgccucgauggcgg

SEQ ID NO: 3115707 - RNA, 13 nt, Mycobacterium bovis subsp bovis AF2122/97
acgccucgccauc

SEQ ID NO: 3115708 - RNA, 13 nt, Mycobacterium bovis subsp bovis AF2122/97
acgccucgccgaa

SEQ ID NO: 3115709 - RNA, 15 nt, Mycobacterium bovis subsp bovis AF2122/97
acgccucgccggcca

SEQ ID NO: 3115710 - RNA, 17 nt, Mycobacterium bovis subsp bovis AF2122/97
acgccucgccggccacc

SEQ ID NO: 3115711 - RNA, 19 nt, Mycobacterium bovis subsp bovis AF2122/97
acgccucgccggccaccag

SEQ ID NO: 3115712 - RNA, 15 nt, Mycobacterium bovis subsp bovis AF2122/97
acgccucugcucagc

SEQ ID NO: 3115713 - RNA, 18 nt, Mycobacterium bovis subsp bovis AF2122/97
acgccugaaacgauugcu

SEQ ID NO: 3115714 - RNA, 14 nt, Mycobacterium bovis subsp bovis AF2122/97
acgccugagccacc

SEQ ID NO: 3115715 - RNA, 20 nt, Mycobacterium bovis subsp bovis AF2122/97
acgccugagccaccaacacc

SEQ ID NO: 3115716 - RNA, 17 nt, Mycobacterium bovis subsp bovis AF2122/97
acgccugcucggagagc

SEQ ID NO: 3115717 - RNA, 18 nt, Mycobacterium bovis subsp bovis AF2122/97
acgccugcucgucggcca

SEQ ID NO: 3115718 - RNA, 22 nt, Mycobacterium bovis subsp bovis AF2122/97
acgccugcucgucggccaccgc

SEQ ID NO: 3115719 - RNA, 15 nt, Mycobacterium bovis subsp bovis AF2122/97
acgccuugagccgag

SEQ ID NO: 3115720 - RNA, 19 nt, Mycobacterium bovis subsp bovis AF2122/97
acgccuugaucggcgaggu

SEQ ID NO: 3115721 - RNA, 14 nt, Mycobacterium bovis subsp bovis AF2122/97
acgccuugcacaag

SEQ ID NO: 3115722 - RNA, 15 nt, Mycobacterium bovis subsp bovis AF2122/97
acgccuuguuggcgc

SEQ ID NO: 3115723 - RNA, 21 nt, Mycobacterium bovis subsp bovis AF2122/97
acgccuuguuggcgcccgggc

SEQ ID NO: 3115724 - RNA, 19 nt, Mycobacterium bovis subsp bovis AF2122/97
acgcgaaaucccccgacac

SEQ ID NO: 3115725 - RNA, 22 nt, Mycobacterium bovis subsp bovis AF2122/97
acgcgaaaugccugcgcgaugc

SEQ ID NO: 3115726 - RNA, 16 nt, Mycobacterium bovis subsp bovis AF2122/97
acgcgaaccggccauc

SEQ ID NO: 3115727 - RNA, 13 nt, Mycobacterium bovis subsp bovis AF2122/97
acgcgaacgcggc

SEQ ID NO: 3115728 - RNA, 16 nt, Mycobacterium bovis subsp bovis AF2122/97
acgcgaagcugagcac

SEQ ID NO: 3115729 - RNA, 16 nt, Mycobacterium bovis subsp bovis AF2122/97
acgcgaauaccagacc

SEQ ID NO: 3115730 - RNA, 21 nt, Mycobacterium bovis subsp bovis AF2122/97
acgcgaauaccagaccggccg

SEQ ID NO: 3115731 - RNA, 22 nt, Mycobacterium bovis subsp bovis AF2122/97
acgcgaaugacgauccagccca

SEQ ID NO: 3115732 - RNA, 15 nt, Mycobacterium bovis subsp bovis AF2122/97
acgcgaaugucgcgc

SEQ ID NO: 3115733 - RNA, 18 nt, Mycobacterium bovis subsp bovis AF2122/97
acgcgacacacgccgccg

SEQ ID NO: 3115734 - RNA, 16 nt, Mycobacterium bovis subsp bovis AF2122/97
acgcgacacgccggcg

SEQ ID NO: 3115735 - RNA, 18 nt, Mycobacterium bovis subsp bovis AF2122/97
acgcgaccaccgccgagc

SEQ ID NO: 3115736 - RNA, 14 nt, Mycobacterium bovis subsp bovis AF2122/97
acgcgaccgcgauc

SEQ ID NO: 3115737 - RNA, 19 nt, Mycobacterium bovis subsp bovis AF2122/97
acgcgaccgcgauccccac

SEQ ID NO: 3115738 - RNA, 17 nt, Mycobacterium bovis subsp bovis AF2122/97
acgcgacgaagcagacg

SEQ ID NO: 3115739 - RNA, 15 nt, Mycobacterium bovis subsp bovis AF2122/97
acgcgacgagccgca

SEQ ID NO: 3115740 - RNA, 19 nt, Mycobacterium bovis subsp bovis AF2122/97
acgcgacgggccgcgaaug

SEQ ID NO: 3115741 - RNA, 15 nt, Mycobacterium bovis subsp bovis AF2122/97
acgcgacucggcggu

SEQ ID NO: 3115742 - RNA, 16 nt, Mycobacterium bovis subsp bovis AF2122/97
acgcgagcaacaccag

SEQ ID NO: 3115743 - RNA, 13 nt, Mycobacterium bovis subsp bovis AF2122/97
acgcgaggcgcuc

SEQ ID NO: 3115744 - RNA, 17 nt, Mycobacterium bovis subsp bovis AF2122/97
acgcgagugcgugaucu

SEQ ID NO: 3115745 - RNA, 20 nt, Mycobacterium bovis subsp bovis AF2122/97
acgcgaucaccucgccacac

SEQ ID NO: 3115746 - RNA, 14 nt, Mycobacterium bovis subsp bovis AF2122/97
acgcgaucagcgcg

SEQ ID NO: 3115747 - RNA, 15 nt, Mycobacterium bovis subsp bovis AF2122/97
acgcgaucagcgcgc

SEQ ID NO: 3115748 - RNA, 14 nt, Mycobacterium bovis subsp bovis AF2122/97
acgcgaucaggcgc

SEQ ID NO: 3115749 - RNA, 12 nt, Mycobacterium bovis subsp bovis AF2122/97
acgcgaucggcg

SEQ ID NO: 3115750 - RNA, 14 nt, Mycobacterium bovis subsp bovis AF2122/97
acgcgaugaccgca

SEQ ID NO: 3115751 - RNA, 20 nt, Mycobacterium bovis subsp bovis AF2122/97
acgcgaugaccgcaccgacc

SEQ ID NO: 3115752 - RNA, 21 nt, Mycobacterium bovis subsp bovis AF2122/97
acgcgauguccagguggcgcg

SEQ ID NO: 3115753 - RNA, 15 nt, Mycobacterium bovis subsp bovis AF2122/97
acgcgcaaccagccu

SEQ ID NO: 3115754 - RNA, 18 nt, Mycobacterium bovis subsp bovis AF2122/97
acgcgcaacgccgccagc

SEQ ID NO: 3115755 - RNA, 22 nt, Mycobacterium bovis subsp bovis AF2122/97
acgcgcaacucgccacggucgc

SEQ ID NO: 3115756 - RNA, 17 nt, Mycobacterium bovis subsp bovis AF2122/97
acgcgcacgcgugccgc

SEQ ID NO: 3115757 - RNA, 18 nt, Mycobacterium bovis subsp bovis AF2122/97
acgcgcacucgaccagga

SEQ ID NO: 3115758 - RNA, 14 nt, Mycobacterium bovis subsp bovis AF2122/97
acgcgcacucgacg

SEQ ID NO: 3115759 - RNA, 17 nt, Mycobacterium bovis subsp bovis AF2122/97
acgcgcagagcguuccg

SEQ ID NO: 3115760 - RNA, 16 nt, Mycobacterium bovis subsp bovis AF2122/97
acgcgcagcaucggcg

SEQ ID NO: 3115761 - RNA, 23 nt, Mycobacterium bovis subsp bovis AF2122/97
acgcgcaucgcacgggccaccag

SEQ ID NO: 3115762 - RNA, 18 nt, Mycobacterium bovis subsp bovis AF2122/97
acgcgcauucgccgggcg

SEQ ID NO: 3115763 - RNA, 20 nt, Mycobacterium bovis subsp bovis AF2122/97
acgcgccccaguucgacggc

SEQ ID NO: 3115764 - RNA, 13 nt, Mycobacterium bovis subsp bovis AF2122/97
acgcgcccgcacc

SEQ ID NO: 3115765 - RNA, 17 nt, Mycobacterium bovis subsp bovis AF2122/97
acgcgcccgcaccaccg

SEQ ID NO: 3115766 - RNA, 12 nt, Mycobacterium bovis subsp bovis AF2122/97
acgcgccgcaca

SEQ ID NO: 3115767 - RNA, 14 nt, Mycobacterium bovis subsp bovis AF2122/97
acgcgccggucagc

SEQ ID NO: 3115768 - RNA, 18 nt, Mycobacterium bovis subsp bovis AF2122/97
acgcgccguaacagccgg

SEQ ID NO: 3115769 - RNA, 21 nt, Mycobacterium bovis subsp bovis AF2122/97
acgcgccguaacagccggccg

SEQ ID NO: 3115770 - RNA, 15 nt, Mycobacterium bovis subsp bovis AF2122/97
acgcgcgagaacacc

SEQ ID NO: 3115771 - RNA, 17 nt, Mycobacterium bovis subsp bovis AF2122/97
acgcucgccgagcagac

SEQ ID NO: 3115772 - RNA, 13 nt, Mycobacterium bovis subsp bovis AF2122/97
acgcucgcgcacc

SEQ ID NO: 3115773 - RNA, 22 nt, Mycobacterium bovis subsp bovis AF2122/97
acgcucgcgggccaaagccguc

SEQ ID NO: 3115774 - RNA, 16 nt, Mycobacterium bovis subsp bovis AF2122/97
acgcucgcugcagcag

SEQ ID NO: 3115775 - RNA, 16 nt, Mycobacterium bovis subsp bovis AF2122/97
acgcucggcacggagu

SEQ ID NO: 3115776 - RNA, 12 nt, Mycobacterium bovis subsp bovis AF2122/97
acgcucggcgcc

SEQ ID NO: 3115777 - RNA, 14 nt, Mycobacterium bovis subsp bovis AF2122/97
acgcucggcgggga

SEQ ID NO: 3115778 - RNA, 20 nt, Mycobacterium bovis subsp bovis AF2122/97
acgcucggcggggaccgcgg

SEQ ID NO: 3115779 - RNA, 19 nt, Mycobacterium bovis subsp bovis AF2122/97
acgcucggcguccgcccag

SEQ ID NO: 3115780 - RNA, 22 nt, Mycobacterium bovis subsp bovis AF2122/97
acgcucggcguccgcccagcac

SEQ ID NO: 3115781 - RNA, 21 nt, Mycobacterium bovis subsp bovis AF2122/97
acgcucggcgugucgggggcu

SEQ ID NO: 3115782 - RNA, 18 nt, Mycobacterium bovis subsp bovis AF2122/97
acgcucgggcgcgcucgu

SEQ ID NO: 3115783 - RNA, 15 nt, Mycobacterium bovis subsp bovis AF2122/97
acgcucggucgccac

SEQ ID NO: 3115784 - RNA, 23 nt, Mycobacterium bovis subsp bovis AF2122/97
acgcucggucgccaccgccggca

SEQ ID NO: 3115785 - RNA, 19 nt, Mycobacterium bovis subsp bovis AF2122/97
acgcucguagaaccggggu

SEQ ID NO: 3115786 - RNA, 20 nt, Mycobacterium bovis subsp bovis AF2122/97
acgcucguuugcgagcaggg

SEQ ID NO: 3115787 - RNA, 17 nt, Mycobacterium bovis subsp bovis AF2122/97
acgcucugcgccacagc

SEQ ID NO: 3115788 - RNA, 20 nt, Mycobacterium bovis subsp bovis AF2122/97
acgcugaauuccacugcgcc

SEQ ID NO: 3115789 - RNA, 23 nt, Mycobacterium bovis subsp bovis AF2122/97
acgcugaauuccacugcgccaca

SEQ ID NO: 3115790 - RNA, 18 nt, Mycobacterium bovis subsp bovis AF2122/97
acgcugaccaacggggca

SEQ ID NO: 3115791 - RNA, 18 nt, Mycobacterium bovis subsp bovis AF2122/97
acgcugacgcccucauag

SEQ ID NO: 3115792 - RNA, 16 nt, Mycobacterium bovis subsp bovis AF2122/97
acgcugacgugaagca

SEQ ID NO: 3115793 - RNA, 20 nt, Mycobacterium bovis subsp bovis AF2122/97
acgcugaggaagcggcggca

SEQ ID NO: 3115794 - RNA, 14 nt, Mycobacterium bovis subsp bovis AF2122/97
acgcugagucccca

SEQ ID NO: 3115795 - RNA, 23 nt, Mycobacterium bovis subsp bovis AF2122/97
acgcugauccacgauaucgaugc

SEQ ID NO: 3115796 - RNA, 21 nt, Mycobacterium bovis subsp bovis AF2122/97
acgcugcaggcggccgagcug

SEQ ID NO: 3115797 - RNA, 19 nt, Mycobacterium bovis subsp bovis AF2122/97
acgcugcccacgggccggc

SEQ ID NO: 3115798 - RNA, 21 nt, Mycobacterium bovis subsp bovis AF2122/97
acgcugcccacgggccggccg

SEQ ID NO: 3115799 - RNA, 24 nt, Mycobacterium bovis subsp bovis AF2122/97
acgcugcccacgggccggccgagc

SEQ ID NO: 3115800 - RNA, 17 nt, Mycobacterium bovis subsp bovis AF2122/97
acgcugccccgccgcca

SEQ ID NO: 3115801 - RNA, 20 nt, Mycobacterium bovis subsp bovis AF2122/97
acgcugccgguguaggccuc

SEQ ID NO: 3115802 - RNA, 15 nt, Mycobacterium bovis subsp bovis AF2122/97
acgcugcgcccggac

SEQ ID NO: 3115803 - RNA, 20 nt, Mycobacterium bovis subsp bovis AF2122/97
acgcugcuggcaugcaggug

SEQ ID NO: 3115804 - RNA, 18 nt, Mycobacterium bovis subsp bovis AF2122/97
acgcuggaggcgaucugc

SEQ ID NO: 3115805 - RNA, 12 nt, Mycobacterium bovis subsp bovis AF2122/97
acgcuggccacg

SEQ ID NO: 3115806 - RNA, 19 nt, Mycobacterium bovis subsp bovis AF2122/97
acgcuggccuccagcuugg

SEQ ID NO: 3115807 - RNA, 14 nt, Mycobacterium bovis subsp bovis AF2122/97
acgcuggccucguc

SEQ ID NO: 3115808 - RNA, 17 nt, Mycobacterium bovis subsp bovis AF2122/97
acgcuggcgcguaucgc

SEQ ID NO: 3115809 - RNA, 19 nt, Mycobacterium bovis subsp bovis AF2122/97
acgcuggcgguguagccgc

SEQ ID NO: 3115810 - RNA, 22 nt, Mycobacterium bovis subsp bovis AF2122/97
acgcuggcguuguugacgauca

SEQ ID NO: 3115811 - RNA, 15 nt, Mycobacterium bovis subsp bovis AF2122/97
acgcugggcgguagc

SEQ ID NO: 3115812 - RNA, 21 nt, Mycobacterium bovis subsp bovis AF2122/97
acgcugggcgguagcuuccgc

SEQ ID NO: 3115813 - RNA, 16 nt, Mycobacterium bovis subsp bovis AF2122/97
acgcuggucggcggcu

SEQ ID NO: 3115814 - RNA, 16 nt, Mycobacterium bovis subsp bovis AF2122/97
acgcuguaagcaugcc

SEQ ID NO: 3115815 - RNA, 16 nt, Mycobacterium bovis subsp bovis AF2122/97
acgcuguccaggucug

SEQ ID NO: 3115816 - RNA, 20 nt, Mycobacterium bovis subsp bovis AF2122/97
acgcugugcgguaucgguca

SEQ ID NO: 3115817 - RNA, 22 nt, Mycobacterium bovis subsp bovis AF2122/97
acgcugugcgguaucggucagc

SEQ ID NO: 3115818 - RNA, 16 nt, Mycobacterium bovis subsp bovis AF2122/97
acgcugugcucgacga

SEQ ID NO: 3115819 - RNA, 21 nt, Mycobacterium bovis subsp bovis AF2122/97
acgcugugggcuuugccgucg

SEQ ID NO: 3115820 - RNA, 20 nt, Mycobacterium bovis subsp bovis AF2122/97
acgcuguugucguccaacgg

SEQ ID NO: 3115821 - RNA, 15 nt, Mycobacterium bovis subsp bovis AF2122/97
acgcuucaccucguc

SEQ ID NO: 3115822 - RNA, 17 nt, Mycobacterium bovis subsp bovis AF2122/97
acgcuucaccucgucga

SEQ ID NO: 3115823 - RNA, 18 nt, Mycobacterium bovis subsp bovis AF2122/97
acgcuucaccucgucgac

SEQ ID NO: 3115824 - RNA, 17 nt, Mycobacterium bovis subsp bovis AF2122/97
acgcuuggguagccuga

SEQ ID NO: 3115825 - RNA, 17 nt, Mycobacterium bovis subsp bovis AF2122/97
acgcuuuccgccgcacc

SEQ ID NO: 3115826 - RNA, 15 nt, Mycobacterium bovis subsp bovis AF2122/97
acgcuuuccggcggu

SEQ ID NO: 3115827 - RNA, 15 nt, Mycobacterium bovis subsp bovis AF2122/97
acggaaggcccggcg

SEQ ID NO: 3115828 - RNA, 20 nt, Mycobacterium bovis subsp bovis AF2122/97
acggaaguaucgccggccgc

SEQ ID NO: 3115829 - RNA, 18 nt, Mycobacterium bovis subsp bovis AF2122/97
acggaaugucagccgguu

SEQ ID NO: 3115830 - RNA, 20 nt, Mycobacterium bovis subsp bovis AF2122/97
acggacccuuccgccgccgc

SEQ ID NO: 3115831 - RNA, 12 nt, Mycobacterium bovis subsp bovis AF2122/97
acggaccgccac

SEQ ID NO: 3115832 - RNA, 17 nt, Mycobacterium bovis subsp bovis AF2122/97
acggaccgcgucgcggg

SEQ ID NO: 3115833 - RNA, 13 nt, Mycobacterium bovis subsp bovis AF2122/97
acggaccgucgcc

SEQ ID NO: 3115834 - RNA, 17 nt, Mycobacterium bovis subsp bovis AF2122/97
acggaccuccucgccca

SEQ ID NO: 3115835 - RNA, 15 nt, Mycobacterium bovis subsp bovis AF2122/97
acggacgaagcaccu

SEQ ID NO: 3115836 - RNA, 17 nt, Mycobacterium bovis subsp bovis AF2122/97
acggacuccggccggcc

SEQ ID NO: 3115837 - RNA, 22 nt, Mycobacterium bovis subsp bovis AF2122/97
acggacuucccgcgcgagccgc

SEQ ID NO: 3115838 - RNA, 16 nt, Mycobacterium bovis subsp bovis AF2122/97
acggagccgccggcgg

SEQ ID NO: 3115839 - RNA, 19 nt, Mycobacterium bovis subsp bovis AF2122/97
acggagccgccggcgguga

SEQ ID NO: 3115840 - RNA, 21 nt, Mycobacterium bovis subsp bovis AF2122/97
acggagccgccggcggugaug

SEQ ID NO: 3115841 - RNA, 13 nt, Mycobacterium bovis subsp bovis AF2122/97
acggagcggccua

SEQ ID NO: 3115842 - RNA, 13 nt, Mycobacterium bovis subsp bovis AF2122/97
acggagggcagga

SEQ ID NO: 3115843 - RNA, 14 nt, Mycobacterium bovis subsp bovis AF2122/97
acggaggugccggc

SEQ ID NO: 3115844 - RNA, 15 nt, Mycobacterium bovis subsp bovis AF2122/97
acggaggugccggcg

SEQ ID NO: 3115845 - RNA, 16 nt, Mycobacterium bovis subsp bovis AF2122/97
acggaggugccggcgc

SEQ ID NO: 3115846 - RNA, 18 nt, Mycobacterium bovis subsp bovis AF2122/97
acggaggugccggcgcca

SEQ ID NO: 3115847 - RNA, 22 nt, Mycobacterium bovis subsp bovis AF2122/97
acggagugucgaugcgcgccgg

SEQ ID NO: 3115848 - RNA, 23 nt, Mycobacterium bovis subsp bovis AF2122/97
acggauaauucaacagcaccgcg

SEQ ID NO: 3115849 - RNA, 18 nt, Mycobacterium bovis subsp bovis AF2122/97
acggauaguucaccacau

SEQ ID NO: 3115850 - RNA, 16 nt, Mycobacterium bovis subsp bovis AF2122/97
acggauaucagcaaca

SEQ ID NO: 3115851 - RNA, 18 nt, Mycobacterium bovis subsp bovis AF2122/97
acggaucaggcccgggcg

SEQ ID NO: 3115852 - RNA, 16 nt, Mycobacterium bovis subsp bovis AF2122/97
acggaucgcggcggcg

SEQ ID NO: 3115853 - RNA, 23 nt, Mycobacterium bovis subsp bovis AF2122/97
acggaucgucgugcacggcggcc

SEQ ID NO: 3115854 - RNA, 21 nt, Mycobacterium bovis subsp bovis AF2122/97
acggaucugagcuagccguuc

SEQ ID NO: 3115855 - RNA, 15 nt, Mycobacterium bovis subsp bovis AF2122/97
acggaugaucagcga

SEQ ID NO: 3115856 - RNA, 14 nt, Mycobacterium bovis subsp bovis AF2122/97
acggaugaugccgg

SEQ ID NO: 3115857 - RNA, 17 nt, Mycobacterium bovis subsp bovis AF2122/97
acggccggcaagcaguc

SEQ ID NO: 3115858 - RNA, 19 nt, Mycobacterium bovis subsp bovis AF2122/97
acggccggccgcggucucc

SEQ ID NO: 3115859 - RNA, 16 nt, Mycobacterium bovis subsp bovis AF2122/97
acggccggccgcugcc

SEQ ID NO: 3115860 - RNA, 22 nt, Mycobacterium bovis subsp bovis AF2122/97
acggccggcggucgggcccggc

SEQ ID NO: 3115861 - RNA, 17 nt, Mycobacterium bovis subsp bovis AF2122/97
acggccgggacggcgau

SEQ ID NO: 3115862 - RNA, 12 nt, Mycobacterium bovis subsp bovis AF2122/97
acggccgucgac

SEQ ID NO: 3115863 - RNA, 19 nt, Mycobacterium bovis subsp bovis AF2122/97
acggccguggaaagccggc

SEQ ID NO: 3115864 - RNA, 16 nt, Mycobacterium bovis subsp bovis AF2122/97
acggccuccaucgcga

SEQ ID NO: 3115865 - RNA, 13 nt, Mycobacterium bovis subsp bovis AF2122/97
acggccugcaacg

SEQ ID NO: 3115866 - RNA, 17 nt, Mycobacterium bovis subsp bovis AF2122/97
acggccugcaacgucac

SEQ ID NO: 3115867 - RNA, 18 nt, Mycobacterium bovis subsp bovis AF2122/97
acggccugcuaaccacgg

SEQ ID NO: 3115868 - RNA, 16 nt, Mycobacterium bovis subsp bovis AF2122/97
acggccuggccaccug

SEQ ID NO: 3115869 - RNA, 19 nt, Mycobacterium bovis subsp bovis AF2122/97
acggccuggccaccugguu

SEQ ID NO: 3115870 - RNA, 22 nt, Mycobacterium bovis subsp bovis AF2122/97
acggccuggggcagccgggcgu

SEQ ID NO: 3115871 - RNA, 18 nt, Mycobacterium bovis subsp bovis AF2122/97
acggcgaaaaucccgcuc

SEQ ID NO: 3115872 - RNA, 16 nt, Mycobacterium bovis subsp bovis AF2122/97
acggcgaaaguccugc

SEQ ID NO: 3115873 - RNA, 18 nt, Mycobacterium bovis subsp bovis AF2122/97
acggcgaaccggcccacc

SEQ ID NO: 3115874 - RNA, 15 nt, Mycobacterium bovis subsp bovis AF2122/97
acggcgaagucgagu

SEQ ID NO: 3115875 - RNA, 22 nt, Mycobacterium bovis subsp bovis AF2122/97
acggcgaaucgguggucgaugg

SEQ ID NO: 3115876 - RNA, 13 nt, Mycobacterium bovis subsp bovis AF2122/97
acggcgacaucgg

SEQ ID NO: 3115877 - RNA, 14 nt, Mycobacterium bovis subsp bovis AF2122/97
acggcgacaucggc

SEQ ID NO: 3115878 - RNA, 19 nt, Mycobacterium bovis subsp bovis AF2122/97
acggcgacaucggcccgau

SEQ ID NO: 3115879 - RNA, 20 nt, Mycobacterium bovis subsp bovis AF2122/97
acggcgaccaccgcggcugc

SEQ ID NO: 3115880 - RNA, 19 nt, Mycobacterium bovis subsp bovis AF2122/97
acggcgaccacgccgccgg

SEQ ID NO: 3115881 - RNA, 17 nt, Mycobacterium bovis subsp bovis AF2122/97
acggcgaccaggagccu

SEQ ID NO: 3115882 - RNA, 22 nt, Mycobacterium bovis subsp bovis AF2122/97
acggcgaccaggagccuccagc

SEQ ID NO: 3115883 - RNA, 12 nt, Mycobacterium bovis subsp bovis AF2122/97
acggcgacccag

SEQ ID NO: 3115884 - RNA, 14 nt, Mycobacterium bovis subsp bovis AF2122/97
acggcgaccgccau

SEQ ID NO: 3115885 - RNA, 17 nt, Mycobacterium bovis subsp bovis AF2122/97
acggcgaccgccaucac

SEQ ID NO: 3115886 - RNA, 22 nt, Mycobacterium bovis subsp bovis AF2122/97
acggcgacgaucucggcggccg

SEQ ID NO: 3115887 - RNA, 16 nt, Mycobacterium bovis subsp bovis AF2122/97
acggcgacggcgccca

SEQ ID NO: 3115888 - RNA, 23 nt, Mycobacterium bovis subsp bovis AF2122/97
acggcgacgugaauggugguguc

SEQ ID NO: 3115889 - RNA, 15 nt, Mycobacterium bovis subsp bovis AF2122/97
acggcgacucgagga

SEQ ID NO: 3115890 - RNA, 24 nt, Mycobacterium bovis subsp bovis AF2122/97
acggcgauauaggacgccgcgccg

SEQ ID NO: 3115891 - RNA, 14 nt, Mycobacterium bovis subsp bovis AF2122/97
acggcgaugcagcc

SEQ ID NO: 3115892 - RNA, 17 nt, Mycobacterium bovis subsp bovis AF2122/97
acggcgaugcagccaca

SEQ ID NO: 3115893 - RNA, 15 nt, Mycobacterium bovis subsp bovis AF2122/97
acggcgauggcgcgc

SEQ ID NO: 3115894 - RNA, 22 nt, Mycobacterium bovis subsp bovis AF2122/97
acggcgauugcccgugcgaugc

SEQ ID NO: 3115895 - RNA, 20 nt, Mycobacterium bovis subsp bovis AF2122/97
acggcgcaacaccucguaug

SEQ ID NO: 3115896 - RNA, 16 nt, Mycobacterium bovis subsp bovis AF2122/97
acggcgcaguagaugc

SEQ ID NO: 3115897 - RNA, 18 nt, Mycobacterium bovis subsp bovis AF2122/97
acggcgcaguuggcacca

SEQ ID NO: 3115898 - RNA, 21 nt, Mycobacterium bovis subsp bovis AF2122/97
acggcgcaguuggcaccagcc

SEQ ID NO: 3115899 - RNA, 21 nt, Mycobacterium bovis subsp bovis AF2122/97
acggcgccauuggcgucccgc

SEQ ID NO: 3115900 - RNA, 14 nt, Mycobacterium bovis subsp bovis AF2122/97
acggcgccgacccg

SEQ ID NO: 3115901 - RNA, 19 nt, Mycobacterium bovis subsp bovis AF2122/97
acggcgccgacccgaucac

SEQ ID NO: 3115902 - RNA, 12 nt, Mycobacterium bovis subsp bovis AF2122/97
acggcgccgcca

SEQ ID NO: 3115903 - RNA, 20 nt, Mycobacterium bovis subsp bovis AF2122/97
acggcgccgcccacggggcg

SEQ ID NO: 3115904 - RNA, 20 nt, Mycobacterium bovis subsp bovis AF2122/97
acggcgccgguuucgaggcg

SEQ ID NO: 3115905 - RNA, 17 nt, Mycobacterium bovis subsp bovis AF2122/97
acggcgccuacaccggc

SEQ ID NO: 3115906 - RNA, 13 nt, Mycobacterium bovis subsp bovis AF2122/97
acggcgcgagccg

SEQ ID NO: 3115907 - RNA, 15 nt, Mycobacterium bovis subsp bovis AF2122/97
acggcgcgagccgca

SEQ ID NO: 3115908 - RNA, 16 nt, Mycobacterium bovis subsp bovis AF2122/97
acggcgcgagccgcac

SEQ ID NO: 3115909 - RNA, 15 nt, Mycobacterium bovis subsp bovis AF2122/97
acggcgcgccagaac

SEQ ID NO: 3115910 - RNA, 14 nt, Mycobacterium bovis subsp bovis AF2122/97
acggcgcggcggag

SEQ ID NO: 3115911 - RNA, 18 nt, Mycobacterium bovis subsp bovis AF2122/97
acggcgcggugcgcucac

SEQ ID NO: 3115912 - RNA, 19 nt, Mycobacterium bovis subsp bovis AF2122/97
acggcgcucggcgagcuca

SEQ ID NO: 3115913 - RNA, 14 nt, Mycobacterium bovis subsp bovis AF2122/97
acggcgcugacgaa

SEQ ID NO: 3115914 - RNA, 16 nt, Mycobacterium bovis subsp bovis AF2122/97
acggcggagucgcgca

SEQ ID NO: 3115915 - RNA, 21 nt, Mycobacterium bovis subsp bovis AF2122/97
acggcggagucgcgcagggcg

SEQ ID NO: 3115916 - RNA, 17 nt, Mycobacterium bovis subsp bovis AF2122/97
acggcggaucggcggcc

SEQ ID NO: 3115917 - RNA, 17 nt, Mycobacterium bovis subsp bovis AF2122/97
acggcggcaacggcggc

SEQ ID NO: 3115918 - RNA, 23 nt, Mycobacterium bovis subsp bovis AF2122/97
acggcggcaacggcggcaucggc

SEQ ID NO: 3115919 - RNA, 14 nt, Mycobacterium bovis subsp bovis AF2122/97
acggcggcagucgc

SEQ ID NO: 3115920 - RNA, 15 nt, Mycobacterium bovis subsp bovis AF2122/97
acggcggcaucggcg

SEQ ID NO: 3115921 - RNA, 16 nt, Mycobacterium bovis subsp bovis AF2122/97
acggcggccaaggucg

SEQ ID NO: 3115922 - RNA, 18 nt, Mycobacterium bovis subsp bovis AF2122/97
acggcggccaaggucgac

SEQ ID NO: 3115923 - RNA, 22 nt, Mycobacterium bovis subsp bovis AF2122/97
acggcggccaccugcuggccgu

SEQ ID NO: 3115924 - RNA, 14 nt, Mycobacterium bovis subsp bovis AF2122/97
acggcggccauggc

SEQ ID NO: 3115925 - RNA, 23 nt, Mycobacterium bovis subsp bovis AF2122/97
acggcggccccggcauugcccga

SEQ ID NO: 3115926 - RNA, 14 nt, Mycobacterium bovis subsp bovis AF2122/97
acggcggcccgcuc

SEQ ID NO: 3115927 - RNA, 14 nt, Mycobacterium bovis subsp bovis AF2122/97
acggcggccgccac

SEQ ID NO: 3115928 - RNA, 15 nt, Mycobacterium bovis subsp bovis AF2122/97
acggcggccgcgaug

SEQ ID NO: 3115929 - RNA, 16 nt, Mycobacterium bovis subsp bovis AF2122/97
acggcggccgcgaugg

SEQ ID NO: 3115930 - RNA, 17 nt, Mycobacterium bovis subsp bovis AF2122/97
acggcggccuucggccg

SEQ ID NO: 3115931 - RNA, 13 nt, Mycobacterium bovis subsp bovis AF2122/97
acggcggcgacgg

SEQ ID NO: 3115932 - RNA, 13 nt, Mycobacterium bovis subsp bovis AF2122/97
acggcggcgaggc

SEQ ID NO: 3115933 - RNA, 14 nt, Mycobacterium bovis subsp bovis AF2122/97
acggcggcgaggcg

SEQ ID NO: 3115934 - RNA, 21 nt, Mycobacterium bovis subsp bovis AF2122/97
acggcggcgaggcggucgccg

SEQ ID NO: 3115935 - RNA, 22 nt, Mycobacterium bovis subsp bovis AF2122/97
acggcggcgaggcggucgccga

SEQ ID NO: 3115936 - RNA, 10 nt, Mycobacterium bovis subsp bovis AF2122/97
acggcggcgc

SEQ ID NO: 3115937 - RNA, 12 nt, Mycobacterium bovis subsp bovis AF2122/97
acggcggcgccg

SEQ ID NO: 3115938 - RNA, 14 nt, Mycobacterium bovis subsp bovis AF2122/97
acggcggcgccgcc

SEQ ID NO: 3115939 - RNA, 17 nt, Mycobacterium bovis subsp bovis AF2122/97
acggcggcgccgcccaa

SEQ ID NO: 3115940 - RNA, 22 nt, Mycobacterium bovis subsp bovis AF2122/97
acggcggcugucggccggguca

SEQ ID NO: 3115941 - RNA, 20 nt, Mycobacterium bovis subsp bovis AF2122/97
acggcgggaacggugccgau

SEQ ID NO: 3115942 - RNA, 19 nt, Mycobacterium bovis subsp bovis AF2122/97
acggcgggaugcagcugcc

SEQ ID NO: 3115943 - RNA, 15 nt, Mycobacterium bovis subsp bovis AF2122/97
acggcgggcgacccg

SEQ ID NO: 3115944 - RNA, 15 nt, Mycobacterium bovis subsp bovis AF2122/97
acgggcgcgucggcg

SEQ ID NO: 3115945 - RNA, 13 nt, Mycobacterium bovis subsp bovis AF2122/97
acgggcggccacc

SEQ ID NO: 3115946 - RNA, 13 nt, Mycobacterium bovis subsp bovis AF2122/97
acgggcggccagg

SEQ ID NO: 3115947 - RNA, 22 nt, Mycobacterium bovis subsp bovis AF2122/97
acgggcggccauggcacugccg

SEQ ID NO: 3115948 - RNA, 15 nt, Mycobacterium bovis subsp bovis AF2122/97
acgggcggggacggc

SEQ ID NO: 3115949 - RNA, 17 nt, Mycobacterium bovis subsp bovis AF2122/97
acgggcggggacggcgg

SEQ ID NO: 3115950 - RNA, 16 nt, Mycobacterium bovis subsp bovis AF2122/97
acgggcuaccggcagc

SEQ ID NO: 3115951 - RNA, 22 nt, Mycobacterium bovis subsp bovis AF2122/97
acgggcugccccuccgggcgca

SEQ ID NO: 3115952 - RNA, 20 nt, Mycobacterium bovis subsp bovis AF2122/97
acgggcuuccgacaugaacc

SEQ ID NO: 3115953 - RNA, 20 nt, Mycobacterium bovis subsp bovis AF2122/97
acggggaugggggagccggu

SEQ ID NO: 3115954 - RNA, 16 nt, Mycobacterium bovis subsp bovis AF2122/97
acggggccgccagcug

SEQ ID NO: 3115955 - RNA, 14 nt, Mycobacterium bovis subsp bovis AF2122/97
acggggcgagcaug

SEQ ID NO: 3115956 - RNA, 16 nt, Mycobacterium bovis subsp bovis AF2122/97
acggggcugaccgcca

SEQ ID NO: 3115957 - RNA, 21 nt, Mycobacterium bovis subsp bovis AF2122/97
acggggcugaccgccaccccg

SEQ ID NO: 3115958 - RNA, 16 nt, Mycobacterium bovis subsp bovis AF2122/97
acgggggcuguccacc

SEQ ID NO: 3115959 - RNA, 20 nt, Mycobacterium bovis subsp bovis AF2122/97
acggggucgcccggggcgca

SEQ ID NO: 3115960 - RNA, 16 nt, Mycobacterium bovis subsp bovis AF2122/97
acggggucgccggcac

SEQ ID NO: 3115961 - RNA, 20 nt, Mycobacterium bovis subsp bovis AF2122/97
acggggucgccggcaccgga

SEQ ID NO: 3115962 - RNA, 15 nt, Mycobacterium bovis subsp bovis AF2122/97
acgggguggcacgca

SEQ ID NO: 3115963 - RNA, 13 nt, Mycobacterium bovis subsp bovis AF2122/97
acggggugguggu

SEQ ID NO: 3115964 - RNA, 19 nt, Mycobacterium bovis subsp bovis AF2122/97
acgggguggugguggaguu

SEQ ID NO: 3115965 - RNA, 16 nt, Mycobacterium bovis subsp bovis AF2122/97
acgggguugaccgcca

SEQ ID NO: 3115966 - RNA, 17 nt, Mycobacterium bovis subsp bovis AF2122/97
acgggguugaccgccac

SEQ ID NO: 3115967 - RNA, 21 nt, Mycobacterium bovis subsp bovis AF2122/97
acgggguugaccgccaccccg

SEQ ID NO: 3115968 - RNA, 16 nt, Mycobacterium bovis subsp bovis AF2122/97
acggguaaucaccgaa

SEQ ID NO: 3115969 - RNA, 15 nt, Mycobacterium bovis subsp bovis AF2122/97
acggguacacccgcu

SEQ ID NO: 3115970 - RNA, 11 nt, Mycobacterium bovis subsp bovis AF2122/97
acgggucagca

SEQ ID NO: 3115971 - RNA, 13 nt, Mycobacterium bovis subsp bovis AF2122/97
acgggucgccgga

SEQ ID NO: 3115972 - RNA, 12 nt, Mycobacterium bovis subsp bovis AF2122/97
acgggucggcga

SEQ ID NO: 3115973 - RNA, 12 nt, Mycobacterium bovis subsp bovis AF2122/97
acgggucggguc

SEQ ID NO: 3115974 - RNA, 23 nt, Mycobacterium bovis subsp bovis AF2122/97
acgggucguaggacaccaccgug

SEQ ID NO: 3115975 - RNA, 20 nt, Mycobacterium bovis subsp bovis AF2122/97
acgggucuggccaacgccgg

SEQ ID NO: 3115976 - RNA, 22 nt, Mycobacterium bovis subsp bovis AF2122/97
acgggugagcaccacgugcgcc

SEQ ID NO: 3115977 - RNA, 17 nt, Mycobacterium bovis subsp bovis AF2122/97
acggguggcccgaccgg

SEQ ID NO: 3115978 - RNA, 14 nt, Mycobacterium bovis subsp bovis AF2122/97
acgggugucgggcg

SEQ ID NO: 3115979 - RNA, 18 nt, Mycobacterium bovis subsp bovis AF2122/97
acggguugucguugcugg

SEQ ID NO: 3115980 - RNA, 23 nt, Mycobacterium bovis subsp bovis AF2122/97
acgguaaucgcgaacgaagucga

SEQ ID NO: 3115981 - RNA, 16 nt, Mycobacterium bovis subsp bovis AF2122/97
acgguacagcuccaca

SEQ ID NO: 3115982 - RNA, 20 nt, Mycobacterium bovis subsp bovis AF2122/97
acgguacugugggcgaucgg

SEQ ID NO: 3115983 - RNA, 14 nt, Mycobacterium bovis subsp bovis AF2122/97
acgguagcacgguc

SEQ ID NO: 3115984 - RNA, 14 nt, Mycobacterium bovis subsp bovis AF2122/97
acggucaagccggc

SEQ ID NO: 3115985 - RNA, 19 nt, Mycobacterium bovis subsp bovis AF2122/97
acggucaaggugcgccgcc

SEQ ID NO: 3115986 - RNA, 22 nt, Mycobacterium bovis subsp bovis AF2122/97
acggucaaggugcgccgccauc

SEQ ID NO: 3115987 - RNA, 23 nt, Mycobacterium bovis subsp bovis AF2122/97
acggucaaucccggccaggggcg

SEQ ID NO: 3115988 - RNA, 12 nt, Mycobacterium bovis subsp bovis AF2122/97
acggucacacgc

SEQ ID NO: 3115989 - RNA, 16 nt, Mycobacterium bovis subsp bovis AF2122/97
acggucacacgccagc

SEQ ID NO: 3115990 - RNA, 21 nt, Mycobacterium bovis subsp bovis AF2122/97
acggucacacgccagccgguu

SEQ ID NO: 3115991 - RNA, 12 nt, Mycobacterium bovis subsp bovis AF2122/97
acggucaccggc

SEQ ID NO: 3115992 - RNA, 14 nt, Mycobacterium bovis subsp bovis AF2122/97
acggucaccggcac

SEQ ID NO: 3115993 - RNA, 14 nt, Mycobacterium bovis subsp bovis AF2122/97
acggucaccggcgc

SEQ ID NO: 3115994 - RNA, 16 nt, Mycobacterium bovis subsp bovis AF2122/97
acggucagcagacugc

SEQ ID NO: 3115995 - RNA, 18 nt, Mycobacterium bovis subsp bovis AF2122/97
acggucagccgcggggcg

SEQ ID NO: 3115996 - RNA, 13 nt, Mycobacterium bovis subsp bovis AF2122/97
acggucagcucgc

SEQ ID NO: 3115997 - RNA, 19 nt, Mycobacterium bovis subsp bovis AF2122/97
acggucagguccugggugu

SEQ ID NO: 3115998 - RNA, 19 nt, Mycobacterium bovis subsp bovis AF2122/97
acggucaugccgccgccga

SEQ ID NO: 3115999 - RNA, 15 nt, Mycobacterium bovis subsp bovis AF2122/97
acgguccacgacguc

SEQ ID NO: 3116000 - RNA, 19 nt, Mycobacterium bovis subsp bovis AF2122/97
acgguccacgguggcgccg

SEQ ID NO: 3116001 - RNA, 15 nt, Mycobacterium bovis subsp bovis AF2122/97
acggucccggcacgu

SEQ ID NO: 3116002 - RNA, 19 nt, Mycobacterium bovis subsp bovis AF2122/97
acggucccggcacgucgac

SEQ ID NO: 3116003 - RNA, 16 nt, Mycobacterium bovis subsp bovis AF2122/97
acgguccguucgaugc

SEQ ID NO: 3116004 - RNA, 18 nt, Mycobacterium bovis subsp bovis AF2122/97
acgguccguucgcgccgu

SEQ ID NO: 3116005 - RNA, 18 nt, Mycobacterium bovis subsp bovis AF2122/97
acggucgaccaggacggu

SEQ ID NO: 3116006 - RNA, 19 nt, Mycobacterium bovis subsp bovis AF2122/97
acggucgccgaccacucga

SEQ ID NO: 3116007 - RNA, 23 nt, Mycobacterium bovis subsp bovis AF2122/97
acggucgccgaccacucgagcgc

SEQ ID NO: 3116008 - RNA, 15 nt, Mycobacterium bovis subsp bovis AF2122/97
acggucgggaccggc

SEQ ID NO: 3116009 - RNA, 15 nt, Mycobacterium bovis subsp bovis AF2122/97
acggucguuggucgg

SEQ ID NO: 3116010 - RNA, 18 nt, Mycobacterium bovis subsp bovis AF2122/97
acggucguuggucggggu

SEQ ID NO: 3116011 - RNA, 17 nt, Mycobacterium bovis subsp bovis AF2122/97
acggucugccacgaggc

SEQ ID NO: 3116012 - RNA, 18 nt, Mycobacterium bovis subsp bovis AF2122/97
acggugaagccgagcgcc

SEQ ID NO: 3116013 - RNA, 14 nt, Mycobacterium bovis subsp bovis AF2122/97
acggugaagccguu

SEQ ID NO: 3116014 - RNA, 20 nt, Mycobacterium bovis subsp bovis AF2122/97
acggugaaucgaagcccggc

SEQ ID NO: 3116015 - RNA, 14 nt, Mycobacterium bovis subsp bovis AF2122/97
acggugaauucacg

SEQ ID NO: 3116016 - RNA, 13 nt, Mycobacterium bovis subsp bovis AF2122/97
acggugacaucgc

SEQ ID NO: 3116017 - RNA, 13 nt, Mycobacterium bovis subsp bovis AF2122/97
acggugaccacgc

SEQ ID NO: 3116018 - RNA, 14 nt, Mycobacterium bovis subsp bovis AF2122/97
acggugacgaucag

SEQ ID NO: 3116019 - RNA, 23 nt, Mycobacterium bovis subsp bovis AF2122/97
acggugacuaccgugcauaccgc

SEQ ID NO: 3116020 - RNA, 23 nt, Mycobacterium bovis subsp bovis AF2122/97
acggugaucagccaccgggugga

SEQ ID NO: 3116021 - RNA, 16 nt, Mycobacterium bovis subsp bovis AF2122/97
acggugaucgccggcu

SEQ ID NO: 3116022 - RNA, 19 nt, Mycobacterium bovis subsp bovis AF2122/97
acggugcagcuccccgccg

SEQ ID NO: 3116023 - RNA, 15 nt, Mycobacterium bovis subsp bovis AF2122/97
acggugccaccgcga

SEQ ID NO: 3116024 - RNA, 20 nt, Mycobacterium bovis subsp bovis AF2122/97
acggugccaccgcgacggca

SEQ ID NO: 3116025 - RNA, 16 nt, Mycobacterium bovis subsp bovis AF2122/97
acggugcgcuggaugu

SEQ ID NO: 3116026 - RNA, 21 nt, Mycobacterium bovis subsp bovis AF2122/97
acggugcgggcuaggcggcgu

SEQ ID NO: 3116027 - RNA, 13 nt, Mycobacterium bovis subsp bovis AF2122/97
acggugcgguugc

SEQ ID NO: 3116028 - RNA, 17 nt, Mycobacterium bovis subsp bovis AF2122/97
acggugcgguugcaucc

SEQ ID NO: 3116029 - RNA, 21 nt, Mycobacterium bovis subsp bovis AF2122/97
acggugcucuucgaugacuag

SEQ ID NO: 3116030 - RNA, 17 nt, Mycobacterium bovis subsp bovis AF2122/97
acggugcugaucggucc

SEQ ID NO: 3116031 - RNA, 22 nt, Mycobacterium bovis subsp bovis AF2122/97
acguccaucaccggcggcccca

SEQ ID NO: 3116032 - RNA, 18 nt, Mycobacterium bovis subsp bovis AF2122/97
acguccaucccggcgccg

SEQ ID NO: 3116033 - RNA, 21 nt, Mycobacterium bovis subsp bovis AF2122/97
acguccaucccggcgccgcgg

SEQ ID NO: 3116034 - RNA, 21 nt, Mycobacterium bovis subsp bovis AF2122/97
acgucccagagaaucagcgug

SEQ ID NO: 3116035 - RNA, 20 nt, Mycobacterium bovis subsp bovis AF2122/97
acgucccagcccuuggcgcg

SEQ ID NO: 3116036 - RNA, 18 nt, Mycobacterium bovis subsp bovis AF2122/97
acgucccgguaauccacu

SEQ ID NO: 3116037 - RNA, 11 nt, Mycobacterium bovis subsp bovis AF2122/97
acguccgcgac

SEQ ID NO: 3116038 - RNA, 15 nt, Mycobacterium bovis subsp bovis AF2122/97
acguccgcgcaccgc

SEQ ID NO: 3116039 - RNA, 15 nt, Mycobacterium bovis subsp bovis AF2122/97
acguccgcgccgagc

SEQ ID NO: 3116040 - RNA, 22 nt, Mycobacterium bovis subsp bovis AF2122/97
acguccgcgggggaccgcccga

SEQ ID NO: 3116041 - RNA, 17 nt, Mycobacterium bovis subsp bovis AF2122/97
acguccucagccgugcc

SEQ ID NO: 3116042 - RNA, 22 nt, Mycobacterium bovis subsp bovis AF2122/97
acguccugcccgucgucggcaa

SEQ ID NO: 3116043 - RNA, 17 nt, Mycobacterium bovis subsp bovis AF2122/97
acgucgacaacgaucgc

SEQ ID NO: 3116044 - RNA, 19 nt, Mycobacterium bovis subsp bovis AF2122/97
acgucgacaacgaucgcgc

SEQ ID NO: 3116045 - RNA, 13 nt, Mycobacterium bovis subsp bovis AF2122/97
acgucgaccgaac

SEQ ID NO: 3116046 - RNA, 19 nt, Mycobacterium bovis subsp bovis AF2122/97
acgucgaccgaacccgacg

SEQ ID NO: 3116047 - RNA, 19 nt, Mycobacterium bovis subsp bovis AF2122/97
acgucgaccgugucaccgc

SEQ ID NO: 3116048 - RNA, 20 nt, Mycobacterium bovis subsp bovis AF2122/97
acgucgacggcgauggcgcg

SEQ ID NO: 3116049 - RNA, 19 nt, Mycobacterium bovis subsp bovis AF2122/97
acgucgacuucagcggccg

SEQ ID NO: 3116050 - RNA, 16 nt, Mycobacterium bovis subsp bovis AF2122/97
acgucgacuuguuggg

SEQ ID NO: 3116051 - RNA, 20 nt, Mycobacterium bovis subsp bovis AF2122/97
acgucgacuuguugggcgcg

SEQ ID NO: 3116052 - RNA, 18 nt, Mycobacterium bovis subsp bovis AF2122/97
acgucgagauccucgucg

SEQ ID NO: 3116053 - RNA, 17 nt, Mycobacterium bovis subsp bovis AF2122/97
acgucgagcacccgcuc

SEQ ID NO: 3116054 - RNA, 15 nt, Mycobacterium bovis subsp bovis AF2122/97
acgucgagcaggcug

SEQ ID NO: 3116055 - RNA, 21 nt, Mycobacterium bovis subsp bovis AF2122/97
acgucgagcgccuugucgauc

SEQ ID NO: 3116056 - RNA, 13 nt, Mycobacterium bovis subsp bovis AF2122/97
acgucgaucagug

SEQ ID NO: 3116057 - RNA, 15 nt, Mycobacterium bovis subsp bovis AF2122/97
acgucgauggugcgg

SEQ ID NO: 3116058 - RNA, 19 nt, Mycobacterium bovis subsp bovis AF2122/97
acgucgauuucggcgaccg

SEQ ID NO: 3116059 - RNA, 15 nt, Mycobacterium bovis subsp bovis AF2122/97
acgucgcccccggcc

SEQ ID NO: 3116060 - RNA, 20 nt, Mycobacterium bovis subsp bovis AF2122/97
acgucgccgacccgggggcg

SEQ ID NO: 3116061 - RNA, 18 nt, Mycobacterium bovis subsp bovis AF2122/97
acgucgccgacgguuacc

SEQ ID NO: 3116062 - RNA, 14 nt, Mycobacterium bovis subsp bovis AF2122/97
acgucgccgccgcg

SEQ ID NO: 3116063 - RNA, 16 nt, Mycobacterium bovis subsp bovis AF2122/97
acgucgccgcggcggc

SEQ ID NO: 3116064 - RNA, 22 nt, Mycobacterium bovis subsp bovis AF2122/97
acgucgccgcggcggcagcggc

SEQ ID NO: 3116065 - RNA, 15 nt, Mycobacterium bovis subsp bovis AF2122/97
acgucgcgcaucgcc

SEQ ID NO: 3116066 - RNA, 17 nt, Mycobacterium bovis subsp bovis AF2122/97
acgucgcgcaucgccuc

SEQ ID NO: 3116067 - RNA, 21 nt, Mycobacterium bovis subsp bovis AF2122/97
acgucgcgcaucgccuccucg

SEQ ID NO: 3116068 - RNA, 15 nt, Mycobacterium bovis subsp bovis AF2122/97
acgucgcgccaggcg

SEQ ID NO: 3116069 - RNA, 18 nt, Mycobacterium bovis subsp bovis AF2122/97
acgucgcggaguagccgc

SEQ ID NO: 3116070 - RNA, 16 nt, Mycobacterium bovis subsp bovis AF2122/97
acgucgcggauugccg

SEQ ID NO: 3116071 - RNA, 14 nt, Mycobacterium bovis subsp bovis AF2122/97
acgucgcggccagc

SEQ ID NO: 3116072 - RNA, 21 nt, Mycobacterium bovis subsp bovis AF2122/97
acgucgcggguaaccggcucc

SEQ ID NO: 3116073 - RNA, 19 nt, Mycobacterium bovis subsp bovis AF2122/97
acgucgcguucuccggcac

SEQ ID NO: 3116074 - RNA, 18 nt, Mycobacterium bovis subsp bovis AF2122/97
acgucgcuguaggccagc

SEQ ID NO: 3116075 - RNA, 19 nt, Mycobacterium bovis subsp bovis AF2122/97
acgucgcuguaggccagcc

SEQ ID NO: 3116076 - RNA, 17 nt, Mycobacterium bovis subsp bovis AF2122/97
acgucggcaaucucgau

SEQ ID NO: 3116077 - RNA, 19 nt, Mycobacterium bovis subsp bovis AF2122/97
acgucggcaaucucgaucu

SEQ ID NO: 3116078 - RNA, 15 nt, Mycobacterium bovis subsp bovis AF2122/97
acgucggcaucggcg

SEQ ID NO: 3116079 - RNA, 12 nt, Mycobacterium bovis subsp bovis AF2122/97
acgucggccagu

SEQ ID NO: 3116080 - RNA, 14 nt, Mycobacterium bovis subsp bovis AF2122/97
acgucggccagugc

SEQ ID NO: 3116081 - RNA, 16 nt, Mycobacterium bovis subsp bovis AF2122/97
acgucggccgcaucgc

SEQ ID NO: 3116082 - RNA, 17 nt, Mycobacterium bovis subsp bovis AF2122/97
acgucggccgcaucgcc

SEQ ID NO: 3116083 - RNA, 23 nt, Mycobacterium bovis subsp bovis AF2122/97
acgucggcgaacggauucccgcc

SEQ ID NO: 3116084 - RNA, 19 nt, Mycobacterium bovis subsp bovis AF2122/97
acgucggcgaauccgccgc

SEQ ID NO: 3116085 - RNA, 20 nt, Mycobacterium bovis subsp bovis AF2122/97
acgucggcgaauccgccgcc

SEQ ID NO: 3116086 - RNA, 15 nt, Mycobacterium bovis subsp bovis AF2122/97
acgucggcgagcucg

SEQ ID NO: 3116087 - RNA, 23 nt, Mycobacterium bovis subsp bovis AF2122/97
acgucggcgagcucggccccgcc

SEQ ID NO: 3116088 - RNA, 12 nt, Mycobacterium bovis subsp bovis AF2122/97
acgucggcggcu

SEQ ID NO: 3116089 - RNA, 21 nt, Mycobacterium bovis subsp bovis AF2122/97
acgucggcggugacggugccg

SEQ ID NO: 3116090 - RNA, 15 nt, Mycobacterium bovis subsp bovis AF2122/97
acgucgggaucgcca

SEQ ID NO: 3116091 - RNA, 19 nt, Mycobacterium bovis subsp bovis AF2122/97
acgucgggcauggcggcgu

SEQ ID NO: 3116092 - RNA, 14 nt, Mycobacterium bovis subsp bovis AF2122/97
acgucgggcccgau

SEQ ID NO: 3116093 - RNA, 23 nt, Mycobacterium bovis subsp bovis AF2122/97
acgucggguugcacggcgauugc

SEQ ID NO: 3116094 - RNA, 18 nt, Mycobacterium bovis subsp bovis AF2122/97
acgucgguaagcgccaag

SEQ ID NO: 3116095 - RNA, 17 nt, Mycobacterium bovis subsp bovis AF2122/97
acgucggugaccucggc

SEQ ID NO: 3116096 - RNA, 17 nt, Mycobacterium bovis subsp bovis AF2122/97
acgucguagaccuccag

SEQ ID NO: 3116097 - RNA, 17 nt, Mycobacterium bovis subsp bovis AF2122/97
acgucgucagccaccgc

SEQ ID NO: 3116098 - RNA, 18 nt, Mycobacterium bovis subsp bovis AF2122/97
acgucgucagccaccgca

SEQ ID NO: 3116099 - RNA, 19 nt, Mycobacterium bovis subsp bovis AF2122/97
acgucgucagccaccgcau

SEQ ID NO: 3116100 - RNA, 22 nt, Mycobacterium bovis subsp bovis AF2122/97
acgucgucgaauccugccgcac

SEQ ID NO: 3116101 - RNA, 13 nt, Mycobacterium bovis subsp bovis AF2122/97
acgucgucgcggg

SEQ ID NO: 3116102 - RNA, 13 nt, Mycobacterium bovis subsp bovis AF2122/97
acgucgucggcca

SEQ ID NO: 3116103 - RNA, 13 nt, Mycobacterium bovis subsp bovis AF2122/97
acgucgucggggu

SEQ ID NO: 3116104 - RNA, 13 nt, Mycobacterium bovis subsp bovis AF2122/97
acgucgucguggu

SEQ ID NO: 3116105 - RNA, 14 nt, Mycobacterium bovis subsp bovis AF2122/97
acgucgugaccggc

SEQ ID NO: 3116106 - RNA, 16 nt, Mycobacterium bovis subsp bovis AF2122/97
acgucguugccgucca

SEQ ID NO: 3116107 - RNA, 18 nt, Mycobacterium bovis subsp bovis AF2122/97
acgucguugccguccacc

SEQ ID NO: 3116108 - RNA, 21 nt, Mycobacterium bovis subsp bovis AF2122/97
acgucguugugcagaucgucg

SEQ ID NO: 3116109 - RNA, 22 nt, Mycobacterium bovis subsp bovis AF2122/97
acgucguugugcagaucgucgc

SEQ ID NO: 3116110 - RNA, 23 nt, Mycobacterium bovis subsp bovis AF2122/97
acgucguuuggccucagcccggc

SEQ ID NO: 3116111 - RNA, 20 nt, Mycobacterium bovis subsp bovis AF2122/97
acgucugacaauuccuggau

SEQ ID NO: 3116112 - RNA, 15 nt, Mycobacterium bovis subsp bovis AF2122/97
acgucugccaggcgc

SEQ ID NO: 3116113 - RNA, 22 nt, Mycobacterium bovis subsp bovis AF2122/97
acgucugccaggcgcagcuggu

SEQ ID NO: 3116114 - RNA, 22 nt, Mycobacterium bovis subsp bovis AF2122/97
acgucuucgaccucacccaccc

SEQ ID NO: 3116115 - RNA, 21 nt, Mycobacterium bovis subsp bovis AF2122/97
acgucuucgggcucguccagc

SEQ ID NO: 3116116 - RNA, 19 nt, Mycobacterium bovis subsp bovis AF2122/97
acgugaacugagggcggaa

SEQ ID NO: 3116117 - RNA, 18 nt, Mycobacterium bovis subsp bovis AF2122/97
acguuggccaggcccgag

SEQ ID NO: 3116118 - RNA, 22 nt, Mycobacterium bovis subsp bovis AF2122/97
acguuggccgagcagggccggc

SEQ ID NO: 3116119 - RNA, 23 nt, Mycobacterium bovis subsp bovis AF2122/97
acguuggccgagcagggccggca

SEQ ID NO: 3116120 - RNA, 18 nt, Mycobacterium bovis subsp bovis AF2122/97
acguuggggauggucccg

SEQ ID NO: 3116121 - RNA, 19 nt, Mycobacterium bovis subsp bovis AF2122/97
acguugguccgcugcagca

SEQ ID NO: 3116122 - RNA, 18 nt, Mycobacterium bovis subsp bovis AF2122/97
acguuguacucgugcggu

SEQ ID NO: 3116123 - RNA, 17 nt, Mycobacterium bovis subsp bovis AF2122/97
acguuguccaccgccac

SEQ ID NO: 3116124 - RNA, 13 nt, Mycobacterium bovis subsp bovis AF2122/97
acguugugccgcu

SEQ ID NO: 3116125 - RNA, 17 nt, Mycobacterium bovis subsp bovis AF2122/97
acguuguucaccgacgc

SEQ ID NO: 3116126 - RNA, 21 nt, Mycobacterium bovis subsp bovis AF2122/97
acguuguuggauccggccacc

SEQ ID NO: 3116127 - RNA, 15 nt, Mycobacterium bovis subsp bovis AF2122/97
acguuuagggugccc

SEQ ID NO: 3116128 - RNA, 19 nt, Mycobacterium bovis subsp bovis AF2122/97
acguuuucgucaccccacc

SEQ ID NO: 3116129 - RNA, 18 nt, Mycobacterium bovis subsp bovis AF2122/97
acuaaacaggccgccacc

SEQ ID NO: 3116130 - RNA, 14 nt, Mycobacterium bovis subsp bovis AF2122/97
acuaacaacaccac

SEQ ID NO: 3116131 - RNA, 16 nt, Mycobacterium bovis subsp bovis AF2122/97
acuaacaacaccacca

SEQ ID NO: 3116132 - RNA, 13 nt, Mycobacterium bovis subsp bovis AF2122/97
acuaacggcagcc

SEQ ID NO: 3116133 - RNA, 17 nt, Mycobacterium bovis subsp bovis AF2122/97
acuacccagccagccgc

SEQ ID NO: 3116134 - RNA, 15 nt, Mycobacterium bovis subsp bovis AF2122/97
acuaccgaucacaua

SEQ ID NO: 3116135 - RNA, 15 nt, Mycobacterium bovis subsp bovis AF2122/97
acuaccgccgcgacc

SEQ ID NO: 3116136 - RNA, 14 nt, Mycobacterium bovis subsp bovis AF2122/97
acuaccgccggcgg

SEQ ID NO: 3116137 - RNA, 16 nt, Mycobacterium bovis subsp bovis AF2122/97
acuaccgccggcggcg

SEQ ID NO: 3116138 - RNA, 18 nt, Mycobacterium bovis subsp bovis AF2122/97
acuaccgugcauaccgca

SEQ ID NO: 3116139 - RNA, 20 nt, Mycobacterium bovis subsp bovis AF2122/97
acuacggccucgcugggcuc

SEQ ID NO: 3116140 - RNA, 17 nt, Mycobacterium bovis subsp bovis AF2122/97
acuacggccuggccacc

SEQ ID NO: 3116141 - RNA, 15 nt, Mycobacterium bovis subsp bovis AF2122/97
acuacggcguccccg

SEQ ID NO: 3116142 - RNA, 14 nt, Mycobacterium bovis subsp bovis AF2122/97
acuacuccgguccc

SEQ ID NO: 3116143 - RNA, 16 nt, Mycobacterium bovis subsp bovis AF2122/97
acuacuccugagauga

SEQ ID NO: 3116144 - RNA, 15 nt, Mycobacterium bovis subsp bovis AF2122/97
acuagacgccgccgc

SEQ ID NO: 3116145 - RNA, 20 nt, Mycobacterium bovis subsp bovis AF2122/97
acuagacgccgccgcugccg

SEQ ID NO: 3116146 - RNA, 14 nt, Mycobacterium bovis subsp bovis AF2122/97
acuagcagcgggcu

SEQ ID NO: 3116147 - RNA, 15 nt, Mycobacterium bovis subsp bovis AF2122/97
acuagcagcgggcug

SEQ ID NO: 3116148 - RNA, 16 nt, Mycobacterium bovis subsp bovis AF2122/97
acuagcauugucgccg

SEQ ID NO: 3116149 - RNA, 14 nt, Mycobacterium bovis subsp bovis AF2122/97
acuagcgagccggc

SEQ ID NO: 3116150 - RNA, 21 nt, Mycobacterium bovis subsp bovis AF2122/97
acuagcgagccggcgccgggu

SEQ ID NO: 3116151 - RNA, 17 nt, Mycobacterium bovis subsp bovis AF2122/97
acuagcgccccuggcac

SEQ ID NO: 3116152 - RNA, 23 nt, Mycobacterium bovis subsp bovis AF2122/97
acuagcgccccuggcaccucgcc

SEQ ID NO: 3116153 - RNA, 21 nt, Mycobacterium bovis subsp bovis AF2122/97
acuagcggcucaccgcgcauc

SEQ ID NO: 3116154 - RNA, 16 nt, Mycobacterium bovis subsp bovis AF2122/97
acuaggcccagcacgg

SEQ ID NO: 3116155 - RNA, 20 nt, Mycobacterium bovis subsp bovis AF2122/97
acuaggccccuggccgccgc

SEQ ID NO: 3116156 - RNA, 21 nt, Mycobacterium bovis subsp bovis AF2122/97
acuaggcuuuccggggaauga

SEQ ID NO: 3116157 - RNA, 20 nt, Mycobacterium bovis subsp bovis AF2122/97
acuaucggccgccggaucag

SEQ ID NO: 3116158 - RNA, 22 nt, Mycobacterium bovis subsp bovis AF2122/97
acuaucgucgugucgccgccgu

SEQ ID NO: 3116159 - RNA, 12 nt, Mycobacterium bovis subsp bovis AF2122/97
acuaugccaacg

SEQ ID NO: 3116160 - RNA, 14 nt, Mycobacterium bovis subsp bovis AF2122/97
acucaaagacccga

SEQ ID NO: 3116161 - RNA, 16 nt, Mycobacterium bovis subsp bovis AF2122/97
acucaacaccagcaag

SEQ ID NO: 3116162 - RNA, 17 nt, Mycobacterium bovis subsp bovis AF2122/97
acucaagauaacggcga

SEQ ID NO: 3116163 - RNA, 19 nt, Mycobacterium bovis subsp bovis AF2122/97
acucaagauuuccaucgca

SEQ ID NO: 3116164 - RNA, 15 nt, Mycobacterium bovis subsp bovis AF2122/97
acucacauuggccag

SEQ ID NO: 3116165 - RNA, 18 nt, Mycobacterium bovis subsp bovis AF2122/97
acucacauuggccagguc

SEQ ID NO: 3116166 - RNA, 12 nt, Mycobacterium bovis subsp bovis AF2122/97
acucaccagcac

SEQ ID NO: 3116167 - RNA, 13 nt, Mycobacterium bovis subsp bovis AF2122/97
acucaccagcacc

SEQ ID NO: 3116168 - RNA, 15 nt, Mycobacterium bovis subsp bovis AF2122/97
acucacccacccgca

SEQ ID NO: 3116169 - RNA, 20 nt, Mycobacterium bovis subsp bovis AF2122/97
acucacccacccgcaccgcg

SEQ ID NO: 3116170 - RNA, 12 nt, Mycobacterium bovis subsp bovis AF2122/97
acucaccccaac

SEQ ID NO: 3116171 - RNA, 20 nt, Mycobacterium bovis subsp bovis AF2122/97
acucacccgagccaucaccg

SEQ ID NO: 3116172 - RNA, 23 nt, Mycobacterium bovis subsp bovis AF2122/97
acucacccgagccaucaccgcaa

SEQ ID NO: 3116173 - RNA, 20 nt, Mycobacterium bovis subsp bovis AF2122/97
acucacccgggcagccugcu

SEQ ID NO: 3116174 - RNA, 15 nt, Mycobacterium bovis subsp bovis AF2122/97
acucaccgugaaccg

SEQ ID NO: 3116175 - RNA, 22 nt, Mycobacterium bovis subsp bovis AF2122/97
acucacgaggcacaaucaccgc

SEQ ID NO: 3116176 - RNA, 23 nt, Mycobacterium bovis subsp bovis AF2122/97
acucacgcaggaaaaccccggcc

SEQ ID NO: 3116177 - RNA, 18 nt, Mycobacterium bovis subsp bovis AF2122/97
acucacgggugcuggcag

SEQ ID NO: 3116178 - RNA, 19 nt, Mycobacterium bovis subsp bovis AF2122/97
acucagaacguggccguua

SEQ ID NO: 3116179 - RNA, 19 nt, Mycobacterium bovis subsp bovis AF2122/97
acucaggaucccgguggca

SEQ ID NO: 3116180 - RNA, 16 nt, Mycobacterium bovis subsp bovis AF2122/97
acucagguacggcggg

SEQ ID NO: 3116181 - RNA, 14 nt, Mycobacterium bovis subsp bovis AF2122/97
acucagucugggga

SEQ ID NO: 3116182 - RNA, 13 nt, Mycobacterium bovis subsp bovis AF2122/97
acucauagaccag

SEQ ID NO: 3116183 - RNA, 14 nt, Mycobacterium bovis subsp bovis AF2122/97
acucaucaccgaug

SEQ ID NO: 3116184 - RNA, 17 nt, Mycobacterium bovis subsp bovis AF2122/97
acucaucagagcgcugg

SEQ ID NO: 3116185 - RNA, 12 nt, Mycobacterium bovis subsp bovis AF2122/97
acucaucgccgg

SEQ ID NO: 3116186 - RNA, 14 nt, Mycobacterium bovis subsp bovis AF2122/97
acucaucggccgcg

SEQ ID NO: 3116187 - RNA, 22 nt, Mycobacterium bovis subsp bovis AF2122/97
acucaucggccgcggucggcca

SEQ ID NO: 3116188 - RNA, 18 nt, Mycobacterium bovis subsp bovis AF2122/97
acucaucgugguaaccau

SEQ ID NO: 3116189 - RNA, 21 nt, Mycobacterium bovis subsp bovis AF2122/97
acucaucuuugacaccggucg

SEQ ID NO: 3116190 - RNA, 19 nt, Mycobacterium bovis subsp bovis AF2122/97
acucauggccggucugcug

SEQ ID NO: 3116191 - RNA, 22 nt, Mycobacterium bovis subsp bovis AF2122/97
acuccaacugaucccguagccg

SEQ ID NO: 3116192 - RNA, 17 nt, Mycobacterium bovis subsp bovis AF2122/97
acuccaagucacagcuc

SEQ ID NO: 3116193 - RNA, 20 nt, Mycobacterium bovis subsp bovis AF2122/97
acuccaagucacagcucacc

SEQ ID NO: 3116194 - RNA, 12 nt, Mycobacterium bovis subsp bovis AF2122/97
acuccaccgcgc

SEQ ID NO: 3116195 - RNA, 14 nt, Mycobacterium bovis subsp bovis AF2122/97
acuccaccgcgccg

SEQ ID NO: 3116196 - RNA, 19 nt, Mycobacterium bovis subsp bovis AF2122/97
acuccacgaucggcccagc

SEQ ID NO: 3116197 - RNA, 20 nt, Mycobacterium bovis subsp bovis AF2122/97
acuccacgaucggcccagcc

SEQ ID NO: 3116198 - RNA, 21 nt, Mycobacterium bovis subsp bovis AF2122/97
acuccacgaucggcccagccc

SEQ ID NO: 3116199 - RNA, 21 nt, Mycobacterium bovis subsp bovis AF2122/97
acuccacgcagcccgucggcg

SEQ ID NO: 3116200 - RNA, 15 nt, Mycobacterium bovis subsp bovis AF2122/97
acuccacgcggaccu

SEQ ID NO: 3116201 - RNA, 14 nt, Mycobacterium bovis subsp bovis AF2122/97
acuccagcaaggcc

SEQ ID NO: 3116202 - RNA, 19 nt, Mycobacterium bovis subsp bovis AF2122/97
acuccagcaaggccagcac

SEQ ID NO: 3116203 - RNA, 20 nt, Mycobacterium bovis subsp bovis AF2122/97
acuccagcaaggccagcacg

SEQ ID NO: 3116204 - RNA, 15 nt, Mycobacterium bovis subsp bovis AF2122/97
acucggcauucaccg

SEQ ID NO: 3116205 - RNA, 21 nt, Mycobacterium bovis subsp bovis AF2122/97
acucggccacggcgucggcca

SEQ ID NO: 3116206 - RNA, 21 nt, Mycobacterium bovis subsp bovis AF2122/97
acucggcccggcaggacuugg

SEQ ID NO: 3116207 - RNA, 13 nt, Mycobacterium bovis subsp bovis AF2122/97
acucggcccggcc

SEQ ID NO: 3116208 - RNA, 18 nt, Mycobacterium bovis subsp bovis AF2122/97
acucggcgaccugccgga

SEQ ID NO: 3116209 - RNA, 18 nt, Mycobacterium bovis subsp bovis AF2122/97
acucggcgauauggccuu

SEQ ID NO: 3116210 - RNA, 16 nt, Mycobacterium bovis subsp bovis AF2122/97
acucggcggccaccau

SEQ ID NO: 3116211 - RNA, 13 nt, Mycobacterium bovis subsp bovis AF2122/97
acucggcggccag

SEQ ID NO: 3116212 - RNA, 14 nt, Mycobacterium bovis subsp bovis AF2122/97
acucggcggccagc

SEQ ID NO: 3116213 - RNA, 22 nt, Mycobacterium bovis subsp bovis AF2122/97
acucggcggccagcgagaucag

SEQ ID NO: 3116214 - RNA, 12 nt, Mycobacterium bovis subsp bovis AF2122/97
acucggcggcuu

SEQ ID NO: 3116215 - RNA, 18 nt, Mycobacterium bovis subsp bovis AF2122/97
acucggcgucgugguggc

SEQ ID NO: 3116216 - RNA, 20 nt, Mycobacterium bovis subsp bovis AF2122/97
acucggcgucgugguggcca

SEQ ID NO: 3116217 - RNA, 23 nt, Mycobacterium bovis subsp bovis AF2122/97
acucggcgucgugguggccacgg

SEQ ID NO: 3116218 - RNA, 20 nt, Mycobacterium bovis subsp bovis AF2122/97
acucgggauucggcagcggc

SEQ ID NO: 3116219 - RNA, 15 nt, Mycobacterium bovis subsp bovis AF2122/97
acucgggcaaugucg

SEQ ID NO: 3116220 - RNA, 23 nt, Mycobacterium bovis subsp bovis AF2122/97
acucgggcaaugucgacaccggc

SEQ ID NO: 3116221 - RNA, 17 nt, Mycobacterium bovis subsp bovis AF2122/97
acucgggcagcgcggcc

SEQ ID NO: 3116222 - RNA, 20 nt, Mycobacterium bovis subsp bovis AF2122/97
acucgggcagcgcggccagu

SEQ ID NO: 3116223 - RNA, 17 nt, Mycobacterium bovis subsp bovis AF2122/97
acucgggcaggccccac

SEQ ID NO: 3116224 - RNA, 19 nt, Mycobacterium bovis subsp bovis AF2122/97
acucgggggcugcacgcuc

SEQ ID NO: 3116225 - RNA, 18 nt, Mycobacterium bovis subsp bovis AF2122/97
acucggucguugccgcgg

SEQ ID NO: 3116226 - RNA, 19 nt, Mycobacterium bovis subsp bovis AF2122/97
acucggucguugccgcggu

SEQ ID NO: 3116227 - RNA, 20 nt, Mycobacterium bovis subsp bovis AF2122/97
acucggucucauagugcagg

SEQ ID NO: 3116228 - RNA, 12 nt, Mycobacterium bovis subsp bovis AF2122/97
acucggugaucg

SEQ ID NO: 3116229 - RNA, 19 nt, Mycobacterium bovis subsp bovis AF2122/97
acucggugaucgcgguggc

SEQ ID NO: 3116230 - RNA, 22 nt, Mycobacterium bovis subsp bovis AF2122/97
acucggugauguagggcugcuc

SEQ ID NO: 3116231 - RNA, 20 nt, Mycobacterium bovis subsp bovis AF2122/97
acucgguucgccccugcaca

SEQ ID NO: 3116232 - RNA, 12 nt, Mycobacterium bovis subsp bovis AF2122/97
acucgucgaugc

SEQ ID NO: 3116233 - RNA, 13 nt, Mycobacterium bovis subsp bovis AF2122/97
acucgucgcugcc

SEQ ID NO: 3116234 - RNA, 14 nt, Mycobacterium bovis subsp bovis AF2122/97
acucgucgcugccc

SEQ ID NO: 3116235 - RNA, 17 nt, Mycobacterium bovis subsp bovis AF2122/97
acucgugcaccgucggg

SEQ ID NO: 3116236 - RNA, 20 nt, Mycobacterium bovis subsp bovis AF2122/97
acucguggaacuccguccgc

SEQ ID NO: 3116237 - RNA, 20 nt, Mycobacterium bovis subsp bovis AF2122/97
acucguggcgccacggcagc

SEQ ID NO: 3116238 - RNA, 14 nt, Mycobacterium bovis subsp bovis AF2122/97
acucguugaccggc

SEQ ID NO: 3116239 - RNA, 19 nt, Mycobacterium bovis subsp bovis AF2122/97
acucguugagcagcuggac

SEQ ID NO: 3116240 - RNA, 15 nt, Mycobacterium bovis subsp bovis AF2122/97
acucguugccgacca

SEQ ID NO: 3116241 - RNA, 14 nt, Mycobacterium bovis subsp bovis AF2122/97
acucuccccuggcc

SEQ ID NO: 3116242 - RNA, 16 nt, Mycobacterium bovis subsp bovis AF2122/97
acucugaugucgggaa

SEQ ID NO: 3116243 - RNA, 14 nt, Mycobacterium bovis subsp bovis AF2122/97
acucugcgacacca

SEQ ID NO: 3116244 - RNA, 15 nt, Mycobacterium bovis subsp bovis AF2122/97
acucugcguccacca

SEQ ID NO: 3116245 - RNA, 16 nt, Mycobacterium bovis subsp bovis AF2122/97
acucugcguccaccac

SEQ ID NO: 3116246 - RNA, 19 nt, Mycobacterium bovis subsp bovis AF2122/97
acucugcguccaccacgca

SEQ ID NO: 3116247 - RNA, 22 nt, Mycobacterium bovis subsp bovis AF2122/97
acucugcguccaccacgcaaaa

SEQ ID NO: 3116248 - RNA, 22 nt, Mycobacterium bovis subsp bovis AF2122/97
acucuucagcuaccuccgccac

SEQ ID NO: 3116249 - RNA, 19 nt, Mycobacterium bovis subsp bovis AF2122/97
acucuucccauuucggcaa

SEQ ID NO: 3116250 - RNA, 18 nt, Mycobacterium bovis subsp bovis AF2122/97
acucuuguccagaaucca

SEQ ID NO: 3116251 - RNA, 15 nt, Mycobacterium bovis subsp bovis AF2122/97
acugaaccguagcgc

SEQ ID NO: 3116252 - RNA, 22 nt, Mycobacterium bovis subsp bovis AF2122/97
acugaacgguuucuuucggcag

SEQ ID NO: 3116253 - RNA, 15 nt, Mycobacterium bovis subsp bovis AF2122/97
acugaacgucaccgu

SEQ ID NO: 3116254 - RNA, 16 nt, Mycobacterium bovis subsp bovis AF2122/97
acugaacucaacacca

SEQ ID NO: 3116255 - RNA, 20 nt, Mycobacterium bovis subsp bovis AF2122/97
acugaacucaacaccagcaa

SEQ ID NO: 3116256 - RNA, 20 nt, Mycobacterium bovis subsp bovis AF2122/97
acugaaucgaccggaacugu

SEQ ID NO: 3116257 - RNA, 16 nt, Mycobacterium bovis subsp bovis AF2122/97
acugaccacgucggac

SEQ ID NO: 3116258 - RNA, 14 nt, Mycobacterium bovis subsp bovis AF2122/97
acugaccaggucug

SEQ ID NO: 3116259 - RNA, 22 nt, Mycobacterium bovis subsp bovis AF2122/97
acugaccccgccgccacgggug

SEQ ID NO: 3116260 - RNA, 23 nt, Mycobacterium bovis subsp bovis AF2122/97
acugaccgucugcgacccgggcc

SEQ ID NO: 3116261 - RNA, 23 nt, Mycobacterium bovis subsp bovis AF2122/97
acugaccucgucaaucaccaccg

SEQ ID NO: 3116262 - RNA, 17 nt, Mycobacterium bovis subsp bovis AF2122/97
acugagaucgcuucccg

SEQ ID NO: 3116263 - RNA, 20 nt, Mycobacterium bovis subsp bovis AF2122/97
acugaggaaagucaccgucc

SEQ ID NO: 3116264 - RNA, 23 nt, Mycobacterium bovis subsp bovis AF2122/97
acugaucggaaacggagccgagc

SEQ ID NO: 3116265 - RNA, 22 nt, Mycobacterium bovis subsp bovis AF2122/97
acugaucuucgagccggcggcc

SEQ ID NO: 3116266 - RNA, 14 nt, Mycobacterium bovis subsp bovis AF2122/97
acugauggcgcgca

SEQ ID NO: 3116267 - RNA, 14 nt, Mycobacterium bovis subsp bovis AF2122/97
acugaugucgccga

SEQ ID NO: 3116268 - RNA, 18 nt, Mycobacterium bovis subsp bovis AF2122/97
acugcacaccaccgccga

SEQ ID NO: 3116269 - RNA, 21 nt, Mycobacterium bovis subsp bovis AF2122/97
acugcacaccaccgccgaaca

SEQ ID NO: 3116270 - RNA, 14 nt, Mycobacterium bovis subsp bovis AF2122/97
acugcacccgaucg

SEQ ID NO: 3116271 - RNA, 20 nt, Mycobacterium bovis subsp bovis AF2122/97
acugcacggagccgccggcg

SEQ ID NO: 3116272 - RNA, 22 nt, Mycobacterium bovis subsp bovis AF2122/97
acugcacggagccgccggcggu

SEQ ID NO: 3116273 - RNA, 13 nt, Mycobacterium bovis subsp bovis AF2122/97
acugcagcgcggc

SEQ ID NO: 3116274 - RNA, 22 nt, Mycobacterium bovis subsp bovis AF2122/97
acugcagugaucgugaccggca

SEQ ID NO: 3116275 - RNA, 21 nt, Mycobacterium bovis subsp bovis AF2122/97
acugcagugccguguccagca

SEQ ID NO: 3116276 - RNA, 24 nt, Mycobacterium bovis subsp bovis AF2122/97
acugcagugccguguccagcaugc

SEQ ID NO: 3116277 - RNA, 14 nt, Mycobacterium bovis subsp bovis AF2122/97
acugcaucaccacu

SEQ ID NO: 3116278 - RNA, 14 nt, Mycobacterium bovis subsp bovis AF2122/97
acugccagcgccgc

SEQ ID NO: 3116279 - RNA, 16 nt, Mycobacterium bovis subsp bovis AF2122/97
acugccagcguugcgg

SEQ ID NO: 3116280 - RNA, 22 nt, Mycobacterium bovis subsp bovis AF2122/97
acugcccgaugaucugugccgc

SEQ ID NO: 3116281 - RNA, 15 nt, Mycobacterium bovis subsp bovis AF2122/97
acugcccgccgacgc

SEQ ID NO: 3116282 - RNA, 17 nt, Mycobacterium bovis subsp bovis AF2122/97
acugcccgccgacgcca

SEQ ID NO: 3116283 - RNA, 18 nt, Mycobacterium bovis subsp bovis AF2122/97
acugcccgcguuugcgaa

SEQ ID NO: 3116284 - RNA, 22 nt, Mycobacterium bovis subsp bovis AF2122/97
acugcccgcguuugcgaagccc

SEQ ID NO: 3116285 - RNA, 22 nt, Mycobacterium bovis subsp bovis AF2122/97
acugcccucaacgaucgcgccg

SEQ ID NO: 3116286 - RNA, 23 nt, Mycobacterium bovis subsp bovis AF2122/97
acugcccucgcuaauugcggccg

SEQ ID NO: 3116287 - RNA, 16 nt, Mycobacterium bovis subsp bovis AF2122/97
acugccgaccagcgcg

SEQ ID NO: 3116288 - RNA, 12 nt, Mycobacterium bovis subsp bovis AF2122/97
acugccgagcac

SEQ ID NO: 3116289 - RNA, 16 nt, Mycobacterium bovis subsp bovis AF2122/97
acugccgagcagacgc

SEQ ID NO: 3116290 - RNA, 15 nt, Mycobacterium bovis subsp bovis AF2122/97
acuggggugcugcgc

SEQ ID NO: 3116291 - RNA, 21 nt, Mycobacterium bovis subsp bovis AF2122/97
acugggucgccuccugccgcc

SEQ ID NO: 3116292 - RNA, 13 nt, Mycobacterium bovis subsp bovis AF2122/97
acugguauuuccc

SEQ ID NO: 3116293 - RNA, 19 nt, Mycobacterium bovis subsp bovis AF2122/97
acuggucacugcccugauu

SEQ ID NO: 3116294 - RNA, 12 nt, Mycobacterium bovis subsp bovis AF2122/97
acuggucgacgc

SEQ ID NO: 3116295 - RNA, 15 nt, Mycobacterium bovis subsp bovis AF2122/97
acuggucgacgccga

SEQ ID NO: 3116296 - RNA, 18 nt, Mycobacterium bovis subsp bovis AF2122/97
acuggucgacgccgagac

SEQ ID NO: 3116297 - RNA, 21 nt, Mycobacterium bovis subsp bovis AF2122/97
acuggucgccaacgccagcac

SEQ ID NO: 3116298 - RNA, 19 nt, Mycobacterium bovis subsp bovis AF2122/97
acuggucgcggcgcuggcu

SEQ ID NO: 3116299 - RNA, 17 nt, Mycobacterium bovis subsp bovis AF2122/97
acuggugcagcgccgac

SEQ ID NO: 3116300 - RNA, 15 nt, Mycobacterium bovis subsp bovis AF2122/97
acuggugccugccgc

SEQ ID NO: 3116301 - RNA, 20 nt, Mycobacterium bovis subsp bovis AF2122/97
acugguggcgauccguagga

SEQ ID NO: 3116302 - RNA, 13 nt, Mycobacterium bovis subsp bovis AF2122/97
acugguggcgcca

SEQ ID NO: 3116303 - RNA, 13 nt, Mycobacterium bovis subsp bovis AF2122/97
acuggugggccau

SEQ ID NO: 3116304 - RNA, 15 nt, Mycobacterium bovis subsp bovis AF2122/97
acugguugggcgaga

SEQ ID NO: 3116305 - RNA, 21 nt, Mycobacterium bovis subsp bovis AF2122/97
acugguugggcgagaccgcga

SEQ ID NO: 3116306 - RNA, 13 nt, Mycobacterium bovis subsp bovis AF2122/97
acugguuggugac

SEQ ID NO: 3116307 - RNA, 20 nt, Mycobacterium bovis subsp bovis AF2122/97
acuguccccguugagauacc

SEQ ID NO: 3116308 - RNA, 18 nt, Mycobacterium bovis subsp bovis AF2122/97
acuguccgcccggaaaaa

SEQ ID NO: 3116309 - RNA, 18 nt, Mycobacterium bovis subsp bovis AF2122/97
acuguccugccagaagac

SEQ ID NO: 3116310 - RNA, 23 nt, Mycobacterium bovis subsp bovis AF2122/97
acugucggguaaccccaccugga

SEQ ID NO: 3116311 - RNA, 17 nt, Mycobacterium bovis subsp bovis AF2122/97
acugucuugggggccaa

SEQ ID NO: 3116312 - RNA, 17 nt, Mycobacterium bovis subsp bovis AF2122/97
acugugaaucugacgac

SEQ ID NO: 3116313 - RNA, 19 nt, Mycobacterium bovis subsp bovis AF2122/97
acugugccgcccccggcac

SEQ ID NO: 3116314 - RNA, 14 nt, Mycobacterium bovis subsp bovis AF2122/97
acugugccgcugca

SEQ ID NO: 3116315 - RNA, 19 nt, Mycobacterium bovis subsp bovis AF2122/97
acugugcgagcugcggguc

SEQ ID NO: 3116316 - RNA, 16 nt, Mycobacterium bovis subsp bovis AF2122/97
acuguggcgccgccgg

SEQ ID NO: 3116317 - RNA, 17 nt, Mycobacterium bovis subsp bovis AF2122/97
acuguggcgccgccggc

SEQ ID NO: 3116318 - RNA, 23 nt, Mycobacterium bovis subsp bovis AF2122/97
acugugggggcgcaccgagcgag

SEQ ID NO: 3116319 - RNA, 15 nt, Mycobacterium bovis subsp bovis AF2122/97
acuguuacggccaca

SEQ ID NO: 3116320 - RNA, 20 nt, Mycobacterium bovis subsp bovis AF2122/97
acuguuaggcgauugcgccg

SEQ ID NO: 3116321 - RNA, 14 nt, Mycobacterium bovis subsp bovis AF2122/97
acuguucugcuggc

SEQ ID NO: 3116322 - RNA, 19 nt, Mycobacterium bovis subsp bovis AF2122/97
acuuagcgggugccagccc

SEQ ID NO: 3116323 - RNA, 13 nt, Mycobacterium bovis subsp bovis AF2122/97
acuucaccggcuc

SEQ ID NO: 3116324 - RNA, 16 nt, Mycobacterium bovis subsp bovis AF2122/97
acuucagcauggugga

SEQ ID NO: 3116325 - RNA, 14 nt, Mycobacterium bovis subsp bovis AF2122/97
acuucauagcgccg

SEQ ID NO: 3116326 - RNA, 17 nt, Mycobacterium bovis subsp bovis AF2122/97
acuucauauaccgcucg

SEQ ID NO: 3116327 - RNA, 15 nt, Mycobacterium bovis subsp bovis AF2122/97
acuucaugaugacaa

SEQ ID NO: 3116328 - RNA, 16 nt, Mycobacterium bovis subsp bovis AF2122/97
acuuccaagccgaccu

SEQ ID NO: 3116329 - RNA, 16 nt, Mycobacterium bovis subsp bovis AF2122/97
acuuccagcccggcaa

SEQ ID NO: 3116330 - RNA, 17 nt, Mycobacterium bovis subsp bovis AF2122/97
acuuccagcccggcaau

SEQ ID NO: 3116331 - RNA, 14 nt, Mycobacterium bovis subsp bovis AF2122/97
acuucccacccggc

SEQ ID NO: 3116332 - RNA, 19 nt, Mycobacterium bovis subsp bovis AF2122/97
acuuccccgguuccgcgau

SEQ ID NO: 3116333 - RNA, 19 nt, Mycobacterium bovis subsp bovis AF2122/97
acuuccgcagcgccacccg

SEQ ID NO: 3116334 - RNA, 21 nt, Mycobacterium bovis subsp bovis AF2122/97
acuuccgggcagcugggcagg

SEQ ID NO: 3116335 - RNA, 18 nt, Mycobacterium bovis subsp bovis AF2122/97
acuucgaaucaggcucca

SEQ ID NO: 3116336 - RNA, 19 nt, Mycobacterium bovis subsp bovis AF2122/97
acuucgacagcggcgauug

SEQ ID NO: 3116337 - RNA, 23 nt, Mycobacterium bovis subsp bovis AF2122/97
acuucgcguuucacgaaacccag

SEQ ID NO: 3116338 - RNA, 15 nt, Mycobacterium bovis subsp bovis AF2122/97
acuucggccacaacc

SEQ ID NO: 3116339 - RNA, 22 nt, Mycobacterium bovis subsp bovis AF2122/97
acuucggcgccgcgccgucccg

SEQ ID NO: 3116340 - RNA, 22 nt, Mycobacterium bovis subsp bovis AF2122/97
acuucggugagcagggcggcga

SEQ ID NO: 3116341 - RNA, 15 nt, Mycobacterium bovis subsp bovis AF2122/97
acuucuaugacgacc

SEQ ID NO: 3116342 - RNA, 14 nt, Mycobacterium bovis subsp bovis AF2122/97
acuucuccaggcug

SEQ ID NO: 3116343 - RNA, 18 nt, Mycobacterium bovis subsp bovis AF2122/97
acuucugguaggcggcca

SEQ ID NO: 3116344 - RNA, 17 nt, Mycobacterium bovis subsp bovis AF2122/97
acuugaucucggcgagc

SEQ ID NO: 3116345 - RNA, 16 nt, Mycobacterium bovis subsp bovis AF2122/97
acuugaugcucgaugc

SEQ ID NO: 3116346 - RNA, 16 nt, Mycobacterium bovis subsp bovis AF2122/97
acuugauuucgaucgc

SEQ ID NO: 3116347 - RNA, 22 nt, Mycobacterium bovis subsp bovis AF2122/97
acuugauuucgaucgcggcaau

SEQ ID NO: 3116348 - RNA, 13 nt, Mycobacterium bovis subsp bovis AF2122/97
acuugcacgcugu

SEQ ID NO: 3116349 - RNA, 14 nt, Mycobacterium bovis subsp bovis AF2122/97
acuugcacgucggc

SEQ ID NO: 3116350 - RNA, 19 nt, Mycobacterium bovis subsp bovis AF2122/97
acuugcaggcgucccagcc

SEQ ID NO: 3116351 - RNA, 16 nt, Mycobacterium bovis subsp bovis AF2122/97
acuugcccgucggcgc

SEQ ID NO: 3116352 - RNA, 17 nt, Mycobacterium bovis subsp bovis AF2122/97
acuugcccgucggcgcc

SEQ ID NO: 3116353 - RNA, 17 nt, Mycobacterium bovis subsp bovis AF2122/97
acuugccgaguggccgc

SEQ ID NO: 3116354 - RNA, 14 nt, Mycobacterium bovis subsp bovis AF2122/97
acuugccgccgcac

SEQ ID NO: 3116355 - RNA, 21 nt, Mycobacterium bovis subsp bovis AF2122/97
acuugccgggcaaucgcucug

SEQ ID NO: 3116356 - RNA, 17 nt, Mycobacterium bovis subsp bovis AF2122/97
acuugccuagcgcgggc

SEQ ID NO: 3116357 - RNA, 12 nt, Mycobacterium bovis subsp bovis AF2122/97
acuugcgagccg

SEQ ID NO: 3116358 - RNA, 14 nt, Mycobacterium bovis subsp bovis AF2122/97
acuugcucacccgu

SEQ ID NO: 3116359 - RNA, 21 nt, Mycobacterium bovis subsp bovis AF2122/97
acuugcugcuccuucucgcgg

SEQ ID NO: 3116360 - RNA, 18 nt, Mycobacterium bovis subsp bovis AF2122/97
acuuggacgacccgggcc

SEQ ID NO: 3116361 - RNA, 17 nt, Mycobacterium bovis subsp bovis AF2122/97
acuuggauggccgaacc

SEQ ID NO: 3116362 - RNA, 23 nt, Mycobacterium bovis subsp bovis AF2122/97
acuuggcccccgacggugaacca

SEQ ID NO: 3116363 - RNA, 19 nt, Mycobacterium bovis subsp bovis AF2122/97
acuuggcggccagccgcuc

SEQ ID NO: 3116364 - RNA, 21 nt, Mycobacterium bovis subsp bovis AF2122/97
acuuggcugcgagagcaccga

SEQ ID NO: 3116365 - RNA, 17 nt, Mycobacterium bovis subsp bovis AF2122/97
acuugggauugcgggcc

SEQ ID NO: 3116366 - RNA, 18 nt, Mycobacterium bovis subsp bovis AF2122/97
acuugucggggugcacac

SEQ ID NO: 3116367 - RNA, 23 nt, Mycobacterium bovis subsp bovis AF2122/97
acuugugccgggcgaugcugggc

SEQ ID NO: 3116368 - RNA, 17 nt, Mycobacterium bovis subsp bovis AF2122/97
acuuguugaccuccucc

SEQ ID NO: 3116369 - RNA, 20 nt, Mycobacterium bovis subsp bovis AF2122/97
acuuguuugucaccgcagcc

SEQ ID NO: 3116370 - RNA, 23 nt, Mycobacterium bovis subsp bovis AF2122/97
acuuucacgcucguuugcgagca

SEQ ID NO: 3116371 - RNA, 13 nt, Mycobacterium bovis subsp bovis AF2122/97
acuuuccggccga

SEQ ID NO: 3116372 - RNA, 20 nt, Mycobacterium bovis subsp bovis AF2122/97
acuuugagucguuggacggc

SEQ ID NO: 3116373 - RNA, 15 nt, Mycobacterium bovis subsp bovis AF2122/97
acuuugguugcccgc

SEQ ID NO: 3116374 - RNA, 13 nt, Mycobacterium bovis subsp bovis AF2122/97
acuuugucgcgga

SEQ ID NO: 3116375 - RNA, 16 nt, Mycobacterium bovis subsp bovis AF2122/97
acuuuuccgccggcca

SEQ ID NO: 3116376 - RNA, 18 nt, Mycobacterium bovis subsp bovis AF2122/97
acuuuuccgccggccagg

SEQ ID NO: 3116377 - RNA, 18 nt, Mycobacterium bovis subsp bovis AF2122/97
agaccaccggcagcgcga

SEQ ID NO: 3116378 - RNA, 16 nt, Mycobacterium bovis subsp bovis AF2122/97
agaccacgccggugac

SEQ ID NO: 3116379 - RNA, 17 nt, Mycobacterium bovis subsp bovis AF2122/97
agaccagacugcagugc

SEQ ID NO: 3116380 - RNA, 14 nt, Mycobacterium bovis subsp bovis AF2122/97
agaccagcaggccc

SEQ ID NO: 3116381 - RNA, 16 nt, Mycobacterium bovis subsp bovis AF2122/97
agaccagcaggcccug

SEQ ID NO: 3116382 - RNA, 17 nt, Mycobacterium bovis subsp bovis AF2122/97
agaccagggcagcggcc

SEQ ID NO: 3116383 - RNA, 19 nt, Mycobacterium bovis subsp bovis AF2122/97
agaccaugccgacgacggg

SEQ ID NO: 3116384 - RNA, 16 nt, Mycobacterium bovis subsp bovis AF2122/97
agaccauggucauguu

SEQ ID NO: 3116385 - RNA, 17 nt, Mycobacterium bovis subsp bovis AF2122/97
agaccauggucauguuc

SEQ ID NO: 3116386 - RNA, 20 nt, Mycobacterium bovis subsp bovis AF2122/97
agacccagcgcggcaacucc

SEQ ID NO: 3116387 - RNA, 22 nt, Mycobacterium bovis subsp bovis AF2122/97
agaccccaaucgaccgcccgcc

SEQ ID NO: 3116388 - RNA, 12 nt, Mycobacterium bovis subsp bovis AF2122/97
agacccgguggc

SEQ ID NO: 3116389 - RNA, 13 nt, Mycobacterium bovis subsp bovis AF2122/97
agacccgguggcg

SEQ ID NO: 3116390 - RNA, 14 nt, Mycobacterium bovis subsp bovis AF2122/97
agacccgucaccgc

SEQ ID NO: 3116391 - RNA, 20 nt, Mycobacterium bovis subsp bovis AF2122/97
agacccgucaccgccgacga

SEQ ID NO: 3116392 - RNA, 19 nt, Mycobacterium bovis subsp bovis AF2122/97
agacccgugagcggagcaa

SEQ ID NO: 3116393 - RNA, 14 nt, Mycobacterium bovis subsp bovis AF2122/97
agacccguucgccg

SEQ ID NO: 3116394 - RNA, 23 nt, Mycobacterium bovis subsp bovis AF2122/97
agacccuggccgucccaccagcc

SEQ ID NO: 3116395 - RNA, 21 nt, Mycobacterium bovis subsp bovis AF2122/97
agacccugggguccagcgucc

SEQ ID NO: 3116396 - RNA, 15 nt, Mycobacterium bovis subsp bovis AF2122/97
agaccgaacagcacc

SEQ ID NO: 3116397 - RNA, 20 nt, Mycobacterium bovis subsp bovis AF2122/97
agaccgaacagcaccgaacc

SEQ ID NO: 3116398 - RNA, 13 nt, Mycobacterium bovis subsp bovis AF2122/97
agaccgaacagcg

SEQ ID NO: 3116399 - RNA, 15 nt, Mycobacterium bovis subsp bovis AF2122/97
agaccgaacagcggc

SEQ ID NO: 3116400 - RNA, 14 nt, Mycobacterium bovis subsp bovis AF2122/97
agaccgagcccgau

SEQ ID NO: 3116401 - RNA, 14 nt, Mycobacterium bovis subsp bovis AF2122/97
agaccgaucggcag

SEQ ID NO: 3116402 - RNA, 13 nt, Mycobacterium bovis subsp bovis AF2122/97
agaccgcagucgc

SEQ ID NO: 3116403 - RNA, 13 nt, Mycobacterium bovis subsp bovis AF2122/97
agaccgccaccgg

SEQ ID NO: 3116404 - RNA, 15 nt, Mycobacterium bovis subsp bovis AF2122/97
agaccgccgacgccg

SEQ ID NO: 3116405 - RNA, 15 nt, Mycobacterium bovis subsp bovis AF2122/97
agaccgccgcugccg

SEQ ID NO: 3116406 - RNA, 22 nt, Mycobacterium bovis subsp bovis AF2122/97
agaccgccgcugccgccgagcu

SEQ ID NO: 3116407 - RNA, 16 nt, Mycobacterium bovis subsp bovis AF2122/97
agaccgccuccaccgc

SEQ ID NO: 3116408 - RNA, 18 nt, Mycobacterium bovis subsp bovis AF2122/97
agaccgccuccaccgccg

SEQ ID NO: 3116409 - RNA, 15 nt, Mycobacterium bovis subsp bovis AF2122/97
agaccgcgaacagcg

SEQ ID NO: 3116410 - RNA, 23 nt, Mycobacterium bovis subsp bovis AF2122/97
agaccgcgaacagcgggggcagc

SEQ ID NO: 3116411 - RNA, 17 nt, Mycobacterium bovis subsp bovis AF2122/97
agaccgcgagcagcaca

SEQ ID NO: 3116412 - RNA, 21 nt, Mycobacterium bovis subsp bovis AF2122/97
agaccgcgagcagcacagcau

SEQ ID NO: 3116413 - RNA, 14 nt, Mycobacterium bovis subsp bovis AF2122/97
agaccgcggccggc

SEQ ID NO: 3116414 - RNA, 13 nt, Mycobacterium bovis subsp bovis AF2122/97
agaccgcggcggc

SEQ ID NO: 3116415 - RNA, 14 nt, Mycobacterium bovis subsp bovis AF2122/97
agaccgcggcggcc

SEQ ID NO: 3116416 - RNA, 19 nt, Mycobacterium bovis subsp bovis AF2122/97
agaccggcgggcagauggu

SEQ ID NO: 3116417 - RNA, 17 nt, Mycobacterium bovis subsp bovis AF2122/97
agaccggcucgucgggc

SEQ ID NO: 3116418 - RNA, 16 nt, Mycobacterium bovis subsp bovis AF2122/97
agaccgggcaccagaa

SEQ ID NO: 3116419 - RNA, 21 nt, Mycobacterium bovis subsp bovis AF2122/97
agaccgguuucuucggccagc

SEQ ID NO: 3116420 - RNA, 22 nt, Mycobacterium bovis subsp bovis AF2122/97
agaccguuacaccaucaaggac

SEQ ID NO: 3116421 - RNA, 23 nt, Mycobacterium bovis subsp bovis AF2122/97
agaccucgaccuggaugggcucg

SEQ ID NO: 3116422 - RNA, 18 nt, Mycobacterium bovis subsp bovis AF2122/97
agaccuggccugcggcag

SEQ ID NO: 3116423 - RNA, 19 nt, Mycobacterium bovis subsp bovis AF2122/97
agaccuggccugcggcagg

SEQ ID NO: 3116424 - RNA, 20 nt, Mycobacterium bovis subsp bovis AF2122/97
agaccuggcggugccggcgg

SEQ ID NO: 3116425 - RNA, 12 nt, Mycobacterium bovis subsp bovis AF2122/97
agaccugguuga

SEQ ID NO: 3116426 - RNA, 15 nt, Mycobacterium bovis subsp bovis AF2122/97
agaccugucgguacc

SEQ ID NO: 3116427 - RNA, 22 nt, Mycobacterium bovis subsp bovis AF2122/97
agaccugucgguaccgcccagu

SEQ ID NO: 3116428 - RNA, 16 nt, Mycobacterium bovis subsp bovis AF2122/97
agaccuucucgccgcc

SEQ ID NO: 3116429 - RNA, 18 nt, Mycobacterium bovis subsp bovis AF2122/97
agaccuucucgccgccgc

SEQ ID NO: 3116430 - RNA, 15 nt, Mycobacterium bovis subsp bovis AF2122/97
agacgaaccgccgac

SEQ ID NO: 3116431 - RNA, 17 nt, Mycobacterium bovis subsp bovis AF2122/97
agacgaaccgccgacgg

SEQ ID NO: 3116432 - RNA, 16 nt, Mycobacterium bovis subsp bovis AF2122/97
agacgacaucgucauc

SEQ ID NO: 3116433 - RNA, 21 nt, Mycobacterium bovis subsp bovis AF2122/97
agacgacaucgucaucagcgc

SEQ ID NO: 3116434 - RNA, 17 nt, Mycobacterium bovis subsp bovis AF2122/97
agacgaccccggugagc

SEQ ID NO: 3116435 - RNA, 16 nt, Mycobacterium bovis subsp bovis AF2122/97
agacgacccgguugug

SEQ ID NO: 3116436 - RNA, 16 nt, Mycobacterium bovis subsp bovis AF2122/97
agacgaccgugcuggg

SEQ ID NO: 3116437 - RNA, 20 nt, Mycobacterium bovis subsp bovis AF2122/97
agacgaccgugcugggcgcc

SEQ ID NO: 3116438 - RNA, 18 nt, Mycobacterium bovis subsp bovis AF2122/97
agacgacgaugaugccgu

SEQ ID NO: 3116439 - RNA, 16 nt, Mycobacterium bovis subsp bovis AF2122/97
agacgaugacagacau

SEQ ID NO: 3116440 - RNA, 14 nt, Mycobacterium bovis subsp bovis AF2122/97
agacgauucggcgg

SEQ ID NO: 3116441 - RNA, 20 nt, Mycobacterium bovis subsp bovis AF2122/97
agacgcaaaagcuccuaaau

SEQ ID NO: 3116442 - RNA, 24 nt, Mycobacterium bovis subsp bovis AF2122/97
agacgcaaaauccccucgcaaccg

SEQ ID NO: 3116443 - RNA, 19 nt, Mycobacterium bovis subsp bovis AF2122/97
agacgcaaaaucgcccaau

SEQ ID NO: 3116444 - RNA, 19 nt, Mycobacterium bovis subsp bovis AF2122/97
agacgcaaaaucgcccauu

SEQ ID NO: 3116445 - RNA, 20 nt, Mycobacterium bovis subsp bovis AF2122/97
agacgcaaaaucgcccgaaa

SEQ ID NO: 3116446 - RNA, 20 nt, Mycobacterium bovis subsp bovis AF2122/97
agacgcagaaucgcacgcga

SEQ ID NO: 3116447 - RNA, 19 nt, Mycobacterium bovis subsp bovis AF2122/97
agacgcagaaucgcccaau

SEQ ID NO: 3116448 - RNA, 20 nt, Mycobacterium bovis subsp bovis AF2122/97
agacgcauaagcccccgaca

SEQ ID NO: 3116449 - RNA, 20 nt, Mycobacterium bovis subsp bovis AF2122/97
agacgcaugucgggccaggc

SEQ ID NO: 3116450 - RNA, 16 nt, Mycobacterium bovis subsp bovis AF2122/97
agacgccacugccagc

SEQ ID NO: 3116451 - RNA, 21 nt, Mycobacterium bovis subsp bovis AF2122/97
agacgccacugccagccgugc

SEQ ID NO: 3116452 - RNA, 16 nt, Mycobacterium bovis subsp bovis AF2122/97
agacgccgacuccgcg

SEQ ID NO: 3116453 - RNA, 21 nt, Mycobacterium bovis subsp bovis AF2122/97
agacgccgccgcugccgcccu

SEQ ID NO: 3116454 - RNA, 12 nt, Mycobacterium bovis subsp bovis AF2122/97
agacgccgccgu

SEQ ID NO: 3116455 - RNA, 14 nt, Mycobacterium bovis subsp bovis AF2122/97
agacgccggggaac

SEQ ID NO: 3116456 - RNA, 18 nt, Mycobacterium bovis subsp bovis AF2122/97
agacgccgucgacgucga

SEQ ID NO: 3116457 - RNA, 19 nt, Mycobacterium bovis subsp bovis AF2122/97
agacgccgucgacgucgau

SEQ ID NO: 3116458 - RNA, 19 nt, Mycobacterium bovis subsp bovis AF2122/97
agacgccgucggcgccggc

SEQ ID NO: 3116459 - RNA, 14 nt, Mycobacterium bovis subsp bovis AF2122/97
agacgcgaaagcac

SEQ ID NO: 3116460 - RNA, 20 nt, Mycobacterium bovis subsp bovis AF2122/97
agacgcgaaaucccccgaca

SEQ ID NO: 3116461 - RNA, 18 nt, Mycobacterium bovis subsp bovis AF2122/97
agacgcggaaucgcaccg

SEQ ID NO: 3116462 - RNA, 22 nt, Mycobacterium bovis subsp bovis AF2122/97
agacgcggaaucgcaucggcgg

SEQ ID NO: 3116463 - RNA, 21 nt, Mycobacterium bovis subsp bovis AF2122/97
agaucaccucccgcggcaccu

SEQ ID NO: 3116464 - RNA, 15 nt, Mycobacterium bovis subsp bovis AF2122/97
agaucacgccgacga

SEQ ID NO: 3116465 - RNA, 14 nt, Mycobacterium bovis subsp bovis AF2122/97
agaucacgcgucgu

SEQ ID NO: 3116466 - RNA, 15 nt, Mycobacterium bovis subsp bovis AF2122/97
agaucacgugccggc

SEQ ID NO: 3116467 - RNA, 19 nt, Mycobacterium bovis subsp bovis AF2122/97
agaucagcaacggcagcga

SEQ ID NO: 3116468 - RNA, 16 nt, Mycobacterium bovis subsp bovis AF2122/97
agaucagcacccaaga

SEQ ID NO: 3116469 - RNA, 15 nt, Mycobacterium bovis subsp bovis AF2122/97
agaucagccgccgcc

SEQ ID NO: 3116470 - RNA, 17 nt, Mycobacterium bovis subsp bovis AF2122/97
agaucagccggcagcga

SEQ ID NO: 3116471 - RNA, 17 nt, Mycobacterium bovis subsp bovis AF2122/97
agaucagccucgcgggc

SEQ ID NO: 3116472 - RNA, 18 nt, Mycobacterium bovis subsp bovis AF2122/97
agaucagccucgcgggca

SEQ ID NO: 3116473 - RNA, 21 nt, Mycobacterium bovis subsp bovis AF2122/97
agaucagccucgcgggcaggg

SEQ ID NO: 3116474 - RNA, 16 nt, Mycobacterium bovis subsp bovis AF2122/97
agaucagcggauccag

SEQ ID NO: 3116475 - RNA, 21 nt, Mycobacterium bovis subsp bovis AF2122/97
agaucagcgucccggucgcca

SEQ ID NO: 3116476 - RNA, 15 nt, Mycobacterium bovis subsp bovis AF2122/97
agaucaugccggcga

SEQ ID NO: 3116477 - RNA, 17 nt, Mycobacterium bovis subsp bovis AF2122/97
agauccagggagcggcu

SEQ ID NO: 3116478 - RNA, 18 nt, Mycobacterium bovis subsp bovis AF2122/97
agauccauuggaugccau

SEQ ID NO: 3116479 - RNA, 14 nt, Mycobacterium bovis subsp bovis AF2122/97
agauccccgccacc

SEQ ID NO: 3116480 - RNA, 19 nt, Mycobacterium bovis subsp bovis AF2122/97
agauccccgccaccgaacg

SEQ ID NO: 3116481 - RNA, 16 nt, Mycobacterium bovis subsp bovis AF2122/97
agauccgacgaccgca

SEQ ID NO: 3116482 - RNA, 19 nt, Mycobacterium bovis subsp bovis AF2122/97
agauccgcagcgucuugau

SEQ ID NO: 3116483 - RNA, 12 nt, Mycobacterium bovis subsp bovis AF2122/97
agauccgccacg

SEQ ID NO: 3116484 - RNA, 13 nt, Mycobacterium bovis subsp bovis AF2122/97
agauccgccgggu

SEQ ID NO: 3116485 - RNA, 23 nt, Mycobacterium bovis subsp bovis AF2122/97
agauccguccgcugguggucagc

SEQ ID NO: 3116486 - RNA, 20 nt, Mycobacterium bovis subsp bovis AF2122/97
agauccucgucgagguccuc

SEQ ID NO: 3116487 - RNA, 19 nt, Mycobacterium bovis subsp bovis AF2122/97
agauccugguaaggccggc

SEQ ID NO: 3116488 - RNA, 22 nt, Mycobacterium bovis subsp bovis AF2122/97
agaucgaacgcagccagcgcca

SEQ ID NO: 3116489 - RNA, 16 nt, Mycobacterium bovis subsp bovis AF2122/97
agaucgagggggacgc

SEQ ID NO: 3116490 - RNA, 20 nt, Mycobacterium bovis subsp bovis AF2122/97
agaucgcccgaguugaagaa

SEQ ID NO: 3116491 - RNA, 12 nt, Mycobacterium bovis subsp bovis AF2122/97
agaucgccgagc

SEQ ID NO: 3116492 - RNA, 14 nt, Mycobacterium bovis subsp bovis AF2122/97
agaucgccgagcgu

SEQ ID NO: 3116493 - RNA, 19 nt, Mycobacterium bovis subsp bovis AF2122/97
agaucgccucgacgcggca

SEQ ID NO: 3116494 - RNA, 21 nt, Mycobacterium bovis subsp bovis AF2122/97
agaucgccucgacgcggcagg

SEQ ID NO: 3116495 - RNA, 15 nt, Mycobacterium bovis subsp bovis AF2122/97
agaucgcggcgaccc

SEQ ID NO: 3116496 - RNA, 18 nt, Mycobacterium bovis subsp bovis AF2122/97
agaucgcgguccgagcgg

SEQ ID NO: 3116497 - RNA, 22 nt, Mycobacterium bovis subsp bovis AF2122/97
agaucgcgguccgagcggcauc

SEQ ID NO: 3116498 - RNA, 20 nt, Mycobacterium bovis subsp bovis AF2122/97
agaucggcagcguggacauc

SEQ ID NO: 3116499 - RNA, 20 nt, Mycobacterium bovis subsp bovis AF2122/97
agaucggcgaaucgggcaaa

SEQ ID NO: 3116500 - RNA, 18 nt, Mycobacterium bovis subsp bovis AF2122/97
agaucggcucaccgaacg

SEQ ID NO: 3116501 - RNA, 16 nt, Mycobacterium bovis subsp bovis AF2122/97
agaucgggccggccgc

SEQ ID NO: 3116502 - RNA, 15 nt, Mycobacterium bovis subsp bovis AF2122/97
agaucguagugcgcg

SEQ ID NO: 3116503 - RNA, 17 nt, Mycobacterium bovis subsp bovis AF2122/97
agaucgucacucccgac

SEQ ID NO: 3116504 - RNA, 14 nt, Mycobacterium bovis subsp bovis AF2122/97
agaucgucgccaug

SEQ ID NO: 3116505 - RNA, 14 nt, Mycobacterium bovis subsp bovis AF2122/97
agaucguuccaggc

SEQ ID NO: 3116506 - RNA, 22 nt, Mycobacterium bovis subsp bovis AF2122/97
agaucguugaugacguugcagc

SEQ ID NO: 3116507 - RNA, 21 nt, Mycobacterium bovis subsp bovis AF2122/97
agaucguugccucgucgccgc

SEQ ID NO: 3116508 - RNA, 23 nt, Mycobacterium bovis subsp bovis AF2122/97
agaucuccccgaccgcgcccgcg

SEQ ID NO: 3116509 - RNA, 19 nt, Mycobacterium bovis subsp bovis AF2122/97
agaucucgcgggcccgcgc

SEQ ID NO: 3116510 - RNA, 14 nt, Mycobacterium bovis subsp bovis AF2122/97
agaucucggccagg

SEQ ID NO: 3116511 - RNA, 14 nt, Mycobacterium bovis subsp bovis AF2122/97
agaucuggguuccc

SEQ ID NO: 3116512 - RNA, 15 nt, Mycobacterium bovis subsp bovis AF2122/97
agaucuucgccgaga

SEQ ID NO: 3116513 - RNA, 13 nt, Mycobacterium bovis subsp bovis AF2122/97
agaucuugcagug

SEQ ID NO: 3116514 - RNA, 22 nt, Mycobacterium bovis subsp bovis AF2122/97
agaucuugcgcaaugccgacgc

SEQ ID NO: 3116515 - RNA, 18 nt, Mycobacterium bovis subsp bovis AF2122/97
agaucuuuucaccaccuc

SEQ ID NO: 3116516 - RNA, 13 nt, Mycobacterium bovis subsp bovis AF2122/97
agaugaaggugac

SEQ ID NO: 3116517 - RNA, 14 nt, Mycobacterium bovis subsp bovis AF2122/97
agaugaaggugacg

SEQ ID NO: 3116518 - RNA, 20 nt, Mycobacterium bovis subsp bovis AF2122/97
agaugaugccguucggaccc

SEQ ID NO: 3116519 - RNA, 15 nt, Mycobacterium bovis subsp bovis AF2122/97
agaugauuucgccga

SEQ ID NO: 3116520 - RNA, 20 nt, Mycobacterium bovis subsp bovis AF2122/97
agaugcaccugcgaggugcc

SEQ ID NO: 3116521 - RNA, 21 nt, Mycobacterium bovis subsp bovis AF2122/97
agaugcacgucgagcaggcug

SEQ ID NO: 3116522 - RNA, 21 nt, Mycobacterium bovis subsp bovis AF2122/97
agaugcagcgggucgccgggc

SEQ ID NO: 3116523 - RNA, 16 nt, Mycobacterium bovis subsp bovis AF2122/97
agaugcauccagcugc

SEQ ID NO: 3116524 - RNA, 16 nt, Mycobacterium bovis subsp bovis AF2122/97
agaugcccagcaggaa

SEQ ID NO: 3116525 - RNA, 16 nt, Mycobacterium bovis subsp bovis AF2122/97
agaugcccgcgaucau

SEQ ID NO: 3116526 - RNA, 12 nt, Mycobacterium bovis subsp bovis AF2122/97
agaugccggcga

SEQ ID NO: 3116527 - RNA, 12 nt, Mycobacterium bovis subsp bovis AF2122/97
agaugccgggcu

SEQ ID NO: 3116528 - RNA, 19 nt, Mycobacterium bovis subsp bovis AF2122/97
agaugccugcuagcagcag

SEQ ID NO: 3116529 - RNA, 20 nt, Mycobacterium bovis subsp bovis AF2122/97
agaugcgcccggcgugguga

SEQ ID NO: 3116530 - RNA, 18 nt, Mycobacterium bovis subsp bovis AF2122/97
agaugcggaacgccgagc

SEQ ID NO: 3116531 - RNA, 15 nt, Mycobacterium bovis subsp bovis AF2122/97
agaugcggcccgggc

SEQ ID NO: 3116532 - RNA, 18 nt, Mycobacterium bovis subsp bovis AF2122/97
agaugcgugcggcagugc

SEQ ID NO: 3116533 - RNA, 12 nt, Mycobacterium bovis subsp bovis AF2122/97
agauggaauggc

SEQ ID NO: 3116534 - RNA, 14 nt, Mycobacterium bovis subsp bovis AF2122/97
agauggcccgucgu

SEQ ID NO: 3116535 - RNA, 21 nt, Mycobacterium bovis subsp bovis AF2122/97
agauggcgaucaugagcagca

SEQ ID NO: 3116536 - RNA, 22 nt, Mycobacterium bovis subsp bovis AF2122/97
agauggcgaucaugagcagcac

SEQ ID NO: 3116537 - RNA, 22 nt, Mycobacterium bovis subsp bovis AF2122/97
agauggcucucggugguccagc

SEQ ID NO: 3116538 - RNA, 20 nt, Mycobacterium bovis subsp bovis AF2122/97
agauggguacccgaucacuc

SEQ ID NO: 3116539 - RNA, 15 nt, Mycobacterium bovis subsp bovis AF2122/97
agauggucgggcggc

SEQ ID NO: 3116540 - RNA, 20 nt, Mycobacterium bovis subsp bovis AF2122/97
agauggucggucgcuucagc

SEQ ID NO: 3116541 - RNA, 21 nt, Mycobacterium bovis subsp bovis AF2122/97
agauguaccucaucgcagacg

SEQ ID NO: 3116542 - RNA, 22 nt, Mycobacterium bovis subsp bovis AF2122/97
agauguccucccauucccaaca

SEQ ID NO: 3116543 - RNA, 13 nt, Mycobacterium bovis subsp bovis AF2122/97
agaugucgaucag

SEQ ID NO: 3116544 - RNA, 15 nt, Mycobacterium bovis subsp bovis AF2122/97
agauguucacgccgc

SEQ ID NO: 3116545 - RNA, 18 nt, Mycobacterium bovis subsp bovis AF2122/97
agauguucacgccgccgg

SEQ ID NO: 3116546 - RNA, 19 nt, Mycobacterium bovis subsp bovis AF2122/97
agauuccucuucaggcccu

SEQ ID NO: 3116547 - RNA, 20 nt, Mycobacterium bovis subsp bovis AF2122/97
agauucgcucaccaccgacc

SEQ ID NO: 3116548 - RNA, 18 nt, Mycobacterium bovis subsp bovis AF2122/97
agauugccgggccgccga

SEQ ID NO: 3116549 - RNA, 16 nt, Mycobacterium bovis subsp bovis AF2122/97
agcacgcccgcgcuga

SEQ ID NO: 3116550 - RNA, 13 nt, Mycobacterium bovis subsp bovis AF2122/97
agcacgccgccgg

SEQ ID NO: 3116551 - RNA, 13 nt, Mycobacterium bovis subsp bovis AF2122/97
agcacgccgucca

SEQ ID NO: 3116552 - RNA, 14 nt, Mycobacterium bovis subsp bovis AF2122/97
agcacgcgcggcgu

SEQ ID NO: 3116553 - RNA, 16 nt, Mycobacterium bovis subsp bovis AF2122/97
agcacgcgggcacugg

SEQ ID NO: 3116554 - RNA, 20 nt, Mycobacterium bovis subsp bovis AF2122/97
agcacgcgugguucggucgg

SEQ ID NO: 3116555 - RNA, 15 nt, Mycobacterium bovis subsp bovis AF2122/97
agcacgcugaccaca

SEQ ID NO: 3116556 - RNA, 13 nt, Mycobacterium bovis subsp bovis AF2122/97
agcacggcaacca

SEQ ID NO: 3116557 - RNA, 14 nt, Mycobacterium bovis subsp bovis AF2122/97
agcacggcgaucgg

SEQ ID NO: 3116558 - RNA, 20 nt, Mycobacterium bovis subsp bovis AF2122/97
agcacggcgcggcggagugc

SEQ ID NO: 3116559 - RNA, 22 nt, Mycobacterium bovis subsp bovis AF2122/97
agcacggcgcggcggagugcau

SEQ ID NO: 3116560 - RNA, 23 nt, Mycobacterium bovis subsp bovis AF2122/97
agcacgggcucgcugcaccagcu

SEQ ID NO: 3116561 - RNA, 24 nt, Mycobacterium bovis subsp bovis AF2122/97
agcacgggcucgcugcaccagcug

SEQ ID NO: 3116562 - RNA, 15 nt, Mycobacterium bovis subsp bovis AF2122/97
agcacggggaccggg

SEQ ID NO: 3116563 - RNA, 18 nt, Mycobacterium bovis subsp bovis AF2122/97
agcacggggaccgggcug

SEQ ID NO: 3116564 - RNA, 15 nt, Mycobacterium bovis subsp bovis AF2122/97
agcacgggugagcac

SEQ ID NO: 3116565 - RNA, 22 nt, Mycobacterium bovis subsp bovis AF2122/97
agcacggugaacaaaugccggu

SEQ ID NO: 3116566 - RNA, 19 nt, Mycobacterium bovis subsp bovis AF2122/97
agcacggugaucagcagca

SEQ ID NO: 3116567 - RNA, 17 nt, Mycobacterium bovis subsp bovis AF2122/97
agcacgguggccgagcc

SEQ ID NO: 3116568 - RNA, 21 nt, Mycobacterium bovis subsp bovis AF2122/97
agcacggugggcgcugggucg

SEQ ID NO: 3116569 - RNA, 23 nt, Mycobacterium bovis subsp bovis AF2122/97
agcacgguguugcgcacccgcgg

SEQ ID NO: 3116570 - RNA, 14 nt, Mycobacterium bovis subsp bovis AF2122/97
agcacguacauggu

SEQ ID NO: 3116571 - RNA, 16 nt, Mycobacterium bovis subsp bovis AF2122/97
agcacguaucgaagcu

SEQ ID NO: 3116572 - RNA, 22 nt, Mycobacterium bovis subsp bovis AF2122/97
agcacgucacgcgcggcggcgu

SEQ ID NO: 3116573 - RNA, 22 nt, Mycobacterium bovis subsp bovis AF2122/97
agcacguccugaaucgguucgg

SEQ ID NO: 3116574 - RNA, 18 nt, Mycobacterium bovis subsp bovis AF2122/97
agcacgucgucgcgggaa

SEQ ID NO: 3116575 - RNA, 15 nt, Mycobacterium bovis subsp bovis AF2122/97
agcacguucaccgcg

SEQ ID NO: 3116576 - RNA, 17 nt, Mycobacterium bovis subsp bovis AF2122/97
agcacguucaccgcgcg

SEQ ID NO: 3116577 - RNA, 19 nt, Mycobacterium bovis subsp bovis AF2122/97
agcacguucaccgcgcgcu

SEQ ID NO: 3116578 - RNA, 15 nt, Mycobacterium bovis subsp bovis AF2122/97
agcacguugacgucc

SEQ ID NO: 3116579 - RNA, 15 nt, Mycobacterium bovis subsp bovis AF2122/97
agcacuaaucggcca

SEQ ID NO: 3116580 - RNA, 18 nt, Mycobacterium bovis subsp bovis AF2122/97
agcacuccgucguaguug

SEQ ID NO: 3116581 - RNA, 15 nt, Mycobacterium bovis subsp bovis AF2122/97
agcacucgcccaagc

SEQ ID NO: 3116582 - RNA, 24 nt, Mycobacterium bovis subsp bovis AF2122/97
agcacucgcccaagcgcagccugg

SEQ ID NO: 3116583 - RNA, 21 nt, Mycobacterium bovis subsp bovis AF2122/97
agcacucgggauucggcagcg

SEQ ID NO: 3116584 - RNA, 17 nt, Mycobacterium bovis subsp bovis AF2122/97
agcacucggugucggcc

SEQ ID NO: 3116585 - RNA, 19 nt, Mycobacterium bovis subsp bovis AF2122/97
agcacucggugucggccgc

SEQ ID NO: 3116586 - RNA, 16 nt, Mycobacterium bovis subsp bovis AF2122/97
agcacugggcuggcca

SEQ ID NO: 3116587 - RNA, 15 nt, Mycobacterium bovis subsp bovis AF2122/97
agcagaaacaucgac

SEQ ID NO: 3116588 - RNA, 14 nt, Mycobacterium bovis subsp bovis AF2122/97
agcagaaggccagc

SEQ ID NO: 3116589 - RNA, 19 nt, Mycobacterium bovis subsp bovis AF2122/97
agcagacacagaaucgcac

SEQ ID NO: 3116590 - RNA, 20 nt, Mycobacterium bovis subsp bovis AF2122/97
agcagacacagaaucgcacg

SEQ ID NO: 3116591 - RNA, 18 nt, Mycobacterium bovis subsp bovis AF2122/97
agcagacacagaaucgcc

SEQ ID NO: 3116592 - RNA, 20 nt, Mycobacterium bovis subsp bovis AF2122/97
agcagacacagaaucgccca

SEQ ID NO: 3116593 - RNA, 19 nt, Mycobacterium bovis subsp bovis AF2122/97
agcagacacuaaagcccuc

SEQ ID NO: 3116594 - RNA, 20 nt, Mycobacterium bovis subsp bovis AF2122/97
agcagacacuaaagcccucg

SEQ ID NO: 3116595 - RNA, 17 nt, Mycobacterium bovis subsp bovis AF2122/97
agcagaccaaguccggu

SEQ ID NO: 3116596 - RNA, 17 nt, Mycobacterium bovis subsp bovis AF2122/97
agcagaccacaacgccu

SEQ ID NO: 3116597 - RNA, 15 nt, Mycobacterium bovis subsp bovis AF2122/97
agcagacccgugccg

SEQ ID NO: 3116598 - RNA, 19 nt, Mycobacterium bovis subsp bovis AF2122/97
agcagacgacgaucagccc

SEQ ID NO: 3116599 - RNA, 17 nt, Mycobacterium bovis subsp bovis AF2122/97
agcagacgcaaaauccc

SEQ ID NO: 3116600 - RNA, 18 nt, Mycobacterium bovis subsp bovis AF2122/97
agcagacgcaaaaucgca

SEQ ID NO: 3116601 - RNA, 19 nt, Mycobacterium bovis subsp bovis AF2122/97
agcagacgcaaaaucgccc

SEQ ID NO: 3116602 - RNA, 19 nt, Mycobacterium bovis subsp bovis AF2122/97
agcagacgcagaaucgcac

SEQ ID NO: 3116603 - RNA, 20 nt, Mycobacterium bovis subsp bovis AF2122/97
agcagacgcagaaucgcaug

SEQ ID NO: 3116604 - RNA, 20 nt, Mycobacterium bovis subsp bovis AF2122/97
agcagacgcagaaucgccca

SEQ ID NO: 3116605 - RNA, 18 nt, Mycobacterium bovis subsp bovis AF2122/97
agcagacgcagagucgca

SEQ ID NO: 3116606 - RNA, 20 nt, Mycobacterium bovis subsp bovis AF2122/97
agcagacgcagagucgcacu

SEQ ID NO: 3116607 - RNA, 13 nt, Mycobacterium bovis subsp bovis AF2122/97
agcagacgccgua

SEQ ID NO: 3116608 - RNA, 18 nt, Mycobacterium bovis subsp bovis AF2122/97
agcagacgccguagccgg

SEQ ID NO: 3116609 - RNA, 18 nt, Mycobacterium bovis subsp bovis AF2122/97
agcagacgcggaaucgca

SEQ ID NO: 3116610 - RNA, 21 nt, Mycobacterium bovis subsp bovis AF2122/97
agcagacgcggaaucgcaucg

SEQ ID NO: 3116611 - RNA, 20 nt, Mycobacterium bovis subsp bovis AF2122/97
agcagacguaaaagcccccg

SEQ ID NO: 3116612 - RNA, 14 nt, Mycobacterium bovis subsp bovis AF2122/97
agcagacugcccuc

SEQ ID NO: 3116613 - RNA, 15 nt, Mycobacterium bovis subsp bovis AF2122/97
agcagacugcccucg

SEQ ID NO: 3116614 - RNA, 18 nt, Mycobacterium bovis subsp bovis AF2122/97
agcagagacaugccggcg

SEQ ID NO: 3116615 - RNA, 13 nt, Mycobacterium bovis subsp bovis AF2122/97
agcagagccccgg

SEQ ID NO: 3116616 - RNA, 13 nt, Mycobacterium bovis subsp bovis AF2122/97
agcagagcggcac

SEQ ID NO: 3116617 - RNA, 23 nt, Mycobacterium bovis subsp bovis AF2122/97
agcagauacuuguugaagccgau

SEQ ID NO: 3116618 - RNA, 15 nt, Mycobacterium bovis subsp bovis AF2122/97
agcagauccaggcgu

SEQ ID NO: 3116619 - RNA, 14 nt, Mycobacterium bovis subsp bovis AF2122/97
agcagauccgcgau

SEQ ID NO: 3116620 - RNA, 22 nt, Mycobacterium bovis subsp bovis AF2122/97
agcagauggguacccgaucacu

SEQ ID NO: 3116621 - RNA, 16 nt, Mycobacterium bovis subsp bovis AF2122/97
agcagauugucgacgg

SEQ ID NO: 3116622 - RNA, 21 nt, Mycobacterium bovis subsp bovis AF2122/97
agcagcaaaacccgagccugg

SEQ ID NO: 3116623 - RNA, 19 nt, Mycobacterium bovis subsp bovis AF2122/97
agcagcaaacaucgcaggc

SEQ ID NO: 3116624 - RNA, 14 nt, Mycobacterium bovis subsp bovis AF2122/97
agcagcaacgcggu

SEQ ID NO: 3116625 - RNA, 23 nt, Mycobacterium bovis subsp bovis AF2122/97
agcagcaauccaaggcucagcag

SEQ ID NO: 3116626 - RNA, 23 nt, Mycobacterium bovis subsp bovis AF2122/97
agcagcaccaacugaauggcacc

SEQ ID NO: 3116627 - RNA, 12 nt, Mycobacterium bovis subsp bovis AF2122/97
agcagcaccacc

SEQ ID NO: 3116628 - RNA, 16 nt, Mycobacterium bovis subsp bovis AF2122/97
agcagcaccacccgca

SEQ ID NO: 3116629 - RNA, 14 nt, Mycobacterium bovis subsp bovis AF2122/97
agcagcacccauac

SEQ ID NO: 3116630 - RNA, 12 nt, Mycobacterium bovis subsp bovis AF2122/97
agcagcacccgg

SEQ ID NO: 3116631 - RNA, 14 nt, Mycobacterium bovis subsp bovis AF2122/97
agcagcaccgacgu

SEQ ID NO: 3116632 - RNA, 24 nt, Mycobacterium bovis subsp bovis AF2122/97
agcagcaccgcgaccaucgcgacg

SEQ ID NO: 3116633 - RNA, 16 nt, Mycobacterium bovis subsp bovis AF2122/97
agcagcacgucgaacu

SEQ ID NO: 3116634 - RNA, 18 nt, Mycobacterium bovis subsp bovis AF2122/97
agcagcagaaacggcgac

SEQ ID NO: 3116635 - RNA, 19 nt, Mycobacterium bovis subsp bovis AF2122/97
agcaggucgccugcccccg

SEQ ID NO: 3116636 - RNA, 17 nt, Mycobacterium bovis subsp bovis AF2122/97
agcaggugauguucagc

SEQ ID NO: 3116637 - RNA, 14 nt, Mycobacterium bovis subsp bovis AF2122/97
agcagguggggguc

SEQ ID NO: 3116638 - RNA, 17 nt, Mycobacterium bovis subsp bovis AF2122/97
agcagguugccgaaguu

SEQ ID NO: 3116639 - RNA, 15 nt, Mycobacterium bovis subsp bovis AF2122/97
agcagguuggucacc

SEQ ID NO: 3116640 - RNA, 15 nt, Mycobacterium bovis subsp bovis AF2122/97
agcaguacaccgccc

SEQ ID NO: 3116641 - RNA, 22 nt, Mycobacterium bovis subsp bovis AF2122/97
agcaguacuaacaacaccacca

SEQ ID NO: 3116642 - RNA, 16 nt, Mycobacterium bovis subsp bovis AF2122/97
agcaguagaucggauc

SEQ ID NO: 3116643 - RNA, 20 nt, Mycobacterium bovis subsp bovis AF2122/97
agcagucgcaaaagccccca

SEQ ID NO: 3116644 - RNA, 11 nt, Mycobacterium bovis subsp bovis AF2122/97
agcagugcagc

SEQ ID NO: 3116645 - RNA, 13 nt, Mycobacterium bovis subsp bovis AF2122/97
agcagugccucgg

SEQ ID NO: 3116646 - RNA, 23 nt, Mycobacterium bovis subsp bovis AF2122/97
agcaguucggcgaugcgcgggug

SEQ ID NO: 3116647 - RNA, 13 nt, Mycobacterium bovis subsp bovis AF2122/97
agcaguuggccga

SEQ ID NO: 3116648 - RNA, 22 nt, Mycobacterium bovis subsp bovis AF2122/97
agcaguuuccguaguaccaaag

SEQ ID NO: 3116649 - RNA, 23 nt, Mycobacterium bovis subsp bovis AF2122/97
agcauaccgccgcugccaugcgg

SEQ ID NO: 3116650 - RNA, 17 nt, Mycobacterium bovis subsp bovis AF2122/97
agcauauccgccggcga

SEQ ID NO: 3116651 - RNA, 19 nt, Mycobacterium bovis subsp bovis AF2122/97
agcauauccgccggcgaca

SEQ ID NO: 3116652 - RNA, 14 nt, Mycobacterium bovis subsp bovis AF2122/97
agcaucaaagcggu

SEQ ID NO: 3116653 - RNA, 14 nt, Mycobacterium bovis subsp bovis AF2122/97
agcaucaacaccgg

SEQ ID NO: 3116654 - RNA, 17 nt, Mycobacterium bovis subsp bovis AF2122/97
agcaucaaccguccccg

SEQ ID NO: 3116655 - RNA, 18 nt, Mycobacterium bovis subsp bovis AF2122/97
agcaucaccguaaagccg

SEQ ID NO: 3116656 - RNA, 16 nt, Mycobacterium bovis subsp bovis AF2122/97
agcaucagcccggcgc

SEQ ID NO: 3116657 - RNA, 13 nt, Mycobacterium bovis subsp bovis AF2122/97
agcaucagcgcca

SEQ ID NO: 3116658 - RNA, 18 nt, Mycobacterium bovis subsp bovis AF2122/97
agcaucagcucgaugccg

SEQ ID NO: 3116659 - RNA, 20 nt, Mycobacterium bovis subsp bovis AF2122/97
agcaucagcucgaugccgug

SEQ ID NO: 3116660 - RNA, 20 nt, Mycobacterium bovis subsp bovis AF2122/97
agcaucaguuugacgccgau

SEQ ID NO: 3116661 - RNA, 20 nt, Mycobacterium bovis subsp bovis AF2122/97
agcauccacccauagacccg

SEQ ID NO: 3116662 - RNA, 19 nt, Mycobacterium bovis subsp bovis AF2122/97
agcauccccgcagcgucca

SEQ ID NO: 3116663 - RNA, 21 nt, Mycobacterium bovis subsp bovis AF2122/97
agcauccgcccgagccgggga

SEQ ID NO: 3116664 - RNA, 20 nt, Mycobacterium bovis subsp bovis AF2122/97
agcauccucgacuugcuugg

SEQ ID NO: 3116665 - RNA, 21 nt, Mycobacterium bovis subsp bovis AF2122/97
agcaucggcaccccggccacu

SEQ ID NO: 3116666 - RNA, 16 nt, Mycobacterium bovis subsp bovis AF2122/97
agcaucggcagcagcg

SEQ ID NO: 3116667 - RNA, 13 nt, Mycobacterium bovis subsp bovis AF2122/97
agcaucgucgcca

SEQ ID NO: 3116668 - RNA, 16 nt, Mycobacterium bovis subsp bovis AF2122/97
agcaucuccgccgguc

SEQ ID NO: 3116669 - RNA, 19 nt, Mycobacterium bovis subsp bovis AF2122/97
agcaucuccgucggccagg

SEQ ID NO: 3116670 - RNA, 21 nt, Mycobacterium bovis subsp bovis AF2122/97
agcaucuccgucggccaggcc

SEQ ID NO: 3116671 - RNA, 20 nt, Mycobacterium bovis subsp bovis AF2122/97
agcaucuccucgccugcccg

SEQ ID NO: 3116672 - RNA, 15 nt, Mycobacterium bovis subsp bovis AF2122/97
agcaucucggcggcc

SEQ ID NO: 3116673 - RNA, 16 nt, Mycobacterium bovis subsp bovis AF2122/97
agcaucucggcggcca

SEQ ID NO: 3116674 - RNA, 22 nt, Mycobacterium bovis subsp bovis AF2122/97
agcaucucggcggccaacagca

SEQ ID NO: 3116675 - RNA, 15 nt, Mycobacterium bovis subsp bovis AF2122/97
agcaucuuuggcggc

SEQ ID NO: 3116676 - RNA, 14 nt, Mycobacterium bovis subsp bovis AF2122/97
agcaugaagucccg

SEQ ID NO: 3116677 - RNA, 14 nt, Mycobacterium bovis subsp bovis AF2122/97
agcaugacaccggc

SEQ ID NO: 3116678 - RNA, 20 nt, Mycobacterium bovis subsp bovis AF2122/97
agcaugacaccggccaccag

SEQ ID NO: 3116679 - RNA, 22 nt, Mycobacterium bovis subsp bovis AF2122/97
agcaugauccgcucguggucgg

SEQ ID NO: 3116680 - RNA, 17 nt, Mycobacterium bovis subsp bovis AF2122/97
agcaugcccagcgcacg

SEQ ID NO: 3116681 - RNA, 14 nt, Mycobacterium bovis subsp bovis AF2122/97
agcaugccgcggcg

SEQ ID NO: 3116682 - RNA, 23 nt, Mycobacterium bovis subsp bovis AF2122/97
agcaugcgauacacggcggcgau

SEQ ID NO: 3116683 - RNA, 18 nt, Mycobacterium bovis subsp bovis AF2122/97
agcauggcccuggcgacc

SEQ ID NO: 3116684 - RNA, 15 nt, Mycobacterium bovis subsp bovis AF2122/97
agcauggcuccgaag

SEQ ID NO: 3116685 - RNA, 16 nt, Mycobacterium bovis subsp bovis AF2122/97
agcauggugcggcggc

SEQ ID NO: 3116686 - RNA, 17 nt, Mycobacterium bovis subsp bovis AF2122/97
agcauggugcggcggcg

SEQ ID NO: 3116687 - RNA, 22 nt, Mycobacterium bovis subsp bovis AF2122/97
agcaugucgcggacccgcgcgu

SEQ ID NO: 3116688 - RNA, 20 nt, Mycobacterium bovis subsp bovis AF2122/97
agcaugucucgggcgcgggu

SEQ ID NO: 3116689 - RNA, 22 nt, Mycobacterium bovis subsp bovis AF2122/97
agcauguuccccgucgccaggg

SEQ ID NO: 3116690 - RNA, 13 nt, Mycobacterium bovis subsp bovis AF2122/97
agcauucaccaaa

SEQ ID NO: 3116691 - RNA, 15 nt, Mycobacterium bovis subsp bovis AF2122/97
agcauugaagaagcc

SEQ ID NO: 3116692 - RNA, 16 nt, Mycobacterium bovis subsp bovis AF2122/97
agcauugaagaagccc

SEQ ID NO: 3116693 - RNA, 16 nt, Mycobacterium bovis subsp bovis AF2122/97
agcauugaccaaucca

SEQ ID NO: 3116694 - RNA, 20 nt, Mycobacterium bovis subsp bovis AF2122/97
agcauugaccaauccacuga

SEQ ID NO: 3116695 - RNA, 15 nt, Mycobacterium bovis subsp bovis AF2122/97
agcauugaguucggc

SEQ ID NO: 3116696 - RNA, 19 nt, Mycobacterium bovis subsp bovis AF2122/97
agccaaaugcgcugucgcc

SEQ ID NO: 3116697 - RNA, 23 nt, Mycobacterium bovis subsp bovis AF2122/97
agccaaccagcccggccgccgag

SEQ ID NO: 3116698 - RNA, 21 nt, Mycobacterium bovis subsp bovis AF2122/97
agccaacccgucuuaucggcg

SEQ ID NO: 3116699 - RNA, 18 nt, Mycobacterium bovis subsp bovis AF2122/97
agccaaccguccggggcc

SEQ ID NO: 3116700 - RNA, 13 nt, Mycobacterium bovis subsp bovis AF2122/97
agccaacgagcgc

SEQ ID NO: 3116701 - RNA, 15 nt, Mycobacterium bovis subsp bovis AF2122/97
agccaacgcaucaug

SEQ ID NO: 3116702 - RNA, 19 nt, Mycobacterium bovis subsp bovis AF2122/97
agccaacgucaccaaguuc

SEQ ID NO: 3116703 - RNA, 19 nt, Mycobacterium bovis subsp bovis AF2122/97
agccaacucgaccgacugc

SEQ ID NO: 3116704 - RNA, 20 nt, Mycobacterium bovis subsp bovis AF2122/97
agccaaugcccuuggccagc

SEQ ID NO: 3116705 - RNA, 23 nt, Mycobacterium bovis subsp bovis AF2122/97
agccaaugcccuuggccagcagg

SEQ ID NO: 3116706 - RNA, 17 nt, Mycobacterium bovis subsp bovis AF2122/97
agccacaaaggcgccgg

SEQ ID NO: 3116707 - RNA, 14 nt, Mycobacterium bovis subsp bovis AF2122/97
agccacaaucgcag

SEQ ID NO: 3116708 - RNA, 20 nt, Mycobacterium bovis subsp bovis AF2122/97
agccacauacaggcccgcca

SEQ ID NO: 3116709 - RNA, 14 nt, Mycobacterium bovis subsp bovis AF2122/97
agccaccaccgccg

SEQ ID NO: 3116710 - RNA, 15 nt, Mycobacterium bovis subsp bovis AF2122/97
agccaccagccgggc

SEQ ID NO: 3116711 - RNA, 18 nt, Mycobacterium bovis subsp bovis AF2122/97
agccaccccugcgguccg

SEQ ID NO: 3116712 - RNA, 13 nt, Mycobacterium bovis subsp bovis AF2122/97
agccaccgaucga

SEQ ID NO: 3116713 - RNA, 19 nt, Mycobacterium bovis subsp bovis AF2122/97
agccaccgcgaaaauucgu

SEQ ID NO: 3116714 - RNA, 21 nt, Mycobacterium bovis subsp bovis AF2122/97
agccaccgggcgugcggcggc

SEQ ID NO: 3116715 - RNA, 20 nt, Mycobacterium bovis subsp bovis AF2122/97
agccaccggguggaacaugu

SEQ ID NO: 3116716 - RNA, 20 nt, Mycobacterium bovis subsp bovis AF2122/97
agccaccgucaugccgacga

SEQ ID NO: 3116717 - RNA, 22 nt, Mycobacterium bovis subsp bovis AF2122/97
agccaccucgacggugacgacc

SEQ ID NO: 3116718 - RNA, 16 nt, Mycobacterium bovis subsp bovis AF2122/97
agccaccugacaaacg

SEQ ID NO: 3116719 - RNA, 21 nt, Mycobacterium bovis subsp bovis AF2122/97
agccacgcacaauacggucag

SEQ ID NO: 3116720 - RNA, 19 nt, Mycobacterium bovis subsp bovis AF2122/97
agccacgcagcacggcacc

SEQ ID NO: 3116721 - RNA, 14 nt, Mycobacterium bovis subsp bovis AF2122/97
agccccaaaucgua

SEQ ID NO: 3116722 - RNA, 13 nt, Mycobacterium bovis subsp bovis AF2122/97
agccccacccgcc

SEQ ID NO: 3116723 - RNA, 16 nt, Mycobacterium bovis subsp bovis AF2122/97
agccccagcgacgucg

SEQ ID NO: 3116724 - RNA, 17 nt, Mycobacterium bovis subsp bovis AF2122/97
agccccagcguucccgc

SEQ ID NO: 3116725 - RNA, 14 nt, Mycobacterium bovis subsp bovis AF2122/97
agccccaucaccac

SEQ ID NO: 3116726 - RNA, 18 nt, Mycobacterium bovis subsp bovis AF2122/97
agcccccgacacgccgug

SEQ ID NO: 3116727 - RNA, 14 nt, Mycobacterium bovis subsp bovis AF2122/97
agcccccgacguug

SEQ ID NO: 3116728 - RNA, 13 nt, Mycobacterium bovis subsp bovis AF2122/97
agcccccgcacgc

SEQ ID NO: 3116729 - RNA, 19 nt, Mycobacterium bovis subsp bovis AF2122/97
agcccccgcgggggcggcc

SEQ ID NO: 3116730 - RNA, 15 nt, Mycobacterium bovis subsp bovis AF2122/97
agcccccggauccgu

SEQ ID NO: 3116731 - RNA, 18 nt, Mycobacterium bovis subsp bovis AF2122/97
agccccgaagccggugcc

SEQ ID NO: 3116732 - RNA, 13 nt, Mycobacterium bovis subsp bovis AF2122/97
agccccgaccagc

SEQ ID NO: 3116733 - RNA, 15 nt, Mycobacterium bovis subsp bovis AF2122/97
agccccgaccagcag

SEQ ID NO: 3116734 - RNA, 14 nt, Mycobacterium bovis subsp bovis AF2122/97
agccccgcgcccac

SEQ ID NO: 3116735 - RNA, 19 nt, Mycobacterium bovis subsp bovis AF2122/97
agccccgcgcccaccccgg

SEQ ID NO: 3116736 - RNA, 17 nt, Mycobacterium bovis subsp bovis AF2122/97
agccccgcggccagcag

SEQ ID NO: 3116737 - RNA, 12 nt, Mycobacterium bovis subsp bovis AF2122/97
agccccucaccu

SEQ ID NO: 3116738 - RNA, 17 nt, Mycobacterium bovis subsp bovis AF2122/97
agccccucaccucggcu

SEQ ID NO: 3116739 - RNA, 17 nt, Mycobacterium bovis subsp bovis AF2122/97
agccccuccgcgccgau

SEQ ID NO: 3116740 - RNA, 21 nt, Mycobacterium bovis subsp bovis AF2122/97
agccccuggaggggcaacagg

SEQ ID NO: 3116741 - RNA, 22 nt, Mycobacterium bovis subsp bovis AF2122/97
agccccuuuugccgcagcaucc

SEQ ID NO: 3116742 - RNA, 17 nt, Mycobacterium bovis subsp bovis AF2122/97
agcccgaaccaccgcgu

SEQ ID NO: 3116743 - RNA, 21 nt, Mycobacterium bovis subsp bovis AF2122/97
agcccgaacgaggcgcccagc

SEQ ID NO: 3116744 - RNA, 17 nt, Mycobacterium bovis subsp bovis AF2122/97
agcccgaagacggggug

SEQ ID NO: 3116745 - RNA, 18 nt, Mycobacterium bovis subsp bovis AF2122/97
agcccgacaccguccagc

SEQ ID NO: 3116746 - RNA, 22 nt, Mycobacterium bovis subsp bovis AF2122/97
agcccgacaccguccagcagcu

SEQ ID NO: 3116747 - RNA, 16 nt, Mycobacterium bovis subsp bovis AF2122/97
agcccgacagcagguu

SEQ ID NO: 3116748 - RNA, 19 nt, Mycobacterium bovis subsp bovis AF2122/97
agcccgacaguggucccgg

SEQ ID NO: 3116749 - RNA, 17 nt, Mycobacterium bovis subsp bovis AF2122/97
agcccgaccgguccagc

SEQ ID NO: 3116750 - RNA, 17 nt, Mycobacterium bovis subsp bovis AF2122/97
agcccgacgcccgacug

SEQ ID NO: 3116751 - RNA, 21 nt, Mycobacterium bovis subsp bovis AF2122/97
agcccgacuggucacugcccu

SEQ ID NO: 3116752 - RNA, 15 nt, Mycobacterium bovis subsp bovis AF2122/97
agcccgagcgcuuga

SEQ ID NO: 3116753 - RNA, 20 nt, Mycobacterium bovis subsp bovis AF2122/97
agcccgagcgcuugaccccg

SEQ ID NO: 3116754 - RNA, 19 nt, Mycobacterium bovis subsp bovis AF2122/97
agcccgagcucaccgcaca

SEQ ID NO: 3116755 - RNA, 15 nt, Mycobacterium bovis subsp bovis AF2122/97
agcccgagcucgccg

SEQ ID NO: 3116756 - RNA, 17 nt, Mycobacterium bovis subsp bovis AF2122/97
agcccgagcucgccgca

SEQ ID NO: 3116757 - RNA, 18 nt, Mycobacterium bovis subsp bovis AF2122/97
agcccgagcucgccgcag

SEQ ID NO: 3116758 - RNA, 19 nt, Mycobacterium bovis subsp bovis AF2122/97
agcccgagcucgccgcagc

SEQ ID NO: 3116759 - RNA, 13 nt, Mycobacterium bovis subsp bovis AF2122/97
agcccgaguugaa

SEQ ID NO: 3116760 - RNA, 21 nt, Mycobacterium bovis subsp bovis AF2122/97
agcccgaguugaaggugccgg

SEQ ID NO: 3116761 - RNA, 21 nt, Mycobacterium bovis subsp bovis AF2122/97
agcccgaguuguucgugccgg

SEQ ID NO: 3116762 - RNA, 14 nt, Mycobacterium bovis subsp bovis AF2122/97
agcccgaugauccc

SEQ ID NO: 3116763 - RNA, 17 nt, Mycobacterium bovis subsp bovis AF2122/97
agcccgaugaucccgcc

SEQ ID NO: 3116764 - RNA, 20 nt, Mycobacterium bovis subsp bovis AF2122/97
agcccgaugaucccgccacc

SEQ ID NO: 3116765 - RNA, 22 nt, Mycobacterium bovis subsp bovis AF2122/97
agcccgaugaucccgccaccga

SEQ ID NO: 3116766 - RNA, 16 nt, Mycobacterium bovis subsp bovis AF2122/97
agcccgaugccgugcc

SEQ ID NO: 3116767 - RNA, 20 nt, Mycobacterium bovis subsp bovis AF2122/97
agcccgaugccgugcccggu

SEQ ID NO: 3116768 - RNA, 21 nt, Mycobacterium bovis subsp bovis AF2122/97
agcccgaugccgugcccggug

SEQ ID NO: 3116769 - RNA, 18 nt, Mycobacterium bovis subsp bovis AF2122/97
agcccgauggugccgacc

SEQ ID NO: 3116770 - RNA, 16 nt, Mycobacterium bovis subsp bovis AF2122/97
agcccgauucagcgcc

SEQ ID NO: 3116771 - RNA, 17 nt, Mycobacterium bovis subsp bovis AF2122/97
agcccgauucagcgccc

SEQ ID NO: 3116772 - RNA, 18 nt, Mycobacterium bovis subsp bovis AF2122/97
agcccgauucagcgcccc

SEQ ID NO: 3116773 - RNA, 12 nt, Mycobacterium bovis subsp bovis AF2122/97
agcccgcaucgc

SEQ ID NO: 3116774 - RNA, 15 nt, Mycobacterium bovis subsp bovis AF2122/97
agcccgcaucgcacc

SEQ ID NO: 3116775 - RNA, 19 nt, Mycobacterium bovis subsp bovis AF2122/97
agcccgccacccuuggccc

SEQ ID NO: 3116776 - RNA, 20 nt, Mycobacterium bovis subsp bovis AF2122/97
agcccgcccgguguguucgg

SEQ ID NO: 3116777 - RNA, 21 nt, Mycobacterium bovis subsp bovis AF2122/97
agcccgcccgguguguucggc

SEQ ID NO: 3116778 - RNA, 21 nt, Mycobacterium bovis subsp bovis AF2122/97
agcccgccgcgaccacgcacc

SEQ ID NO: 3116779 - RNA, 19 nt, Mycobacterium bovis subsp bovis AF2122/97
agcccgccggacccgcccu

SEQ ID NO: 3116780 - RNA, 22 nt, Mycobacterium bovis subsp bovis AF2122/97
agcccgccggauccgccagacc

SEQ ID NO: 3116781 - RNA, 12 nt, Mycobacterium bovis subsp bovis AF2122/97
agcccgccgggc

SEQ ID NO: 3116782 - RNA, 13 nt, Mycobacterium bovis subsp bovis AF2122/97
agcccgcgaucuc

SEQ ID NO: 3116783 - RNA, 18 nt, Mycobacterium bovis subsp bovis AF2122/97
agcccgcgcagcgguccg

SEQ ID NO: 3116784 - RNA, 23 nt, Mycobacterium bovis subsp bovis AF2122/97
agcccgcguucaggaugccagga

SEQ ID NO: 3116785 - RNA, 23 nt, Mycobacterium bovis subsp bovis AF2122/97
agcccgcuggccguauaggcccg

SEQ ID NO: 3116786 - RNA, 16 nt, Mycobacterium bovis subsp bovis AF2122/97
agcccgcuggccuccu

SEQ ID NO: 3116787 - RNA, 15 nt, Mycobacterium bovis subsp bovis AF2122/97
agcccggaacccgag

SEQ ID NO: 3116788 - RNA, 14 nt, Mycobacterium bovis subsp bovis AF2122/97
agcccggaaucgcg

SEQ ID NO: 3116789 - RNA, 20 nt, Mycobacterium bovis subsp bovis AF2122/97
agcccggaccgcccgugccg

SEQ ID NO: 3116790 - RNA, 16 nt, Mycobacterium bovis subsp bovis AF2122/97
agcccggacgcgcgga

SEQ ID NO: 3116791 - RNA, 21 nt, Mycobacterium bovis subsp bovis AF2122/97
agcccggacguaggcaccccg

SEQ ID NO: 3116792 - RNA, 15 nt, Mycobacterium bovis subsp bovis AF2122/97
agcccggagcgguca

SEQ ID NO: 3116793 - RNA, 15 nt, Mycobacterium bovis subsp bovis AF2122/97
agcccggcagaugug

SEQ ID NO: 3116794 - RNA, 16 nt, Mycobacterium bovis subsp bovis AF2122/97
agcccggccagccgca

SEQ ID NO: 3116795 - RNA, 17 nt, Mycobacterium bovis subsp bovis AF2122/97
agcccggccgccgagga

SEQ ID NO: 3116796 - RNA, 12 nt, Mycobacterium bovis subsp bovis AF2122/97
agcccggccgcg

SEQ ID NO: 3116797 - RNA, 14 nt, Mycobacterium bovis subsp bovis AF2122/97
agcccggccgcgcc

SEQ ID NO: 3116798 - RNA, 15 nt, Mycobacterium bovis subsp bovis AF2122/97
agcccggccgcgccc

SEQ ID NO: 3116799 - RNA, 20 nt, Mycobacterium bovis subsp bovis AF2122/97
agcccggccucggcgagcac

SEQ ID NO: 3116800 - RNA, 21 nt, Mycobacterium bovis subsp bovis AF2122/97
agcccggccucggcgagcacg

SEQ ID NO: 3116801 - RNA, 14 nt, Mycobacterium bovis subsp bovis AF2122/97
agcccggccuugcc

SEQ ID NO: 3116802 - RNA, 18 nt, Mycobacterium bovis subsp bovis AF2122/97
agcccggccuugccgccg

SEQ ID NO: 3116803 - RNA, 19 nt, Mycobacterium bovis subsp bovis AF2122/97
agcccggccuugccgccgg

SEQ ID NO: 3116804 - RNA, 21 nt, Mycobacterium bovis subsp bovis AF2122/97
agcccggccuugccgccggcc

SEQ ID NO: 3116805 - RNA, 19 nt, Mycobacterium bovis subsp bovis AF2122/97
agcccggcgacgacccggg

SEQ ID NO: 3116806 - RNA, 16 nt, Mycobacterium bovis subsp bovis AF2122/97
agcccggcgcgccgag

SEQ ID NO: 3116807 - RNA, 17 nt, Mycobacterium bovis subsp bovis AF2122/97
agcccggcgcgccgagu

SEQ ID NO: 3116808 - RNA, 16 nt, Mycobacterium bovis subsp bovis AF2122/97
agccgacgccggugcc

SEQ ID NO: 3116809 - RNA, 17 nt, Mycobacterium bovis subsp bovis AF2122/97
agccgacgccggugccg

SEQ ID NO: 3116810 - RNA, 18 nt, Mycobacterium bovis subsp bovis AF2122/97
agccgacgccggugccgg

SEQ ID NO: 3116811 - RNA, 16 nt, Mycobacterium bovis subsp bovis AF2122/97
agccgacgccuuccag

SEQ ID NO: 3116812 - RNA, 15 nt, Mycobacterium bovis subsp bovis AF2122/97
agccgacgucgccga

SEQ ID NO: 3116813 - RNA, 17 nt, Mycobacterium bovis subsp bovis AF2122/97
agccgacgugcggcggc

SEQ ID NO: 3116814 - RNA, 18 nt, Mycobacterium bovis subsp bovis AF2122/97
agccgacgugcggcggcc

SEQ ID NO: 3116815 - RNA, 19 nt, Mycobacterium bovis subsp bovis AF2122/97
agccgacguugaagccgcc

SEQ ID NO: 3116816 - RNA, 19 nt, Mycobacterium bovis subsp bovis AF2122/97
agccgacuaucggccgccg

SEQ ID NO: 3116817 - RNA, 20 nt, Mycobacterium bovis subsp bovis AF2122/97
agccgacuaucggccgccgg

SEQ ID NO: 3116818 - RNA, 10 nt, Mycobacterium bovis subsp bovis AF2122/97
agccgagcac

SEQ ID NO: 3116819 - RNA, 16 nt, Mycobacterium bovis subsp bovis AF2122/97
agccgagccagcagcu

SEQ ID NO: 3116820 - RNA, 14 nt, Mycobacterium bovis subsp bovis AF2122/97
agccgagccagcuc

SEQ ID NO: 3116821 - RNA, 19 nt, Mycobacterium bovis subsp bovis AF2122/97
agccgagcccgucgaucag

SEQ ID NO: 3116822 - RNA, 12 nt, Mycobacterium bovis subsp bovis AF2122/97
agccgagcggcg

SEQ ID NO: 3116823 - RNA, 14 nt, Mycobacterium bovis subsp bovis AF2122/97
agccgagcggcggc

SEQ ID NO: 3116824 - RNA, 15 nt, Mycobacterium bovis subsp bovis AF2122/97
agccgagcggcggca

SEQ ID NO: 3116825 - RNA, 17 nt, Mycobacterium bovis subsp bovis AF2122/97
agccgagcggcggcacu

SEQ ID NO: 3116826 - RNA, 15 nt, Mycobacterium bovis subsp bovis AF2122/97
agccgagcguggcgu

SEQ ID NO: 3116827 - RNA, 21 nt, Mycobacterium bovis subsp bovis AF2122/97
agccgagguucaaagcagcgc

SEQ ID NO: 3116828 - RNA, 22 nt, Mycobacterium bovis subsp bovis AF2122/97
agccgagguucaaagcagcgca

SEQ ID NO: 3116829 - RNA, 21 nt, Mycobacterium bovis subsp bovis AF2122/97
agccgauacaggccacgcacc

SEQ ID NO: 3116830 - RNA, 22 nt, Mycobacterium bovis subsp bovis AF2122/97
agccgauacaggccacgcaccg

SEQ ID NO: 3116831 - RNA, 16 nt, Mycobacterium bovis subsp bovis AF2122/97
agccgauauaccaggg

SEQ ID NO: 3116832 - RNA, 15 nt, Mycobacterium bovis subsp bovis AF2122/97
agccgaucaccgccg

SEQ ID NO: 3116833 - RNA, 22 nt, Mycobacterium bovis subsp bovis AF2122/97
agccgaucaguuccuguagccg

SEQ ID NO: 3116834 - RNA, 18 nt, Mycobacterium bovis subsp bovis AF2122/97
agccgaucaucaccggca

SEQ ID NO: 3116835 - RNA, 20 nt, Mycobacterium bovis subsp bovis AF2122/97
agccgaucaucaccggcaua

SEQ ID NO: 3116836 - RNA, 14 nt, Mycobacterium bovis subsp bovis AF2122/97
agccgauccagcag

SEQ ID NO: 3116837 - RNA, 17 nt, Mycobacterium bovis subsp bovis AF2122/97
agccgauccagcaggcc

SEQ ID NO: 3116838 - RNA, 16 nt, Mycobacterium bovis subsp bovis AF2122/97
agccgauccgaucgca

SEQ ID NO: 3116839 - RNA, 17 nt, Mycobacterium bovis subsp bovis AF2122/97
agccgauccgaucgcag

SEQ ID NO: 3116840 - RNA, 14 nt, Mycobacterium bovis subsp bovis AF2122/97
agccgaucgagcag

SEQ ID NO: 3116841 - RNA, 15 nt, Mycobacterium bovis subsp bovis AF2122/97
agccgaucgcccgcu

SEQ ID NO: 3116842 - RNA, 20 nt, Mycobacterium bovis subsp bovis AF2122/97
agccgaucggugccagaaug

SEQ ID NO: 3116843 - RNA, 20 nt, Mycobacterium bovis subsp bovis AF2122/97
agccgaucgucucggccacg

SEQ ID NO: 3116844 - RNA, 18 nt, Mycobacterium bovis subsp bovis AF2122/97
agccgaugaucgaacacg

SEQ ID NO: 3116845 - RNA, 23 nt, Mycobacterium bovis subsp bovis AF2122/97
agccgauuuuuccacaccagcuu

SEQ ID NO: 3116846 - RNA, 19 nt, Mycobacterium bovis subsp bovis AF2122/97
agccgcaaaaucgaugacg

SEQ ID NO: 3116847 - RNA, 19 nt, Mycobacterium bovis subsp bovis AF2122/97
agccgcacaaacgggcgug

SEQ ID NO: 3116848 - RNA, 20 nt, Mycobacterium bovis subsp bovis AF2122/97
agccgcaccaguggcgccca

SEQ ID NO: 3116849 - RNA, 14 nt, Mycobacterium bovis subsp bovis AF2122/97
agccgcaccccgcc

SEQ ID NO: 3116850 - RNA, 12 nt, Mycobacterium bovis subsp bovis AF2122/97
agccgcaccgcu

SEQ ID NO: 3116851 - RNA, 20 nt, Mycobacterium bovis subsp bovis AF2122/97
agccgcacgaugccgggaac

SEQ ID NO: 3116852 - RNA, 13 nt, Mycobacterium bovis subsp bovis AF2122/97
agccgcagaugca

SEQ ID NO: 3116853 - RNA, 12 nt, Mycobacterium bovis subsp bovis AF2122/97
agccgcagcacc

SEQ ID NO: 3116854 - RNA, 13 nt, Mycobacterium bovis subsp bovis AF2122/97
agccgcagcaccu

SEQ ID NO: 3116855 - RNA, 14 nt, Mycobacterium bovis subsp bovis AF2122/97
agccgcagcaccuc

SEQ ID NO: 3116856 - RNA, 22 nt, Mycobacterium bovis subsp bovis AF2122/97
agccgcagcccgugacugguga

SEQ ID NO: 3116857 - RNA, 15 nt, Mycobacterium bovis subsp bovis AF2122/97
agccgcagccgcagg

SEQ ID NO: 3116858 - RNA, 17 nt, Mycobacterium bovis subsp bovis AF2122/97
agccgcagccgcaggcc

SEQ ID NO: 3116859 - RNA, 19 nt, Mycobacterium bovis subsp bovis AF2122/97
agccgcagccgcaggccau

SEQ ID NO: 3116860 - RNA, 22 nt, Mycobacterium bovis subsp bovis AF2122/97
agccgcagcggccugaccggcu

SEQ ID NO: 3116861 - RNA, 16 nt, Mycobacterium bovis subsp bovis AF2122/97
agccgcagcugagccg

SEQ ID NO: 3116862 - RNA, 14 nt, Mycobacterium bovis subsp bovis AF2122/97
agccgcagcuuggc

SEQ ID NO: 3116863 - RNA, 15 nt, Mycobacterium bovis subsp bovis AF2122/97
agccgcaggugggcg

SEQ ID NO: 3116864 - RNA, 22 nt, Mycobacterium bovis subsp bovis AF2122/97
agccgcauaggccccgccagcg

SEQ ID NO: 3116865 - RNA, 19 nt, Mycobacterium bovis subsp bovis AF2122/97
agccgcaucuggccggcgg

SEQ ID NO: 3116866 - RNA, 20 nt, Mycobacterium bovis subsp bovis AF2122/97
agccgcaucuggccggcggu

SEQ ID NO: 3116867 - RNA, 23 nt, Mycobacterium bovis subsp bovis AF2122/97
agccgccaccguacgacagucgc

SEQ ID NO: 3116868 - RNA, 15 nt, Mycobacterium bovis subsp bovis AF2122/97
agccgccagcccguc

SEQ ID NO: 3116869 - RNA, 21 nt, Mycobacterium bovis subsp bovis AF2122/97
agccgccauugagcucccgca

SEQ ID NO: 3116870 - RNA, 17 nt, Mycobacterium bovis subsp bovis AF2122/97
agccgcccaagccgccg

SEQ ID NO: 3116871 - RNA, 13 nt, Mycobacterium bovis subsp bovis AF2122/97
agccgccccggca

SEQ ID NO: 3116872 - RNA, 11 nt, Mycobacterium bovis subsp bovis AF2122/97
agccgcccgcc

SEQ ID NO: 3116873 - RNA, 15 nt, Mycobacterium bovis subsp bovis AF2122/97
agccgcccgcccacc

SEQ ID NO: 3116874 - RNA, 17 nt, Mycobacterium bovis subsp bovis AF2122/97
agccgcccgcccaccuc

SEQ ID NO: 3116875 - RNA, 23 nt, Mycobacterium bovis subsp bovis AF2122/97
agccgcccgcccaccucgaucgc

SEQ ID NO: 3116876 - RNA, 14 nt, Mycobacterium bovis subsp bovis AF2122/97
agccgcccgcccgg

SEQ ID NO: 3116877 - RNA, 23 nt, Mycobacterium bovis subsp bovis AF2122/97
agccgcccgcccggacgcaacac

SEQ ID NO: 3116878 - RNA, 16 nt, Mycobacterium bovis subsp bovis AF2122/97
agccgcccucccuggg

SEQ ID NO: 3116879 - RNA, 17 nt, Mycobacterium bovis subsp bovis AF2122/97
agccgccgacucggcac

SEQ ID NO: 3116880 - RNA, 15 nt, Mycobacterium bovis subsp bovis AF2122/97
agccgccgccggcaa

SEQ ID NO: 3116881 - RNA, 15 nt, Mycobacterium bovis subsp bovis AF2122/97
agccgccgcgacggc

SEQ ID NO: 3116882 - RNA, 22 nt, Mycobacterium bovis subsp bovis AF2122/97
agccgccgcggucagauccaga

SEQ ID NO: 3116883 - RNA, 23 nt, Mycobacterium bovis subsp bovis AF2122/97
agccgccgcuucaccccacuggc

SEQ ID NO: 3116884 - RNA, 16 nt, Mycobacterium bovis subsp bovis AF2122/97
agccgccggcaguggg

SEQ ID NO: 3116885 - RNA, 12 nt, Mycobacterium bovis subsp bovis AF2122/97
agccgccggccc

SEQ ID NO: 3116886 - RNA, 13 nt, Mycobacterium bovis subsp bovis AF2122/97
agccgccggcccc

SEQ ID NO: 3116887 - RNA, 16 nt, Mycobacterium bovis subsp bovis AF2122/97
agccgccggccccgcc

SEQ ID NO: 3116888 - RNA, 19 nt, Mycobacterium bovis subsp bovis AF2122/97
agccgccggccccgccagc

SEQ ID NO: 3116889 - RNA, 22 nt, Mycobacterium bovis subsp bovis AF2122/97
agccgccggccccgccagcgcc

SEQ ID NO: 3116890 - RNA, 17 nt, Mycobacterium bovis subsp bovis AF2122/97
agccgccggcgccgaac

SEQ ID NO: 3116891 - RNA, 14 nt, Mycobacterium bovis subsp bovis AF2122/97
agccgccgggugcg

SEQ ID NO: 3116892 - RNA, 22 nt, Mycobacterium bovis subsp bovis AF2122/97
agccgccgggugcgccguugcc

SEQ ID NO: 3116893 - RNA, 13 nt, Mycobacterium bovis subsp bovis AF2122/97
agccgccggugcc

SEQ ID NO: 3116894 - RNA, 17 nt, Mycobacterium bovis subsp bovis AF2122/97
agccgccggugccgccg

SEQ ID NO: 3116895 - RNA, 13 nt, Mycobacterium bovis subsp bovis AF2122/97
agccggcgguggg

SEQ ID NO: 3116896 - RNA, 15 nt, Mycobacterium bovis subsp bovis AF2122/97
agccggcgguggggc

SEQ ID NO: 3116897 - RNA, 22 nt, Mycobacterium bovis subsp bovis AF2122/97
agccggcugcauccuccucguc

SEQ ID NO: 3116898 - RNA, 18 nt, Mycobacterium bovis subsp bovis AF2122/97
agccggcuguuaggcgau

SEQ ID NO: 3116899 - RNA, 20 nt, Mycobacterium bovis subsp bovis AF2122/97
agccggcuucggugagcggg

SEQ ID NO: 3116900 - RNA, 21 nt, Mycobacterium bovis subsp bovis AF2122/97
agccggcuucggugagcgggc

SEQ ID NO: 3116901 - RNA, 19 nt, Mycobacterium bovis subsp bovis AF2122/97
agccggcuugggcgguagc

SEQ ID NO: 3116902 - RNA, 20 nt, Mycobacterium bovis subsp bovis AF2122/97
agccggcuugggcgguagcc

SEQ ID NO: 3116903 - RNA, 21 nt, Mycobacterium bovis subsp bovis AF2122/97
agccggcuugggcgguagccg

SEQ ID NO: 3116904 - RNA, 16 nt, Mycobacterium bovis subsp bovis AF2122/97
agccgggaacgcugac

SEQ ID NO: 3116905 - RNA, 20 nt, Mycobacterium bovis subsp bovis AF2122/97
agccgggaacgcugacgccc

SEQ ID NO: 3116906 - RNA, 21 nt, Mycobacterium bovis subsp bovis AF2122/97
agccgggaccauagucgccgu

SEQ ID NO: 3116907 - RNA, 17 nt, Mycobacterium bovis subsp bovis AF2122/97
agccgggauugccgcca

SEQ ID NO: 3116908 - RNA, 13 nt, Mycobacterium bovis subsp bovis AF2122/97
agccgggcaacca

SEQ ID NO: 3116909 - RNA, 22 nt, Mycobacterium bovis subsp bovis AF2122/97
agccgggcaaccagcagcaggu

SEQ ID NO: 3116910 - RNA, 20 nt, Mycobacterium bovis subsp bovis AF2122/97
agccgggcaccacccuugcc

SEQ ID NO: 3116911 - RNA, 13 nt, Mycobacterium bovis subsp bovis AF2122/97
agccgggccaacc

SEQ ID NO: 3116912 - RNA, 19 nt, Mycobacterium bovis subsp bovis AF2122/97
agccgggccaaccggucgu

SEQ ID NO: 3116913 - RNA, 12 nt, Mycobacterium bovis subsp bovis AF2122/97
agccgggcccca

SEQ ID NO: 3116914 - RNA, 22 nt, Mycobacterium bovis subsp bovis AF2122/97
agccgggccccacaucgccccc

SEQ ID NO: 3116915 - RNA, 15 nt, Mycobacterium bovis subsp bovis AF2122/97
agccgggccguccgg

SEQ ID NO: 3116916 - RNA, 14 nt, Mycobacterium bovis subsp bovis AF2122/97
agccgggcgcgccg

SEQ ID NO: 3116917 - RNA, 17 nt, Mycobacterium bovis subsp bovis AF2122/97
agccgggcgcgccggcc

SEQ ID NO: 3116918 - RNA, 15 nt, Mycobacterium bovis subsp bovis AF2122/97
agccgggcggccucg

SEQ ID NO: 3116919 - RNA, 18 nt, Mycobacterium bovis subsp bovis AF2122/97
agccgggcggccucguug

SEQ ID NO: 3116920 - RNA, 16 nt, Mycobacterium bovis subsp bovis AF2122/97
agccgggcgucgcugg

SEQ ID NO: 3116921 - RNA, 15 nt, Mycobacterium bovis subsp bovis AF2122/97
agccgggcucgucga

SEQ ID NO: 3116922 - RNA, 23 nt, Mycobacterium bovis subsp bovis AF2122/97
agccgggcuggccgacucgaggu

SEQ ID NO: 3116923 - RNA, 14 nt, Mycobacterium bovis subsp bovis AF2122/97
agccggggaacgug

SEQ ID NO: 3116924 - RNA, 19 nt, Mycobacterium bovis subsp bovis AF2122/97
agccgggguucaccgucga

SEQ ID NO: 3116925 - RNA, 17 nt, Mycobacterium bovis subsp bovis AF2122/97
agccgggugccacaacc

SEQ ID NO: 3116926 - RNA, 13 nt, Mycobacterium bovis subsp bovis AF2122/97
agccgggugccgg

SEQ ID NO: 3116927 - RNA, 22 nt, Mycobacterium bovis subsp bovis AF2122/97
agccgggugggagcagccgaac

SEQ ID NO: 3116928 - RNA, 23 nt, Mycobacterium bovis subsp bovis AF2122/97
agccgggugggagcagccgaacc

SEQ ID NO: 3116929 - RNA, 19 nt, Mycobacterium bovis subsp bovis AF2122/97
agccggguugccugcgcga

SEQ ID NO: 3116930 - RNA, 21 nt, Mycobacterium bovis subsp bovis AF2122/97
agccggguuuggugcagccgc

SEQ ID NO: 3116931 - RNA, 15 nt, Mycobacterium bovis subsp bovis AF2122/97
agccgguaaccgcgu

SEQ ID NO: 3116932 - RNA, 18 nt, Mycobacterium bovis subsp bovis AF2122/97
agccgguaaccgcgucga

SEQ ID NO: 3116933 - RNA, 23 nt, Mycobacterium bovis subsp bovis AF2122/97
agccgguagaucagcgccugguc

SEQ ID NO: 3116934 - RNA, 13 nt, Mycobacterium bovis subsp bovis AF2122/97
agccgguagccgg

SEQ ID NO: 3116935 - RNA, 20 nt, Mycobacterium bovis subsp bovis AF2122/97
agccgguccagacccagcuc

SEQ ID NO: 3116936 - RNA, 22 nt, Mycobacterium bovis subsp bovis AF2122/97
agccgguccagacccagcucgu

SEQ ID NO: 3116937 - RNA, 13 nt, Mycobacterium bovis subsp bovis AF2122/97
agccggucggcac

SEQ ID NO: 3116938 - RNA, 17 nt, Mycobacterium bovis subsp bovis AF2122/97
agccggucuugcaucgc

SEQ ID NO: 3116939 - RNA, 19 nt, Mycobacterium bovis subsp bovis AF2122/97
agccggugacaaguggugc

SEQ ID NO: 3116940 - RNA, 23 nt, Mycobacterium bovis subsp bovis AF2122/97
agccggugacaaguggugcccuu

SEQ ID NO: 3116941 - RNA, 15 nt, Mycobacterium bovis subsp bovis AF2122/97
agccggugaccgcga

SEQ ID NO: 3116942 - RNA, 17 nt, Mycobacterium bovis subsp bovis AF2122/97
agccggugacguggugg

SEQ ID NO: 3116943 - RNA, 16 nt, Mycobacterium bovis subsp bovis AF2122/97
agccggugccacugcc

SEQ ID NO: 3116944 - RNA, 17 nt, Mycobacterium bovis subsp bovis AF2122/97
agccggugccacugccg

SEQ ID NO: 3116945 - RNA, 11 nt, Mycobacterium bovis subsp bovis AF2122/97
agccggugccg

SEQ ID NO: 3116946 - RNA, 18 nt, Mycobacterium bovis subsp bovis AF2122/97
agccggugccgacggcgc

SEQ ID NO: 3116947 - RNA, 19 nt, Mycobacterium bovis subsp bovis AF2122/97
agccggugccgacggcgcc

SEQ ID NO: 3116948 - RNA, 21 nt, Mycobacterium bovis subsp bovis AF2122/97
agccggugccgacggcgccga

SEQ ID NO: 3116949 - RNA, 12 nt, Mycobacterium bovis subsp bovis AF2122/97
agccggugccgg

SEQ ID NO: 3116950 - RNA, 15 nt, Mycobacterium bovis subsp bovis AF2122/97
agccggugccggcgc

SEQ ID NO: 3116951 - RNA, 15 nt, Mycobacterium bovis subsp bovis AF2122/97
agccggugccggcgu

SEQ ID NO: 3116952 - RNA, 21 nt, Mycobacterium bovis subsp bovis AF2122/97
agccggugccggcguugccgc

SEQ ID NO: 3116953 - RNA, 22 nt, Mycobacterium bovis subsp bovis AF2122/97
agccgguggucugcgcggugcc

SEQ ID NO: 3116954 - RNA, 23 nt, Mycobacterium bovis subsp bovis AF2122/97
agccgguggucugcgcggugccc

SEQ ID NO: 3116955 - RNA, 13 nt, Mycobacterium bovis subsp bovis AF2122/97
agccgguguugau

SEQ ID NO: 3116956 - RNA, 15 nt, Mycobacterium bovis subsp bovis AF2122/97
agccgguucgcccag

SEQ ID NO: 3116957 - RNA, 19 nt, Mycobacterium bovis subsp bovis AF2122/97
agccgguuggcugccggca

SEQ ID NO: 3116958 - RNA, 17 nt, Mycobacterium bovis subsp bovis AF2122/97
agccgguugucgcagcg

SEQ ID NO: 3116959 - RNA, 18 nt, Mycobacterium bovis subsp bovis AF2122/97
agccgguugucgcagcgc

SEQ ID NO: 3116960 - RNA, 13 nt, Mycobacterium bovis subsp bovis AF2122/97
agccguagcgguc

SEQ ID NO: 3116961 - RNA, 20 nt, Mycobacterium bovis subsp bovis AF2122/97
agccguagcugggcaccccg

SEQ ID NO: 3116962 - RNA, 18 nt, Mycobacterium bovis subsp bovis AF2122/97
agccguaguaguggccgc

SEQ ID NO: 3116963 - RNA, 23 nt, Mycobacterium bovis subsp bovis AF2122/97
agccguaguaguggccgccaccc

SEQ ID NO: 3116964 - RNA, 15 nt, Mycobacterium bovis subsp bovis AF2122/97
agccguaucggugug

SEQ ID NO: 3116965 - RNA, 13 nt, Mycobacterium bovis subsp bovis AF2122/97
agccgucaccgcg

SEQ ID NO: 3116966 - RNA, 16 nt, Mycobacterium bovis subsp bovis AF2122/97
agccgucaccgcgacc

SEQ ID NO: 3116967 - RNA, 20 nt, Mycobacterium bovis subsp bovis AF2122/97
agccgucaccgcgaccccug

SEQ ID NO: 3116968 - RNA, 13 nt, Mycobacterium bovis subsp bovis AF2122/97
agccgucacgccg

SEQ ID NO: 3116969 - RNA, 15 nt, Mycobacterium bovis subsp bovis AF2122/97
agccguccaauuccg

SEQ ID NO: 3116970 - RNA, 13 nt, Mycobacterium bovis subsp bovis AF2122/97
agccguccgacca

SEQ ID NO: 3116971 - RNA, 18 nt, Mycobacterium bovis subsp bovis AF2122/97
agccguccgggcggccuc

SEQ ID NO: 3116972 - RNA, 13 nt, Mycobacterium bovis subsp bovis AF2122/97
agccgucgagcag

SEQ ID NO: 3116973 - RNA, 21 nt, Mycobacterium bovis subsp bovis AF2122/97
agccgucgagcagccgagcuc

SEQ ID NO: 3116974 - RNA, 14 nt, Mycobacterium bovis subsp bovis AF2122/97
agccgucgaucccg

SEQ ID NO: 3116975 - RNA, 12 nt, Mycobacterium bovis subsp bovis AF2122/97
agccgucgaugu

SEQ ID NO: 3116976 - RNA, 16 nt, Mycobacterium bovis subsp bovis AF2122/97
agccgucgcgacgucg

SEQ ID NO: 3116977 - RNA, 18 nt, Mycobacterium bovis subsp bovis AF2122/97
agccgucgcgacgucggc

SEQ ID NO: 3116978 - RNA, 21 nt, Mycobacterium bovis subsp bovis AF2122/97
agccgucgcgacgucggccgu

SEQ ID NO: 3116979 - RNA, 19 nt, Mycobacterium bovis subsp bovis AF2122/97
agccgucggcgcugcgcgc

SEQ ID NO: 3116980 - RNA, 18 nt, Mycobacterium bovis subsp bovis AF2122/97
agccgucguccgcugacc

SEQ ID NO: 3116981 - RNA, 22 nt, Mycobacterium bovis subsp bovis AF2122/97
agcgaaccaccggcgccgccgg

SEQ ID NO: 3116982 - RNA, 23 nt, Mycobacterium bovis subsp bovis AF2122/97
agcgaacccgagccgccguggaa

SEQ ID NO: 3116983 - RNA, 13 nt, Mycobacterium bovis subsp bovis AF2122/97
agcgaaccgccgg

SEQ ID NO: 3116984 - RNA, 15 nt, Mycobacterium bovis subsp bovis AF2122/97
agcgaaccgccggca

SEQ ID NO: 3116985 - RNA, 16 nt, Mycobacterium bovis subsp bovis AF2122/97
agcgaaccgccggcac

SEQ ID NO: 3116986 - RNA, 17 nt, Mycobacterium bovis subsp bovis AF2122/97
agcgaaccgccggcacc

SEQ ID NO: 3116987 - RNA, 20 nt, Mycobacterium bovis subsp bovis AF2122/97
agcgaaccgccggcaccgcc

SEQ ID NO: 3116988 - RNA, 14 nt, Mycobacterium bovis subsp bovis AF2122/97
agcgaacggccagg

SEQ ID NO: 3116989 - RNA, 17 nt, Mycobacterium bovis subsp bovis AF2122/97
agcgaacggccaggaca

SEQ ID NO: 3116990 - RNA, 15 nt, Mycobacterium bovis subsp bovis AF2122/97
agcgaacggcgcagu

SEQ ID NO: 3116991 - RNA, 19 nt, Mycobacterium bovis subsp bovis AF2122/97
agcgaacggguagucgggc

SEQ ID NO: 3116992 - RNA, 21 nt, Mycobacterium bovis subsp bovis AF2122/97
agcgaagccagaucgcuagga

SEQ ID NO: 3116993 - RNA, 14 nt, Mycobacterium bovis subsp bovis AF2122/97
agcgaagugucgcu

SEQ ID NO: 3116994 - RNA, 15 nt, Mycobacterium bovis subsp bovis AF2122/97
agcgaaucacccgcg

SEQ ID NO: 3116995 - RNA, 12 nt, Mycobacterium bovis subsp bovis AF2122/97
agcgaauccagc

SEQ ID NO: 3116996 - RNA, 17 nt, Mycobacterium bovis subsp bovis AF2122/97
agcgaauccaggccgua

SEQ ID NO: 3116997 - RNA, 18 nt, Mycobacterium bovis subsp bovis AF2122/97
agcgaaucgcuggugaag

SEQ ID NO: 3116998 - RNA, 16 nt, Mycobacterium bovis subsp bovis AF2122/97
agcgaauggggcagcu

SEQ ID NO: 3116999 - RNA, 20 nt, Mycobacterium bovis subsp bovis AF2122/97
agcgacaagugcacgaaguc

SEQ ID NO: 3117000 - RNA, 23 nt, Mycobacterium bovis subsp bovis AF2122/97
agcgacacguuggcggaugcccg

SEQ ID NO: 3117001 - RNA, 16 nt, Mycobacterium bovis subsp bovis AF2122/97
agcgacagcagcgcca

SEQ ID NO: 3117002 - RNA, 19 nt, Mycobacterium bovis subsp bovis AF2122/97
agcgacagcagcgccaccc

SEQ ID NO: 3117003 - RNA, 20 nt, Mycobacterium bovis subsp bovis AF2122/97
agcgacagcgcggcgcgaca

SEQ ID NO: 3117004 - RNA, 21 nt, Mycobacterium bovis subsp bovis AF2122/97
agcgaccaauagguccccaca

SEQ ID NO: 3117005 - RNA, 19 nt, Mycobacterium bovis subsp bovis AF2122/97
agcgaccaaugcagugcga

SEQ ID NO: 3117006 - RNA, 20 nt, Mycobacterium bovis subsp bovis AF2122/97
agcgaccacgucaagaagaa

SEQ ID NO: 3117007 - RNA, 16 nt, Mycobacterium bovis subsp bovis AF2122/97
agcgaccaggucgcca

SEQ ID NO: 3117008 - RNA, 18 nt, Mycobacterium bovis subsp bovis AF2122/97
agcgacccccagcgcccg

SEQ ID NO: 3117009 - RNA, 20 nt, Mycobacterium bovis subsp bovis AF2122/97
agcgacccccagcgcccgcc

SEQ ID NO: 3117010 - RNA, 16 nt, Mycobacterium bovis subsp bovis AF2122/97
agcgacccggccagcg

SEQ ID NO: 3117011 - RNA, 15 nt, Mycobacterium bovis subsp bovis AF2122/97
agcgaccgcggcccc

SEQ ID NO: 3117012 - RNA, 16 nt, Mycobacterium bovis subsp bovis AF2122/97
agcgaccgcugcagau

SEQ ID NO: 3117013 - RNA, 22 nt, Mycobacterium bovis subsp bovis AF2122/97
agcgaccgguaauccguugccg

SEQ ID NO: 3117014 - RNA, 17 nt, Mycobacterium bovis subsp bovis AF2122/97
agcgaccgucccagcgc

SEQ ID NO: 3117015 - RNA, 23 nt, Mycobacterium bovis subsp bovis AF2122/97
agcgaccgucccagcgccgcagu

SEQ ID NO: 3117016 - RNA, 17 nt, Mycobacterium bovis subsp bovis AF2122/97
agcgaccgucgucaccg

SEQ ID NO: 3117017 - RNA, 18 nt, Mycobacterium bovis subsp bovis AF2122/97
agcgaccgucgucaccgc

SEQ ID NO: 3117018 - RNA, 21 nt, Mycobacterium bovis subsp bovis AF2122/97
agcgaccuagcagcgcugcga

SEQ ID NO: 3117019 - RNA, 19 nt, Mycobacterium bovis subsp bovis AF2122/97
agcgaccucacugcggcgc

SEQ ID NO: 3117020 - RNA, 21 nt, Mycobacterium bovis subsp bovis AF2122/97
agcgaccucacugcggcgcca

SEQ ID NO: 3117021 - RNA, 15 nt, Mycobacterium bovis subsp bovis AF2122/97
agcgaccuggguuuc

SEQ ID NO: 3117022 - RNA, 17 nt, Mycobacterium bovis subsp bovis AF2122/97
agcgacgaagucgcagc

SEQ ID NO: 3117023 - RNA, 23 nt, Mycobacterium bovis subsp bovis AF2122/97
agcgacgaccacaccacgauggc

SEQ ID NO: 3117024 - RNA, 14 nt, Mycobacterium bovis subsp bovis AF2122/97
agcgacgagcagca

SEQ ID NO: 3117025 - RNA, 15 nt, Mycobacterium bovis subsp bovis AF2122/97
agcgacgagcagcaa

SEQ ID NO: 3117026 - RNA, 15 nt, Mycobacterium bovis subsp bovis AF2122/97
agcgacgcacgcagu

SEQ ID NO: 3117027 - RNA, 17 nt, Mycobacterium bovis subsp bovis AF2122/97
agcgacgcauaaccggc

SEQ ID NO: 3117028 - RNA, 19 nt, Mycobacterium bovis subsp bovis AF2122/97
agcgacgcauaaccggcgc

SEQ ID NO: 3117029 - RNA, 16 nt, Mycobacterium bovis subsp bovis AF2122/97
agcgacgccaucugcu

SEQ ID NO: 3117030 - RNA, 21 nt, Mycobacterium bovis subsp bovis AF2122/97
agcgacgcgauuucgucgucg

SEQ ID NO: 3117031 - RNA, 16 nt, Mycobacterium bovis subsp bovis AF2122/97
agcgacgcggccagcg

SEQ ID NO: 3117032 - RNA, 21 nt, Mycobacterium bovis subsp bovis AF2122/97
agcgacgcuaggacggcugcc

SEQ ID NO: 3117033 - RNA, 12 nt, Mycobacterium bovis subsp bovis AF2122/97
agcgacggcaaa

SEQ ID NO: 3117034 - RNA, 17 nt, Mycobacterium bovis subsp bovis AF2122/97
agcgacggccgccagca

SEQ ID NO: 3117035 - RNA, 20 nt, Mycobacterium bovis subsp bovis AF2122/97
agcgacggccgccagcagcu

SEQ ID NO: 3117036 - RNA, 16 nt, Mycobacterium bovis subsp bovis AF2122/97
agcgacggcgcucggc

SEQ ID NO: 3117037 - RNA, 23 nt, Mycobacterium bovis subsp bovis AF2122/97
agcgacggucccggcacgucgac

SEQ ID NO: 3117038 - RNA, 20 nt, Mycobacterium bovis subsp bovis AF2122/97
agcgacgguuuagcgccggu

SEQ ID NO: 3117039 - RNA, 19 nt, Mycobacterium bovis subsp bovis AF2122/97
agcgacguuaaugacgcca

SEQ ID NO: 3117040 - RNA, 17 nt, Mycobacterium bovis subsp bovis AF2122/97
agcgacuccaccccacc

SEQ ID NO: 3117041 - RNA, 23 nt, Mycobacterium bovis subsp bovis AF2122/97
agcgacuccaccccacccagcga

SEQ ID NO: 3117042 - RNA, 14 nt, Mycobacterium bovis subsp bovis AF2122/97
agcgacuccagcgc

SEQ ID NO: 3117043 - RNA, 18 nt, Mycobacterium bovis subsp bovis AF2122/97
agcgacuccagcgcccgg

SEQ ID NO: 3117044 - RNA, 23 nt, Mycobacterium bovis subsp bovis AF2122/97
agcgacuccguaccggguuccau

SEQ ID NO: 3117045 - RNA, 17 nt, Mycobacterium bovis subsp bovis AF2122/97
agcgacucgccggcgaa

SEQ ID NO: 3117046 - RNA, 17 nt, Mycobacterium bovis subsp bovis AF2122/97
agcgacugcagcggcgc

SEQ ID NO: 3117047 - RNA, 18 nt, Mycobacterium bovis subsp bovis AF2122/97
agcgacugcagcggcgca

SEQ ID NO: 3117048 - RNA, 19 nt, Mycobacterium bovis subsp bovis AF2122/97
agcgagacuucgacgcggc

SEQ ID NO: 3117049 - RNA, 12 nt, Mycobacterium bovis subsp bovis AF2122/97
agcgagcagcuc

SEQ ID NO: 3117050 - RNA, 21 nt, Mycobacterium bovis subsp bovis AF2122/97
agcgagcauaccgccgcugcc

SEQ ID NO: 3117051 - RNA, 22 nt, Mycobacterium bovis subsp bovis AF2122/97
agcgagcccagcugcgccgaac

SEQ ID NO: 3117052 - RNA, 12 nt, Mycobacterium bovis subsp bovis AF2122/97
agcgagccggcg

SEQ ID NO: 3117053 - RNA, 18 nt, Mycobacterium bovis subsp bovis AF2122/97
agcgagccguaucggacg

SEQ ID NO: 3117054 - RNA, 21 nt, Mycobacterium bovis subsp bovis AF2122/97
agcgagcgcaaaucgauugcg

SEQ ID NO: 3117055 - RNA, 12 nt, Mycobacterium bovis subsp bovis AF2122/97
agcgagcgcaca

SEQ ID NO: 3117056 - RNA, 20 nt, Mycobacterium bovis subsp bovis AF2122/97
agcgagcgcgcguagcgggg

SEQ ID NO: 3117057 - RNA, 15 nt, Mycobacterium bovis subsp bovis AF2122/97
agcgagcggcaccaa

SEQ ID NO: 3117058 - RNA, 20 nt, Mycobacterium bovis subsp bovis AF2122/97
agcgagcucagcgaugcggc

SEQ ID NO: 3117059 - RNA, 23 nt, Mycobacterium bovis subsp bovis AF2122/97
agcgagcucagcgaugcggcccu

SEQ ID NO: 3117060 - RNA, 19 nt, Mycobacterium bovis subsp bovis AF2122/97
agcgaggaauuccgcuacc

SEQ ID NO: 3117061 - RNA, 18 nt, Mycobacterium bovis subsp bovis AF2122/97
agcgaggacaagcccgcu

SEQ ID NO: 3117062 - RNA, 12 nt, Mycobacterium bovis subsp bovis AF2122/97
agcgaggccagc

SEQ ID NO: 3117063 - RNA, 13 nt, Mycobacterium bovis subsp bovis AF2122/97
agcgaggccagcg

SEQ ID NO: 3117064 - RNA, 16 nt, Mycobacterium bovis subsp bovis AF2122/97
agcgagucgaacccgc

SEQ ID NO: 3117065 - RNA, 14 nt, Mycobacterium bovis subsp bovis AF2122/97
agcgagucgacgaa

SEQ ID NO: 3117066 - RNA, 13 nt, Mycobacterium bovis subsp bovis AF2122/97
agcgaguugcagu

SEQ ID NO: 3117067 - RNA, 15 nt, Mycobacterium bovis subsp bovis AF2122/97
agcgccaucgagguc

SEQ ID NO: 3117068 - RNA, 21 nt, Mycobacterium bovis subsp bovis AF2122/97
agcgccaugcccucggcgccg

SEQ ID NO: 3117069 - RNA, 17 nt, Mycobacterium bovis subsp bovis AF2122/97
agcgccauuccaagacg

SEQ ID NO: 3117070 - RNA, 15 nt, Mycobacterium bovis subsp bovis AF2122/97
agcgcccccagcagc

SEQ ID NO: 3117071 - RNA, 19 nt, Mycobacterium bovis subsp bovis AF2122/97
agcgcccccagcagcugcg

SEQ ID NO: 3117072 - RNA, 14 nt, Mycobacterium bovis subsp bovis AF2122/97
agcgcccccgcugc

SEQ ID NO: 3117073 - RNA, 19 nt, Mycobacterium bovis subsp bovis AF2122/97
agcgccccgcgguccuggu

SEQ ID NO: 3117074 - RNA, 15 nt, Mycobacterium bovis subsp bovis AF2122/97
agcgccccggcgcgu

SEQ ID NO: 3117075 - RNA, 16 nt, Mycobacterium bovis subsp bovis AF2122/97
agcgccccuggcaccu

SEQ ID NO: 3117076 - RNA, 17 nt, Mycobacterium bovis subsp bovis AF2122/97
agcgcccgcagguggcu

SEQ ID NO: 3117077 - RNA, 15 nt, Mycobacterium bovis subsp bovis AF2122/97
agcgcccgcgcggcc

SEQ ID NO: 3117078 - RNA, 16 nt, Mycobacterium bovis subsp bovis AF2122/97
agcgcccgcgcggcca

SEQ ID NO: 3117079 - RNA, 12 nt, Mycobacterium bovis subsp bovis AF2122/97
agcgcccggaug

SEQ ID NO: 3117080 - RNA, 23 nt, Mycobacterium bovis subsp bovis AF2122/97
agcgcccggauguccgccgacgu

SEQ ID NO: 3117081 - RNA, 14 nt, Mycobacterium bovis subsp bovis AF2122/97
agcgcccggccacu

SEQ ID NO: 3117082 - RNA, 19 nt, Mycobacterium bovis subsp bovis AF2122/97
agcgcccggccacuccagu

SEQ ID NO: 3117083 - RNA, 22 nt, Mycobacterium bovis subsp bovis AF2122/97
agcgcccggcccgccaccccgu

SEQ ID NO: 3117084 - RNA, 20 nt, Mycobacterium bovis subsp bovis AF2122/97
agcgcccgucguagguggcc

SEQ ID NO: 3117085 - RNA, 18 nt, Mycobacterium bovis subsp bovis AF2122/97
agcgcccuuggacgcgau

SEQ ID NO: 3117086 - RNA, 19 nt, Mycobacterium bovis subsp bovis AF2122/97
agcgcccuuggacgcgaug

SEQ ID NO: 3117087 - RNA, 17 nt, Mycobacterium bovis subsp bovis AF2122/97
agcgccgaauucauccg

SEQ ID NO: 3117088 - RNA, 19 nt, Mycobacterium bovis subsp bovis AF2122/97
agcgccgacagccgauccg

SEQ ID NO: 3117089 - RNA, 17 nt, Mycobacterium bovis subsp bovis AF2122/97
agcgccgauaccagcca

SEQ ID NO: 3117090 - RNA, 20 nt, Mycobacterium bovis subsp bovis AF2122/97
agcgccgauguggccggcga

SEQ ID NO: 3117091 - RNA, 22 nt, Mycobacterium bovis subsp bovis AF2122/97
agcgccgauguggccggcgaug

SEQ ID NO: 3117092 - RNA, 13 nt, Mycobacterium bovis subsp bovis AF2122/97
agcgccgcacaga

SEQ ID NO: 3117093 - RNA, 18 nt, Mycobacterium bovis subsp bovis AF2122/97
agcgccgcacagaaaacg

SEQ ID NO: 3117094 - RNA, 15 nt, Mycobacterium bovis subsp bovis AF2122/97
agcgccgcacccgcu

SEQ ID NO: 3117095 - RNA, 12 nt, Mycobacterium bovis subsp bovis AF2122/97
agcgccgcacuu

SEQ ID NO: 3117096 - RNA, 23 nt, Mycobacterium bovis subsp bovis AF2122/97
agcgccgcagcgaaaacccgguc

SEQ ID NO: 3117097 - RNA, 13 nt, Mycobacterium bovis subsp bovis AF2122/97
agcgccgccaccc

SEQ ID NO: 3117098 - RNA, 21 nt, Mycobacterium bovis subsp bovis AF2122/97
agcgccgccagguguucgccg

SEQ ID NO: 3117099 - RNA, 10 nt, Mycobacterium bovis subsp bovis AF2122/97
agcgccgccg

SEQ ID NO: 3117100 - RNA, 13 nt, Mycobacterium bovis subsp bovis AF2122/97
agcgccgccgagg

SEQ ID NO: 3117101 - RNA, 11 nt, Mycobacterium bovis subsp bovis AF2122/97
agcgccgccgc

SEQ ID NO: 3117102 - RNA, 15 nt, Mycobacterium bovis subsp bovis AF2122/97
agcgccgccgccgac

SEQ ID NO: 3117103 - RNA, 14 nt, Mycobacterium bovis subsp bovis AF2122/97
agcgccgccgcgag

SEQ ID NO: 3117104 - RNA, 20 nt, Mycobacterium bovis subsp bovis AF2122/97
agcgccgccgcgagcgccgg

SEQ ID NO: 3117105 - RNA, 23 nt, Mycobacterium bovis subsp bovis AF2122/97
agcgccgccggaagcgccggccg

SEQ ID NO: 3117106 - RNA, 16 nt, Mycobacterium bovis subsp bovis AF2122/97
agcgccgccggcgccg

SEQ ID NO: 3117107 - RNA, 20 nt, Mycobacterium bovis subsp bovis AF2122/97
agcgccgcgcuugcgaucgg

SEQ ID NO: 3117108 - RNA, 12 nt, Mycobacterium bovis subsp bovis AF2122/97
agcgccgcggcc

SEQ ID NO: 3117109 - RNA, 17 nt, Mycobacterium bovis subsp bovis AF2122/97
agcgccgcggcccgcuc

SEQ ID NO: 3117110 - RNA, 20 nt, Mycobacterium bovis subsp bovis AF2122/97
agcgccgcguggcuggcggc

SEQ ID NO: 3117111 - RNA, 19 nt, Mycobacterium bovis subsp bovis AF2122/97
agcgccgcuaugaggcagu

SEQ ID NO: 3117112 - RNA, 16 nt, Mycobacterium bovis subsp bovis AF2122/97
agcgccgcugacuccu

SEQ ID NO: 3117113 - RNA, 22 nt, Mycobacterium bovis subsp bovis AF2122/97
agcgccgcugacuccugcggca

SEQ ID NO: 3117114 - RNA, 15 nt, Mycobacterium bovis subsp bovis AF2122/97
agcgccgcuuggcga

SEQ ID NO: 3117115 - RNA, 16 nt, Mycobacterium bovis subsp bovis AF2122/97
agcgccgcuuggcgau

SEQ ID NO: 3117116 - RNA, 19 nt, Mycobacterium bovis subsp bovis AF2122/97
agcgccgcuuggcgauccg

SEQ ID NO: 3117117 - RNA, 14 nt, Mycobacterium bovis subsp bovis AF2122/97
agcgccggcaccga

SEQ ID NO: 3117118 - RNA, 14 nt, Mycobacterium bovis subsp bovis AF2122/97
agcgccggcaucgc

SEQ ID NO: 3117119 - RNA, 13 nt, Mycobacterium bovis subsp bovis AF2122/97
agcgccggccagg

SEQ ID NO: 3117120 - RNA, 11 nt, Mycobacterium bovis subsp bovis AF2122/97
agcgccggccc

SEQ ID NO: 3117121 - RNA, 12 nt, Mycobacterium bovis subsp bovis AF2122/97
agcgccggccga

SEQ ID NO: 3117122 - RNA, 13 nt, Mycobacterium bovis subsp bovis AF2122/97
agcgccggccgcg

SEQ ID NO: 3117123 - RNA, 15 nt, Mycobacterium bovis subsp bovis AF2122/97
agcgccggcuucggg

SEQ ID NO: 3117124 - RNA, 19 nt, Mycobacterium bovis subsp bovis AF2122/97
agcgccggcuucggguguu

SEQ ID NO: 3117125 - RNA, 18 nt, Mycobacterium bovis subsp bovis AF2122/97
agcgccggggugugcggg

SEQ ID NO: 3117126 - RNA, 23 nt, Mycobacterium bovis subsp bovis AF2122/97
agcgccggucagggacgaacugc

SEQ ID NO: 3117127 - RNA, 18 nt, Mycobacterium bovis subsp bovis AF2122/97
agcgccgguuuaggccau

SEQ ID NO: 3117128 - RNA, 18 nt, Mycobacterium bovis subsp bovis AF2122/97
agcgccguacagcggcgg

SEQ ID NO: 3117129 - RNA, 19 nt, Mycobacterium bovis subsp bovis AF2122/97
agcgccguacagcggcggc

SEQ ID NO: 3117130 - RNA, 19 nt, Mycobacterium bovis subsp bovis AF2122/97
agcgccgugaacggaugug

SEQ ID NO: 3117131 - RNA, 16 nt, Mycobacterium bovis subsp bovis AF2122/97
agcgccuaccagcacc

SEQ ID NO: 3117132 - RNA, 19 nt, Mycobacterium bovis subsp bovis AF2122/97
agcgccucaagcucgccgg

SEQ ID NO: 3117133 - RNA, 20 nt, Mycobacterium bovis subsp bovis AF2122/97
agcgccucaagcucgccgga

SEQ ID NO: 3117134 - RNA, 23 nt, Mycobacterium bovis subsp bovis AF2122/97
agcgccuccacucuucgggcggc

SEQ ID NO: 3117135 - RNA, 15 nt, Mycobacterium bovis subsp bovis AF2122/97
agcgccuccagcacc

SEQ ID NO: 3117136 - RNA, 16 nt, Mycobacterium bovis subsp bovis AF2122/97
agcgccuccagcacca

SEQ ID NO: 3117137 - RNA, 17 nt, Mycobacterium bovis subsp bovis AF2122/97
agcgccuccagcaccac

SEQ ID NO: 3117138 - RNA, 22 nt, Mycobacterium bovis subsp bovis AF2122/97
agcgccucgaccugacugguca

SEQ ID NO: 3117139 - RNA, 12 nt, Mycobacterium bovis subsp bovis AF2122/97
agcgccucgaug

SEQ ID NO: 3117140 - RNA, 13 nt, Mycobacterium bovis subsp bovis AF2122/97
agcgccucgccgg

SEQ ID NO: 3117141 - RNA, 16 nt, Mycobacterium bovis subsp bovis AF2122/97
agcgccucgccggcca

SEQ ID NO: 3117142 - RNA, 20 nt, Mycobacterium bovis subsp bovis AF2122/97
agcgccucgccggccacccg

SEQ ID NO: 3117143 - RNA, 21 nt, Mycobacterium bovis subsp bovis AF2122/97
agcgccucgccggccacccgc

SEQ ID NO: 3117144 - RNA, 18 nt, Mycobacterium bovis subsp bovis AF2122/97
agcgccucgggaggcagc

SEQ ID NO: 3117145 - RNA, 19 nt, Mycobacterium bovis subsp bovis AF2122/97
agcgccucgguggucuugg

SEQ ID NO: 3117146 - RNA, 17 nt, Mycobacterium bovis subsp bovis AF2122/97
agcgccugagcggccuc

SEQ ID NO: 3117147 - RNA, 21 nt, Mycobacterium bovis subsp bovis AF2122/97
agcgccugcgcccagccguuc

SEQ ID NO: 3117148 - RNA, 20 nt, Mycobacterium bovis subsp bovis AF2122/97
agcgccugcggcagcacccg

SEQ ID NO: 3117149 - RNA, 15 nt, Mycobacterium bovis subsp bovis AF2122/97
agcgccuugucgauc

SEQ ID NO: 3117150 - RNA, 19 nt, Mycobacterium bovis subsp bovis AF2122/97
agcgccuugucgaucucgu

SEQ ID NO: 3117151 - RNA, 16 nt, Mycobacterium bovis subsp bovis AF2122/97
agcgccuuguggcaca

SEQ ID NO: 3117152 - RNA, 14 nt, Mycobacterium bovis subsp bovis AF2122/97
agcgcgaaagcgcc

SEQ ID NO: 3117153 - RNA, 15 nt, Mycobacterium bovis subsp bovis AF2122/97
agcgcgaacaccaug

SEQ ID NO: 3117154 - RNA, 19 nt, Mycobacterium bovis subsp bovis AF2122/97
agcgcgguuggcugaugac

SEQ ID NO: 3117155 - RNA, 17 nt, Mycobacterium bovis subsp bovis AF2122/97
agcgcgguuucggcgau

SEQ ID NO: 3117156 - RNA, 19 nt, Mycobacterium bovis subsp bovis AF2122/97
agcgcgguuucggcgauga

SEQ ID NO: 3117157 - RNA, 15 nt, Mycobacterium bovis subsp bovis AF2122/97
agcgcguagcgggcg

SEQ ID NO: 3117158 - RNA, 18 nt, Mycobacterium bovis subsp bovis AF2122/97
agcgcguaguccgcaucc

SEQ ID NO: 3117159 - RNA, 21 nt, Mycobacterium bovis subsp bovis AF2122/97
agcgcguauggcucaccccgg

SEQ ID NO: 3117160 - RNA, 22 nt, Mycobacterium bovis subsp bovis AF2122/97
agcgcguauggcucaccccggu

SEQ ID NO: 3117161 - RNA, 12 nt, Mycobacterium bovis subsp bovis AF2122/97
agcgcgucgccg

SEQ ID NO: 3117162 - RNA, 19 nt, Mycobacterium bovis subsp bovis AF2122/97
agcgcgucggagccgggca

SEQ ID NO: 3117163 - RNA, 21 nt, Mycobacterium bovis subsp bovis AF2122/97
agcgcgucgggaugcgcguua

SEQ ID NO: 3117164 - RNA, 17 nt, Mycobacterium bovis subsp bovis AF2122/97
agcgcgucggucaccga

SEQ ID NO: 3117165 - RNA, 13 nt, Mycobacterium bovis subsp bovis AF2122/97
agcgcgucgucca

SEQ ID NO: 3117166 - RNA, 22 nt, Mycobacterium bovis subsp bovis AF2122/97
agcgcgugcuguggaugccgac

SEQ ID NO: 3117167 - RNA, 19 nt, Mycobacterium bovis subsp bovis AF2122/97
agcgcgugguaccgcuugu

SEQ ID NO: 3117168 - RNA, 16 nt, Mycobacterium bovis subsp bovis AF2122/97
agcgcgugugcgucgc

SEQ ID NO: 3117169 - RNA, 19 nt, Mycobacterium bovis subsp bovis AF2122/97
agcgcgugugcgucgcacg

SEQ ID NO: 3117170 - RNA, 23 nt, Mycobacterium bovis subsp bovis AF2122/97
agcgcguugagcucaauggcuuc

SEQ ID NO: 3117171 - RNA, 13 nt, Mycobacterium bovis subsp bovis AF2122/97
agcgcuaucaccg

SEQ ID NO: 3117172 - RNA, 17 nt, Mycobacterium bovis subsp bovis AF2122/97
agcgcuaucaccgccuc

SEQ ID NO: 3117173 - RNA, 20 nt, Mycobacterium bovis subsp bovis AF2122/97
agcgcucacauaagcgagga

SEQ ID NO: 3117174 - RNA, 24 nt, Mycobacterium bovis subsp bovis AF2122/97
agcgcuccagcacccgcgcgacgc

SEQ ID NO: 3117175 - RNA, 15 nt, Mycobacterium bovis subsp bovis AF2122/97
agcgcuccagccgcg

SEQ ID NO: 3117176 - RNA, 17 nt, Mycobacterium bovis subsp bovis AF2122/97
agcgcucgaucacggcg

SEQ ID NO: 3117177 - RNA, 20 nt, Mycobacterium bovis subsp bovis AF2122/97
agcgcucgaucacggcggga

SEQ ID NO: 3117178 - RNA, 14 nt, Mycobacterium bovis subsp bovis AF2122/97
agcgcucgaucagg

SEQ ID NO: 3117179 - RNA, 21 nt, Mycobacterium bovis subsp bovis AF2122/97
agcgcucguagaaucggcuca

SEQ ID NO: 3117180 - RNA, 14 nt, Mycobacterium bovis subsp bovis AF2122/97
agcgcugccaccgc

SEQ ID NO: 3117181 - RNA, 16 nt, Mycobacterium bovis subsp bovis AF2122/97
agcgcugccaccgcgg

SEQ ID NO: 3117182 - RNA, 17 nt, Mycobacterium bovis subsp bovis AF2122/97
agcgcugccaccgcggu

SEQ ID NO: 3117183 - RNA, 13 nt, Mycobacterium bovis subsp bovis AF2122/97
agcgcugcucccg

SEQ ID NO: 3117184 - RNA, 18 nt, Mycobacterium bovis subsp bovis AF2122/97
agcgcuggcaggccgggc

SEQ ID NO: 3117185 - RNA, 21 nt, Mycobacterium bovis subsp bovis AF2122/97
agcgcuggcaggccgggcacc

SEQ ID NO: 3117186 - RNA, 15 nt, Mycobacterium bovis subsp bovis AF2122/97
agcgcuucacgggcc

SEQ ID NO: 3117187 - RNA, 17 nt, Mycobacterium bovis subsp bovis AF2122/97
agcgcuucggcggucgc

SEQ ID NO: 3117188 - RNA, 17 nt, Mycobacterium bovis subsp bovis AF2122/97
agcgcuucgucggccgg

SEQ ID NO: 3117189 - RNA, 20 nt, Mycobacterium bovis subsp bovis AF2122/97
agcgcuucgucggccggcac

SEQ ID NO: 3117190 - RNA, 21 nt, Mycobacterium bovis subsp bovis AF2122/97
agcgcuucgucggccggcacc

SEQ ID NO: 3117191 - RNA, 22 nt, Mycobacterium bovis subsp bovis AF2122/97
agcgcuucgucggccggcaccc

SEQ ID NO: 3117192 - RNA, 23 nt, Mycobacterium bovis subsp bovis AF2122/97
agcgcuucgucggccggcacccc

SEQ ID NO: 3117193 - RNA, 14 nt, Mycobacterium bovis subsp bovis AF2122/97
agcgcuugacccgc

SEQ ID NO: 3117194 - RNA, 15 nt, Mycobacterium bovis subsp bovis AF2122/97
agcgcuugacccgcg

SEQ ID NO: 3117195 - RNA, 17 nt, Mycobacterium bovis subsp bovis AF2122/97
agcgcuuugaugccgau

SEQ ID NO: 3117196 - RNA, 17 nt, Mycobacterium bovis subsp bovis AF2122/97
agcgcuuuggucgucgg

SEQ ID NO: 3117197 - RNA, 15 nt, Mycobacterium bovis subsp bovis AF2122/97
agcggaagcgguuga

SEQ ID NO: 3117198 - RNA, 17 nt, Mycobacterium bovis subsp bovis AF2122/97
agcggaauccgaacgcg

SEQ ID NO: 3117199 - RNA, 18 nt, Mycobacterium bovis subsp bovis AF2122/97
agcggaauggaggccgcc

SEQ ID NO: 3117200 - RNA, 20 nt, Mycobacterium bovis subsp bovis AF2122/97
agcggaauggaggccgccga

SEQ ID NO: 3117201 - RNA, 14 nt, Mycobacterium bovis subsp bovis AF2122/97
agcggaauggcgcc

SEQ ID NO: 3117202 - RNA, 20 nt, Mycobacterium bovis subsp bovis AF2122/97
agcggacacauaagcccccg

SEQ ID NO: 3117203 - RNA, 14 nt, Mycobacterium bovis subsp bovis AF2122/97
agcggacagcucgc

SEQ ID NO: 3117204 - RNA, 16 nt, Mycobacterium bovis subsp bovis AF2122/97
agcggacagcucgcgg

SEQ ID NO: 3117205 - RNA, 22 nt, Mycobacterium bovis subsp bovis AF2122/97
agcggaccccacgaguagccgg

SEQ ID NO: 3117206 - RNA, 21 nt, Mycobacterium bovis subsp bovis AF2122/97
agcggacccgacagccgcugc

SEQ ID NO: 3117207 - RNA, 17 nt, Mycobacterium bovis subsp bovis AF2122/97
agcggacccgaccgucg

SEQ ID NO: 3117208 - RNA, 20 nt, Mycobacterium bovis subsp bovis AF2122/97
agcggacccgaccgucgucg

SEQ ID NO: 3117209 - RNA, 17 nt, Mycobacterium bovis subsp bovis AF2122/97
agcggaccgagccgauc

SEQ ID NO: 3117210 - RNA, 16 nt, Mycobacterium bovis subsp bovis AF2122/97
agcggaccgaugacga

SEQ ID NO: 3117211 - RNA, 17 nt, Mycobacterium bovis subsp bovis AF2122/97
agcggaccgaugacgau

SEQ ID NO: 3117212 - RNA, 19 nt, Mycobacterium bovis subsp bovis AF2122/97
agcggaccgcugccugccg

SEQ ID NO: 3117213 - RNA, 21 nt, Mycobacterium bovis subsp bovis AF2122/97
agcggacucgagucugcgcag

SEQ ID NO: 3117214 - RNA, 20 nt, Mycobacterium bovis subsp bovis AF2122/97
agcggagacgaucgccaggc

SEQ ID NO: 3117215 - RNA, 19 nt, Mycobacterium bovis subsp bovis AF2122/97
agcggagcaauuccacgau

SEQ ID NO: 3117216 - RNA, 19 nt, Mycobacterium bovis subsp bovis AF2122/97
agcggagccacucggcccg

SEQ ID NO: 3117217 - RNA, 21 nt, Mycobacterium bovis subsp bovis AF2122/97
agcggagccacucggcccggc

SEQ ID NO: 3117218 - RNA, 13 nt, Mycobacterium bovis subsp bovis AF2122/97
agcggagccggcg

SEQ ID NO: 3117219 - RNA, 14 nt, Mycobacterium bovis subsp bovis AF2122/97
agcggaguaaacaa

SEQ ID NO: 3117220 - RNA, 23 nt, Mycobacterium bovis subsp bovis AF2122/97
agcggaguaaacaaacccaacac

SEQ ID NO: 3117221 - RNA, 23 nt, Mycobacterium bovis subsp bovis AF2122/97
agcggauagcggcaaagccgggu

SEQ ID NO: 3117222 - RNA, 15 nt, Mycobacterium bovis subsp bovis AF2122/97
agcggaucaagcgca

SEQ ID NO: 3117223 - RNA, 22 nt, Mycobacterium bovis subsp bovis AF2122/97
agcggaucaggucuggcgcgga

SEQ ID NO: 3117224 - RNA, 16 nt, Mycobacterium bovis subsp bovis AF2122/97
agcggauccaggccuc

SEQ ID NO: 3117225 - RNA, 18 nt, Mycobacterium bovis subsp bovis AF2122/97
agcggauccaggccucgc

SEQ ID NO: 3117226 - RNA, 23 nt, Mycobacterium bovis subsp bovis AF2122/97
agcggauccaggccucgcaccgg

SEQ ID NO: 3117227 - RNA, 22 nt, Mycobacterium bovis subsp bovis AF2122/97
agcggaucccgccggugugccc

SEQ ID NO: 3117228 - RNA, 19 nt, Mycobacterium bovis subsp bovis AF2122/97
agcggauccgugucgcaga

SEQ ID NO: 3117229 - RNA, 13 nt, Mycobacterium bovis subsp bovis AF2122/97
agcggaucgcggu

SEQ ID NO: 3117230 - RNA, 15 nt, Mycobacterium bovis subsp bovis AF2122/97
agcggaucgcgguca

SEQ ID NO: 3117231 - RNA, 16 nt, Mycobacterium bovis subsp bovis AF2122/97
agcggaucgcggucag

SEQ ID NO: 3117232 - RNA, 22 nt, Mycobacterium bovis subsp bovis AF2122/97
agcggaucgcggucagcggguc

SEQ ID NO: 3117233 - RNA, 17 nt, Mycobacterium bovis subsp bovis AF2122/97
agcggauguccccgacg

SEQ ID NO: 3117234 - RNA, 20 nt, Mycobacterium bovis subsp bovis AF2122/97
agcggauuggccuugugcag

SEQ ID NO: 3117235 - RNA, 17 nt, Mycobacterium bovis subsp bovis AF2122/97
agcggcaacaugucacc

SEQ ID NO: 3117236 - RNA, 21 nt, Mycobacterium bovis subsp bovis AF2122/97
agcggcaacaugucaccugca

SEQ ID NO: 3117237 - RNA, 18 nt, Mycobacterium bovis subsp bovis AF2122/97
agcggcaacgaucgacac

SEQ ID NO: 3117238 - RNA, 20 nt, Mycobacterium bovis subsp bovis AF2122/97
agcggcaagaaguucuucgc

SEQ ID NO: 3117239 - RNA, 17 nt, Mycobacterium bovis subsp bovis AF2122/97
agcggcaauggccagca

SEQ ID NO: 3117240 - RNA, 20 nt, Mycobacterium bovis subsp bovis AF2122/97
agcggcggguagauccgccg

SEQ ID NO: 3117241 - RNA, 19 nt, Mycobacterium bovis subsp bovis AF2122/97
agcggcgggucccgccacc

SEQ ID NO: 3117242 - RNA, 17 nt, Mycobacterium bovis subsp bovis AF2122/97
agcggcggucucggcgu

SEQ ID NO: 3117243 - RNA, 23 nt, Mycobacterium bovis subsp bovis AF2122/97
agcggcggucucggcgucgacca

SEQ ID NO: 3117244 - RNA, 19 nt, Mycobacterium bovis subsp bovis AF2122/97
agcggcgguggugucgcuc

SEQ ID NO: 3117245 - RNA, 17 nt, Mycobacterium bovis subsp bovis AF2122/97
agcggcgucgucgucga

SEQ ID NO: 3117246 - RNA, 23 nt, Mycobacterium bovis subsp bovis AF2122/97
agcggcgugucguugccagggcg

SEQ ID NO: 3117247 - RNA, 18 nt, Mycobacterium bovis subsp bovis AF2122/97
agcggcguuccgggccga

SEQ ID NO: 3117248 - RNA, 23 nt, Mycobacterium bovis subsp bovis AF2122/97
agcggcguuccgggccgaucacc

SEQ ID NO: 3117249 - RNA, 14 nt, Mycobacterium bovis subsp bovis AF2122/97
agcggcucaccgcg

SEQ ID NO: 3117250 - RNA, 18 nt, Mycobacterium bovis subsp bovis AF2122/97
agcggcuccgaaggccgc

SEQ ID NO: 3117251 - RNA, 19 nt, Mycobacterium bovis subsp bovis AF2122/97
agcggcuccgaaggccgcc

SEQ ID NO: 3117252 - RNA, 17 nt, Mycobacterium bovis subsp bovis AF2122/97
agcggcucggcggcgcg

SEQ ID NO: 3117253 - RNA, 14 nt, Mycobacterium bovis subsp bovis AF2122/97
agcggcucggcggg

SEQ ID NO: 3117254 - RNA, 14 nt, Mycobacterium bovis subsp bovis AF2122/97
agcggcugaccggg

SEQ ID NO: 3117255 - RNA, 15 nt, Mycobacterium bovis subsp bovis AF2122/97
agcggcugaccgggc

SEQ ID NO: 3117256 - RNA, 13 nt, Mycobacterium bovis subsp bovis AF2122/97
agcggcugagccg

SEQ ID NO: 3117257 - RNA, 18 nt, Mycobacterium bovis subsp bovis AF2122/97
agcggcugcggcaacgag

SEQ ID NO: 3117258 - RNA, 21 nt, Mycobacterium bovis subsp bovis AF2122/97
agcggcugcggcaacgagguc

SEQ ID NO: 3117259 - RNA, 16 nt, Mycobacterium bovis subsp bovis AF2122/97
agcggcugcugcgcgg

SEQ ID NO: 3117260 - RNA, 16 nt, Mycobacterium bovis subsp bovis AF2122/97
agcggcuugcccaggc

SEQ ID NO: 3117261 - RNA, 19 nt, Mycobacterium bovis subsp bovis AF2122/97
agcggcuugcccaggcgca

SEQ ID NO: 3117262 - RNA, 15 nt, Mycobacterium bovis subsp bovis AF2122/97
agcggcuuggccggg

SEQ ID NO: 3117263 - RNA, 19 nt, Mycobacterium bovis subsp bovis AF2122/97
agcggcuuggccgggagug

SEQ ID NO: 3117264 - RNA, 23 nt, Mycobacterium bovis subsp bovis AF2122/97
agcggcuugggauuugggcgagu

SEQ ID NO: 3117265 - RNA, 22 nt, Mycobacterium bovis subsp bovis AF2122/97
agcgggauauggaugacaaacg

SEQ ID NO: 3117266 - RNA, 23 nt, Mycobacterium bovis subsp bovis AF2122/97
agcgggaucaugaccaucgaggc

SEQ ID NO: 3117267 - RNA, 16 nt, Mycobacterium bovis subsp bovis AF2122/97
agcgggaugagcucgu

SEQ ID NO: 3117268 - RNA, 13 nt, Mycobacterium bovis subsp bovis AF2122/97
agcgggauugccg

SEQ ID NO: 3117269 - RNA, 14 nt, Mycobacterium bovis subsp bovis AF2122/97
agcgggauugccga

SEQ ID NO: 3117270 - RNA, 22 nt, Mycobacterium bovis subsp bovis AF2122/97
agcgggauugccgagaacaccg

SEQ ID NO: 3117271 - RNA, 16 nt, Mycobacterium bovis subsp bovis AF2122/97
agcgggcaacugcagc

SEQ ID NO: 3117272 - RNA, 20 nt, Mycobacterium bovis subsp bovis AF2122/97
agcgggcaagaugaucgcgu

SEQ ID NO: 3117273 - RNA, 17 nt, Mycobacterium bovis subsp bovis AF2122/97
agcgggcaagucgccca

SEQ ID NO: 3117274 - RNA, 15 nt, Mycobacterium bovis subsp bovis AF2122/97
agcgggcacgccgcc

SEQ ID NO: 3117275 - RNA, 17 nt, Mycobacterium bovis subsp bovis AF2122/97
agcgggcgaugagcgcg

SEQ ID NO: 3117276 - RNA, 22 nt, Mycobacterium bovis subsp bovis AF2122/97
agcgggcgcccuugagccgccg

SEQ ID NO: 3117277 - RNA, 22 nt, Mycobacterium bovis subsp bovis AF2122/97
agcgggcgggccugcgcgaucc

SEQ ID NO: 3117278 - RNA, 13 nt, Mycobacterium bovis subsp bovis AF2122/97
agcgggcgucgcg

SEQ ID NO: 3117279 - RNA, 20 nt, Mycobacterium bovis subsp bovis AF2122/97
agcgggcuguaggcgaucac

SEQ ID NO: 3117280 - RNA, 17 nt, Mycobacterium bovis subsp bovis AF2122/97
agcgggggagcgaacgg

SEQ ID NO: 3117281 - RNA, 19 nt, Mycobacterium bovis subsp bovis AF2122/97
agcgggggagcgaacggcg

SEQ ID NO: 3117282 - RNA, 21 nt, Mycobacterium bovis subsp bovis AF2122/97
agcggggucuugacggcgcca

SEQ ID NO: 3117283 - RNA, 15 nt, Mycobacterium bovis subsp bovis AF2122/97
agcgggucagcucga

SEQ ID NO: 3117284 - RNA, 17 nt, Mycobacterium bovis subsp bovis AF2122/97
agcggguccccggucag

SEQ ID NO: 3117285 - RNA, 18 nt, Mycobacterium bovis subsp bovis AF2122/97
agcggguccccggucagg

SEQ ID NO: 3117286 - RNA, 20 nt, Mycobacterium bovis subsp bovis AF2122/97
agcggguccccggucaggac

SEQ ID NO: 3117287 - RNA, 13 nt, Mycobacterium bovis subsp bovis AF2122/97
agcggguccgacg

SEQ ID NO: 3117288 - RNA, 22 nt, Mycobacterium bovis subsp bovis AF2122/97
agcgggucgaccccggccagga

SEQ ID NO: 3117289 - RNA, 15 nt, Mycobacterium bovis subsp bovis AF2122/97
agcgggucgccgggc

SEQ ID NO: 3117290 - RNA, 18 nt, Mycobacterium bovis subsp bovis AF2122/97
agcgggugccagcccguu

SEQ ID NO: 3117291 - RNA, 23 nt, Mycobacterium bovis subsp bovis AF2122/97
agcgggugccagcccguugcagg

SEQ ID NO: 3117292 - RNA, 13 nt, Mycobacterium bovis subsp bovis AF2122/97
agcgggugccauc

SEQ ID NO: 3117293 - RNA, 21 nt, Mycobacterium bovis subsp bovis AF2122/97
agcgggugccaucgguggugg

SEQ ID NO: 3117294 - RNA, 22 nt, Mycobacterium bovis subsp bovis AF2122/97
agcgggugccaucggugguggc

SEQ ID NO: 3117295 - RNA, 14 nt, Mycobacterium bovis subsp bovis AF2122/97
agcgggugcgggcg

SEQ ID NO: 3117296 - RNA, 15 nt, Mycobacterium bovis subsp bovis AF2122/97
agcggguggccggga

SEQ ID NO: 3117297 - RNA, 19 nt, Mycobacterium bovis subsp bovis AF2122/97
agcggguucaacgcgcgca

SEQ ID NO: 3117298 - RNA, 21 nt, Mycobacterium bovis subsp bovis AF2122/97
agcggguucgacguugaucgc

SEQ ID NO: 3117299 - RNA, 23 nt, Mycobacterium bovis subsp bovis AF2122/97
agcggguucgacguugaucgcca

SEQ ID NO: 3117300 - RNA, 17 nt, Mycobacterium bovis subsp bovis AF2122/97
agcggguugcggucacc

SEQ ID NO: 3117301 - RNA, 21 nt, Mycobacterium bovis subsp bovis AF2122/97
agcggguugggaccgaacacg

SEQ ID NO: 3117302 - RNA, 14 nt, Mycobacterium bovis subsp bovis AF2122/97
agcgguaaugccag

SEQ ID NO: 3117303 - RNA, 18 nt, Mycobacterium bovis subsp bovis AF2122/97
agcgguacguaaucgagc

SEQ ID NO: 3117304 - RNA, 15 nt, Mycobacterium bovis subsp bovis AF2122/97
agcgguagccgagcu

SEQ ID NO: 3117305 - RNA, 17 nt, Mycobacterium bovis subsp bovis AF2122/97
agcgguagccgagcucg

SEQ ID NO: 3117306 - RNA, 18 nt, Mycobacterium bovis subsp bovis AF2122/97
agcgguagcucauugccg

SEQ ID NO: 3117307 - RNA, 15 nt, Mycobacterium bovis subsp bovis AF2122/97
agcgguaggagcggg

SEQ ID NO: 3117308 - RNA, 17 nt, Mycobacterium bovis subsp bovis AF2122/97
agcgguccagccaccgc

SEQ ID NO: 3117309 - RNA, 16 nt, Mycobacterium bovis subsp bovis AF2122/97
agcgguccagcgucgc

SEQ ID NO: 3117310 - RNA, 21 nt, Mycobacterium bovis subsp bovis AF2122/97
agcgguccagcgucgccgcca

SEQ ID NO: 3117311 - RNA, 12 nt, Mycobacterium bovis subsp bovis AF2122/97
agcggucgaucu

SEQ ID NO: 3117312 - RNA, 13 nt, Mycobacterium bovis subsp bovis AF2122/97
agcggucggcggu

SEQ ID NO: 3117313 - RNA, 17 nt, Mycobacterium bovis subsp bovis AF2122/97
agcggugaauucggcga

SEQ ID NO: 3117314 - RNA, 17 nt, Mycobacterium bovis subsp bovis AF2122/97
agcggugaggugaccaa

SEQ ID NO: 3117315 - RNA, 15 nt, Mycobacterium bovis subsp bovis AF2122/97
agcggugaugggggu

SEQ ID NO: 3117316 - RNA, 14 nt, Mycobacterium bovis subsp bovis AF2122/97
agcggugcagcccg

SEQ ID NO: 3117317 - RNA, 12 nt, Mycobacterium bovis subsp bovis AF2122/97
agcgguggacga

SEQ ID NO: 3117318 - RNA, 16 nt, Mycobacterium bovis subsp bovis AF2122/97
agcgguggcaagccua

SEQ ID NO: 3117319 - RNA, 22 nt, Mycobacterium bovis subsp bovis AF2122/97
agcgguggccucccacggcgcg

SEQ ID NO: 3117320 - RNA, 14 nt, Mycobacterium bovis subsp bovis AF2122/97
agcgguggcguggu

SEQ ID NO: 3117321 - RNA, 20 nt, Mycobacterium bovis subsp bovis AF2122/97
agcgguggugagugcgucuc

SEQ ID NO: 3117322 - RNA, 15 nt, Mycobacterium bovis subsp bovis AF2122/97
agcgguguagccggc

SEQ ID NO: 3117323 - RNA, 23 nt, Mycobacterium bovis subsp bovis AF2122/97
agcgguguugccggagacgucgc

SEQ ID NO: 3117324 - RNA, 14 nt, Mycobacterium bovis subsp bovis AF2122/97
agcgguugaaguug

SEQ ID NO: 3117325 - RNA, 16 nt, Mycobacterium bovis subsp bovis AF2122/97
agcgguugacccacag

SEQ ID NO: 3117326 - RNA, 17 nt, Mycobacterium bovis subsp bovis AF2122/97
agcucaccgacggagau

SEQ ID NO: 3117327 - RNA, 14 nt, Mycobacterium bovis subsp bovis AF2122/97
agcucaccgucgag

SEQ ID NO: 3117328 - RNA, 15 nt, Mycobacterium bovis subsp bovis AF2122/97
agcucaccgucgagg

SEQ ID NO: 3117329 - RNA, 22 nt, Mycobacterium bovis subsp bovis AF2122/97
agcucaccucaugaucucacca

SEQ ID NO: 3117330 - RNA, 13 nt, Mycobacterium bovis subsp bovis AF2122/97
agcucacgccggg

SEQ ID NO: 3117331 - RNA, 17 nt, Mycobacterium bovis subsp bovis AF2122/97
agcucacgcugaagccg

SEQ ID NO: 3117332 - RNA, 14 nt, Mycobacterium bovis subsp bovis AF2122/97
agcucacggcggaa

SEQ ID NO: 3117333 - RNA, 16 nt, Mycobacterium bovis subsp bovis AF2122/97
agcucacgugcugccg

SEQ ID NO: 3117334 - RNA, 18 nt, Mycobacterium bovis subsp bovis AF2122/97
agcucacgugcugccgau

SEQ ID NO: 3117335 - RNA, 17 nt, Mycobacterium bovis subsp bovis AF2122/97
agcucacuucacgccgc

SEQ ID NO: 3117336 - RNA, 15 nt, Mycobacterium bovis subsp bovis AF2122/97
agcucagaccggcgc

SEQ ID NO: 3117337 - RNA, 17 nt, Mycobacterium bovis subsp bovis AF2122/97
agcucagaccggcgccg

SEQ ID NO: 3117338 - RNA, 12 nt, Mycobacterium bovis subsp bovis AF2122/97
agcucagcugcg

SEQ ID NO: 3117339 - RNA, 19 nt, Mycobacterium bovis subsp bovis AF2122/97
agcucagugaugcgccccg

SEQ ID NO: 3117340 - RNA, 13 nt, Mycobacterium bovis subsp bovis AF2122/97
agcucaucgccgc

SEQ ID NO: 3117341 - RNA, 14 nt, Mycobacterium bovis subsp bovis AF2122/97
agcucaucgccgcu

SEQ ID NO: 3117342 - RNA, 17 nt, Mycobacterium bovis subsp bovis AF2122/97
agcucaucgccgcuacc

SEQ ID NO: 3117343 - RNA, 15 nt, Mycobacterium bovis subsp bovis AF2122/97
agcuccaaccaugcg

SEQ ID NO: 3117344 - RNA, 19 nt, Mycobacterium bovis subsp bovis AF2122/97
agcuccaaccaugcgguua

SEQ ID NO: 3117345 - RNA, 19 nt, Mycobacterium bovis subsp bovis AF2122/97
agcuccaccgugacggcca

SEQ ID NO: 3117346 - RNA, 20 nt, Mycobacterium bovis subsp bovis AF2122/97
agcuccaccgugacggccau

SEQ ID NO: 3117347 - RNA, 20 nt, Mycobacterium bovis subsp bovis AF2122/97
agcuccagcaaaacccgcuc

SEQ ID NO: 3117348 - RNA, 21 nt, Mycobacterium bovis subsp bovis AF2122/97
agcuccagcaaaacccgcucc

SEQ ID NO: 3117349 - RNA, 12 nt, Mycobacterium bovis subsp bovis AF2122/97
agcuccccgacc

SEQ ID NO: 3117350 - RNA, 16 nt, Mycobacterium bovis subsp bovis AF2122/97
agcuccccgaccgaac

SEQ ID NO: 3117351 - RNA, 19 nt, Mycobacterium bovis subsp bovis AF2122/97
agcucccgccacgucgccg

SEQ ID NO: 3117352 - RNA, 21 nt, Mycobacterium bovis subsp bovis AF2122/97
agcucccgccacgucgccggc

SEQ ID NO: 3117353 - RNA, 21 nt, Mycobacterium bovis subsp bovis AF2122/97
agcucccugggcgucgaccac

SEQ ID NO: 3117354 - RNA, 15 nt, Mycobacterium bovis subsp bovis AF2122/97
agcuccgccgccgac

SEQ ID NO: 3117355 - RNA, 13 nt, Mycobacterium bovis subsp bovis AF2122/97
agcuccgcgcagc

SEQ ID NO: 3117356 - RNA, 19 nt, Mycobacterium bovis subsp bovis AF2122/97
agcuccgcgcagccaggga

SEQ ID NO: 3117357 - RNA, 16 nt, Mycobacterium bovis subsp bovis AF2122/97
agcuccgggucgacga

SEQ ID NO: 3117358 - RNA, 19 nt, Mycobacterium bovis subsp bovis AF2122/97
agcuccgggugcagaucgc

SEQ ID NO: 3117359 - RNA, 19 nt, Mycobacterium bovis subsp bovis AF2122/97
agcuccgucgcggccgaga

SEQ ID NO: 3117360 - RNA, 19 nt, Mycobacterium bovis subsp bovis AF2122/97
agcuccgugacaccgggga

SEQ ID NO: 3117361 - RNA, 22 nt, Mycobacterium bovis subsp bovis AF2122/97
agcuccguggugcuagcgccgc

SEQ ID NO: 3117362 - RNA, 24 nt, Mycobacterium bovis subsp bovis AF2122/97
agcuccguggugcuagcgccgcca

SEQ ID NO: 3117363 - RNA, 14 nt, Mycobacterium bovis subsp bovis AF2122/97
agcuccugcaugcc

SEQ ID NO: 3117364 - RNA, 15 nt, Mycobacterium bovis subsp bovis AF2122/97
agcuccugcaugccg

SEQ ID NO: 3117365 - RNA, 20 nt, Mycobacterium bovis subsp bovis AF2122/97
agcuccuguaacugcuccug

SEQ ID NO: 3117366 - RNA, 15 nt, Mycobacterium bovis subsp bovis AF2122/97
agcuccuugagcaau

SEQ ID NO: 3117367 - RNA, 20 nt, Mycobacterium bovis subsp bovis AF2122/97
agcucgaacagcucgaucag

SEQ ID NO: 3117368 - RNA, 22 nt, Mycobacterium bovis subsp bovis AF2122/97
agcucgaacagguuggccccgg

SEQ ID NO: 3117369 - RNA, 15 nt, Mycobacterium bovis subsp bovis AF2122/97
agcucgaagcccgga

SEQ ID NO: 3117370 - RNA, 17 nt, Mycobacterium bovis subsp bovis AF2122/97
agcucgacaacugcccg

SEQ ID NO: 3117371 - RNA, 18 nt, Mycobacterium bovis subsp bovis AF2122/97
agcucgacaacugcccga

SEQ ID NO: 3117372 - RNA, 17 nt, Mycobacterium bovis subsp bovis AF2122/97
agcucgaccgcccggcu

SEQ ID NO: 3117373 - RNA, 13 nt, Mycobacterium bovis subsp bovis AF2122/97
agcucgaggacca

SEQ ID NO: 3117374 - RNA, 16 nt, Mycobacterium bovis subsp bovis AF2122/97
agcucgaggaccaccu

SEQ ID NO: 3117375 - RNA, 22 nt, Mycobacterium bovis subsp bovis AF2122/97
agcucgaggaccaccuggucgc

SEQ ID NO: 3117376 - RNA, 14 nt, Mycobacterium bovis subsp bovis AF2122/97
agcucgauacccag

SEQ ID NO: 3117377 - RNA, 19 nt, Mycobacterium bovis subsp bovis AF2122/97
agcucgauacccaggaugu

SEQ ID NO: 3117378 - RNA, 22 nt, Mycobacterium bovis subsp bovis AF2122/97
agcucgaucagccgggugcgca

SEQ ID NO: 3117379 - RNA, 13 nt, Mycobacterium bovis subsp bovis AF2122/97
agcucgaugccgu

SEQ ID NO: 3117380 - RNA, 14 nt, Mycobacterium bovis subsp bovis AF2122/97
agcucgaugccgug

SEQ ID NO: 3117381 - RNA, 15 nt, Mycobacterium bovis subsp bovis AF2122/97
agcucgccgcagcgu

SEQ ID NO: 3117382 - RNA, 18 nt, Mycobacterium bovis subsp bovis AF2122/97
agcucgccggcacgcagc

SEQ ID NO: 3117383 - RNA, 12 nt, Mycobacterium bovis subsp bovis AF2122/97
agcucgccggcg

SEQ ID NO: 3117384 - RNA, 13 nt, Mycobacterium bovis subsp bovis AF2122/97
agcucgccggcga

SEQ ID NO: 3117385 - RNA, 16 nt, Mycobacterium bovis subsp bovis AF2122/97
agcucgccgugaccag

SEQ ID NO: 3117386 - RNA, 18 nt, Mycobacterium bovis subsp bovis AF2122/97
agcucgcgcacgucgacg

SEQ ID NO: 3117387 - RNA, 18 nt, Mycobacterium bovis subsp bovis AF2122/97
agcucgcgcucgcucacg

SEQ ID NO: 3117388 - RNA, 20 nt, Mycobacterium bovis subsp bovis AF2122/97
agcucgcgcugugccgugcg

SEQ ID NO: 3117389 - RNA, 18 nt, Mycobacterium bovis subsp bovis AF2122/97
agcucgcggugggcuucc

SEQ ID NO: 3117390 - RNA, 20 nt, Mycobacterium bovis subsp bovis AF2122/97
agcucgcugacggcaaacga

SEQ ID NO: 3117391 - RNA, 22 nt, Mycobacterium bovis subsp bovis AF2122/97
agcucggcagcaucuccgucgg

SEQ ID NO: 3117392 - RNA, 24 nt, Mycobacterium bovis subsp bovis AF2122/97
agcucggcagcaucuccgucggcc

SEQ ID NO: 3117393 - RNA, 20 nt, Mycobacterium bovis subsp bovis AF2122/97
agcucggccaccagcgcccg

SEQ ID NO: 3117394 - RNA, 23 nt, Mycobacterium bovis subsp bovis AF2122/97
agcucggccaccagcgcccggcc

SEQ ID NO: 3117395 - RNA, 24 nt, Mycobacterium bovis subsp bovis AF2122/97
agcucggccagcacgccgccggcc

SEQ ID NO: 3117396 - RNA, 19 nt, Mycobacterium bovis subsp bovis AF2122/97
agcucggccaggcuggcca

SEQ ID NO: 3117397 - RNA, 17 nt, Mycobacterium bovis subsp bovis AF2122/97
agcucggccccgccgcc

SEQ ID NO: 3117398 - RNA, 22 nt, Mycobacterium bovis subsp bovis AF2122/97
agcucggccccgccgccggugc

SEQ ID NO: 3117399 - RNA, 16 nt, Mycobacterium bovis subsp bovis AF2122/97
agcucggcccuguucg

SEQ ID NO: 3117400 - RNA, 22 nt, Mycobacterium bovis subsp bovis AF2122/97
agcucggccugaagcuugucca

SEQ ID NO: 3117401 - RNA, 19 nt, Mycobacterium bovis subsp bovis AF2122/97
agcucggcgaacggcacca

SEQ ID NO: 3117402 - RNA, 23 nt, Mycobacterium bovis subsp bovis AF2122/97
agcucggcgaugcugagccgguc

SEQ ID NO: 3117403 - RNA, 14 nt, Mycobacterium bovis subsp bovis AF2122/97
agcucggcggcagc

SEQ ID NO: 3117404 - RNA, 16 nt, Mycobacterium bovis subsp bovis AF2122/97
agcucggcggcagcgg

SEQ ID NO: 3117405 - RNA, 15 nt, Mycobacterium bovis subsp bovis AF2122/97
agcucggcugcucga

SEQ ID NO: 3117406 - RNA, 18 nt, Mycobacterium bovis subsp bovis AF2122/97
agcucgggcagggaccgc

SEQ ID NO: 3117407 - RNA, 15 nt, Mycobacterium bovis subsp bovis AF2122/97
agcucgggcgcacgg

SEQ ID NO: 3117408 - RNA, 16 nt, Mycobacterium bovis subsp bovis AF2122/97
agcucggggcgaugag

SEQ ID NO: 3117409 - RNA, 19 nt, Mycobacterium bovis subsp bovis AF2122/97
agcucgggggcgccggcgc

SEQ ID NO: 3117410 - RNA, 20 nt, Mycobacterium bovis subsp bovis AF2122/97
agcucgggugcgaacaacgc

SEQ ID NO: 3117411 - RNA, 18 nt, Mycobacterium bovis subsp bovis AF2122/97
agcucggucaccacggcg

SEQ ID NO: 3117412 - RNA, 19 nt, Mycobacterium bovis subsp bovis AF2122/97
agcuggcgcgcgggguggc

SEQ ID NO: 3117413 - RNA, 20 nt, Mycobacterium bovis subsp bovis AF2122/97
agcuggcuacgggccgcucc

SEQ ID NO: 3117414 - RNA, 15 nt, Mycobacterium bovis subsp bovis AF2122/97
agcugggcaccccgu

SEQ ID NO: 3117415 - RNA, 24 nt, Mycobacterium bovis subsp bovis AF2122/97
agcugggcaucaucagcggcgccg

SEQ ID NO: 3117416 - RNA, 14 nt, Mycobacterium bovis subsp bovis AF2122/97
agcugggcugaugg

SEQ ID NO: 3117417 - RNA, 19 nt, Mycobacterium bovis subsp bovis AF2122/97
agcuggggaacagcagcgc

SEQ ID NO: 3117418 - RNA, 12 nt, Mycobacterium bovis subsp bovis AF2122/97
agcugggucccg

SEQ ID NO: 3117419 - RNA, 22 nt, Mycobacterium bovis subsp bovis AF2122/97
agcugggugaccucgucgaccg

SEQ ID NO: 3117420 - RNA, 13 nt, Mycobacterium bovis subsp bovis AF2122/97
agcugggugcgcc

SEQ ID NO: 3117421 - RNA, 18 nt, Mycobacterium bovis subsp bovis AF2122/97
agcugguaaacgggugga

SEQ ID NO: 3117422 - RNA, 19 nt, Mycobacterium bovis subsp bovis AF2122/97
agcugguaggucaccgguc

SEQ ID NO: 3117423 - RNA, 22 nt, Mycobacterium bovis subsp bovis AF2122/97
agcugguaggucaccggucacc

SEQ ID NO: 3117424 - RNA, 22 nt, Mycobacterium bovis subsp bovis AF2122/97
agcuggucccacaccuccucga

SEQ ID NO: 3117425 - RNA, 19 nt, Mycobacterium bovis subsp bovis AF2122/97
agcugguccuccaaggcgg

SEQ ID NO: 3117426 - RNA, 23 nt, Mycobacterium bovis subsp bovis AF2122/97
agcugguccuccaaggcggucac

SEQ ID NO: 3117427 - RNA, 20 nt, Mycobacterium bovis subsp bovis AF2122/97
agcuggucggcuucggggua

SEQ ID NO: 3117428 - RNA, 22 nt, Mycobacterium bovis subsp bovis AF2122/97
agcuggugaucagcucagugau

SEQ ID NO: 3117429 - RNA, 21 nt, Mycobacterium bovis subsp bovis AF2122/97
agcuggugcagaauucggcgc

SEQ ID NO: 3117430 - RNA, 15 nt, Mycobacterium bovis subsp bovis AF2122/97
agcugguugacggcg

SEQ ID NO: 3117431 - RNA, 16 nt, Mycobacterium bovis subsp bovis AF2122/97
agcugguugacggcga

SEQ ID NO: 3117432 - RNA, 15 nt, Mycobacterium bovis subsp bovis AF2122/97
agcugguuggcgccg

SEQ ID NO: 3117433 - RNA, 15 nt, Mycobacterium bovis subsp bovis AF2122/97
agcugguugugcugg

SEQ ID NO: 3117434 - RNA, 18 nt, Mycobacterium bovis subsp bovis AF2122/97
agcugguuugcggugccc

SEQ ID NO: 3117435 - RNA, 20 nt, Mycobacterium bovis subsp bovis AF2122/97
agcuguacauacucugcgac

SEQ ID NO: 3117436 - RNA, 22 nt, Mycobacterium bovis subsp bovis AF2122/97
agcugucccucgggaucaccga

SEQ ID NO: 3117437 - RNA, 15 nt, Mycobacterium bovis subsp bovis AF2122/97
agcugucgaccgcga

SEQ ID NO: 3117438 - RNA, 19 nt, Mycobacterium bovis subsp bovis AF2122/97
agcugucgaccgcgaucac

SEQ ID NO: 3117439 - RNA, 17 nt, Mycobacterium bovis subsp bovis AF2122/97
agcugucgccuuugagg

SEQ ID NO: 3117440 - RNA, 20 nt, Mycobacterium bovis subsp bovis AF2122/97
agcugucggcuuccuccucg

SEQ ID NO: 3117441 - RNA, 15 nt, Mycobacterium bovis subsp bovis AF2122/97
agcugucgucgcccc

SEQ ID NO: 3117442 - RNA, 20 nt, Mycobacterium bovis subsp bovis AF2122/97
agcugugaacaggccgaggc

SEQ ID NO: 3117443 - RNA, 12 nt, Mycobacterium bovis subsp bovis AF2122/97
agcugugguggu

SEQ ID NO: 3117444 - RNA, 17 nt, Mycobacterium bovis subsp bovis AF2122/97
agcugugguggugaugg

SEQ ID NO: 3117445 - RNA, 15 nt, Mycobacterium bovis subsp bovis AF2122/97
agcuguugaccgugu

SEQ ID NO: 3117446 - RNA, 21 nt, Mycobacterium bovis subsp bovis AF2122/97
agcuguuggcguggaucuugg

SEQ ID NO: 3117447 - RNA, 15 nt, Mycobacterium bovis subsp bovis AF2122/97
agcuguuugccggcu

SEQ ID NO: 3117448 - RNA, 21 nt, Mycobacterium bovis subsp bovis AF2122/97
agcuuaggugugguucccggc

SEQ ID NO: 3117449 - RNA, 16 nt, Mycobacterium bovis subsp bovis AF2122/97
agcuucaacaccggca

SEQ ID NO: 3117450 - RNA, 18 nt, Mycobacterium bovis subsp bovis AF2122/97
agcuucaacaccggcauc

SEQ ID NO: 3117451 - RNA, 13 nt, Mycobacterium bovis subsp bovis AF2122/97
agcuucaaugucg

SEQ ID NO: 3117452 - RNA, 21 nt, Mycobacterium bovis subsp bovis AF2122/97
agcuucccgguagcggcggca

SEQ ID NO: 3117453 - RNA, 23 nt, Mycobacterium bovis subsp bovis AF2122/97
agcuuccgcgacgcucgcugcag

SEQ ID NO: 3117454 - RNA, 12 nt, Mycobacterium bovis subsp bovis AF2122/97
agcuuccgcgcg

SEQ ID NO: 3117455 - RNA, 17 nt, Mycobacterium bovis subsp bovis AF2122/97
agcuuccgguccagcgg

SEQ ID NO: 3117456 - RNA, 15 nt, Mycobacterium bovis subsp bovis AF2122/97
agcuucgcgcagccg

SEQ ID NO: 3117457 - RNA, 16 nt, Mycobacterium bovis subsp bovis AF2122/97
agcuucgcgcagccgg

SEQ ID NO: 3117458 - RNA, 15 nt, Mycobacterium bovis subsp bovis AF2122/97
agcuugacaacccug

SEQ ID NO: 3117459 - RNA, 18 nt, Mycobacterium bovis subsp bovis AF2122/97
agcuugacaucggucagc

SEQ ID NO: 3117460 - RNA, 23 nt, Mycobacterium bovis subsp bovis AF2122/97
agcuugacccacgagagcgcugu

SEQ ID NO: 3117461 - RNA, 16 nt, Mycobacterium bovis subsp bovis AF2122/97
agcuugacguugccgg

SEQ ID NO: 3117462 - RNA, 17 nt, Mycobacterium bovis subsp bovis AF2122/97
agcuugagcgugagcgc

SEQ ID NO: 3117463 - RNA, 19 nt, Mycobacterium bovis subsp bovis AF2122/97
agcuugagcgugagcgccg

SEQ ID NO: 3117464 - RNA, 18 nt, Mycobacterium bovis subsp bovis AF2122/97
agcuugaucccauccaga

SEQ ID NO: 3117465 - RNA, 16 nt, Mycobacterium bovis subsp bovis AF2122/97
agcuugaucgccgagg

SEQ ID NO: 3117466 - RNA, 16 nt, Mycobacterium bovis subsp bovis AF2122/97
agcuugcagugccgcc

SEQ ID NO: 3117467 - RNA, 17 nt, Mycobacterium bovis subsp bovis AF2122/97
agcuugccaaucaccgu

SEQ ID NO: 3117468 - RNA, 16 nt, Mycobacterium bovis subsp bovis AF2122/97
agcuugcccgacggcg

SEQ ID NO: 3117469 - RNA, 15 nt, Mycobacterium bovis subsp bovis AF2122/97
agcuugccgucgcug

SEQ ID NO: 3117470 - RNA, 18 nt, Mycobacterium bovis subsp bovis AF2122/97
agcuugccgucgcugacg

SEQ ID NO: 3117471 - RNA, 13 nt, Mycobacterium bovis subsp bovis AF2122/97
agcuugcgccgca

SEQ ID NO: 3117472 - RNA, 19 nt, Mycobacterium bovis subsp bovis AF2122/97
agcuugcggccgaauuccu

SEQ ID NO: 3117473 - RNA, 15 nt, Mycobacterium bovis subsp bovis AF2122/97
agcuuggacucaucg

SEQ ID NO: 3117474 - RNA, 20 nt, Mycobacterium bovis subsp bovis AF2122/97
agcuuggagaucgccgccgg

SEQ ID NO: 3117475 - RNA, 22 nt, Mycobacterium bovis subsp bovis AF2122/97
agcuuggccgguucaggggugg

SEQ ID NO: 3117476 - RNA, 23 nt, Mycobacterium bovis subsp bovis AF2122/97
agcuuggccgguucagggguggc

SEQ ID NO: 3117477 - RNA, 15 nt, Mycobacterium bovis subsp bovis AF2122/97
agcuuggcggccagc

SEQ ID NO: 3117478 - RNA, 15 nt, Mycobacterium bovis subsp bovis AF2122/97
agcuuggcgucgaug

SEQ ID NO: 3117479 - RNA, 18 nt, Mycobacterium bovis subsp bovis AF2122/97
agcuuggcgucgaugcgg

SEQ ID NO: 3117480 - RNA, 21 nt, Mycobacterium bovis subsp bovis AF2122/97
agcuugggccggugcagcacg

SEQ ID NO: 3117481 - RNA, 15 nt, Mycobacterium bovis subsp bovis AF2122/97
agcuugggcgaucgu

SEQ ID NO: 3117482 - RNA, 14 nt, Mycobacterium bovis subsp bovis AF2122/97
agcuuggucgccgg

SEQ ID NO: 3117483 - RNA, 15 nt, Mycobacterium bovis subsp bovis AF2122/97
agcuuggucgccggg

SEQ ID NO: 3117484 - RNA, 16 nt, Mycobacterium bovis subsp bovis AF2122/97
agcuuguagcgcucgu

SEQ ID NO: 3117485 - RNA, 13 nt, Mycobacterium bovis subsp bovis AF2122/97
agcuuguccagau

SEQ ID NO: 3117486 - RNA, 14 nt, Mycobacterium bovis subsp bovis AF2122/97
agcuugucgagcag

SEQ ID NO: 3117487 - RNA, 15 nt, Mycobacterium bovis subsp bovis AF2122/97
agcuugucgggcacc

SEQ ID NO: 3117488 - RNA, 20 nt, Mycobacterium bovis subsp bovis AF2122/97
agcuuguuuuccaccagcga

SEQ ID NO: 3117489 - RNA, 16 nt, Mycobacterium bovis subsp bovis AF2122/97
agcuuuaucugcaugc

SEQ ID NO: 3117490 - RNA, 20 nt, Mycobacterium bovis subsp bovis AF2122/97
aggaaaaccccggccaccag

SEQ ID NO: 3117491 - RNA, 17 nt, Mycobacterium bovis subsp bovis AF2122/97
aggaacaacgcgcaacc

SEQ ID NO: 3117492 - RNA, 16 nt, Mycobacterium bovis subsp bovis AF2122/97
aggaacaggcaaagua

SEQ ID NO: 3117493 - RNA, 21 nt, Mycobacterium bovis subsp bovis AF2122/97
aggaaccacccaccggccacc

SEQ ID NO: 3117494 - RNA, 23 nt, Mycobacterium bovis subsp bovis AF2122/97
aggaaccacccaccggccaccag

SEQ ID NO: 3117495 - RNA, 19 nt, Mycobacterium bovis subsp bovis AF2122/97
aggaaccgaucggucgauc

SEQ ID NO: 3117496 - RNA, 11 nt, Mycobacterium bovis subsp bovis AF2122/97
aggaaccgggc

SEQ ID NO: 3117497 - RNA, 18 nt, Mycobacterium bovis subsp bovis AF2122/97
aggaaccgggcaaaucaa

SEQ ID NO: 3117498 - RNA, 18 nt, Mycobacterium bovis subsp bovis AF2122/97
aggagauccuuaucgcuc

SEQ ID NO: 3117499 - RNA, 22 nt, Mycobacterium bovis subsp bovis AF2122/97
aggagaucucugagcgggcggg

SEQ ID NO: 3117500 - RNA, 12 nt, Mycobacterium bovis subsp bovis AF2122/97
aggagaugccga

SEQ ID NO: 3117501 - RNA, 16 nt, Mycobacterium bovis subsp bovis AF2122/97
aggagcagcacgucga

SEQ ID NO: 3117502 - RNA, 22 nt, Mycobacterium bovis subsp bovis AF2122/97
aggagcagggcucguccaucag

SEQ ID NO: 3117503 - RNA, 19 nt, Mycobacterium bovis subsp bovis AF2122/97
aggagcccguccaggcccg

SEQ ID NO: 3117504 - RNA, 23 nt, Mycobacterium bovis subsp bovis AF2122/97
aggagccggcaaccgacucgaca

SEQ ID NO: 3117505 - RNA, 13 nt, Mycobacterium bovis subsp bovis AF2122/97
aggagccgucacg

SEQ ID NO: 3117506 - RNA, 16 nt, Mycobacterium bovis subsp bovis AF2122/97
aggagccgucacgccg

SEQ ID NO: 3117507 - RNA, 14 nt, Mycobacterium bovis subsp bovis AF2122/97
aggagcgcggcccg

SEQ ID NO: 3117508 - RNA, 16 nt, Mycobacterium bovis subsp bovis AF2122/97
aggagcgggugcauuc

SEQ ID NO: 3117509 - RNA, 23 nt, Mycobacterium bovis subsp bovis AF2122/97
aggagcgugucggccggccaggu

SEQ ID NO: 3117510 - RNA, 17 nt, Mycobacterium bovis subsp bovis AF2122/97
aggagguuguagucaga

SEQ ID NO: 3117511 - RNA, 22 nt, Mycobacterium bovis subsp bovis AF2122/97
aggagugguacggcucggcgcu

SEQ ID NO: 3117512 - RNA, 21 nt, Mycobacterium bovis subsp bovis AF2122/97
aggauagggcuuugucaccgg

SEQ ID NO: 3117513 - RNA, 22 nt, Mycobacterium bovis subsp bovis AF2122/97
aggauagggcuuugucaccggc

SEQ ID NO: 3117514 - RNA, 15 nt, Mycobacterium bovis subsp bovis AF2122/97
aggauaucgccgaga

SEQ ID NO: 3117515 - RNA, 12 nt, Mycobacterium bovis subsp bovis AF2122/97
aggaucagcccg

SEQ ID NO: 3117516 - RNA, 16 nt, Mycobacterium bovis subsp bovis AF2122/97
aggaucagcgcacugg

SEQ ID NO: 3117517 - RNA, 16 nt, Mycobacterium bovis subsp bovis AF2122/97
aggaucaguacgcugc

SEQ ID NO: 3117518 - RNA, 20 nt, Mycobacterium bovis subsp bovis AF2122/97
aggaucauguccaucgcgcg

SEQ ID NO: 3117519 - RNA, 17 nt, Mycobacterium bovis subsp bovis AF2122/97
aggaucccgccgcugcc

SEQ ID NO: 3117520 - RNA, 19 nt, Mycobacterium bovis subsp bovis AF2122/97
aggaucccgguggcagcac

SEQ ID NO: 3117521 - RNA, 21 nt, Mycobacterium bovis subsp bovis AF2122/97
aggaucgaggcgucggcaacc

SEQ ID NO: 3117522 - RNA, 19 nt, Mycobacterium bovis subsp bovis AF2122/97
aggaucgcaaugccgugcg

SEQ ID NO: 3117523 - RNA, 22 nt, Mycobacterium bovis subsp bovis AF2122/97
aggaucgccugagcgccgcggc

SEQ ID NO: 3117524 - RNA, 18 nt, Mycobacterium bovis subsp bovis AF2122/97
aggaucgcgcccaccgau

SEQ ID NO: 3117525 - RNA, 24 nt, Mycobacterium bovis subsp bovis AF2122/97
aggaucgcggcgccgucgucagcg

SEQ ID NO: 3117526 - RNA, 16 nt, Mycobacterium bovis subsp bovis AF2122/97
aggaucgcuacgucga

SEQ ID NO: 3117527 - RNA, 20 nt, Mycobacterium bovis subsp bovis AF2122/97
aggaucggcuugggaaaccc

SEQ ID NO: 3117528 - RNA, 19 nt, Mycobacterium bovis subsp bovis AF2122/97
aggaugagcgcuucugcgu

SEQ ID NO: 3117529 - RNA, 13 nt, Mycobacterium bovis subsp bovis AF2122/97
aggaugaugaccg

SEQ ID NO: 3117530 - RNA, 18 nt, Mycobacterium bovis subsp bovis AF2122/97
aggaugccgaaccgcgcg

SEQ ID NO: 3117531 - RNA, 22 nt, Mycobacterium bovis subsp bovis AF2122/97
aggaugcgcaacaccucaccgc

SEQ ID NO: 3117532 - RNA, 12 nt, Mycobacterium bovis subsp bovis AF2122/97
aggaugcugagc

SEQ ID NO: 3117533 - RNA, 21 nt, Mycobacterium bovis subsp bovis AF2122/97
aggaugcugagcgccaggccg

SEQ ID NO: 3117534 - RNA, 22 nt, Mycobacterium bovis subsp bovis AF2122/97
aggaugcugagcgccaggccgc

SEQ ID NO: 3117535 - RNA, 19 nt, Mycobacterium bovis subsp bovis AF2122/97
aggauggugcggccgcggc

SEQ ID NO: 3117536 - RNA, 19 nt, Mycobacterium bovis subsp bovis AF2122/97
aggaugucgagcccgucga

SEQ ID NO: 3117537 - RNA, 23 nt, Mycobacterium bovis subsp bovis AF2122/97
aggauucccucgacagugcugcc

SEQ ID NO: 3117538 - RNA, 14 nt, Mycobacterium bovis subsp bovis AF2122/97
aggauucugcugac

SEQ ID NO: 3117539 - RNA, 14 nt, Mycobacterium bovis subsp bovis AF2122/97
aggauugccgagcg

SEQ ID NO: 3117540 - RNA, 18 nt, Mycobacterium bovis subsp bovis AF2122/97
aggauuugauaggcgcgc

SEQ ID NO: 3117541 - RNA, 13 nt, Mycobacterium bovis subsp bovis AF2122/97
aggcaaacaccag

SEQ ID NO: 3117542 - RNA, 13 nt, Mycobacterium bovis subsp bovis AF2122/97
aggcaagccagca

SEQ ID NO: 3117543 - RNA, 22 nt, Mycobacterium bovis subsp bovis AF2122/97
aggcaaugcccgaccggucugg

SEQ ID NO: 3117544 - RNA, 23 nt, Mycobacterium bovis subsp bovis AF2122/97
aggcaaugcgagcacccguugau

SEQ ID NO: 3117545 - RNA, 18 nt, Mycobacterium bovis subsp bovis AF2122/97
aggcacaacaucgccgca

SEQ ID NO: 3117546 - RNA, 20 nt, Mycobacterium bovis subsp bovis AF2122/97
aggcacaacaucgccgcagu

SEQ ID NO: 3117547 - RNA, 19 nt, Mycobacterium bovis subsp bovis AF2122/97
aggcacaucgcgaaaccgg

SEQ ID NO: 3117548 - RNA, 16 nt, Mycobacterium bovis subsp bovis AF2122/97
aggcaccccgaucacc

SEQ ID NO: 3117549 - RNA, 20 nt, Mycobacterium bovis subsp bovis AF2122/97
aggcaccccgaucacccgca

SEQ ID NO: 3117550 - RNA, 21 nt, Mycobacterium bovis subsp bovis AF2122/97
aggcaccgaaaaacaccagcg

SEQ ID NO: 3117551 - RNA, 18 nt, Mycobacterium bovis subsp bovis AF2122/97
aggcaccgaucggugccg

SEQ ID NO: 3117552 - RNA, 21 nt, Mycobacterium bovis subsp bovis AF2122/97
aggcaccggaugauguggugu

SEQ ID NO: 3117553 - RNA, 21 nt, Mycobacterium bovis subsp bovis AF2122/97
aggcaccuauagggacgugcc

SEQ ID NO: 3117554 - RNA, 13 nt, Mycobacterium bovis subsp bovis AF2122/97
aggcacggguguu

SEQ ID NO: 3117555 - RNA, 12 nt, Mycobacterium bovis subsp bovis AF2122/97
aggcacgucgaa

SEQ ID NO: 3117556 - RNA, 15 nt, Mycobacterium bovis subsp bovis AF2122/97
aggcagcgaccgucg

SEQ ID NO: 3117557 - RNA, 17 nt, Mycobacterium bovis subsp bovis AF2122/97
aggcagcguagugcugc

SEQ ID NO: 3117558 - RNA, 20 nt, Mycobacterium bovis subsp bovis AF2122/97
aggcagcguagugcugcgcg

SEQ ID NO: 3117559 - RNA, 19 nt, Mycobacterium bovis subsp bovis AF2122/97
aggcagcgucgucgacgac

SEQ ID NO: 3117560 - RNA, 15 nt, Mycobacterium bovis subsp bovis AF2122/97
aggcagcuccgccgc

SEQ ID NO: 3117561 - RNA, 22 nt, Mycobacterium bovis subsp bovis AF2122/97
aggcagcuugccaaucaccgua

SEQ ID NO: 3117562 - RNA, 15 nt, Mycobacterium bovis subsp bovis AF2122/97
aggcaggccggcucg

SEQ ID NO: 3117563 - RNA, 21 nt, Mycobacterium bovis subsp bovis AF2122/97
aggcagguuggccaccgccca

SEQ ID NO: 3117564 - RNA, 13 nt, Mycobacterium bovis subsp bovis AF2122/97
aggcaucaccgga

SEQ ID NO: 3117565 - RNA, 16 nt, Mycobacterium bovis subsp bovis AF2122/97
aggcauucgagcacgu

SEQ ID NO: 3117566 - RNA, 22 nt, Mycobacterium bovis subsp bovis AF2122/97
aggcauuggugaguagauugcu

SEQ ID NO: 3117567 - RNA, 20 nt, Mycobacterium bovis subsp bovis AF2122/97
aggccaaccacagccucgua

SEQ ID NO: 3117568 - RNA, 16 nt, Mycobacterium bovis subsp bovis AF2122/97
aggccaacccugcggc

SEQ ID NO: 3117569 - RNA, 13 nt, Mycobacterium bovis subsp bovis AF2122/97
aggccaaccgguu

SEQ ID NO: 3117570 - RNA, 14 nt, Mycobacterium bovis subsp bovis AF2122/97
aggccaagccgcgg

SEQ ID NO: 3117571 - RNA, 20 nt, Mycobacterium bovis subsp bovis AF2122/97
aggccaagguggccaccaaa

SEQ ID NO: 3117572 - RNA, 21 nt, Mycobacterium bovis subsp bovis AF2122/97
aggccaccacugcgcccgcca

SEQ ID NO: 3117573 - RNA, 14 nt, Mycobacterium bovis subsp bovis AF2122/97
aggccaccccgacc

SEQ ID NO: 3117574 - RNA, 19 nt, Mycobacterium bovis subsp bovis AF2122/97
aggccacccgcgaagccgc

SEQ ID NO: 3117575 - RNA, 20 nt, Mycobacterium bovis subsp bovis AF2122/97
aggccacccgcgaagccgcc

SEQ ID NO: 3117576 - RNA, 19 nt, Mycobacterium bovis subsp bovis AF2122/97
aggccaccggcgaccgacg

SEQ ID NO: 3117577 - RNA, 12 nt, Mycobacterium bovis subsp bovis AF2122/97
aggccaccgucg

SEQ ID NO: 3117578 - RNA, 14 nt, Mycobacterium bovis subsp bovis AF2122/97
aggccaccgucgcg

SEQ ID NO: 3117579 - RNA, 21 nt, Mycobacterium bovis subsp bovis AF2122/97
aggccacgccagcucgccggc

SEQ ID NO: 3117580 - RNA, 21 nt, Mycobacterium bovis subsp bovis AF2122/97
aggccacggggauuggcgacg

SEQ ID NO: 3117581 - RNA, 16 nt, Mycobacterium bovis subsp bovis AF2122/97
aggccacugccgacca

SEQ ID NO: 3117582 - RNA, 18 nt, Mycobacterium bovis subsp bovis AF2122/97
aggccacugccgaccagc

SEQ ID NO: 3117583 - RNA, 12 nt, Mycobacterium bovis subsp bovis AF2122/97
aggccacugcgu

SEQ ID NO: 3117584 - RNA, 18 nt, Mycobacterium bovis subsp bovis AF2122/97
aggccagagucgcccgca

SEQ ID NO: 3117585 - RNA, 20 nt, Mycobacterium bovis subsp bovis AF2122/97
aggccagagucgcccgcaca

SEQ ID NO: 3117586 - RNA, 23 nt, Mycobacterium bovis subsp bovis AF2122/97
aggccagcaugucgggccgcucg

SEQ ID NO: 3117587 - RNA, 15 nt, Mycobacterium bovis subsp bovis AF2122/97
aggccagcgaaucgc

SEQ ID NO: 3117588 - RNA, 17 nt, Mycobacterium bovis subsp bovis AF2122/97
aggccagcgcgcccgcg

SEQ ID NO: 3117589 - RNA, 13 nt, Mycobacterium bovis subsp bovis AF2122/97
aggccagggcggu

SEQ ID NO: 3117590 - RNA, 19 nt, Mycobacterium bovis subsp bovis AF2122/97
aggccagggugaccaggcc

SEQ ID NO: 3117591 - RNA, 20 nt, Mycobacterium bovis subsp bovis AF2122/97
aggccauagucagacgacga

SEQ ID NO: 3117592 - RNA, 21 nt, Mycobacterium bovis subsp bovis AF2122/97
aggccauagucagacgacgau

SEQ ID NO: 3117593 - RNA, 23 nt, Mycobacterium bovis subsp bovis AF2122/97
aggccauccgggcugccaaggcc

SEQ ID NO: 3117594 - RNA, 21 nt, Mycobacterium bovis subsp bovis AF2122/97
aggccaugcucgccaaaccca

SEQ ID NO: 3117595 - RNA, 17 nt, Mycobacterium bovis subsp bovis AF2122/97
aggccaugggaaccgac

SEQ ID NO: 3117596 - RNA, 14 nt, Mycobacterium bovis subsp bovis AF2122/97
aggcccacccgggc

SEQ ID NO: 3117597 - RNA, 12 nt, Mycobacterium bovis subsp bovis AF2122/97
aggcccacggca

SEQ ID NO: 3117598 - RNA, 18 nt, Mycobacterium bovis subsp bovis AF2122/97
aggcccacggcagcgccg

SEQ ID NO: 3117599 - RNA, 17 nt, Mycobacterium bovis subsp bovis AF2122/97
aggcccagcaaccgcuc

SEQ ID NO: 3117600 - RNA, 18 nt, Mycobacterium bovis subsp bovis AF2122/97
aggcccagcaaccgcucg

SEQ ID NO: 3117601 - RNA, 14 nt, Mycobacterium bovis subsp bovis AF2122/97
aggcccagcacggu

SEQ ID NO: 3117602 - RNA, 18 nt, Mycobacterium bovis subsp bovis AF2122/97
aggcccagcggaucgaca

SEQ ID NO: 3117603 - RNA, 20 nt, Mycobacterium bovis subsp bovis AF2122/97
aggcccaucucgggcaggcc

SEQ ID NO: 3117604 - RNA, 16 nt, Mycobacterium bovis subsp bovis AF2122/97
aggccccgccagcgcc

SEQ ID NO: 3117605 - RNA, 19 nt, Mycobacterium bovis subsp bovis AF2122/97
aggccccgccagcgccggu

SEQ ID NO: 3117606 - RNA, 20 nt, Mycobacterium bovis subsp bovis AF2122/97
aggccccgccagcgccgguc

SEQ ID NO: 3117607 - RNA, 22 nt, Mycobacterium bovis subsp bovis AF2122/97
aggccccggugccgaccgguug

SEQ ID NO: 3117608 - RNA, 14 nt, Mycobacterium bovis subsp bovis AF2122/97
aggccccuggccgc

SEQ ID NO: 3117609 - RNA, 16 nt, Mycobacterium bovis subsp bovis AF2122/97
aggcccgacggcgccc

SEQ ID NO: 3117610 - RNA, 23 nt, Mycobacterium bovis subsp bovis AF2122/97
aggcccgcacguuggcggccagc

SEQ ID NO: 3117611 - RNA, 22 nt, Mycobacterium bovis subsp bovis AF2122/97
aggcccgccacaacggcggcgc

SEQ ID NO: 3117612 - RNA, 17 nt, Mycobacterium bovis subsp bovis AF2122/97
aggcccggcgcggccgc

SEQ ID NO: 3117613 - RNA, 19 nt, Mycobacterium bovis subsp bovis AF2122/97
aggcccgggcggaugcugu

SEQ ID NO: 3117614 - RNA, 13 nt, Mycobacterium bovis subsp bovis AF2122/97
aggcccgggcggc

SEQ ID NO: 3117615 - RNA, 15 nt, Mycobacterium bovis subsp bovis AF2122/97
aggcccgggcggcca

SEQ ID NO: 3117616 - RNA, 17 nt, Mycobacterium bovis subsp bovis AF2122/97
aggcccgggcggccagc

SEQ ID NO: 3117617 - RNA, 22 nt, Mycobacterium bovis subsp bovis AF2122/97
aggcccgggcggccagcugcag

SEQ ID NO: 3117618 - RNA, 15 nt, Mycobacterium bovis subsp bovis AF2122/97
aggcccucgacggcg

SEQ ID NO: 3117619 - RNA, 18 nt, Mycobacterium bovis subsp bovis AF2122/97
aggcccucgggacugcgc

SEQ ID NO: 3117620 - RNA, 15 nt, Mycobacterium bovis subsp bovis AF2122/97
aggcccugcggccac

SEQ ID NO: 3117621 - RNA, 13 nt, Mycobacterium bovis subsp bovis AF2122/97
aggcccuggccag

SEQ ID NO: 3117622 - RNA, 20 nt, Mycobacterium bovis subsp bovis AF2122/97
aggcccuggccgcgccgggg

SEQ ID NO: 3117623 - RNA, 17 nt, Mycobacterium bovis subsp bovis AF2122/97
aggccgacaaugucggc

SEQ ID NO: 3117624 - RNA, 22 nt, Mycobacterium bovis subsp bovis AF2122/97
aggccgacaaugucggcgaugc

SEQ ID NO: 3117625 - RNA, 14 nt, Mycobacterium bovis subsp bovis AF2122/97
aggccgaccagcac

SEQ ID NO: 3117626 - RNA, 13 nt, Mycobacterium bovis subsp bovis AF2122/97
aggccgaccgcgc

SEQ ID NO: 3117627 - RNA, 13 nt, Mycobacterium bovis subsp bovis AF2122/97
aggccgaccugua

SEQ ID NO: 3117628 - RNA, 21 nt, Mycobacterium bovis subsp bovis AF2122/97
aggccgaccuguaugccgcgg

SEQ ID NO: 3117629 - RNA, 23 nt, Mycobacterium bovis subsp bovis AF2122/97
aggccgaccuguaugccgcggug

SEQ ID NO: 3117630 - RNA, 23 nt, Mycobacterium bovis subsp bovis AF2122/97
aggccgacgacauugggcgcggu

SEQ ID NO: 3117631 - RNA, 13 nt, Mycobacterium bovis subsp bovis AF2122/97
aggccgacgucga

SEQ ID NO: 3117632 - RNA, 18 nt, Mycobacterium bovis subsp bovis AF2122/97
aggccgacgucgaccacu

SEQ ID NO: 3117633 - RNA, 12 nt, Mycobacterium bovis subsp bovis AF2122/97
aggccgagcaga

SEQ ID NO: 3117634 - RNA, 14 nt, Mycobacterium bovis subsp bovis AF2122/97
aggccgagcccggu

SEQ ID NO: 3117635 - RNA, 23 nt, Mycobacterium bovis subsp bovis AF2122/97
aggccgagcucguugcuggcggc

SEQ ID NO: 3117636 - RNA, 13 nt, Mycobacterium bovis subsp bovis AF2122/97
aggccgaucagcg

SEQ ID NO: 3117637 - RNA, 21 nt, Mycobacterium bovis subsp bovis AF2122/97
aggccgaucagcguggcgccc

SEQ ID NO: 3117638 - RNA, 19 nt, Mycobacterium bovis subsp bovis AF2122/97
aggccgaugacgaugccgc

SEQ ID NO: 3117639 - RNA, 13 nt, Mycobacterium bovis subsp bovis AF2122/97
aggccgaugccga

SEQ ID NO: 3117640 - RNA, 19 nt, Mycobacterium bovis subsp bovis AF2122/97
aggccgauguacugugccg

SEQ ID NO: 3117641 - RNA, 13 nt, Mycobacterium bovis subsp bovis AF2122/97
aggccgcaaugcg

SEQ ID NO: 3117642 - RNA, 13 nt, Mycobacterium bovis subsp bovis AF2122/97
aggccgcaccgcc

SEQ ID NO: 3117643 - RNA, 14 nt, Mycobacterium bovis subsp bovis AF2122/97
aggccgcaccgcca

SEQ ID NO: 3117644 - RNA, 15 nt, Mycobacterium bovis subsp bovis AF2122/97
aggccgcaccgccac

SEQ ID NO: 3117645 - RNA, 15 nt, Mycobacterium bovis subsp bovis AF2122/97
aggccgccagccggc

SEQ ID NO: 3117646 - RNA, 20 nt, Mycobacterium bovis subsp bovis AF2122/97
aggccgccagccggcgcacu

SEQ ID NO: 3117647 - RNA, 16 nt, Mycobacterium bovis subsp bovis AF2122/97
aggccgccaucgccgc

SEQ ID NO: 3117648 - RNA, 17 nt, Mycobacterium bovis subsp bovis AF2122/97
aggccgccaucgccgcc

SEQ ID NO: 3117649 - RNA, 19 nt, Mycobacterium bovis subsp bovis AF2122/97
aggccgccaucgccgccaa

SEQ ID NO: 3117650 - RNA, 12 nt, Mycobacterium bovis subsp bovis AF2122/97
aggccgccgcca

SEQ ID NO: 3117651 - RNA, 16 nt, Mycobacterium bovis subsp bovis AF2122/97
aggccgccgccgucgg

SEQ ID NO: 3117652 - RNA, 22 nt, Mycobacterium bovis subsp bovis AF2122/97
aggccgccgccgucggcgagca

SEQ ID NO: 3117653 - RNA, 14 nt, Mycobacterium bovis subsp bovis AF2122/97
aggccgccgcggcg

SEQ ID NO: 3117654 - RNA, 16 nt, Mycobacterium bovis subsp bovis AF2122/97
aggccgccggacccgu

SEQ ID NO: 3117655 - RNA, 19 nt, Mycobacterium bovis subsp bovis AF2122/97
aggccgccggacccgucga

SEQ ID NO: 3117656 - RNA, 16 nt, Mycobacterium bovis subsp bovis AF2122/97
aggccgccguggugau

SEQ ID NO: 3117657 - RNA, 19 nt, Mycobacterium bovis subsp bovis AF2122/97
aggccgccguggugaucaa

SEQ ID NO: 3117658 - RNA, 14 nt, Mycobacterium bovis subsp bovis AF2122/97
aggccgccguugcc

SEQ ID NO: 3117659 - RNA, 21 nt, Mycobacterium bovis subsp bovis AF2122/97
aggccgcgcgacaacccggcg

SEQ ID NO: 3117660 - RNA, 15 nt, Mycobacterium bovis subsp bovis AF2122/97
aggccgcgcgcaggg

SEQ ID NO: 3117661 - RNA, 16 nt, Mycobacterium bovis subsp bovis AF2122/97
aggccgcgcgcagggc

SEQ ID NO: 3117662 - RNA, 15 nt, Mycobacterium bovis subsp bovis AF2122/97
aggccgcgcggcggc

SEQ ID NO: 3117663 - RNA, 16 nt, Mycobacterium bovis subsp bovis AF2122/97
aggccgcgcggcggcg

SEQ ID NO: 3117664 - RNA, 20 nt, Mycobacterium bovis subsp bovis AF2122/97
aggccgcgcggcggcgccgg

SEQ ID NO: 3117665 - RNA, 22 nt, Mycobacterium bovis subsp bovis AF2122/97
aggccgcgcggcggcgccggcg

SEQ ID NO: 3117666 - RNA, 16 nt, Mycobacterium bovis subsp bovis AF2122/97
aggccgcgcucgucga

SEQ ID NO: 3117667 - RNA, 12 nt, Mycobacterium bovis subsp bovis AF2122/97
aggccgcggugu

SEQ ID NO: 3117668 - RNA, 14 nt, Mycobacterium bovis subsp bovis AF2122/97
aggccgcugccagc

SEQ ID NO: 3117669 - RNA, 16 nt, Mycobacterium bovis subsp bovis AF2122/97
aggccgcugccagcau

SEQ ID NO: 3117670 - RNA, 14 nt, Mycobacterium bovis subsp bovis AF2122/97
aggccgcugggccg

SEQ ID NO: 3117671 - RNA, 19 nt, Mycobacterium bovis subsp bovis AF2122/97
aggcgauugcgccgcacac

SEQ ID NO: 3117672 - RNA, 22 nt, Mycobacterium bovis subsp bovis AF2122/97
aggcgauugucggggccgcagg

SEQ ID NO: 3117673 - RNA, 18 nt, Mycobacterium bovis subsp bovis AF2122/97
aggcgcaagaaugccgcc

SEQ ID NO: 3117674 - RNA, 16 nt, Mycobacterium bovis subsp bovis AF2122/97
aggcgcagcgccagcg

SEQ ID NO: 3117675 - RNA, 16 nt, Mycobacterium bovis subsp bovis AF2122/97
aggcgcagcugggugc

SEQ ID NO: 3117676 - RNA, 14 nt, Mycobacterium bovis subsp bovis AF2122/97
aggcgcagcugguu

SEQ ID NO: 3117677 - RNA, 16 nt, Mycobacterium bovis subsp bovis AF2122/97
aggcgccacugcuucc

SEQ ID NO: 3117678 - RNA, 16 nt, Mycobacterium bovis subsp bovis AF2122/97
aggcgcccaacaggcg

SEQ ID NO: 3117679 - RNA, 17 nt, Mycobacterium bovis subsp bovis AF2122/97
aggcgcccaacaggcgg

SEQ ID NO: 3117680 - RNA, 12 nt, Mycobacterium bovis subsp bovis AF2122/97
aggcgcccacaa

SEQ ID NO: 3117681 - RNA, 21 nt, Mycobacterium bovis subsp bovis AF2122/97
aggcgcccagcgacaacacca

SEQ ID NO: 3117682 - RNA, 16 nt, Mycobacterium bovis subsp bovis AF2122/97
aggcgccgaugucguc

SEQ ID NO: 3117683 - RNA, 15 nt, Mycobacterium bovis subsp bovis AF2122/97
aggcgccgcagggcc

SEQ ID NO: 3117684 - RNA, 20 nt, Mycobacterium bovis subsp bovis AF2122/97
aggcgccgcagggccgcgcg

SEQ ID NO: 3117685 - RNA, 14 nt, Mycobacterium bovis subsp bovis AF2122/97
aggcgccgcuaucg

SEQ ID NO: 3117686 - RNA, 16 nt, Mycobacterium bovis subsp bovis AF2122/97
aggcgccggucgccug

SEQ ID NO: 3117687 - RNA, 21 nt, Mycobacterium bovis subsp bovis AF2122/97
aggcgcgacguagacgacguc

SEQ ID NO: 3117688 - RNA, 13 nt, Mycobacterium bovis subsp bovis AF2122/97
aggcgcgcaccac

SEQ ID NO: 3117689 - RNA, 13 nt, Mycobacterium bovis subsp bovis AF2122/97
aggcgcgccgcac

SEQ ID NO: 3117690 - RNA, 12 nt, Mycobacterium bovis subsp bovis AF2122/97
aggcgcggccca

SEQ ID NO: 3117691 - RNA, 22 nt, Mycobacterium bovis subsp bovis AF2122/97
aggcgcggcgacaagccgagcc

SEQ ID NO: 3117692 - RNA, 12 nt, Mycobacterium bovis subsp bovis AF2122/97
aggcgcgggcga

SEQ ID NO: 3117693 - RNA, 20 nt, Mycobacterium bovis subsp bovis AF2122/97
aggcgcgggcgacgucuugg

SEQ ID NO: 3117694 - RNA, 13 nt, Mycobacterium bovis subsp bovis AF2122/97
aggcgcggucacc

SEQ ID NO: 3117695 - RNA, 17 nt, Mycobacterium bovis subsp bovis AF2122/97
aggcgcggucaccgcgu

SEQ ID NO: 3117696 - RNA, 15 nt, Mycobacterium bovis subsp bovis AF2122/97
aggcgcuaggaacgc

SEQ ID NO: 3117697 - RNA, 19 nt, Mycobacterium bovis subsp bovis AF2122/97
aggcgcucacccgccgcgg

SEQ ID NO: 3117698 - RNA, 16 nt, Mycobacterium bovis subsp bovis AF2122/97
aggcgcucaucaccca

SEQ ID NO: 3117699 - RNA, 17 nt, Mycobacterium bovis subsp bovis AF2122/97
aggcgcucaucacccag

SEQ ID NO: 3117700 - RNA, 21 nt, Mycobacterium bovis subsp bovis AF2122/97
aggcgcucccggagcacaauc

SEQ ID NO: 3117701 - RNA, 22 nt, Mycobacterium bovis subsp bovis AF2122/97
aggcgcuccuucagggcgucga

SEQ ID NO: 3117702 - RNA, 22 nt, Mycobacterium bovis subsp bovis AF2122/97
aggcgcugaacgcgagcaacac

SEQ ID NO: 3117703 - RNA, 23 nt, Mycobacterium bovis subsp bovis AF2122/97
aggcgcugaagaucaacaggcgu

SEQ ID NO: 3117704 - RNA, 14 nt, Mycobacterium bovis subsp bovis AF2122/97
aggcgcugcagcau

SEQ ID NO: 3117705 - RNA, 16 nt, Mycobacterium bovis subsp bovis AF2122/97
aggcgcuggcccgcca

SEQ ID NO: 3117706 - RNA, 16 nt, Mycobacterium bovis subsp bovis AF2122/97
aggcgcuggcggguca

SEQ ID NO: 3117707 - RNA, 15 nt, Mycobacterium bovis subsp bovis AF2122/97
aggcgcuucgccaca

SEQ ID NO: 3117708 - RNA, 16 nt, Mycobacterium bovis subsp bovis AF2122/97
aggcgcuucgccacac

SEQ ID NO: 3117709 - RNA, 13 nt, Mycobacterium bovis subsp bovis AF2122/97
aggcggcaaggac

SEQ ID NO: 3117710 - RNA, 12 nt, Mycobacterium bovis subsp bovis AF2122/97
aggcggcagguu

SEQ ID NO: 3117711 - RNA, 12 nt, Mycobacterium bovis subsp bovis AF2122/97
aggcggccaggu

SEQ ID NO: 3117712 - RNA, 20 nt, Mycobacterium bovis subsp bovis AF2122/97
aggcggccaucgacgacacg

SEQ ID NO: 3117713 - RNA, 21 nt, Mycobacterium bovis subsp bovis AF2122/97
aggcggccggguucgcgucug

SEQ ID NO: 3117714 - RNA, 19 nt, Mycobacterium bovis subsp bovis AF2122/97
aggcggccgucgucggcca

SEQ ID NO: 3117715 - RNA, 24 nt, Mycobacterium bovis subsp bovis AF2122/97
aggcggccuugccgggccgcgcgg

SEQ ID NO: 3117716 - RNA, 12 nt, Mycobacterium bovis subsp bovis AF2122/97
aggcggcgacgc

SEQ ID NO: 3117717 - RNA, 14 nt, Mycobacterium bovis subsp bovis AF2122/97
aggcggcgacgccg

SEQ ID NO: 3117718 - RNA, 18 nt, Mycobacterium bovis subsp bovis AF2122/97
aggcggcgccgcacccac

SEQ ID NO: 3117719 - RNA, 16 nt, Mycobacterium bovis subsp bovis AF2122/97
aggcggcgcgggucgg

SEQ ID NO: 3117720 - RNA, 12 nt, Mycobacterium bovis subsp bovis AF2122/97
aggcggcggccc

SEQ ID NO: 3117721 - RNA, 19 nt, Mycobacterium bovis subsp bovis AF2122/97
aggcggcggccuggcaccc

SEQ ID NO: 3117722 - RNA, 20 nt, Mycobacterium bovis subsp bovis AF2122/97
aggcggcuggcccgcaugcc

SEQ ID NO: 3117723 - RNA, 19 nt, Mycobacterium bovis subsp bovis AF2122/97
aggcggcuugaucagccgc

SEQ ID NO: 3117724 - RNA, 20 nt, Mycobacterium bovis subsp bovis AF2122/97
aggcggcuugaucagccgcc

SEQ ID NO: 3117725 - RNA, 23 nt, Mycobacterium bovis subsp bovis AF2122/97
aggcgggagcggaauggcgccgg

SEQ ID NO: 3117726 - RNA, 14 nt, Mycobacterium bovis subsp bovis AF2122/97
aggcgggcggcacc

SEQ ID NO: 3117727 - RNA, 17 nt, Mycobacterium bovis subsp bovis AF2122/97
aggcggguacaccacgg

SEQ ID NO: 3117728 - RNA, 22 nt, Mycobacterium bovis subsp bovis AF2122/97
aggcgggugcggcaauaccgaa

SEQ ID NO: 3117729 - RNA, 21 nt, Mycobacterium bovis subsp bovis AF2122/97
aggcggucgaucauggcggca

SEQ ID NO: 3117730 - RNA, 13 nt, Mycobacterium bovis subsp bovis AF2122/97
aggcggucgccga

SEQ ID NO: 3117731 - RNA, 18 nt, Mycobacterium bovis subsp bovis AF2122/97
aggcggucuuguccagga

SEQ ID NO: 3117732 - RNA, 19 nt, Mycobacterium bovis subsp bovis AF2122/97
aggcggugacccguucagc

SEQ ID NO: 3117733 - RNA, 14 nt, Mycobacterium bovis subsp bovis AF2122/97
aggcgguguccaga

SEQ ID NO: 3117734 - RNA, 13 nt, Mycobacterium bovis subsp bovis AF2122/97
aggcgucaccccg

SEQ ID NO: 3117735 - RNA, 21 nt, Mycobacterium bovis subsp bovis AF2122/97
aggcguccaucgccaccgcgu

SEQ ID NO: 3117736 - RNA, 22 nt, Mycobacterium bovis subsp bovis AF2122/97
aggcgucgaacagugccucgcg

SEQ ID NO: 3117737 - RNA, 19 nt, Mycobacterium bovis subsp bovis AF2122/97
aggcgugacgcuaacgucg

SEQ ID NO: 3117738 - RNA, 13 nt, Mycobacterium bovis subsp bovis AF2122/97
aggcgugcacagg

SEQ ID NO: 3117739 - RNA, 18 nt, Mycobacterium bovis subsp bovis AF2122/97
aggcgugcacaggucagc

SEQ ID NO: 3117740 - RNA, 19 nt, Mycobacterium bovis subsp bovis AF2122/97
aggcgugcuugaccgccug

SEQ ID NO: 3117741 - RNA, 21 nt, Mycobacterium bovis subsp bovis AF2122/97
aggcguguagccugcggcggu

SEQ ID NO: 3117742 - RNA, 21 nt, Mycobacterium bovis subsp bovis AF2122/97
aggcguucgacucgaccgcga

SEQ ID NO: 3117743 - RNA, 23 nt, Mycobacterium bovis subsp bovis AF2122/97
aggcguucgacucgaccgcgacg

SEQ ID NO: 3117744 - RNA, 17 nt, Mycobacterium bovis subsp bovis AF2122/97
aggcguugaacugugcg

SEQ ID NO: 3117745 - RNA, 22 nt, Mycobacterium bovis subsp bovis AF2122/97
aggcguugaacugugcggcagc

SEQ ID NO: 3117746 - RNA, 20 nt, Mycobacterium bovis subsp bovis AF2122/97
aggcguuggaucccagcccg

SEQ ID NO: 3117747 - RNA, 19 nt, Mycobacterium bovis subsp bovis AF2122/97
aggcguuguagcgguccag

SEQ ID NO: 3117748 - RNA, 21 nt, Mycobacterium bovis subsp bovis AF2122/97
aggcguuguagcgguccagcg

SEQ ID NO: 3117749 - RNA, 20 nt, Mycobacterium bovis subsp bovis AF2122/97
aggcuaauagcucgccggcg

SEQ ID NO: 3117750 - RNA, 17 nt, Mycobacterium bovis subsp bovis AF2122/97
aggcuaguugccaacac

SEQ ID NO: 3117751 - RNA, 15 nt, Mycobacterium bovis subsp bovis AF2122/97
aggcucaaucgauga

SEQ ID NO: 3117752 - RNA, 18 nt, Mycobacterium bovis subsp bovis AF2122/97
aggcucacacucggccgg

SEQ ID NO: 3117753 - RNA, 21 nt, Mycobacterium bovis subsp bovis AF2122/97
aggcucaccaggcgagccggc

SEQ ID NO: 3117754 - RNA, 16 nt, Mycobacterium bovis subsp bovis AF2122/97
aggcucagcagcgccg

SEQ ID NO: 3117755 - RNA, 20 nt, Mycobacterium bovis subsp bovis AF2122/97
aggcucagcagcgccgcgcg

SEQ ID NO: 3117756 - RNA, 17 nt, Mycobacterium bovis subsp bovis AF2122/97
aggcucauccgccgggc

SEQ ID NO: 3117757 - RNA, 15 nt, Mycobacterium bovis subsp bovis AF2122/97
agggcggcagcgagg

SEQ ID NO: 3117758 - RNA, 20 nt, Mycobacterium bovis subsp bovis AF2122/97
agggcggcagcgaggcucgc

SEQ ID NO: 3117759 - RNA, 22 nt, Mycobacterium bovis subsp bovis AF2122/97
agggcggccuccccgaccugca

SEQ ID NO: 3117760 - RNA, 13 nt, Mycobacterium bovis subsp bovis AF2122/97
agggcggcgaggu

SEQ ID NO: 3117761 - RNA, 18 nt, Mycobacterium bovis subsp bovis AF2122/97
agggcggggcagaagucg

SEQ ID NO: 3117762 - RNA, 19 nt, Mycobacterium bovis subsp bovis AF2122/97
agggcggugccaucgggcg

SEQ ID NO: 3117763 - RNA, 21 nt, Mycobacterium bovis subsp bovis AF2122/97
agggcggugccaucgggcgcg

SEQ ID NO: 3117764 - RNA, 15 nt, Mycobacterium bovis subsp bovis AF2122/97
agggcgguggccacc

SEQ ID NO: 3117765 - RNA, 18 nt, Mycobacterium bovis subsp bovis AF2122/97
agggcgucgaacucaucu

SEQ ID NO: 3117766 - RNA, 17 nt, Mycobacterium bovis subsp bovis AF2122/97
agggcgucgccgccguu

SEQ ID NO: 3117767 - RNA, 22 nt, Mycobacterium bovis subsp bovis AF2122/97
agggcuaucguggcggcgucga

SEQ ID NO: 3117768 - RNA, 16 nt, Mycobacterium bovis subsp bovis AF2122/97
agggcuccucgugcac

SEQ ID NO: 3117769 - RNA, 14 nt, Mycobacterium bovis subsp bovis AF2122/97
agggcucggcggcc

SEQ ID NO: 3117770 - RNA, 17 nt, Mycobacterium bovis subsp bovis AF2122/97
agggcucggcggcccgg

SEQ ID NO: 3117771 - RNA, 19 nt, Mycobacterium bovis subsp bovis AF2122/97
agggcucggcggcccggcc

SEQ ID NO: 3117772 - RNA, 14 nt, Mycobacterium bovis subsp bovis AF2122/97
agggcucgguggcg

SEQ ID NO: 3117773 - RNA, 19 nt, Mycobacterium bovis subsp bovis AF2122/97
agggcucgguggcgccggg

SEQ ID NO: 3117774 - RNA, 16 nt, Mycobacterium bovis subsp bovis AF2122/97
agggcugcgaugcggu

SEQ ID NO: 3117775 - RNA, 16 nt, Mycobacterium bovis subsp bovis AF2122/97
agggcuuccagggcga

SEQ ID NO: 3117776 - RNA, 15 nt, Mycobacterium bovis subsp bovis AF2122/97
agggcuugucgccgg

SEQ ID NO: 3117777 - RNA, 19 nt, Mycobacterium bovis subsp bovis AF2122/97
agggcuugucgccggcaua

SEQ ID NO: 3117778 - RNA, 20 nt, Mycobacterium bovis subsp bovis AF2122/97
agggcuuugucaccggcuuc

SEQ ID NO: 3117779 - RNA, 13 nt, Mycobacterium bovis subsp bovis AF2122/97
aggggagcugacc

SEQ ID NO: 3117780 - RNA, 15 nt, Mycobacterium bovis subsp bovis AF2122/97
aggggcaacagggga

SEQ ID NO: 3117781 - RNA, 19 nt, Mycobacterium bovis subsp bovis AF2122/97
aggggcaauugccugcgcu

SEQ ID NO: 3117782 - RNA, 15 nt, Mycobacterium bovis subsp bovis AF2122/97
aggggcagcacguca

SEQ ID NO: 3117783 - RNA, 16 nt, Mycobacterium bovis subsp bovis AF2122/97
aggggcgcggguggaa

SEQ ID NO: 3117784 - RNA, 20 nt, Mycobacterium bovis subsp bovis AF2122/97
aggggcgucugcagcgggcg

SEQ ID NO: 3117785 - RNA, 17 nt, Mycobacterium bovis subsp bovis AF2122/97
aggggcuuuugcgucug

SEQ ID NO: 3117786 - RNA, 21 nt, Mycobacterium bovis subsp bovis AF2122/97
aggggcuuuugcgucugcucg

SEQ ID NO: 3117787 - RNA, 19 nt, Mycobacterium bovis subsp bovis AF2122/97
aggggguggugucgcggcc

SEQ ID NO: 3117788 - RNA, 16 nt, Mycobacterium bovis subsp bovis AF2122/97
aggggugcccggcggc

SEQ ID NO: 3117789 - RNA, 18 nt, Mycobacterium bovis subsp bovis AF2122/97
aggggugcccggcggcca

SEQ ID NO: 3117790 - RNA, 16 nt, Mycobacterium bovis subsp bovis AF2122/97
agggguggcgcgggcc

SEQ ID NO: 3117791 - RNA, 21 nt, Mycobacterium bovis subsp bovis AF2122/97
agggguggcgcgggccggcga

SEQ ID NO: 3117792 - RNA, 21 nt, Mycobacterium bovis subsp bovis AF2122/97
aggggugugugcugccgcaca

SEQ ID NO: 3117793 - RNA, 19 nt, Mycobacterium bovis subsp bovis AF2122/97
aggguauccacgccgggca

SEQ ID NO: 3117794 - RNA, 22 nt, Mycobacterium bovis subsp bovis AF2122/97
aggguaucgaaaaguagaccga

SEQ ID NO: 3117795 - RNA, 18 nt, Mycobacterium bovis subsp bovis AF2122/97
agggucacaaacccagca

SEQ ID NO: 3117796 - RNA, 17 nt, Mycobacterium bovis subsp bovis AF2122/97
agggucagcgccgcgcc

SEQ ID NO: 3117797 - RNA, 16 nt, Mycobacterium bovis subsp bovis AF2122/97
agggucaucgccagcg

SEQ ID NO: 3117798 - RNA, 21 nt, Mycobacterium bovis subsp bovis AF2122/97
agggucaugucgaucagcgcg

SEQ ID NO: 3117799 - RNA, 16 nt, Mycobacterium bovis subsp bovis AF2122/97
agggucgacguaggac

SEQ ID NO: 3117800 - RNA, 22 nt, Mycobacterium bovis subsp bovis AF2122/97
agggucgccgcauugcagaacc

SEQ ID NO: 3117801 - RNA, 18 nt, Mycobacterium bovis subsp bovis AF2122/97
agggucgggguccgcggc

SEQ ID NO: 3117802 - RNA, 16 nt, Mycobacterium bovis subsp bovis AF2122/97
agggucguacgucgga

SEQ ID NO: 3117803 - RNA, 23 nt, Mycobacterium bovis subsp bovis AF2122/97
agggucugcgccgccggcggcgg

SEQ ID NO: 3117804 - RNA, 19 nt, Mycobacterium bovis subsp bovis AF2122/97
agggugaagacaccggcgu

SEQ ID NO: 3117805 - RNA, 17 nt, Mycobacterium bovis subsp bovis AF2122/97
agggugaccaacgucga

SEQ ID NO: 3117806 - RNA, 22 nt, Mycobacterium bovis subsp bovis AF2122/97
agggugaccaggccgagcucgu

SEQ ID NO: 3117807 - RNA, 18 nt, Mycobacterium bovis subsp bovis AF2122/97
agggugacccccaauccu

SEQ ID NO: 3117808 - RNA, 19 nt, Mycobacterium bovis subsp bovis AF2122/97
agggugcccgcguugccaa

SEQ ID NO: 3117809 - RNA, 17 nt, Mycobacterium bovis subsp bovis AF2122/97
agggugcccucggccgc

SEQ ID NO: 3117810 - RNA, 12 nt, Mycobacterium bovis subsp bovis AF2122/97
agggugccggcg

SEQ ID NO: 3117811 - RNA, 15 nt, Mycobacterium bovis subsp bovis AF2122/97
agggugccggcgccg

SEQ ID NO: 3117812 - RNA, 19 nt, Mycobacterium bovis subsp bovis AF2122/97
agggugccggcgccgcccu

SEQ ID NO: 3117813 - RNA, 23 nt, Mycobacterium bovis subsp bovis AF2122/97
agggugccggcggugacggcggc

SEQ ID NO: 3117814 - RNA, 15 nt, Mycobacterium bovis subsp bovis AF2122/97
agggugccggucacg

SEQ ID NO: 3117815 - RNA, 19 nt, Mycobacterium bovis subsp bovis AF2122/97
agggugccggucacgucga

SEQ ID NO: 3117816 - RNA, 16 nt, Mycobacterium bovis subsp bovis AF2122/97
agggugcgcuugcggc

SEQ ID NO: 3117817 - RNA, 16 nt, Mycobacterium bovis subsp bovis AF2122/97
aggguggaccggucga

SEQ ID NO: 3117818 - RNA, 18 nt, Mycobacterium bovis subsp bovis AF2122/97
aggguggaccggucgaca

SEQ ID NO: 3117819 - RNA, 13 nt, Mycobacterium bovis subsp bovis AF2122/97
aggguggccagca

SEQ ID NO: 3117820 - RNA, 14 nt, Mycobacterium bovis subsp bovis AF2122/97
aggguggccagcag

SEQ ID NO: 3117821 - RNA, 15 nt, Mycobacterium bovis subsp bovis AF2122/97
aggguggccagcagg

SEQ ID NO: 3117822 - RNA, 22 nt, Mycobacterium bovis subsp bovis AF2122/97
agggugggcgacgucaucgccg

SEQ ID NO: 3117823 - RNA, 15 nt, Mycobacterium bovis subsp bovis AF2122/97
agggugggcgagcga

SEQ ID NO: 3117824 - RNA, 14 nt, Mycobacterium bovis subsp bovis AF2122/97
aggguggggccggc

SEQ ID NO: 3117825 - RNA, 16 nt, Mycobacterium bovis subsp bovis AF2122/97
aggguggggccggcgg

SEQ ID NO: 3117826 - RNA, 21 nt, Mycobacterium bovis subsp bovis AF2122/97
aggguggggcgguggccggcg

SEQ ID NO: 3117827 - RNA, 22 nt, Mycobacterium bovis subsp bovis AF2122/97
aggguggggcgguggccggcga

SEQ ID NO: 3117828 - RNA, 20 nt, Mycobacterium bovis subsp bovis AF2122/97
aggguguugcggcugaccuc

SEQ ID NO: 3117829 - RNA, 20 nt, Mycobacterium bovis subsp bovis AF2122/97
aggguucggacggcugguag

SEQ ID NO: 3117830 - RNA, 21 nt, Mycobacterium bovis subsp bovis AF2122/97
aggguuuccaagucggagcgg

SEQ ID NO: 3117831 - RNA, 13 nt, Mycobacterium bovis subsp bovis AF2122/97
agguaagcagcca

SEQ ID NO: 3117832 - RNA, 16 nt, Mycobacterium bovis subsp bovis AF2122/97
agguaagcagccagca

SEQ ID NO: 3117833 - RNA, 17 nt, Mycobacterium bovis subsp bovis AF2122/97
agguaagcagccagcaa

SEQ ID NO: 3117834 - RNA, 23 nt, Mycobacterium bovis subsp bovis AF2122/97
agguaagcgaacggguagucggg

SEQ ID NO: 3117835 - RNA, 14 nt, Mycobacterium bovis subsp bovis AF2122/97
agguaauucgucca

SEQ ID NO: 3117836 - RNA, 17 nt, Mycobacterium bovis subsp bovis AF2122/97
agguaccgcgugcgccg

SEQ ID NO: 3117837 - RNA, 20 nt, Mycobacterium bovis subsp bovis AF2122/97
agguaccgcgugcgccgggg

SEQ ID NO: 3117838 - RNA, 14 nt, Mycobacterium bovis subsp bovis AF2122/97
agguacgccaggug

SEQ ID NO: 3117839 - RNA, 13 nt, Mycobacterium bovis subsp bovis AF2122/97
agguacgccucga

SEQ ID NO: 3117840 - RNA, 18 nt, Mycobacterium bovis subsp bovis AF2122/97
agguacgcgaucagcgcg

SEQ ID NO: 3117841 - RNA, 22 nt, Mycobacterium bovis subsp bovis AF2122/97
agguacgucuuggaucacgcga

SEQ ID NO: 3117842 - RNA, 21 nt, Mycobacterium bovis subsp bovis AF2122/97
agguacucaguguuccgccac

SEQ ID NO: 3117843 - RNA, 19 nt, Mycobacterium bovis subsp bovis AF2122/97
aggucgugcucccacguga

SEQ ID NO: 3117844 - RNA, 23 nt, Mycobacterium bovis subsp bovis AF2122/97
aggucguggacuuuauggcuagu

SEQ ID NO: 3117845 - RNA, 23 nt, Mycobacterium bovis subsp bovis AF2122/97
aggucguuucccuggccgccgcc

SEQ ID NO: 3117846 - RNA, 15 nt, Mycobacterium bovis subsp bovis AF2122/97
aggucuccggcaagc

SEQ ID NO: 3117847 - RNA, 23 nt, Mycobacterium bovis subsp bovis AF2122/97
aggucuccggcaagccgauugcu

SEQ ID NO: 3117848 - RNA, 20 nt, Mycobacterium bovis subsp bovis AF2122/97
aggucugacagaccgggcac

SEQ ID NO: 3117849 - RNA, 14 nt, Mycobacterium bovis subsp bovis AF2122/97
aggucugcggccga

SEQ ID NO: 3117850 - RNA, 14 nt, Mycobacterium bovis subsp bovis AF2122/97
aggucuggcgcgga

SEQ ID NO: 3117851 - RNA, 19 nt, Mycobacterium bovis subsp bovis AF2122/97
aggucuucaggccgcgcau

SEQ ID NO: 3117852 - RNA, 21 nt, Mycobacterium bovis subsp bovis AF2122/97
aggugaacgacaugggcaggc

SEQ ID NO: 3117853 - RNA, 22 nt, Mycobacterium bovis subsp bovis AF2122/97
aggugaacgcugucccagcccg

SEQ ID NO: 3117854 - RNA, 14 nt, Mycobacterium bovis subsp bovis AF2122/97
aggugaacugguug

SEQ ID NO: 3117855 - RNA, 16 nt, Mycobacterium bovis subsp bovis AF2122/97
aggugaaucgcgucga

SEQ ID NO: 3117856 - RNA, 21 nt, Mycobacterium bovis subsp bovis AF2122/97
aggugacauguugccgcugac

SEQ ID NO: 3117857 - RNA, 20 nt, Mycobacterium bovis subsp bovis AF2122/97
aggugaccgagaucgucgcg

SEQ ID NO: 3117858 - RNA, 20 nt, Mycobacterium bovis subsp bovis AF2122/97
aggugacgacgagggcggga

SEQ ID NO: 3117859 - RNA, 20 nt, Mycobacterium bovis subsp bovis AF2122/97
aggugacgaucaggucgccg

SEQ ID NO: 3117860 - RNA, 20 nt, Mycobacterium bovis subsp bovis AF2122/97
aggugacgcccgcuccgcgg

SEQ ID NO: 3117861 - RNA, 16 nt, Mycobacterium bovis subsp bovis AF2122/97
aggugacgccgccagc

SEQ ID NO: 3117862 - RNA, 17 nt, Mycobacterium bovis subsp bovis AF2122/97
aggugacgccgccagca

SEQ ID NO: 3117863 - RNA, 19 nt, Mycobacterium bovis subsp bovis AF2122/97
aggugacgccgccagcacc

SEQ ID NO: 3117864 - RNA, 15 nt, Mycobacterium bovis subsp bovis AF2122/97
aggugacggugacga

SEQ ID NO: 3117865 - RNA, 13 nt, Mycobacterium bovis subsp bovis AF2122/97
aggugaucagcag

SEQ ID NO: 3117866 - RNA, 17 nt, Mycobacterium bovis subsp bovis AF2122/97
aggugaucggaagaaac

SEQ ID NO: 3117867 - RNA, 16 nt, Mycobacterium bovis subsp bovis AF2122/97
aggugaugaacaccgg

SEQ ID NO: 3117868 - RNA, 17 nt, Mycobacterium bovis subsp bovis AF2122/97
aggugaugagugcggac

SEQ ID NO: 3117869 - RNA, 14 nt, Mycobacterium bovis subsp bovis AF2122/97
aggugaugccgccg

SEQ ID NO: 3117870 - RNA, 19 nt, Mycobacterium bovis subsp bovis AF2122/97
aggugauucgcgcagcgcg

SEQ ID NO: 3117871 - RNA, 18 nt, Mycobacterium bovis subsp bovis AF2122/97
aggugauuggucacaccc

SEQ ID NO: 3117872 - RNA, 22 nt, Mycobacterium bovis subsp bovis AF2122/97
aggugcaccauuguuccguccc

SEQ ID NO: 3117873 - RNA, 15 nt, Mycobacterium bovis subsp bovis AF2122/97
aggugcaucgccaca

SEQ ID NO: 3117874 - RNA, 13 nt, Mycobacterium bovis subsp bovis AF2122/97
aggugcaugucga

SEQ ID NO: 3117875 - RNA, 15 nt, Mycobacterium bovis subsp bovis AF2122/97
aggugcaugucgaug

SEQ ID NO: 3117876 - RNA, 19 nt, Mycobacterium bovis subsp bovis AF2122/97
aggugccaaacgccgcccg

SEQ ID NO: 3117877 - RNA, 21 nt, Mycobacterium bovis subsp bovis AF2122/97
aggugccaaacgccgcccgcc

SEQ ID NO: 3117878 - RNA, 15 nt, Mycobacterium bovis subsp bovis AF2122/97
aggugccaaccgcgg

SEQ ID NO: 3117879 - RNA, 17 nt, Mycobacterium bovis subsp bovis AF2122/97
aggugccaaccgcggcg

SEQ ID NO: 3117880 - RNA, 16 nt, Mycobacterium bovis subsp bovis AF2122/97
aggugcccaagcaguc

SEQ ID NO: 3117881 - RNA, 18 nt, Mycobacterium bovis subsp bovis AF2122/97
aggugcccaaggccagga

SEQ ID NO: 3117882 - RNA, 19 nt, Mycobacterium bovis subsp bovis AF2122/97
aggugccgaagaugaccgc

SEQ ID NO: 3117883 - RNA, 12 nt, Mycobacterium bovis subsp bovis AF2122/97
aggugccgaccg

SEQ ID NO: 3117884 - RNA, 11 nt, Mycobacterium bovis subsp bovis AF2122/97
aggugccgggg

SEQ ID NO: 3117885 - RNA, 16 nt, Mycobacterium bovis subsp bovis AF2122/97
aggugccggggcccca

SEQ ID NO: 3117886 - RNA, 16 nt, Mycobacterium bovis subsp bovis AF2122/97
aggugcgcgaccagga

SEQ ID NO: 3117887 - RNA, 22 nt, Mycobacterium bovis subsp bovis AF2122/97
aggugcuggugaucugcugggc

SEQ ID NO: 3117888 - RNA, 14 nt, Mycobacterium bovis subsp bovis AF2122/97
agguggccagcgcg

SEQ ID NO: 3117889 - RNA, 12 nt, Mycobacterium bovis subsp bovis AF2122/97
agguggccaggc

SEQ ID NO: 3117890 - RNA, 20 nt, Mycobacterium bovis subsp bovis AF2122/97
agguggccgcucuccacccc

SEQ ID NO: 3117891 - RNA, 14 nt, Mycobacterium bovis subsp bovis AF2122/97
agguggcgagcgcc

SEQ ID NO: 3117892 - RNA, 16 nt, Mycobacterium bovis subsp bovis AF2122/97
agguggcgagcgccuu

SEQ ID NO: 3117893 - RNA, 16 nt, Mycobacterium bovis subsp bovis AF2122/97
agguggcgcggggccg

SEQ ID NO: 3117894 - RNA, 20 nt, Mycobacterium bovis subsp bovis AF2122/97
agguggcgcggggccgccgc

SEQ ID NO: 3117895 - RNA, 21 nt, Mycobacterium bovis subsp bovis AF2122/97
agguggcguaauugucgaugu

SEQ ID NO: 3117896 - RNA, 24 nt, Mycobacterium bovis subsp bovis AF2122/97
agguggcguaauugucgauguccg

SEQ ID NO: 3117897 - RNA, 14 nt, Mycobacterium bovis subsp bovis AF2122/97
agguggcugcgccg

SEQ ID NO: 3117898 - RNA, 22 nt, Mycobacterium bovis subsp bovis AF2122/97
agguggcuggcugugccgagcu

SEQ ID NO: 3117899 - RNA, 15 nt, Mycobacterium bovis subsp bovis AF2122/97
aggugggauugaagc

SEQ ID NO: 3117900 - RNA, 19 nt, Mycobacterium bovis subsp bovis AF2122/97
aggugggcguuggcgacga

SEQ ID NO: 3117901 - RNA, 23 nt, Mycobacterium bovis subsp bovis AF2122/97
agguggucaucgccacgccugcu

SEQ ID NO: 3117902 - RNA, 20 nt, Mycobacterium bovis subsp bovis AF2122/97
agguggucuuggcgguggcc

SEQ ID NO: 3117903 - RNA, 23 nt, Mycobacterium bovis subsp bovis AF2122/97
agguggugacacgacgugcagga

SEQ ID NO: 3117904 - RNA, 19 nt, Mycobacterium bovis subsp bovis AF2122/97
agguguagcccuccgagca

SEQ ID NO: 3117905 - RNA, 15 nt, Mycobacterium bovis subsp bovis AF2122/97
aggugucgggcucgc

SEQ ID NO: 3117906 - RNA, 21 nt, Mycobacterium bovis subsp bovis AF2122/97
aggugugcgacgacggcgccg

SEQ ID NO: 3117907 - RNA, 19 nt, Mycobacterium bovis subsp bovis AF2122/97
aggugugcgucuccagcug

SEQ ID NO: 3117908 - RNA, 22 nt, Mycobacterium bovis subsp bovis AF2122/97
agguguguggcgccggggacca

SEQ ID NO: 3117909 - RNA, 15 nt, Mycobacterium bovis subsp bovis AF2122/97
agguguguggcggcg

SEQ ID NO: 3117910 - RNA, 18 nt, Mycobacterium bovis subsp bovis AF2122/97
agguguugcgguggguga

SEQ ID NO: 3117911 - RNA, 17 nt, Mycobacterium bovis subsp bovis AF2122/97
agguguuggugcggggu

SEQ ID NO: 3117912 - RNA, 23 nt, Mycobacterium bovis subsp bovis AF2122/97
agguuccaccgggcgucgucggu

SEQ ID NO: 3117913 - RNA, 16 nt, Mycobacterium bovis subsp bovis AF2122/97
agguuccacggccagg

SEQ ID NO: 3117914 - RNA, 17 nt, Mycobacterium bovis subsp bovis AF2122/97
agguucgaucgcgguga

SEQ ID NO: 3117915 - RNA, 16 nt, Mycobacterium bovis subsp bovis AF2122/97
agguucuucuccacca

SEQ ID NO: 3117916 - RNA, 19 nt, Mycobacterium bovis subsp bovis AF2122/97
agguucuucuccaccaccg

SEQ ID NO: 3117917 - RNA, 16 nt, Mycobacterium bovis subsp bovis AF2122/97
agguugaacgccgcca

SEQ ID NO: 3117918 - RNA, 21 nt, Mycobacterium bovis subsp bovis AF2122/97
agguugcaaccuugggcgccg

SEQ ID NO: 3117919 - RNA, 15 nt, Mycobacterium bovis subsp bovis AF2122/97
agguugccgaaguuu

SEQ ID NO: 3117920 - RNA, 19 nt, Mycobacterium bovis subsp bovis AF2122/97
agguugccgcaccagucgc

SEQ ID NO: 3117921 - RNA, 17 nt, Mycobacterium bovis subsp bovis AF2122/97
agguugccuuggcggcc

SEQ ID NO: 3117922 - RNA, 18 nt, Mycobacterium bovis subsp bovis AF2122/97
agguugccuuggcggcca

SEQ ID NO: 3117923 - RNA, 22 nt, Mycobacterium bovis subsp bovis AF2122/97
agguugcgccauaacaccgggu

SEQ ID NO: 3117924 - RNA, 16 nt, Mycobacterium bovis subsp bovis AF2122/97
agguugcgccgaccgg

SEQ ID NO: 3117925 - RNA, 16 nt, Mycobacterium bovis subsp bovis AF2122/97
agguugcguugcagga

SEQ ID NO: 3117926 - RNA, 19 nt, Mycobacterium bovis subsp bovis AF2122/97
agguuggcaagcacggcgu

SEQ ID NO: 3117927 - RNA, 17 nt, Mycobacterium bovis subsp bovis AF2122/97
agguuggccaccgccca

SEQ ID NO: 3117928 - RNA, 19 nt, Mycobacterium bovis subsp bovis AF2122/97
agguugggaacagccuauu

SEQ ID NO: 3117929 - RNA, 20 nt, Mycobacterium bovis subsp bovis AF2122/97
aguccagggcgccacgggug

SEQ ID NO: 3117930 - RNA, 19 nt, Mycobacterium bovis subsp bovis AF2122/97
aguccaugugcccaggucu

SEQ ID NO: 3117931 - RNA, 15 nt, Mycobacterium bovis subsp bovis AF2122/97
agucccacugccacu

SEQ ID NO: 3117932 - RNA, 15 nt, Mycobacterium bovis subsp bovis AF2122/97
agucccagcgccgca

SEQ ID NO: 3117933 - RNA, 18 nt, Mycobacterium bovis subsp bovis AF2122/97
aguccccaggugggcagc

SEQ ID NO: 3117934 - RNA, 12 nt, Mycobacterium bovis subsp bovis AF2122/97
agucccccgcuc

SEQ ID NO: 3117935 - RNA, 20 nt, Mycobacterium bovis subsp bovis AF2122/97
aguccccgcuuggcgagcca

SEQ ID NO: 3117936 - RNA, 22 nt, Mycobacterium bovis subsp bovis AF2122/97
agucccgaacaauucacgcacc

SEQ ID NO: 3117937 - RNA, 20 nt, Mycobacterium bovis subsp bovis AF2122/97
agucccgccguugccgccgu

SEQ ID NO: 3117938 - RNA, 19 nt, Mycobacterium bovis subsp bovis AF2122/97
agucccgguagaccaugaa

SEQ ID NO: 3117939 - RNA, 19 nt, Mycobacterium bovis subsp bovis AF2122/97
agucccgugacgaacuucg

SEQ ID NO: 3117940 - RNA, 17 nt, Mycobacterium bovis subsp bovis AF2122/97
aguccgaaagccgccga

SEQ ID NO: 3117941 - RNA, 17 nt, Mycobacterium bovis subsp bovis AF2122/97
aguccgacaccacggac

SEQ ID NO: 3117942 - RNA, 22 nt, Mycobacterium bovis subsp bovis AF2122/97
aguccgacaccacggaccagcg

SEQ ID NO: 3117943 - RNA, 16 nt, Mycobacterium bovis subsp bovis AF2122/97
aguccgacaccggcgg

SEQ ID NO: 3117944 - RNA, 20 nt, Mycobacterium bovis subsp bovis AF2122/97
aguccgacaccggcggcauc

SEQ ID NO: 3117945 - RNA, 17 nt, Mycobacterium bovis subsp bovis AF2122/97
aguccgacaguccgcgc

SEQ ID NO: 3117946 - RNA, 20 nt, Mycobacterium bovis subsp bovis AF2122/97
aguccgacaguccgcgccgg

SEQ ID NO: 3117947 - RNA, 15 nt, Mycobacterium bovis subsp bovis AF2122/97
aguccgagacgucgg

SEQ ID NO: 3117948 - RNA, 16 nt, Mycobacterium bovis subsp bovis AF2122/97
aguccgagcuuggccg

SEQ ID NO: 3117949 - RNA, 20 nt, Mycobacterium bovis subsp bovis AF2122/97
aguccgagggcgucgccgcc

SEQ ID NO: 3117950 - RNA, 21 nt, Mycobacterium bovis subsp bovis AF2122/97
aguccgaucacccgcacucca

SEQ ID NO: 3117951 - RNA, 17 nt, Mycobacterium bovis subsp bovis AF2122/97
aguccgaucgccgaggc

SEQ ID NO: 3117952 - RNA, 16 nt, Mycobacterium bovis subsp bovis AF2122/97
aguccgcauggucagc

SEQ ID NO: 3117953 - RNA, 20 nt, Mycobacterium bovis subsp bovis AF2122/97
aguccgcgccgacggccagc

SEQ ID NO: 3117954 - RNA, 13 nt, Mycobacterium bovis subsp bovis AF2122/97
aguccgcgccggc

SEQ ID NO: 3117955 - RNA, 20 nt, Mycobacterium bovis subsp bovis AF2122/97
aguccgcgccggcgggcgcg

SEQ ID NO: 3117956 - RNA, 18 nt, Mycobacterium bovis subsp bovis AF2122/97
aguccgcgcgcaagucga

SEQ ID NO: 3117957 - RNA, 14 nt, Mycobacterium bovis subsp bovis AF2122/97
aguccgcgcucagc

SEQ ID NO: 3117958 - RNA, 20 nt, Mycobacterium bovis subsp bovis AF2122/97
aguccgcgcucagcuccggc

SEQ ID NO: 3117959 - RNA, 23 nt, Mycobacterium bovis subsp bovis AF2122/97
aguccgcggaucaccaucgccgc

SEQ ID NO: 3117960 - RNA, 18 nt, Mycobacterium bovis subsp bovis AF2122/97
aguccgcuacugcgacca

SEQ ID NO: 3117961 - RNA, 15 nt, Mycobacterium bovis subsp bovis AF2122/97
aguccgcugagcggg

SEQ ID NO: 3117962 - RNA, 15 nt, Mycobacterium bovis subsp bovis AF2122/97
aguccggacggcagc

SEQ ID NO: 3117963 - RNA, 20 nt, Mycobacterium bovis subsp bovis AF2122/97
aguccggcccccgacuccgg

SEQ ID NO: 3117964 - RNA, 14 nt, Mycobacterium bovis subsp bovis AF2122/97
aguccggccgaccc

SEQ ID NO: 3117965 - RNA, 21 nt, Mycobacterium bovis subsp bovis AF2122/97
aguccggcucauccgacggga

SEQ ID NO: 3117966 - RNA, 21 nt, Mycobacterium bovis subsp bovis AF2122/97
aguccgggccccuucgcagca

SEQ ID NO: 3117967 - RNA, 19 nt, Mycobacterium bovis subsp bovis AF2122/97
aguccgguagcuguggugg

SEQ ID NO: 3117968 - RNA, 14 nt, Mycobacterium bovis subsp bovis AF2122/97
aguccggucgcggc

SEQ ID NO: 3117969 - RNA, 17 nt, Mycobacterium bovis subsp bovis AF2122/97
aguccguacuugccacc

SEQ ID NO: 3117970 - RNA, 21 nt, Mycobacterium bovis subsp bovis AF2122/97
aguccgucgacaccgcggacc

SEQ ID NO: 3117971 - RNA, 22 nt, Mycobacterium bovis subsp bovis AF2122/97
aguccucgggcaggcggccagc

SEQ ID NO: 3117972 - RNA, 17 nt, Mycobacterium bovis subsp bovis AF2122/97
aguccugcagugcggcg

SEQ ID NO: 3117973 - RNA, 14 nt, Mycobacterium bovis subsp bovis AF2122/97
aguccuggcucggc

SEQ ID NO: 3117974 - RNA, 12 nt, Mycobacterium bovis subsp bovis AF2122/97
aguccuugcgcc

SEQ ID NO: 3117975 - RNA, 16 nt, Mycobacterium bovis subsp bovis AF2122/97
agucgaaaacagcgau

SEQ ID NO: 3117976 - RNA, 19 nt, Mycobacterium bovis subsp bovis AF2122/97
agucgaaaacagcgauccg

SEQ ID NO: 3117977 - RNA, 21 nt, Mycobacterium bovis subsp bovis AF2122/97
agucgaaaacagcgauccgau

SEQ ID NO: 3117978 - RNA, 21 nt, Mycobacterium bovis subsp bovis AF2122/97
agucgaagaaccugagcacca

SEQ ID NO: 3117979 - RNA, 22 nt, Mycobacterium bovis subsp bovis AF2122/97
agucgaauggcaacacaccgaa

SEQ ID NO: 3117980 - RNA, 15 nt, Mycobacterium bovis subsp bovis AF2122/97
agucgaaugucccgg

SEQ ID NO: 3117981 - RNA, 18 nt, Mycobacterium bovis subsp bovis AF2122/97
agucgaccaugagccggc

SEQ ID NO: 3117982 - RNA, 21 nt, Mycobacterium bovis subsp bovis AF2122/97
agucgaccaugagccggcgcc

SEQ ID NO: 3117983 - RNA, 13 nt, Mycobacterium bovis subsp bovis AF2122/97
agucgacccugcc

SEQ ID NO: 3117984 - RNA, 19 nt, Mycobacterium bovis subsp bovis AF2122/97
agucgacgaacgccucacc

SEQ ID NO: 3117985 - RNA, 16 nt, Mycobacterium bovis subsp bovis AF2122/97
agucgacgaacucgcc

SEQ ID NO: 3117986 - RNA, 18 nt, Mycobacterium bovis subsp bovis AF2122/97
agucgacgacguggcugc

SEQ ID NO: 3117987 - RNA, 16 nt, Mycobacterium bovis subsp bovis AF2122/97
agucgacgccgcagcg

SEQ ID NO: 3117988 - RNA, 14 nt, Mycobacterium bovis subsp bovis AF2122/97
agucgacggccagu

SEQ ID NO: 3117989 - RNA, 18 nt, Mycobacterium bovis subsp bovis AF2122/97
agucgacggugccgucgg

SEQ ID NO: 3117990 - RNA, 19 nt, Mycobacterium bovis subsp bovis AF2122/97
agucgacggugccgucggu

SEQ ID NO: 3117991 - RNA, 21 nt, Mycobacterium bovis subsp bovis AF2122/97
agucgacggugccgucggugc

SEQ ID NO: 3117992 - RNA, 13 nt, Mycobacterium bovis subsp bovis AF2122/97
agucgacgucgau

SEQ ID NO: 3117993 - RNA, 19 nt, Mycobacterium bovis subsp bovis AF2122/97
agucgacgucucuggugca

SEQ ID NO: 3117994 - RNA, 20 nt, Mycobacterium bovis subsp bovis AF2122/97
agucgaucacguacgccgcc

SEQ ID NO: 3117995 - RNA, 23 nt, Mycobacterium bovis subsp bovis AF2122/97
agucgaucacguacgccgccgau

SEQ ID NO: 3117996 - RNA, 13 nt, Mycobacterium bovis subsp bovis AF2122/97
agucgaucgcggc

SEQ ID NO: 3117997 - RNA, 12 nt, Mycobacterium bovis subsp bovis AF2122/97
agucgaugcuga

SEQ ID NO: 3117998 - RNA, 19 nt, Mycobacterium bovis subsp bovis AF2122/97
agucgauguacaccgugcg

SEQ ID NO: 3117999 - RNA, 17 nt, Mycobacterium bovis subsp bovis AF2122/97
agucgauugccaccgag

SEQ ID NO: 3118000 - RNA, 20 nt, Mycobacterium bovis subsp bovis AF2122/97
agucgauuggcugcgccgau

SEQ ID NO: 3118001 - RNA, 23 nt, Mycobacterium bovis subsp bovis AF2122/97
agucgauuggcugcgccgauacc

SEQ ID NO: 3118002 - RNA, 18 nt, Mycobacterium bovis subsp bovis AF2122/97
agucgauuucggcggcga

SEQ ID NO: 3118003 - RNA, 21 nt, Mycobacterium bovis subsp bovis AF2122/97
agucgauuucggcggcgaggc

SEQ ID NO: 3118004 - RNA, 18 nt, Mycobacterium bovis subsp bovis AF2122/97
agucgcacggugccgccg

SEQ ID NO: 3118005 - RNA, 15 nt, Mycobacterium bovis subsp bovis AF2122/97
agucgcacugcgccg

SEQ ID NO: 3118006 - RNA, 22 nt, Mycobacterium bovis subsp bovis AF2122/97
agucgcagccaggcacguccga

SEQ ID NO: 3118007 - RNA, 16 nt, Mycobacterium bovis subsp bovis AF2122/97
agucgcaggaucggcg

SEQ ID NO: 3118008 - RNA, 15 nt, Mycobacterium bovis subsp bovis AF2122/97
agucgccagaccgca

SEQ ID NO: 3118009 - RNA, 16 nt, Mycobacterium bovis subsp bovis AF2122/97
agucgcccagccgagc

SEQ ID NO: 3118010 - RNA, 23 nt, Mycobacterium bovis subsp bovis AF2122/97
agucgccgaggacgccggcgccg

SEQ ID NO: 3118011 - RNA, 14 nt, Mycobacterium bovis subsp bovis AF2122/97
agucgccgcgggca

SEQ ID NO: 3118012 - RNA, 13 nt, Mycobacterium bovis subsp bovis AF2122/97
agucgccggccgg

SEQ ID NO: 3118013 - RNA, 14 nt, Mycobacterium bovis subsp bovis AF2122/97
agucgccggccggc

SEQ ID NO: 3118014 - RNA, 13 nt, Mycobacterium bovis subsp bovis AF2122/97
agucgccgucgug

SEQ ID NO: 3118015 - RNA, 13 nt, Mycobacterium bovis subsp bovis AF2122/97
agugccagguggg

SEQ ID NO: 3118016 - RNA, 21 nt, Mycobacterium bovis subsp bovis AF2122/97
agugccagugcgcagcccgca

SEQ ID NO: 3118017 - RNA, 15 nt, Mycobacterium bovis subsp bovis AF2122/97
agugccccgccgagc

SEQ ID NO: 3118018 - RNA, 18 nt, Mycobacterium bovis subsp bovis AF2122/97
agugccccgccgagcggu

SEQ ID NO: 3118019 - RNA, 18 nt, Mycobacterium bovis subsp bovis AF2122/97
agugcccgcacugccgcc

SEQ ID NO: 3118020 - RNA, 20 nt, Mycobacterium bovis subsp bovis AF2122/97
agugcccgcacugccgccgg

SEQ ID NO: 3118021 - RNA, 15 nt, Mycobacterium bovis subsp bovis AF2122/97
agugcccggccaacc

SEQ ID NO: 3118022 - RNA, 16 nt, Mycobacterium bovis subsp bovis AF2122/97
agugcccggccaacca

SEQ ID NO: 3118023 - RNA, 22 nt, Mycobacterium bovis subsp bovis AF2122/97
agugccgccaccgccaccgcgg

SEQ ID NO: 3118024 - RNA, 12 nt, Mycobacterium bovis subsp bovis AF2122/97
agugccgccggc

SEQ ID NO: 3118025 - RNA, 15 nt, Mycobacterium bovis subsp bovis AF2122/97
agugccgccgucgcc

SEQ ID NO: 3118026 - RNA, 16 nt, Mycobacterium bovis subsp bovis AF2122/97
agugccgccgucgcca

SEQ ID NO: 3118027 - RNA, 13 nt, Mycobacterium bovis subsp bovis AF2122/97
agugccuccgaca

SEQ ID NO: 3118028 - RNA, 21 nt, Mycobacterium bovis subsp bovis AF2122/97
agugccucgauuguggccagc

SEQ ID NO: 3118029 - RNA, 12 nt, Mycobacterium bovis subsp bovis AF2122/97
agugccucgcgg

SEQ ID NO: 3118030 - RNA, 14 nt, Mycobacterium bovis subsp bovis AF2122/97
agugccucggcgau

SEQ ID NO: 3118031 - RNA, 23 nt, Mycobacterium bovis subsp bovis AF2122/97
agugccucggcgaugggccgguc

SEQ ID NO: 3118032 - RNA, 15 nt, Mycobacterium bovis subsp bovis AF2122/97
agugccucggcggcg

SEQ ID NO: 3118033 - RNA, 22 nt, Mycobacterium bovis subsp bovis AF2122/97
agugccuuccucggcaagucga

SEQ ID NO: 3118034 - RNA, 14 nt, Mycobacterium bovis subsp bovis AF2122/97
agugcgacccgggc

SEQ ID NO: 3118035 - RNA, 14 nt, Mycobacterium bovis subsp bovis AF2122/97
agugcgacggcgac

SEQ ID NO: 3118036 - RNA, 22 nt, Mycobacterium bovis subsp bovis AF2122/97
agugcgacguaaagggcgucgu

SEQ ID NO: 3118037 - RNA, 18 nt, Mycobacterium bovis subsp bovis AF2122/97
agugcgacucugcgucug

SEQ ID NO: 3118038 - RNA, 20 nt, Mycobacterium bovis subsp bovis AF2122/97
agugcgacugcgaaugcugg

SEQ ID NO: 3118039 - RNA, 15 nt, Mycobacterium bovis subsp bovis AF2122/97
agugcgaugcggugu

SEQ ID NO: 3118040 - RNA, 19 nt, Mycobacterium bovis subsp bovis AF2122/97
agugcgcagaacaccaccg

SEQ ID NO: 3118041 - RNA, 15 nt, Mycobacterium bovis subsp bovis AF2122/97
agugcgcagcccgca

SEQ ID NO: 3118042 - RNA, 23 nt, Mycobacterium bovis subsp bovis AF2122/97
agugcgcgcuggaucgugcuggu

SEQ ID NO: 3118043 - RNA, 16 nt, Mycobacterium bovis subsp bovis AF2122/97
agugcgcggaucaaca

SEQ ID NO: 3118044 - RNA, 22 nt, Mycobacterium bovis subsp bovis AF2122/97
agugcggcacgaucgccaacga

SEQ ID NO: 3118045 - RNA, 21 nt, Mycobacterium bovis subsp bovis AF2122/97
agugcggccuuggcgacgucg

SEQ ID NO: 3118046 - RNA, 15 nt, Mycobacterium bovis subsp bovis AF2122/97
agugcggcugcaacg

SEQ ID NO: 3118047 - RNA, 17 nt, Mycobacterium bovis subsp bovis AF2122/97
agugcggcugcaacgau

SEQ ID NO: 3118048 - RNA, 14 nt, Mycobacterium bovis subsp bovis AF2122/97
agugcgggcaugcc

SEQ ID NO: 3118049 - RNA, 13 nt, Mycobacterium bovis subsp bovis AF2122/97
agugcgggcggcg

SEQ ID NO: 3118050 - RNA, 14 nt, Mycobacterium bovis subsp bovis AF2122/97
agugcgggcggcgu

SEQ ID NO: 3118051 - RNA, 22 nt, Mycobacterium bovis subsp bovis AF2122/97
agugcggugagauggcggugag

SEQ ID NO: 3118052 - RNA, 18 nt, Mycobacterium bovis subsp bovis AF2122/97
agugcgguggcaggugau

SEQ ID NO: 3118053 - RNA, 19 nt, Mycobacterium bovis subsp bovis AF2122/97
agugcggugugugcaagcc

SEQ ID NO: 3118054 - RNA, 23 nt, Mycobacterium bovis subsp bovis AF2122/97
agugcggugugugcaagccgaac

SEQ ID NO: 3118055 - RNA, 17 nt, Mycobacterium bovis subsp bovis AF2122/97
agugcgucucgguggcu

SEQ ID NO: 3118056 - RNA, 14 nt, Mycobacterium bovis subsp bovis AF2122/97
agugcuccguccga

SEQ ID NO: 3118057 - RNA, 21 nt, Mycobacterium bovis subsp bovis AF2122/97
agugcucgcaaucguuggcca

SEQ ID NO: 3118058 - RNA, 13 nt, Mycobacterium bovis subsp bovis AF2122/97
agugcucgcagcc

SEQ ID NO: 3118059 - RNA, 13 nt, Mycobacterium bovis subsp bovis AF2122/97
agugcucgccggc

SEQ ID NO: 3118060 - RNA, 20 nt, Mycobacterium bovis subsp bovis AF2122/97
agugcuggccgaagaacuca

SEQ ID NO: 3118061 - RNA, 13 nt, Mycobacterium bovis subsp bovis AF2122/97
agugcuucuuccc

SEQ ID NO: 3118062 - RNA, 17 nt, Mycobacterium bovis subsp bovis AF2122/97
aguggaaacccgccgaa

SEQ ID NO: 3118063 - RNA, 17 nt, Mycobacterium bovis subsp bovis AF2122/97
aguggaagccgaccacc

SEQ ID NO: 3118064 - RNA, 18 nt, Mycobacterium bovis subsp bovis AF2122/97
aguggacgugucaucacg

SEQ ID NO: 3118065 - RNA, 19 nt, Mycobacterium bovis subsp bovis AF2122/97
aguggagccccgacugcug

SEQ ID NO: 3118066 - RNA, 22 nt, Mycobacterium bovis subsp bovis AF2122/97
aguggauccggcagcagccggc

SEQ ID NO: 3118067 - RNA, 14 nt, Mycobacterium bovis subsp bovis AF2122/97
aguggcaaucccgc

SEQ ID NO: 3118068 - RNA, 18 nt, Mycobacterium bovis subsp bovis AF2122/97
aguggcagccagcggcga

SEQ ID NO: 3118069 - RNA, 16 nt, Mycobacterium bovis subsp bovis AF2122/97
aguggcagcccgucgg

SEQ ID NO: 3118070 - RNA, 23 nt, Mycobacterium bovis subsp bovis AF2122/97
aguggcccgcgggcaagccggac

SEQ ID NO: 3118071 - RNA, 19 nt, Mycobacterium bovis subsp bovis AF2122/97
aguggccgcauuagccugc

SEQ ID NO: 3118072 - RNA, 12 nt, Mycobacterium bovis subsp bovis AF2122/97
aguggccgccgg

SEQ ID NO: 3118073 - RNA, 14 nt, Mycobacterium bovis subsp bovis AF2122/97
aguggccgccgggc

SEQ ID NO: 3118074 - RNA, 13 nt, Mycobacterium bovis subsp bovis AF2122/97
aguggccguggau

SEQ ID NO: 3118075 - RNA, 16 nt, Mycobacterium bovis subsp bovis AF2122/97
aguggcgacgagcaac

SEQ ID NO: 3118076 - RNA, 19 nt, Mycobacterium bovis subsp bovis AF2122/97
aguggcgacgagcaacgcc

SEQ ID NO: 3118077 - RNA, 15 nt, Mycobacterium bovis subsp bovis AF2122/97
aguggcgcaccaccu

SEQ ID NO: 3118078 - RNA, 16 nt, Mycobacterium bovis subsp bovis AF2122/97
aguggcgccagggccu

SEQ ID NO: 3118079 - RNA, 17 nt, Mycobacterium bovis subsp bovis AF2122/97
aguggcgcgcggcgccg

SEQ ID NO: 3118080 - RNA, 20 nt, Mycobacterium bovis subsp bovis AF2122/97
aguggcgcgcggcgccgcaa

SEQ ID NO: 3118081 - RNA, 13 nt, Mycobacterium bovis subsp bovis AF2122/97
aguggcgcggcga

SEQ ID NO: 3118082 - RNA, 17 nt, Mycobacterium bovis subsp bovis AF2122/97
aguggcuacgcgaucag

SEQ ID NO: 3118083 - RNA, 22 nt, Mycobacterium bovis subsp bovis AF2122/97
aguggcuguacccgaccagcac

SEQ ID NO: 3118084 - RNA, 13 nt, Mycobacterium bovis subsp bovis AF2122/97
agugggacuggcg

SEQ ID NO: 3118085 - RNA, 20 nt, Mycobacterium bovis subsp bovis AF2122/97
agugggaugaccuuggccgu

SEQ ID NO: 3118086 - RNA, 13 nt, Mycobacterium bovis subsp bovis AF2122/97
agugggccgacgu

SEQ ID NO: 3118087 - RNA, 20 nt, Mycobacterium bovis subsp bovis AF2122/97
agugggcgguaccucgucga

SEQ ID NO: 3118088 - RNA, 18 nt, Mycobacterium bovis subsp bovis AF2122/97
agugggcguuggcggcaa

SEQ ID NO: 3118089 - RNA, 18 nt, Mycobacterium bovis subsp bovis AF2122/97
agugggcuuuugcgucug

SEQ ID NO: 3118090 - RNA, 20 nt, Mycobacterium bovis subsp bovis AF2122/97
agugggcuuuugcgucugcu

SEQ ID NO: 3118091 - RNA, 18 nt, Mycobacterium bovis subsp bovis AF2122/97
aguggggguccggcggcc

SEQ ID NO: 3118092 - RNA, 22 nt, Mycobacterium bovis subsp bovis AF2122/97
agugggggugguaccggcggcg

SEQ ID NO: 3118093 - RNA, 14 nt, Mycobacterium bovis subsp bovis AF2122/97
agugggugccggca

SEQ ID NO: 3118094 - RNA, 22 nt, Mycobacterium bovis subsp bovis AF2122/97
agugggugccggcacccgucgg

SEQ ID NO: 3118095 - RNA, 16 nt, Mycobacterium bovis subsp bovis AF2122/97
agugguaggccgccgg

SEQ ID NO: 3118096 - RNA, 23 nt, Mycobacterium bovis subsp bovis AF2122/97
aguggucccguucgcccgcccgu

SEQ ID NO: 3118097 - RNA, 15 nt, Mycobacterium bovis subsp bovis AF2122/97
aguggugaccgacgc

SEQ ID NO: 3118098 - RNA, 20 nt, Mycobacterium bovis subsp bovis AF2122/97
aguggugaccgacgcggaca

SEQ ID NO: 3118099 - RNA, 18 nt, Mycobacterium bovis subsp bovis AF2122/97
aguggugauccagccguc

SEQ ID NO: 3118100 - RNA, 19 nt, Mycobacterium bovis subsp bovis AF2122/97
aguggugauccagccgucg

SEQ ID NO: 3118101 - RNA, 15 nt, Mycobacterium bovis subsp bovis AF2122/97
aguggugggcguggc

SEQ ID NO: 3118102 - RNA, 16 nt, Mycobacterium bovis subsp bovis AF2122/97
aguuggcuugcgcgca

SEQ ID NO: 3118103 - RNA, 15 nt, Mycobacterium bovis subsp bovis AF2122/97
aguugggcguucagg

SEQ ID NO: 3118104 - RNA, 15 nt, Mycobacterium bovis subsp bovis AF2122/97
aguugggugggugca

SEQ ID NO: 3118105 - RNA, 16 nt, Mycobacterium bovis subsp bovis AF2122/97
aguugguucaccgcga

SEQ ID NO: 3118106 - RNA, 15 nt, Mycobacterium bovis subsp bovis AF2122/97
aguuguagacgucga

SEQ ID NO: 3118107 - RNA, 21 nt, Mycobacterium bovis subsp bovis AF2122/97
aguugugcgcacucuuuccuu

SEQ ID NO: 3118108 - RNA, 23 nt, Mycobacterium bovis subsp bovis AF2122/97
aguugugcguugcgcugcgcgac

SEQ ID NO: 3118109 - RNA, 17 nt, Mycobacterium bovis subsp bovis AF2122/97
aguuguucgugccggcg

SEQ ID NO: 3118110 - RNA, 12 nt, Mycobacterium bovis subsp bovis AF2122/97
aguuguugcagg

SEQ ID NO: 3118111 - RNA, 13 nt, Mycobacterium bovis subsp bovis AF2122/97
aguuguugcagga

SEQ ID NO: 3118112 - RNA, 19 nt, Mycobacterium bovis subsp bovis AF2122/97
aguuucaccuugcgcacca

SEQ ID NO: 3118113 - RNA, 19 nt, Mycobacterium bovis subsp bovis AF2122/97
aguuucugcucgaccguca

SEQ ID NO: 3118114 - RNA, 13 nt, Mycobacterium bovis subsp bovis AF2122/97
aguuuggcggcgc

SEQ ID NO: 3118115 - RNA, 14 nt, Mycobacterium bovis subsp bovis AF2122/97
aguuuucaccgcga

SEQ ID NO: 3118116 - RNA, 13 nt, Mycobacterium bovis subsp bovis AF2122/97
aguuuucggccgc

SEQ ID NO: 3118117 - RNA, 23 nt, Mycobacterium bovis subsp bovis AF2122/97
auaaacccgaggcucgugcgugu

SEQ ID NO: 3118118 - RNA, 17 nt, Mycobacterium bovis subsp bovis AF2122/97
auaaaccgcacaucgcu

SEQ ID NO: 3118119 - RNA, 16 nt, Mycobacterium bovis subsp bovis AF2122/97
auaacagcaggcauuc

SEQ ID NO: 3118120 - RNA, 17 nt, Mycobacterium bovis subsp bovis AF2122/97
auaacccaaccgcgcca

SEQ ID NO: 3118121 - RNA, 15 nt, Mycobacterium bovis subsp bovis AF2122/97
auaaccggccauguc

SEQ ID NO: 3118122 - RNA, 22 nt, Mycobacterium bovis subsp bovis AF2122/97
auaaccggcgcgccccgccgca

SEQ ID NO: 3118123 - RNA, 19 nt, Mycobacterium bovis subsp bovis AF2122/97
auaaccguugaccucuucg

SEQ ID NO: 3118124 - RNA, 14 nt, Mycobacterium bovis subsp bovis AF2122/97
auaacgacucgcga

SEQ ID NO: 3118125 - RNA, 14 nt, Mycobacterium bovis subsp bovis AF2122/97
auaacgcggaguuc

SEQ ID NO: 3118126 - RNA, 23 nt, Mycobacterium bovis subsp bovis AF2122/97
auaacuaauuuggugguguucau

SEQ ID NO: 3118127 - RNA, 14 nt, Mycobacterium bovis subsp bovis AF2122/97
auaacuccgcggcg

SEQ ID NO: 3118128 - RNA, 21 nt, Mycobacterium bovis subsp bovis AF2122/97
auaagcucguagagcaccgca

SEQ ID NO: 3118129 - RNA, 18 nt, Mycobacterium bovis subsp bovis AF2122/97
auaaggaccgcgcccaga

SEQ ID NO: 3118130 - RNA, 20 nt, Mycobacterium bovis subsp bovis AF2122/97
auacacccaacucaugggcc

SEQ ID NO: 3118131 - RNA, 14 nt, Mycobacterium bovis subsp bovis AF2122/97
auacaccuccugcc

SEQ ID NO: 3118132 - RNA, 15 nt, Mycobacterium bovis subsp bovis AF2122/97
auacacgagguagcc

SEQ ID NO: 3118133 - RNA, 13 nt, Mycobacterium bovis subsp bovis AF2122/97
auacacggcggcg

SEQ ID NO: 3118134 - RNA, 17 nt, Mycobacterium bovis subsp bovis AF2122/97
auacagaucuggguucc

SEQ ID NO: 3118135 - RNA, 17 nt, Mycobacterium bovis subsp bovis AF2122/97
auacagcaggccgcgcu

SEQ ID NO: 3118136 - RNA, 13 nt, Mycobacterium bovis subsp bovis AF2122/97
auacagccgccga

SEQ ID NO: 3118137 - RNA, 22 nt, Mycobacterium bovis subsp bovis AF2122/97
auacagcggaggauagggcuuu

SEQ ID NO: 3118138 - RNA, 23 nt, Mycobacterium bovis subsp bovis AF2122/97
auacaggccacgcaccgggugca

SEQ ID NO: 3118139 - RNA, 20 nt, Mycobacterium bovis subsp bovis AF2122/97
auacaggcccgccagcaggg

SEQ ID NO: 3118140 - RNA, 19 nt, Mycobacterium bovis subsp bovis AF2122/97
auacauccaggcuguggcc

SEQ ID NO: 3118141 - RNA, 17 nt, Mycobacterium bovis subsp bovis AF2122/97
auacaucgccuugccca

SEQ ID NO: 3118142 - RNA, 22 nt, Mycobacterium bovis subsp bovis AF2122/97
auaccacuuugcguucccaucc

SEQ ID NO: 3118143 - RNA, 20 nt, Mycobacterium bovis subsp bovis AF2122/97
auaccagaccggccgacgug

SEQ ID NO: 3118144 - RNA, 21 nt, Mycobacterium bovis subsp bovis AF2122/97
auaccagcguuugaacgcaug

SEQ ID NO: 3118145 - RNA, 17 nt, Mycobacterium bovis subsp bovis AF2122/97
auaccagggcaucagca

SEQ ID NO: 3118146 - RNA, 16 nt, Mycobacterium bovis subsp bovis AF2122/97
auacccagcgcccggc

SEQ ID NO: 3118147 - RNA, 13 nt, Mycobacterium bovis subsp bovis AF2122/97
auacccaggaugu

SEQ ID NO: 3118148 - RNA, 19 nt, Mycobacterium bovis subsp bovis AF2122/97
auacccaucaacaucggcc

SEQ ID NO: 3118149 - RNA, 20 nt, Mycobacterium bovis subsp bovis AF2122/97
auacccaucaacaucggccc

SEQ ID NO: 3118150 - RNA, 12 nt, Mycobacterium bovis subsp bovis AF2122/97
auacccgggcgg

SEQ ID NO: 3118151 - RNA, 15 nt, Mycobacterium bovis subsp bovis AF2122/97
auaccgaacagcacc

SEQ ID NO: 3118152 - RNA, 23 nt, Mycobacterium bovis subsp bovis AF2122/97
auaccgaaccgguguagcagcgc

SEQ ID NO: 3118153 - RNA, 14 nt, Mycobacterium bovis subsp bovis AF2122/97
auaccgccagcgcc

SEQ ID NO: 3118154 - RNA, 18 nt, Mycobacterium bovis subsp bovis AF2122/97
auaccgccagcgccaccg

SEQ ID NO: 3118155 - RNA, 15 nt, Mycobacterium bovis subsp bovis AF2122/97
auaccgccgcgcagc

SEQ ID NO: 3118156 - RNA, 18 nt, Mycobacterium bovis subsp bovis AF2122/97
auaccgccgcgcagccgc

SEQ ID NO: 3118157 - RNA, 22 nt, Mycobacterium bovis subsp bovis AF2122/97
auaccgcucagggugcgccgca

SEQ ID NO: 3118158 - RNA, 14 nt, Mycobacterium bovis subsp bovis AF2122/97
auaccgcuggggcu

SEQ ID NO: 3118159 - RNA, 20 nt, Mycobacterium bovis subsp bovis AF2122/97
auaccgcuggggcuguaguc

SEQ ID NO: 3118160 - RNA, 19 nt, Mycobacterium bovis subsp bovis AF2122/97
auaccgcugggucgccguu

SEQ ID NO: 3118161 - RNA, 18 nt, Mycobacterium bovis subsp bovis AF2122/97
auaccggcaucgaagugc

SEQ ID NO: 3118162 - RNA, 20 nt, Mycobacterium bovis subsp bovis AF2122/97
auaccggcggcgagcggccu

SEQ ID NO: 3118163 - RNA, 15 nt, Mycobacterium bovis subsp bovis AF2122/97
auaccggcuggccag

SEQ ID NO: 3118164 - RNA, 17 nt, Mycobacterium bovis subsp bovis AF2122/97
auaccggcuggccaggu

SEQ ID NO: 3118165 - RNA, 21 nt, Mycobacterium bovis subsp bovis AF2122/97
auaccggcuggccagguggcc

SEQ ID NO: 3118166 - RNA, 21 nt, Mycobacterium bovis subsp bovis AF2122/97
auaccgggaggacaccagcug

SEQ ID NO: 3118167 - RNA, 21 nt, Mycobacterium bovis subsp bovis AF2122/97
auaccgguggcagccugcugc

SEQ ID NO: 3118168 - RNA, 23 nt, Mycobacterium bovis subsp bovis AF2122/97
auaccguucacccagcggaaccg

SEQ ID NO: 3118169 - RNA, 14 nt, Mycobacterium bovis subsp bovis AF2122/97
auaccucgccaucc

SEQ ID NO: 3118170 - RNA, 14 nt, Mycobacterium bovis subsp bovis AF2122/97
auaccucgccgccc

SEQ ID NO: 3118171 - RNA, 17 nt, Mycobacterium bovis subsp bovis AF2122/97
auaccucgccgcccugu

SEQ ID NO: 3118172 - RNA, 12 nt, Mycobacterium bovis subsp bovis AF2122/97
auaccucggcga

SEQ ID NO: 3118173 - RNA, 16 nt, Mycobacterium bovis subsp bovis AF2122/97
auaccuuccagaucgc

SEQ ID NO: 3118174 - RNA, 14 nt, Mycobacterium bovis subsp bovis AF2122/97
auacgaagccgccg

SEQ ID NO: 3118175 - RNA, 17 nt, Mycobacterium bovis subsp bovis AF2122/97
auacgagcagugaccgc

SEQ ID NO: 3118176 - RNA, 22 nt, Mycobacterium bovis subsp bovis AF2122/97
auacgauguucagguugcugau

SEQ ID NO: 3118177 - RNA, 20 nt, Mycobacterium bovis subsp bovis AF2122/97
auacgcaccgguaccgacgg

SEQ ID NO: 3118178 - RNA, 21 nt, Mycobacterium bovis subsp bovis AF2122/97
auacgccaccggcaaucggcg

SEQ ID NO: 3118179 - RNA, 19 nt, Mycobacterium bovis subsp bovis AF2122/97
auacgcccacuccagcagc

SEQ ID NO: 3118180 - RNA, 19 nt, Mycobacterium bovis subsp bovis AF2122/97
auacgccggccgcgcuggu

SEQ ID NO: 3118181 - RNA, 14 nt, Mycobacterium bovis subsp bovis AF2122/97
auacggccggccgu

SEQ ID NO: 3118182 - RNA, 13 nt, Mycobacterium bovis subsp bovis AF2122/97
auacgggcaguga

SEQ ID NO: 3118183 - RNA, 22 nt, Mycobacterium bovis subsp bovis AF2122/97
auacuaauggcgccaccggccg

SEQ ID NO: 3118184 - RNA, 15 nt, Mycobacterium bovis subsp bovis AF2122/97
auacuccgcgagccc

SEQ ID NO: 3118185 - RNA, 21 nt, Mycobacterium bovis subsp bovis AF2122/97
auacucgaguggcgaacgggu

SEQ ID NO: 3118186 - RNA, 14 nt, Mycobacterium bovis subsp bovis AF2122/97
auagaacucgccgc

SEQ ID NO: 3118187 - RNA, 19 nt, Mycobacterium bovis subsp bovis AF2122/97
auagaacucgccgcuggca

SEQ ID NO: 3118188 - RNA, 13 nt, Mycobacterium bovis subsp bovis AF2122/97
aucacaucgcccg

SEQ ID NO: 3118189 - RNA, 14 nt, Mycobacterium bovis subsp bovis AF2122/97
aucacaucgcccgg

SEQ ID NO: 3118190 - RNA, 23 nt, Mycobacterium bovis subsp bovis AF2122/97
aucacaucggccucugaccagcc

SEQ ID NO: 3118191 - RNA, 17 nt, Mycobacterium bovis subsp bovis AF2122/97
aucacaugcaagccgac

SEQ ID NO: 3118192 - RNA, 13 nt, Mycobacterium bovis subsp bovis AF2122/97
aucaccaccgcac

SEQ ID NO: 3118193 - RNA, 15 nt, Mycobacterium bovis subsp bovis AF2122/97
aucaccaccggcacc

SEQ ID NO: 3118194 - RNA, 18 nt, Mycobacterium bovis subsp bovis AF2122/97
aucaccaccggcaccgcu

SEQ ID NO: 3118195 - RNA, 22 nt, Mycobacterium bovis subsp bovis AF2122/97
aucaccacgaaugaucgucccg

SEQ ID NO: 3118196 - RNA, 18 nt, Mycobacterium bovis subsp bovis AF2122/97
aucaccacggcguugccg

SEQ ID NO: 3118197 - RNA, 19 nt, Mycobacterium bovis subsp bovis AF2122/97
aucaccacuggacccgccc

SEQ ID NO: 3118198 - RNA, 21 nt, Mycobacterium bovis subsp bovis AF2122/97
aucaccacuggacccgcccag

SEQ ID NO: 3118199 - RNA, 12 nt, Mycobacterium bovis subsp bovis AF2122/97
aucaccagaaau

SEQ ID NO: 3118200 - RNA, 14 nt, Mycobacterium bovis subsp bovis AF2122/97
aucaccagcagugg

SEQ ID NO: 3118201 - RNA, 20 nt, Mycobacterium bovis subsp bovis AF2122/97
aucaccaggguguauggcca

SEQ ID NO: 3118202 - RNA, 22 nt, Mycobacterium bovis subsp bovis AF2122/97
aucaccaggguuggcaccguca

SEQ ID NO: 3118203 - RNA, 23 nt, Mycobacterium bovis subsp bovis AF2122/97
aucaccaggguuggcaccgucag

SEQ ID NO: 3118204 - RNA, 13 nt, Mycobacterium bovis subsp bovis AF2122/97
aucaccauccagc

SEQ ID NO: 3118205 - RNA, 21 nt, Mycobacterium bovis subsp bovis AF2122/97
aucaccauccagcccaucccg

SEQ ID NO: 3118206 - RNA, 18 nt, Mycobacterium bovis subsp bovis AF2122/97
aucaccaugaucagcgcc

SEQ ID NO: 3118207 - RNA, 21 nt, Mycobacterium bovis subsp bovis AF2122/97
aucacccacucgacgucgucg

SEQ ID NO: 3118208 - RNA, 13 nt, Mycobacterium bovis subsp bovis AF2122/97
aucacccagcgcc

SEQ ID NO: 3118209 - RNA, 12 nt, Mycobacterium bovis subsp bovis AF2122/97
aucaccccgcca

SEQ ID NO: 3118210 - RNA, 17 nt, Mycobacterium bovis subsp bovis AF2122/97
aucaccccgccaugcgg

SEQ ID NO: 3118211 - RNA, 14 nt, Mycobacterium bovis subsp bovis AF2122/97
aucaccccggccgg

SEQ ID NO: 3118212 - RNA, 19 nt, Mycobacterium bovis subsp bovis AF2122/97
aucacccuguuugcccaac

SEQ ID NO: 3118213 - RNA, 21 nt, Mycobacterium bovis subsp bovis AF2122/97
aucaccgaacggcgaggugcc

SEQ ID NO: 3118214 - RNA, 21 nt, Mycobacterium bovis subsp bovis AF2122/97
aucaccgaauaccgccgcgca

SEQ ID NO: 3118215 - RNA, 21 nt, Mycobacterium bovis subsp bovis AF2122/97
aucaccgaaugcacgacggug

SEQ ID NO: 3118216 - RNA, 15 nt, Mycobacterium bovis subsp bovis AF2122/97
aucaccgacaccgug

SEQ ID NO: 3118217 - RNA, 16 nt, Mycobacterium bovis subsp bovis AF2122/97
aucaccgacgcgucgg

SEQ ID NO: 3118218 - RNA, 20 nt, Mycobacterium bovis subsp bovis AF2122/97
aucaccgccagcugggcagc

SEQ ID NO: 3118219 - RNA, 23 nt, Mycobacterium bovis subsp bovis AF2122/97
aucaccgccagcugggcagccag

SEQ ID NO: 3118220 - RNA, 20 nt, Mycobacterium bovis subsp bovis AF2122/97
aucaccgccgcggccgccgu

SEQ ID NO: 3118221 - RNA, 14 nt, Mycobacterium bovis subsp bovis AF2122/97
aucaccgccggcgg

SEQ ID NO: 3118222 - RNA, 22 nt, Mycobacterium bovis subsp bovis AF2122/97
aucaccgccuuugccgccggca

SEQ ID NO: 3118223 - RNA, 14 nt, Mycobacterium bovis subsp bovis AF2122/97
aucaccgcgccagc

SEQ ID NO: 3118224 - RNA, 22 nt, Mycobacterium bovis subsp bovis AF2122/97
aucaccgcguaguccaggccgu

SEQ ID NO: 3118225 - RNA, 22 nt, Mycobacterium bovis subsp bovis AF2122/97
aucaccgcuguguucagcgcau

SEQ ID NO: 3118226 - RNA, 17 nt, Mycobacterium bovis subsp bovis AF2122/97
aucaccggaacccccag

SEQ ID NO: 3118227 - RNA, 20 nt, Mycobacterium bovis subsp bovis AF2122/97
aucaccggagcgccgagcuc

SEQ ID NO: 3118228 - RNA, 18 nt, Mycobacterium bovis subsp bovis AF2122/97
aucaccggcauacagccg

SEQ ID NO: 3118229 - RNA, 22 nt, Mycobacterium bovis subsp bovis AF2122/97
aucaccggcaugcgugccggca

SEQ ID NO: 3118230 - RNA, 19 nt, Mycobacterium bovis subsp bovis AF2122/97
aucaccggcgcaccgucgc

SEQ ID NO: 3118231 - RNA, 18 nt, Mycobacterium bovis subsp bovis AF2122/97
aucaccggugcgcuggag

SEQ ID NO: 3118232 - RNA, 14 nt, Mycobacterium bovis subsp bovis AF2122/97
aucaccgucgcccg

SEQ ID NO: 3118233 - RNA, 22 nt, Mycobacterium bovis subsp bovis AF2122/97
aucaccgucguacucggcggcc

SEQ ID NO: 3118234 - RNA, 19 nt, Mycobacterium bovis subsp bovis AF2122/97
aucaccgugcggucgugcc

SEQ ID NO: 3118235 - RNA, 16 nt, Mycobacterium bovis subsp bovis AF2122/97
aucaccucaccaguca

SEQ ID NO: 3118236 - RNA, 17 nt, Mycobacterium bovis subsp bovis AF2122/97
aucaccucccgcggcac

SEQ ID NO: 3118237 - RNA, 15 nt, Mycobacterium bovis subsp bovis AF2122/97
aucaccucggcgacg

SEQ ID NO: 3118238 - RNA, 21 nt, Mycobacterium bovis subsp bovis AF2122/97
aucaccucggcgacgucggcg

SEQ ID NO: 3118239 - RNA, 20 nt, Mycobacterium bovis subsp bovis AF2122/97
aucaccugcagcacgacgug

SEQ ID NO: 3118240 - RNA, 21 nt, Mycobacterium bovis subsp bovis AF2122/97
aucaccuggcgugucgccgcc

SEQ ID NO: 3118241 - RNA, 15 nt, Mycobacterium bovis subsp bovis AF2122/97
aucaccuucggccga

SEQ ID NO: 3118242 - RNA, 23 nt, Mycobacterium bovis subsp bovis AF2122/97
aucaccuucggccgaccgggcuc

SEQ ID NO: 3118243 - RNA, 14 nt, Mycobacterium bovis subsp bovis AF2122/97
aucaccuucgucgc

SEQ ID NO: 3118244 - RNA, 20 nt, Mycobacterium bovis subsp bovis AF2122/97
aucaccuucgucgcggccgc

SEQ ID NO: 3118245 - RNA, 23 nt, Mycobacterium bovis subsp bovis AF2122/97
aucaccuucgucgcggccgcggc

SEQ ID NO: 3118246 - RNA, 14 nt, Mycobacterium bovis subsp bovis AF2122/97
aucacgaccgcgca

SEQ ID NO: 3118247 - RNA, 11 nt, Mycobacterium bovis subsp bovis AF2122/97
aucacgacgcc

SEQ ID NO: 3118248 - RNA, 19 nt, Mycobacterium bovis subsp bovis AF2122/97
aucacgauguccucgaugc

SEQ ID NO: 3118249 - RNA, 23 nt, Mycobacterium bovis subsp bovis AF2122/97
aucacgccaccauccccggcaac

SEQ ID NO: 3118250 - RNA, 14 nt, Mycobacterium bovis subsp bovis AF2122/97
aucacgccgccgga

SEQ ID NO: 3118251 - RNA, 16 nt, Mycobacterium bovis subsp bovis AF2122/97
aucacgccgccggcga

SEQ ID NO: 3118252 - RNA, 22 nt, Mycobacterium bovis subsp bovis AF2122/97
aucacgccggccucgccgaagc

SEQ ID NO: 3118253 - RNA, 15 nt, Mycobacterium bovis subsp bovis AF2122/97
aucacgcgaaugacg

SEQ ID NO: 3118254 - RNA, 14 nt, Mycobacterium bovis subsp bovis AF2122/97
aucacggaccaggc

SEQ ID NO: 3118255 - RNA, 14 nt, Mycobacterium bovis subsp bovis AF2122/97
aucacggcaccgaa

SEQ ID NO: 3118256 - RNA, 18 nt, Mycobacterium bovis subsp bovis AF2122/97
aucacggcaccgaagugc

SEQ ID NO: 3118257 - RNA, 13 nt, Mycobacterium bovis subsp bovis AF2122/97
aucacggccaacc

SEQ ID NO: 3118258 - RNA, 14 nt, Mycobacterium bovis subsp bovis AF2122/97
aucacggcggcccc

SEQ ID NO: 3118259 - RNA, 18 nt, Mycobacterium bovis subsp bovis AF2122/97
aucacggcggccccggca

SEQ ID NO: 3118260 - RNA, 15 nt, Mycobacterium bovis subsp bovis AF2122/97
aucacggcggggauc

SEQ ID NO: 3118261 - RNA, 18 nt, Mycobacterium bovis subsp bovis AF2122/97
aucacgggcuaccggcag

SEQ ID NO: 3118262 - RNA, 21 nt, Mycobacterium bovis subsp bovis AF2122/97
aucacgggcuaccggcagcug

SEQ ID NO: 3118263 - RNA, 23 nt, Mycobacterium bovis subsp bovis AF2122/97
aucacgggcuaccggcagcugcu

SEQ ID NO: 3118264 - RNA, 22 nt, Mycobacterium bovis subsp bovis AF2122/97
aucacgucgucagccaccgcau

SEQ ID NO: 3118265 - RNA, 11 nt, Mycobacterium bovis subsp bovis AF2122/97
aucacgugccg

SEQ ID NO: 3118266 - RNA, 16 nt, Mycobacterium bovis subsp bovis AF2122/97
aucacguggaccacgg

SEQ ID NO: 3118267 - RNA, 16 nt, Mycobacterium bovis subsp bovis AF2122/97
aucacguggugcggcc

SEQ ID NO: 3118268 - RNA, 22 nt, Mycobacterium bovis subsp bovis AF2122/97
aucacguggugcggccgggucg

SEQ ID NO: 3118269 - RNA, 14 nt, Mycobacterium bovis subsp bovis AF2122/97
aucacguugcgcug

SEQ ID NO: 3118270 - RNA, 22 nt, Mycobacterium bovis subsp bovis AF2122/97
aucacucacccgggcagccugc

SEQ ID NO: 3118271 - RNA, 18 nt, Mycobacterium bovis subsp bovis AF2122/97
aucacucccccacacacc

SEQ ID NO: 3118272 - RNA, 22 nt, Mycobacterium bovis subsp bovis AF2122/97
aucacugaggcugcggguggga

SEQ ID NO: 3118273 - RNA, 21 nt, Mycobacterium bovis subsp bovis AF2122/97
aucagaacgcggccucgucga

SEQ ID NO: 3118274 - RNA, 23 nt, Mycobacterium bovis subsp bovis AF2122/97
aucaugucgaagaaccggccgac

SEQ ID NO: 3118275 - RNA, 13 nt, Mycobacterium bovis subsp bovis AF2122/97
aucaugucggccg

SEQ ID NO: 3118276 - RNA, 14 nt, Mycobacterium bovis subsp bovis AF2122/97
aucaugucggccgg

SEQ ID NO: 3118277 - RNA, 21 nt, Mycobacterium bovis subsp bovis AF2122/97
aucauguggucaacggccgac

SEQ ID NO: 3118278 - RNA, 21 nt, Mycobacterium bovis subsp bovis AF2122/97
auccaaaccuuugauucuaac

SEQ ID NO: 3118279 - RNA, 15 nt, Mycobacterium bovis subsp bovis AF2122/97
auccaacgaccucca

SEQ ID NO: 3118280 - RNA, 14 nt, Mycobacterium bovis subsp bovis AF2122/97
auccaacgcggcgc

SEQ ID NO: 3118281 - RNA, 14 nt, Mycobacterium bovis subsp bovis AF2122/97
auccaacuggccgc

SEQ ID NO: 3118282 - RNA, 16 nt, Mycobacterium bovis subsp bovis AF2122/97
auccaacuggccgcgu

SEQ ID NO: 3118283 - RNA, 14 nt, Mycobacterium bovis subsp bovis AF2122/97
auccacaaucacau

SEQ ID NO: 3118284 - RNA, 21 nt, Mycobacterium bovis subsp bovis AF2122/97
auccacaccggauaggugguc

SEQ ID NO: 3118285 - RNA, 22 nt, Mycobacterium bovis subsp bovis AF2122/97
auccaccagcuggugagccaga

SEQ ID NO: 3118286 - RNA, 12 nt, Mycobacterium bovis subsp bovis AF2122/97
auccacccggca

SEQ ID NO: 3118287 - RNA, 13 nt, Mycobacterium bovis subsp bovis AF2122/97
auccaccgcagau

SEQ ID NO: 3118288 - RNA, 18 nt, Mycobacterium bovis subsp bovis AF2122/97
auccaccgguccagggcc

SEQ ID NO: 3118289 - RNA, 21 nt, Mycobacterium bovis subsp bovis AF2122/97
auccacgacaucguaggccgg

SEQ ID NO: 3118290 - RNA, 13 nt, Mycobacterium bovis subsp bovis AF2122/97
auccacgccgacc

SEQ ID NO: 3118291 - RNA, 14 nt, Mycobacterium bovis subsp bovis AF2122/97
auccacgccgggca

SEQ ID NO: 3118292 - RNA, 13 nt, Mycobacterium bovis subsp bovis AF2122/97
auccacggagacc

SEQ ID NO: 3118293 - RNA, 17 nt, Mycobacterium bovis subsp bovis AF2122/97
auccacggcgaugcagc

SEQ ID NO: 3118294 - RNA, 19 nt, Mycobacterium bovis subsp bovis AF2122/97
auccacggucgaccaggac

SEQ ID NO: 3118295 - RNA, 15 nt, Mycobacterium bovis subsp bovis AF2122/97
auccacgguugccgg

SEQ ID NO: 3118296 - RNA, 20 nt, Mycobacterium bovis subsp bovis AF2122/97
auccacgguugccggcggcg

SEQ ID NO: 3118297 - RNA, 23 nt, Mycobacterium bovis subsp bovis AF2122/97
auccacgguugccggcggcgacg

SEQ ID NO: 3118298 - RNA, 15 nt, Mycobacterium bovis subsp bovis AF2122/97
auccacgucgcccag

SEQ ID NO: 3118299 - RNA, 15 nt, Mycobacterium bovis subsp bovis AF2122/97
auccacgucgcggcg

SEQ ID NO: 3118300 - RNA, 16 nt, Mycobacterium bovis subsp bovis AF2122/97
auccacgucgcggcgu

SEQ ID NO: 3118301 - RNA, 15 nt, Mycobacterium bovis subsp bovis AF2122/97
auccacuccgccaac

SEQ ID NO: 3118302 - RNA, 21 nt, Mycobacterium bovis subsp bovis AF2122/97
auccacuuccgggcgaccaac

SEQ ID NO: 3118303 - RNA, 22 nt, Mycobacterium bovis subsp bovis AF2122/97
auccacuuccgggcgaccaaca

SEQ ID NO: 3118304 - RNA, 18 nt, Mycobacterium bovis subsp bovis AF2122/97
auccagaacaacggcgcg

SEQ ID NO: 3118305 - RNA, 18 nt, Mycobacterium bovis subsp bovis AF2122/97
auccagaacgcaucgguc

SEQ ID NO: 3118306 - RNA, 15 nt, Mycobacterium bovis subsp bovis AF2122/97
auccagaaguaggcg

SEQ ID NO: 3118307 - RNA, 20 nt, Mycobacterium bovis subsp bovis AF2122/97
auccagagacaugucgcugc

SEQ ID NO: 3118308 - RNA, 14 nt, Mycobacterium bovis subsp bovis AF2122/97
auccagauaauccu

SEQ ID NO: 3118309 - RNA, 16 nt, Mycobacterium bovis subsp bovis AF2122/97
auccagaugcccagca

SEQ ID NO: 3118310 - RNA, 19 nt, Mycobacterium bovis subsp bovis AF2122/97
auccagcagccaggagccg

SEQ ID NO: 3118311 - RNA, 15 nt, Mycobacterium bovis subsp bovis AF2122/97
auccagccaugcggu

SEQ ID NO: 3118312 - RNA, 17 nt, Mycobacterium bovis subsp bovis AF2122/97
auccagcccaucccgau

SEQ ID NO: 3118313 - RNA, 16 nt, Mycobacterium bovis subsp bovis AF2122/97
auccagcccgacgccc

SEQ ID NO: 3118314 - RNA, 22 nt, Mycobacterium bovis subsp bovis AF2122/97
auccagcccuguuugacugcga

SEQ ID NO: 3118315 - RNA, 14 nt, Mycobacterium bovis subsp bovis AF2122/97
auccagccgugcgg

SEQ ID NO: 3118316 - RNA, 14 nt, Mycobacterium bovis subsp bovis AF2122/97
auccagcgccgacc

SEQ ID NO: 3118317 - RNA, 17 nt, Mycobacterium bovis subsp bovis AF2122/97
auccagcgcugaccggc

SEQ ID NO: 3118318 - RNA, 23 nt, Mycobacterium bovis subsp bovis AF2122/97
auccagcugucguugaucggcac

SEQ ID NO: 3118319 - RNA, 16 nt, Mycobacterium bovis subsp bovis AF2122/97
auccaggccaccccga

SEQ ID NO: 3118320 - RNA, 22 nt, Mycobacterium bovis subsp bovis AF2122/97
auccaggcccagccgagcggcg

SEQ ID NO: 3118321 - RNA, 15 nt, Mycobacterium bovis subsp bovis AF2122/97
auccaggcuguggcc

SEQ ID NO: 3118322 - RNA, 19 nt, Mycobacterium bovis subsp bovis AF2122/97
auccaggcuguggccagca

SEQ ID NO: 3118323 - RNA, 22 nt, Mycobacterium bovis subsp bovis AF2122/97
auccaggcuguggccagcauca

SEQ ID NO: 3118324 - RNA, 15 nt, Mycobacterium bovis subsp bovis AF2122/97
auccagggagcggcu

SEQ ID NO: 3118325 - RNA, 14 nt, Mycobacterium bovis subsp bovis AF2122/97
auccagggugccgg

SEQ ID NO: 3118326 - RNA, 17 nt, Mycobacterium bovis subsp bovis AF2122/97
auccagggugccgguca

SEQ ID NO: 3118327 - RNA, 19 nt, Mycobacterium bovis subsp bovis AF2122/97
auccagguugaggugugcc

SEQ ID NO: 3118328 - RNA, 16 nt, Mycobacterium bovis subsp bovis AF2122/97
auccaguaaccguccg

SEQ ID NO: 3118329 - RNA, 17 nt, Mycobacterium bovis subsp bovis AF2122/97
auccaguaaccguccgc

SEQ ID NO: 3118330 - RNA, 19 nt, Mycobacterium bovis subsp bovis AF2122/97
auccagugcgguggccagu

SEQ ID NO: 3118331 - RNA, 15 nt, Mycobacterium bovis subsp bovis AF2122/97
auccaguucaccgcg

SEQ ID NO: 3118332 - RNA, 16 nt, Mycobacterium bovis subsp bovis AF2122/97
auccaguucaccgcgc

SEQ ID NO: 3118333 - RNA, 12 nt, Mycobacterium bovis subsp bovis AF2122/97
auccauccugcc

SEQ ID NO: 3118334 - RNA, 15 nt, Mycobacterium bovis subsp bovis AF2122/97
auccaucugugcgcg

SEQ ID NO: 3118335 - RNA, 21 nt, Mycobacterium bovis subsp bovis AF2122/97
auccaugauggccgucagcca

SEQ ID NO: 3118336 - RNA, 23 nt, Mycobacterium bovis subsp bovis AF2122/97
auccaugauggccgucagccagg

SEQ ID NO: 3118337 - RNA, 15 nt, Mycobacterium bovis subsp bovis AF2122/97
auccauucggcggcg

SEQ ID NO: 3118338 - RNA, 18 nt, Mycobacterium bovis subsp bovis AF2122/97
aucccaacccaugaugug

SEQ ID NO: 3118339 - RNA, 14 nt, Mycobacterium bovis subsp bovis AF2122/97
aucccaacuccucc

SEQ ID NO: 3118340 - RNA, 22 nt, Mycobacterium bovis subsp bovis AF2122/97
aucccacgcccggccccgcggc

SEQ ID NO: 3118341 - RNA, 14 nt, Mycobacterium bovis subsp bovis AF2122/97
aucccagaucggcg

SEQ ID NO: 3118342 - RNA, 15 nt, Mycobacterium bovis subsp bovis AF2122/97
aucccaggggcaccg

SEQ ID NO: 3118343 - RNA, 22 nt, Mycobacterium bovis subsp bovis AF2122/97
aucccagugccagugccagcgu

SEQ ID NO: 3118344 - RNA, 13 nt, Mycobacterium bovis subsp bovis AF2122/97
auccccagcacca

SEQ ID NO: 3118345 - RNA, 14 nt, Mycobacterium bovis subsp bovis AF2122/97
aucccccaggcgaa

SEQ ID NO: 3118346 - RNA, 20 nt, Mycobacterium bovis subsp bovis AF2122/97
aucccccgacacgccgaacg

SEQ ID NO: 3118347 - RNA, 12 nt, Mycobacterium bovis subsp bovis AF2122/97
aucccccggcug

SEQ ID NO: 3118348 - RNA, 12 nt, Mycobacterium bovis subsp bovis AF2122/97
auccccgccacc

SEQ ID NO: 3118349 - RNA, 13 nt, Mycobacterium bovis subsp bovis AF2122/97
auccccgccggcg

SEQ ID NO: 3118350 - RNA, 14 nt, Mycobacterium bovis subsp bovis AF2122/97
auccccgccggcgc

SEQ ID NO: 3118351 - RNA, 20 nt, Mycobacterium bovis subsp bovis AF2122/97
auccccgccggcgccaccgu

SEQ ID NO: 3118352 - RNA, 13 nt, Mycobacterium bovis subsp bovis AF2122/97
auccccgcggcgg

SEQ ID NO: 3118353 - RNA, 21 nt, Mycobacterium bovis subsp bovis AF2122/97
auccccgguucugcgcccacc

SEQ ID NO: 3118354 - RNA, 13 nt, Mycobacterium bovis subsp bovis AF2122/97
auccccuggccag

SEQ ID NO: 3118355 - RNA, 15 nt, Mycobacterium bovis subsp bovis AF2122/97
auccccuggccagca

SEQ ID NO: 3118356 - RNA, 17 nt, Mycobacterium bovis subsp bovis AF2122/97
auccccuggccagcaga

SEQ ID NO: 3118357 - RNA, 16 nt, Mycobacterium bovis subsp bovis AF2122/97
auccccuugguggcca

SEQ ID NO: 3118358 - RNA, 17 nt, Mycobacterium bovis subsp bovis AF2122/97
auccccuugguggccag

SEQ ID NO: 3118359 - RNA, 19 nt, Mycobacterium bovis subsp bovis AF2122/97
aucccgaaguagaagccca

SEQ ID NO: 3118360 - RNA, 21 nt, Mycobacterium bovis subsp bovis AF2122/97
aucccgaaguagaagcccagg

SEQ ID NO: 3118361 - RNA, 22 nt, Mycobacterium bovis subsp bovis AF2122/97
auccgggagugcgccggcuggc

SEQ ID NO: 3118362 - RNA, 15 nt, Mycobacterium bovis subsp bovis AF2122/97
auccgggcaaccgau

SEQ ID NO: 3118363 - RNA, 17 nt, Mycobacterium bovis subsp bovis AF2122/97
auccgggucaguaggcg

SEQ ID NO: 3118364 - RNA, 22 nt, Mycobacterium bovis subsp bovis AF2122/97
auccgggugagcuacucacggu

SEQ ID NO: 3118365 - RNA, 19 nt, Mycobacterium bovis subsp bovis AF2122/97
auccggguggcgucaccgc

SEQ ID NO: 3118366 - RNA, 22 nt, Mycobacterium bovis subsp bovis AF2122/97
auccggguggcgucaccgccgg

SEQ ID NO: 3118367 - RNA, 14 nt, Mycobacterium bovis subsp bovis AF2122/97
auccggucagcgcg

SEQ ID NO: 3118368 - RNA, 15 nt, Mycobacterium bovis subsp bovis AF2122/97
auccggucgaugacc

SEQ ID NO: 3118369 - RNA, 19 nt, Mycobacterium bovis subsp bovis AF2122/97
auccggucgaugaccucgu

SEQ ID NO: 3118370 - RNA, 20 nt, Mycobacterium bovis subsp bovis AF2122/97
auccggucgaugucagccac

SEQ ID NO: 3118371 - RNA, 16 nt, Mycobacterium bovis subsp bovis AF2122/97
auccggucggccaggc

SEQ ID NO: 3118372 - RNA, 20 nt, Mycobacterium bovis subsp bovis AF2122/97
auccggucggccaggccguc

SEQ ID NO: 3118373 - RNA, 13 nt, Mycobacterium bovis subsp bovis AF2122/97
auccggucggccc

SEQ ID NO: 3118374 - RNA, 16 nt, Mycobacterium bovis subsp bovis AF2122/97
auccggucucggccga

SEQ ID NO: 3118375 - RNA, 19 nt, Mycobacterium bovis subsp bovis AF2122/97
auccggugccgcgaucgcg

SEQ ID NO: 3118376 - RNA, 20 nt, Mycobacterium bovis subsp bovis AF2122/97
auccgguguugagaucgccc

SEQ ID NO: 3118377 - RNA, 17 nt, Mycobacterium bovis subsp bovis AF2122/97
auccgguucgccgccgu

SEQ ID NO: 3118378 - RNA, 16 nt, Mycobacterium bovis subsp bovis AF2122/97
auccgguucugggccu

SEQ ID NO: 3118379 - RNA, 22 nt, Mycobacterium bovis subsp bovis AF2122/97
auccgugaaucgagcaccgcaa

SEQ ID NO: 3118380 - RNA, 20 nt, Mycobacterium bovis subsp bovis AF2122/97
auccgugccgaaaaucgcag

SEQ ID NO: 3118381 - RNA, 13 nt, Mycobacterium bovis subsp bovis AF2122/97
auccgugucgaga

SEQ ID NO: 3118382 - RNA, 18 nt, Mycobacterium bovis subsp bovis AF2122/97
auccgugugucuugaccu

SEQ ID NO: 3118383 - RNA, 17 nt, Mycobacterium bovis subsp bovis AF2122/97
auccuccucgucgacgu

SEQ ID NO: 3118384 - RNA, 15 nt, Mycobacterium bovis subsp bovis AF2122/97
auccugaccagccag

SEQ ID NO: 3118385 - RNA, 16 nt, Mycobacterium bovis subsp bovis AF2122/97
auccugcacgacccgc

SEQ ID NO: 3118386 - RNA, 19 nt, Mycobacterium bovis subsp bovis AF2122/97
auccugcagcucgggcagg

SEQ ID NO: 3118387 - RNA, 16 nt, Mycobacterium bovis subsp bovis AF2122/97
auccugcgguugaguu

SEQ ID NO: 3118388 - RNA, 19 nt, Mycobacterium bovis subsp bovis AF2122/97
auccuggccacucccagcc

SEQ ID NO: 3118389 - RNA, 18 nt, Mycobacterium bovis subsp bovis AF2122/97
auccuggccgauggcguc

SEQ ID NO: 3118390 - RNA, 14 nt, Mycobacterium bovis subsp bovis AF2122/97
auccuggccgccgc

SEQ ID NO: 3118391 - RNA, 18 nt, Mycobacterium bovis subsp bovis AF2122/97
auccuggcggcugcagcc

SEQ ID NO: 3118392 - RNA, 21 nt, Mycobacterium bovis subsp bovis AF2122/97
auccuggcggcugcagccgac

SEQ ID NO: 3118393 - RNA, 18 nt, Mycobacterium bovis subsp bovis AF2122/97
auccugggugucgcgggu

SEQ ID NO: 3118394 - RNA, 19 nt, Mycobacterium bovis subsp bovis AF2122/97
auccugguaaggccggccg

SEQ ID NO: 3118395 - RNA, 14 nt, Mycobacterium bovis subsp bovis AF2122/97
auccuucgccggcg

SEQ ID NO: 3118396 - RNA, 15 nt, Mycobacterium bovis subsp bovis AF2122/97
auccuucgccggcgc

SEQ ID NO: 3118397 - RNA, 13 nt, Mycobacterium bovis subsp bovis AF2122/97
auccuugccaauc

SEQ ID NO: 3118398 - RNA, 15 nt, Mycobacterium bovis subsp bovis AF2122/97
auccuuugccgccga

SEQ ID NO: 3118399 - RNA, 15 nt, Mycobacterium bovis subsp bovis AF2122/97
aucgaaaaaccucga

SEQ ID NO: 3118400 - RNA, 15 nt, Mycobacterium bovis subsp bovis AF2122/97
aucgaaccgcugcuc

SEQ ID NO: 3118401 - RNA, 20 nt, Mycobacterium bovis subsp bovis AF2122/97
aucgaacugggggccggcac

SEQ ID NO: 3118402 - RNA, 23 nt, Mycobacterium bovis subsp bovis AF2122/97
aucgaacuucgauucuggccgga

SEQ ID NO: 3118403 - RNA, 14 nt, Mycobacterium bovis subsp bovis AF2122/97
aucgaagaccagca

SEQ ID NO: 3118404 - RNA, 14 nt, Mycobacterium bovis subsp bovis AF2122/97
aucgaagcccggcg

SEQ ID NO: 3118405 - RNA, 17 nt, Mycobacterium bovis subsp bovis AF2122/97
aucgaagcccggcggca

SEQ ID NO: 3118406 - RNA, 15 nt, Mycobacterium bovis subsp bovis AF2122/97
aucgaagcggcugcu

SEQ ID NO: 3118407 - RNA, 15 nt, Mycobacterium bovis subsp bovis AF2122/97
aucgacaaucgcacg

SEQ ID NO: 3118408 - RNA, 14 nt, Mycobacterium bovis subsp bovis AF2122/97
aucgacaccaccau

SEQ ID NO: 3118409 - RNA, 13 nt, Mycobacterium bovis subsp bovis AF2122/97
aucgacacccgcu

SEQ ID NO: 3118410 - RNA, 12 nt, Mycobacterium bovis subsp bovis AF2122/97
aucgacacccuu

SEQ ID NO: 3118411 - RNA, 20 nt, Mycobacterium bovis subsp bovis AF2122/97
aucgacacccuuaggaccca

SEQ ID NO: 3118412 - RNA, 15 nt, Mycobacterium bovis subsp bovis AF2122/97
aucgacaccgcccga

SEQ ID NO: 3118413 - RNA, 14 nt, Mycobacterium bovis subsp bovis AF2122/97
aucgacagcagcgc

SEQ ID NO: 3118414 - RNA, 13 nt, Mycobacterium bovis subsp bovis AF2122/97
aucgacagccccg

SEQ ID NO: 3118415 - RNA, 14 nt, Mycobacterium bovis subsp bovis AF2122/97
aucgacagccccgc

SEQ ID NO: 3118416 - RNA, 20 nt, Mycobacterium bovis subsp bovis AF2122/97
aucgacaguugcgccagcgu

SEQ ID NO: 3118417 - RNA, 20 nt, Mycobacterium bovis subsp bovis AF2122/97
aucgacauaguuggcgcccg

SEQ ID NO: 3118418 - RNA, 16 nt, Mycobacterium bovis subsp bovis AF2122/97
aucgacaucaccaccg

SEQ ID NO: 3118419 - RNA, 20 nt, Mycobacterium bovis subsp bovis AF2122/97
aucgaccaauucgaccgcgc

SEQ ID NO: 3118420 - RNA, 21 nt, Mycobacterium bovis subsp bovis AF2122/97
aucgaccaccggguagccggc

SEQ ID NO: 3118421 - RNA, 17 nt, Mycobacterium bovis subsp bovis AF2122/97
aucgacccggucgacgg

SEQ ID NO: 3118422 - RNA, 15 nt, Mycobacterium bovis subsp bovis AF2122/97
aucgacccuccagca

SEQ ID NO: 3118423 - RNA, 20 nt, Mycobacterium bovis subsp bovis AF2122/97
aucgaccgcccgccagcgau

SEQ ID NO: 3118424 - RNA, 21 nt, Mycobacterium bovis subsp bovis AF2122/97
aucgaccgccuccucgauagc

SEQ ID NO: 3118425 - RNA, 14 nt, Mycobacterium bovis subsp bovis AF2122/97
aucgaccgcggccg

SEQ ID NO: 3118426 - RNA, 17 nt, Mycobacterium bovis subsp bovis AF2122/97
aucgaccgcggccgggu

SEQ ID NO: 3118427 - RNA, 17 nt, Mycobacterium bovis subsp bovis AF2122/97
aucgaccgcuggaucgc

SEQ ID NO: 3118428 - RNA, 12 nt, Mycobacterium bovis subsp bovis AF2122/97
aucgaccguccg

SEQ ID NO: 3118429 - RNA, 17 nt, Mycobacterium bovis subsp bovis AF2122/97
aucgaccguccggguca

SEQ ID NO: 3118430 - RNA, 14 nt, Mycobacterium bovis subsp bovis AF2122/97
aucgaccuggccac

SEQ ID NO: 3118431 - RNA, 16 nt, Mycobacterium bovis subsp bovis AF2122/97
aucgacgacacguuga

SEQ ID NO: 3118432 - RNA, 19 nt, Mycobacterium bovis subsp bovis AF2122/97
aucgacgagcgauacgucg

SEQ ID NO: 3118433 - RNA, 22 nt, Mycobacterium bovis subsp bovis AF2122/97
aucgacgagcgauacgucguca

SEQ ID NO: 3118434 - RNA, 16 nt, Mycobacterium bovis subsp bovis AF2122/97
aucgacggcggccuuc

SEQ ID NO: 3118435 - RNA, 15 nt, Mycobacterium bovis subsp bovis AF2122/97
aucgacucacacacc

SEQ ID NO: 3118436 - RNA, 21 nt, Mycobacterium bovis subsp bovis AF2122/97
aucgacucacggaucugagcu

SEQ ID NO: 3118437 - RNA, 22 nt, Mycobacterium bovis subsp bovis AF2122/97
aucgacuccggauggaacugga

SEQ ID NO: 3118438 - RNA, 15 nt, Mycobacterium bovis subsp bovis AF2122/97
aucgacugaucgcca

SEQ ID NO: 3118439 - RNA, 17 nt, Mycobacterium bovis subsp bovis AF2122/97
aucgacugaucgccacc

SEQ ID NO: 3118440 - RNA, 15 nt, Mycobacterium bovis subsp bovis AF2122/97
aucgacugccagcgc

SEQ ID NO: 3118441 - RNA, 23 nt, Mycobacterium bovis subsp bovis AF2122/97
aucgagacgcacggccaccgcgc

SEQ ID NO: 3118442 - RNA, 16 nt, Mycobacterium bovis subsp bovis AF2122/97
aucgagaguugaaucc

SEQ ID NO: 3118443 - RNA, 20 nt, Mycobacterium bovis subsp bovis AF2122/97
aucgagcaccgcaaccacgc

SEQ ID NO: 3118444 - RNA, 13 nt, Mycobacterium bovis subsp bovis AF2122/97
aucgagcaggccg

SEQ ID NO: 3118445 - RNA, 15 nt, Mycobacterium bovis subsp bovis AF2122/97
aucgagcaggccgcc

SEQ ID NO: 3118446 - RNA, 16 nt, Mycobacterium bovis subsp bovis AF2122/97
aucgagcaggccgccc

SEQ ID NO: 3118447 - RNA, 20 nt, Mycobacterium bovis subsp bovis AF2122/97
aucgagcagggugaccagga

SEQ ID NO: 3118448 - RNA, 22 nt, Mycobacterium bovis subsp bovis AF2122/97
aucgccgaggccucggccagcg

SEQ ID NO: 3118449 - RNA, 14 nt, Mycobacterium bovis subsp bovis AF2122/97
aucgccgcccccgu

SEQ ID NO: 3118450 - RNA, 11 nt, Mycobacterium bovis subsp bovis AF2122/97
aucgccgccgc

SEQ ID NO: 3118451 - RNA, 22 nt, Mycobacterium bovis subsp bovis AF2122/97
aucgccgccgcgcguucggcgc

SEQ ID NO: 3118452 - RNA, 15 nt, Mycobacterium bovis subsp bovis AF2122/97
aucgccgccguugcc

SEQ ID NO: 3118453 - RNA, 13 nt, Mycobacterium bovis subsp bovis AF2122/97
aucgccgcgauca

SEQ ID NO: 3118454 - RNA, 16 nt, Mycobacterium bovis subsp bovis AF2122/97
aucgccgcgauggcgg

SEQ ID NO: 3118455 - RNA, 14 nt, Mycobacterium bovis subsp bovis AF2122/97
aucgccgcgggcga

SEQ ID NO: 3118456 - RNA, 16 nt, Mycobacterium bovis subsp bovis AF2122/97
aucgccgcuaccguca

SEQ ID NO: 3118457 - RNA, 17 nt, Mycobacterium bovis subsp bovis AF2122/97
aucgccgcuacgccggc

SEQ ID NO: 3118458 - RNA, 16 nt, Mycobacterium bovis subsp bovis AF2122/97
aucgccgcuggccagc

SEQ ID NO: 3118459 - RNA, 20 nt, Mycobacterium bovis subsp bovis AF2122/97
aucgccgcuggccagcacac

SEQ ID NO: 3118460 - RNA, 20 nt, Mycobacterium bovis subsp bovis AF2122/97
aucgccgcuugacgcagcuc

SEQ ID NO: 3118461 - RNA, 19 nt, Mycobacterium bovis subsp bovis AF2122/97
aucgccggaccgguguggc

SEQ ID NO: 3118462 - RNA, 15 nt, Mycobacterium bovis subsp bovis AF2122/97
aucgccggagucgac

SEQ ID NO: 3118463 - RNA, 20 nt, Mycobacterium bovis subsp bovis AF2122/97
aucgccggagucgacccugc

SEQ ID NO: 3118464 - RNA, 12 nt, Mycobacterium bovis subsp bovis AF2122/97
aucgccggccgc

SEQ ID NO: 3118465 - RNA, 13 nt, Mycobacterium bovis subsp bovis AF2122/97
aucgccggccgcg

SEQ ID NO: 3118466 - RNA, 19 nt, Mycobacterium bovis subsp bovis AF2122/97
aucgccggccgcgggcgcg

SEQ ID NO: 3118467 - RNA, 14 nt, Mycobacterium bovis subsp bovis AF2122/97
aucgccggccgcgu

SEQ ID NO: 3118468 - RNA, 19 nt, Mycobacterium bovis subsp bovis AF2122/97
aucgccggccugcucggcg

SEQ ID NO: 3118469 - RNA, 19 nt, Mycobacterium bovis subsp bovis AF2122/97
aucgccggcgcgccgauga

SEQ ID NO: 3118470 - RNA, 20 nt, Mycobacterium bovis subsp bovis AF2122/97
aucgccggcuucgcccagag

SEQ ID NO: 3118471 - RNA, 15 nt, Mycobacterium bovis subsp bovis AF2122/97
aucgccgggcuuggc

SEQ ID NO: 3118472 - RNA, 21 nt, Mycobacterium bovis subsp bovis AF2122/97
aucgccgggcuuggccgcgcc

SEQ ID NO: 3118473 - RNA, 21 nt, Mycobacterium bovis subsp bovis AF2122/97
aucgccgucagcaccgcuacg

SEQ ID NO: 3118474 - RNA, 17 nt, Mycobacterium bovis subsp bovis AF2122/97
aucgccguccagcaaua

SEQ ID NO: 3118475 - RNA, 14 nt, Mycobacterium bovis subsp bovis AF2122/97
aucgccgugcgccg

SEQ ID NO: 3118476 - RNA, 15 nt, Mycobacterium bovis subsp bovis AF2122/97
aucgccuaccggccu

SEQ ID NO: 3118477 - RNA, 20 nt, Mycobacterium bovis subsp bovis AF2122/97
aucgccuaccggccuuucca

SEQ ID NO: 3118478 - RNA, 22 nt, Mycobacterium bovis subsp bovis AF2122/97
aucgccuccaggcgccacccga

SEQ ID NO: 3118479 - RNA, 12 nt, Mycobacterium bovis subsp bovis AF2122/97
aucgccuccucg

SEQ ID NO: 3118480 - RNA, 18 nt, Mycobacterium bovis subsp bovis AF2122/97
aucgccuccucgacgucg

SEQ ID NO: 3118481 - RNA, 21 nt, Mycobacterium bovis subsp bovis AF2122/97
aucgccuccucgacgucggcg

SEQ ID NO: 3118482 - RNA, 13 nt, Mycobacterium bovis subsp bovis AF2122/97
aucgccucgacgc

SEQ ID NO: 3118483 - RNA, 15 nt, Mycobacterium bovis subsp bovis AF2122/97
aucgccucgacgcgg

SEQ ID NO: 3118484 - RNA, 20 nt, Mycobacterium bovis subsp bovis AF2122/97
aucgccucgacgcggcaggc

SEQ ID NO: 3118485 - RNA, 20 nt, Mycobacterium bovis subsp bovis AF2122/97
aucgccucgaggaccaccac

SEQ ID NO: 3118486 - RNA, 21 nt, Mycobacterium bovis subsp bovis AF2122/97
aucgccucggacacggcagcc

SEQ ID NO: 3118487 - RNA, 20 nt, Mycobacterium bovis subsp bovis AF2122/97
aucgccucggcguaggcgau

SEQ ID NO: 3118488 - RNA, 16 nt, Mycobacterium bovis subsp bovis AF2122/97
aucgccugagcgccgc

SEQ ID NO: 3118489 - RNA, 23 nt, Mycobacterium bovis subsp bovis AF2122/97
aucgccugauaugacuugcgcgc

SEQ ID NO: 3118490 - RNA, 13 nt, Mycobacterium bovis subsp bovis AF2122/97
aucgccugcgccu

SEQ ID NO: 3118491 - RNA, 23 nt, Mycobacterium bovis subsp bovis AF2122/97
aucgccugcgccuuggucgccgg

SEQ ID NO: 3118492 - RNA, 23 nt, Mycobacterium bovis subsp bovis AF2122/97
aucgccuggaugccgaucgggag

SEQ ID NO: 3118493 - RNA, 20 nt, Mycobacterium bovis subsp bovis AF2122/97
aucgccugggcuuggcgacg

SEQ ID NO: 3118494 - RNA, 20 nt, Mycobacterium bovis subsp bovis AF2122/97
aucgccuuggcgcccgcgaa

SEQ ID NO: 3118495 - RNA, 22 nt, Mycobacterium bovis subsp bovis AF2122/97
aucgcgaaacagcuugcugcgc

SEQ ID NO: 3118496 - RNA, 17 nt, Mycobacterium bovis subsp bovis AF2122/97
aucgcgaacaucgccag

SEQ ID NO: 3118497 - RNA, 20 nt, Mycobacterium bovis subsp bovis AF2122/97
aucgcgaacgaagucgacga

SEQ ID NO: 3118498 - RNA, 18 nt, Mycobacterium bovis subsp bovis AF2122/97
aucgcgaacucgggcaau

SEQ ID NO: 3118499 - RNA, 15 nt, Mycobacterium bovis subsp bovis AF2122/97
aucgcgacacggcca

SEQ ID NO: 3118500 - RNA, 16 nt, Mycobacterium bovis subsp bovis AF2122/97
aucgcgacacggccau

SEQ ID NO: 3118501 - RNA, 19 nt, Mycobacterium bovis subsp bovis AF2122/97
aucgcgacacggccauccg

SEQ ID NO: 3118502 - RNA, 13 nt, Mycobacterium bovis subsp bovis AF2122/97
aucgcgacaucgg

SEQ ID NO: 3118503 - RNA, 18 nt, Mycobacterium bovis subsp bovis AF2122/97
aucgcgacaucgguggcg

SEQ ID NO: 3118504 - RNA, 18 nt, Mycobacterium bovis subsp bovis AF2122/97
aucgcgacccgaucgcgc

SEQ ID NO: 3118505 - RNA, 15 nt, Mycobacterium bovis subsp bovis AF2122/97
aucgcgacgaugccc

SEQ ID NO: 3118506 - RNA, 17 nt, Mycobacterium bovis subsp bovis AF2122/97
aucgcgacgaugccccg

SEQ ID NO: 3118507 - RNA, 15 nt, Mycobacterium bovis subsp bovis AF2122/97
aucgcgacggcaagc

SEQ ID NO: 3118508 - RNA, 20 nt, Mycobacterium bovis subsp bovis AF2122/97
aucgcgacggcaagcacggu

SEQ ID NO: 3118509 - RNA, 13 nt, Mycobacterium bovis subsp bovis AF2122/97
aucgcgacggccc

SEQ ID NO: 3118510 - RNA, 15 nt, Mycobacterium bovis subsp bovis AF2122/97
aucgcgagccagcug

SEQ ID NO: 3118511 - RNA, 17 nt, Mycobacterium bovis subsp bovis AF2122/97
aucgcgagcugcgacga

SEQ ID NO: 3118512 - RNA, 18 nt, Mycobacterium bovis subsp bovis AF2122/97
aucgcgauccacccggca

SEQ ID NO: 3118513 - RNA, 24 nt, Mycobacterium bovis subsp bovis AF2122/97
aucgcgaucggggcgacgauccgc

SEQ ID NO: 3118514 - RNA, 14 nt, Mycobacterium bovis subsp bovis AF2122/97
aucgcgauuccggc

SEQ ID NO: 3118515 - RNA, 14 nt, Mycobacterium bovis subsp bovis AF2122/97
aucgcgcaccgcau

SEQ ID NO: 3118516 - RNA, 18 nt, Mycobacterium bovis subsp bovis AF2122/97
aucgcgcagcgccgccac

SEQ ID NO: 3118517 - RNA, 18 nt, Mycobacterium bovis subsp bovis AF2122/97
aucgcgccaucgucgcgc

SEQ ID NO: 3118518 - RNA, 19 nt, Mycobacterium bovis subsp bovis AF2122/97
aucgcgcccaccgaugcga

SEQ ID NO: 3118519 - RNA, 16 nt, Mycobacterium bovis subsp bovis AF2122/97
aucgcgccgucggcga

SEQ ID NO: 3118520 - RNA, 16 nt, Mycobacterium bovis subsp bovis AF2122/97
aucgcgccgucgucga

SEQ ID NO: 3118521 - RNA, 16 nt, Mycobacterium bovis subsp bovis AF2122/97
aucgcgccuauccaaa

SEQ ID NO: 3118522 - RNA, 22 nt, Mycobacterium bovis subsp bovis AF2122/97
aucgcgccuuugagcccgcgau

SEQ ID NO: 3118523 - RNA, 17 nt, Mycobacterium bovis subsp bovis AF2122/97
aucgcgcgagcgauggg

SEQ ID NO: 3118524 - RNA, 23 nt, Mycobacterium bovis subsp bovis AF2122/97
aucgcgcggcugugcccgaucag

SEQ ID NO: 3118525 - RNA, 15 nt, Mycobacterium bovis subsp bovis AF2122/97
aucgcggaaccguac

SEQ ID NO: 3118526 - RNA, 18 nt, Mycobacterium bovis subsp bovis AF2122/97
aucgcggaagcgggcgau

SEQ ID NO: 3118527 - RNA, 14 nt, Mycobacterium bovis subsp bovis AF2122/97
aucgcggagccagg

SEQ ID NO: 3118528 - RNA, 21 nt, Mycobacterium bovis subsp bovis AF2122/97
aucgcggagccaggacgacgc

SEQ ID NO: 3118529 - RNA, 18 nt, Mycobacterium bovis subsp bovis AF2122/97
aucgcggcaucgacgcgg

SEQ ID NO: 3118530 - RNA, 23 nt, Mycobacterium bovis subsp bovis AF2122/97
aucgcggcaucgacgcggccaac

SEQ ID NO: 3118531 - RNA, 12 nt, Mycobacterium bovis subsp bovis AF2122/97
aucgcggccaca

SEQ ID NO: 3118532 - RNA, 22 nt, Mycobacterium bovis subsp bovis AF2122/97
aucgcggcccggcccuccgggc

SEQ ID NO: 3118533 - RNA, 23 nt, Mycobacterium bovis subsp bovis AF2122/97
aucgcggccgaaacuucgcccgg

SEQ ID NO: 3118534 - RNA, 22 nt, Mycobacterium bovis subsp bovis AF2122/97
aucggcauguuccuugcggccg

SEQ ID NO: 3118535 - RNA, 15 nt, Mycobacterium bovis subsp bovis AF2122/97
aucggccaacaccac

SEQ ID NO: 3118536 - RNA, 10 nt, Mycobacterium bovis subsp bovis AF2122/97
aucggccacc

SEQ ID NO: 3118537 - RNA, 17 nt, Mycobacterium bovis subsp bovis AF2122/97
aucggccaccaucgccc

SEQ ID NO: 3118538 - RNA, 14 nt, Mycobacterium bovis subsp bovis AF2122/97
aucggccaccuguu

SEQ ID NO: 3118539 - RNA, 20 nt, Mycobacterium bovis subsp bovis AF2122/97
aucggccagccguucucgcc

SEQ ID NO: 3118540 - RNA, 19 nt, Mycobacterium bovis subsp bovis AF2122/97
aucggcccagcccuucagc

SEQ ID NO: 3118541 - RNA, 18 nt, Mycobacterium bovis subsp bovis AF2122/97
aucggcccccaacgcggu

SEQ ID NO: 3118542 - RNA, 20 nt, Mycobacterium bovis subsp bovis AF2122/97
aucggccccgaaacgauggc

SEQ ID NO: 3118543 - RNA, 12 nt, Mycobacterium bovis subsp bovis AF2122/97
aucggcccgauc

SEQ ID NO: 3118544 - RNA, 18 nt, Mycobacterium bovis subsp bovis AF2122/97
aucggcccgugccacagc

SEQ ID NO: 3118545 - RNA, 22 nt, Mycobacterium bovis subsp bovis AF2122/97
aucggcccgugccacagcucgc

SEQ ID NO: 3118546 - RNA, 14 nt, Mycobacterium bovis subsp bovis AF2122/97
aucggccggcagau

SEQ ID NO: 3118547 - RNA, 22 nt, Mycobacterium bovis subsp bovis AF2122/97
aucggccgugaauucgccgaac

SEQ ID NO: 3118548 - RNA, 15 nt, Mycobacterium bovis subsp bovis AF2122/97
aucggccugccggca

SEQ ID NO: 3118549 - RNA, 17 nt, Mycobacterium bovis subsp bovis AF2122/97
aucggccugccggcagc

SEQ ID NO: 3118550 - RNA, 21 nt, Mycobacterium bovis subsp bovis AF2122/97
aucggccuguucgccgucgcu

SEQ ID NO: 3118551 - RNA, 22 nt, Mycobacterium bovis subsp bovis AF2122/97
aucggcgaacaaccacgcacgg

SEQ ID NO: 3118552 - RNA, 16 nt, Mycobacterium bovis subsp bovis AF2122/97
aucggcgacaggagac

SEQ ID NO: 3118553 - RNA, 12 nt, Mycobacterium bovis subsp bovis AF2122/97
aucggcgacgaa

SEQ ID NO: 3118554 - RNA, 13 nt, Mycobacterium bovis subsp bovis AF2122/97
aucggcgacgccg

SEQ ID NO: 3118555 - RNA, 23 nt, Mycobacterium bovis subsp bovis AF2122/97
aucggcgaggccucggcggccgu

SEQ ID NO: 3118556 - RNA, 18 nt, Mycobacterium bovis subsp bovis AF2122/97
aucggcgaggucccggcc

SEQ ID NO: 3118557 - RNA, 19 nt, Mycobacterium bovis subsp bovis AF2122/97
aucggcgaggucccggccg

SEQ ID NO: 3118558 - RNA, 17 nt, Mycobacterium bovis subsp bovis AF2122/97
aucggcgcaaucaacgu

SEQ ID NO: 3118559 - RNA, 22 nt, Mycobacterium bovis subsp bovis AF2122/97
aucggcgccaauucagcggcaa

SEQ ID NO: 3118560 - RNA, 15 nt, Mycobacterium bovis subsp bovis AF2122/97
aucggcgcgccgauc

SEQ ID NO: 3118561 - RNA, 13 nt, Mycobacterium bovis subsp bovis AF2122/97
aucggcgcgucga

SEQ ID NO: 3118562 - RNA, 14 nt, Mycobacterium bovis subsp bovis AF2122/97
aucggcggaccgca

SEQ ID NO: 3118563 - RNA, 15 nt, Mycobacterium bovis subsp bovis AF2122/97
aucggcggaccgcag

SEQ ID NO: 3118564 - RNA, 15 nt, Mycobacterium bovis subsp bovis AF2122/97
aucggcggcaaccgc

SEQ ID NO: 3118565 - RNA, 15 nt, Mycobacterium bovis subsp bovis AF2122/97
aucggcggccggcac

SEQ ID NO: 3118566 - RNA, 16 nt, Mycobacterium bovis subsp bovis AF2122/97
aucggcggccggcacg

SEQ ID NO: 3118567 - RNA, 18 nt, Mycobacterium bovis subsp bovis AF2122/97
aucggcggcguccagcag

SEQ ID NO: 3118568 - RNA, 15 nt, Mycobacterium bovis subsp bovis AF2122/97
aucggcggcgucgac

SEQ ID NO: 3118569 - RNA, 17 nt, Mycobacterium bovis subsp bovis AF2122/97
aucggcggcgucgacgu

SEQ ID NO: 3118570 - RNA, 19 nt, Mycobacterium bovis subsp bovis AF2122/97
aucggcggcgucuucgucg

SEQ ID NO: 3118571 - RNA, 21 nt, Mycobacterium bovis subsp bovis AF2122/97
aucggcgggucugggucaggc

SEQ ID NO: 3118572 - RNA, 13 nt, Mycobacterium bovis subsp bovis AF2122/97
aucggcuaccuaa

SEQ ID NO: 3118573 - RNA, 13 nt, Mycobacterium bovis subsp bovis AF2122/97
aucggcuccgccg

SEQ ID NO: 3118574 - RNA, 16 nt, Mycobacterium bovis subsp bovis AF2122/97
aucgggaagccgccgg

SEQ ID NO: 3118575 - RNA, 18 nt, Mycobacterium bovis subsp bovis AF2122/97
aucgggaaguacggcagg

SEQ ID NO: 3118576 - RNA, 13 nt, Mycobacterium bovis subsp bovis AF2122/97
aucgggaaugacc

SEQ ID NO: 3118577 - RNA, 23 nt, Mycobacterium bovis subsp bovis AF2122/97
aucgggaaugucuuuggucgccg

SEQ ID NO: 3118578 - RNA, 21 nt, Mycobacterium bovis subsp bovis AF2122/97
aucgggaauuucgucggccau

SEQ ID NO: 3118579 - RNA, 19 nt, Mycobacterium bovis subsp bovis AF2122/97
aucgggaccggggacgcgc

SEQ ID NO: 3118580 - RNA, 13 nt, Mycobacterium bovis subsp bovis AF2122/97
aucgggagccgca

SEQ ID NO: 3118581 - RNA, 13 nt, Mycobacterium bovis subsp bovis AF2122/97
aucgggagcggcu

SEQ ID NO: 3118582 - RNA, 17 nt, Mycobacterium bovis subsp bovis AF2122/97
aucgggagcggcugcgg

SEQ ID NO: 3118583 - RNA, 14 nt, Mycobacterium bovis subsp bovis AF2122/97
aucgggaucgcugc

SEQ ID NO: 3118584 - RNA, 16 nt, Mycobacterium bovis subsp bovis AF2122/97
aucgggaucugggcuc

SEQ ID NO: 3118585 - RNA, 19 nt, Mycobacterium bovis subsp bovis AF2122/97
aucgggcccccuggaucgc

SEQ ID NO: 3118586 - RNA, 19 nt, Mycobacterium bovis subsp bovis AF2122/97
aucgggccgaauaccacac

SEQ ID NO: 3118587 - RNA, 15 nt, Mycobacterium bovis subsp bovis AF2122/97
aucgggccgccgagc

SEQ ID NO: 3118588 - RNA, 14 nt, Mycobacterium bovis subsp bovis AF2122/97
aucgggccggcgcg

SEQ ID NO: 3118589 - RNA, 22 nt, Mycobacterium bovis subsp bovis AF2122/97
aucgggcgagcucgucgagcgc

SEQ ID NO: 3118590 - RNA, 15 nt, Mycobacterium bovis subsp bovis AF2122/97
aucgggcggcaccgc

SEQ ID NO: 3118591 - RNA, 16 nt, Mycobacterium bovis subsp bovis AF2122/97
aucgggcggcaccgcu

SEQ ID NO: 3118592 - RNA, 18 nt, Mycobacterium bovis subsp bovis AF2122/97
aucgggcucagcggcgac

SEQ ID NO: 3118593 - RNA, 17 nt, Mycobacterium bovis subsp bovis AF2122/97
aucgggcuucggccaga

SEQ ID NO: 3118594 - RNA, 13 nt, Mycobacterium bovis subsp bovis AF2122/97
aucggggcaccgu

SEQ ID NO: 3118595 - RNA, 17 nt, Mycobacterium bovis subsp bovis AF2122/97
aucggggcaccgugcgg

SEQ ID NO: 3118596 - RNA, 15 nt, Mycobacterium bovis subsp bovis AF2122/97
aucggggccacugag

SEQ ID NO: 3118597 - RNA, 13 nt, Mycobacterium bovis subsp bovis AF2122/97
aucggggcgacga

SEQ ID NO: 3118598 - RNA, 22 nt, Mycobacterium bovis subsp bovis AF2122/97
aucgggguggucgcaccgccgg

SEQ ID NO: 3118599 - RNA, 16 nt, Mycobacterium bovis subsp bovis AF2122/97
aucgggucacccccgg

SEQ ID NO: 3118600 - RNA, 20 nt, Mycobacterium bovis subsp bovis AF2122/97
aucgggucacccccggccag

SEQ ID NO: 3118601 - RNA, 17 nt, Mycobacterium bovis subsp bovis AF2122/97
aucggguucuucaacuc

SEQ ID NO: 3118602 - RNA, 17 nt, Mycobacterium bovis subsp bovis AF2122/97
aucgguauaacgacucg

SEQ ID NO: 3118603 - RNA, 16 nt, Mycobacterium bovis subsp bovis AF2122/97
aucggucaccgcggca

SEQ ID NO: 3118604 - RNA, 14 nt, Mycobacterium bovis subsp bovis AF2122/97
aucggucagcgggc

SEQ ID NO: 3118605 - RNA, 15 nt, Mycobacterium bovis subsp bovis AF2122/97
aucgguccaaagcac

SEQ ID NO: 3118606 - RNA, 12 nt, Mycobacterium bovis subsp bovis AF2122/97
aucggucgaucg

SEQ ID NO: 3118607 - RNA, 13 nt, Mycobacterium bovis subsp bovis AF2122/97
aucggucguccgg

SEQ ID NO: 3118608 - RNA, 22 nt, Mycobacterium bovis subsp bovis AF2122/97
aucggugaauguugccgccgcg

SEQ ID NO: 3118609 - RNA, 17 nt, Mycobacterium bovis subsp bovis AF2122/97
aucggugaucaaaccgg

SEQ ID NO: 3118610 - RNA, 23 nt, Mycobacterium bovis subsp bovis AF2122/97
aucggugaugaacgacauccggc

SEQ ID NO: 3118611 - RNA, 23 nt, Mycobacterium bovis subsp bovis AF2122/97
aucggugccaaaggacgacaccg

SEQ ID NO: 3118612 - RNA, 23 nt, Mycobacterium bovis subsp bovis AF2122/97
aucggugccacguucgcgggcgu

SEQ ID NO: 3118613 - RNA, 18 nt, Mycobacterium bovis subsp bovis AF2122/97
aucggugcuggucgccgc

SEQ ID NO: 3118614 - RNA, 22 nt, Mycobacterium bovis subsp bovis AF2122/97
aucggugcuggucgccgcggca

SEQ ID NO: 3118615 - RNA, 14 nt, Mycobacterium bovis subsp bovis AF2122/97
aucgguggccacca

SEQ ID NO: 3118616 - RNA, 17 nt, Mycobacterium bovis subsp bovis AF2122/97
aucggugggcgggugcg

SEQ ID NO: 3118617 - RNA, 21 nt, Mycobacterium bovis subsp bovis AF2122/97
aucgguggucguaggugacga

SEQ ID NO: 3118618 - RNA, 12 nt, Mycobacterium bovis subsp bovis AF2122/97
aucgguucggcc

SEQ ID NO: 3118619 - RNA, 17 nt, Mycobacterium bovis subsp bovis AF2122/97
aucgguucguagcgggc

SEQ ID NO: 3118620 - RNA, 20 nt, Mycobacterium bovis subsp bovis AF2122/97
aucgguugaccggucgacca

SEQ ID NO: 3118621 - RNA, 13 nt, Mycobacterium bovis subsp bovis AF2122/97
aucuccggcuggc

SEQ ID NO: 3118622 - RNA, 16 nt, Mycobacterium bovis subsp bovis AF2122/97
aucuccgggucgaugu

SEQ ID NO: 3118623 - RNA, 15 nt, Mycobacterium bovis subsp bovis AF2122/97
aucuccgucggccag

SEQ ID NO: 3118624 - RNA, 17 nt, Mycobacterium bovis subsp bovis AF2122/97
aucuccgucggccaggc

SEQ ID NO: 3118625 - RNA, 18 nt, Mycobacterium bovis subsp bovis AF2122/97
aucuccucgccugcccga

SEQ ID NO: 3118626 - RNA, 19 nt, Mycobacterium bovis subsp bovis AF2122/97
aucuccucggcgaugccgu

SEQ ID NO: 3118627 - RNA, 22 nt, Mycobacterium bovis subsp bovis AF2122/97
aucuccuuggccguucggcgcc

SEQ ID NO: 3118628 - RNA, 15 nt, Mycobacterium bovis subsp bovis AF2122/97
aucucgaaggccgcc

SEQ ID NO: 3118629 - RNA, 21 nt, Mycobacterium bovis subsp bovis AF2122/97
aucucgaaggccgccaaccgu

SEQ ID NO: 3118630 - RNA, 17 nt, Mycobacterium bovis subsp bovis AF2122/97
aucucgaccagcgccga

SEQ ID NO: 3118631 - RNA, 18 nt, Mycobacterium bovis subsp bovis AF2122/97
aucucgaccagcgccgau

SEQ ID NO: 3118632 - RNA, 18 nt, Mycobacterium bovis subsp bovis AF2122/97
aucucgaccggcuugccc

SEQ ID NO: 3118633 - RNA, 24 nt, Mycobacterium bovis subsp bovis AF2122/97
aucucgaccucgucggccgacacc

SEQ ID NO: 3118634 - RNA, 23 nt, Mycobacterium bovis subsp bovis AF2122/97
aucucgacggccucgucgauguu

SEQ ID NO: 3118635 - RNA, 14 nt, Mycobacterium bovis subsp bovis AF2122/97
aucucgaucaucau

SEQ ID NO: 3118636 - RNA, 17 nt, Mycobacterium bovis subsp bovis AF2122/97
aucucgaucgacccggu

SEQ ID NO: 3118637 - RNA, 13 nt, Mycobacterium bovis subsp bovis AF2122/97
aucucgcaccgcg

SEQ ID NO: 3118638 - RNA, 14 nt, Mycobacterium bovis subsp bovis AF2122/97
aucucgcccaccuc

SEQ ID NO: 3118639 - RNA, 18 nt, Mycobacterium bovis subsp bovis AF2122/97
aucucgccggcgaagacc

SEQ ID NO: 3118640 - RNA, 21 nt, Mycobacterium bovis subsp bovis AF2122/97
aucucgccggcgaagaccgcc

SEQ ID NO: 3118641 - RNA, 18 nt, Mycobacterium bovis subsp bovis AF2122/97
aucucgccggugagccgg

SEQ ID NO: 3118642 - RNA, 24 nt, Mycobacterium bovis subsp bovis AF2122/97
aucucggcagagacguacugggcg

SEQ ID NO: 3118643 - RNA, 20 nt, Mycobacterium bovis subsp bovis AF2122/97
aucucggccagggucacaaa

SEQ ID NO: 3118644 - RNA, 16 nt, Mycobacterium bovis subsp bovis AF2122/97
aucucggcgcagccgg

SEQ ID NO: 3118645 - RNA, 12 nt, Mycobacterium bovis subsp bovis AF2122/97
aucucggcggcc

SEQ ID NO: 3118646 - RNA, 15 nt, Mycobacterium bovis subsp bovis AF2122/97
aucucggcggccaac

SEQ ID NO: 3118647 - RNA, 17 nt, Mycobacterium bovis subsp bovis AF2122/97
aucucggcguugccgcc

SEQ ID NO: 3118648 - RNA, 19 nt, Mycobacterium bovis subsp bovis AF2122/97
aucucggcguugccgccgu

SEQ ID NO: 3118649 - RNA, 17 nt, Mycobacterium bovis subsp bovis AF2122/97
aucucgggcaggccguc

SEQ ID NO: 3118650 - RNA, 15 nt, Mycobacterium bovis subsp bovis AF2122/97
aucucggucagaugc

SEQ ID NO: 3118651 - RNA, 15 nt, Mycobacterium bovis subsp bovis AF2122/97
aucucgguggacggc

SEQ ID NO: 3118652 - RNA, 22 nt, Mycobacterium bovis subsp bovis AF2122/97
aucucgguggacggcaggcggc

SEQ ID NO: 3118653 - RNA, 16 nt, Mycobacterium bovis subsp bovis AF2122/97
aucucguacuccccgc

SEQ ID NO: 3118654 - RNA, 16 nt, Mycobacterium bovis subsp bovis AF2122/97
aucucgucgucgcggc

SEQ ID NO: 3118655 - RNA, 18 nt, Mycobacterium bovis subsp bovis AF2122/97
aucucuaccagccgcccc

SEQ ID NO: 3118656 - RNA, 23 nt, Mycobacterium bovis subsp bovis AF2122/97
aucucuaccagccgccccggcuu

SEQ ID NO: 3118657 - RNA, 16 nt, Mycobacterium bovis subsp bovis AF2122/97
aucucuccggcggcga

SEQ ID NO: 3118658 - RNA, 12 nt, Mycobacterium bovis subsp bovis AF2122/97
aucucuccugga

SEQ ID NO: 3118659 - RNA, 16 nt, Mycobacterium bovis subsp bovis AF2122/97
aucucugagcgggcgg

SEQ ID NO: 3118660 - RNA, 20 nt, Mycobacterium bovis subsp bovis AF2122/97
aucugaaaauugacccccua

SEQ ID NO: 3118661 - RNA, 22 nt, Mycobacterium bovis subsp bovis AF2122/97
aucugacgacgcgacacgccga

SEQ ID NO: 3118662 - RNA, 14 nt, Mycobacterium bovis subsp bovis AF2122/97
aucugacggcgccg

SEQ ID NO: 3118663 - RNA, 19 nt, Mycobacterium bovis subsp bovis AF2122/97
aucugaggcuuccagcucg

SEQ ID NO: 3118664 - RNA, 17 nt, Mycobacterium bovis subsp bovis AF2122/97
aucugaguggacggccg

SEQ ID NO: 3118665 - RNA, 16 nt, Mycobacterium bovis subsp bovis AF2122/97
aucugauccggugccg

SEQ ID NO: 3118666 - RNA, 14 nt, Mycobacterium bovis subsp bovis AF2122/97
aucugaucggcgcg

SEQ ID NO: 3118667 - RNA, 23 nt, Mycobacterium bovis subsp bovis AF2122/97
aucugcacgagugcggcgaccag

SEQ ID NO: 3118668 - RNA, 14 nt, Mycobacterium bovis subsp bovis AF2122/97
aucugcaggcccag

SEQ ID NO: 3118669 - RNA, 18 nt, Mycobacterium bovis subsp bovis AF2122/97
aucugcaggcccaggcug

SEQ ID NO: 3118670 - RNA, 14 nt, Mycobacterium bovis subsp bovis AF2122/97
aucugccaccgcgg

SEQ ID NO: 3118671 - RNA, 16 nt, Mycobacterium bovis subsp bovis AF2122/97
aucugccaccgcgggc

SEQ ID NO: 3118672 - RNA, 14 nt, Mycobacterium bovis subsp bovis AF2122/97
aucugccacguuga

SEQ ID NO: 3118673 - RNA, 17 nt, Mycobacterium bovis subsp bovis AF2122/97
aucugcccccgccggcc

SEQ ID NO: 3118674 - RNA, 22 nt, Mycobacterium bovis subsp bovis AF2122/97
aucugcccccgccggccgucga

SEQ ID NO: 3118675 - RNA, 16 nt, Mycobacterium bovis subsp bovis AF2122/97
aucugcccggugaucc

SEQ ID NO: 3118676 - RNA, 14 nt, Mycobacterium bovis subsp bovis AF2122/97
aucugcccuguucg

SEQ ID NO: 3118677 - RNA, 12 nt, Mycobacterium bovis subsp bovis AF2122/97
aucugccggccg

SEQ ID NO: 3118678 - RNA, 15 nt, Mycobacterium bovis subsp bovis AF2122/97
aucugccggccggcg

SEQ ID NO: 3118679 - RNA, 18 nt, Mycobacterium bovis subsp bovis AF2122/97
aucugccggccggcgggc

SEQ ID NO: 3118680 - RNA, 18 nt, Mycobacterium bovis subsp bovis AF2122/97
aucugcgacaagaccggc

SEQ ID NO: 3118681 - RNA, 18 nt, Mycobacterium bovis subsp bovis AF2122/97
aucugcgcaaccgagcgg

SEQ ID NO: 3118682 - RNA, 19 nt, Mycobacterium bovis subsp bovis AF2122/97
aucugcgcgaggggccggc

SEQ ID NO: 3118683 - RNA, 20 nt, Mycobacterium bovis subsp bovis AF2122/97
aucugcgcgaggggccggcu

SEQ ID NO: 3118684 - RNA, 14 nt, Mycobacterium bovis subsp bovis AF2122/97
aucugcgcgaugcc

SEQ ID NO: 3118685 - RNA, 15 nt, Mycobacterium bovis subsp bovis AF2122/97
aucugcgcgucaggc

SEQ ID NO: 3118686 - RNA, 21 nt, Mycobacterium bovis subsp bovis AF2122/97
aucugcggaggcgaccccggc

SEQ ID NO: 3118687 - RNA, 18 nt, Mycobacterium bovis subsp bovis AF2122/97
aucugcgggccggugaac

SEQ ID NO: 3118688 - RNA, 16 nt, Mycobacterium bovis subsp bovis AF2122/97
aucugcuagcuuggcg

SEQ ID NO: 3118689 - RNA, 18 nt, Mycobacterium bovis subsp bovis AF2122/97
aucugcuccgcagcagac

SEQ ID NO: 3118690 - RNA, 13 nt, Mycobacterium bovis subsp bovis AF2122/97
aucugcuccucgg

SEQ ID NO: 3118691 - RNA, 23 nt, Mycobacterium bovis subsp bovis AF2122/97
aucugcuccucggucagcggggu

SEQ ID NO: 3118692 - RNA, 14 nt, Mycobacterium bovis subsp bovis AF2122/97
aucugcucggcauc

SEQ ID NO: 3118693 - RNA, 23 nt, Mycobacterium bovis subsp bovis AF2122/97
aucugcucguagcggcggcgccc

SEQ ID NO: 3118694 - RNA, 19 nt, Mycobacterium bovis subsp bovis AF2122/97
aucugcucguggguaccga

SEQ ID NO: 3118695 - RNA, 13 nt, Mycobacterium bovis subsp bovis AF2122/97
aucugcugcagcg

SEQ ID NO: 3118696 - RNA, 11 nt, Mycobacterium bovis subsp bovis AF2122/97
aucugcugccg

SEQ ID NO: 3118697 - RNA, 16 nt, Mycobacterium bovis subsp bovis AF2122/97
aucugcugcucgauca

SEQ ID NO: 3118698 - RNA, 22 nt, Mycobacterium bovis subsp bovis AF2122/97
aucugcugugucguacccggca

SEQ ID NO: 3118699 - RNA, 21 nt, Mycobacterium bovis subsp bovis AF2122/97
aucugcuugccaccgccgccg

SEQ ID NO: 3118700 - RNA, 18 nt, Mycobacterium bovis subsp bovis AF2122/97
aucugcuuggugaccuga

SEQ ID NO: 3118701 - RNA, 19 nt, Mycobacterium bovis subsp bovis AF2122/97
aucuggccgaacgacgggu

SEQ ID NO: 3118702 - RNA, 15 nt, Mycobacterium bovis subsp bovis AF2122/97
aucuggccggcggug

SEQ ID NO: 3118703 - RNA, 16 nt, Mycobacterium bovis subsp bovis AF2122/97
aucuggccuuggcagu

SEQ ID NO: 3118704 - RNA, 15 nt, Mycobacterium bovis subsp bovis AF2122/97
aucuggcgcugcugg

SEQ ID NO: 3118705 - RNA, 22 nt, Mycobacterium bovis subsp bovis AF2122/97
aucuggcguagugcucgccggc

SEQ ID NO: 3118706 - RNA, 18 nt, Mycobacterium bovis subsp bovis AF2122/97
aucuggcuggugauggcc

SEQ ID NO: 3118707 - RNA, 20 nt, Mycobacterium bovis subsp bovis AF2122/97
aucugggcuuucgcgugcgg

SEQ ID NO: 3118708 - RNA, 16 nt, Mycobacterium bovis subsp bovis AF2122/97
augcccuggggguggc

SEQ ID NO: 3118709 - RNA, 18 nt, Mycobacterium bovis subsp bovis AF2122/97
augcccuggggguggcag

SEQ ID NO: 3118710 - RNA, 18 nt, Mycobacterium bovis subsp bovis AF2122/97
augcccuugcggaagaag

SEQ ID NO: 3118711 - RNA, 14 nt, Mycobacterium bovis subsp bovis AF2122/97
augcccuuggccag

SEQ ID NO: 3118712 - RNA, 16 nt, Mycobacterium bovis subsp bovis AF2122/97
augcccuuggccagca

SEQ ID NO: 3118713 - RNA, 17 nt, Mycobacterium bovis subsp bovis AF2122/97
augcccuuggccagcag

SEQ ID NO: 3118714 - RNA, 17 nt, Mycobacterium bovis subsp bovis AF2122/97
augccgaccggcacccg

SEQ ID NO: 3118715 - RNA, 20 nt, Mycobacterium bovis subsp bovis AF2122/97
augccgaccggcacccgcgg

SEQ ID NO: 3118716 - RNA, 22 nt, Mycobacterium bovis subsp bovis AF2122/97
augccgaccggcacccgcggcg

SEQ ID NO: 3118717 - RNA, 18 nt, Mycobacterium bovis subsp bovis AF2122/97
augccgacgacggguugg

SEQ ID NO: 3118718 - RNA, 18 nt, Mycobacterium bovis subsp bovis AF2122/97
augccgagcgaccguccc

SEQ ID NO: 3118719 - RNA, 13 nt, Mycobacterium bovis subsp bovis AF2122/97
augccgaucggcc

SEQ ID NO: 3118720 - RNA, 23 nt, Mycobacterium bovis subsp bovis AF2122/97
augccgaucggccugcagcgaug

SEQ ID NO: 3118721 - RNA, 16 nt, Mycobacterium bovis subsp bovis AF2122/97
augccgaugucgaugc

SEQ ID NO: 3118722 - RNA, 19 nt, Mycobacterium bovis subsp bovis AF2122/97
augccgaugucgaugccgc

SEQ ID NO: 3118723 - RNA, 20 nt, Mycobacterium bovis subsp bovis AF2122/97
augccgaugucgggcacggu

SEQ ID NO: 3118724 - RNA, 23 nt, Mycobacterium bovis subsp bovis AF2122/97
augccgccaugcgcaccagucca

SEQ ID NO: 3118725 - RNA, 15 nt, Mycobacterium bovis subsp bovis AF2122/97
augccgcccaucacc

SEQ ID NO: 3118726 - RNA, 17 nt, Mycobacterium bovis subsp bovis AF2122/97
augccgcccaucacccc

SEQ ID NO: 3118727 - RNA, 19 nt, Mycobacterium bovis subsp bovis AF2122/97
augccgcccaucaccccga

SEQ ID NO: 3118728 - RNA, 19 nt, Mycobacterium bovis subsp bovis AF2122/97
augccgcccccauaacugc

SEQ ID NO: 3118729 - RNA, 17 nt, Mycobacterium bovis subsp bovis AF2122/97
augccgcccgcgccgcc

SEQ ID NO: 3118730 - RNA, 18 nt, Mycobacterium bovis subsp bovis AF2122/97
augccgcccgcgccgccg

SEQ ID NO: 3118731 - RNA, 21 nt, Mycobacterium bovis subsp bovis AF2122/97
augccgcccgcgccgccggac

SEQ ID NO: 3118732 - RNA, 10 nt, Mycobacterium bovis subsp bovis AF2122/97
augccgccga

SEQ ID NO: 3118733 - RNA, 19 nt, Mycobacterium bovis subsp bovis AF2122/97
augccgccgaagccgcgca

SEQ ID NO: 3118734 - RNA, 20 nt, Mycobacterium bovis subsp bovis AF2122/97
augccgcggaggcggccagc

SEQ ID NO: 3118735 - RNA, 11 nt, Mycobacterium bovis subsp bovis AF2122/97
augccgcggcc

SEQ ID NO: 3118736 - RNA, 14 nt, Mycobacterium bovis subsp bovis AF2122/97
augccgcggccagu

SEQ ID NO: 3118737 - RNA, 20 nt, Mycobacterium bovis subsp bovis AF2122/97
augccgcggccaguacgucg

SEQ ID NO: 3118738 - RNA, 21 nt, Mycobacterium bovis subsp bovis AF2122/97
augccgcggccaguacgucga

SEQ ID NO: 3118739 - RNA, 13 nt, Mycobacterium bovis subsp bovis AF2122/97
augccgcggugga

SEQ ID NO: 3118740 - RNA, 23 nt, Mycobacterium bovis subsp bovis AF2122/97
augccgcgguggaugcgaugcgc

SEQ ID NO: 3118741 - RNA, 17 nt, Mycobacterium bovis subsp bovis AF2122/97
augccgcucucggcgau

SEQ ID NO: 3118742 - RNA, 21 nt, Mycobacterium bovis subsp bovis AF2122/97
augccggacgccaugcccgca

SEQ ID NO: 3118743 - RNA, 19 nt, Mycobacterium bovis subsp bovis AF2122/97
augccggcauaaaccgcgu

SEQ ID NO: 3118744 - RNA, 16 nt, Mycobacterium bovis subsp bovis AF2122/97
augccggccgcggggc

SEQ ID NO: 3118745 - RNA, 23 nt, Mycobacterium bovis subsp bovis AF2122/97
augccggcgaacucgcgccgagc

SEQ ID NO: 3118746 - RNA, 19 nt, Mycobacterium bovis subsp bovis AF2122/97
augccggcgaaggccagca

SEQ ID NO: 3118747 - RNA, 20 nt, Mycobacterium bovis subsp bovis AF2122/97
augccgggaaccaacaccag

SEQ ID NO: 3118748 - RNA, 18 nt, Mycobacterium bovis subsp bovis AF2122/97
augccgggcugaggcggc

SEQ ID NO: 3118749 - RNA, 19 nt, Mycobacterium bovis subsp bovis AF2122/97
augccggugccgggcacca

SEQ ID NO: 3118750 - RNA, 13 nt, Mycobacterium bovis subsp bovis AF2122/97
augccgguguuga

SEQ ID NO: 3118751 - RNA, 22 nt, Mycobacterium bovis subsp bovis AF2122/97
augccguaguaaggagccgggc

SEQ ID NO: 3118752 - RNA, 15 nt, Mycobacterium bovis subsp bovis AF2122/97
augccguauagcgca

SEQ ID NO: 3118753 - RNA, 13 nt, Mycobacterium bovis subsp bovis AF2122/97
augccgucgccgg

SEQ ID NO: 3118754 - RNA, 18 nt, Mycobacterium bovis subsp bovis AF2122/97
augccgucgccggucagg

SEQ ID NO: 3118755 - RNA, 15 nt, Mycobacterium bovis subsp bovis AF2122/97
augccgugccgggcc

SEQ ID NO: 3118756 - RNA, 17 nt, Mycobacterium bovis subsp bovis AF2122/97
augccgugcgccacggc

SEQ ID NO: 3118757 - RNA, 17 nt, Mycobacterium bovis subsp bovis AF2122/97
augccgugcugggccga

SEQ ID NO: 3118758 - RNA, 17 nt, Mycobacterium bovis subsp bovis AF2122/97
augccguggccgccaug

SEQ ID NO: 3118759 - RNA, 18 nt, Mycobacterium bovis subsp bovis AF2122/97
augccguucaugccaugg

SEQ ID NO: 3118760 - RNA, 16 nt, Mycobacterium bovis subsp bovis AF2122/97
augccguugcgaucgc

SEQ ID NO: 3118761 - RNA, 14 nt, Mycobacterium bovis subsp bovis AF2122/97
augccuaccgggcc

SEQ ID NO: 3118762 - RNA, 18 nt, Mycobacterium bovis subsp bovis AF2122/97
augccugcccaccuucga

SEQ ID NO: 3118763 - RNA, 23 nt, Mycobacterium bovis subsp bovis AF2122/97
augccuggaaucgcggagccagg

SEQ ID NO: 3118764 - RNA, 15 nt, Mycobacterium bovis subsp bovis AF2122/97
augccuucggccaac

SEQ ID NO: 3118765 - RNA, 19 nt, Mycobacterium bovis subsp bovis AF2122/97
augccuucguagcggccgc

SEQ ID NO: 3118766 - RNA, 20 nt, Mycobacterium bovis subsp bovis AF2122/97
augccuucguagcggccgca

SEQ ID NO: 3118767 - RNA, 15 nt, Mycobacterium bovis subsp bovis AF2122/97
augccuugaccgcgg

SEQ ID NO: 3118768 - RNA, 17 nt, Mycobacterium bovis subsp bovis AF2122/97
augcgaaccgaggugcc

SEQ ID NO: 3118769 - RNA, 19 nt, Mycobacterium bovis subsp bovis AF2122/97
augcgacagaugccgggcu

SEQ ID NO: 3118770 - RNA, 19 nt, Mycobacterium bovis subsp bovis AF2122/97
augcgacgaaccucggcgg

SEQ ID NO: 3118771 - RNA, 18 nt, Mycobacterium bovis subsp bovis AF2122/97
augcgacgucaggguauc

SEQ ID NO: 3118772 - RNA, 14 nt, Mycobacterium bovis subsp bovis AF2122/97
augcgagaacgucg

SEQ ID NO: 3118773 - RNA, 20 nt, Mycobacterium bovis subsp bovis AF2122/97
augcgagguucagccugagc

SEQ ID NO: 3118774 - RNA, 14 nt, Mycobacterium bovis subsp bovis AF2122/97
augcgauaggcccg

SEQ ID NO: 3118775 - RNA, 15 nt, Mycobacterium bovis subsp bovis AF2122/97
augcgaugcgcgccg

SEQ ID NO: 3118776 - RNA, 19 nt, Mycobacterium bovis subsp bovis AF2122/97
augcgauucugcguccugc

SEQ ID NO: 3118777 - RNA, 19 nt, Mycobacterium bovis subsp bovis AF2122/97
augcgauucugcgucugcu

SEQ ID NO: 3118778 - RNA, 20 nt, Mycobacterium bovis subsp bovis AF2122/97
augcgauucugcgucugcuc

SEQ ID NO: 3118779 - RNA, 16 nt, Mycobacterium bovis subsp bovis AF2122/97
augcgauugccgucgu

SEQ ID NO: 3118780 - RNA, 21 nt, Mycobacterium bovis subsp bovis AF2122/97
augcgcaacaccucaccgcgg

SEQ ID NO: 3118781 - RNA, 22 nt, Mycobacterium bovis subsp bovis AF2122/97
augcgcaacuucuucagcagcg

SEQ ID NO: 3118782 - RNA, 19 nt, Mycobacterium bovis subsp bovis AF2122/97
augcgcaauagaccgcagu

SEQ ID NO: 3118783 - RNA, 17 nt, Mycobacterium bovis subsp bovis AF2122/97
augcgcaccaguccagc

SEQ ID NO: 3118784 - RNA, 14 nt, Mycobacterium bovis subsp bovis AF2122/97
augcgcacucccgg

SEQ ID NO: 3118785 - RNA, 20 nt, Mycobacterium bovis subsp bovis AF2122/97
augcgcagaaacgccgagcg

SEQ ID NO: 3118786 - RNA, 12 nt, Mycobacterium bovis subsp bovis AF2122/97
augcgcagugca

SEQ ID NO: 3118787 - RNA, 17 nt, Mycobacterium bovis subsp bovis AF2122/97
augcgcagugcaccgcg

SEQ ID NO: 3118788 - RNA, 15 nt, Mycobacterium bovis subsp bovis AF2122/97
augcgccaacccggc

SEQ ID NO: 3118789 - RNA, 16 nt, Mycobacterium bovis subsp bovis AF2122/97
augcgccaacccggcc

SEQ ID NO: 3118790 - RNA, 17 nt, Mycobacterium bovis subsp bovis AF2122/97
augcgccagcgagcgca

SEQ ID NO: 3118791 - RNA, 14 nt, Mycobacterium bovis subsp bovis AF2122/97
augcgccaggcuga

SEQ ID NO: 3118792 - RNA, 18 nt, Mycobacterium bovis subsp bovis AF2122/97
augcgccaggcugaagaa

SEQ ID NO: 3118793 - RNA, 15 nt, Mycobacterium bovis subsp bovis AF2122/97
augcgccaucucgac

SEQ ID NO: 3118794 - RNA, 19 nt, Mycobacterium bovis subsp bovis AF2122/97
augcuggcgaucgcgacga

SEQ ID NO: 3118795 - RNA, 21 nt, Mycobacterium bovis subsp bovis AF2122/97
augcuggcggccucgccggcg

SEQ ID NO: 3118796 - RNA, 21 nt, Mycobacterium bovis subsp bovis AF2122/97
augcugggcccgccagcccag

SEQ ID NO: 3118797 - RNA, 13 nt, Mycobacterium bovis subsp bovis AF2122/97
augcugggcgaga

SEQ ID NO: 3118798 - RNA, 21 nt, Mycobacterium bovis subsp bovis AF2122/97
augcuggggccuggucccacc

SEQ ID NO: 3118799 - RNA, 20 nt, Mycobacterium bovis subsp bovis AF2122/97
augcugucagacggcgucug

SEQ ID NO: 3118800 - RNA, 19 nt, Mycobacterium bovis subsp bovis AF2122/97
augcugucggugccgucga

SEQ ID NO: 3118801 - RNA, 20 nt, Mycobacterium bovis subsp bovis AF2122/97
augcuucggagaccgccucg

SEQ ID NO: 3118802 - RNA, 20 nt, Mycobacterium bovis subsp bovis AF2122/97
augcuuguguucgugguugu

SEQ ID NO: 3118803 - RNA, 19 nt, Mycobacterium bovis subsp bovis AF2122/97
auggaaaacgccaugccgg

SEQ ID NO: 3118804 - RNA, 14 nt, Mycobacterium bovis subsp bovis AF2122/97
auggaaggcggcca

SEQ ID NO: 3118805 - RNA, 20 nt, Mycobacterium bovis subsp bovis AF2122/97
auggaaggcggccaggugca

SEQ ID NO: 3118806 - RNA, 18 nt, Mycobacterium bovis subsp bovis AF2122/97
auggaaguaaggcacggg

SEQ ID NO: 3118807 - RNA, 15 nt, Mycobacterium bovis subsp bovis AF2122/97
auggacaacagcuug

SEQ ID NO: 3118808 - RNA, 16 nt, Mycobacterium bovis subsp bovis AF2122/97
auggacaacagcuugg

SEQ ID NO: 3118809 - RNA, 13 nt, Mycobacterium bovis subsp bovis AF2122/97
auggacaccaacc

SEQ ID NO: 3118810 - RNA, 13 nt, Mycobacterium bovis subsp bovis AF2122/97
auggacaccaccu

SEQ ID NO: 3118811 - RNA, 13 nt, Mycobacterium bovis subsp bovis AF2122/97
auggaccgccgcc

SEQ ID NO: 3118812 - RNA, 15 nt, Mycobacterium bovis subsp bovis AF2122/97
auggaccgccgccga

SEQ ID NO: 3118813 - RNA, 16 nt, Mycobacterium bovis subsp bovis AF2122/97
auggaccgccgccgac

SEQ ID NO: 3118814 - RNA, 22 nt, Mycobacterium bovis subsp bovis AF2122/97
auggacgcuuggguagccugac

SEQ ID NO: 3118815 - RNA, 17 nt, Mycobacterium bovis subsp bovis AF2122/97
auggacggcagccagcc

SEQ ID NO: 3118816 - RNA, 21 nt, Mycobacterium bovis subsp bovis AF2122/97
auggacggccaggugcagggu

SEQ ID NO: 3118817 - RNA, 13 nt, Mycobacterium bovis subsp bovis AF2122/97
auggagccgcgac

SEQ ID NO: 3118818 - RNA, 12 nt, Mycobacterium bovis subsp bovis AF2122/97
auggagccggug

SEQ ID NO: 3118819 - RNA, 20 nt, Mycobacterium bovis subsp bovis AF2122/97
auggaucccacgaguuggcc

SEQ ID NO: 3118820 - RNA, 23 nt, Mycobacterium bovis subsp bovis AF2122/97
auggauguaggcuucgccgaguu

SEQ ID NO: 3118821 - RNA, 16 nt, Mycobacterium bovis subsp bovis AF2122/97
auggauugcggcacgg

SEQ ID NO: 3118822 - RNA, 21 nt, Mycobacterium bovis subsp bovis AF2122/97
auggauuggcgucagcagcaa

SEQ ID NO: 3118823 - RNA, 13 nt, Mycobacterium bovis subsp bovis AF2122/97
auggcaagccguu

SEQ ID NO: 3118824 - RNA, 13 nt, Mycobacterium bovis subsp bovis AF2122/97
auggcaagcggcc

SEQ ID NO: 3118825 - RNA, 20 nt, Mycobacterium bovis subsp bovis AF2122/97
auggcaagucaacaccgcgg

SEQ ID NO: 3118826 - RNA, 16 nt, Mycobacterium bovis subsp bovis AF2122/97
auggcaauauccggga

SEQ ID NO: 3118827 - RNA, 17 nt, Mycobacterium bovis subsp bovis AF2122/97
auggcacgcgggaagug

SEQ ID NO: 3118828 - RNA, 12 nt, Mycobacterium bovis subsp bovis AF2122/97
auggcacugccg

SEQ ID NO: 3118829 - RNA, 15 nt, Mycobacterium bovis subsp bovis AF2122/97
auggcacugccggca

SEQ ID NO: 3118830 - RNA, 21 nt, Mycobacterium bovis subsp bovis AF2122/97
auggcacugccggcacgccga

SEQ ID NO: 3118831 - RNA, 18 nt, Mycobacterium bovis subsp bovis AF2122/97
auggcaggcgaaggcggc

SEQ ID NO: 3118832 - RNA, 22 nt, Mycobacterium bovis subsp bovis AF2122/97
auggcauugcgcccaccgaaac

SEQ ID NO: 3118833 - RNA, 20 nt, Mycobacterium bovis subsp bovis AF2122/97
auggccacccgguggcguuu

SEQ ID NO: 3118834 - RNA, 22 nt, Mycobacterium bovis subsp bovis AF2122/97
auggccaccgaacgcggccacc

SEQ ID NO: 3118835 - RNA, 15 nt, Mycobacterium bovis subsp bovis AF2122/97
auggccaccggcggu

SEQ ID NO: 3118836 - RNA, 11 nt, Mycobacterium bovis subsp bovis AF2122/97
auggccagcac

SEQ ID NO: 3118837 - RNA, 21 nt, Mycobacterium bovis subsp bovis AF2122/97
auggccagcaccacggccagc

SEQ ID NO: 3118838 - RNA, 16 nt, Mycobacterium bovis subsp bovis AF2122/97
auggccagcacggugu

SEQ ID NO: 3118839 - RNA, 15 nt, Mycobacterium bovis subsp bovis AF2122/97
auggccagcaucagc

SEQ ID NO: 3118840 - RNA, 21 nt, Mycobacterium bovis subsp bovis AF2122/97
auggccagguuguagacggca

SEQ ID NO: 3118841 - RNA, 17 nt, Mycobacterium bovis subsp bovis AF2122/97
auggccccgggcgguga

SEQ ID NO: 3118842 - RNA, 23 nt, Mycobacterium bovis subsp bovis AF2122/97
auggccccugucauguccugggc

SEQ ID NO: 3118843 - RNA, 19 nt, Mycobacterium bovis subsp bovis AF2122/97
auggcccggcucacagcac

SEQ ID NO: 3118844 - RNA, 22 nt, Mycobacterium bovis subsp bovis AF2122/97
auggcccggcucacagcacagc

SEQ ID NO: 3118845 - RNA, 20 nt, Mycobacterium bovis subsp bovis AF2122/97
auggcccguuggcagcacag

SEQ ID NO: 3118846 - RNA, 13 nt, Mycobacterium bovis subsp bovis AF2122/97
auggcccugggcc

SEQ ID NO: 3118847 - RNA, 12 nt, Mycobacterium bovis subsp bovis AF2122/97
cagcggcgaccg

SEQ ID NO: 3118848 - RNA, 16 nt, Mycobacterium bovis subsp bovis AF2122/97
cagcggcgaucaggcg

SEQ ID NO: 3118849 - RNA, 14 nt, Mycobacterium bovis subsp bovis AF2122/97
cagcggcgaucgga

SEQ ID NO: 3118850 - RNA, 15 nt, Mycobacterium bovis subsp bovis AF2122/97
cagcggcgaucggag

SEQ ID NO: 3118851 - RNA, 17 nt, Mycobacterium bovis subsp bovis AF2122/97
cagcgucaccucaccga

SEQ ID NO: 3118852 - RNA, 13 nt, Mycobacterium bovis subsp bovis AF2122/97
cagcgucagcugu

SEQ ID NO: 3118853 - RNA, 21 nt, Mycobacterium bovis subsp bovis AF2122/97
cagcgucagcuguuugccggc

SEQ ID NO: 3118854 - RNA, 22 nt, Mycobacterium bovis subsp bovis AF2122/97
cagcgucagcuguuugccggcu

SEQ ID NO: 3118855 - RNA, 13 nt, Mycobacterium bovis subsp bovis AF2122/97
cagcgucaggugc

SEQ ID NO: 3118856 - RNA, 17 nt, Mycobacterium bovis subsp bovis AF2122/97
cagcgucaucccgaugu

SEQ ID NO: 3118857 - RNA, 18 nt, Mycobacterium bovis subsp bovis AF2122/97
cagcgucauccucgucgu

SEQ ID NO: 3118858 - RNA, 19 nt, Mycobacterium bovis subsp bovis AF2122/97
cagcguccaaaccuucaac

SEQ ID NO: 3118859 - RNA, 16 nt, Mycobacterium bovis subsp bovis AF2122/97
cagcguccagccgccc

SEQ ID NO: 3118860 - RNA, 17 nt, Mycobacterium bovis subsp bovis AF2122/97
cagcguccagccgcccu

SEQ ID NO: 3118861 - RNA, 14 nt, Mycobacterium bovis subsp bovis AF2122/97
cagcgucccgaugu

SEQ ID NO: 3118862 - RNA, 17 nt, Mycobacterium bovis subsp bovis AF2122/97
cagcgucccggucgcca

SEQ ID NO: 3118863 - RNA, 17 nt, Mycobacterium bovis subsp bovis AF2122/97
cagcguccgaaccaccu

SEQ ID NO: 3118864 - RNA, 18 nt, Mycobacterium bovis subsp bovis AF2122/97
cagcguccgaaccaccug

SEQ ID NO: 3118865 - RNA, 19 nt, Mycobacterium bovis subsp bovis AF2122/97
cagcguccgucgucggcgu

SEQ ID NO: 3118866 - RNA, 12 nt, Mycobacterium bovis subsp bovis AF2122/97
cagcgucgacac

SEQ ID NO: 3118867 - RNA, 13 nt, Mycobacterium bovis subsp bovis AF2122/97
cagcgucgaucgu

SEQ ID NO: 3118868 - RNA, 12 nt, Mycobacterium bovis subsp bovis AF2122/97
cagcgucgcacg

SEQ ID NO: 3118869 - RNA, 13 nt, Mycobacterium bovis subsp bovis AF2122/97
cagcgucgcacgc

SEQ ID NO: 3118870 - RNA, 16 nt, Mycobacterium bovis subsp bovis AF2122/97
cagcgucgcggccacg

SEQ ID NO: 3118871 - RNA, 18 nt, Mycobacterium bovis subsp bovis AF2122/97
cagcgucgcuaucgugcg

SEQ ID NO: 3118872 - RNA, 17 nt, Mycobacterium bovis subsp bovis AF2122/97
cagcgucggugccacca

SEQ ID NO: 3118873 - RNA, 17 nt, Mycobacterium bovis subsp bovis AF2122/97
cagcgucguaaccgucg

SEQ ID NO: 3118874 - RNA, 18 nt, Mycobacterium bovis subsp bovis AF2122/97
cagcgucguaaccgucgc

SEQ ID NO: 3118875 - RNA, 14 nt, Mycobacterium bovis subsp bovis AF2122/97
cagcgucuccuuga

SEQ ID NO: 3118876 - RNA, 20 nt, Mycobacterium bovis subsp bovis AF2122/97
cagcgucucggaggcgacca

SEQ ID NO: 3118877 - RNA, 16 nt, Mycobacterium bovis subsp bovis AF2122/97
cagcgucucucgcagc

SEQ ID NO: 3118878 - RNA, 17 nt, Mycobacterium bovis subsp bovis AF2122/97
cagcgucucucgcagcu

SEQ ID NO: 3118879 - RNA, 17 nt, Mycobacterium bovis subsp bovis AF2122/97
cagcgucuggccgucgc

SEQ ID NO: 3118880 - RNA, 23 nt, Mycobacterium bovis subsp bovis AF2122/97
cagcgucuucagguccaccgcug

SEQ ID NO: 3118881 - RNA, 12 nt, Mycobacterium bovis subsp bovis AF2122/97
cagcgugaacug

SEQ ID NO: 3118882 - RNA, 14 nt, Mycobacterium bovis subsp bovis AF2122/97
cagcgugaccaccg

SEQ ID NO: 3118883 - RNA, 17 nt, Mycobacterium bovis subsp bovis AF2122/97
cagcgugaccaccgccg

SEQ ID NO: 3118884 - RNA, 15 nt, Mycobacterium bovis subsp bovis AF2122/97
cagcgugagugcagc

SEQ ID NO: 3118885 - RNA, 19 nt, Mycobacterium bovis subsp bovis AF2122/97
cagcgugaucugcagggcc

SEQ ID NO: 3118886 - RNA, 16 nt, Mycobacterium bovis subsp bovis AF2122/97
cagcgugaucuggcca

SEQ ID NO: 3118887 - RNA, 18 nt, Mycobacterium bovis subsp bovis AF2122/97
cagcgugaucuggccacg

SEQ ID NO: 3118888 - RNA, 14 nt, Mycobacterium bovis subsp bovis AF2122/97
cagcgugcagcggc

SEQ ID NO: 3118889 - RNA, 20 nt, Mycobacterium bovis subsp bovis AF2122/97
cagcgugcagcggcgggcga

SEQ ID NO: 3118890 - RNA, 13 nt, Mycobacterium bovis subsp bovis AF2122/97
cagcgugcccgcc

SEQ ID NO: 3118891 - RNA, 17 nt, Mycobacterium bovis subsp bovis AF2122/97
cagcgugcccgccaccg

SEQ ID NO: 3118892 - RNA, 20 nt, Mycobacterium bovis subsp bovis AF2122/97
cagcgugcccgccaccggcg

SEQ ID NO: 3118893 - RNA, 12 nt, Mycobacterium bovis subsp bovis AF2122/97
cagcgugcgaug

SEQ ID NO: 3118894 - RNA, 19 nt, Mycobacterium bovis subsp bovis AF2122/97
cagcgugcgcuggcugaca

SEQ ID NO: 3118895 - RNA, 21 nt, Mycobacterium bovis subsp bovis AF2122/97
cagcguggacgcccgcccgca

SEQ ID NO: 3118896 - RNA, 23 nt, Mycobacterium bovis subsp bovis AF2122/97
cagcguggacguacugucgucgc

SEQ ID NO: 3118897 - RNA, 21 nt, Mycobacterium bovis subsp bovis AF2122/97
cagcguggagaucacgugccg

SEQ ID NO: 3118898 - RNA, 20 nt, Mycobacterium bovis subsp bovis AF2122/97
cagcguggagcgcaaguuga

SEQ ID NO: 3118899 - RNA, 22 nt, Mycobacterium bovis subsp bovis AF2122/97
cagcguggcgcccgugccgccc

SEQ ID NO: 3118900 - RNA, 13 nt, Mycobacterium bovis subsp bovis AF2122/97
cagcguggcuggc

SEQ ID NO: 3118901 - RNA, 14 nt, Mycobacterium bovis subsp bovis AF2122/97
cagcgugggcagcg

SEQ ID NO: 3118902 - RNA, 15 nt, Mycobacterium bovis subsp bovis AF2122/97
cagcguggggccgcc

SEQ ID NO: 3118903 - RNA, 16 nt, Mycobacterium bovis subsp bovis AF2122/97
cagcguggggccgcca

SEQ ID NO: 3118904 - RNA, 17 nt, Mycobacterium bovis subsp bovis AF2122/97
cagcguggggccgccac

SEQ ID NO: 3118905 - RNA, 18 nt, Mycobacterium bovis subsp bovis AF2122/97
cagcguggggccgccacc

SEQ ID NO: 3118906 - RNA, 22 nt, Mycobacterium bovis subsp bovis AF2122/97
cagcguggggccgccaccagcg

SEQ ID NO: 3118907 - RNA, 20 nt, Mycobacterium bovis subsp bovis AF2122/97
cagcguggugaagucggugc

SEQ ID NO: 3118908 - RNA, 14 nt, Mycobacterium bovis subsp bovis AF2122/97
cagcguggugaucc

SEQ ID NO: 3118909 - RNA, 22 nt, Mycobacterium bovis subsp bovis AF2122/97
cagcguguaguggcccgcgggc

SEQ ID NO: 3118910 - RNA, 21 nt, Mycobacterium bovis subsp bovis AF2122/97
cagcgugucuugucgcgcagc

SEQ ID NO: 3118911 - RNA, 22 nt, Mycobacterium bovis subsp bovis AF2122/97
cagcgugugcucgugggcgacg

SEQ ID NO: 3118912 - RNA, 19 nt, Mycobacterium bovis subsp bovis AF2122/97
cagcguguggagcucgcgg

SEQ ID NO: 3118913 - RNA, 20 nt, Mycobacterium bovis subsp bovis AF2122/97
cagcguguggagcucgcggc

SEQ ID NO: 3118914 - RNA, 18 nt, Mycobacterium bovis subsp bovis AF2122/97
cagcguguugagggcugu

SEQ ID NO: 3118915 - RNA, 18 nt, Mycobacterium bovis subsp bovis AF2122/97
cagcguguugcguucggu

SEQ ID NO: 3118916 - RNA, 19 nt, Mycobacterium bovis subsp bovis AF2122/97
cagcguuaggucgccggcu

SEQ ID NO: 3118917 - RNA, 21 nt, Mycobacterium bovis subsp bovis AF2122/97
cagcguucgguugaacgaccu

SEQ ID NO: 3118918 - RNA, 18 nt, Mycobacterium bovis subsp bovis AF2122/97
cagcguugacggcuucgg

SEQ ID NO: 3118919 - RNA, 14 nt, Mycobacterium bovis subsp bovis AF2122/97
cagcguuggccgcu

SEQ ID NO: 3118920 - RNA, 13 nt, Mycobacterium bovis subsp bovis AF2122/97
cagcguuggcggc

SEQ ID NO: 3118921 - RNA, 15 nt, Mycobacterium bovis subsp bovis AF2122/97
cagcguuggcggcga

SEQ ID NO: 3118922 - RNA, 23 nt, Mycobacterium bovis subsp bovis AF2122/97
cagcguugucggguggcugcugg

SEQ ID NO: 3118923 - RNA, 17 nt, Mycobacterium bovis subsp bovis AF2122/97
cagcguuugcuggcgga

SEQ ID NO: 3118924 - RNA, 19 nt, Mycobacterium bovis subsp bovis AF2122/97
cagcguuugcuggcggaac

SEQ ID NO: 3118925 - RNA, 23 nt, Mycobacterium bovis subsp bovis AF2122/97
cagcuaaaaaccgcugccggugu

SEQ ID NO: 3118926 - RNA, 15 nt, Mycobacterium bovis subsp bovis AF2122/97
cagcuaacccgccac

SEQ ID NO: 3118927 - RNA, 17 nt, Mycobacterium bovis subsp bovis AF2122/97
cagcuaacccgccacgu

SEQ ID NO: 3118928 - RNA, 14 nt, Mycobacterium bovis subsp bovis AF2122/97
cagcuaauaccugc

SEQ ID NO: 3118929 - RNA, 20 nt, Mycobacterium bovis subsp bovis AF2122/97
cagcuaccccggcggucagg

SEQ ID NO: 3118930 - RNA, 14 nt, Mycobacterium bovis subsp bovis AF2122/97
cagcuaccuccgcc

SEQ ID NO: 3118931 - RNA, 21 nt, Mycobacterium bovis subsp bovis AF2122/97
cagcuagaccaggaugagcgc

SEQ ID NO: 3118932 - RNA, 17 nt, Mycobacterium bovis subsp bovis AF2122/97
cagcuagaccgaucacc

SEQ ID NO: 3118933 - RNA, 13 nt, Mycobacterium bovis subsp bovis AF2122/97
cagcuagcccggc

SEQ ID NO: 3118934 - RNA, 17 nt, Mycobacterium bovis subsp bovis AF2122/97
cagcuagcccggcagca

SEQ ID NO: 3118935 - RNA, 22 nt, Mycobacterium bovis subsp bovis AF2122/97
cagcuagguauugccgcagacg

SEQ ID NO: 3118936 - RNA, 17 nt, Mycobacterium bovis subsp bovis AF2122/97
cagcuaguggccgagua

SEQ ID NO: 3118937 - RNA, 14 nt, Mycobacterium bovis subsp bovis AF2122/97
cagcucaccaccca

SEQ ID NO: 3118938 - RNA, 15 nt, Mycobacterium bovis subsp bovis AF2122/97
cagcucaccacccag

SEQ ID NO: 3118939 - RNA, 23 nt, Mycobacterium bovis subsp bovis AF2122/97
cagcucaccacccgcacuccaag

SEQ ID NO: 3118940 - RNA, 21 nt, Mycobacterium bovis subsp bovis AF2122/97
cagcucacccggagcacccgg

SEQ ID NO: 3118941 - RNA, 22 nt, Mycobacterium bovis subsp bovis AF2122/97
cagcucacccggagcacccggg

SEQ ID NO: 3118942 - RNA, 17 nt, Mycobacterium bovis subsp bovis AF2122/97
cagcucaccuuccucga

SEQ ID NO: 3118943 - RNA, 20 nt, Mycobacterium bovis subsp bovis AF2122/97
cagcucacggacgcugggcg

SEQ ID NO: 3118944 - RNA, 21 nt, Mycobacterium bovis subsp bovis AF2122/97
cagcucacggacgcugggcgg

SEQ ID NO: 3118945 - RNA, 13 nt, Mycobacterium bovis subsp bovis AF2122/97
cagcucagcugcg

SEQ ID NO: 3118946 - RNA, 20 nt, Mycobacterium bovis subsp bovis AF2122/97
cagcucagugaugcgccccg

SEQ ID NO: 3118947 - RNA, 22 nt, Mycobacterium bovis subsp bovis AF2122/97
cagcucagugaugcgccccgga

SEQ ID NO: 3118948 - RNA, 18 nt, Mycobacterium bovis subsp bovis AF2122/97
cagcucaucgauccucgc

SEQ ID NO: 3118949 - RNA, 19 nt, Mycobacterium bovis subsp bovis AF2122/97
cagcucaucgcgcacgccc

SEQ ID NO: 3118950 - RNA, 19 nt, Mycobacterium bovis subsp bovis AF2122/97
cagcuccacacacugugcu

SEQ ID NO: 3118951 - RNA, 12 nt, Mycobacterium bovis subsp bovis AF2122/97
cagcuccaccag

SEQ ID NO: 3118952 - RNA, 17 nt, Mycobacterium bovis subsp bovis AF2122/97
cagcuccacuggcgucu

SEQ ID NO: 3118953 - RNA, 20 nt, Mycobacterium bovis subsp bovis AF2122/97
cagcuccagcaaaacccgcu

SEQ ID NO: 3118954 - RNA, 23 nt, Mycobacterium bovis subsp bovis AF2122/97
cagcuccagcaaaacccgcucca

SEQ ID NO: 3118955 - RNA, 15 nt, Mycobacterium bovis subsp bovis AF2122/97
cagcucccgccacgu

SEQ ID NO: 3118956 - RNA, 18 nt, Mycobacterium bovis subsp bovis AF2122/97
cagcucccgccacgucgc

SEQ ID NO: 3118957 - RNA, 14 nt, Mycobacterium bovis subsp bovis AF2122/97
cagcucccgggcgg

SEQ ID NO: 3118958 - RNA, 21 nt, Mycobacterium bovis subsp bovis AF2122/97
cagcucccgggcggcggccug

SEQ ID NO: 3118959 - RNA, 14 nt, Mycobacterium bovis subsp bovis AF2122/97
cagcuccgccgccg

SEQ ID NO: 3118960 - RNA, 13 nt, Mycobacterium bovis subsp bovis AF2122/97
cagcuccgccugc

SEQ ID NO: 3118961 - RNA, 19 nt, Mycobacterium bovis subsp bovis AF2122/97
cagcuccgccugccgcugg

SEQ ID NO: 3118962 - RNA, 23 nt, Mycobacterium bovis subsp bovis AF2122/97
cagcuccgggucgacgacgucgc

SEQ ID NO: 3118963 - RNA, 17 nt, Mycobacterium bovis subsp bovis AF2122/97
cagcuccgggugcagau

SEQ ID NO: 3118964 - RNA, 17 nt, Mycobacterium bovis subsp bovis AF2122/97
cagcuccgugacaccgg

SEQ ID NO: 3118965 - RNA, 19 nt, Mycobacterium bovis subsp bovis AF2122/97
cagcuccucagccaccgcg

SEQ ID NO: 3118966 - RNA, 12 nt, Mycobacterium bovis subsp bovis AF2122/97
cagcuccuccga

SEQ ID NO: 3118967 - RNA, 18 nt, Mycobacterium bovis subsp bovis AF2122/97
cagcuccucgcgcucgcc

SEQ ID NO: 3118968 - RNA, 22 nt, Mycobacterium bovis subsp bovis AF2122/97
cagcuccucgcgcucgccggug

SEQ ID NO: 3118969 - RNA, 21 nt, Mycobacterium bovis subsp bovis AF2122/97
cagcuccuguaacugcuccug

SEQ ID NO: 3118970 - RNA, 16 nt, Mycobacterium bovis subsp bovis AF2122/97
cagcucgaacagcucg

SEQ ID NO: 3118971 - RNA, 17 nt, Mycobacterium bovis subsp bovis AF2122/97
cagcucgaacagguugg

SEQ ID NO: 3118972 - RNA, 14 nt, Mycobacterium bovis subsp bovis AF2122/97
cagcucgaccagga

SEQ ID NO: 3118973 - RNA, 15 nt, Mycobacterium bovis subsp bovis AF2122/97
cagcucgaccaggaa

SEQ ID NO: 3118974 - RNA, 17 nt, Mycobacterium bovis subsp bovis AF2122/97
cagcucgagcgccucgg

SEQ ID NO: 3118975 - RNA, 17 nt, Mycobacterium bovis subsp bovis AF2122/97
cagcucgaggaccaccu

SEQ ID NO: 3118976 - RNA, 15 nt, Mycobacterium bovis subsp bovis AF2122/97
cagcucgauacccag

SEQ ID NO: 3118977 - RNA, 22 nt, Mycobacterium bovis subsp bovis AF2122/97
cagcucgauacccaggaugugu

SEQ ID NO: 3118978 - RNA, 18 nt, Mycobacterium bovis subsp bovis AF2122/97
cagcucgaucacgccggc

SEQ ID NO: 3118979 - RNA, 20 nt, Mycobacterium bovis subsp bovis AF2122/97
cagcucgaucacgccggccu

SEQ ID NO: 3118980 - RNA, 14 nt, Mycobacterium bovis subsp bovis AF2122/97
cagcucgccggccg

SEQ ID NO: 3118981 - RNA, 23 nt, Mycobacterium bovis subsp bovis AF2122/97
cagcucgccuaguugcaacgggu

SEQ ID NO: 3118982 - RNA, 16 nt, Mycobacterium bovis subsp bovis AF2122/97
cagcucgcgcacccag

SEQ ID NO: 3118983 - RNA, 18 nt, Mycobacterium bovis subsp bovis AF2122/97
cagcucgcgcacccagcc

SEQ ID NO: 3118984 - RNA, 19 nt, Mycobacterium bovis subsp bovis AF2122/97
cagcucgcgcacccagccc

SEQ ID NO: 3118985 - RNA, 23 nt, Mycobacterium bovis subsp bovis AF2122/97
cagcucgcgcacccagcccagcc

SEQ ID NO: 3118986 - RNA, 14 nt, Mycobacterium bovis subsp bovis AF2122/97
cagcucgcgcacgu

SEQ ID NO: 3118987 - RNA, 14 nt, Mycobacterium bovis subsp bovis AF2122/97
cagcucgcgggccg

SEQ ID NO: 3118988 - RNA, 19 nt, Mycobacterium bovis subsp bovis AF2122/97
cagcucgcgggccgcgucg

SEQ ID NO: 3118989 - RNA, 12 nt, Mycobacterium bovis subsp bovis AF2122/97
cagcucgcugua

SEQ ID NO: 3118990 - RNA, 14 nt, Mycobacterium bovis subsp bovis AF2122/97
cagcucggcaacgu

SEQ ID NO: 3118991 - RNA, 19 nt, Mycobacterium bovis subsp bovis AF2122/97
cagcucggccaggcuggcc

SEQ ID NO: 3118992 - RNA, 16 nt, Mycobacterium bovis subsp bovis AF2122/97
cagcucggccagugcc

SEQ ID NO: 3118993 - RNA, 21 nt, Mycobacterium bovis subsp bovis AF2122/97
cagcucggccagugccgguuc

SEQ ID NO: 3118994 - RNA, 16 nt, Mycobacterium bovis subsp bovis AF2122/97
cagcucggcggcagcg

SEQ ID NO: 3118995 - RNA, 20 nt, Mycobacterium bovis subsp bovis AF2122/97
cagcucggcggcagcggcgg

SEQ ID NO: 3118996 - RNA, 21 nt, Mycobacterium bovis subsp bovis AF2122/97
cagcucggcggcagcggcggu

SEQ ID NO: 3118997 - RNA, 17 nt, Mycobacterium bovis subsp bovis AF2122/97
cagcucggcgggcucgu

SEQ ID NO: 3118998 - RNA, 13 nt, Mycobacterium bovis subsp bovis AF2122/97
cagcucgggcagg

SEQ ID NO: 3118999 - RNA, 13 nt, Mycobacterium bovis subsp bovis AF2122/97
cagcucgggggcg

SEQ ID NO: 3119000 - RNA, 16 nt, Mycobacterium bovis subsp bovis AF2122/97
cagcucgggggcgccg

SEQ ID NO: 3119001 - RNA, 17 nt, Mycobacterium bovis subsp bovis AF2122/97
cagcucgggggcgccgg

SEQ ID NO: 3119002 - RNA, 22 nt, Mycobacterium bovis subsp bovis AF2122/97
cagcucgggggcgccggcgccc

SEQ ID NO: 3119003 - RNA, 14 nt, Mycobacterium bovis subsp bovis AF2122/97
cagcucggugacaa

SEQ ID NO: 3119004 - RNA, 17 nt, Mycobacterium bovis subsp bovis AF2122/97
cagcucggugcacggcg

SEQ ID NO: 3119005 - RNA, 23 nt, Mycobacterium bovis subsp bovis AF2122/97
cagcucggugcacggcgcuacca

SEQ ID NO: 3119006 - RNA, 13 nt, Mycobacterium bovis subsp bovis AF2122/97
cagcucgucgagc

SEQ ID NO: 3119007 - RNA, 12 nt, Mycobacterium bovis subsp bovis AF2122/97
cagcucgucggc

SEQ ID NO: 3119008 - RNA, 15 nt, Mycobacterium bovis subsp bovis AF2122/97
cagcugaaucgggau

SEQ ID NO: 3119009 - RNA, 22 nt, Mycobacterium bovis subsp bovis AF2122/97
cagcugacacccgcagcugugg

SEQ ID NO: 3119010 - RNA, 23 nt, Mycobacterium bovis subsp bovis AF2122/97
cagcugacgagccgguggcgugg

SEQ ID NO: 3119011 - RNA, 15 nt, Mycobacterium bovis subsp bovis AF2122/97
cagcugacgggccgc

SEQ ID NO: 3119012 - RNA, 16 nt, Mycobacterium bovis subsp bovis AF2122/97
cagcugacgggccgcu

SEQ ID NO: 3119013 - RNA, 19 nt, Mycobacterium bovis subsp bovis AF2122/97
cagcugacgggccgcugug

SEQ ID NO: 3119014 - RNA, 17 nt, Mycobacterium bovis subsp bovis AF2122/97
cagcugacgucaccacg

SEQ ID NO: 3119015 - RNA, 15 nt, Mycobacterium bovis subsp bovis AF2122/97
cagcugagccgucgg

SEQ ID NO: 3119016 - RNA, 17 nt, Mycobacterium bovis subsp bovis AF2122/97
cagcugagccgucggcg

SEQ ID NO: 3119017 - RNA, 19 nt, Mycobacterium bovis subsp bovis AF2122/97
cagcugagcggccggcaug

SEQ ID NO: 3119018 - RNA, 13 nt, Mycobacterium bovis subsp bovis AF2122/97
cagcugaucccag

SEQ ID NO: 3119019 - RNA, 19 nt, Mycobacterium bovis subsp bovis AF2122/97
cagcugaucuuggcaagcc

SEQ ID NO: 3119020 - RNA, 20 nt, Mycobacterium bovis subsp bovis AF2122/97
cagcugcaaugacuggaccg

SEQ ID NO: 3119021 - RNA, 23 nt, Mycobacterium bovis subsp bovis AF2122/97
cagcugcaaugacuggaccgcgg

SEQ ID NO: 3119022 - RNA, 18 nt, Mycobacterium bovis subsp bovis AF2122/97
cagcugcacacagagguc

SEQ ID NO: 3119023 - RNA, 13 nt, Mycobacterium bovis subsp bovis AF2122/97
cagcugcaccucc

SEQ ID NO: 3119024 - RNA, 14 nt, Mycobacterium bovis subsp bovis AF2122/97
cagcugcaccuccg

SEQ ID NO: 3119025 - RNA, 22 nt, Mycobacterium bovis subsp bovis AF2122/97
cagcugcaccuccgacggccgc

SEQ ID NO: 3119026 - RNA, 12 nt, Mycobacterium bovis subsp bovis AF2122/97
cagcugcccgcc

SEQ ID NO: 3119027 - RNA, 15 nt, Mycobacterium bovis subsp bovis AF2122/97
cagcugcccgccagc

SEQ ID NO: 3119028 - RNA, 17 nt, Mycobacterium bovis subsp bovis AF2122/97
cagcugcccgccagcgc

SEQ ID NO: 3119029 - RNA, 19 nt, Mycobacterium bovis subsp bovis AF2122/97
cagcugcccgccagcgccg

SEQ ID NO: 3119030 - RNA, 21 nt, Mycobacterium bovis subsp bovis AF2122/97
cagcugcccgccagcgccgcc

SEQ ID NO: 3119031 - RNA, 14 nt, Mycobacterium bovis subsp bovis AF2122/97
cagcugcccggcgu

SEQ ID NO: 3119032 - RNA, 22 nt, Mycobacterium bovis subsp bovis AF2122/97
cagcugccgaucaauggcaacg

SEQ ID NO: 3119033 - RNA, 23 nt, Mycobacterium bovis subsp bovis AF2122/97
cagcugccgcacccccuccgcga

SEQ ID NO: 3119034 - RNA, 13 nt, Mycobacterium bovis subsp bovis AF2122/97
cagcugccggcga

SEQ ID NO: 3119035 - RNA, 21 nt, Mycobacterium bovis subsp bovis AF2122/97
cagcugcgcacgucgggcccg

SEQ ID NO: 3119036 - RNA, 13 nt, Mycobacterium bovis subsp bovis AF2122/97
cagcugcgcaucg

SEQ ID NO: 3119037 - RNA, 18 nt, Mycobacterium bovis subsp bovis AF2122/97
cagcugcgcaucgccacc

SEQ ID NO: 3119038 - RNA, 15 nt, Mycobacterium bovis subsp bovis AF2122/97
cagcugcgcgggcga

SEQ ID NO: 3119039 - RNA, 17 nt, Mycobacterium bovis subsp bovis AF2122/97
cagcugcgcgggcgagu

SEQ ID NO: 3119040 - RNA, 16 nt, Mycobacterium bovis subsp bovis AF2122/97
cagcugcggacuggca

SEQ ID NO: 3119041 - RNA, 23 nt, Mycobacterium bovis subsp bovis AF2122/97
cagcugcggacuggcauccgccc

SEQ ID NO: 3119042 - RNA, 22 nt, Mycobacterium bovis subsp bovis AF2122/97
cagcugcggauacagccgccgc

SEQ ID NO: 3119043 - RNA, 23 nt, Mycobacterium bovis subsp bovis AF2122/97
cagcugcggauacagccgccgcc

SEQ ID NO: 3119044 - RNA, 20 nt, Mycobacterium bovis subsp bovis AF2122/97
cagcugcggauccaccacgc

SEQ ID NO: 3119045 - RNA, 23 nt, Mycobacterium bovis subsp bovis AF2122/97
cagcugcggauccaccacgcugg

SEQ ID NO: 3119046 - RNA, 21 nt, Mycobacterium bovis subsp bovis AF2122/97
cagcugcggauuaagucggcg

SEQ ID NO: 3119047 - RNA, 23 nt, Mycobacterium bovis subsp bovis AF2122/97
cagcugcggauuaagucggcggc

SEQ ID NO: 3119048 - RNA, 16 nt, Mycobacterium bovis subsp bovis AF2122/97
cagcugcggcuccggc

SEQ ID NO: 3119049 - RNA, 18 nt, Mycobacterium bovis subsp bovis AF2122/97
cagcugcggcuccggcgg

SEQ ID NO: 3119050 - RNA, 23 nt, Mycobacterium bovis subsp bovis AF2122/97
cagcugcggcuccggcggcagcg

SEQ ID NO: 3119051 - RNA, 21 nt, Mycobacterium bovis subsp bovis AF2122/97
cagcugcguggcgaaccaggg

SEQ ID NO: 3119052 - RNA, 20 nt, Mycobacterium bovis subsp bovis AF2122/97
cagcugcucggucaggcggc

SEQ ID NO: 3119053 - RNA, 11 nt, Mycobacterium bovis subsp bovis AF2122/97
cagcugcucgu

SEQ ID NO: 3119054 - RNA, 20 nt, Mycobacterium bovis subsp bovis AF2122/97
cagcugcucgucuuggcggc

SEQ ID NO: 3119055 - RNA, 14 nt, Mycobacterium bovis subsp bovis AF2122/97
cagcugcugccgau

SEQ ID NO: 3119056 - RNA, 22 nt, Mycobacterium bovis subsp bovis AF2122/97
cagcugcuggaugucgucgacg

SEQ ID NO: 3119057 - RNA, 16 nt, Mycobacterium bovis subsp bovis AF2122/97
cagcuggacggccucc

SEQ ID NO: 3119058 - RNA, 13 nt, Mycobacterium bovis subsp bovis AF2122/97
cagcuggacuccg

SEQ ID NO: 3119059 - RNA, 16 nt, Mycobacterium bovis subsp bovis AF2122/97
cagcuggacuccgguc

SEQ ID NO: 3119060 - RNA, 12 nt, Mycobacterium bovis subsp bovis AF2122/97
cagcuggccacu

SEQ ID NO: 3119061 - RNA, 11 nt, Mycobacterium bovis subsp bovis AF2122/97
cagcuggccgc

SEQ ID NO: 3119062 - RNA, 14 nt, Mycobacterium bovis subsp bovis AF2122/97
cagcuggccgggug

SEQ ID NO: 3119063 - RNA, 21 nt, Mycobacterium bovis subsp bovis AF2122/97
cagcuggcgaaugcgggccuc

SEQ ID NO: 3119064 - RNA, 21 nt, Mycobacterium bovis subsp bovis AF2122/97
cagcuggcgauacagcgacag

SEQ ID NO: 3119065 - RNA, 15 nt, Mycobacterium bovis subsp bovis AF2122/97
cagcuggcgcagccu

SEQ ID NO: 3119066 - RNA, 20 nt, Mycobacterium bovis subsp bovis AF2122/97
cagcuggcgcagccugccga

SEQ ID NO: 3119067 - RNA, 22 nt, Mycobacterium bovis subsp bovis AF2122/97
cagcuggcgcagccugccgaug

SEQ ID NO: 3119068 - RNA, 19 nt, Mycobacterium bovis subsp bovis AF2122/97
cagcuggcggcagcgguuu

SEQ ID NO: 3119069 - RNA, 14 nt, Mycobacterium bovis subsp bovis AF2122/97
cagcugggcagcca

SEQ ID NO: 3119070 - RNA, 17 nt, Mycobacterium bovis subsp bovis AF2122/97
cagcugggcagccagau

SEQ ID NO: 3119071 - RNA, 22 nt, Mycobacterium bovis subsp bovis AF2122/97
cagcugggcagccagaucucca

SEQ ID NO: 3119072 - RNA, 15 nt, Mycobacterium bovis subsp bovis AF2122/97
cagcugggcaucacc

SEQ ID NO: 3119073 - RNA, 18 nt, Mycobacterium bovis subsp bovis AF2122/97
cagcugggcaucaccgcc

SEQ ID NO: 3119074 - RNA, 19 nt, Mycobacterium bovis subsp bovis AF2122/97
cagcugggcaucaccgccg

SEQ ID NO: 3119075 - RNA, 20 nt, Mycobacterium bovis subsp bovis AF2122/97
cagcugggcaucaccgccgc

SEQ ID NO: 3119076 - RNA, 22 nt, Mycobacterium bovis subsp bovis AF2122/97
cagcugggcaucaccgccgcgg

SEQ ID NO: 3119077 - RNA, 14 nt, Mycobacterium bovis subsp bovis AF2122/97
cagcugggcgacca

SEQ ID NO: 3119078 - RNA, 17 nt, Mycobacterium bovis subsp bovis AF2122/97
cagcugggcgaccacuu

SEQ ID NO: 3119079 - RNA, 17 nt, Mycobacterium bovis subsp bovis AF2122/97
cagcuggggcggauaug

SEQ ID NO: 3119080 - RNA, 20 nt, Mycobacterium bovis subsp bovis AF2122/97
cagcugggugaccucgucga

SEQ ID NO: 3119081 - RNA, 19 nt, Mycobacterium bovis subsp bovis AF2122/97
cagcugguagcgcaccaca

SEQ ID NO: 3119082 - RNA, 16 nt, Mycobacterium bovis subsp bovis AF2122/97
cagcuggucggcuucg

SEQ ID NO: 3119083 - RNA, 19 nt, Mycobacterium bovis subsp bovis AF2122/97
cagcuggucgugggccacc

SEQ ID NO: 3119084 - RNA, 22 nt, Mycobacterium bovis subsp bovis AF2122/97
cagcuggucgugggccaccacc

SEQ ID NO: 3119085 - RNA, 23 nt, Mycobacterium bovis subsp bovis AF2122/97
cagcuggucgugggccaccaccu

SEQ ID NO: 3119086 - RNA, 15 nt, Mycobacterium bovis subsp bovis AF2122/97
cagcuggugcugcuu

SEQ ID NO: 3119087 - RNA, 20 nt, Mycobacterium bovis subsp bovis AF2122/97
cagcuggugcugcuuauugg

SEQ ID NO: 3119088 - RNA, 16 nt, Mycobacterium bovis subsp bovis AF2122/97
cagcugguggcggcgg

SEQ ID NO: 3119089 - RNA, 15 nt, Mycobacterium bovis subsp bovis AF2122/97
cagcugguugugcug

SEQ ID NO: 3119090 - RNA, 16 nt, Mycobacterium bovis subsp bovis AF2122/97
cagcugguugugcugg

SEQ ID NO: 3119091 - RNA, 13 nt, Mycobacterium bovis subsp bovis AF2122/97
cagcugucauccc

SEQ ID NO: 3119092 - RNA, 18 nt, Mycobacterium bovis subsp bovis AF2122/97
cagcugucauccccggcc

SEQ ID NO: 3119093 - RNA, 22 nt, Mycobacterium bovis subsp bovis AF2122/97
cagcugucauccccggccagcc

SEQ ID NO: 3119094 - RNA, 17 nt, Mycobacterium bovis subsp bovis AF2122/97
cagcugugaacaggccg

SEQ ID NO: 3119095 - RNA, 22 nt, Mycobacterium bovis subsp bovis AF2122/97
cagcugugaacaggccgaggcg

SEQ ID NO: 3119096 - RNA, 16 nt, Mycobacterium bovis subsp bovis AF2122/97
cagcugugcgacccgc

SEQ ID NO: 3119097 - RNA, 17 nt, Mycobacterium bovis subsp bovis AF2122/97
cagcuguugucgcggaa

SEQ ID NO: 3119098 - RNA, 22 nt, Mycobacterium bovis subsp bovis AF2122/97
cagcuuagccgcagcuuggccu

SEQ ID NO: 3119099 - RNA, 15 nt, Mycobacterium bovis subsp bovis AF2122/97
cagcuucaacaccgg

SEQ ID NO: 3119100 - RNA, 21 nt, Mycobacterium bovis subsp bovis AF2122/97
cagcuuccgcugaacaccgug

SEQ ID NO: 3119101 - RNA, 17 nt, Mycobacterium bovis subsp bovis AF2122/97
cagcuucgccagguggc

SEQ ID NO: 3119102 - RNA, 21 nt, Mycobacterium bovis subsp bovis AF2122/97
cagcuucgccagguggccgcu

SEQ ID NO: 3119103 - RNA, 21 nt, Mycobacterium bovis subsp bovis AF2122/97
cagcuucucagcaccaugcuc

SEQ ID NO: 3119104 - RNA, 14 nt, Mycobacterium bovis subsp bovis AF2122/97
cagcuucucgccga

SEQ ID NO: 3119105 - RNA, 15 nt, Mycobacterium bovis subsp bovis AF2122/97
cagcuugacaucggu

SEQ ID NO: 3119106 - RNA, 20 nt, Mycobacterium bovis subsp bovis AF2122/97
cagcuugaccgaccacgcga

SEQ ID NO: 3119107 - RNA, 19 nt, Mycobacterium bovis subsp bovis AF2122/97
cagcuugagcacacguccg

SEQ ID NO: 3119108 - RNA, 20 nt, Mycobacterium bovis subsp bovis AF2122/97
cagcuugaugucuuuggcgu

SEQ ID NO: 3119109 - RNA, 16 nt, Mycobacterium bovis subsp bovis AF2122/97
cagcuugcccgacggc

SEQ ID NO: 3119110 - RNA, 16 nt, Mycobacterium bovis subsp bovis AF2122/97
cagcuugccgaccugc

SEQ ID NO: 3119111 - RNA, 14 nt, Mycobacterium bovis subsp bovis AF2122/97
cagcuugcgcagcc

SEQ ID NO: 3119112 - RNA, 16 nt, Mycobacterium bovis subsp bovis AF2122/97
cagcuugcggagccgc

SEQ ID NO: 3119113 - RNA, 20 nt, Mycobacterium bovis subsp bovis AF2122/97
cagcuugcggagccgccgcu

SEQ ID NO: 3119114 - RNA, 16 nt, Mycobacterium bovis subsp bovis AF2122/97
cagcuugcugcgcacc

SEQ ID NO: 3119115 - RNA, 21 nt, Mycobacterium bovis subsp bovis AF2122/97
cagcuuggacccugcgccgcc

SEQ ID NO: 3119116 - RNA, 22 nt, Mycobacterium bovis subsp bovis AF2122/97
cagcuuggacccugcgccgcca

SEQ ID NO: 3119117 - RNA, 24 nt, Mycobacterium bovis subsp bovis AF2122/97
cagcuuggagaggcggugcagcuc

SEQ ID NO: 3119118 - RNA, 18 nt, Mycobacterium bovis subsp bovis AF2122/97
cagcuuggagaucgccgc

SEQ ID NO: 3119119 - RNA, 21 nt, Mycobacterium bovis subsp bovis AF2122/97
cagcuuggagaucgccgccgg

SEQ ID NO: 3119120 - RNA, 14 nt, Mycobacterium bovis subsp bovis AF2122/97
cagcuuggccagcc

SEQ ID NO: 3119121 - RNA, 13 nt, Mycobacterium bovis subsp bovis AF2122/97
cagcuuggccggu

SEQ ID NO: 3119122 - RNA, 14 nt, Mycobacterium bovis subsp bovis AF2122/97
cagcuuggcgucga

SEQ ID NO: 3119123 - RNA, 18 nt, Mycobacterium bovis subsp bovis AF2122/97
cagcuuggcgucgaugcg

SEQ ID NO: 3119124 - RNA, 17 nt, Mycobacterium bovis subsp bovis AF2122/97
cagcuugggcagcagcg

SEQ ID NO: 3119125 - RNA, 20 nt, Mycobacterium bovis subsp bovis AF2122/97
cagcuugggcagcagcgcgc

SEQ ID NO: 3119126 - RNA, 22 nt, Mycobacterium bovis subsp bovis AF2122/97
cagcuugggcagcagcgcgcgg

SEQ ID NO: 3119127 - RNA, 20 nt, Mycobacterium bovis subsp bovis AF2122/97
cagcuugguggcguggcccu

SEQ ID NO: 3119128 - RNA, 14 nt, Mycobacterium bovis subsp bovis AF2122/97
cagcuugucgggca

SEQ ID NO: 3119129 - RNA, 18 nt, Mycobacterium bovis subsp bovis AF2122/97
cagcuugugggcgacggc

SEQ ID NO: 3119130 - RNA, 21 nt, Mycobacterium bovis subsp bovis AF2122/97
cagcuuguuuuccaccagcga

SEQ ID NO: 3119131 - RNA, 23 nt, Mycobacterium bovis subsp bovis AF2122/97
cagcuuguuuuccaccagcgagc

SEQ ID NO: 3119132 - RNA, 17 nt, Mycobacterium bovis subsp bovis AF2122/97
cagcuuucuuggcgggc

SEQ ID NO: 3119133 - RNA, 16 nt, Mycobacterium bovis subsp bovis AF2122/97
cagcuuugacgcccuc

SEQ ID NO: 3119134 - RNA, 15 nt, Mycobacterium bovis subsp bovis AF2122/97
cagcuuugagucccg

SEQ ID NO: 3119135 - RNA, 20 nt, Mycobacterium bovis subsp bovis AF2122/97
cagcuuuugcaccggaccgu

SEQ ID NO: 3119136 - RNA, 15 nt, Mycobacterium bovis subsp bovis AF2122/97
caggaaaaccccggc

SEQ ID NO: 3119137 - RNA, 16 nt, Mycobacterium bovis subsp bovis AF2122/97
caggaacaaugagauc

SEQ ID NO: 3119138 - RNA, 22 nt, Mycobacterium bovis subsp bovis AF2122/97
caggaacacucgcgaauaaccu

SEQ ID NO: 3119139 - RNA, 19 nt, Mycobacterium bovis subsp bovis AF2122/97
caggaaccacccaccggcc

SEQ ID NO: 3119140 - RNA, 12 nt, Mycobacterium bovis subsp bovis AF2122/97
caggaacgccgu

SEQ ID NO: 3119141 - RNA, 16 nt, Mycobacterium bovis subsp bovis AF2122/97
caggaacgccgugccg

SEQ ID NO: 3119142 - RNA, 21 nt, Mycobacterium bovis subsp bovis AF2122/97
caggaacgccgugccguacgc

SEQ ID NO: 3119143 - RNA, 17 nt, Mycobacterium bovis subsp bovis AF2122/97
caggaacggcccgggau

SEQ ID NO: 3119144 - RNA, 16 nt, Mycobacterium bovis subsp bovis AF2122/97
caggaacggcucggcc

SEQ ID NO: 3119145 - RNA, 20 nt, Mycobacterium bovis subsp bovis AF2122/97
caggaacuugugccgggcga

SEQ ID NO: 3119146 - RNA, 16 nt, Mycobacterium bovis subsp bovis AF2122/97
caggaagcccacgauc

SEQ ID NO: 3119147 - RNA, 13 nt, Mycobacterium bovis subsp bovis AF2122/97
caggaagccgaga

SEQ ID NO: 3119148 - RNA, 14 nt, Mycobacterium bovis subsp bovis AF2122/97
caggaagccgagac

SEQ ID NO: 3119149 - RNA, 19 nt, Mycobacterium bovis subsp bovis AF2122/97
caggaagccgagaccacgc

SEQ ID NO: 3119150 - RNA, 15 nt, Mycobacterium bovis subsp bovis AF2122/97
caggaagcgguggcc

SEQ ID NO: 3119151 - RNA, 23 nt, Mycobacterium bovis subsp bovis AF2122/97
caggaaguacgcgacgggccgcg

SEQ ID NO: 3119152 - RNA, 12 nt, Mycobacterium bovis subsp bovis AF2122/97
caggaagucccg

SEQ ID NO: 3119153 - RNA, 13 nt, Mycobacterium bovis subsp bovis AF2122/97
caggaagucgcgg

SEQ ID NO: 3119154 - RNA, 17 nt, Mycobacterium bovis subsp bovis AF2122/97
caggaagucgcggacgu

SEQ ID NO: 3119155 - RNA, 19 nt, Mycobacterium bovis subsp bovis AF2122/97
caggaaugccgcggggauc

SEQ ID NO: 3119156 - RNA, 23 nt, Mycobacterium bovis subsp bovis AF2122/97
caggaauuccccaccgucgucgu

SEQ ID NO: 3119157 - RNA, 21 nt, Mycobacterium bovis subsp bovis AF2122/97
caggacaauggacaccaaccc

SEQ ID NO: 3119158 - RNA, 22 nt, Mycobacterium bovis subsp bovis AF2122/97
caggacaccuugcguccguagc

SEQ ID NO: 3119159 - RNA, 16 nt, Mycobacterium bovis subsp bovis AF2122/97
caggacagcagccgcc

SEQ ID NO: 3119160 - RNA, 16 nt, Mycobacterium bovis subsp bovis AF2122/97
caggaccaacgccaac

SEQ ID NO: 3119161 - RNA, 17 nt, Mycobacterium bovis subsp bovis AF2122/97
caggaccaacgccaacg

SEQ ID NO: 3119162 - RNA, 21 nt, Mycobacterium bovis subsp bovis AF2122/97
caggaccaacgccaacgccac

SEQ ID NO: 3119163 - RNA, 17 nt, Mycobacterium bovis subsp bovis AF2122/97
caggaccagcaccgccg

SEQ ID NO: 3119164 - RNA, 18 nt, Mycobacterium bovis subsp bovis AF2122/97
caggaccagcaccgccgc

SEQ ID NO: 3119165 - RNA, 19 nt, Mycobacterium bovis subsp bovis AF2122/97
caggaccagcaccgccgcg

SEQ ID NO: 3119166 - RNA, 23 nt, Mycobacterium bovis subsp bovis AF2122/97
caggaccgcgccgaucaccaccg

SEQ ID NO: 3119167 - RNA, 17 nt, Mycobacterium bovis subsp bovis AF2122/97
caggaccgggaucguca

SEQ ID NO: 3119168 - RNA, 18 nt, Mycobacterium bovis subsp bovis AF2122/97
caggaccgggaucgucag

SEQ ID NO: 3119169 - RNA, 20 nt, Mycobacterium bovis subsp bovis AF2122/97
caggaccugcgucaucgcgg

SEQ ID NO: 3119170 - RNA, 20 nt, Mycobacterium bovis subsp bovis AF2122/97
caggacgaacgcuggcggcg

SEQ ID NO: 3119171 - RNA, 16 nt, Mycobacterium bovis subsp bovis AF2122/97
caggacgacgccgacg

SEQ ID NO: 3119172 - RNA, 22 nt, Mycobacterium bovis subsp bovis AF2122/97
caggacgacgccgacgaugacg

SEQ ID NO: 3119173 - RNA, 21 nt, Mycobacterium bovis subsp bovis AF2122/97
caggacgcccacaugcucagg

SEQ ID NO: 3119174 - RNA, 14 nt, Mycobacterium bovis subsp bovis AF2122/97
caggacgcugccgg

SEQ ID NO: 3119175 - RNA, 17 nt, Mycobacterium bovis subsp bovis AF2122/97
caggacgcugccggugu

SEQ ID NO: 3119176 - RNA, 16 nt, Mycobacterium bovis subsp bovis AF2122/97
caggacggaucgucgu

SEQ ID NO: 3119177 - RNA, 17 nt, Mycobacterium bovis subsp bovis AF2122/97
caggacggcuaccaccg

SEQ ID NO: 3119178 - RNA, 18 nt, Mycobacterium bovis subsp bovis AF2122/97
caggacgguugguccgcc

SEQ ID NO: 3119179 - RNA, 14 nt, Mycobacterium bovis subsp bovis AF2122/97
caggacgucggcga

SEQ ID NO: 3119180 - RNA, 16 nt, Mycobacterium bovis subsp bovis AF2122/97
caggacgucggcgaau

SEQ ID NO: 3119181 - RNA, 21 nt, Mycobacterium bovis subsp bovis AF2122/97
caggacguuugagaccccaac

SEQ ID NO: 3119182 - RNA, 16 nt, Mycobacterium bovis subsp bovis AF2122/97
caggacuccggccgca

SEQ ID NO: 3119183 - RNA, 19 nt, Mycobacterium bovis subsp bovis AF2122/97
caggacuccggccgcacgc

SEQ ID NO: 3119184 - RNA, 21 nt, Mycobacterium bovis subsp bovis AF2122/97
caggacugaacaguugcacac

SEQ ID NO: 3119185 - RNA, 17 nt, Mycobacterium bovis subsp bovis AF2122/97
caggacuggcaccgcca

SEQ ID NO: 3119186 - RNA, 18 nt, Mycobacterium bovis subsp bovis AF2122/97
caggacuggcaccgccag

SEQ ID NO: 3119187 - RNA, 22 nt, Mycobacterium bovis subsp bovis AF2122/97
caggacuggcaccgccagccac

SEQ ID NO: 3119188 - RNA, 21 nt, Mycobacterium bovis subsp bovis AF2122/97
caggagaauuaguuucguccc

SEQ ID NO: 3119189 - RNA, 22 nt, Mycobacterium bovis subsp bovis AF2122/97
caggagaucaacauccugggca

SEQ ID NO: 3119190 - RNA, 11 nt, Mycobacterium bovis subsp bovis AF2122/97
caggagcagca

SEQ ID NO: 3119191 - RNA, 19 nt, Mycobacterium bovis subsp bovis AF2122/97
caggagcagcacgucgaac

SEQ ID NO: 3119192 - RNA, 19 nt, Mycobacterium bovis subsp bovis AF2122/97
caggagccccagguagucg

SEQ ID NO: 3119193 - RNA, 20 nt, Mycobacterium bovis subsp bovis AF2122/97
caggagcgccgucaucgcag

SEQ ID NO: 3119194 - RNA, 22 nt, Mycobacterium bovis subsp bovis AF2122/97
caggagcgcgaugaccucggcg

SEQ ID NO: 3119195 - RNA, 16 nt, Mycobacterium bovis subsp bovis AF2122/97
caggagcgcggcccgc

SEQ ID NO: 3119196 - RNA, 18 nt, Mycobacterium bovis subsp bovis AF2122/97
caggagcgcggcccgccu

SEQ ID NO: 3119197 - RNA, 23 nt, Mycobacterium bovis subsp bovis AF2122/97
caggagcgcggcccgccucggcg

SEQ ID NO: 3119198 - RNA, 16 nt, Mycobacterium bovis subsp bovis AF2122/97
caggagcggauagcgg

SEQ ID NO: 3119199 - RNA, 14 nt, Mycobacterium bovis subsp bovis AF2122/97
caggagcgugucgg

SEQ ID NO: 3119200 - RNA, 15 nt, Mycobacterium bovis subsp bovis AF2122/97
caggagcgugucggc

SEQ ID NO: 3119201 - RNA, 16 nt, Mycobacterium bovis subsp bovis AF2122/97
caggagcgugucggcc

SEQ ID NO: 3119202 - RNA, 23 nt, Mycobacterium bovis subsp bovis AF2122/97
caggaggcgaaugucuucgccgu

SEQ ID NO: 3119203 - RNA, 19 nt, Mycobacterium bovis subsp bovis AF2122/97
caggaggcguccggcucau

SEQ ID NO: 3119204 - RNA, 18 nt, Mycobacterium bovis subsp bovis AF2122/97
caggagguugggaacagc

SEQ ID NO: 3119205 - RNA, 20 nt, Mycobacterium bovis subsp bovis AF2122/97
caggagguugggaacagccu

SEQ ID NO: 3119206 - RNA, 23 nt, Mycobacterium bovis subsp bovis AF2122/97
caggagugcgggcaugccggcga

SEQ ID NO: 3119207 - RNA, 15 nt, Mycobacterium bovis subsp bovis AF2122/97
caggaguggccacgu

SEQ ID NO: 3119208 - RNA, 20 nt, Mycobacterium bovis subsp bovis AF2122/97
caggaguuugaccaccuggu

SEQ ID NO: 3119209 - RNA, 16 nt, Mycobacterium bovis subsp bovis AF2122/97
caggauaaacccggcg

SEQ ID NO: 3119210 - RNA, 21 nt, Mycobacterium bovis subsp bovis AF2122/97
caggauaccgaaaucaccuca

SEQ ID NO: 3119211 - RNA, 16 nt, Mycobacterium bovis subsp bovis AF2122/97
caggauauuucuaaau

SEQ ID NO: 3119212 - RNA, 16 nt, Mycobacterium bovis subsp bovis AF2122/97
caggaucacacuggcc

SEQ ID NO: 3119213 - RNA, 21 nt, Mycobacterium bovis subsp bovis AF2122/97
caggaucacacuggccugcuc

SEQ ID NO: 3119214 - RNA, 23 nt, Mycobacterium bovis subsp bovis AF2122/97
caggaucacccacucgacgucgu

SEQ ID NO: 3119215 - RNA, 22 nt, Mycobacterium bovis subsp bovis AF2122/97
caggaucccgguggcagcacag

SEQ ID NO: 3119216 - RNA, 14 nt, Mycobacterium bovis subsp bovis AF2122/97
caggauccgacccc

SEQ ID NO: 3119217 - RNA, 17 nt, Mycobacterium bovis subsp bovis AF2122/97
caggaucgaggcgucgg

SEQ ID NO: 3119218 - RNA, 15 nt, Mycobacterium bovis subsp bovis AF2122/97
caggaucgcaaugcc

SEQ ID NO: 3119219 - RNA, 22 nt, Mycobacterium bovis subsp bovis AF2122/97
caggaucgcaaugccgugcgcc

SEQ ID NO: 3119220 - RNA, 23 nt, Mycobacterium bovis subsp bovis AF2122/97
caggaucgcaaugccgugcgcca

SEQ ID NO: 3119221 - RNA, 14 nt, Mycobacterium bovis subsp bovis AF2122/97
caggaucgccugag

SEQ ID NO: 3119222 - RNA, 21 nt, Mycobacterium bovis subsp bovis AF2122/97
caggaucgccugagcgccgcg

SEQ ID NO: 3119223 - RNA, 14 nt, Mycobacterium bovis subsp bovis AF2122/97
caggaucgcggcgc

SEQ ID NO: 3119224 - RNA, 17 nt, Mycobacterium bovis subsp bovis AF2122/97
caggaucgcggcgccgu

SEQ ID NO: 3119225 - RNA, 20 nt, Mycobacterium bovis subsp bovis AF2122/97
caggaucgcggcgccgucgu

SEQ ID NO: 3119226 - RNA, 17 nt, Mycobacterium bovis subsp bovis AF2122/97
caggaucgcuacgucga

SEQ ID NO: 3119227 - RNA, 20 nt, Mycobacterium bovis subsp bovis AF2122/97
caggaucgcuacgucgaccg

SEQ ID NO: 3119228 - RNA, 23 nt, Mycobacterium bovis subsp bovis AF2122/97
caggaucggcuugggaaacccgg

SEQ ID NO: 3119229 - RNA, 20 nt, Mycobacterium bovis subsp bovis AF2122/97
caggaucuguuugggcaucu

SEQ ID NO: 3119230 - RNA, 16 nt, Mycobacterium bovis subsp bovis AF2122/97
caggaugaagacgcgg

SEQ ID NO: 3119231 - RNA, 13 nt, Mycobacterium bovis subsp bovis AF2122/97
caggaugaugacc

SEQ ID NO: 3119232 - RNA, 19 nt, Mycobacterium bovis subsp bovis AF2122/97
caggaugaugaccgccauc

SEQ ID NO: 3119233 - RNA, 18 nt, Mycobacterium bovis subsp bovis AF2122/97
caggaugguugcgacggc

SEQ ID NO: 3119234 - RNA, 16 nt, Mycobacterium bovis subsp bovis AF2122/97
caggauucccagucca

SEQ ID NO: 3119235 - RNA, 22 nt, Mycobacterium bovis subsp bovis AF2122/97
caggauucccagucgcggcgcg

SEQ ID NO: 3119236 - RNA, 17 nt, Mycobacterium bovis subsp bovis AF2122/97
caggauucggcggucgc

SEQ ID NO: 3119237 - RNA, 21 nt, Mycobacterium bovis subsp bovis AF2122/97
caggauucugcugaccaugac

SEQ ID NO: 3119238 - RNA, 15 nt, Mycobacterium bovis subsp bovis AF2122/97
caggcaagccagcac

SEQ ID NO: 3119239 - RNA, 20 nt, Mycobacterium bovis subsp bovis AF2122/97
caggcaagccagcacugcca

SEQ ID NO: 3119240 - RNA, 22 nt, Mycobacterium bovis subsp bovis AF2122/97
caggcaaguugugagggaggcc

SEQ ID NO: 3119241 - RNA, 14 nt, Mycobacterium bovis subsp bovis AF2122/97
caggcacaacaucg

SEQ ID NO: 3119242 - RNA, 19 nt, Mycobacterium bovis subsp bovis AF2122/97
caggcaccacgaccgacac

SEQ ID NO: 3119243 - RNA, 15 nt, Mycobacterium bovis subsp bovis AF2122/97
caggcaccggaugau

SEQ ID NO: 3119244 - RNA, 19 nt, Mycobacterium bovis subsp bovis AF2122/97
caggcaccggaugaugugg

SEQ ID NO: 3119245 - RNA, 20 nt, Mycobacterium bovis subsp bovis AF2122/97
caggcacguccgaucggcgc

SEQ ID NO: 3119246 - RNA, 16 nt, Mycobacterium bovis subsp bovis AF2122/97
caggcacuccagcggc

SEQ ID NO: 3119247 - RNA, 19 nt, Mycobacterium bovis subsp bovis AF2122/97
caggcacuccagcggcggg

SEQ ID NO: 3119248 - RNA, 13 nt, Mycobacterium bovis subsp bovis AF2122/97
caggcagcuccgc

SEQ ID NO: 3119249 - RNA, 14 nt, Mycobacterium bovis subsp bovis AF2122/97
caggcagcuccgcc

SEQ ID NO: 3119250 - RNA, 15 nt, Mycobacterium bovis subsp bovis AF2122/97
caggcagcuccgccg

SEQ ID NO: 3119251 - RNA, 17 nt, Mycobacterium bovis subsp bovis AF2122/97
caggcagcuccgccgcc

SEQ ID NO: 3119252 - RNA, 16 nt, Mycobacterium bovis subsp bovis AF2122/97
caggcagcucggcaac

SEQ ID NO: 3119253 - RNA, 14 nt, Mycobacterium bovis subsp bovis AF2122/97
caggcaggaggcgu

SEQ ID NO: 3119254 - RNA, 12 nt, Mycobacterium bovis subsp bovis AF2122/97
caggcagguugg

SEQ ID NO: 3119255 - RNA, 17 nt, Mycobacterium bovis subsp bovis AF2122/97
caggcagguuggccacc

SEQ ID NO: 3119256 - RNA, 22 nt, Mycobacterium bovis subsp bovis AF2122/97
caggcagguuggccaccgccca

SEQ ID NO: 3119257 - RNA, 16 nt, Mycobacterium bovis subsp bovis AF2122/97
caggcaguccaccgcg

SEQ ID NO: 3119258 - RNA, 17 nt, Mycobacterium bovis subsp bovis AF2122/97
caggcaguccaccgcgc

SEQ ID NO: 3119259 - RNA, 14 nt, Mycobacterium bovis subsp bovis AF2122/97
caggcauggcgccg

SEQ ID NO: 3119260 - RNA, 19 nt, Mycobacterium bovis subsp bovis AF2122/97
caggcauggcgccguugcc

SEQ ID NO: 3119261 - RNA, 19 nt, Mycobacterium bovis subsp bovis AF2122/97
caggcauucccgcggcaac

SEQ ID NO: 3119262 - RNA, 20 nt, Mycobacterium bovis subsp bovis AF2122/97
caggcauucccgcggcaacg

SEQ ID NO: 3119263 - RNA, 20 nt, Mycobacterium bovis subsp bovis AF2122/97
caggcauuuucacugugccg

SEQ ID NO: 3119264 - RNA, 20 nt, Mycobacterium bovis subsp bovis AF2122/97
caggccaacggcgcugccgg

SEQ ID NO: 3119265 - RNA, 21 nt, Mycobacterium bovis subsp bovis AF2122/97
caggccaacuuggcggccagc

SEQ ID NO: 3119266 - RNA, 22 nt, Mycobacterium bovis subsp bovis AF2122/97
caggccaacuuggcggccagcc

SEQ ID NO: 3119267 - RNA, 23 nt, Mycobacterium bovis subsp bovis AF2122/97
caggccaacuuggcggccagccg

SEQ ID NO: 3119268 - RNA, 19 nt, Mycobacterium bovis subsp bovis AF2122/97
caggccaagguggccacca

SEQ ID NO: 3119269 - RNA, 12 nt, Mycobacterium bovis subsp bovis AF2122/97
caggccaccccg

SEQ ID NO: 3119270 - RNA, 15 nt, Mycobacterium bovis subsp bovis AF2122/97
caggccaccccgacc

SEQ ID NO: 3119271 - RNA, 18 nt, Mycobacterium bovis subsp bovis AF2122/97
caggccaccccgaccucc

SEQ ID NO: 3119272 - RNA, 20 nt, Mycobacterium bovis subsp bovis AF2122/97
caggccaccgcagacgccgu

SEQ ID NO: 3119273 - RNA, 14 nt, Mycobacterium bovis subsp bovis AF2122/97
caggccacgggcgu

SEQ ID NO: 3119274 - RNA, 17 nt, Mycobacterium bovis subsp bovis AF2122/97
caggccacgggcgugcu

SEQ ID NO: 3119275 - RNA, 21 nt, Mycobacterium bovis subsp bovis AF2122/97
caggccacguagcagcgccgg

SEQ ID NO: 3119276 - RNA, 15 nt, Mycobacterium bovis subsp bovis AF2122/97
caggccacugccgac

SEQ ID NO: 3119277 - RNA, 16 nt, Mycobacterium bovis subsp bovis AF2122/97
caggccacugccgacc

SEQ ID NO: 3119278 - RNA, 21 nt, Mycobacterium bovis subsp bovis AF2122/97
caggccacugcguuccaucgc

SEQ ID NO: 3119279 - RNA, 15 nt, Mycobacterium bovis subsp bovis AF2122/97
caggccagagucgcc

SEQ ID NO: 3119280 - RNA, 17 nt, Mycobacterium bovis subsp bovis AF2122/97
caggccagagucgcccg

SEQ ID NO: 3119281 - RNA, 13 nt, Mycobacterium bovis subsp bovis AF2122/97
caggccagcgcuc

SEQ ID NO: 3119282 - RNA, 18 nt, Mycobacterium bovis subsp bovis AF2122/97
caggccagggcgguggcc

SEQ ID NO: 3119283 - RNA, 23 nt, Mycobacterium bovis subsp bovis AF2122/97
caggccagggucagcucggugau

SEQ ID NO: 3119284 - RNA, 15 nt, Mycobacterium bovis subsp bovis AF2122/97
caggccagugccacc

SEQ ID NO: 3119285 - RNA, 16 nt, Mycobacterium bovis subsp bovis AF2122/97
caggccagugccaccu

SEQ ID NO: 3119286 - RNA, 17 nt, Mycobacterium bovis subsp bovis AF2122/97
caggccagugccaccug

SEQ ID NO: 3119287 - RNA, 19 nt, Mycobacterium bovis subsp bovis AF2122/97
caggccagugccaccuggg

SEQ ID NO: 3119288 - RNA, 22 nt, Mycobacterium bovis subsp bovis AF2122/97
caggccagugccaccugggcgg

SEQ ID NO: 3119289 - RNA, 15 nt, Mycobacterium bovis subsp bovis AF2122/97
caggccagugugagg

SEQ ID NO: 3119290 - RNA, 12 nt, Mycobacterium bovis subsp bovis AF2122/97
caggcccacccg

SEQ ID NO: 3119291 - RNA, 15 nt, Mycobacterium bovis subsp bovis AF2122/97
caggcccacccgggc

SEQ ID NO: 3119292 - RNA, 17 nt, Mycobacterium bovis subsp bovis AF2122/97
caggcccacggcgacca

SEQ ID NO: 3119293 - RNA, 19 nt, Mycobacterium bovis subsp bovis AF2122/97
caggcccacggcgaccagg

SEQ ID NO: 3119294 - RNA, 13 nt, Mycobacterium bovis subsp bovis AF2122/97
caggcccagcgga

SEQ ID NO: 3119295 - RNA, 19 nt, Mycobacterium bovis subsp bovis AF2122/97
caggcccauacgugccgcc

SEQ ID NO: 3119296 - RNA, 20 nt, Mycobacterium bovis subsp bovis AF2122/97
caggcccauacgugccgccg

SEQ ID NO: 3119297 - RNA, 23 nt, Mycobacterium bovis subsp bovis AF2122/97
caggcccauacgugccgccgaug

SEQ ID NO: 3119298 - RNA, 16 nt, Mycobacterium bovis subsp bovis AF2122/97
caggcccaucucgggc

SEQ ID NO: 3119299 - RNA, 14 nt, Mycobacterium bovis subsp bovis AF2122/97
caggcccauggcag

SEQ ID NO: 3119300 - RNA, 19 nt, Mycobacterium bovis subsp bovis AF2122/97
caggccccacaccuuggcg

SEQ ID NO: 3119301 - RNA, 20 nt, Mycobacterium bovis subsp bovis AF2122/97
caggccccacuggugcagcg

SEQ ID NO: 3119302 - RNA, 16 nt, Mycobacterium bovis subsp bovis AF2122/97
caggccccgggaacgc

SEQ ID NO: 3119303 - RNA, 18 nt, Mycobacterium bovis subsp bovis AF2122/97
caggccccggugccgacc

SEQ ID NO: 3119304 - RNA, 20 nt, Mycobacterium bovis subsp bovis AF2122/97
caggccccggugccgaccgg

SEQ ID NO: 3119305 - RNA, 21 nt, Mycobacterium bovis subsp bovis AF2122/97
caggcccgaguuaccggugac

SEQ ID NO: 3119306 - RNA, 18 nt, Mycobacterium bovis subsp bovis AF2122/97
caggcccgccagcagggc

SEQ ID NO: 3119307 - RNA, 20 nt, Mycobacterium bovis subsp bovis AF2122/97
caggcccgccagcagggcca

SEQ ID NO: 3119308 - RNA, 13 nt, Mycobacterium bovis subsp bovis AF2122/97
caggcccggcggu

SEQ ID NO: 3119309 - RNA, 20 nt, Mycobacterium bovis subsp bovis AF2122/97
caggcccggcggugugcgca

SEQ ID NO: 3119310 - RNA, 16 nt, Mycobacterium bovis subsp bovis AF2122/97
caggcccgggcggaug

SEQ ID NO: 3119311 - RNA, 18 nt, Mycobacterium bovis subsp bovis AF2122/97
caggcccgguggcggcuc

SEQ ID NO: 3119312 - RNA, 18 nt, Mycobacterium bovis subsp bovis AF2122/97
caggcccgugccuggccg

SEQ ID NO: 3119313 - RNA, 20 nt, Mycobacterium bovis subsp bovis AF2122/97
caggcccgugccuggccggu

SEQ ID NO: 3119314 - RNA, 23 nt, Mycobacterium bovis subsp bovis AF2122/97
caggcccgugccuggccggugcg

SEQ ID NO: 3119315 - RNA, 23 nt, Mycobacterium bovis subsp bovis AF2122/97
caggcccucgggacugcgcggcu

SEQ ID NO: 3119316 - RNA, 19 nt, Mycobacterium bovis subsp bovis AF2122/97
caggcccucgggugucaca

SEQ ID NO: 3119317 - RNA, 15 nt, Mycobacterium bovis subsp bovis AF2122/97
caggcccugccgacg

SEQ ID NO: 3119318 - RNA, 23 nt, Mycobacterium bovis subsp bovis AF2122/97
caggcccugccgacgcuccaggg

SEQ ID NO: 3119319 - RNA, 18 nt, Mycobacterium bovis subsp bovis AF2122/97
caggcccuggccacccag

SEQ ID NO: 3119320 - RNA, 23 nt, Mycobacterium bovis subsp bovis AF2122/97
caggcccugguagugaacggauc

SEQ ID NO: 3119321 - RNA, 19 nt, Mycobacterium bovis subsp bovis AF2122/97
caggccgaagacgugccgg

SEQ ID NO: 3119322 - RNA, 22 nt, Mycobacterium bovis subsp bovis AF2122/97
caggccgaagacgugccggcuc

SEQ ID NO: 3119323 - RNA, 19 nt, Mycobacterium bovis subsp bovis AF2122/97
caggccgacaaugucggcg

SEQ ID NO: 3119324 - RNA, 23 nt, Mycobacterium bovis subsp bovis AF2122/97
caggccgacaaugucggcgaugc

SEQ ID NO: 3119325 - RNA, 11 nt, Mycobacterium bovis subsp bovis AF2122/97
caggccgacac

SEQ ID NO: 3119326 - RNA, 14 nt, Mycobacterium bovis subsp bovis AF2122/97
caggccgaccauaa

SEQ ID NO: 3119327 - RNA, 14 nt, Mycobacterium bovis subsp bovis AF2122/97
caggccgacgucga

SEQ ID NO: 3119328 - RNA, 14 nt, Mycobacterium bovis subsp bovis AF2122/97
caggccgagcagau

SEQ ID NO: 3119329 - RNA, 18 nt, Mycobacterium bovis subsp bovis AF2122/97
caggccgagcccggugcu

SEQ ID NO: 3119330 - RNA, 15 nt, Mycobacterium bovis subsp bovis AF2122/97
caggccgagcucguu

SEQ ID NO: 3119331 - RNA, 13 nt, Mycobacterium bovis subsp bovis AF2122/97
caggccgaggcga

SEQ ID NO: 3119332 - RNA, 21 nt, Mycobacterium bovis subsp bovis AF2122/97
caggccgaucagcgcggcgcc

SEQ ID NO: 3119333 - RNA, 17 nt, Mycobacterium bovis subsp bovis AF2122/97
caggccgaugacgaugc

SEQ ID NO: 3119334 - RNA, 19 nt, Mycobacterium bovis subsp bovis AF2122/97
caggccgaugacgaugccg

SEQ ID NO: 3119335 - RNA, 21 nt, Mycobacterium bovis subsp bovis AF2122/97
caggccgaugacgaugccgcc

SEQ ID NO: 3119336 - RNA, 22 nt, Mycobacterium bovis subsp bovis AF2122/97
caggccgaugacgaugccgccg

SEQ ID NO: 3119337 - RNA, 16 nt, Mycobacterium bovis subsp bovis AF2122/97
caggccgaugcggguc

SEQ ID NO: 3119338 - RNA, 15 nt, Mycobacterium bovis subsp bovis AF2122/97
caggccgcaaugcgu

SEQ ID NO: 3119339 - RNA, 22 nt, Mycobacterium bovis subsp bovis AF2122/97
caggccgccaccgucaccgccg

SEQ ID NO: 3119340 - RNA, 15 nt, Mycobacterium bovis subsp bovis AF2122/97
caggccgcccagcug

SEQ ID NO: 3119341 - RNA, 17 nt, Mycobacterium bovis subsp bovis AF2122/97
caggccgcccagcuguc

SEQ ID NO: 3119342 - RNA, 13 nt, Mycobacterium bovis subsp bovis AF2122/97
caggccgccgcca

SEQ ID NO: 3119343 - RNA, 12 nt, Mycobacterium bovis subsp bovis AF2122/97
caggccgccgcg

SEQ ID NO: 3119344 - RNA, 14 nt, Mycobacterium bovis subsp bovis AF2122/97
caggccgccugggg

SEQ ID NO: 3119345 - RNA, 12 nt, Mycobacterium bovis subsp bovis AF2122/97
caggccgcgaca

SEQ ID NO: 3119346 - RNA, 15 nt, Mycobacterium bovis subsp bovis AF2122/97
caggccgcgcauggu

SEQ ID NO: 3119347 - RNA, 17 nt, Mycobacterium bovis subsp bovis AF2122/97
caggccgcgcaugguca

SEQ ID NO: 3119348 - RNA, 19 nt, Mycobacterium bovis subsp bovis AF2122/97
caggccgcgcauggucagg

SEQ ID NO: 3119349 - RNA, 14 nt, Mycobacterium bovis subsp bovis AF2122/97
caggccgcgcgaca

SEQ ID NO: 3119350 - RNA, 20 nt, Mycobacterium bovis subsp bovis AF2122/97
caggccgcgcgacaacccgg

SEQ ID NO: 3119351 - RNA, 15 nt, Mycobacterium bovis subsp bovis AF2122/97
caggccgcgcgcacc

SEQ ID NO: 3119352 - RNA, 16 nt, Mycobacterium bovis subsp bovis AF2122/97
caggccgcgcgcaccg

SEQ ID NO: 3119353 - RNA, 12 nt, Mycobacterium bovis subsp bovis AF2122/97
caggccgcgcgg

SEQ ID NO: 3119354 - RNA, 23 nt, Mycobacterium bovis subsp bovis AF2122/97
caggccgcgcggacccagcaccc

SEQ ID NO: 3119355 - RNA, 17 nt, Mycobacterium bovis subsp bovis AF2122/97
caggccgcggagaaggc

SEQ ID NO: 3119356 - RNA, 20 nt, Mycobacterium bovis subsp bovis AF2122/97
caggccgcugacacccgcca

SEQ ID NO: 3119357 - RNA, 18 nt, Mycobacterium bovis subsp bovis AF2122/97
caggccgcuugccccgcc

SEQ ID NO: 3119358 - RNA, 14 nt, Mycobacterium bovis subsp bovis AF2122/97
caggccggcaaggc

SEQ ID NO: 3119359 - RNA, 17 nt, Mycobacterium bovis subsp bovis AF2122/97
caggccggcacccacca

SEQ ID NO: 3119360 - RNA, 13 nt, Mycobacterium bovis subsp bovis AF2122/97
caggccggccacc

SEQ ID NO: 3119361 - RNA, 14 nt, Mycobacterium bovis subsp bovis AF2122/97
caggccggccacca

SEQ ID NO: 3119362 - RNA, 23 nt, Mycobacterium bovis subsp bovis AF2122/97
caggccggccaccaguccgaugg

SEQ ID NO: 3119363 - RNA, 16 nt, Mycobacterium bovis subsp bovis AF2122/97
caggccggccaccgag

SEQ ID NO: 3119364 - RNA, 18 nt, Mycobacterium bovis subsp bovis AF2122/97
caggccggccgcgaucca

SEQ ID NO: 3119365 - RNA, 18 nt, Mycobacterium bovis subsp bovis AF2122/97
caggccgggacagcgccg

SEQ ID NO: 3119366 - RNA, 16 nt, Mycobacterium bovis subsp bovis AF2122/97
caggccgggcgcaagc

SEQ ID NO: 3119367 - RNA, 12 nt, Mycobacterium bovis subsp bovis AF2122/97
caggccggugac

SEQ ID NO: 3119368 - RNA, 21 nt, Mycobacterium bovis subsp bovis AF2122/97
caggccgguuugcacgcacca

SEQ ID NO: 3119369 - RNA, 23 nt, Mycobacterium bovis subsp bovis AF2122/97
caggccgguuugcacgcaccaca

SEQ ID NO: 3119370 - RNA, 17 nt, Mycobacterium bovis subsp bovis AF2122/97
caggccguacgacggca

SEQ ID NO: 3119371 - RNA, 17 nt, Mycobacterium bovis subsp bovis AF2122/97
caggccguaguggccgg

SEQ ID NO: 3119372 - RNA, 15 nt, Mycobacterium bovis subsp bovis AF2122/97
caggccgucaccgac

SEQ ID NO: 3119373 - RNA, 17 nt, Mycobacterium bovis subsp bovis AF2122/97
caggccgucaccgacgc

SEQ ID NO: 3119374 - RNA, 20 nt, Mycobacterium bovis subsp bovis AF2122/97
caggccgucgaguuccggcc

SEQ ID NO: 3119375 - RNA, 21 nt, Mycobacterium bovis subsp bovis AF2122/97
caggccgucgaguuccggccg

SEQ ID NO: 3119376 - RNA, 22 nt, Mycobacterium bovis subsp bovis AF2122/97
caggccgucgaguuccggccgg

SEQ ID NO: 3119377 - RNA, 23 nt, Mycobacterium bovis subsp bovis AF2122/97
caggccgucgaguuccggccggu

SEQ ID NO: 3119378 - RNA, 14 nt, Mycobacterium bovis subsp bovis AF2122/97
caggccgucgauga

SEQ ID NO: 3119379 - RNA, 14 nt, Mycobacterium bovis subsp bovis AF2122/97
caggccgucgccgg

SEQ ID NO: 3119380 - RNA, 22 nt, Mycobacterium bovis subsp bovis AF2122/97
caggccgucgcgccucaucggc

SEQ ID NO: 3119381 - RNA, 13 nt, Mycobacterium bovis subsp bovis AF2122/97
caggccgucggcg

SEQ ID NO: 3119382 - RNA, 19 nt, Mycobacterium bovis subsp bovis AF2122/97
caggccgucguugccggcg

SEQ ID NO: 3119383 - RNA, 20 nt, Mycobacterium bovis subsp bovis AF2122/97
caggccgucguugccggcga

SEQ ID NO: 3119384 - RNA, 23 nt, Mycobacterium bovis subsp bovis AF2122/97
caggccgucguugccggcgacca

SEQ ID NO: 3119385 - RNA, 17 nt, Mycobacterium bovis subsp bovis AF2122/97
caggccuagcgcggcga

SEQ ID NO: 3119386 - RNA, 20 nt, Mycobacterium bovis subsp bovis AF2122/97
caggccuagcgcggcgacga

SEQ ID NO: 3119387 - RNA, 22 nt, Mycobacterium bovis subsp bovis AF2122/97
caggccuagcgcggcgacgauu

SEQ ID NO: 3119388 - RNA, 16 nt, Mycobacterium bovis subsp bovis AF2122/97
caggccuaggccgagg

SEQ ID NO: 3119389 - RNA, 22 nt, Mycobacterium bovis subsp bovis AF2122/97
caggccuaggucgacgccgacc

SEQ ID NO: 3119390 - RNA, 19 nt, Mycobacterium bovis subsp bovis AF2122/97
caggccuaguccggcacug

SEQ ID NO: 3119391 - RNA, 17 nt, Mycobacterium bovis subsp bovis AF2122/97
caggccuccaagcccgc

SEQ ID NO: 3119392 - RNA, 18 nt, Mycobacterium bovis subsp bovis AF2122/97
caggccuccaagcccgcc

SEQ ID NO: 3119393 - RNA, 19 nt, Mycobacterium bovis subsp bovis AF2122/97
caggccuccaagcccgccg

SEQ ID NO: 3119394 - RNA, 20 nt, Mycobacterium bovis subsp bovis AF2122/97
caggccuccaagcccgccgg

SEQ ID NO: 3119395 - RNA, 22 nt, Mycobacterium bovis subsp bovis AF2122/97
caggccuccucuuggguccaca

SEQ ID NO: 3119396 - RNA, 14 nt, Mycobacterium bovis subsp bovis AF2122/97
caggccucggcgcc

SEQ ID NO: 3119397 - RNA, 18 nt, Mycobacterium bovis subsp bovis AF2122/97
caggccucggcgccgccc

SEQ ID NO: 3119398 - RNA, 14 nt, Mycobacterium bovis subsp bovis AF2122/97
caggccuggcgagc

SEQ ID NO: 3119399 - RNA, 16 nt, Mycobacterium bovis subsp bovis AF2122/97
caggccuggcgagcca

SEQ ID NO: 3119400 - RNA, 20 nt, Mycobacterium bovis subsp bovis AF2122/97
caggccuuggugcggccggg

SEQ ID NO: 3119401 - RNA, 20 nt, Mycobacterium bovis subsp bovis AF2122/97
caggcgaacaccagauggcu

SEQ ID NO: 3119402 - RNA, 19 nt, Mycobacterium bovis subsp bovis AF2122/97
caggcgaaggcggcuucgc

SEQ ID NO: 3119403 - RNA, 17 nt, Mycobacterium bovis subsp bovis AF2122/97
caggcgaaguacccggc

SEQ ID NO: 3119404 - RNA, 14 nt, Mycobacterium bovis subsp bovis AF2122/97
caggcgaccgggga

SEQ ID NO: 3119405 - RNA, 23 nt, Mycobacterium bovis subsp bovis AF2122/97
caggcgacggcccucgagcagcg

SEQ ID NO: 3119406 - RNA, 16 nt, Mycobacterium bovis subsp bovis AF2122/97
caggcgagccgccacc

SEQ ID NO: 3119407 - RNA, 15 nt, Mycobacterium bovis subsp bovis AF2122/97
caggcgagccggcgc

SEQ ID NO: 3119408 - RNA, 18 nt, Mycobacterium bovis subsp bovis AF2122/97
caggcgagccggcgcgca

SEQ ID NO: 3119409 - RNA, 19 nt, Mycobacterium bovis subsp bovis AF2122/97
caggcgagugaacucgucc

SEQ ID NO: 3119410 - RNA, 20 nt, Mycobacterium bovis subsp bovis AF2122/97
caggcgaguuaggccgccag

SEQ ID NO: 3119411 - RNA, 23 nt, Mycobacterium bovis subsp bovis AF2122/97
caggcgaguuaggccgccagccg

SEQ ID NO: 3119412 - RNA, 19 nt, Mycobacterium bovis subsp bovis AF2122/97
caggcgaucgcccggcccc

SEQ ID NO: 3119413 - RNA, 15 nt, Mycobacterium bovis subsp bovis AF2122/97
caggcgaucuggccg

SEQ ID NO: 3119414 - RNA, 18 nt, Mycobacterium bovis subsp bovis AF2122/97
caggcgaucuggccgaac

SEQ ID NO: 3119415 - RNA, 21 nt, Mycobacterium bovis subsp bovis AF2122/97
caggcgauugcccgcgcucgc

SEQ ID NO: 3119416 - RNA, 17 nt, Mycobacterium bovis subsp bovis AF2122/97
caggcgcaccaggcggc

SEQ ID NO: 3119417 - RNA, 14 nt, Mycobacterium bovis subsp bovis AF2122/97
caggcgcauagggc

SEQ ID NO: 3119418 - RNA, 22 nt, Mycobacterium bovis subsp bovis AF2122/97
caggcgcauagggccaccgccg

SEQ ID NO: 3119419 - RNA, 16 nt, Mycobacterium bovis subsp bovis AF2122/97
caggcgccacccgaau

SEQ ID NO: 3119420 - RNA, 17 nt, Mycobacterium bovis subsp bovis AF2122/97
caggcgccacugcuucc

SEQ ID NO: 3119421 - RNA, 15 nt, Mycobacterium bovis subsp bovis AF2122/97
caggcgcccacaaau

SEQ ID NO: 3119422 - RNA, 14 nt, Mycobacterium bovis subsp bovis AF2122/97
caggcgccgauguc

SEQ ID NO: 3119423 - RNA, 15 nt, Mycobacterium bovis subsp bovis AF2122/97
caggcgccgucucgc

SEQ ID NO: 3119424 - RNA, 16 nt, Mycobacterium bovis subsp bovis AF2122/97
caggcgccgugggcuu

SEQ ID NO: 3119425 - RNA, 11 nt, Mycobacterium bovis subsp bovis AF2122/97
caggcgcgacg

SEQ ID NO: 3119426 - RNA, 19 nt, Mycobacterium bovis subsp bovis AF2122/97
caggcgcgacguagacgac

SEQ ID NO: 3119427 - RNA, 14 nt, Mycobacterium bovis subsp bovis AF2122/97
caggcgcgccgcac

SEQ ID NO: 3119428 - RNA, 15 nt, Mycobacterium bovis subsp bovis AF2122/97
caggcgcgccgcacc

SEQ ID NO: 3119429 - RNA, 16 nt, Mycobacterium bovis subsp bovis AF2122/97
caggcgcgccgcaccc

SEQ ID NO: 3119430 - RNA, 18 nt, Mycobacterium bovis subsp bovis AF2122/97
caggcgcgccgcacccgg

SEQ ID NO: 3119431 - RNA, 21 nt, Mycobacterium bovis subsp bovis AF2122/97
caggcgcgccgcacccgggac

SEQ ID NO: 3119432 - RNA, 13 nt, Mycobacterium bovis subsp bovis AF2122/97
caggcgcggccca

SEQ ID NO: 3119433 - RNA, 16 nt, Mycobacterium bovis subsp bovis AF2122/97
caggcgcggcccaggu

SEQ ID NO: 3119434 - RNA, 23 nt, Mycobacterium bovis subsp bovis AF2122/97
caggcgcggcgacaagccgagcc

SEQ ID NO: 3119435 - RNA, 13 nt, Mycobacterium bovis subsp bovis AF2122/97
caggcgcgucggu

SEQ ID NO: 3119436 - RNA, 15 nt, Mycobacterium bovis subsp bovis AF2122/97
caggcgcgucggugg

SEQ ID NO: 3119437 - RNA, 16 nt, Mycobacterium bovis subsp bovis AF2122/97
caggcgcucagcgcgg

SEQ ID NO: 3119438 - RNA, 17 nt, Mycobacterium bovis subsp bovis AF2122/97
caggcgcucagcgcggc

SEQ ID NO: 3119439 - RNA, 21 nt, Mycobacterium bovis subsp bovis AF2122/97
caggcgcucagcgcggccacg

SEQ ID NO: 3119440 - RNA, 16 nt, Mycobacterium bovis subsp bovis AF2122/97
caggcgcucaucaccc

SEQ ID NO: 3119441 - RNA, 23 nt, Mycobacterium bovis subsp bovis AF2122/97
caggcgcucaucacccagcgccg

SEQ ID NO: 3119442 - RNA, 19 nt, Mycobacterium bovis subsp bovis AF2122/97
caggcgcucgaaggccgca

SEQ ID NO: 3119443 - RNA, 18 nt, Mycobacterium bovis subsp bovis AF2122/97
caggcgcugcagcauggc

SEQ ID NO: 3119444 - RNA, 20 nt, Mycobacterium bovis subsp bovis AF2122/97
caggcgcugcagcauggcuc

SEQ ID NO: 3119445 - RNA, 23 nt, Mycobacterium bovis subsp bovis AF2122/97
caggcgcugcagcauggcuccga

SEQ ID NO: 3119446 - RNA, 14 nt, Mycobacterium bovis subsp bovis AF2122/97
caggcgcugccggu

SEQ ID NO: 3119447 - RNA, 14 nt, Mycobacterium bovis subsp bovis AF2122/97
caggcgcuuggccg

SEQ ID NO: 3119448 - RNA, 17 nt, Mycobacterium bovis subsp bovis AF2122/97
caggcggacgggacgca

SEQ ID NO: 3119449 - RNA, 11 nt, Mycobacterium bovis subsp bovis AF2122/97
caggcggcagg

SEQ ID NO: 3119450 - RNA, 12 nt, Mycobacterium bovis subsp bovis AF2122/97
caggcggcaggu

SEQ ID NO: 3119451 - RNA, 13 nt, Mycobacterium bovis subsp bovis AF2122/97
caggcggccagcg

SEQ ID NO: 3119452 - RNA, 14 nt, Mycobacterium bovis subsp bovis AF2122/97
caggcggccgccag

SEQ ID NO: 3119453 - RNA, 14 nt, Mycobacterium bovis subsp bovis AF2122/97
caggcggccgccgg

SEQ ID NO: 3119454 - RNA, 21 nt, Mycobacterium bovis subsp bovis AF2122/97
caggcggccgccgggaaauau

SEQ ID NO: 3119455 - RNA, 17 nt, Mycobacterium bovis subsp bovis AF2122/97
caggcggccgcgucguc

SEQ ID NO: 3119456 - RNA, 14 nt, Mycobacterium bovis subsp bovis AF2122/97
caggcggccgucgu

SEQ ID NO: 3119457 - RNA, 13 nt, Mycobacterium bovis subsp bovis AF2122/97
caggcggcggccu

SEQ ID NO: 3119458 - RNA, 20 nt, Mycobacterium bovis subsp bovis AF2122/97
caggcggcucaaccucuggc

SEQ ID NO: 3119459 - RNA, 13 nt, Mycobacterium bovis subsp bovis AF2122/97
caggcggcuggcc

SEQ ID NO: 3119460 - RNA, 15 nt, Mycobacterium bovis subsp bovis AF2122/97
caggcggcuggcccg

SEQ ID NO: 3119461 - RNA, 16 nt, Mycobacterium bovis subsp bovis AF2122/97
caggcggcuggcccgc

SEQ ID NO: 3119462 - RNA, 17 nt, Mycobacterium bovis subsp bovis AF2122/97
caggcggcuggcccgca

SEQ ID NO: 3119463 - RNA, 20 nt, Mycobacterium bovis subsp bovis AF2122/97
caggcggcuggcccgcaugc

SEQ ID NO: 3119464 - RNA, 18 nt, Mycobacterium bovis subsp bovis AF2122/97
caggcgggaacgaucgau

SEQ ID NO: 3119465 - RNA, 20 nt, Mycobacterium bovis subsp bovis AF2122/97
caggcgggaacgaucgauga

SEQ ID NO: 3119466 - RNA, 18 nt, Mycobacterium bovis subsp bovis AF2122/97
caggcgggacaaccgggc

SEQ ID NO: 3119467 - RNA, 19 nt, Mycobacterium bovis subsp bovis AF2122/97
caggcgggacaaccgggcg

SEQ ID NO: 3119468 - RNA, 16 nt, Mycobacterium bovis subsp bovis AF2122/97
caggcgggggaucggu

SEQ ID NO: 3119469 - RNA, 22 nt, Mycobacterium bovis subsp bovis AF2122/97
caggcgggggaucggugguacg

SEQ ID NO: 3119470 - RNA, 20 nt, Mycobacterium bovis subsp bovis AF2122/97
caggcgguacgggucgccgg

SEQ ID NO: 3119471 - RNA, 17 nt, Mycobacterium bovis subsp bovis AF2122/97
caggcggugaacaccgc

SEQ ID NO: 3119472 - RNA, 20 nt, Mycobacterium bovis subsp bovis AF2122/97
caggcguagguccuugucgg

SEQ ID NO: 3119473 - RNA, 22 nt, Mycobacterium bovis subsp bovis AF2122/97
caggcguagguccuugucggcc

SEQ ID NO: 3119474 - RNA, 13 nt, Mycobacterium bovis subsp bovis AF2122/97
caggcguaucccg

SEQ ID NO: 3119475 - RNA, 14 nt, Mycobacterium bovis subsp bovis AF2122/97
caggcguccaucag

SEQ ID NO: 3119476 - RNA, 20 nt, Mycobacterium bovis subsp bovis AF2122/97
caggcgucccagccgaucac

SEQ ID NO: 3119477 - RNA, 13 nt, Mycobacterium bovis subsp bovis AF2122/97
caggcgucccgcc

SEQ ID NO: 3119478 - RNA, 12 nt, Mycobacterium bovis subsp bovis AF2122/97
caggcgugcaca

SEQ ID NO: 3119479 - RNA, 16 nt, Mycobacterium bovis subsp bovis AF2122/97
caggcgugcacagguc

SEQ ID NO: 3119480 - RNA, 23 nt, Mycobacterium bovis subsp bovis AF2122/97
caggcgugcaucgcgauuccggc

SEQ ID NO: 3119481 - RNA, 19 nt, Mycobacterium bovis subsp bovis AF2122/97
caggcgugcuugaccgccu

SEQ ID NO: 3119482 - RNA, 21 nt, Mycobacterium bovis subsp bovis AF2122/97
caggcgugcuugaccgccugg

SEQ ID NO: 3119483 - RNA, 15 nt, Mycobacterium bovis subsp bovis AF2122/97
caggcguucgacguc

SEQ ID NO: 3119484 - RNA, 15 nt, Mycobacterium bovis subsp bovis AF2122/97
caggcguugaacgca

SEQ ID NO: 3119485 - RNA, 19 nt, Mycobacterium bovis subsp bovis AF2122/97
caggcuaauagcucgccgg

SEQ ID NO: 3119486 - RNA, 21 nt, Mycobacterium bovis subsp bovis AF2122/97
caggcuaauagcucgccggcg

SEQ ID NO: 3119487 - RNA, 17 nt, Mycobacterium bovis subsp bovis AF2122/97
caggcuaaucagccagg

SEQ ID NO: 3119488 - RNA, 21 nt, Mycobacterium bovis subsp bovis AF2122/97
caggcuaccguuacccgggau

SEQ ID NO: 3119489 - RNA, 19 nt, Mycobacterium bovis subsp bovis AF2122/97
caggcuaguugccaacaca

SEQ ID NO: 3119490 - RNA, 20 nt, Mycobacterium bovis subsp bovis AF2122/97
caggcuauggugccggugau

SEQ ID NO: 3119491 - RNA, 18 nt, Mycobacterium bovis subsp bovis AF2122/97
caggcucacacucggccg

SEQ ID NO: 3119492 - RNA, 20 nt, Mycobacterium bovis subsp bovis AF2122/97
caggcucacacucggccggg

SEQ ID NO: 3119493 - RNA, 12 nt, Mycobacterium bovis subsp bovis AF2122/97
caggcucaccga

SEQ ID NO: 3119494 - RNA, 20 nt, Mycobacterium bovis subsp bovis AF2122/97
caggcucagcugguggcggc

SEQ ID NO: 3119495 - RNA, 23 nt, Mycobacterium bovis subsp bovis AF2122/97
caggcucauccgccgggccaggc

SEQ ID NO: 3119496 - RNA, 17 nt, Mycobacterium bovis subsp bovis AF2122/97
caggcucgccgaugcug

SEQ ID NO: 3119497 - RNA, 21 nt, Mycobacterium bovis subsp bovis AF2122/97
caggcucgggcaaggccaccg

SEQ ID NO: 3119498 - RNA, 22 nt, Mycobacterium bovis subsp bovis AF2122/97
caggcucgggcaaggccaccgg

SEQ ID NO: 3119499 - RNA, 22 nt, Mycobacterium bovis subsp bovis AF2122/97
caggcugaaaccuugcggcaga

SEQ ID NO: 3119500 - RNA, 16 nt, Mycobacterium bovis subsp bovis AF2122/97
caggcugaaggacggc

SEQ ID NO: 3119501 - RNA, 17 nt, Mycobacterium bovis subsp bovis AF2122/97
caggcugcagucgagca

SEQ ID NO: 3119502 - RNA, 19 nt, Mycobacterium bovis subsp bovis AF2122/97
caggcugccuccggaaggc

SEQ ID NO: 3119503 - RNA, 20 nt, Mycobacterium bovis subsp bovis AF2122/97
caggcugcggauacuguucu

SEQ ID NO: 3119504 - RNA, 21 nt, Mycobacterium bovis subsp bovis AF2122/97
caggcugcggauacuguucug

SEQ ID NO: 3119505 - RNA, 14 nt, Mycobacterium bovis subsp bovis AF2122/97
caggcuggcgaugg

SEQ ID NO: 3119506 - RNA, 22 nt, Mycobacterium bovis subsp bovis AF2122/97
caggcuggcgauggccguccga

SEQ ID NO: 3119507 - RNA, 20 nt, Mycobacterium bovis subsp bovis AF2122/97
caggcugggcagaccgaucg

SEQ ID NO: 3119508 - RNA, 22 nt, Mycobacterium bovis subsp bovis AF2122/97
caggcugggcagaccgaucggc

SEQ ID NO: 3119509 - RNA, 21 nt, Mycobacterium bovis subsp bovis AF2122/97
caggcugguccgggugccggu

SEQ ID NO: 3119510 - RNA, 14 nt, Mycobacterium bovis subsp bovis AF2122/97
caggcuguccgacu

SEQ ID NO: 3119511 - RNA, 15 nt, Mycobacterium bovis subsp bovis AF2122/97
caggcugucgcgggc

SEQ ID NO: 3119512 - RNA, 22 nt, Mycobacterium bovis subsp bovis AF2122/97
caggcugucgcgggccaccacc

SEQ ID NO: 3119513 - RNA, 16 nt, Mycobacterium bovis subsp bovis AF2122/97
caggcuguggccagca

SEQ ID NO: 3119514 - RNA, 18 nt, Mycobacterium bovis subsp bovis AF2122/97
caggcuguggccagcauc

SEQ ID NO: 3119515 - RNA, 15 nt, Mycobacterium bovis subsp bovis AF2122/97
caggcuuagcuuccg

SEQ ID NO: 3119516 - RNA, 18 nt, Mycobacterium bovis subsp bovis AF2122/97
caggcuuccagccacagc

SEQ ID NO: 3119517 - RNA, 23 nt, Mycobacterium bovis subsp bovis AF2122/97
caggcuuccagccacagcccggc

SEQ ID NO: 3119518 - RNA, 12 nt, Mycobacterium bovis subsp bovis AF2122/97
caggcuucuggg

SEQ ID NO: 3119519 - RNA, 23 nt, Mycobacterium bovis subsp bovis AF2122/97
caggcuucugggguuggcucggc

SEQ ID NO: 3119520 - RNA, 15 nt, Mycobacterium bovis subsp bovis AF2122/97
caggcuugacugcac

SEQ ID NO: 3119521 - RNA, 16 nt, Mycobacterium bovis subsp bovis AF2122/97
caggcuugacugcaca

SEQ ID NO: 3119522 - RNA, 15 nt, Mycobacterium bovis subsp bovis AF2122/97
caggcuugcggcacc

SEQ ID NO: 3119523 - RNA, 20 nt, Mycobacterium bovis subsp bovis AF2122/97
cagggaaccauugcccgacg

SEQ ID NO: 3119524 - RNA, 20 nt, Mycobacterium bovis subsp bovis AF2122/97
cagggaagcaagggcgaugg

SEQ ID NO: 3119525 - RNA, 17 nt, Mycobacterium bovis subsp bovis AF2122/97
cagggaauagcggcgcc

SEQ ID NO: 3119526 - RNA, 12 nt, Mycobacterium bovis subsp bovis AF2122/97
cagggacccgag

SEQ ID NO: 3119527 - RNA, 13 nt, Mycobacterium bovis subsp bovis AF2122/97
cagggacccgaga

SEQ ID NO: 3119528 - RNA, 19 nt, Mycobacterium bovis subsp bovis AF2122/97
cagggacccggcgccgucg

SEQ ID NO: 3119529 - RNA, 23 nt, Mycobacterium bovis subsp bovis AF2122/97
cagggacccggcgccgucgauga

SEQ ID NO: 3119530 - RNA, 14 nt, Mycobacterium bovis subsp bovis AF2122/97
cagggaccgguuau

SEQ ID NO: 3119531 - RNA, 14 nt, Mycobacterium bovis subsp bovis AF2122/97
cagggacgaugccc

SEQ ID NO: 3119532 - RNA, 21 nt, Mycobacterium bovis subsp bovis AF2122/97
cagggagccguucaacgugga

SEQ ID NO: 3119533 - RNA, 13 nt, Mycobacterium bovis subsp bovis AF2122/97
cagggagcggcug

SEQ ID NO: 3119534 - RNA, 13 nt, Mycobacterium bovis subsp bovis AF2122/97
cagggaggggccg

SEQ ID NO: 3119535 - RNA, 15 nt, Mycobacterium bovis subsp bovis AF2122/97
cagggaggucgccgc

SEQ ID NO: 3119536 - RNA, 19 nt, Mycobacterium bovis subsp bovis AF2122/97
cagggaggucgccgcaucg

SEQ ID NO: 3119537 - RNA, 13 nt, Mycobacterium bovis subsp bovis AF2122/97
cagggagugccgc

SEQ ID NO: 3119538 - RNA, 15 nt, Mycobacterium bovis subsp bovis AF2122/97
cagggagugccgcac

SEQ ID NO: 3119539 - RNA, 21 nt, Mycobacterium bovis subsp bovis AF2122/97
cagggagugccgcacgauggc

SEQ ID NO: 3119540 - RNA, 14 nt, Mycobacterium bovis subsp bovis AF2122/97
cagggaucaccccg

SEQ ID NO: 3119541 - RNA, 18 nt, Mycobacterium bovis subsp bovis AF2122/97
cagggaucaccccggccg

SEQ ID NO: 3119542 - RNA, 22 nt, Mycobacterium bovis subsp bovis AF2122/97
cagggaucagccgugcgggccg

SEQ ID NO: 3119543 - RNA, 21 nt, Mycobacterium bovis subsp bovis AF2122/97
cagggaucuagaggcggcccc

SEQ ID NO: 3119544 - RNA, 15 nt, Mycobacterium bovis subsp bovis AF2122/97
cagggauucuggaug

SEQ ID NO: 3119545 - RNA, 16 nt, Mycobacterium bovis subsp bovis AF2122/97
cagggcaacggccgcu

SEQ ID NO: 3119546 - RNA, 20 nt, Mycobacterium bovis subsp bovis AF2122/97
cagggcaacggccgcuagcg

SEQ ID NO: 3119547 - RNA, 16 nt, Mycobacterium bovis subsp bovis AF2122/97
cagggcacguggcggu

SEQ ID NO: 3119548 - RNA, 15 nt, Mycobacterium bovis subsp bovis AF2122/97
cagggcacguucggc

SEQ ID NO: 3119549 - RNA, 20 nt, Mycobacterium bovis subsp bovis AF2122/97
cagggcacguucggcgcaca

SEQ ID NO: 3119550 - RNA, 22 nt, Mycobacterium bovis subsp bovis AF2122/97
cagggcacguucggcgcacagc

SEQ ID NO: 3119551 - RNA, 17 nt, Mycobacterium bovis subsp bovis AF2122/97
cagggcagcccggcgau

SEQ ID NO: 3119552 - RNA, 12 nt, Mycobacterium bovis subsp bovis AF2122/97
cagggcagcggc

SEQ ID NO: 3119553 - RNA, 20 nt, Mycobacterium bovis subsp bovis AF2122/97
cagggcauugcggcccgcga

SEQ ID NO: 3119554 - RNA, 16 nt, Mycobacterium bovis subsp bovis AF2122/97
cagggccaccaccacg

SEQ ID NO: 3119555 - RNA, 20 nt, Mycobacterium bovis subsp bovis AF2122/97
cagggccaccaccacggcca

SEQ ID NO: 3119556 - RNA, 13 nt, Mycobacterium bovis subsp bovis AF2122/97
cagggccaccgcg

SEQ ID NO: 3119557 - RNA, 12 nt, Mycobacterium bovis subsp bovis AF2122/97
cagggccacugg

SEQ ID NO: 3119558 - RNA, 18 nt, Mycobacterium bovis subsp bovis AF2122/97
cagggccacuggccgguu

SEQ ID NO: 3119559 - RNA, 19 nt, Mycobacterium bovis subsp bovis AF2122/97
cagggccagaucgccgggc

SEQ ID NO: 3119560 - RNA, 14 nt, Mycobacterium bovis subsp bovis AF2122/97
cagggccagcggca

SEQ ID NO: 3119561 - RNA, 16 nt, Mycobacterium bovis subsp bovis AF2122/97
cagggccagcggcagc

SEQ ID NO: 3119562 - RNA, 17 nt, Mycobacterium bovis subsp bovis AF2122/97
cagggccagcggcagcc

SEQ ID NO: 3119563 - RNA, 14 nt, Mycobacterium bovis subsp bovis AF2122/97
cagggccccaccga

SEQ ID NO: 3119564 - RNA, 15 nt, Mycobacterium bovis subsp bovis AF2122/97
cagggccccaccgag

SEQ ID NO: 3119565 - RNA, 17 nt, Mycobacterium bovis subsp bovis AF2122/97
cagggcccgcaacaucg

SEQ ID NO: 3119566 - RNA, 15 nt, Mycobacterium bovis subsp bovis AF2122/97
cagggcccuagccgg

SEQ ID NO: 3119567 - RNA, 17 nt, Mycobacterium bovis subsp bovis AF2122/97
cagggcccuagccggcg

SEQ ID NO: 3119568 - RNA, 21 nt, Mycobacterium bovis subsp bovis AF2122/97
cagggcccuagccggcgcgcc

SEQ ID NO: 3119569 - RNA, 23 nt, Mycobacterium bovis subsp bovis AF2122/97
cagggcccugcuggcccaacauc

SEQ ID NO: 3119570 - RNA, 16 nt, Mycobacterium bovis subsp bovis AF2122/97
cagggccgacgcgaac

SEQ ID NO: 3119571 - RNA, 12 nt, Mycobacterium bovis subsp bovis AF2122/97
cagggccgagca

SEQ ID NO: 3119572 - RNA, 22 nt, Mycobacterium bovis subsp bovis AF2122/97
cagggccgcaguggcaagcugu

SEQ ID NO: 3119573 - RNA, 14 nt, Mycobacterium bovis subsp bovis AF2122/97
cagggccgccgaag

SEQ ID NO: 3119574 - RNA, 16 nt, Mycobacterium bovis subsp bovis AF2122/97
cagggccgccgaagcu

SEQ ID NO: 3119575 - RNA, 12 nt, Mycobacterium bovis subsp bovis AF2122/97
cagggccgccgc

SEQ ID NO: 3119576 - RNA, 20 nt, Mycobacterium bovis subsp bovis AF2122/97
cagggccgccgcgaacgggu

SEQ ID NO: 3119577 - RNA, 13 nt, Mycobacterium bovis subsp bovis AF2122/97
cagggccgccgcu

SEQ ID NO: 3119578 - RNA, 14 nt, Mycobacterium bovis subsp bovis AF2122/97
cagggccgcgcgca

SEQ ID NO: 3119579 - RNA, 13 nt, Mycobacterium bovis subsp bovis AF2122/97
cagggccgcucgc

SEQ ID NO: 3119580 - RNA, 14 nt, Mycobacterium bovis subsp bovis AF2122/97
cagggccgcucgcc

SEQ ID NO: 3119581 - RNA, 19 nt, Mycobacterium bovis subsp bovis AF2122/97
cagggccggcaccgcagcg

SEQ ID NO: 3119582 - RNA, 22 nt, Mycobacterium bovis subsp bovis AF2122/97
cagggccuccacccgccacggu

SEQ ID NO: 3119583 - RNA, 16 nt, Mycobacterium bovis subsp bovis AF2122/97
cagggccucgaccgcc

SEQ ID NO: 3119584 - RNA, 16 nt, Mycobacterium bovis subsp bovis AF2122/97
cagggccucggucgcc

SEQ ID NO: 3119585 - RNA, 14 nt, Mycobacterium bovis subsp bovis AF2122/97
cagggccuggaaga

SEQ ID NO: 3119586 - RNA, 15 nt, Mycobacterium bovis subsp bovis AF2122/97
cagggccuggccaca

SEQ ID NO: 3119587 - RNA, 22 nt, Mycobacterium bovis subsp bovis AF2122/97
cagggccuguucgagaucgccg

SEQ ID NO: 3119588 - RNA, 11 nt, Mycobacterium bovis subsp bovis AF2122/97
cagggccuuga

SEQ ID NO: 3119589 - RNA, 19 nt, Mycobacterium bovis subsp bovis AF2122/97
cagggccuugaucggcaca

SEQ ID NO: 3119590 - RNA, 14 nt, Mycobacterium bovis subsp bovis AF2122/97
cagggcgacggcca

SEQ ID NO: 3119591 - RNA, 20 nt, Mycobacterium bovis subsp bovis AF2122/97
cagggcgaucugcgcgaugc

SEQ ID NO: 3119592 - RNA, 18 nt, Mycobacterium bovis subsp bovis AF2122/97
cagggcgcaaaccacccg

SEQ ID NO: 3119593 - RNA, 21 nt, Mycobacterium bovis subsp bovis AF2122/97
cagggcgcaaaccacccgcaa

SEQ ID NO: 3119594 - RNA, 19 nt, Mycobacterium bovis subsp bovis AF2122/97
cagggcgccacugaccgcg

SEQ ID NO: 3119595 - RNA, 22 nt, Mycobacterium bovis subsp bovis AF2122/97
cagggcgccgaauuggcccggg

SEQ ID NO: 3119596 - RNA, 20 nt, Mycobacterium bovis subsp bovis AF2122/97
cagggcgccgaucgugcccc

SEQ ID NO: 3119597 - RNA, 20 nt, Mycobacterium bovis subsp bovis AF2122/97
cagggcgcggaucugcagca

SEQ ID NO: 3119598 - RNA, 16 nt, Mycobacterium bovis subsp bovis AF2122/97
cagggcggcaacggcg

SEQ ID NO: 3119599 - RNA, 15 nt, Mycobacterium bovis subsp bovis AF2122/97
cagggcggccucccc

SEQ ID NO: 3119600 - RNA, 23 nt, Mycobacterium bovis subsp bovis AF2122/97
cagggcggccuccccgaccugca

SEQ ID NO: 3119601 - RNA, 22 nt, Mycobacterium bovis subsp bovis AF2122/97
cagggcggcguuaccaccguca

SEQ ID NO: 3119602 - RNA, 17 nt, Mycobacterium bovis subsp bovis AF2122/97
cagggcgggcgucgagg

SEQ ID NO: 3119603 - RNA, 20 nt, Mycobacterium bovis subsp bovis AF2122/97
cagggcggugccaucgggcg

SEQ ID NO: 3119604 - RNA, 17 nt, Mycobacterium bovis subsp bovis AF2122/97
cagggcggugcucuucg

SEQ ID NO: 3119605 - RNA, 17 nt, Mycobacterium bovis subsp bovis AF2122/97
cagggcgguggccaccc

SEQ ID NO: 3119606 - RNA, 20 nt, Mycobacterium bovis subsp bovis AF2122/97
cagggcgguggccacccggc

SEQ ID NO: 3119607 - RNA, 22 nt, Mycobacterium bovis subsp bovis AF2122/97
cagggcgguggccacccggccg

SEQ ID NO: 3119608 - RNA, 23 nt, Mycobacterium bovis subsp bovis AF2122/97
cagggcgguggccacccggccgc

SEQ ID NO: 3119609 - RNA, 15 nt, Mycobacterium bovis subsp bovis AF2122/97
cagggcgucgaccgc

SEQ ID NO: 3119610 - RNA, 17 nt, Mycobacterium bovis subsp bovis AF2122/97
cagggcgucgaccgcgg

SEQ ID NO: 3119611 - RNA, 22 nt, Mycobacterium bovis subsp bovis AF2122/97
cagggcgucgaccgcggcccgg

SEQ ID NO: 3119612 - RNA, 12 nt, Mycobacterium bovis subsp bovis AF2122/97
cagggcgucggc

SEQ ID NO: 3119613 - RNA, 17 nt, Mycobacterium bovis subsp bovis AF2122/97
cagggcgucggcgaauu

SEQ ID NO: 3119614 - RNA, 15 nt, Mycobacterium bovis subsp bovis AF2122/97
cagggcgucggcgac

SEQ ID NO: 3119615 - RNA, 19 nt, Mycobacterium bovis subsp bovis AF2122/97
cagggcgucggcgacgucc

SEQ ID NO: 3119616 - RNA, 14 nt, Mycobacterium bovis subsp bovis AF2122/97
cagggcucgcucgc

SEQ ID NO: 3119617 - RNA, 15 nt, Mycobacterium bovis subsp bovis AF2122/97
cagggcucgcucgcc

SEQ ID NO: 3119618 - RNA, 12 nt, Mycobacterium bovis subsp bovis AF2122/97
cagggcucggcg

SEQ ID NO: 3119619 - RNA, 14 nt, Mycobacterium bovis subsp bovis AF2122/97
cagggcucggcggc

SEQ ID NO: 3119620 - RNA, 15 nt, Mycobacterium bovis subsp bovis AF2122/97
cagggcucggcggcc

SEQ ID NO: 3119621 - RNA, 17 nt, Mycobacterium bovis subsp bovis AF2122/97
cagggcucggcggcccg

SEQ ID NO: 3119622 - RNA, 19 nt, Mycobacterium bovis subsp bovis AF2122/97
cagggcucggcggcccggc

SEQ ID NO: 3119623 - RNA, 21 nt, Mycobacterium bovis subsp bovis AF2122/97
cagggcucggcggcccggccg

SEQ ID NO: 3119624 - RNA, 22 nt, Mycobacterium bovis subsp bovis AF2122/97
cagggcucggcggcccggccga

SEQ ID NO: 3119625 - RNA, 17 nt, Mycobacterium bovis subsp bovis AF2122/97
cagggcuucgugcacca

SEQ ID NO: 3119626 - RNA, 14 nt, Mycobacterium bovis subsp bovis AF2122/97
caggggaccgcggc

SEQ ID NO: 3119627 - RNA, 18 nt, Mycobacterium bovis subsp bovis AF2122/97
caggggaccgcggcgcgu

SEQ ID NO: 3119628 - RNA, 13 nt, Mycobacterium bovis subsp bovis AF2122/97
caggggacgacca

SEQ ID NO: 3119629 - RNA, 18 nt, Mycobacterium bovis subsp bovis AF2122/97
caggggacgaccaugccg

SEQ ID NO: 3119630 - RNA, 16 nt, Mycobacterium bovis subsp bovis AF2122/97
caggggaucccccgcg

SEQ ID NO: 3119631 - RNA, 19 nt, Mycobacterium bovis subsp bovis AF2122/97
caggggaucccccgcgcga

SEQ ID NO: 3119632 - RNA, 13 nt, Mycobacterium bovis subsp bovis AF2122/97
caggggcagcgcg

SEQ ID NO: 3119633 - RNA, 14 nt, Mycobacterium bovis subsp bovis AF2122/97
caggggcagcgcgg

SEQ ID NO: 3119634 - RNA, 17 nt, Mycobacterium bovis subsp bovis AF2122/97
caggggcagcgcggcca

SEQ ID NO: 3119635 - RNA, 17 nt, Mycobacterium bovis subsp bovis AF2122/97
caggggccagcgcgcca

SEQ ID NO: 3119636 - RNA, 16 nt, Mycobacterium bovis subsp bovis AF2122/97
cagggggcgugccgcc

SEQ ID NO: 3119637 - RNA, 14 nt, Mycobacterium bovis subsp bovis AF2122/97
cagggguggcgcgg

SEQ ID NO: 3119638 - RNA, 19 nt, Mycobacterium bovis subsp bovis AF2122/97
cagggguggcgcgggccgg

SEQ ID NO: 3119639 - RNA, 23 nt, Mycobacterium bovis subsp bovis AF2122/97
cagggguggcgcgggccggcgac

SEQ ID NO: 3119640 - RNA, 23 nt, Mycobacterium bovis subsp bovis AF2122/97
caggggugugccguggucgaaga

SEQ ID NO: 3119641 - RNA, 16 nt, Mycobacterium bovis subsp bovis AF2122/97
caggguauccacgccg

SEQ ID NO: 3119642 - RNA, 20 nt, Mycobacterium bovis subsp bovis AF2122/97
caggguauccacgccgggca

SEQ ID NO: 3119643 - RNA, 21 nt, Mycobacterium bovis subsp bovis AF2122/97
caggguauccacgccgggcaa

SEQ ID NO: 3119644 - RNA, 18 nt, Mycobacterium bovis subsp bovis AF2122/97
cagggucacaaacccagc

SEQ ID NO: 3119645 - RNA, 19 nt, Mycobacterium bovis subsp bovis AF2122/97
cagggucaccugcgggccc

SEQ ID NO: 3119646 - RNA, 15 nt, Mycobacterium bovis subsp bovis AF2122/97
cagggucagcgccgc

SEQ ID NO: 3119647 - RNA, 14 nt, Mycobacterium bovis subsp bovis AF2122/97
cagggucagcuggg

SEQ ID NO: 3119648 - RNA, 13 nt, Mycobacterium bovis subsp bovis AF2122/97
cagggucccgccg

SEQ ID NO: 3119649 - RNA, 17 nt, Mycobacterium bovis subsp bovis AF2122/97
cagggucccgccgccug

SEQ ID NO: 3119650 - RNA, 17 nt, Mycobacterium bovis subsp bovis AF2122/97
cagggucgaguucgcag

SEQ ID NO: 3119651 - RNA, 23 nt, Mycobacterium bovis subsp bovis AF2122/97
cagggucguagacgguuaccgcg

SEQ ID NO: 3119652 - RNA, 15 nt, Mycobacterium bovis subsp bovis AF2122/97
cagggucugcgccgc

SEQ ID NO: 3119653 - RNA, 17 nt, Mycobacterium bovis subsp bovis AF2122/97
cagggucugcgccgccg

SEQ ID NO: 3119654 - RNA, 18 nt, Mycobacterium bovis subsp bovis AF2122/97
cagggucugcgccgccgg

SEQ ID NO: 3119655 - RNA, 14 nt, Mycobacterium bovis subsp bovis AF2122/97
cagggucugcucau

SEQ ID NO: 3119656 - RNA, 16 nt, Mycobacterium bovis subsp bovis AF2122/97
cagggucugugcaugc

SEQ ID NO: 3119657 - RNA, 14 nt, Mycobacterium bovis subsp bovis AF2122/97
cagggugacuucgc

SEQ ID NO: 3119658 - RNA, 20 nt, Mycobacterium bovis subsp bovis AF2122/97
cagggugacuucgcugcggu

SEQ ID NO: 3119659 - RNA, 13 nt, Mycobacterium bovis subsp bovis AF2122/97
cagggugccggcg

SEQ ID NO: 3119660 - RNA, 17 nt, Mycobacterium bovis subsp bovis AF2122/97
cagggugccggcgccgc

SEQ ID NO: 3119661 - RNA, 20 nt, Mycobacterium bovis subsp bovis AF2122/97
cagggugccggcgccgcccu

SEQ ID NO: 3119662 - RNA, 20 nt, Mycobacterium bovis subsp bovis AF2122/97
cagggugccggcggugacgg

SEQ ID NO: 3119663 - RNA, 17 nt, Mycobacterium bovis subsp bovis AF2122/97
cagggugcgccgcagca

SEQ ID NO: 3119664 - RNA, 20 nt, Mycobacterium bovis subsp bovis AF2122/97
cagggugcgccgcagcaggu

SEQ ID NO: 3119665 - RNA, 13 nt, Mycobacterium bovis subsp bovis AF2122/97
cagggugcgccgg

SEQ ID NO: 3119666 - RNA, 13 nt, Mycobacterium bovis subsp bovis AF2122/97
caggguggccagc

SEQ ID NO: 3119667 - RNA, 16 nt, Mycobacterium bovis subsp bovis AF2122/97
caggguggccagcagg

SEQ ID NO: 3119668 - RNA, 17 nt, Mycobacterium bovis subsp bovis AF2122/97
caggguggcccggggac

SEQ ID NO: 3119669 - RNA, 13 nt, Mycobacterium bovis subsp bovis AF2122/97
caggguggcgacg

SEQ ID NO: 3119670 - RNA, 10 nt, Mycobacterium bovis subsp bovis AF2122/97
cagggugggc

SEQ ID NO: 3119671 - RNA, 23 nt, Mycobacterium bovis subsp bovis AF2122/97
cagggugggcgacgucaucgccg

SEQ ID NO: 3119672 - RNA, 12 nt, Mycobacterium bovis subsp bovis AF2122/97
cagggugggcuu

SEQ ID NO: 3119673 - RNA, 14 nt, Mycobacterium bovis subsp bovis AF2122/97
caggguggggcggu

SEQ ID NO: 3119674 - RNA, 18 nt, Mycobacterium bovis subsp bovis AF2122/97
caggguguauggccacca

SEQ ID NO: 3119675 - RNA, 20 nt, Mycobacterium bovis subsp bovis AF2122/97
caggguguauggccaccacg

SEQ ID NO: 3119676 - RNA, 13 nt, Mycobacterium bovis subsp bovis AF2122/97
cagggugucacgc

SEQ ID NO: 3119677 - RNA, 18 nt, Mycobacterium bovis subsp bovis AF2122/97
cagggugucgaagagcag

SEQ ID NO: 3119678 - RNA, 24 nt, Mycobacterium bovis subsp bovis AF2122/97
cagggugucgacaaccgcugccgc

SEQ ID NO: 3119679 - RNA, 18 nt, Mycobacterium bovis subsp bovis AF2122/97
caggguguuuauggcccu

SEQ ID NO: 3119680 - RNA, 21 nt, Mycobacterium bovis subsp bovis AF2122/97
caggguguuuauggcccuggg

SEQ ID NO: 3119681 - RNA, 23 nt, Mycobacterium bovis subsp bovis AF2122/97
caggguguuuauggcccugggcc

SEQ ID NO: 3119682 - RNA, 18 nt, Mycobacterium bovis subsp bovis AF2122/97
caggguucgucgggacgc

SEQ ID NO: 3119683 - RNA, 21 nt, Mycobacterium bovis subsp bovis AF2122/97
caggguucgucgggacgccgc

SEQ ID NO: 3119684 - RNA, 20 nt, Mycobacterium bovis subsp bovis AF2122/97
caggguugccccgaagcggg

SEQ ID NO: 3119685 - RNA, 17 nt, Mycobacterium bovis subsp bovis AF2122/97
caggguuggcaccguca

SEQ ID NO: 3119686 - RNA, 17 nt, Mycobacterium bovis subsp bovis AF2122/97
cagguaaacggauucga

SEQ ID NO: 3119687 - RNA, 14 nt, Mycobacterium bovis subsp bovis AF2122/97
cagguaaccccgca

SEQ ID NO: 3119688 - RNA, 20 nt, Mycobacterium bovis subsp bovis AF2122/97
cagguaagcagccagcaaca

SEQ ID NO: 3119689 - RNA, 23 nt, Mycobacterium bovis subsp bovis AF2122/97
cagguacaucccggugucgaugc

SEQ ID NO: 3119690 - RNA, 21 nt, Mycobacterium bovis subsp bovis AF2122/97
cagguacgccucgacagcggc

SEQ ID NO: 3119691 - RNA, 23 nt, Mycobacterium bovis subsp bovis AF2122/97
cagguacgccucgacagcggcaa

SEQ ID NO: 3119692 - RNA, 17 nt, Mycobacterium bovis subsp bovis AF2122/97
cagguacggcgggcggc

SEQ ID NO: 3119693 - RNA, 20 nt, Mycobacterium bovis subsp bovis AF2122/97
cagguacggcgggcggccgc

SEQ ID NO: 3119694 - RNA, 21 nt, Mycobacterium bovis subsp bovis AF2122/97
cagguacggcgggcggccgcu

SEQ ID NO: 3119695 - RNA, 20 nt, Mycobacterium bovis subsp bovis AF2122/97
cagguacucaguguuccgcc

SEQ ID NO: 3119696 - RNA, 18 nt, Mycobacterium bovis subsp bovis AF2122/97
cagguacuccccguugcc

SEQ ID NO: 3119697 - RNA, 19 nt, Mycobacterium bovis subsp bovis AF2122/97
cagguagaccggaaaccac

SEQ ID NO: 3119698 - RNA, 22 nt, Mycobacterium bovis subsp bovis AF2122/97
cagguagaccggaaaccacagc

SEQ ID NO: 3119699 - RNA, 20 nt, Mycobacterium bovis subsp bovis AF2122/97
cagguagcggguugggaccg

SEQ ID NO: 3119700 - RNA, 21 nt, Mycobacterium bovis subsp bovis AF2122/97
cagguagcggguugggaccga

SEQ ID NO: 3119701 - RNA, 20 nt, Mycobacterium bovis subsp bovis AF2122/97
cagguauuugccgugcucac

SEQ ID NO: 3119702 - RNA, 22 nt, Mycobacterium bovis subsp bovis AF2122/97
caggucaauggucuuuguccac

SEQ ID NO: 3119703 - RNA, 13 nt, Mycobacterium bovis subsp bovis AF2122/97
caggucaccggcc

SEQ ID NO: 3119704 - RNA, 15 nt, Mycobacterium bovis subsp bovis AF2122/97
caggucaccggccgc

SEQ ID NO: 3119705 - RNA, 16 nt, Mycobacterium bovis subsp bovis AF2122/97
caggucaccggccgcc

SEQ ID NO: 3119706 - RNA, 18 nt, Mycobacterium bovis subsp bovis AF2122/97
caggucaccggccgccga

SEQ ID NO: 3119707 - RNA, 21 nt, Mycobacterium bovis subsp bovis AF2122/97
caggucacuacuccggucccg

SEQ ID NO: 3119708 - RNA, 14 nt, Mycobacterium bovis subsp bovis AF2122/97
caggucagccgcgc

SEQ ID NO: 3119709 - RNA, 16 nt, Mycobacterium bovis subsp bovis AF2122/97
caggucagccgcgcgg

SEQ ID NO: 3119710 - RNA, 17 nt, Mycobacterium bovis subsp bovis AF2122/97
caggucagcgcugccac

SEQ ID NO: 3119711 - RNA, 22 nt, Mycobacterium bovis subsp bovis AF2122/97
caggucagcgcugccaccgcgg

SEQ ID NO: 3119712 - RNA, 18 nt, Mycobacterium bovis subsp bovis AF2122/97
caggucauauugcggugc

SEQ ID NO: 3119713 - RNA, 19 nt, Mycobacterium bovis subsp bovis AF2122/97
caggucauauugcggugca

SEQ ID NO: 3119714 - RNA, 21 nt, Mycobacterium bovis subsp bovis AF2122/97
caggucaucggcggcggggac

SEQ ID NO: 3119715 - RNA, 18 nt, Mycobacterium bovis subsp bovis AF2122/97
caggucauugcacgccug

SEQ ID NO: 3119716 - RNA, 16 nt, Mycobacterium bovis subsp bovis AF2122/97
cagguccaaguccucc

SEQ ID NO: 3119717 - RNA, 14 nt, Mycobacterium bovis subsp bovis AF2122/97
cagguccaccgcug

SEQ ID NO: 3119718 - RNA, 15 nt, Mycobacterium bovis subsp bovis AF2122/97
cagguccaccgcugc

SEQ ID NO: 3119719 - RNA, 17 nt, Mycobacterium bovis subsp bovis AF2122/97
cagguccaccgcugccg

SEQ ID NO: 3119720 - RNA, 18 nt, Mycobacterium bovis subsp bovis AF2122/97
cagguccaccgcugccgg

SEQ ID NO: 3119721 - RNA, 21 nt, Mycobacterium bovis subsp bovis AF2122/97
cagguccaccgcugccggcag

SEQ ID NO: 3119722 - RNA, 22 nt, Mycobacterium bovis subsp bovis AF2122/97
cagguccaccgcugccggcagc

SEQ ID NO: 3119723 - RNA, 14 nt, Mycobacterium bovis subsp bovis AF2122/97
cagguccaccggcc

SEQ ID NO: 3119724 - RNA, 19 nt, Mycobacterium bovis subsp bovis AF2122/97
cagguccccgacaacggcg

SEQ ID NO: 3119725 - RNA, 21 nt, Mycobacterium bovis subsp bovis AF2122/97
cagguccccgacaacggcggc

SEQ ID NO: 3119726 - RNA, 14 nt, Mycobacterium bovis subsp bovis AF2122/97
cagguccgccccgu

SEQ ID NO: 3119727 - RNA, 14 nt, Mycobacterium bovis subsp bovis AF2122/97
cagguccgccggug

SEQ ID NO: 3119728 - RNA, 23 nt, Mycobacterium bovis subsp bovis AF2122/97
cagguccgccggugccgccgucg

SEQ ID NO: 3119729 - RNA, 16 nt, Mycobacterium bovis subsp bovis AF2122/97
cagguccgcggccgcg

SEQ ID NO: 3119730 - RNA, 17 nt, Mycobacterium bovis subsp bovis AF2122/97
cagguccgcggccgcgg

SEQ ID NO: 3119731 - RNA, 19 nt, Mycobacterium bovis subsp bovis AF2122/97
cagguccgcgugcugccgu

SEQ ID NO: 3119732 - RNA, 17 nt, Mycobacterium bovis subsp bovis AF2122/97
cagguccggguuggcca

SEQ ID NO: 3119733 - RNA, 18 nt, Mycobacterium bovis subsp bovis AF2122/97
cagguccggguuggccac

SEQ ID NO: 3119734 - RNA, 16 nt, Mycobacterium bovis subsp bovis AF2122/97
cagguccugcgccgca

SEQ ID NO: 3119735 - RNA, 16 nt, Mycobacterium bovis subsp bovis AF2122/97
caggucgacaccgcgg

SEQ ID NO: 3119736 - RNA, 20 nt, Mycobacterium bovis subsp bovis AF2122/97
caggucgacauaggccaccu

SEQ ID NO: 3119737 - RNA, 16 nt, Mycobacterium bovis subsp bovis AF2122/97
caggucgacggccacg

SEQ ID NO: 3119738 - RNA, 18 nt, Mycobacterium bovis subsp bovis AF2122/97
caggucgacggccacggu

SEQ ID NO: 3119739 - RNA, 16 nt, Mycobacterium bovis subsp bovis AF2122/97
caggucgagcaccggc

SEQ ID NO: 3119740 - RNA, 17 nt, Mycobacterium bovis subsp bovis AF2122/97
caggucgagcaccggcu

SEQ ID NO: 3119741 - RNA, 23 nt, Mycobacterium bovis subsp bovis AF2122/97
caggucgaggcaggccucggcgc

SEQ ID NO: 3119742 - RNA, 16 nt, Mycobacterium bovis subsp bovis AF2122/97
caggucgauaccggcg

SEQ ID NO: 3119743 - RNA, 14 nt, Mycobacterium bovis subsp bovis AF2122/97
caggucgaugcugc

SEQ ID NO: 3119744 - RNA, 13 nt, Mycobacterium bovis subsp bovis AF2122/97
caggucgcaccac

SEQ ID NO: 3119745 - RNA, 23 nt, Mycobacterium bovis subsp bovis AF2122/97
caggucgcagaccagacugcagu

SEQ ID NO: 3119746 - RNA, 23 nt, Mycobacterium bovis subsp bovis AF2122/97
caggucgccagcucggcacccgc

SEQ ID NO: 3119747 - RNA, 16 nt, Mycobacterium bovis subsp bovis AF2122/97
caggucgcccaacacc

SEQ ID NO: 3119748 - RNA, 19 nt, Mycobacterium bovis subsp bovis AF2122/97
caggucgcccaacaccgcg

SEQ ID NO: 3119749 - RNA, 20 nt, Mycobacterium bovis subsp bovis AF2122/97
caggucgcccaacaccgcgc

SEQ ID NO: 3119750 - RNA, 23 nt, Mycobacterium bovis subsp bovis AF2122/97
caggucgcccaacaccgcgccga

SEQ ID NO: 3119751 - RNA, 15 nt, Mycobacterium bovis subsp bovis AF2122/97
caggucgccgagacc

SEQ ID NO: 3119752 - RNA, 18 nt, Mycobacterium bovis subsp bovis AF2122/97
caggucgccgagaccggc

SEQ ID NO: 3119753 - RNA, 15 nt, Mycobacterium bovis subsp bovis AF2122/97
caggucgccuuccca

SEQ ID NO: 3119754 - RNA, 18 nt, Mycobacterium bovis subsp bovis AF2122/97
caggucgcgauagccgcc

SEQ ID NO: 3119755 - RNA, 19 nt, Mycobacterium bovis subsp bovis AF2122/97
caggucgcgauagccgccg

SEQ ID NO: 3119756 - RNA, 21 nt, Mycobacterium bovis subsp bovis AF2122/97
caggucgcgauagccgccgcg

SEQ ID NO: 3119757 - RNA, 19 nt, Mycobacterium bovis subsp bovis AF2122/97
caggucggaacuagccagu

SEQ ID NO: 3119758 - RNA, 16 nt, Mycobacterium bovis subsp bovis AF2122/97
caggucggcauccucu

SEQ ID NO: 3119759 - RNA, 22 nt, Mycobacterium bovis subsp bovis AF2122/97
caggucggcauccucugaacca

SEQ ID NO: 3119760 - RNA, 22 nt, Mycobacterium bovis subsp bovis AF2122/97
caggucggcccacggugucccg

SEQ ID NO: 3119761 - RNA, 13 nt, Mycobacterium bovis subsp bovis AF2122/97
caggucggccgcc

SEQ ID NO: 3119762 - RNA, 15 nt, Mycobacterium bovis subsp bovis AF2122/97
caggucggccgccuc

SEQ ID NO: 3119763 - RNA, 16 nt, Mycobacterium bovis subsp bovis AF2122/97
caggucggccgccucg

SEQ ID NO: 3119764 - RNA, 23 nt, Mycobacterium bovis subsp bovis AF2122/97
caggucggcgaacaaccgccgcu

SEQ ID NO: 3119765 - RNA, 22 nt, Mycobacterium bovis subsp bovis AF2122/97
caggucggcgaugaugacggcg

SEQ ID NO: 3119766 - RNA, 16 nt, Mycobacterium bovis subsp bovis AF2122/97
caggucgggcccccgg

SEQ ID NO: 3119767 - RNA, 19 nt, Mycobacterium bovis subsp bovis AF2122/97
caggucggucaggucgagg

SEQ ID NO: 3119768 - RNA, 15 nt, Mycobacterium bovis subsp bovis AF2122/97
caggucggugcgguc

SEQ ID NO: 3119769 - RNA, 18 nt, Mycobacterium bovis subsp bovis AF2122/97
caggucggugcggucauc

SEQ ID NO: 3119770 - RNA, 17 nt, Mycobacterium bovis subsp bovis AF2122/97
caggucggugggcggcg

SEQ ID NO: 3119771 - RNA, 18 nt, Mycobacterium bovis subsp bovis AF2122/97
caggucggugggcggcga

SEQ ID NO: 3119772 - RNA, 21 nt, Mycobacterium bovis subsp bovis AF2122/97
caggucgguggucucgacggc

SEQ ID NO: 3119773 - RNA, 21 nt, Mycobacterium bovis subsp bovis AF2122/97
caggucggugugcaucgccgg

SEQ ID NO: 3119774 - RNA, 15 nt, Mycobacterium bovis subsp bovis AF2122/97
caggucgucacgccc

SEQ ID NO: 3119775 - RNA, 15 nt, Mycobacterium bovis subsp bovis AF2122/97
caggucgucggcguc

SEQ ID NO: 3119776 - RNA, 14 nt, Mycobacterium bovis subsp bovis AF2122/97
caggucgugcccgg

SEQ ID NO: 3119777 - RNA, 15 nt, Mycobacterium bovis subsp bovis AF2122/97
caggucgugcccggg

SEQ ID NO: 3119778 - RNA, 16 nt, Mycobacterium bovis subsp bovis AF2122/97
caggucgugcccggga

SEQ ID NO: 3119779 - RNA, 22 nt, Mycobacterium bovis subsp bovis AF2122/97
caggucguuugugaacaccccu

SEQ ID NO: 3119780 - RNA, 20 nt, Mycobacterium bovis subsp bovis AF2122/97
caggucuacccggucgccgg

SEQ ID NO: 3119781 - RNA, 22 nt, Mycobacterium bovis subsp bovis AF2122/97
caggucuccaucaaccgcgcug

SEQ ID NO: 3119782 - RNA, 16 nt, Mycobacterium bovis subsp bovis AF2122/97
caggucuccuugggcg

SEQ ID NO: 3119783 - RNA, 15 nt, Mycobacterium bovis subsp bovis AF2122/97
caggucugcggugcu

SEQ ID NO: 3119784 - RNA, 16 nt, Mycobacterium bovis subsp bovis AF2122/97
caggucuucgaccacg

SEQ ID NO: 3119785 - RNA, 16 nt, Mycobacterium bovis subsp bovis AF2122/97
caggucuucgcugucg

SEQ ID NO: 3119786 - RNA, 21 nt, Mycobacterium bovis subsp bovis AF2122/97
caggugaccaguaggcaagca

SEQ ID NO: 3119787 - RNA, 15 nt, Mycobacterium bovis subsp bovis AF2122/97
caggugacgcccgcu

SEQ ID NO: 3119788 - RNA, 22 nt, Mycobacterium bovis subsp bovis AF2122/97
caggugacguucgaugcccugg

SEQ ID NO: 3119789 - RNA, 15 nt, Mycobacterium bovis subsp bovis AF2122/97
caggugagaccaggu

SEQ ID NO: 3119790 - RNA, 17 nt, Mycobacterium bovis subsp bovis AF2122/97
caggugagaccagguuc

SEQ ID NO: 3119791 - RNA, 16 nt, Mycobacterium bovis subsp bovis AF2122/97
caggugagugcggcgu

SEQ ID NO: 3119792 - RNA, 13 nt, Mycobacterium bovis subsp bovis AF2122/97
caggugaucgcga

SEQ ID NO: 3119793 - RNA, 14 nt, Mycobacterium bovis subsp bovis AF2122/97
caggugaugccgcc

SEQ ID NO: 3119794 - RNA, 16 nt, Mycobacterium bovis subsp bovis AF2122/97
caggugauucgcgcag

SEQ ID NO: 3119795 - RNA, 13 nt, Mycobacterium bovis subsp bovis AF2122/97
caggugcagcacc

SEQ ID NO: 3119796 - RNA, 15 nt, Mycobacterium bovis subsp bovis AF2122/97
caggugcagcaccag

SEQ ID NO: 3119797 - RNA, 14 nt, Mycobacterium bovis subsp bovis AF2122/97
caggugccaaacgc

SEQ ID NO: 3119798 - RNA, 14 nt, Mycobacterium bovis subsp bovis AF2122/97
caggugccaaccgc

SEQ ID NO: 3119799 - RNA, 17 nt, Mycobacterium bovis subsp bovis AF2122/97
caggugccaaccgcggc

SEQ ID NO: 3119800 - RNA, 18 nt, Mycobacterium bovis subsp bovis AF2122/97
caggugccagaccagggc

SEQ ID NO: 3119801 - RNA, 14 nt, Mycobacterium bovis subsp bovis AF2122/97
caggugcccgcccc

SEQ ID NO: 3119802 - RNA, 16 nt, Mycobacterium bovis subsp bovis AF2122/97
caggugcccgccccga

SEQ ID NO: 3119803 - RNA, 13 nt, Mycobacterium bovis subsp bovis AF2122/97
caggugcccggcc

SEQ ID NO: 3119804 - RNA, 20 nt, Mycobacterium bovis subsp bovis AF2122/97
caggugcccggccaaaaugg

SEQ ID NO: 3119805 - RNA, 13 nt, Mycobacterium bovis subsp bovis AF2122/97
caggugccgugau

SEQ ID NO: 3119806 - RNA, 19 nt, Mycobacterium bovis subsp bovis AF2122/97
caggugccguggcuaccgc

SEQ ID NO: 3119807 - RNA, 18 nt, Mycobacterium bovis subsp bovis AF2122/97
caggugccuuucggcaga

SEQ ID NO: 3119808 - RNA, 20 nt, Mycobacterium bovis subsp bovis AF2122/97
caggugcgccguggcaucgc

SEQ ID NO: 3119809 - RNA, 21 nt, Mycobacterium bovis subsp bovis AF2122/97
caggugcgccuggcuggccag

SEQ ID NO: 3119810 - RNA, 22 nt, Mycobacterium bovis subsp bovis AF2122/97
caggugcgccuggcuggccagc

SEQ ID NO: 3119811 - RNA, 23 nt, Mycobacterium bovis subsp bovis AF2122/97
caggugcgccuggcuggccagcu

SEQ ID NO: 3119812 - RNA, 13 nt, Mycobacterium bovis subsp bovis AF2122/97
caggugcgcgacc

SEQ ID NO: 3119813 - RNA, 14 nt, Mycobacterium bovis subsp bovis AF2122/97
caggugcgcgacca

SEQ ID NO: 3119814 - RNA, 17 nt, Mycobacterium bovis subsp bovis AF2122/97
caggugcgcgaccagga

SEQ ID NO: 3119815 - RNA, 19 nt, Mycobacterium bovis subsp bovis AF2122/97
caggugcggcggcaucggu

SEQ ID NO: 3119816 - RNA, 15 nt, Mycobacterium bovis subsp bovis AF2122/97
caggugcgggccggu

SEQ ID NO: 3119817 - RNA, 16 nt, Mycobacterium bovis subsp bovis AF2122/97
caggugcucgucaucc

SEQ ID NO: 3119818 - RNA, 14 nt, Mycobacterium bovis subsp bovis AF2122/97
caggugcucgucga

SEQ ID NO: 3119819 - RNA, 14 nt, Mycobacterium bovis subsp bovis AF2122/97
caggugcugggcga

SEQ ID NO: 3119820 - RNA, 21 nt, Mycobacterium bovis subsp bovis AF2122/97
caggugcugggcgaggugagg

SEQ ID NO: 3119821 - RNA, 22 nt, Mycobacterium bovis subsp bovis AF2122/97
caggugcuguuugguugcgcca

SEQ ID NO: 3119822 - RNA, 13 nt, Mycobacterium bovis subsp bovis AF2122/97
cagguggccaggc

SEQ ID NO: 3119823 - RNA, 14 nt, Mycobacterium bovis subsp bovis AF2122/97
cagguggccgucgc

SEQ ID NO: 3119824 - RNA, 19 nt, Mycobacterium bovis subsp bovis AF2122/97
cagguggccgucgccgaag

SEQ ID NO: 3119825 - RNA, 23 nt, Mycobacterium bovis subsp bovis AF2122/97
cagguggcgagcgccuuucgguc

SEQ ID NO: 3119826 - RNA, 22 nt, Mycobacterium bovis subsp bovis AF2122/97
cagguggcuguucaccucuugg

SEQ ID NO: 3119827 - RNA, 15 nt, Mycobacterium bovis subsp bovis AF2122/97
caggugggcagcagg

SEQ ID NO: 3119828 - RNA, 17 nt, Mycobacterium bovis subsp bovis AF2122/97
caggugggcagcaggcc

SEQ ID NO: 3119829 - RNA, 20 nt, Mycobacterium bovis subsp bovis AF2122/97
caggugggcagcaggcccac

SEQ ID NO: 3119830 - RNA, 18 nt, Mycobacterium bovis subsp bovis AF2122/97
caggugggccgagagcag

SEQ ID NO: 3119831 - RNA, 20 nt, Mycobacterium bovis subsp bovis AF2122/97
caggugggcguuggcgacga

SEQ ID NO: 3119832 - RNA, 22 nt, Mycobacterium bovis subsp bovis AF2122/97
caggugggcguuggcgacgaag

SEQ ID NO: 3119833 - RNA, 20 nt, Mycobacterium bovis subsp bovis AF2122/97
cagguggugacacgacgugc

SEQ ID NO: 3119834 - RNA, 12 nt, Mycobacterium bovis subsp bovis AF2122/97
caggugugcccc

SEQ ID NO: 3119835 - RNA, 15 nt, Mycobacterium bovis subsp bovis AF2122/97
caggugugccccgcu

SEQ ID NO: 3119836 - RNA, 18 nt, Mycobacterium bovis subsp bovis AF2122/97
caggugugugacgaucgu

SEQ ID NO: 3119837 - RNA, 22 nt, Mycobacterium bovis subsp bovis AF2122/97
cagguguucgccggagacccgg

SEQ ID NO: 3119838 - RNA, 19 nt, Mycobacterium bovis subsp bovis AF2122/97
cagguguugacgauccggu

SEQ ID NO: 3119839 - RNA, 18 nt, Mycobacterium bovis subsp bovis AF2122/97
cagguguugacgccaacg

SEQ ID NO: 3119840 - RNA, 20 nt, Mycobacterium bovis subsp bovis AF2122/97
cagguguuggacgccuugca

SEQ ID NO: 3119841 - RNA, 15 nt, Mycobacterium bovis subsp bovis AF2122/97
cagguuccgcacgau

SEQ ID NO: 3119842 - RNA, 19 nt, Mycobacterium bovis subsp bovis AF2122/97
cagguuccgcacgaucggg

SEQ ID NO: 3119843 - RNA, 15 nt, Mycobacterium bovis subsp bovis AF2122/97
cagguuccgcugucg

SEQ ID NO: 3119844 - RNA, 16 nt, Mycobacterium bovis subsp bovis AF2122/97
cagguuccgcugucga

SEQ ID NO: 3119845 - RNA, 19 nt, Mycobacterium bovis subsp bovis AF2122/97
cagguucgagggugacccc

SEQ ID NO: 3119846 - RNA, 15 nt, Mycobacterium bovis subsp bovis AF2122/97
cagguucuucuccac

SEQ ID NO: 3119847 - RNA, 20 nt, Mycobacterium bovis subsp bovis AF2122/97
cagguucuucuccaccaccg

SEQ ID NO: 3119848 - RNA, 17 nt, Mycobacterium bovis subsp bovis AF2122/97
cagguucuugaccagca

SEQ ID NO: 3119849 - RNA, 19 nt, Mycobacterium bovis subsp bovis AF2122/97
cagguugaggugugccgac

SEQ ID NO: 3119850 - RNA, 22 nt, Mycobacterium bovis subsp bovis AF2122/97
cagguugcccgguggaaugcca

SEQ ID NO: 3119851 - RNA, 14 nt, Mycobacterium bovis subsp bovis AF2122/97
cagguugccgucgg

SEQ ID NO: 3119852 - RNA, 21 nt, Mycobacterium bovis subsp bovis AF2122/97
cagguugcgccauaacaccgg

SEQ ID NO: 3119853 - RNA, 20 nt, Mycobacterium bovis subsp bovis AF2122/97
cagguugcguugcaggaaag

SEQ ID NO: 3119854 - RNA, 18 nt, Mycobacterium bovis subsp bovis AF2122/97
cagguuggagcccgagcu

SEQ ID NO: 3119855 - RNA, 19 nt, Mycobacterium bovis subsp bovis AF2122/97
cagguuggauacggugcga

SEQ ID NO: 3119856 - RNA, 13 nt, Mycobacterium bovis subsp bovis AF2122/97
cagguuggcacgc

SEQ ID NO: 3119857 - RNA, 17 nt, Mycobacterium bovis subsp bovis AF2122/97
cagguuggccaccgccc

SEQ ID NO: 3119858 - RNA, 14 nt, Mycobacterium bovis subsp bovis AF2122/97
cagguuggccccgg

SEQ ID NO: 3119859 - RNA, 15 nt, Mycobacterium bovis subsp bovis AF2122/97
cagguuggccccggc

SEQ ID NO: 3119860 - RNA, 17 nt, Mycobacterium bovis subsp bovis AF2122/97
cagguuggccccggccc

SEQ ID NO: 3119861 - RNA, 18 nt, Mycobacterium bovis subsp bovis AF2122/97
cagguuggccccggcccg

SEQ ID NO: 3119862 - RNA, 20 nt, Mycobacterium bovis subsp bovis AF2122/97
cagguuggcggcugcacgcu

SEQ ID NO: 3119863 - RNA, 20 nt, Mycobacterium bovis subsp bovis AF2122/97
cagguugguaauccgggcaa

SEQ ID NO: 3119864 - RNA, 19 nt, Mycobacterium bovis subsp bovis AF2122/97
cagguuggugcucagcggc

SEQ ID NO: 3119865 - RNA, 17 nt, Mycobacterium bovis subsp bovis AF2122/97
cagguuguaguccgcgc

SEQ ID NO: 3119866 - RNA, 16 nt, Mycobacterium bovis subsp bovis AF2122/97
cagguugugauccugg

SEQ ID NO: 3119867 - RNA, 20 nt, Mycobacterium bovis subsp bovis AF2122/97
cagguuugcgccgcgcagcg

SEQ ID NO: 3119868 - RNA, 14 nt, Mycobacterium bovis subsp bovis AF2122/97
cagguuuucgaucu

SEQ ID NO: 3119869 - RNA, 16 nt, Mycobacterium bovis subsp bovis AF2122/97
caguaaccguccgcgg

SEQ ID NO: 3119870 - RNA, 20 nt, Mycobacterium bovis subsp bovis AF2122/97
caguaauacugccguucggg

SEQ ID NO: 3119871 - RNA, 13 nt, Mycobacterium bovis subsp bovis AF2122/97
caguacaccggcg

SEQ ID NO: 3119872 - RNA, 14 nt, Mycobacterium bovis subsp bovis AF2122/97
caguacaccggcgu

SEQ ID NO: 3119873 - RNA, 20 nt, Mycobacterium bovis subsp bovis AF2122/97
caguaccaccggcaccggcc

SEQ ID NO: 3119874 - RNA, 20 nt, Mycobacterium bovis subsp bovis AF2122/97
caguaccgucaucgcggugu

SEQ ID NO: 3119875 - RNA, 21 nt, Mycobacterium bovis subsp bovis AF2122/97
caguacgcgcugagcgacugc

SEQ ID NO: 3119876 - RNA, 15 nt, Mycobacterium bovis subsp bovis AF2122/97
caguacgguccggcg

SEQ ID NO: 3119877 - RNA, 16 nt, Mycobacterium bovis subsp bovis AF2122/97
caguacgguccggcgu

SEQ ID NO: 3119878 - RNA, 16 nt, Mycobacterium bovis subsp bovis AF2122/97
caguacggugguaaga

SEQ ID NO: 3119879 - RNA, 22 nt, Mycobacterium bovis subsp bovis AF2122/97
caguacggugguaagacgccga

SEQ ID NO: 3119880 - RNA, 21 nt, Mycobacterium bovis subsp bovis AF2122/97
caguacuaacaacaccaccag

SEQ ID NO: 3119881 - RNA, 14 nt, Mycobacterium bovis subsp bovis AF2122/97
caguagaucgcgaa

SEQ ID NO: 3119882 - RNA, 18 nt, Mycobacterium bovis subsp bovis AF2122/97
caguagcagcggcucggc

SEQ ID NO: 3119883 - RNA, 14 nt, Mycobacterium bovis subsp bovis AF2122/97
caguagccacgccc

SEQ ID NO: 3119884 - RNA, 17 nt, Mycobacterium bovis subsp bovis AF2122/97
caguagccacgcccaca

SEQ ID NO: 3119885 - RNA, 20 nt, Mycobacterium bovis subsp bovis AF2122/97
caguagcugcucaucgcgcc

SEQ ID NO: 3119886 - RNA, 22 nt, Mycobacterium bovis subsp bovis AF2122/97
caguagcugcucaucgcgcccg

SEQ ID NO: 3119887 - RNA, 21 nt, Mycobacterium bovis subsp bovis AF2122/97
caguaggccuccgcugccgcc

SEQ ID NO: 3119888 - RNA, 22 nt, Mycobacterium bovis subsp bovis AF2122/97
caguaggccuccgcugccgccc

SEQ ID NO: 3119889 - RNA, 21 nt, Mycobacterium bovis subsp bovis AF2122/97
caguaguagcgcaaccgcgcu

SEQ ID NO: 3119890 - RNA, 16 nt, Mycobacterium bovis subsp bovis AF2122/97
caguaucgaggccgac

SEQ ID NO: 3119891 - RNA, 18 nt, Mycobacterium bovis subsp bovis AF2122/97
caguaucgaggccgacga

SEQ ID NO: 3119892 - RNA, 18 nt, Mycobacterium bovis subsp bovis AF2122/97
caguaugcggugcccgcc

SEQ ID NO: 3119893 - RNA, 13 nt, Mycobacterium bovis subsp bovis AF2122/97
caguauggccgcc

SEQ ID NO: 3119894 - RNA, 18 nt, Mycobacterium bovis subsp bovis AF2122/97
caguauggccgccaccgc

SEQ ID NO: 3119895 - RNA, 20 nt, Mycobacterium bovis subsp bovis AF2122/97
caguauggccgccaccgcga

SEQ ID NO: 3119896 - RNA, 15 nt, Mycobacterium bovis subsp bovis AF2122/97
cagucaacagggcca

SEQ ID NO: 3119897 - RNA, 18 nt, Mycobacterium bovis subsp bovis AF2122/97
cagucaacagggccagga

SEQ ID NO: 3119898 - RNA, 21 nt, Mycobacterium bovis subsp bovis AF2122/97
cagucaacagggccaggacaa

SEQ ID NO: 3119899 - RNA, 18 nt, Mycobacterium bovis subsp bovis AF2122/97
cagucacgcccaccacug

SEQ ID NO: 3119900 - RNA, 16 nt, Mycobacterium bovis subsp bovis AF2122/97
cagucacggaccgcuu

SEQ ID NO: 3119901 - RNA, 16 nt, Mycobacterium bovis subsp bovis AF2122/97
cagucagcuccgcgca

SEQ ID NO: 3119902 - RNA, 13 nt, Mycobacterium bovis subsp bovis AF2122/97
cagucaggaaacc

SEQ ID NO: 3119903 - RNA, 16 nt, Mycobacterium bovis subsp bovis AF2122/97
cagucaggaaaccggc

SEQ ID NO: 3119904 - RNA, 17 nt, Mycobacterium bovis subsp bovis AF2122/97
cagucaggaaaccggcg

SEQ ID NO: 3119905 - RNA, 23 nt, Mycobacterium bovis subsp bovis AF2122/97
cagucaggccuagcgcggcgacg

SEQ ID NO: 3119906 - RNA, 21 nt, Mycobacterium bovis subsp bovis AF2122/97
cagucauguccauagccggca

SEQ ID NO: 3119907 - RNA, 22 nt, Mycobacterium bovis subsp bovis AF2122/97
caguccaaucuucucgagccgc

SEQ ID NO: 3119908 - RNA, 18 nt, Mycobacterium bovis subsp bovis AF2122/97
caguccaccgcgcggcgc

SEQ ID NO: 3119909 - RNA, 24 nt, Mycobacterium bovis subsp bovis AF2122/97
caguccaccgcgcggcgcagcacc

SEQ ID NO: 3119910 - RNA, 19 nt, Mycobacterium bovis subsp bovis AF2122/97
caguccacugaucaggccg

SEQ ID NO: 3119911 - RNA, 12 nt, Mycobacterium bovis subsp bovis AF2122/97
caguccagccgg

SEQ ID NO: 3119912 - RNA, 21 nt, Mycobacterium bovis subsp bovis AF2122/97
caguccagcgcgccacccagc

SEQ ID NO: 3119913 - RNA, 23 nt, Mycobacterium bovis subsp bovis AF2122/97
caguccaggcacuccagcggcgg

SEQ ID NO: 3119914 - RNA, 15 nt, Mycobacterium bovis subsp bovis AF2122/97
cagucccaacacggc

SEQ ID NO: 3119915 - RNA, 21 nt, Mycobacterium bovis subsp bovis AF2122/97
cagucccagcacacccccguc

SEQ ID NO: 3119916 - RNA, 12 nt, Mycobacterium bovis subsp bovis AF2122/97
cagucccccgcu

SEQ ID NO: 3119917 - RNA, 18 nt, Mycobacterium bovis subsp bovis AF2122/97
cagucccccgcucgacca

SEQ ID NO: 3119918 - RNA, 16 nt, Mycobacterium bovis subsp bovis AF2122/97
caguccccgccggccu

SEQ ID NO: 3119919 - RNA, 13 nt, Mycobacterium bovis subsp bovis AF2122/97
cagucccggcgca

SEQ ID NO: 3119920 - RNA, 22 nt, Mycobacterium bovis subsp bovis AF2122/97
cagucccggugggcggcucguc

SEQ ID NO: 3119921 - RNA, 13 nt, Mycobacterium bovis subsp bovis AF2122/97
cagucccgugacg

SEQ ID NO: 3119922 - RNA, 17 nt, Mycobacterium bovis subsp bovis AF2122/97
caguccgaaagccgccg

SEQ ID NO: 3119923 - RNA, 18 nt, Mycobacterium bovis subsp bovis AF2122/97
caguccgaagcugcugcu

SEQ ID NO: 3119924 - RNA, 20 nt, Mycobacterium bovis subsp bovis AF2122/97
caguccgacaccacggacca

SEQ ID NO: 3119925 - RNA, 15 nt, Mycobacterium bovis subsp bovis AF2122/97
caguccgacaccggc

SEQ ID NO: 3119926 - RNA, 18 nt, Mycobacterium bovis subsp bovis AF2122/97
caguccgacaccggcggc

SEQ ID NO: 3119927 - RNA, 23 nt, Mycobacterium bovis subsp bovis AF2122/97
caguccgacaccggcggcaucga

SEQ ID NO: 3119928 - RNA, 21 nt, Mycobacterium bovis subsp bovis AF2122/97
caguccgagcuuggccgccgc

SEQ ID NO: 3119929 - RNA, 16 nt, Mycobacterium bovis subsp bovis AF2122/97
caguccgaucgccgag

SEQ ID NO: 3119930 - RNA, 15 nt, Mycobacterium bovis subsp bovis AF2122/97
caguccgcagcgucc

SEQ ID NO: 3119931 - RNA, 13 nt, Mycobacterium bovis subsp bovis AF2122/97
caguccgcgccgg

SEQ ID NO: 3119932 - RNA, 15 nt, Mycobacterium bovis subsp bovis AF2122/97
caguccgcgccggcg

SEQ ID NO: 3119933 - RNA, 16 nt, Mycobacterium bovis subsp bovis AF2122/97
caguccgcgccggcgg

SEQ ID NO: 3119934 - RNA, 13 nt, Mycobacterium bovis subsp bovis AF2122/97
caguccggacggc

SEQ ID NO: 3119935 - RNA, 15 nt, Mycobacterium bovis subsp bovis AF2122/97
caguccggcccccga

SEQ ID NO: 3119936 - RNA, 17 nt, Mycobacterium bovis subsp bovis AF2122/97
caguccggcccccgacu

SEQ ID NO: 3119937 - RNA, 22 nt, Mycobacterium bovis subsp bovis AF2122/97
caguccggcccccgacuccggc

SEQ ID NO: 3119938 - RNA, 18 nt, Mycobacterium bovis subsp bovis AF2122/97
caguccggcguucccgcc

SEQ ID NO: 3119939 - RNA, 21 nt, Mycobacterium bovis subsp bovis AF2122/97
caguccggggcgcaggucguc

SEQ ID NO: 3119940 - RNA, 15 nt, Mycobacterium bovis subsp bovis AF2122/97
caguccguccagguc

SEQ ID NO: 3119941 - RNA, 14 nt, Mycobacterium bovis subsp bovis AF2122/97
caguccgucggccu

SEQ ID NO: 3119942 - RNA, 16 nt, Mycobacterium bovis subsp bovis AF2122/97
caguccucaucgagcg

SEQ ID NO: 3119943 - RNA, 19 nt, Mycobacterium bovis subsp bovis AF2122/97
caguccucaucgagcgcgc

SEQ ID NO: 3119944 - RNA, 21 nt, Mycobacterium bovis subsp bovis AF2122/97
caguccucaucgagcgcgcga

SEQ ID NO: 3119945 - RNA, 23 nt, Mycobacterium bovis subsp bovis AF2122/97
caguccucaucgagcgcgcgacg

SEQ ID NO: 3119946 - RNA, 22 nt, Mycobacterium bovis subsp bovis AF2122/97
caguccucgggcaggcggccag

SEQ ID NO: 3119947 - RNA, 15 nt, Mycobacterium bovis subsp bovis AF2122/97
cagucgaagaagacc

SEQ ID NO: 3119948 - RNA, 21 nt, Mycobacterium bovis subsp bovis AF2122/97
cagucgaccggacacuccugc

SEQ ID NO: 3119949 - RNA, 14 nt, Mycobacterium bovis subsp bovis AF2122/97
cagucgagcaccug

SEQ ID NO: 3119950 - RNA, 23 nt, Mycobacterium bovis subsp bovis AF2122/97
cagucgagcaccugccgaucggg

SEQ ID NO: 3119951 - RNA, 12 nt, Mycobacterium bovis subsp bovis AF2122/97
cagucgaucgcg

SEQ ID NO: 3119952 - RNA, 15 nt, Mycobacterium bovis subsp bovis AF2122/97
cagucgaucgcggcc

SEQ ID NO: 3119953 - RNA, 19 nt, Mycobacterium bovis subsp bovis AF2122/97
cagucgaucgcggcccgca

SEQ ID NO: 3119954 - RNA, 15 nt, Mycobacterium bovis subsp bovis AF2122/97
cagucgaugagugac

SEQ ID NO: 3119955 - RNA, 18 nt, Mycobacterium bovis subsp bovis AF2122/97
cagucgauguccugccgu

SEQ ID NO: 3119956 - RNA, 17 nt, Mycobacterium bovis subsp bovis AF2122/97
cagucgauuucggcggc

SEQ ID NO: 3119957 - RNA, 19 nt, Mycobacterium bovis subsp bovis AF2122/97
cagucgcaaaagcccccau

SEQ ID NO: 3119958 - RNA, 18 nt, Mycobacterium bovis subsp bovis AF2122/97
cagucgcacggugccgcc

SEQ ID NO: 3119959 - RNA, 19 nt, Mycobacterium bovis subsp bovis AF2122/97
cagucgcacggugccgccg

SEQ ID NO: 3119960 - RNA, 14 nt, Mycobacterium bovis subsp bovis AF2122/97
cagucgcagcacgg

SEQ ID NO: 3119961 - RNA, 20 nt, Mycobacterium bovis subsp bovis AF2122/97
cagucgcagccaggcacguc

SEQ ID NO: 3119962 - RNA, 18 nt, Mycobacterium bovis subsp bovis AF2122/97
cagucgcaggaucggcgg

SEQ ID NO: 3119963 - RNA, 15 nt, Mycobacterium bovis subsp bovis AF2122/97
cagucgccggccggc

SEQ ID NO: 3119964 - RNA, 17 nt, Mycobacterium bovis subsp bovis AF2122/97
cagucgccggccggccc

SEQ ID NO: 3119965 - RNA, 12 nt, Mycobacterium bovis subsp bovis AF2122/97
cagucgcgcgcu

SEQ ID NO: 3119966 - RNA, 15 nt, Mycobacterium bovis subsp bovis AF2122/97
cagucgcgcgcucgc

SEQ ID NO: 3119967 - RNA, 16 nt, Mycobacterium bovis subsp bovis AF2122/97
cagucgcgcgcucgcg

SEQ ID NO: 3119968 - RNA, 12 nt, Mycobacterium bovis subsp bovis AF2122/97
cagucgcggcgc

SEQ ID NO: 3119969 - RNA, 12 nt, Mycobacterium bovis subsp bovis AF2122/97
cagucgcggcgu

SEQ ID NO: 3119970 - RNA, 22 nt, Mycobacterium bovis subsp bovis AF2122/97
cagucgcgguaccaucaccgcg

SEQ ID NO: 3119971 - RNA, 13 nt, Mycobacterium bovis subsp bovis AF2122/97
cagucgcucgcug

SEQ ID NO: 3119972 - RNA, 14 nt, Mycobacterium bovis subsp bovis AF2122/97
cagucgcugggugg

SEQ ID NO: 3119973 - RNA, 22 nt, Mycobacterium bovis subsp bovis AF2122/97
cagucgcuggguggcgggccgg

SEQ ID NO: 3119974 - RNA, 13 nt, Mycobacterium bovis subsp bovis AF2122/97
cagucggccaccu

SEQ ID NO: 3119975 - RNA, 15 nt, Mycobacterium bovis subsp bovis AF2122/97
cagucggcgccgccg

SEQ ID NO: 3119976 - RNA, 12 nt, Mycobacterium bovis subsp bovis AF2122/97
cagucgggcagc

SEQ ID NO: 3119977 - RNA, 14 nt, Mycobacterium bovis subsp bovis AF2122/97
cagucgggcagcgc

SEQ ID NO: 3119978 - RNA, 14 nt, Mycobacterium bovis subsp bovis AF2122/97
cagucgugggcugu

SEQ ID NO: 3119979 - RNA, 23 nt, Mycobacterium bovis subsp bovis AF2122/97
cagucguugaugcuucgaaccgu

SEQ ID NO: 3119980 - RNA, 19 nt, Mycobacterium bovis subsp bovis AF2122/97
cagucucaagguuucgaca

SEQ ID NO: 3119981 - RNA, 14 nt, Mycobacterium bovis subsp bovis AF2122/97
cagucugcgacugg

SEQ ID NO: 3119982 - RNA, 15 nt, Mycobacterium bovis subsp bovis AF2122/97
cagucugggcgaucg

SEQ ID NO: 3119983 - RNA, 17 nt, Mycobacterium bovis subsp bovis AF2122/97
cagucugggcgaucgcu

SEQ ID NO: 3119984 - RNA, 22 nt, Mycobacterium bovis subsp bovis AF2122/97
cagucugggcgaucgcuucgca

SEQ ID NO: 3119985 - RNA, 17 nt, Mycobacterium bovis subsp bovis AF2122/97
cagugaaaccaccggcc

SEQ ID NO: 3119986 - RNA, 20 nt, Mycobacterium bovis subsp bovis AF2122/97
cagugaaauccgagccgcga

SEQ ID NO: 3119987 - RNA, 17 nt, Mycobacterium bovis subsp bovis AF2122/97
cagugaaauugccgccg

SEQ ID NO: 3119988 - RNA, 17 nt, Mycobacterium bovis subsp bovis AF2122/97
cagugaagacaccaggc

SEQ ID NO: 3119989 - RNA, 19 nt, Mycobacterium bovis subsp bovis AF2122/97
cagugaagacaccaggccc

SEQ ID NO: 3119990 - RNA, 22 nt, Mycobacterium bovis subsp bovis AF2122/97
cagugaagacaccaggcccggu

SEQ ID NO: 3119991 - RNA, 16 nt, Mycobacterium bovis subsp bovis AF2122/97
cagugaauugcccaag

SEQ ID NO: 3119992 - RNA, 17 nt, Mycobacterium bovis subsp bovis AF2122/97
cagugacagugcgucga

SEQ ID NO: 3119993 - RNA, 16 nt, Mycobacterium bovis subsp bovis AF2122/97
cagugaccgcuggugu

SEQ ID NO: 3119994 - RNA, 15 nt, Mycobacterium bovis subsp bovis AF2122/97
cagugaccucgucgg

SEQ ID NO: 3119995 - RNA, 20 nt, Mycobacterium bovis subsp bovis AF2122/97
cagugaccugggcgccccag

SEQ ID NO: 3119996 - RNA, 14 nt, Mycobacterium bovis subsp bovis AF2122/97
cagugacgccacga

SEQ ID NO: 3119997 - RNA, 17 nt, Mycobacterium bovis subsp bovis AF2122/97
cagugacgccacgaccg

SEQ ID NO: 3119998 - RNA, 21 nt, Mycobacterium bovis subsp bovis AF2122/97
cagugacgccucgacacccag

SEQ ID NO: 3119999 - RNA, 22 nt, Mycobacterium bovis subsp bovis AF2122/97
cagugacgccucgacacccagc

SEQ ID NO: 3120000 - RNA, 20 nt, Mycobacterium bovis subsp bovis AF2122/97
cagugacguuccgcucgccg

SEQ ID NO: 3120001 - RNA, 14 nt, Mycobacterium bovis subsp bovis AF2122/97
cagugagcagccgg

SEQ ID NO: 3120002 - RNA, 19 nt, Mycobacterium bovis subsp bovis AF2122/97
cagugagcagccggaccgu

SEQ ID NO: 3120003 - RNA, 13 nt, Mycobacterium bovis subsp bovis AF2122/97
cagugagcccgcu

SEQ ID NO: 3120004 - RNA, 13 nt, Mycobacterium bovis subsp bovis AF2122/97
cagugagccgcca

SEQ ID NO: 3120005 - RNA, 15 nt, Mycobacterium bovis subsp bovis AF2122/97
cagugagccgccauu

SEQ ID NO: 3120006 - RNA, 20 nt, Mycobacterium bovis subsp bovis AF2122/97
cagugagggucccacggcgg

SEQ ID NO: 3120007 - RNA, 15 nt, Mycobacterium bovis subsp bovis AF2122/97
cagugaucaccaacc

SEQ ID NO: 3120008 - RNA, 16 nt, Mycobacterium bovis subsp bovis AF2122/97
cagugaucaccaaccc

SEQ ID NO: 3120009 - RNA, 15 nt, Mycobacterium bovis subsp bovis AF2122/97
cagugaugcgccccg

SEQ ID NO: 3120010 - RNA, 23 nt, Mycobacterium bovis subsp bovis AF2122/97
cagugauucggccugagcggcca

SEQ ID NO: 3120011 - RNA, 22 nt, Mycobacterium bovis subsp bovis AF2122/97
cagugauugagcagcaagccgc

SEQ ID NO: 3120012 - RNA, 20 nt, Mycobacterium bovis subsp bovis AF2122/97
cagugcaagaccgcaucggc

SEQ ID NO: 3120013 - RNA, 13 nt, Mycobacterium bovis subsp bovis AF2122/97
cagugcaccgcgu

SEQ ID NO: 3120014 - RNA, 16 nt, Mycobacterium bovis subsp bovis AF2122/97
cagugcagacaggcgg

SEQ ID NO: 3120015 - RNA, 21 nt, Mycobacterium bovis subsp bovis AF2122/97
cagugcagacaggcggcggcc

SEQ ID NO: 3120016 - RNA, 23 nt, Mycobacterium bovis subsp bovis AF2122/97
cagugcagacaggcggcggccug

SEQ ID NO: 3120017 - RNA, 17 nt, Mycobacterium bovis subsp bovis AF2122/97
cagugcagcaacacgau

SEQ ID NO: 3120018 - RNA, 17 nt, Mycobacterium bovis subsp bovis AF2122/97
cagugcagcgaucccgg

SEQ ID NO: 3120019 - RNA, 14 nt, Mycobacterium bovis subsp bovis AF2122/97
cagugcaggcggcc

SEQ ID NO: 3120020 - RNA, 16 nt, Mycobacterium bovis subsp bovis AF2122/97
cagugcaggcggccgc

SEQ ID NO: 3120021 - RNA, 18 nt, Mycobacterium bovis subsp bovis AF2122/97
cagugcaggcggccgcca

SEQ ID NO: 3120022 - RNA, 16 nt, Mycobacterium bovis subsp bovis AF2122/97
cagugcaucgaucacc

SEQ ID NO: 3120023 - RNA, 19 nt, Mycobacterium bovis subsp bovis AF2122/97
cagugcaucgaucaccgcu

SEQ ID NO: 3120024 - RNA, 12 nt, Mycobacterium bovis subsp bovis AF2122/97
cagugcaucggu

SEQ ID NO: 3120025 - RNA, 15 nt, Mycobacterium bovis subsp bovis AF2122/97
cagugcaucggucag

SEQ ID NO: 3120026 - RNA, 23 nt, Mycobacterium bovis subsp bovis AF2122/97
cagugcaucggucagcgccgacu

SEQ ID NO: 3120027 - RNA, 16 nt, Mycobacterium bovis subsp bovis AF2122/97
cagugccaaagcggca

SEQ ID NO: 3120028 - RNA, 19 nt, Mycobacterium bovis subsp bovis AF2122/97
cagugccaauuccagcccc

SEQ ID NO: 3120029 - RNA, 15 nt, Mycobacterium bovis subsp bovis AF2122/97
cagugccaccugggc

SEQ ID NO: 3120030 - RNA, 17 nt, Mycobacterium bovis subsp bovis AF2122/97
cagugccaccugggcgg

SEQ ID NO: 3120031 - RNA, 18 nt, Mycobacterium bovis subsp bovis AF2122/97
cagugccacgccugagcc

SEQ ID NO: 3120032 - RNA, 20 nt, Mycobacterium bovis subsp bovis AF2122/97
cagugccagaacccggacag

SEQ ID NO: 3120033 - RNA, 22 nt, Mycobacterium bovis subsp bovis AF2122/97
cagugccagaacccggacaggg

SEQ ID NO: 3120034 - RNA, 19 nt, Mycobacterium bovis subsp bovis AF2122/97
cagugccaggugggugaac

SEQ ID NO: 3120035 - RNA, 20 nt, Mycobacterium bovis subsp bovis AF2122/97
cagugccagugccagcgucc

SEQ ID NO: 3120036 - RNA, 14 nt, Mycobacterium bovis subsp bovis AF2122/97
cagugccaucgcca

SEQ ID NO: 3120037 - RNA, 14 nt, Mycobacterium bovis subsp bovis AF2122/97
cagugccccgcccg

SEQ ID NO: 3120038 - RNA, 15 nt, Mycobacterium bovis subsp bovis AF2122/97
cagugccccgccgag

SEQ ID NO: 3120039 - RNA, 17 nt, Mycobacterium bovis subsp bovis AF2122/97
cagugccccgccgagcg

SEQ ID NO: 3120040 - RNA, 19 nt, Mycobacterium bovis subsp bovis AF2122/97
cagugccccgccgagcggu

SEQ ID NO: 3120041 - RNA, 16 nt, Mycobacterium bovis subsp bovis AF2122/97
cagugcccgcacugcc

SEQ ID NO: 3120042 - RNA, 18 nt, Mycobacterium bovis subsp bovis AF2122/97
cagugcccgcacugccgc

SEQ ID NO: 3120043 - RNA, 21 nt, Mycobacterium bovis subsp bovis AF2122/97
cagugcccgcacugccgccgg

SEQ ID NO: 3120044 - RNA, 22 nt, Mycobacterium bovis subsp bovis AF2122/97
cagugccgcacccagaccgccg

SEQ ID NO: 3120045 - RNA, 23 nt, Mycobacterium bovis subsp bovis AF2122/97
cagugccgcacccagaccgccga

SEQ ID NO: 3120046 - RNA, 12 nt, Mycobacterium bovis subsp bovis AF2122/97
cagugccgugcu

SEQ ID NO: 3120047 - RNA, 16 nt, Mycobacterium bovis subsp bovis AF2122/97
cagugccgugcugaac

SEQ ID NO: 3120048 - RNA, 20 nt, Mycobacterium bovis subsp bovis AF2122/97
cagugccguguccagcaugc

SEQ ID NO: 3120049 - RNA, 12 nt, Mycobacterium bovis subsp bovis AF2122/97
cagugccucgcg

SEQ ID NO: 3120050 - RNA, 18 nt, Mycobacterium bovis subsp bovis AF2122/97
cagugccucggcggcguu

SEQ ID NO: 3120051 - RNA, 23 nt, Mycobacterium bovis subsp bovis AF2122/97
cagugcgaacucaucgugguaac

SEQ ID NO: 3120052 - RNA, 17 nt, Mycobacterium bovis subsp bovis AF2122/97
cagugcgacccgggcgu

SEQ ID NO: 3120053 - RNA, 20 nt, Mycobacterium bovis subsp bovis AF2122/97
cagugcgacguaaagggcgu

SEQ ID NO: 3120054 - RNA, 21 nt, Mycobacterium bovis subsp bovis AF2122/97
cagugcgcaacccagccgcgc

SEQ ID NO: 3120055 - RNA, 23 nt, Mycobacterium bovis subsp bovis AF2122/97
cagugcgcaacccagccgcgcca

SEQ ID NO: 3120056 - RNA, 14 nt, Mycobacterium bovis subsp bovis AF2122/97
cagugcgcagaaca

SEQ ID NO: 3120057 - RNA, 16 nt, Mycobacterium bovis subsp bovis AF2122/97
cagugcgcagaacacc

SEQ ID NO: 3120058 - RNA, 21 nt, Mycobacterium bovis subsp bovis AF2122/97
cagugcgcagaacaccaccgc

SEQ ID NO: 3120059 - RNA, 22 nt, Mycobacterium bovis subsp bovis AF2122/97
cagugcgcagaacaccaccgcc

SEQ ID NO: 3120060 - RNA, 23 nt, Mycobacterium bovis subsp bovis AF2122/97
cagugcgcagaacaccaccgcca

SEQ ID NO: 3120061 - RNA, 22 nt, Mycobacterium bovis subsp bovis AF2122/97
cagugcgcggaucaacaggccg

SEQ ID NO: 3120062 - RNA, 17 nt, Mycobacterium bovis subsp bovis AF2122/97
cagugcggccuuggcga

SEQ ID NO: 3120063 - RNA, 15 nt, Mycobacterium bovis subsp bovis AF2122/97
cagugcgggcggcgu

SEQ ID NO: 3120064 - RNA, 17 nt, Mycobacterium bovis subsp bovis AF2122/97
cagugcggucccgacca

SEQ ID NO: 3120065 - RNA, 18 nt, Mycobacterium bovis subsp bovis AF2122/97
cagugcgguggcagguga

SEQ ID NO: 3120066 - RNA, 20 nt, Mycobacterium bovis subsp bovis AF2122/97
cagugcucaucgacaaucgc

SEQ ID NO: 3120067 - RNA, 12 nt, Mycobacterium bovis subsp bovis AF2122/97
cagugcucccga

SEQ ID NO: 3120068 - RNA, 11 nt, Mycobacterium bovis subsp bovis AF2122/97
cagugcucgca

SEQ ID NO: 3120069 - RNA, 15 nt, Mycobacterium bovis subsp bovis AF2122/97
cagugcucgcccagu

SEQ ID NO: 3120070 - RNA, 20 nt, Mycobacterium bovis subsp bovis AF2122/97
cagugcugcaccgauucggg

SEQ ID NO: 3120071 - RNA, 12 nt, Mycobacterium bovis subsp bovis AF2122/97
cagugcugccuu

SEQ ID NO: 3120072 - RNA, 15 nt, Mycobacterium bovis subsp bovis AF2122/97
caguggauccggcag

SEQ ID NO: 3120073 - RNA, 20 nt, Mycobacterium bovis subsp bovis AF2122/97
caguggauccggcagcagcc

SEQ ID NO: 3120074 - RNA, 17 nt, Mycobacterium bovis subsp bovis AF2122/97
caguggaugcauacacg

SEQ ID NO: 3120075 - RNA, 20 nt, Mycobacterium bovis subsp bovis AF2122/97
caguggcaagcugucgucgc

SEQ ID NO: 3120076 - RNA, 22 nt, Mycobacterium bovis subsp bovis AF2122/97
caguggccaccaucaccucgca

SEQ ID NO: 3120077 - RNA, 13 nt, Mycobacterium bovis subsp bovis AF2122/97
caguggccgccgg

SEQ ID NO: 3120078 - RNA, 13 nt, Mycobacterium bovis subsp bovis AF2122/97
caguggcgacgag

SEQ ID NO: 3120079 - RNA, 15 nt, Mycobacterium bovis subsp bovis AF2122/97
caguggcgcauuggc

SEQ ID NO: 3120080 - RNA, 19 nt, Mycobacterium bovis subsp bovis AF2122/97
caguggcgcccauggccac

SEQ ID NO: 3120081 - RNA, 11 nt, Mycobacterium bovis subsp bovis AF2122/97
caguggcgcgg

SEQ ID NO: 3120082 - RNA, 20 nt, Mycobacterium bovis subsp bovis AF2122/97
caguggcgcguaggcccaac

SEQ ID NO: 3120083 - RNA, 17 nt, Mycobacterium bovis subsp bovis AF2122/97
caguggcguuacgcucg

SEQ ID NO: 3120084 - RNA, 21 nt, Mycobacterium bovis subsp bovis AF2122/97
caguggcguuacgcucggcga

SEQ ID NO: 3120085 - RNA, 23 nt, Mycobacterium bovis subsp bovis AF2122/97
cagugggacaaagacgccgucgg

SEQ ID NO: 3120086 - RNA, 15 nt, Mycobacterium bovis subsp bovis AF2122/97
cagugggacgggcgc

SEQ ID NO: 3120087 - RNA, 17 nt, Mycobacterium bovis subsp bovis AF2122/97
cagugggacuggcguga

SEQ ID NO: 3120088 - RNA, 22 nt, Mycobacterium bovis subsp bovis AF2122/97
cagugggcaauccggucagcgc

SEQ ID NO: 3120089 - RNA, 21 nt, Mycobacterium bovis subsp bovis AF2122/97
cagugggcgguugaucgccgg

SEQ ID NO: 3120090 - RNA, 22 nt, Mycobacterium bovis subsp bovis AF2122/97
cagugggcgguugaucgccggc

SEQ ID NO: 3120091 - RNA, 20 nt, Mycobacterium bovis subsp bovis AF2122/97
caguggggguccggcggccg

SEQ ID NO: 3120092 - RNA, 22 nt, Mycobacterium bovis subsp bovis AF2122/97
cagugggggugguaccggcggc

SEQ ID NO: 3120093 - RNA, 20 nt, Mycobacterium bovis subsp bovis AF2122/97
caguggucgauuucggcgcg

SEQ ID NO: 3120094 - RNA, 17 nt, Mycobacterium bovis subsp bovis AF2122/97
caguggucggcuccgcg

SEQ ID NO: 3120095 - RNA, 17 nt, Mycobacterium bovis subsp bovis AF2122/97
cagugguuacagaugaa

SEQ ID NO: 3120096 - RNA, 18 nt, Mycobacterium bovis subsp bovis AF2122/97
caguguacaccgcgcccg

SEQ ID NO: 3120097 - RNA, 19 nt, Mycobacterium bovis subsp bovis AF2122/97
caguguacaccgcgcccgc

SEQ ID NO: 3120098 - RNA, 23 nt, Mycobacterium bovis subsp bovis AF2122/97
cagugucagcaagaucggcagcg

SEQ ID NO: 3120099 - RNA, 17 nt, Mycobacterium bovis subsp bovis AF2122/97
cagugucguggucgugg

SEQ ID NO: 3120100 - RNA, 19 nt, Mycobacterium bovis subsp bovis AF2122/97
cagugugaagaccaccgcc

SEQ ID NO: 3120101 - RNA, 22 nt, Mycobacterium bovis subsp bovis AF2122/97
cagugugcgguuggaucggcgg

SEQ ID NO: 3120102 - RNA, 21 nt, Mycobacterium bovis subsp bovis AF2122/97
caguguggcgaugaccacgcc

SEQ ID NO: 3120103 - RNA, 17 nt, Mycobacterium bovis subsp bovis AF2122/97
caguguggugcggcgcg

SEQ ID NO: 3120104 - RNA, 18 nt, Mycobacterium bovis subsp bovis AF2122/97
caguguuccgccacccgc

SEQ ID NO: 3120105 - RNA, 17 nt, Mycobacterium bovis subsp bovis AF2122/97
caguguugcaguggcga

SEQ ID NO: 3120106 - RNA, 15 nt, Mycobacterium bovis subsp bovis AF2122/97
caguguugcgcugcg

SEQ ID NO: 3120107 - RNA, 16 nt, Mycobacterium bovis subsp bovis AF2122/97
caguguugcgcugcgg

SEQ ID NO: 3120108 - RNA, 18 nt, Mycobacterium bovis subsp bovis AF2122/97
caguguugcgcugcggcc

SEQ ID NO: 3120109 - RNA, 14 nt, Mycobacterium bovis subsp bovis AF2122/97
caguucaccgcgcu

SEQ ID NO: 3120110 - RNA, 18 nt, Mycobacterium bovis subsp bovis AF2122/97
caguucacgcucgacgac

SEQ ID NO: 3120111 - RNA, 20 nt, Mycobacterium bovis subsp bovis AF2122/97
caguucaucgggcaccaacc

SEQ ID NO: 3120112 - RNA, 20 nt, Mycobacterium bovis subsp bovis AF2122/97
caguuccacccggugccgca

SEQ ID NO: 3120113 - RNA, 13 nt, Mycobacterium bovis subsp bovis AF2122/97
caguuccaccgcg

SEQ ID NO: 3120114 - RNA, 14 nt, Mycobacterium bovis subsp bovis AF2122/97
caguuccagcucgc

SEQ ID NO: 3120115 - RNA, 17 nt, Mycobacterium bovis subsp bovis AF2122/97
caguucccagaccaccg

SEQ ID NO: 3120116 - RNA, 15 nt, Mycobacterium bovis subsp bovis AF2122/97
caguuccccgggcuc

SEQ ID NO: 3120117 - RNA, 22 nt, Mycobacterium bovis subsp bovis AF2122/97
caguucccgaaccccgaccgcu

SEQ ID NO: 3120118 - RNA, 19 nt, Mycobacterium bovis subsp bovis AF2122/97
caguucccggccauagccc

SEQ ID NO: 3120119 - RNA, 16 nt, Mycobacterium bovis subsp bovis AF2122/97
caguucccuacaccca

SEQ ID NO: 3120120 - RNA, 21 nt, Mycobacterium bovis subsp bovis AF2122/97
caguuccgcggcgaguggcuc

SEQ ID NO: 3120121 - RNA, 18 nt, Mycobacterium bovis subsp bovis AF2122/97
caguuccgcugcggugcc

SEQ ID NO: 3120122 - RNA, 13 nt, Mycobacterium bovis subsp bovis AF2122/97
caguuccggugac

SEQ ID NO: 3120123 - RNA, 17 nt, Mycobacterium bovis subsp bovis AF2122/97
caguucgacggcgucaa

SEQ ID NO: 3120124 - RNA, 12 nt, Mycobacterium bovis subsp bovis AF2122/97
caguucgccgcg

SEQ ID NO: 3120125 - RNA, 15 nt, Mycobacterium bovis subsp bovis AF2122/97
caguucgcgccacgc

SEQ ID NO: 3120126 - RNA, 13 nt, Mycobacterium bovis subsp bovis AF2122/97
caguucgcgccgu

SEQ ID NO: 3120127 - RNA, 18 nt, Mycobacterium bovis subsp bovis AF2122/97
caguucgcgccguggcgu

SEQ ID NO: 3120128 - RNA, 19 nt, Mycobacterium bovis subsp bovis AF2122/97
caguucgcgccguggcguc

SEQ ID NO: 3120129 - RNA, 21 nt, Mycobacterium bovis subsp bovis AF2122/97
caguucgcgccguggcgucgg

SEQ ID NO: 3120130 - RNA, 22 nt, Mycobacterium bovis subsp bovis AF2122/97
caguucgcgccguggcgucggu

SEQ ID NO: 3120131 - RNA, 17 nt, Mycobacterium bovis subsp bovis AF2122/97
caguucggccgucaugg

SEQ ID NO: 3120132 - RNA, 15 nt, Mycobacterium bovis subsp bovis AF2122/97
caguucggcgaugcg

SEQ ID NO: 3120133 - RNA, 20 nt, Mycobacterium bovis subsp bovis AF2122/97
caguucggcgaugcgcgggu

SEQ ID NO: 3120134 - RNA, 14 nt, Mycobacterium bovis subsp bovis AF2122/97
caguucggcggccg

SEQ ID NO: 3120135 - RNA, 18 nt, Mycobacterium bovis subsp bovis AF2122/97
caguucggcggccgccgc

SEQ ID NO: 3120136 - RNA, 13 nt, Mycobacterium bovis subsp bovis AF2122/97
caguucggcgucg

SEQ ID NO: 3120137 - RNA, 16 nt, Mycobacterium bovis subsp bovis AF2122/97
caguucguggcuggca

SEQ ID NO: 3120138 - RNA, 22 nt, Mycobacterium bovis subsp bovis AF2122/97
caguucgugggucaacgucagg

SEQ ID NO: 3120139 - RNA, 17 nt, Mycobacterium bovis subsp bovis AF2122/97
caguucucgcgcuugcg

SEQ ID NO: 3120140 - RNA, 17 nt, Mycobacterium bovis subsp bovis AF2122/97
caguucucggucccgcc

SEQ ID NO: 3120141 - RNA, 20 nt, Mycobacterium bovis subsp bovis AF2122/97
caguucuugauuagccauua

SEQ ID NO: 3120142 - RNA, 16 nt, Mycobacterium bovis subsp bovis AF2122/97
caguugaacucgacca

SEQ ID NO: 3120143 - RNA, 22 nt, Mycobacterium bovis subsp bovis AF2122/97
caguugaacucgaccaccgccg

SEQ ID NO: 3120144 - RNA, 12 nt, Mycobacterium bovis subsp bovis AF2122/97
caguugacccau

SEQ ID NO: 3120145 - RNA, 20 nt, Mycobacterium bovis subsp bovis AF2122/97
caguugaucaggccgaugcg

SEQ ID NO: 3120146 - RNA, 23 nt, Mycobacterium bovis subsp bovis AF2122/97
caguugaugcggaugucgucgac

SEQ ID NO: 3120147 - RNA, 19 nt, Mycobacterium bovis subsp bovis AF2122/97
caguugcacaccgaucggc

SEQ ID NO: 3120148 - RNA, 20 nt, Mycobacterium bovis subsp bovis AF2122/97
caguugcacaccgaucggca

SEQ ID NO: 3120149 - RNA, 20 nt, Mycobacterium bovis subsp bovis AF2122/97
caguugcacaccggcacugc

SEQ ID NO: 3120150 - RNA, 13 nt, Mycobacterium bovis subsp bovis AF2122/97
caguugcccgacg

SEQ ID NO: 3120151 - RNA, 17 nt, Mycobacterium bovis subsp bovis AF2122/97
caguugcccgacgccgg

SEQ ID NO: 3120152 - RNA, 21 nt, Mycobacterium bovis subsp bovis AF2122/97
caguugcccgacgccggucac

SEQ ID NO: 3120153 - RNA, 16 nt, Mycobacterium bovis subsp bovis AF2122/97
caguugcgcuccaaca

SEQ ID NO: 3120154 - RNA, 21 nt, Mycobacterium bovis subsp bovis AF2122/97
caguugcguuguccaccauca

SEQ ID NO: 3120155 - RNA, 23 nt, Mycobacterium bovis subsp bovis AF2122/97
caguugcguuguccaccaucaac

SEQ ID NO: 3120156 - RNA, 21 nt, Mycobacterium bovis subsp bovis AF2122/97
caguuggaacugaugaaccac

SEQ ID NO: 3120157 - RNA, 15 nt, Mycobacterium bovis subsp bovis AF2122/97
caguuggaacugccc

SEQ ID NO: 3120158 - RNA, 15 nt, Mycobacterium bovis subsp bovis AF2122/97
caguuggcaccagcc

SEQ ID NO: 3120159 - RNA, 16 nt, Mycobacterium bovis subsp bovis AF2122/97
caguuggcaccagccg

SEQ ID NO: 3120160 - RNA, 17 nt, Mycobacterium bovis subsp bovis AF2122/97
caguuggcagcgcuggc

SEQ ID NO: 3120161 - RNA, 20 nt, Mycobacterium bovis subsp bovis AF2122/97
caguuggccaugcaccgaug

SEQ ID NO: 3120162 - RNA, 15 nt, Mycobacterium bovis subsp bovis AF2122/97
caguugggccucagc

SEQ ID NO: 3120163 - RNA, 18 nt, Mycobacterium bovis subsp bovis AF2122/97
caguugguagagcaccag

SEQ ID NO: 3120164 - RNA, 19 nt, Mycobacterium bovis subsp bovis AF2122/97
caguugguagagcaccagg

SEQ ID NO: 3120165 - RNA, 16 nt, Mycobacterium bovis subsp bovis AF2122/97
caguugguagccgccc

SEQ ID NO: 3120166 - RNA, 19 nt, Mycobacterium bovis subsp bovis AF2122/97
caguugguagccgcccucc

SEQ ID NO: 3120167 - RNA, 22 nt, Mycobacterium bovis subsp bovis AF2122/97
caguuguauuccgggguaucga

SEQ ID NO: 3120168 - RNA, 21 nt, Mycobacterium bovis subsp bovis AF2122/97
caguuucggcgucgucgacgg

SEQ ID NO: 3120169 - RNA, 16 nt, Mycobacterium bovis subsp bovis AF2122/97
caguuugugccgccgc

SEQ ID NO: 3120170 - RNA, 15 nt, Mycobacterium bovis subsp bovis AF2122/97
caguuuucaccgcga

SEQ ID NO: 3120171 - RNA, 13 nt, Mycobacterium bovis subsp bovis AF2122/97
cauaaaccgcguc

SEQ ID NO: 3120172 - RNA, 20 nt, Mycobacterium bovis subsp bovis AF2122/97
cauaaaccgcguccgcgcgu

SEQ ID NO: 3120173 - RNA, 17 nt, Mycobacterium bovis subsp bovis AF2122/97
cauaaaugcgcguucga

SEQ ID NO: 3120174 - RNA, 20 nt, Mycobacterium bovis subsp bovis AF2122/97
cauaacccuggccggugcgc

SEQ ID NO: 3120175 - RNA, 16 nt, Mycobacterium bovis subsp bovis AF2122/97
cauaaccggcgcgccc

SEQ ID NO: 3120176 - RNA, 18 nt, Mycobacterium bovis subsp bovis AF2122/97
cauaacgcgaacccgcga

SEQ ID NO: 3120177 - RNA, 20 nt, Mycobacterium bovis subsp bovis AF2122/97
cauaacgcgaacccgcgagg

SEQ ID NO: 3120178 - RNA, 15 nt, Mycobacterium bovis subsp bovis AF2122/97
cauaagcccccgaca

SEQ ID NO: 3120179 - RNA, 20 nt, Mycobacterium bovis subsp bovis AF2122/97
cauaagcccccgacacgccg

SEQ ID NO: 3120180 - RNA, 23 nt, Mycobacterium bovis subsp bovis AF2122/97
cauaagcccccgcacgcacggcg

SEQ ID NO: 3120181 - RNA, 24 nt, Mycobacterium bovis subsp bovis AF2122/97
cauaagcccccgcacgcacggcgu

SEQ ID NO: 3120182 - RNA, 23 nt, Mycobacterium bovis subsp bovis AF2122/97
cauaagcccccgcacgcucgccc

SEQ ID NO: 3120183 - RNA, 14 nt, Mycobacterium bovis subsp bovis AF2122/97
cauaaggcgugacg

SEQ ID NO: 3120184 - RNA, 16 nt, Mycobacterium bovis subsp bovis AF2122/97
cauacaaccccgcgcu

SEQ ID NO: 3120185 - RNA, 15 nt, Mycobacterium bovis subsp bovis AF2122/97
cauacacaacgccau

SEQ ID NO: 3120186 - RNA, 22 nt, Mycobacterium bovis subsp bovis AF2122/97
cauacacaacgccaugugugca

SEQ ID NO: 3120187 - RNA, 15 nt, Mycobacterium bovis subsp bovis AF2122/97
cauacaccggccggu

SEQ ID NO: 3120188 - RNA, 12 nt, Mycobacterium bovis subsp bovis AF2122/97
cauacacgguag

SEQ ID NO: 3120189 - RNA, 15 nt, Mycobacterium bovis subsp bovis AF2122/97
cauacagcaggccgc

SEQ ID NO: 3120190 - RNA, 13 nt, Mycobacterium bovis subsp bovis AF2122/97
cauacagccgccg

SEQ ID NO: 3120191 - RNA, 12 nt, Mycobacterium bovis subsp bovis AF2122/97
cauacagccggc

SEQ ID NO: 3120192 - RNA, 15 nt, Mycobacterium bovis subsp bovis AF2122/97
cauacagcgcccgga

SEQ ID NO: 3120193 - RNA, 21 nt, Mycobacterium bovis subsp bovis AF2122/97
cauacaggcccgccagcaggg

SEQ ID NO: 3120194 - RNA, 20 nt, Mycobacterium bovis subsp bovis AF2122/97
cauacaucgccuugcccagc

SEQ ID NO: 3120195 - RNA, 17 nt, Mycobacterium bovis subsp bovis AF2122/97
cauacccagcucgucgc

SEQ ID NO: 3120196 - RNA, 19 nt, Mycobacterium bovis subsp bovis AF2122/97
cauaccgaugguggugcca

SEQ ID NO: 3120197 - RNA, 23 nt, Mycobacterium bovis subsp bovis AF2122/97
cauaccgaugguggugccaaccu

SEQ ID NO: 3120198 - RNA, 22 nt, Mycobacterium bovis subsp bovis AF2122/97
cauaccgcaauggcggccuugc

SEQ ID NO: 3120199 - RNA, 14 nt, Mycobacterium bovis subsp bovis AF2122/97
cauaccggccgcca

SEQ ID NO: 3120200 - RNA, 18 nt, Mycobacterium bovis subsp bovis AF2122/97
cauaccggccgccaucau

SEQ ID NO: 3120201 - RNA, 11 nt, Mycobacterium bovis subsp bovis AF2122/97
cauaccggcgc

SEQ ID NO: 3120202 - RNA, 17 nt, Mycobacterium bovis subsp bovis AF2122/97
cauaccguucacccagc

SEQ ID NO: 3120203 - RNA, 17 nt, Mycobacterium bovis subsp bovis AF2122/97
cauacgaacucaccgcc

SEQ ID NO: 3120204 - RNA, 18 nt, Mycobacterium bovis subsp bovis AF2122/97
cauacgaacucaccgcca

SEQ ID NO: 3120205 - RNA, 18 nt, Mycobacterium bovis subsp bovis AF2122/97
cauacgacagcccgccgg

SEQ ID NO: 3120206 - RNA, 17 nt, Mycobacterium bovis subsp bovis AF2122/97
cauacgagcagugaccg

SEQ ID NO: 3120207 - RNA, 20 nt, Mycobacterium bovis subsp bovis AF2122/97
cauacgagcagugaccgcug

SEQ ID NO: 3120208 - RNA, 23 nt, Mycobacterium bovis subsp bovis AF2122/97
cauacgccaaguacgcgaccgcg

SEQ ID NO: 3120209 - RNA, 19 nt, Mycobacterium bovis subsp bovis AF2122/97
cauacgcccacuccagcag

SEQ ID NO: 3120210 - RNA, 22 nt, Mycobacterium bovis subsp bovis AF2122/97
cauacgcccacuccagcagcuc

SEQ ID NO: 3120211 - RNA, 14 nt, Mycobacterium bovis subsp bovis AF2122/97
cauacgccggccgc

SEQ ID NO: 3120212 - RNA, 16 nt, Mycobacterium bovis subsp bovis AF2122/97
cauacgcgcgcggucg

SEQ ID NO: 3120213 - RNA, 21 nt, Mycobacterium bovis subsp bovis AF2122/97
cauacgucggggccgcacugu

SEQ ID NO: 3120214 - RNA, 12 nt, Mycobacterium bovis subsp bovis AF2122/97
cauacucggcgg

SEQ ID NO: 3120215 - RNA, 19 nt, Mycobacterium bovis subsp bovis AF2122/97
cauacucugcgacaccacg

SEQ ID NO: 3120216 - RNA, 21 nt, Mycobacterium bovis subsp bovis AF2122/97
cauacuggcgguccgaugcgc

SEQ ID NO: 3120217 - RNA, 16 nt, Mycobacterium bovis subsp bovis AF2122/97
cauacuugcgccgacu

SEQ ID NO: 3120218 - RNA, 20 nt, Mycobacterium bovis subsp bovis AF2122/97
cauagaaauacaggcccggc

SEQ ID NO: 3120219 - RNA, 16 nt, Mycobacterium bovis subsp bovis AF2122/97
cauagaacucgccgcu

SEQ ID NO: 3120220 - RNA, 17 nt, Mycobacterium bovis subsp bovis AF2122/97
cauagaacucgccgcug

SEQ ID NO: 3120221 - RNA, 21 nt, Mycobacterium bovis subsp bovis AF2122/97
cauagacagggccgcucgccu

SEQ ID NO: 3120222 - RNA, 16 nt, Mycobacterium bovis subsp bovis AF2122/97
cauagaccaccggcag

SEQ ID NO: 3120223 - RNA, 20 nt, Mycobacterium bovis subsp bovis AF2122/97
cauagaccucgccggugacg

SEQ ID NO: 3120224 - RNA, 14 nt, Mycobacterium bovis subsp bovis AF2122/97
cauagagcggcacc

SEQ ID NO: 3120225 - RNA, 16 nt, Mycobacterium bovis subsp bovis AF2122/97
cauagagcggcaccag

SEQ ID NO: 3120226 - RNA, 19 nt, Mycobacterium bovis subsp bovis AF2122/97
cauagcaauccgcacagcg

SEQ ID NO: 3120227 - RNA, 22 nt, Mycobacterium bovis subsp bovis AF2122/97
cauagcaccucgaugaugcgcu

SEQ ID NO: 3120228 - RNA, 15 nt, Mycobacterium bovis subsp bovis AF2122/97
cauagccacgcaagc

SEQ ID NO: 3120229 - RNA, 17 nt, Mycobacterium bovis subsp bovis AF2122/97
cauagccacgcaagcaa

SEQ ID NO: 3120230 - RNA, 17 nt, Mycobacterium bovis subsp bovis AF2122/97
cauagccgaacagcgga

SEQ ID NO: 3120231 - RNA, 15 nt, Mycobacterium bovis subsp bovis AF2122/97
cauagccgcgacccg

SEQ ID NO: 3120232 - RNA, 18 nt, Mycobacterium bovis subsp bovis AF2122/97
cauagccguugcgggcca

SEQ ID NO: 3120233 - RNA, 21 nt, Mycobacterium bovis subsp bovis AF2122/97
cauagccguugcgggccaggc

SEQ ID NO: 3120234 - RNA, 16 nt, Mycobacterium bovis subsp bovis AF2122/97
cauagccugcgccgac

SEQ ID NO: 3120235 - RNA, 17 nt, Mycobacterium bovis subsp bovis AF2122/97
cauagccugcgccgacc

SEQ ID NO: 3120236 - RNA, 21 nt, Mycobacterium bovis subsp bovis AF2122/97
cauagcgacggcgcucggcga

SEQ ID NO: 3120237 - RNA, 14 nt, Mycobacterium bovis subsp bovis AF2122/97
cauagcgccgcgcc

SEQ ID NO: 3120238 - RNA, 15 nt, Mycobacterium bovis subsp bovis AF2122/97
cauagcgccgcgccc

SEQ ID NO: 3120239 - RNA, 17 nt, Mycobacterium bovis subsp bovis AF2122/97
cauagcgccgcgcccac

SEQ ID NO: 3120240 - RNA, 19 nt, Mycobacterium bovis subsp bovis AF2122/97
cauagcggcccaucgggcg

SEQ ID NO: 3120241 - RNA, 15 nt, Mycobacterium bovis subsp bovis AF2122/97
cauagcugccggccc

SEQ ID NO: 3120242 - RNA, 19 nt, Mycobacterium bovis subsp bovis AF2122/97
cauagcugccggcccacca

SEQ ID NO: 3120243 - RNA, 15 nt, Mycobacterium bovis subsp bovis AF2122/97
cauaggaucgcgccc

SEQ ID NO: 3120244 - RNA, 19 nt, Mycobacterium bovis subsp bovis AF2122/97
cauaggcaaggucaacccg

SEQ ID NO: 3120245 - RNA, 22 nt, Mycobacterium bovis subsp bovis AF2122/97
cauaggccaccuccgaggccgc

SEQ ID NO: 3120246 - RNA, 16 nt, Mycobacterium bovis subsp bovis AF2122/97
cauaggcccacggcag

SEQ ID NO: 3120247 - RNA, 20 nt, Mycobacterium bovis subsp bovis AF2122/97
cauaggcccacggcagcgcc

SEQ ID NO: 3120248 - RNA, 19 nt, Mycobacterium bovis subsp bovis AF2122/97
cauaggccccgccagcgcc

SEQ ID NO: 3120249 - RNA, 13 nt, Mycobacterium bovis subsp bovis AF2122/97
cauaggccgacgg

SEQ ID NO: 3120250 - RNA, 12 nt, Mycobacterium bovis subsp bovis AF2122/97
cauaggccggcg

SEQ ID NO: 3120251 - RNA, 16 nt, Mycobacterium bovis subsp bovis AF2122/97
cauaggccugcagccg

SEQ ID NO: 3120252 - RNA, 17 nt, Mycobacterium bovis subsp bovis AF2122/97
cauaggcgcugaacgcg

SEQ ID NO: 3120253 - RNA, 16 nt, Mycobacterium bovis subsp bovis AF2122/97
cauaggcggccaucga

SEQ ID NO: 3120254 - RNA, 19 nt, Mycobacterium bovis subsp bovis AF2122/97
cauagguaguugcucggcu

SEQ ID NO: 3120255 - RNA, 15 nt, Mycobacterium bovis subsp bovis AF2122/97
cauagguaugcccgg

SEQ ID NO: 3120256 - RNA, 16 nt, Mycobacterium bovis subsp bovis AF2122/97
cauagucagacgacga

SEQ ID NO: 3120257 - RNA, 17 nt, Mycobacterium bovis subsp bovis AF2122/97
cauaguccgaaccgagc

SEQ ID NO: 3120258 - RNA, 20 nt, Mycobacterium bovis subsp bovis AF2122/97
cauagugaggccgaccagca

SEQ ID NO: 3120259 - RNA, 15 nt, Mycobacterium bovis subsp bovis AF2122/97
cauagugcggcagcg

SEQ ID NO: 3120260 - RNA, 16 nt, Mycobacterium bovis subsp bovis AF2122/97
cauagugcggcugcaa

SEQ ID NO: 3120261 - RNA, 14 nt, Mycobacterium bovis subsp bovis AF2122/97
cauaguuggcgccc

SEQ ID NO: 3120262 - RNA, 15 nt, Mycobacterium bovis subsp bovis AF2122/97
cauaguuggcgcccg

SEQ ID NO: 3120263 - RNA, 18 nt, Mycobacterium bovis subsp bovis AF2122/97
cauaguuguuccuggucg

SEQ ID NO: 3120264 - RNA, 13 nt, Mycobacterium bovis subsp bovis AF2122/97
cauauagaucacu

SEQ ID NO: 3120265 - RNA, 15 nt, Mycobacterium bovis subsp bovis AF2122/97
cauauagcggaccga

SEQ ID NO: 3120266 - RNA, 16 nt, Mycobacterium bovis subsp bovis AF2122/97
cauauaggagcgggug

SEQ ID NO: 3120267 - RNA, 13 nt, Mycobacterium bovis subsp bovis AF2122/97
cauaucaaccccg

SEQ ID NO: 3120268 - RNA, 17 nt, Mycobacterium bovis subsp bovis AF2122/97
cauauccgccccagcug

SEQ ID NO: 3120269 - RNA, 13 nt, Mycobacterium bovis subsp bovis AF2122/97
cauauccgccggc

SEQ ID NO: 3120270 - RNA, 20 nt, Mycobacterium bovis subsp bovis AF2122/97
cauaucgauaaccgcgacca

SEQ ID NO: 3120271 - RNA, 23 nt, Mycobacterium bovis subsp bovis AF2122/97
cauaucgugaugugcccauucau

SEQ ID NO: 3120272 - RNA, 22 nt, Mycobacterium bovis subsp bovis AF2122/97
caucaaaaacgaacccaggcac

SEQ ID NO: 3120273 - RNA, 17 nt, Mycobacterium bovis subsp bovis AF2122/97
caucaaacccccggggc

SEQ ID NO: 3120274 - RNA, 15 nt, Mycobacterium bovis subsp bovis AF2122/97
caucaacaucggccc

SEQ ID NO: 3120275 - RNA, 19 nt, Mycobacterium bovis subsp bovis AF2122/97
caucaacaucggcccgcug

SEQ ID NO: 3120276 - RNA, 20 nt, Mycobacterium bovis subsp bovis AF2122/97
caucaaccguccccggcguc

SEQ ID NO: 3120277 - RNA, 14 nt, Mycobacterium bovis subsp bovis AF2122/97
caucaacgacacca

SEQ ID NO: 3120278 - RNA, 22 nt, Mycobacterium bovis subsp bovis AF2122/97
caucaacgacaccagaucguuc

SEQ ID NO: 3120279 - RNA, 14 nt, Mycobacterium bovis subsp bovis AF2122/97
caucaacgccacga

SEQ ID NO: 3120280 - RNA, 15 nt, Mycobacterium bovis subsp bovis AF2122/97
caucaacgcgggcgc

SEQ ID NO: 3120281 - RNA, 16 nt, Mycobacterium bovis subsp bovis AF2122/97
caucaacgcgggcgcu

SEQ ID NO: 3120282 - RNA, 19 nt, Mycobacterium bovis subsp bovis AF2122/97
caucaacugcaucaccacu

SEQ ID NO: 3120283 - RNA, 20 nt, Mycobacterium bovis subsp bovis AF2122/97
caucaagaaacguggugacg

SEQ ID NO: 3120284 - RNA, 15 nt, Mycobacterium bovis subsp bovis AF2122/97
caucaagagcgcgcc

SEQ ID NO: 3120285 - RNA, 13 nt, Mycobacterium bovis subsp bovis AF2122/97
caucacacccauc

SEQ ID NO: 3120286 - RNA, 13 nt, Mycobacterium bovis subsp bovis AF2122/97
caucacacccggu

SEQ ID NO: 3120287 - RNA, 14 nt, Mycobacterium bovis subsp bovis AF2122/97
caucacauccacgc

SEQ ID NO: 3120288 - RNA, 20 nt, Mycobacterium bovis subsp bovis AF2122/97
caucaccaaaaacccgguga

SEQ ID NO: 3120289 - RNA, 19 nt, Mycobacterium bovis subsp bovis AF2122/97
caucaccacaccggcagcu

SEQ ID NO: 3120290 - RNA, 16 nt, Mycobacterium bovis subsp bovis AF2122/97
caucaccaccgcacgg

SEQ ID NO: 3120291 - RNA, 15 nt, Mycobacterium bovis subsp bovis AF2122/97
caucaccaccgccgg

SEQ ID NO: 3120292 - RNA, 17 nt, Mycobacterium bovis subsp bovis AF2122/97
caucaccaccggcaccg

SEQ ID NO: 3120293 - RNA, 14 nt, Mycobacterium bovis subsp bovis AF2122/97
caucaccacggccg

SEQ ID NO: 3120294 - RNA, 16 nt, Mycobacterium bovis subsp bovis AF2122/97
caucaccacggccgcc

SEQ ID NO: 3120295 - RNA, 20 nt, Mycobacterium bovis subsp bovis AF2122/97
caucaccacuggacccgccc

SEQ ID NO: 3120296 - RNA, 22 nt, Mycobacterium bovis subsp bovis AF2122/97
caucaccacuggacccgcccag

SEQ ID NO: 3120297 - RNA, 14 nt, Mycobacterium bovis subsp bovis AF2122/97
caucaccagcagug

SEQ ID NO: 3120298 - RNA, 11 nt, Mycobacterium bovis subsp bovis AF2122/97
caucaccagcg

SEQ ID NO: 3120299 - RNA, 13 nt, Mycobacterium bovis subsp bovis AF2122/97
caucaccagcggc

SEQ ID NO: 3120300 - RNA, 13 nt, Mycobacterium bovis subsp bovis AF2122/97
caucacccagcgc

SEQ ID NO: 3120301 - RNA, 14 nt, Mycobacterium bovis subsp bovis AF2122/97
caucacccagcgcc

SEQ ID NO: 3120302 - RNA, 18 nt, Mycobacterium bovis subsp bovis AF2122/97
caucacccagcgccgacc

SEQ ID NO: 3120303 - RNA, 17 nt, Mycobacterium bovis subsp bovis AF2122/97
caucaccccggccuugg

SEQ ID NO: 3120304 - RNA, 21 nt, Mycobacterium bovis subsp bovis AF2122/97
caucaccccggccuuggcggc

SEQ ID NO: 3120305 - RNA, 16 nt, Mycobacterium bovis subsp bovis AF2122/97
caucaccgaacggcga

SEQ ID NO: 3120306 - RNA, 16 nt, Mycobacterium bovis subsp bovis AF2122/97
caucaccgacgcgucg

SEQ ID NO: 3120307 - RNA, 18 nt, Mycobacterium bovis subsp bovis AF2122/97
caucaccgacgcgucggc

SEQ ID NO: 3120308 - RNA, 15 nt, Mycobacterium bovis subsp bovis AF2122/97
caucaccgccagccc

SEQ ID NO: 3120309 - RNA, 16 nt, Mycobacterium bovis subsp bovis AF2122/97
caucaccgccagcccc

SEQ ID NO: 3120310 - RNA, 20 nt, Mycobacterium bovis subsp bovis AF2122/97
caucaccgccagccccgcgc

SEQ ID NO: 3120311 - RNA, 22 nt, Mycobacterium bovis subsp bovis AF2122/97
caucaccgccagccccgcgccc

SEQ ID NO: 3120312 - RNA, 11 nt, Mycobacterium bovis subsp bovis AF2122/97
caucaccgccg

SEQ ID NO: 3120313 - RNA, 14 nt, Mycobacterium bovis subsp bovis AF2122/97
caucaccgccgcgg

SEQ ID NO: 3120314 - RNA, 18 nt, Mycobacterium bovis subsp bovis AF2122/97
caucaccgccgcggccgc

SEQ ID NO: 3120315 - RNA, 21 nt, Mycobacterium bovis subsp bovis AF2122/97
caucaccgccgcggccgccgu

SEQ ID NO: 3120316 - RNA, 22 nt, Mycobacterium bovis subsp bovis AF2122/97
caucaccgccgcggccgccguc

SEQ ID NO: 3120317 - RNA, 21 nt, Mycobacterium bovis subsp bovis AF2122/97
caucaccgccuuugccgccgg

SEQ ID NO: 3120318 - RNA, 24 nt, Mycobacterium bovis subsp bovis AF2122/97
caucaccgcgccagccuccaccag

SEQ ID NO: 3120319 - RNA, 22 nt, Mycobacterium bovis subsp bovis AF2122/97
caucaccggagcuuguugcagc

SEQ ID NO: 3120320 - RNA, 20 nt, Mycobacterium bovis subsp bovis AF2122/97
caucaccggcauacagccgg

SEQ ID NO: 3120321 - RNA, 12 nt, Mycobacterium bovis subsp bovis AF2122/97
caucaccggcgc

SEQ ID NO: 3120322 - RNA, 15 nt, Mycobacterium bovis subsp bovis AF2122/97
caucaccggcggccc

SEQ ID NO: 3120323 - RNA, 16 nt, Mycobacterium bovis subsp bovis AF2122/97
caucaccggcggcccc

SEQ ID NO: 3120324 - RNA, 14 nt, Mycobacterium bovis subsp bovis AF2122/97
caucaccggugcgc

SEQ ID NO: 3120325 - RNA, 14 nt, Mycobacterium bovis subsp bovis AF2122/97
caucaccgucgccc

SEQ ID NO: 3120326 - RNA, 16 nt, Mycobacterium bovis subsp bovis AF2122/97
caucaccgucgcccgg

SEQ ID NO: 3120327 - RNA, 14 nt, Mycobacterium bovis subsp bovis AF2122/97
caucaccuccgcga

SEQ ID NO: 3120328 - RNA, 17 nt, Mycobacterium bovis subsp bovis AF2122/97
caucacgaaggcguucg

SEQ ID NO: 3120329 - RNA, 14 nt, Mycobacterium bovis subsp bovis AF2122/97
caucacgaccaggg

SEQ ID NO: 3120330 - RNA, 17 nt, Mycobacterium bovis subsp bovis AF2122/97
caucacgacucccccgg

SEQ ID NO: 3120331 - RNA, 17 nt, Mycobacterium bovis subsp bovis AF2122/97
caucacgccccagguuc

SEQ ID NO: 3120332 - RNA, 22 nt, Mycobacterium bovis subsp bovis AF2122/97
caucacgccgccggaggugaca

SEQ ID NO: 3120333 - RNA, 19 nt, Mycobacterium bovis subsp bovis AF2122/97
caucacgcgcucaccgacg

SEQ ID NO: 3120334 - RNA, 15 nt, Mycobacterium bovis subsp bovis AF2122/97
caucacggaccaggc

SEQ ID NO: 3120335 - RNA, 16 nt, Mycobacterium bovis subsp bovis AF2122/97
caucacggaccaggcc

SEQ ID NO: 3120336 - RNA, 16 nt, Mycobacterium bovis subsp bovis AF2122/97
caucacggcggggauc

SEQ ID NO: 3120337 - RNA, 23 nt, Mycobacterium bovis subsp bovis AF2122/97
caucacggcggggaucgcuggcc

SEQ ID NO: 3120338 - RNA, 15 nt, Mycobacterium bovis subsp bovis AF2122/97
caucacgggacgacg

SEQ ID NO: 3120339 - RNA, 17 nt, Mycobacterium bovis subsp bovis AF2122/97
caucacgggacgacggc

SEQ ID NO: 3120340 - RNA, 12 nt, Mycobacterium bovis subsp bovis AF2122/97
caucacggucag

SEQ ID NO: 3120341 - RNA, 18 nt, Mycobacterium bovis subsp bovis AF2122/97
caucacgguggccgcacg

SEQ ID NO: 3120342 - RNA, 19 nt, Mycobacterium bovis subsp bovis AF2122/97
caucacgguggccgcacga

SEQ ID NO: 3120343 - RNA, 16 nt, Mycobacterium bovis subsp bovis AF2122/97
caucagaaucaggcuc

SEQ ID NO: 3120344 - RNA, 16 nt, Mycobacterium bovis subsp bovis AF2122/97
caucagaaugccuggc

SEQ ID NO: 3120345 - RNA, 18 nt, Mycobacterium bovis subsp bovis AF2122/97
caucagaaugccuggccc

SEQ ID NO: 3120346 - RNA, 23 nt, Mycobacterium bovis subsp bovis AF2122/97
caucagaccaaugaccgccagca

SEQ ID NO: 3120347 - RNA, 17 nt, Mycobacterium bovis subsp bovis AF2122/97
caucagagacagcagcg

SEQ ID NO: 3120348 - RNA, 16 nt, Mycobacterium bovis subsp bovis AF2122/97
caucagagcgcugguu

SEQ ID NO: 3120349 - RNA, 16 nt, Mycobacterium bovis subsp bovis AF2122/97
caucagaucgccgacu

SEQ ID NO: 3120350 - RNA, 17 nt, Mycobacterium bovis subsp bovis AF2122/97
caucagauucgcgcugg

SEQ ID NO: 3120351 - RNA, 19 nt, Mycobacterium bovis subsp bovis AF2122/97
caucagauucgcgcuggcc

SEQ ID NO: 3120352 - RNA, 14 nt, Mycobacterium bovis subsp bovis AF2122/97
caucagcagagccc

SEQ ID NO: 3120353 - RNA, 16 nt, Mycobacterium bovis subsp bovis AF2122/97
caucagcagagccccg

SEQ ID NO: 3120354 - RNA, 17 nt, Mycobacterium bovis subsp bovis AF2122/97
caucagcccggcgcgcc

SEQ ID NO: 3120355 - RNA, 22 nt, Mycobacterium bovis subsp bovis AF2122/97
caucagcccggcgcgccgaguu

SEQ ID NO: 3120356 - RNA, 20 nt, Mycobacterium bovis subsp bovis AF2122/97
caucagcccuucagcgaagc

SEQ ID NO: 3120357 - RNA, 15 nt, Mycobacterium bovis subsp bovis AF2122/97
caucagccgcaccag

SEQ ID NO: 3120358 - RNA, 17 nt, Mycobacterium bovis subsp bovis AF2122/97
caucagccgcaccagug

SEQ ID NO: 3120359 - RNA, 18 nt, Mycobacterium bovis subsp bovis AF2122/97
caucagcgacaagugcac

SEQ ID NO: 3120360 - RNA, 14 nt, Mycobacterium bovis subsp bovis AF2122/97
caucagcgcgaccg

SEQ ID NO: 3120361 - RNA, 14 nt, Mycobacterium bovis subsp bovis AF2122/97
caucagcggcgcca

SEQ ID NO: 3120362 - RNA, 22 nt, Mycobacterium bovis subsp bovis AF2122/97
caucagcuuuugcaccggaccg

SEQ ID NO: 3120363 - RNA, 14 nt, Mycobacterium bovis subsp bovis AF2122/97
caucaggccgcgcg

SEQ ID NO: 3120364 - RNA, 21 nt, Mycobacterium bovis subsp bovis AF2122/97
caucagggccuuggcgggauc

SEQ ID NO: 3120365 - RNA, 14 nt, Mycobacterium bovis subsp bovis AF2122/97
caucaggucggcga

SEQ ID NO: 3120366 - RNA, 18 nt, Mycobacterium bovis subsp bovis AF2122/97
caucaggucgucguccug

SEQ ID NO: 3120367 - RNA, 16 nt, Mycobacterium bovis subsp bovis AF2122/97
caucaggugcgccugg

SEQ ID NO: 3120368 - RNA, 17 nt, Mycobacterium bovis subsp bovis AF2122/97
caucaggugcgccuggc

SEQ ID NO: 3120369 - RNA, 14 nt, Mycobacterium bovis subsp bovis AF2122/97
caucagugcgccgg

SEQ ID NO: 3120370 - RNA, 15 nt, Mycobacterium bovis subsp bovis AF2122/97
caucaucgacgcgcg

SEQ ID NO: 3120371 - RNA, 16 nt, Mycobacterium bovis subsp bovis AF2122/97
caucaucgccaccacc

SEQ ID NO: 3120372 - RNA, 20 nt, Mycobacterium bovis subsp bovis AF2122/97
caucaucgcccaccgcaacg

SEQ ID NO: 3120373 - RNA, 17 nt, Mycobacterium bovis subsp bovis AF2122/97
caucaucgcccugggcg

SEQ ID NO: 3120374 - RNA, 18 nt, Mycobacterium bovis subsp bovis AF2122/97
caucaucggaaccguuug

SEQ ID NO: 3120375 - RNA, 22 nt, Mycobacterium bovis subsp bovis AF2122/97
caucaucuggucgaccaucggu

SEQ ID NO: 3120376 - RNA, 16 nt, Mycobacterium bovis subsp bovis AF2122/97
caucaugccgcccauc

SEQ ID NO: 3120377 - RNA, 20 nt, Mycobacterium bovis subsp bovis AF2122/97
caucaugccgcccaucaccc

SEQ ID NO: 3120378 - RNA, 15 nt, Mycobacterium bovis subsp bovis AF2122/97
caucauggccgugua

SEQ ID NO: 3120379 - RNA, 16 nt, Mycobacterium bovis subsp bovis AF2122/97
caucaugguccgggcc

SEQ ID NO: 3120380 - RNA, 14 nt, Mycobacterium bovis subsp bovis AF2122/97
caucaugucggcgc

SEQ ID NO: 3120381 - RNA, 15 nt, Mycobacterium bovis subsp bovis AF2122/97
caucaugucggcgca

SEQ ID NO: 3120382 - RNA, 17 nt, Mycobacterium bovis subsp bovis AF2122/97
caucauguggucaacgg

SEQ ID NO: 3120383 - RNA, 17 nt, Mycobacterium bovis subsp bovis AF2122/97
cauccaaaaucgccuga

SEQ ID NO: 3120384 - RNA, 14 nt, Mycobacterium bovis subsp bovis AF2122/97
cauccaacgaccuc

SEQ ID NO: 3120385 - RNA, 21 nt, Mycobacterium bovis subsp bovis AF2122/97
cauccaacgaccuccacgccc

SEQ ID NO: 3120386 - RNA, 17 nt, Mycobacterium bovis subsp bovis AF2122/97
cauccacaccgcggcgg

SEQ ID NO: 3120387 - RNA, 18 nt, Mycobacterium bovis subsp bovis AF2122/97
cauccacaccgcggcggc

SEQ ID NO: 3120388 - RNA, 15 nt, Mycobacterium bovis subsp bovis AF2122/97
cauccaccgauggcg

SEQ ID NO: 3120389 - RNA, 23 nt, Mycobacterium bovis subsp bovis AF2122/97
cauccaccgcagauccccgccac

SEQ ID NO: 3120390 - RNA, 16 nt, Mycobacterium bovis subsp bovis AF2122/97
cauccacuccgccaac

SEQ ID NO: 3120391 - RNA, 20 nt, Mycobacterium bovis subsp bovis AF2122/97
cauccacugcgagggcacgc

SEQ ID NO: 3120392 - RNA, 21 nt, Mycobacterium bovis subsp bovis AF2122/97
cauccagaaguaggcgaccgc

SEQ ID NO: 3120393 - RNA, 19 nt, Mycobacterium bovis subsp bovis AF2122/97
cauccagagacaugucgcu

SEQ ID NO: 3120394 - RNA, 18 nt, Mycobacterium bovis subsp bovis AF2122/97
cauccagagcuggcuacg

SEQ ID NO: 3120395 - RNA, 17 nt, Mycobacterium bovis subsp bovis AF2122/97
cauccagaugcccagca

SEQ ID NO: 3120396 - RNA, 11 nt, Mycobacterium bovis subsp bovis AF2122/97
cauccagccgu

SEQ ID NO: 3120397 - RNA, 14 nt, Mycobacterium bovis subsp bovis AF2122/97
cauccagccgugcg

SEQ ID NO: 3120398 - RNA, 12 nt, Mycobacterium bovis subsp bovis AF2122/97
cauccagcgcgu

SEQ ID NO: 3120399 - RNA, 15 nt, Mycobacterium bovis subsp bovis AF2122/97
cauccagcgcuucgg

SEQ ID NO: 3120400 - RNA, 16 nt, Mycobacterium bovis subsp bovis AF2122/97
cauccagcgcuucggc

SEQ ID NO: 3120401 - RNA, 20 nt, Mycobacterium bovis subsp bovis AF2122/97
cauccagcgcuucggccuga

SEQ ID NO: 3120402 - RNA, 14 nt, Mycobacterium bovis subsp bovis AF2122/97
cauccagcugcugc

SEQ ID NO: 3120403 - RNA, 21 nt, Mycobacterium bovis subsp bovis AF2122/97
cauccagcugcugccgauaca

SEQ ID NO: 3120404 - RNA, 17 nt, Mycobacterium bovis subsp bovis AF2122/97
cauccaggcugucgcgg

SEQ ID NO: 3120405 - RNA, 23 nt, Mycobacterium bovis subsp bovis AF2122/97
cauccaggggcgcaacucaucgu

SEQ ID NO: 3120406 - RNA, 13 nt, Mycobacterium bovis subsp bovis AF2122/97
cauccaucgccag

SEQ ID NO: 3120407 - RNA, 14 nt, Mycobacterium bovis subsp bovis AF2122/97
cauccaucgccagu

SEQ ID NO: 3120408 - RNA, 22 nt, Mycobacterium bovis subsp bovis AF2122/97
cauccaugauggccgucagcca

SEQ ID NO: 3120409 - RNA, 13 nt, Mycobacterium bovis subsp bovis AF2122/97
cauccauucggcg

SEQ ID NO: 3120410 - RNA, 18 nt, Mycobacterium bovis subsp bovis AF2122/97
cauccauucggcggcggc

SEQ ID NO: 3120411 - RNA, 14 nt, Mycobacterium bovis subsp bovis AF2122/97
caucccaacccaug

SEQ ID NO: 3120412 - RNA, 22 nt, Mycobacterium bovis subsp bovis AF2122/97
caucccagcgaaugcugacaug

SEQ ID NO: 3120413 - RNA, 13 nt, Mycobacterium bovis subsp bovis AF2122/97
cauccccgccggc

SEQ ID NO: 3120414 - RNA, 16 nt, Mycobacterium bovis subsp bovis AF2122/97
cauccccuggccagca

SEQ ID NO: 3120415 - RNA, 19 nt, Mycobacterium bovis subsp bovis AF2122/97
cauccccuggccagcagag

SEQ ID NO: 3120416 - RNA, 23 nt, Mycobacterium bovis subsp bovis AF2122/97
caucccgaaguagaagcccagga

SEQ ID NO: 3120417 - RNA, 13 nt, Mycobacterium bovis subsp bovis AF2122/97
caucccgaccagc

SEQ ID NO: 3120418 - RNA, 16 nt, Mycobacterium bovis subsp bovis AF2122/97
caucccgaucccggcc

SEQ ID NO: 3120419 - RNA, 16 nt, Mycobacterium bovis subsp bovis AF2122/97
caucccgauccugccc

SEQ ID NO: 3120420 - RNA, 22 nt, Mycobacterium bovis subsp bovis AF2122/97
caucccgauguaccccagcgcc

SEQ ID NO: 3120421 - RNA, 14 nt, Mycobacterium bovis subsp bovis AF2122/97
caucccgccacacc

SEQ ID NO: 3120422 - RNA, 17 nt, Mycobacterium bovis subsp bovis AF2122/97
caucccggaccgauggu

SEQ ID NO: 3120423 - RNA, 18 nt, Mycobacterium bovis subsp bovis AF2122/97
caucccggaccgaugguu

SEQ ID NO: 3120424 - RNA, 15 nt, Mycobacterium bovis subsp bovis AF2122/97
caucccggagccgcu

SEQ ID NO: 3120425 - RNA, 15 nt, Mycobacterium bovis subsp bovis AF2122/97
caucccggccgagua

SEQ ID NO: 3120426 - RNA, 22 nt, Mycobacterium bovis subsp bovis AF2122/97
caucccggccgaguaccagccc

SEQ ID NO: 3120427 - RNA, 12 nt, Mycobacterium bovis subsp bovis AF2122/97
caucccggcgcc

SEQ ID NO: 3120428 - RNA, 15 nt, Mycobacterium bovis subsp bovis AF2122/97
caucccggcgccgcg

SEQ ID NO: 3120429 - RNA, 18 nt, Mycobacterium bovis subsp bovis AF2122/97
caucccggugucgaugcg

SEQ ID NO: 3120430 - RNA, 19 nt, Mycobacterium bovis subsp bovis AF2122/97
caucccgguuccggcgauc

SEQ ID NO: 3120431 - RNA, 17 nt, Mycobacterium bovis subsp bovis AF2122/97
caucccguucagcuucc

SEQ ID NO: 3120432 - RNA, 18 nt, Mycobacterium bovis subsp bovis AF2122/97
caucccucaguguacacc

SEQ ID NO: 3120433 - RNA, 21 nt, Mycobacterium bovis subsp bovis AF2122/97
caucccucaguguacaccgcg

SEQ ID NO: 3120434 - RNA, 22 nt, Mycobacterium bovis subsp bovis AF2122/97
caucccucaguguacaccgcgc

SEQ ID NO: 3120435 - RNA, 13 nt, Mycobacterium bovis subsp bovis AF2122/97
caucccugacgaa

SEQ ID NO: 3120436 - RNA, 15 nt, Mycobacterium bovis subsp bovis AF2122/97
cauccgacagcagcc

SEQ ID NO: 3120437 - RNA, 12 nt, Mycobacterium bovis subsp bovis AF2122/97
cauccgaucacg

SEQ ID NO: 3120438 - RNA, 14 nt, Mycobacterium bovis subsp bovis AF2122/97
cauccgaucacgac

SEQ ID NO: 3120439 - RNA, 19 nt, Mycobacterium bovis subsp bovis AF2122/97
cauccgaucacgacguugc

SEQ ID NO: 3120440 - RNA, 14 nt, Mycobacterium bovis subsp bovis AF2122/97
cauccgaucgccgc

SEQ ID NO: 3120441 - RNA, 15 nt, Mycobacterium bovis subsp bovis AF2122/97
cauccgaucgccgcg

SEQ ID NO: 3120442 - RNA, 16 nt, Mycobacterium bovis subsp bovis AF2122/97
cauccgaucgccgcga

SEQ ID NO: 3120443 - RNA, 13 nt, Mycobacterium bovis subsp bovis AF2122/97
cauccgccccgcc

SEQ ID NO: 3120444 - RNA, 14 nt, Mycobacterium bovis subsp bovis AF2122/97
cauccgccccgccc

SEQ ID NO: 3120445 - RNA, 15 nt, Mycobacterium bovis subsp bovis AF2122/97
cauccgccccgcccg

SEQ ID NO: 3120446 - RNA, 21 nt, Mycobacterium bovis subsp bovis AF2122/97
cauccgccccgcccgcaccca

SEQ ID NO: 3120447 - RNA, 14 nt, Mycobacterium bovis subsp bovis AF2122/97
cauccgccgccccc

SEQ ID NO: 3120448 - RNA, 13 nt, Mycobacterium bovis subsp bovis AF2122/97
cauccgccgggcc

SEQ ID NO: 3120449 - RNA, 17 nt, Mycobacterium bovis subsp bovis AF2122/97
cauccgccgggccaggc

SEQ ID NO: 3120450 - RNA, 15 nt, Mycobacterium bovis subsp bovis AF2122/97
cauccgcgacggcgc

SEQ ID NO: 3120451 - RNA, 18 nt, Mycobacterium bovis subsp bovis AF2122/97
cauccgcgacggcgcccu

SEQ ID NO: 3120452 - RNA, 23 nt, Mycobacterium bovis subsp bovis AF2122/97
cauccgcuugcggggccgggcga

SEQ ID NO: 3120453 - RNA, 18 nt, Mycobacterium bovis subsp bovis AF2122/97
cauccggauauggaaagc

SEQ ID NO: 3120454 - RNA, 20 nt, Mycobacterium bovis subsp bovis AF2122/97
cauccggccgucggcgggca

SEQ ID NO: 3120455 - RNA, 21 nt, Mycobacterium bovis subsp bovis AF2122/97
cauccggccgucggcgggcau

SEQ ID NO: 3120456 - RNA, 18 nt, Mycobacterium bovis subsp bovis AF2122/97
cauccggcggcggccagg

SEQ ID NO: 3120457 - RNA, 15 nt, Mycobacterium bovis subsp bovis AF2122/97
cauccgggccgagcg

SEQ ID NO: 3120458 - RNA, 20 nt, Mycobacterium bovis subsp bovis AF2122/97
cauccgggccgagcgcacca

SEQ ID NO: 3120459 - RNA, 22 nt, Mycobacterium bovis subsp bovis AF2122/97
cauccgggccgagcgcaccacg

SEQ ID NO: 3120460 - RNA, 16 nt, Mycobacterium bovis subsp bovis AF2122/97
cauccgggccgcggcc

SEQ ID NO: 3120461 - RNA, 17 nt, Mycobacterium bovis subsp bovis AF2122/97
cauccgggcgaccacca

SEQ ID NO: 3120462 - RNA, 23 nt, Mycobacterium bovis subsp bovis AF2122/97
cauccgggcgaccaccaccgccg

SEQ ID NO: 3120463 - RNA, 17 nt, Mycobacterium bovis subsp bovis AF2122/97
cauccgggcucgcaugu

SEQ ID NO: 3120464 - RNA, 22 nt, Mycobacterium bovis subsp bovis AF2122/97
cauccggucgaugucagccacc

SEQ ID NO: 3120465 - RNA, 17 nt, Mycobacterium bovis subsp bovis AF2122/97
cauccgguucgccgccg

SEQ ID NO: 3120466 - RNA, 19 nt, Mycobacterium bovis subsp bovis AF2122/97
cauccgguuuggucgccgc

SEQ ID NO: 3120467 - RNA, 22 nt, Mycobacterium bovis subsp bovis AF2122/97
cauccgguuuggucgccgcguc

SEQ ID NO: 3120468 - RNA, 19 nt, Mycobacterium bovis subsp bovis AF2122/97
cauccgucaaguggcaacc

SEQ ID NO: 3120469 - RNA, 19 nt, Mycobacterium bovis subsp bovis AF2122/97
cauccgucguacacgccau

SEQ ID NO: 3120470 - RNA, 13 nt, Mycobacterium bovis subsp bovis AF2122/97
cauccuccucguc

SEQ ID NO: 3120471 - RNA, 15 nt, Mycobacterium bovis subsp bovis AF2122/97
cauccuccucgucga

SEQ ID NO: 3120472 - RNA, 17 nt, Mycobacterium bovis subsp bovis AF2122/97
cauccuccucgucgacg

SEQ ID NO: 3120473 - RNA, 18 nt, Mycobacterium bovis subsp bovis AF2122/97
cauccuccucgucgacgu

SEQ ID NO: 3120474 - RNA, 15 nt, Mycobacterium bovis subsp bovis AF2122/97
cauccuccugcgccg

SEQ ID NO: 3120475 - RNA, 17 nt, Mycobacterium bovis subsp bovis AF2122/97
cauccuccugcgccgca

SEQ ID NO: 3120476 - RNA, 19 nt, Mycobacterium bovis subsp bovis AF2122/97
cauccucgacuugcuuggc

SEQ ID NO: 3120477 - RNA, 13 nt, Mycobacterium bovis subsp bovis AF2122/97
cauccucgagcug

SEQ ID NO: 3120478 - RNA, 18 nt, Mycobacterium bovis subsp bovis AF2122/97
cauccucgagcugcuggc

SEQ ID NO: 3120479 - RNA, 19 nt, Mycobacterium bovis subsp bovis AF2122/97
cauccucugaaccagcuga

SEQ ID NO: 3120480 - RNA, 15 nt, Mycobacterium bovis subsp bovis AF2122/97
cauccugcacgaccc

SEQ ID NO: 3120481 - RNA, 12 nt, Mycobacterium bovis subsp bovis AF2122/97
cauccugcagcu

SEQ ID NO: 3120482 - RNA, 15 nt, Mycobacterium bovis subsp bovis AF2122/97
cauccugcagcucgg

SEQ ID NO: 3120483 - RNA, 17 nt, Mycobacterium bovis subsp bovis AF2122/97
cauccugcagcucgggc

SEQ ID NO: 3120484 - RNA, 19 nt, Mycobacterium bovis subsp bovis AF2122/97
cauccugcagcucgggcag

SEQ ID NO: 3120485 - RNA, 21 nt, Mycobacterium bovis subsp bovis AF2122/97
cauccugccuuacacgccugg

SEQ ID NO: 3120486 - RNA, 19 nt, Mycobacterium bovis subsp bovis AF2122/97
cauccuuaugcgcggugac

SEQ ID NO: 3120487 - RNA, 12 nt, Mycobacterium bovis subsp bovis AF2122/97
cauccuucacca

SEQ ID NO: 3120488 - RNA, 16 nt, Mycobacterium bovis subsp bovis AF2122/97
cauccuucaccagcug

SEQ ID NO: 3120489 - RNA, 15 nt, Mycobacterium bovis subsp bovis AF2122/97
cauccuucgccggcg

SEQ ID NO: 3120490 - RNA, 17 nt, Mycobacterium bovis subsp bovis AF2122/97
cauccuucgccggcgcc

SEQ ID NO: 3120491 - RNA, 21 nt, Mycobacterium bovis subsp bovis AF2122/97
cauccuucgccggcgccagca

SEQ ID NO: 3120492 - RNA, 15 nt, Mycobacterium bovis subsp bovis AF2122/97
cauccuugacgcggc

SEQ ID NO: 3120493 - RNA, 19 nt, Mycobacterium bovis subsp bovis AF2122/97
cauccuugacgcggccaca

SEQ ID NO: 3120494 - RNA, 18 nt, Mycobacterium bovis subsp bovis AF2122/97
cauccuugaggucaucgg

SEQ ID NO: 3120495 - RNA, 20 nt, Mycobacterium bovis subsp bovis AF2122/97
cauccuugaggucaucgggc

SEQ ID NO: 3120496 - RNA, 16 nt, Mycobacterium bovis subsp bovis AF2122/97
caucgaaaaaccucga

SEQ ID NO: 3120497 - RNA, 21 nt, Mycobacterium bovis subsp bovis AF2122/97
caucgaaaaaccucgacgccc

SEQ ID NO: 3120498 - RNA, 14 nt, Mycobacterium bovis subsp bovis AF2122/97
caucgaacucugga

SEQ ID NO: 3120499 - RNA, 19 nt, Mycobacterium bovis subsp bovis AF2122/97
caucgacccgaucacgcug

SEQ ID NO: 3120500 - RNA, 16 nt, Mycobacterium bovis subsp bovis AF2122/97
caucgaccgcccgcca

SEQ ID NO: 3120501 - RNA, 13 nt, Mycobacterium bovis subsp bovis AF2122/97
caucgaccguccg

SEQ ID NO: 3120502 - RNA, 14 nt, Mycobacterium bovis subsp bovis AF2122/97
caucgaccguccgg

SEQ ID NO: 3120503 - RNA, 16 nt, Mycobacterium bovis subsp bovis AF2122/97
caucgaccuggccacg

SEQ ID NO: 3120504 - RNA, 23 nt, Mycobacterium bovis subsp bovis AF2122/97
caucgacgagccgcggucggcgu

SEQ ID NO: 3120505 - RNA, 23 nt, Mycobacterium bovis subsp bovis AF2122/97
caucgacguagcgaagugcgcgc

SEQ ID NO: 3120506 - RNA, 18 nt, Mycobacterium bovis subsp bovis AF2122/97
caucgacguuccagcagu

SEQ ID NO: 3120507 - RNA, 17 nt, Mycobacterium bovis subsp bovis AF2122/97
caucgacuugccgccgc

SEQ ID NO: 3120508 - RNA, 20 nt, Mycobacterium bovis subsp bovis AF2122/97
caucgacuugccgccgcaca

SEQ ID NO: 3120509 - RNA, 15 nt, Mycobacterium bovis subsp bovis AF2122/97
caucgagacgagcca

SEQ ID NO: 3120510 - RNA, 17 nt, Mycobacterium bovis subsp bovis AF2122/97
caucgagacgagccacg

SEQ ID NO: 3120511 - RNA, 18 nt, Mycobacterium bovis subsp bovis AF2122/97
caucgagacgcacggcca

SEQ ID NO: 3120512 - RNA, 21 nt, Mycobacterium bovis subsp bovis AF2122/97
caucgagacgcacggccaccg

SEQ ID NO: 3120513 - RNA, 14 nt, Mycobacterium bovis subsp bovis AF2122/97
caucgagaucgccg

SEQ ID NO: 3120514 - RNA, 17 nt, Mycobacterium bovis subsp bovis AF2122/97
caucgagaucgccguug

SEQ ID NO: 3120515 - RNA, 15 nt, Mycobacterium bovis subsp bovis AF2122/97
caucgagcagcccgg

SEQ ID NO: 3120516 - RNA, 19 nt, Mycobacterium bovis subsp bovis AF2122/97
caucgagcaguggccgccg

SEQ ID NO: 3120517 - RNA, 22 nt, Mycobacterium bovis subsp bovis AF2122/97
caucgagcccggacgagugcac

SEQ ID NO: 3120518 - RNA, 12 nt, Mycobacterium bovis subsp bovis AF2122/97
caucgagcggga

SEQ ID NO: 3120519 - RNA, 17 nt, Mycobacterium bovis subsp bovis AF2122/97
caucgagcgggaucggg

SEQ ID NO: 3120520 - RNA, 19 nt, Mycobacterium bovis subsp bovis AF2122/97
caucgagcugaccugguuc

SEQ ID NO: 3120521 - RNA, 19 nt, Mycobacterium bovis subsp bovis AF2122/97
caucgaggcgaucaccgcg

SEQ ID NO: 3120522 - RNA, 20 nt, Mycobacterium bovis subsp bovis AF2122/97
caucgaggcgaucaccgcgc

SEQ ID NO: 3120523 - RNA, 21 nt, Mycobacterium bovis subsp bovis AF2122/97
caucgaggucguuucccuggc

SEQ ID NO: 3120524 - RNA, 17 nt, Mycobacterium bovis subsp bovis AF2122/97
caucgaguccaccaccu

SEQ ID NO: 3120525 - RNA, 20 nt, Mycobacterium bovis subsp bovis AF2122/97
caucgaguccaccaccuggc

SEQ ID NO: 3120526 - RNA, 16 nt, Mycobacterium bovis subsp bovis AF2122/97
caucgaguucggcccg

SEQ ID NO: 3120527 - RNA, 14 nt, Mycobacterium bovis subsp bovis AF2122/97
caucgaucaccgcu

SEQ ID NO: 3120528 - RNA, 14 nt, Mycobacterium bovis subsp bovis AF2122/97
caucgaucagaugc

SEQ ID NO: 3120529 - RNA, 20 nt, Mycobacterium bovis subsp bovis AF2122/97
caucgaucccguucggggcc

SEQ ID NO: 3120530 - RNA, 19 nt, Mycobacterium bovis subsp bovis AF2122/97
caucgauccucgcccgcac

SEQ ID NO: 3120531 - RNA, 19 nt, Mycobacterium bovis subsp bovis AF2122/97
caucgaucgagcaggccgc

SEQ ID NO: 3120532 - RNA, 20 nt, Mycobacterium bovis subsp bovis AF2122/97
caucgaucgagcaggccgcc

SEQ ID NO: 3120533 - RNA, 21 nt, Mycobacterium bovis subsp bovis AF2122/97
caucgaucgagcaggccgccc

SEQ ID NO: 3120534 - RNA, 22 nt, Mycobacterium bovis subsp bovis AF2122/97
caucgaugucagugaucaccaa

SEQ ID NO: 3120535 - RNA, 21 nt, Mycobacterium bovis subsp bovis AF2122/97
caucgaugucggcucggcccc

SEQ ID NO: 3120536 - RNA, 13 nt, Mycobacterium bovis subsp bovis AF2122/97
caucgcacccacc

SEQ ID NO: 3120537 - RNA, 14 nt, Mycobacterium bovis subsp bovis AF2122/97
caucgcacccacca

SEQ ID NO: 3120538 - RNA, 14 nt, Mycobacterium bovis subsp bovis AF2122/97
caucgcacgggcca

SEQ ID NO: 3120539 - RNA, 17 nt, Mycobacterium bovis subsp bovis AF2122/97
caucgcacgggccacca

SEQ ID NO: 3120540 - RNA, 13 nt, Mycobacterium bovis subsp bovis AF2122/97
caucgcagacggc

SEQ ID NO: 3120541 - RNA, 13 nt, Mycobacterium bovis subsp bovis AF2122/97
caucgcaggcacc

SEQ ID NO: 3120542 - RNA, 22 nt, Mycobacterium bovis subsp bovis AF2122/97
caucgcaggcaccccgaucacc

SEQ ID NO: 3120543 - RNA, 14 nt, Mycobacterium bovis subsp bovis AF2122/97
caucgccaacacca

SEQ ID NO: 3120544 - RNA, 18 nt, Mycobacterium bovis subsp bovis AF2122/97
caucgccaacaccaacca

SEQ ID NO: 3120545 - RNA, 19 nt, Mycobacterium bovis subsp bovis AF2122/97
caucgccaacaccaaccag

SEQ ID NO: 3120546 - RNA, 20 nt, Mycobacterium bovis subsp bovis AF2122/97
caucgccaaugcgggaaacc

SEQ ID NO: 3120547 - RNA, 21 nt, Mycobacterium bovis subsp bovis AF2122/97
caucgccacacccaaaccggc

SEQ ID NO: 3120548 - RNA, 13 nt, Mycobacterium bovis subsp bovis AF2122/97
caucgccaccacc

SEQ ID NO: 3120549 - RNA, 15 nt, Mycobacterium bovis subsp bovis AF2122/97
caucgccaccacccc

SEQ ID NO: 3120550 - RNA, 21 nt, Mycobacterium bovis subsp bovis AF2122/97
caucgccaccaccccgucgag

SEQ ID NO: 3120551 - RNA, 15 nt, Mycobacterium bovis subsp bovis AF2122/97
caucgccaccaucac

SEQ ID NO: 3120552 - RNA, 13 nt, Mycobacterium bovis subsp bovis AF2122/97
caucgccaccgcg

SEQ ID NO: 3120553 - RNA, 12 nt, Mycobacterium bovis subsp bovis AF2122/97
caucgccacgcc

SEQ ID NO: 3120554 - RNA, 14 nt, Mycobacterium bovis subsp bovis AF2122/97
caucgccagcagca

SEQ ID NO: 3120555 - RNA, 17 nt, Mycobacterium bovis subsp bovis AF2122/97
caucgccagcaucagcc

SEQ ID NO: 3120556 - RNA, 20 nt, Mycobacterium bovis subsp bovis AF2122/97
caucgccagcaucagcccgg

SEQ ID NO: 3120557 - RNA, 21 nt, Mycobacterium bovis subsp bovis AF2122/97
caucgccagcaucagcccggc

SEQ ID NO: 3120558 - RNA, 21 nt, Mycobacterium bovis subsp bovis AF2122/97
caucgccagccugugcugcca

SEQ ID NO: 3120559 - RNA, 14 nt, Mycobacterium bovis subsp bovis AF2122/97
caucgccagcgccg

SEQ ID NO: 3120560 - RNA, 18 nt, Mycobacterium bovis subsp bovis AF2122/97
caucgccagcgccggcca

SEQ ID NO: 3120561 - RNA, 14 nt, Mycobacterium bovis subsp bovis AF2122/97
caucgccagcggca

SEQ ID NO: 3120562 - RNA, 13 nt, Mycobacterium bovis subsp bovis AF2122/97
caucgccaggccc

SEQ ID NO: 3120563 - RNA, 19 nt, Mycobacterium bovis subsp bovis AF2122/97
caucgccauaccggccgcc

SEQ ID NO: 3120564 - RNA, 20 nt, Mycobacterium bovis subsp bovis AF2122/97
caucgccauaccggccgcca

SEQ ID NO: 3120565 - RNA, 21 nt, Mycobacterium bovis subsp bovis AF2122/97
caucgccauaccggccgccau

SEQ ID NO: 3120566 - RNA, 15 nt, Mycobacterium bovis subsp bovis AF2122/97
caucgcccaacaacg

SEQ ID NO: 3120567 - RNA, 17 nt, Mycobacterium bovis subsp bovis AF2122/97
caucgcccggaaccggc

SEQ ID NO: 3120568 - RNA, 13 nt, Mycobacterium bovis subsp bovis AF2122/97
caucgcccggugc

SEQ ID NO: 3120569 - RNA, 22 nt, Mycobacterium bovis subsp bovis AF2122/97
caucgcccugggcgccggcguc

SEQ ID NO: 3120570 - RNA, 16 nt, Mycobacterium bovis subsp bovis AF2122/97
caucgccgacacccuc

SEQ ID NO: 3120571 - RNA, 15 nt, Mycobacterium bovis subsp bovis AF2122/97
caucgccgacccgcc

SEQ ID NO: 3120572 - RNA, 13 nt, Mycobacterium bovis subsp bovis AF2122/97
caucgccgacgcc

SEQ ID NO: 3120573 - RNA, 23 nt, Mycobacterium bovis subsp bovis AF2122/97
caucgccgaugauguuuuccccg

SEQ ID NO: 3120574 - RNA, 16 nt, Mycobacterium bovis subsp bovis AF2122/97
caucgccgccaaccac

SEQ ID NO: 3120575 - RNA, 17 nt, Mycobacterium bovis subsp bovis AF2122/97
caucgccgccaaccacu

SEQ ID NO: 3120576 - RNA, 14 nt, Mycobacterium bovis subsp bovis AF2122/97
caucgccgcccccg

SEQ ID NO: 3120577 - RNA, 21 nt, Mycobacterium bovis subsp bovis AF2122/97
caucgccgcccgagcacccca

SEQ ID NO: 3120578 - RNA, 16 nt, Mycobacterium bovis subsp bovis AF2122/97
caucgccgccgcgcgu

SEQ ID NO: 3120579 - RNA, 12 nt, Mycobacterium bovis subsp bovis AF2122/97
caucgccgccgg

SEQ ID NO: 3120580 - RNA, 15 nt, Mycobacterium bovis subsp bovis AF2122/97
caucgccgccggugc

SEQ ID NO: 3120581 - RNA, 21 nt, Mycobacterium bovis subsp bovis AF2122/97
caucgccgccggugccgcccg

SEQ ID NO: 3120582 - RNA, 13 nt, Mycobacterium bovis subsp bovis AF2122/97
caucgccgcuggc

SEQ ID NO: 3120583 - RNA, 15 nt, Mycobacterium bovis subsp bovis AF2122/97
caucgccgcuggcca

SEQ ID NO: 3120584 - RNA, 13 nt, Mycobacterium bovis subsp bovis AF2122/97
caucgccggaccg

SEQ ID NO: 3120585 - RNA, 18 nt, Mycobacterium bovis subsp bovis AF2122/97
caucgccggaccggugug

SEQ ID NO: 3120586 - RNA, 13 nt, Mycobacterium bovis subsp bovis AF2122/97
caucgccggaguc

SEQ ID NO: 3120587 - RNA, 13 nt, Mycobacterium bovis subsp bovis AF2122/97
caucgccggcacg

SEQ ID NO: 3120588 - RNA, 12 nt, Mycobacterium bovis subsp bovis AF2122/97
caucgccggcgc

SEQ ID NO: 3120589 - RNA, 16 nt, Mycobacterium bovis subsp bovis AF2122/97
caucgccggcgcgccg

SEQ ID NO: 3120590 - RNA, 20 nt, Mycobacterium bovis subsp bovis AF2122/97
caucgccggguagcuguaca

SEQ ID NO: 3120591 - RNA, 15 nt, Mycobacterium bovis subsp bovis AF2122/97
caucgccucaccacg

SEQ ID NO: 3120592 - RNA, 16 nt, Mycobacterium bovis subsp bovis AF2122/97
caucgccuccagccgg

SEQ ID NO: 3120593 - RNA, 18 nt, Mycobacterium bovis subsp bovis AF2122/97
caucgccuccagccggcg

SEQ ID NO: 3120594 - RNA, 22 nt, Mycobacterium bovis subsp bovis AF2122/97
caucgccuccagccggcgaaug

SEQ ID NO: 3120595 - RNA, 16 nt, Mycobacterium bovis subsp bovis AF2122/97
caucgccuccaggcgc

SEQ ID NO: 3120596 - RNA, 21 nt, Mycobacterium bovis subsp bovis AF2122/97
caucgccuccaggcgccaccc

SEQ ID NO: 3120597 - RNA, 14 nt, Mycobacterium bovis subsp bovis AF2122/97
caucgccuccucga

SEQ ID NO: 3120598 - RNA, 16 nt, Mycobacterium bovis subsp bovis AF2122/97
caucgccuccucgacg

SEQ ID NO: 3120599 - RNA, 13 nt, Mycobacterium bovis subsp bovis AF2122/97
caucgccucgagg

SEQ ID NO: 3120600 - RNA, 14 nt, Mycobacterium bovis subsp bovis AF2122/97
caucgccucgagga

SEQ ID NO: 3120601 - RNA, 23 nt, Mycobacterium bovis subsp bovis AF2122/97
caucgccucggcgcugcgcaccg

SEQ ID NO: 3120602 - RNA, 19 nt, Mycobacterium bovis subsp bovis AF2122/97
caucgccuugaacauggga

SEQ ID NO: 3120603 - RNA, 15 nt, Mycobacterium bovis subsp bovis AF2122/97
caucgccuugcccag

SEQ ID NO: 3120604 - RNA, 17 nt, Mycobacterium bovis subsp bovis AF2122/97
caucgccuugcccagcg

SEQ ID NO: 3120605 - RNA, 22 nt, Mycobacterium bovis subsp bovis AF2122/97
caucgcgaaaccggaccugacc

SEQ ID NO: 3120606 - RNA, 17 nt, Mycobacterium bovis subsp bovis AF2122/97
caucgcgacggcaagca

SEQ ID NO: 3120607 - RNA, 13 nt, Mycobacterium bovis subsp bovis AF2122/97
caucgcgacggcc

SEQ ID NO: 3120608 - RNA, 15 nt, Mycobacterium bovis subsp bovis AF2122/97
caucgcgacggcccg

SEQ ID NO: 3120609 - RNA, 18 nt, Mycobacterium bovis subsp bovis AF2122/97
caucgcgacggcccgauc

SEQ ID NO: 3120610 - RNA, 18 nt, Mycobacterium bovis subsp bovis AF2122/97
caucgcgacuagacgccg

SEQ ID NO: 3120611 - RNA, 21 nt, Mycobacterium bovis subsp bovis AF2122/97
caucgcgacuagacgccgccg

SEQ ID NO: 3120612 - RNA, 22 nt, Mycobacterium bovis subsp bovis AF2122/97
caucgcgacuagacgccgccgc

SEQ ID NO: 3120613 - RNA, 19 nt, Mycobacterium bovis subsp bovis AF2122/97
caucgcgaucggggcgacg

SEQ ID NO: 3120614 - RNA, 22 nt, Mycobacterium bovis subsp bovis AF2122/97
caucgcgaucggggcgacgauc

SEQ ID NO: 3120615 - RNA, 18 nt, Mycobacterium bovis subsp bovis AF2122/97
caucgcgauuccggcggc

SEQ ID NO: 3120616 - RNA, 19 nt, Mycobacterium bovis subsp bovis AF2122/97
caucgcgauuccggcggcc

SEQ ID NO: 3120617 - RNA, 20 nt, Mycobacterium bovis subsp bovis AF2122/97
caucgcgauuccggcggcca

SEQ ID NO: 3120618 - RNA, 22 nt, Mycobacterium bovis subsp bovis AF2122/97
caucgcgauuccggcggccacg

SEQ ID NO: 3120619 - RNA, 22 nt, Mycobacterium bovis subsp bovis AF2122/97
caucgcgcaaccgggcggacag

SEQ ID NO: 3120620 - RNA, 21 nt, Mycobacterium bovis subsp bovis AF2122/97
caucgcgccuuugagcccgcg

SEQ ID NO: 3120621 - RNA, 16 nt, Mycobacterium bovis subsp bovis AF2122/97
caucgcgcgcggcucc

SEQ ID NO: 3120622 - RNA, 17 nt, Mycobacterium bovis subsp bovis AF2122/97
caucgcgcgcggcuccg

SEQ ID NO: 3120623 - RNA, 14 nt, Mycobacterium bovis subsp bovis AF2122/97
caucgcgcggacca

SEQ ID NO: 3120624 - RNA, 16 nt, Mycobacterium bovis subsp bovis AF2122/97
caucgcgcugcggccc

SEQ ID NO: 3120625 - RNA, 13 nt, Mycobacterium bovis subsp bovis AF2122/97
caucgcggcaucg

SEQ ID NO: 3120626 - RNA, 22 nt, Mycobacterium bovis subsp bovis AF2122/97
caucgcggcaucgacgcggcca

SEQ ID NO: 3120627 - RNA, 11 nt, Mycobacterium bovis subsp bovis AF2122/97
caucgcggcga

SEQ ID NO: 3120628 - RNA, 16 nt, Mycobacterium bovis subsp bovis AF2122/97
caucgcggcggcgcuc

SEQ ID NO: 3120629 - RNA, 17 nt, Mycobacterium bovis subsp bovis AF2122/97
caucgcgggcggcgcug

SEQ ID NO: 3120630 - RNA, 19 nt, Mycobacterium bovis subsp bovis AF2122/97
caucgcgggcggcgcuggc

SEQ ID NO: 3120631 - RNA, 22 nt, Mycobacterium bovis subsp bovis AF2122/97
caucgcgggcgugccgaccagc

SEQ ID NO: 3120632 - RNA, 19 nt, Mycobacterium bovis subsp bovis AF2122/97
caucgcgggugaucuccac

SEQ ID NO: 3120633 - RNA, 20 nt, Mycobacterium bovis subsp bovis AF2122/97
caucgcgggugaucuccacc

SEQ ID NO: 3120634 - RNA, 21 nt, Mycobacterium bovis subsp bovis AF2122/97
caucgcgggugaucuccaccg

SEQ ID NO: 3120635 - RNA, 23 nt, Mycobacterium bovis subsp bovis AF2122/97
caucgcgggugaucuccaccggc

SEQ ID NO: 3120636 - RNA, 21 nt, Mycobacterium bovis subsp bovis AF2122/97
caucgcggucgccaccguguc

SEQ ID NO: 3120637 - RNA, 16 nt, Mycobacterium bovis subsp bovis AF2122/97
caucgcgucggcgaug

SEQ ID NO: 3120638 - RNA, 19 nt, Mycobacterium bovis subsp bovis AF2122/97
caucgcgucgucuucuucg

SEQ ID NO: 3120639 - RNA, 21 nt, Mycobacterium bovis subsp bovis AF2122/97
caucgcugggcacucggcccg

SEQ ID NO: 3120640 - RNA, 21 nt, Mycobacterium bovis subsp bovis AF2122/97
caucgcuguaggcagccucuc

SEQ ID NO: 3120641 - RNA, 21 nt, Mycobacterium bovis subsp bovis AF2122/97
caucggaaccguuugacgcgc

SEQ ID NO: 3120642 - RNA, 13 nt, Mycobacterium bovis subsp bovis AF2122/97
caucggaaucgcg

SEQ ID NO: 3120643 - RNA, 20 nt, Mycobacterium bovis subsp bovis AF2122/97
caucggacagcauguucccc

SEQ ID NO: 3120644 - RNA, 14 nt, Mycobacterium bovis subsp bovis AF2122/97
caucggacagcgcc

SEQ ID NO: 3120645 - RNA, 22 nt, Mycobacterium bovis subsp bovis AF2122/97
caucggacagcgccuggccgga

SEQ ID NO: 3120646 - RNA, 14 nt, Mycobacterium bovis subsp bovis AF2122/97
caucggauggcccc

SEQ ID NO: 3120647 - RNA, 17 nt, Mycobacterium bovis subsp bovis AF2122/97
caucggcaaggcggauc

SEQ ID NO: 3120648 - RNA, 16 nt, Mycobacterium bovis subsp bovis AF2122/97
caucggcacaggcggc

SEQ ID NO: 3120649 - RNA, 19 nt, Mycobacterium bovis subsp bovis AF2122/97
caucggcacaggcggccag

SEQ ID NO: 3120650 - RNA, 21 nt, Mycobacterium bovis subsp bovis AF2122/97
caucggcacaggcggccagca

SEQ ID NO: 3120651 - RNA, 11 nt, Mycobacterium bovis subsp bovis AF2122/97
caucggcaccc

SEQ ID NO: 3120652 - RNA, 16 nt, Mycobacterium bovis subsp bovis AF2122/97
caucggcaccccggcc

SEQ ID NO: 3120653 - RNA, 18 nt, Mycobacterium bovis subsp bovis AF2122/97
caucggcaccccggccac

SEQ ID NO: 3120654 - RNA, 13 nt, Mycobacterium bovis subsp bovis AF2122/97
caucggcaccguc

SEQ ID NO: 3120655 - RNA, 16 nt, Mycobacterium bovis subsp bovis AF2122/97
caucggcaccgucucg

SEQ ID NO: 3120656 - RNA, 15 nt, Mycobacterium bovis subsp bovis AF2122/97
caucggcagcagcgc

SEQ ID NO: 3120657 - RNA, 16 nt, Mycobacterium bovis subsp bovis AF2122/97
caucggcagcagcgca

SEQ ID NO: 3120658 - RNA, 21 nt, Mycobacterium bovis subsp bovis AF2122/97
caucggcagcagcgcaacggc

SEQ ID NO: 3120659 - RNA, 19 nt, Mycobacterium bovis subsp bovis AF2122/97
caucggcagccccugccga

SEQ ID NO: 3120660 - RNA, 23 nt, Mycobacterium bovis subsp bovis AF2122/97
caucggcauccgcggggagucga

SEQ ID NO: 3120661 - RNA, 12 nt, Mycobacterium bovis subsp bovis AF2122/97
caucggccaccu

SEQ ID NO: 3120662 - RNA, 20 nt, Mycobacterium bovis subsp bovis AF2122/97
caucggccaccuguuggcau

SEQ ID NO: 3120663 - RNA, 12 nt, Mycobacterium bovis subsp bovis AF2122/97
caucggccagca

SEQ ID NO: 3120664 - RNA, 19 nt, Mycobacterium bovis subsp bovis AF2122/97
caucggccagccguucucg

SEQ ID NO: 3120665 - RNA, 20 nt, Mycobacterium bovis subsp bovis AF2122/97
caucggccagcuugaggucc

SEQ ID NO: 3120666 - RNA, 18 nt, Mycobacterium bovis subsp bovis AF2122/97
caucggccaucucgucga

SEQ ID NO: 3120667 - RNA, 18 nt, Mycobacterium bovis subsp bovis AF2122/97
caucggcccgaucaccau

SEQ ID NO: 3120668 - RNA, 12 nt, Mycobacterium bovis subsp bovis AF2122/97
caucggcccgcu

SEQ ID NO: 3120669 - RNA, 14 nt, Mycobacterium bovis subsp bovis AF2122/97
caucggccgcgguc

SEQ ID NO: 3120670 - RNA, 22 nt, Mycobacterium bovis subsp bovis AF2122/97
caucggccgcggucggccacca

SEQ ID NO: 3120671 - RNA, 14 nt, Mycobacterium bovis subsp bovis AF2122/97
caucggccggcguc

SEQ ID NO: 3120672 - RNA, 21 nt, Mycobacterium bovis subsp bovis AF2122/97
caucggccggguuaucggcag

SEQ ID NO: 3120673 - RNA, 18 nt, Mycobacterium bovis subsp bovis AF2122/97
caucggccucugaccagc

SEQ ID NO: 3120674 - RNA, 15 nt, Mycobacterium bovis subsp bovis AF2122/97
caucggcgaacaacc

SEQ ID NO: 3120675 - RNA, 18 nt, Mycobacterium bovis subsp bovis AF2122/97
caucggcgacaggagacg

SEQ ID NO: 3120676 - RNA, 13 nt, Mycobacterium bovis subsp bovis AF2122/97
caucggcgaccgc

SEQ ID NO: 3120677 - RNA, 19 nt, Mycobacterium bovis subsp bovis AF2122/97
caucggcgaccgccugcgc

SEQ ID NO: 3120678 - RNA, 23 nt, Mycobacterium bovis subsp bovis AF2122/97
caucggcgaggccucggcggccg

SEQ ID NO: 3120679 - RNA, 18 nt, Mycobacterium bovis subsp bovis AF2122/97
caucggcgcuggcaggcu

SEQ ID NO: 3120680 - RNA, 17 nt, Mycobacterium bovis subsp bovis AF2122/97
caucggcggagucgacg

SEQ ID NO: 3120681 - RNA, 23 nt, Mycobacterium bovis subsp bovis AF2122/97
caucggcggcaaggguggugacg

SEQ ID NO: 3120682 - RNA, 14 nt, Mycobacterium bovis subsp bovis AF2122/97
caucggcggcgucg

SEQ ID NO: 3120683 - RNA, 17 nt, Mycobacterium bovis subsp bovis AF2122/97
caucggcggcgucgacg

SEQ ID NO: 3120684 - RNA, 21 nt, Mycobacterium bovis subsp bovis AF2122/97
caucggcggcgucgacgucca

SEQ ID NO: 3120685 - RNA, 22 nt, Mycobacterium bovis subsp bovis AF2122/97
caucggcgggucugggucaggc

SEQ ID NO: 3120686 - RNA, 18 nt, Mycobacterium bovis subsp bovis AF2122/97
caucggcuaggccggccg

SEQ ID NO: 3120687 - RNA, 19 nt, Mycobacterium bovis subsp bovis AF2122/97
caucggcuaggccggccgg

SEQ ID NO: 3120688 - RNA, 17 nt, Mycobacterium bovis subsp bovis AF2122/97
caucggcuggccgcgcc

SEQ ID NO: 3120689 - RNA, 20 nt, Mycobacterium bovis subsp bovis AF2122/97
caucggcuuugaggcgugca

SEQ ID NO: 3120690 - RNA, 12 nt, Mycobacterium bovis subsp bovis AF2122/97
caucgggaccgg

SEQ ID NO: 3120691 - RNA, 22 nt, Mycobacterium bovis subsp bovis AF2122/97
caucgggaccggggacgcgccc

SEQ ID NO: 3120692 - RNA, 13 nt, Mycobacterium bovis subsp bovis AF2122/97
caucgggagccgc

SEQ ID NO: 3120693 - RNA, 14 nt, Mycobacterium bovis subsp bovis AF2122/97
caucgggagccgca

SEQ ID NO: 3120694 - RNA, 14 nt, Mycobacterium bovis subsp bovis AF2122/97
caucgggccgccga

SEQ ID NO: 3120695 - RNA, 20 nt, Mycobacterium bovis subsp bovis AF2122/97
caucgggccgguggacgugc

SEQ ID NO: 3120696 - RNA, 19 nt, Mycobacterium bovis subsp bovis AF2122/97
caucgggcgagcucgucga

SEQ ID NO: 3120697 - RNA, 12 nt, Mycobacterium bovis subsp bovis AF2122/97
caucgggcgcgg

SEQ ID NO: 3120698 - RNA, 15 nt, Mycobacterium bovis subsp bovis AF2122/97
caucgggcggcaccg

SEQ ID NO: 3120699 - RNA, 21 nt, Mycobacterium bovis subsp bovis AF2122/97
caucgggcuugcgcagcagcg

SEQ ID NO: 3120700 - RNA, 17 nt, Mycobacterium bovis subsp bovis AF2122/97
caucgggguggccacca

SEQ ID NO: 3120701 - RNA, 20 nt, Mycobacterium bovis subsp bovis AF2122/97
caucgggucgcugccggcug

SEQ ID NO: 3120702 - RNA, 14 nt, Mycobacterium bovis subsp bovis AF2122/97
caucggguggcgag

SEQ ID NO: 3120703 - RNA, 17 nt, Mycobacterium bovis subsp bovis AF2122/97
caucggguggcgaggca

SEQ ID NO: 3120704 - RNA, 23 nt, Mycobacterium bovis subsp bovis AF2122/97
caucggguucuucaacuccggga

SEQ ID NO: 3120705 - RNA, 23 nt, Mycobacterium bovis subsp bovis AF2122/97
caucgguaauagcggaacgggca

SEQ ID NO: 3120706 - RNA, 16 nt, Mycobacterium bovis subsp bovis AF2122/97
caucggucaccgcggc

SEQ ID NO: 3120707 - RNA, 20 nt, Mycobacterium bovis subsp bovis AF2122/97
caucggucagcaugggguag

SEQ ID NO: 3120708 - RNA, 16 nt, Mycobacterium bovis subsp bovis AF2122/97
caucggucagcgccga

SEQ ID NO: 3120709 - RNA, 18 nt, Mycobacterium bovis subsp bovis AF2122/97
caucggucagcgccgacu

SEQ ID NO: 3120710 - RNA, 17 nt, Mycobacterium bovis subsp bovis AF2122/97
caucggucagcgcggca

SEQ ID NO: 3120711 - RNA, 22 nt, Mycobacterium bovis subsp bovis AF2122/97
caucggucagcgggcacgccgc

SEQ ID NO: 3120712 - RNA, 14 nt, Mycobacterium bovis subsp bovis AF2122/97
caucggucccacug

SEQ ID NO: 3120713 - RNA, 20 nt, Mycobacterium bovis subsp bovis AF2122/97
caucggucccacugccggug

SEQ ID NO: 3120714 - RNA, 16 nt, Mycobacterium bovis subsp bovis AF2122/97
caucggucucgcacca

SEQ ID NO: 3120715 - RNA, 17 nt, Mycobacterium bovis subsp bovis AF2122/97
caucggugaucaaaccg

SEQ ID NO: 3120716 - RNA, 21 nt, Mycobacterium bovis subsp bovis AF2122/97
caucggugaucaaaccggcgg

SEQ ID NO: 3120717 - RNA, 22 nt, Mycobacterium bovis subsp bovis AF2122/97
caucggugaucaaaccggcggc

SEQ ID NO: 3120718 - RNA, 15 nt, Mycobacterium bovis subsp bovis AF2122/97
caucggugaugaguc

SEQ ID NO: 3120719 - RNA, 19 nt, Mycobacterium bovis subsp bovis AF2122/97
caucggugccacggcaccg

SEQ ID NO: 3120720 - RNA, 20 nt, Mycobacterium bovis subsp bovis AF2122/97
caucggugccacguucgcgg

SEQ ID NO: 3120721 - RNA, 20 nt, Mycobacterium bovis subsp bovis AF2122/97
caucggugcgcacggcggcc

SEQ ID NO: 3120722 - RNA, 17 nt, Mycobacterium bovis subsp bovis AF2122/97
caucggugcgggcgcca

SEQ ID NO: 3120723 - RNA, 12 nt, Mycobacterium bovis subsp bovis AF2122/97
caucgguggcgc

SEQ ID NO: 3120724 - RNA, 13 nt, Mycobacterium bovis subsp bovis AF2122/97
caucgguggcggc

SEQ ID NO: 3120725 - RNA, 22 nt, Mycobacterium bovis subsp bovis AF2122/97
caucggugguaacaccggcgag

SEQ ID NO: 3120726 - RNA, 21 nt, Mycobacterium bovis subsp bovis AF2122/97
caucggugguggcgucgaugg

SEQ ID NO: 3120727 - RNA, 20 nt, Mycobacterium bovis subsp bovis AF2122/97
caucggugguuagguggcug

SEQ ID NO: 3120728 - RNA, 12 nt, Mycobacterium bovis subsp bovis AF2122/97
caucgguugacc

SEQ ID NO: 3120729 - RNA, 20 nt, Mycobacterium bovis subsp bovis AF2122/97
caucgguugacccggcagcc

SEQ ID NO: 3120730 - RNA, 16 nt, Mycobacterium bovis subsp bovis AF2122/97
caucguaggccggcau

SEQ ID NO: 3120731 - RNA, 14 nt, Mycobacterium bovis subsp bovis AF2122/97
caucgucaggaacc

SEQ ID NO: 3120732 - RNA, 12 nt, Mycobacterium bovis subsp bovis AF2122/97
caucgucaucga

SEQ ID NO: 3120733 - RNA, 18 nt, Mycobacterium bovis subsp bovis AF2122/97
caucgucaucgacgagcg

SEQ ID NO: 3120734 - RNA, 21 nt, Mycobacterium bovis subsp bovis AF2122/97
caucguccacgcagaggcggc

SEQ ID NO: 3120735 - RNA, 23 nt, Mycobacterium bovis subsp bovis AF2122/97
caucguccacgcagaggcggcug

SEQ ID NO: 3120736 - RNA, 16 nt, Mycobacterium bovis subsp bovis AF2122/97
caucgucgaagaccuc

SEQ ID NO: 3120737 - RNA, 13 nt, Mycobacterium bovis subsp bovis AF2122/97
caucgucgacgcc

SEQ ID NO: 3120738 - RNA, 22 nt, Mycobacterium bovis subsp bovis AF2122/97
caucgucgagcgcggugccgcc

SEQ ID NO: 3120739 - RNA, 22 nt, Mycobacterium bovis subsp bovis AF2122/97
caucgucgccaagcccaggcga

SEQ ID NO: 3120740 - RNA, 15 nt, Mycobacterium bovis subsp bovis AF2122/97
caucgucgccgagcg

SEQ ID NO: 3120741 - RNA, 15 nt, Mycobacterium bovis subsp bovis AF2122/97
caucgucgccgcgca

SEQ ID NO: 3120742 - RNA, 16 nt, Mycobacterium bovis subsp bovis AF2122/97
caucgucgcgacgacg

SEQ ID NO: 3120743 - RNA, 21 nt, Mycobacterium bovis subsp bovis AF2122/97
caucgucggaaugcuggggcc

SEQ ID NO: 3120744 - RNA, 13 nt, Mycobacterium bovis subsp bovis AF2122/97
caucgucggcaac

SEQ ID NO: 3120745 - RNA, 14 nt, Mycobacterium bovis subsp bovis AF2122/97
caucgucggcgggc

SEQ ID NO: 3120746 - RNA, 15 nt, Mycobacterium bovis subsp bovis AF2122/97
caucgucggcgggcg

SEQ ID NO: 3120747 - RNA, 20 nt, Mycobacterium bovis subsp bovis AF2122/97
caucgucggcgggcggcagc

SEQ ID NO: 3120748 - RNA, 15 nt, Mycobacterium bovis subsp bovis AF2122/97
caucgucugguggca

SEQ ID NO: 3120749 - RNA, 14 nt, Mycobacterium bovis subsp bovis AF2122/97
caucgugcugaagc

SEQ ID NO: 3120750 - RNA, 16 nt, Mycobacterium bovis subsp bovis AF2122/97
caucgugcugaagcug

SEQ ID NO: 3120751 - RNA, 14 nt, Mycobacterium bovis subsp bovis AF2122/97
caucguggcgucgu

SEQ ID NO: 3120752 - RNA, 22 nt, Mycobacterium bovis subsp bovis AF2122/97
caucguggcgucgugcgcggcc

SEQ ID NO: 3120753 - RNA, 12 nt, Mycobacterium bovis subsp bovis AF2122/97
caucgugguaac

SEQ ID NO: 3120754 - RNA, 18 nt, Mycobacterium bovis subsp bovis AF2122/97
caucguucaugaucggca

SEQ ID NO: 3120755 - RNA, 18 nt, Mycobacterium bovis subsp bovis AF2122/97
caucguugacccggcgau

SEQ ID NO: 3120756 - RNA, 19 nt, Mycobacterium bovis subsp bovis AF2122/97
caucguugccggugccgcc

SEQ ID NO: 3120757 - RNA, 19 nt, Mycobacterium bovis subsp bovis AF2122/97
caucguuggccgggcacgc

SEQ ID NO: 3120758 - RNA, 15 nt, Mycobacterium bovis subsp bovis AF2122/97
caucguugucauaga

SEQ ID NO: 3120759 - RNA, 18 nt, Mycobacterium bovis subsp bovis AF2122/97
caucuacaucgucgagcg

SEQ ID NO: 3120760 - RNA, 21 nt, Mycobacterium bovis subsp bovis AF2122/97
caucuacaucgucgagcgcgg

SEQ ID NO: 3120761 - RNA, 17 nt, Mycobacterium bovis subsp bovis AF2122/97
caucuaccagcucaccc

SEQ ID NO: 3120762 - RNA, 23 nt, Mycobacterium bovis subsp bovis AF2122/97
caucuagguucaguuccaccgcg

SEQ ID NO: 3120763 - RNA, 22 nt, Mycobacterium bovis subsp bovis AF2122/97
caucucaccgggcccgacgacg

SEQ ID NO: 3120764 - RNA, 14 nt, Mycobacterium bovis subsp bovis AF2122/97
caucuccaccgucg

SEQ ID NO: 3120765 - RNA, 16 nt, Mycobacterium bovis subsp bovis AF2122/97
caucucccgaccgccg

SEQ ID NO: 3120766 - RNA, 19 nt, Mycobacterium bovis subsp bovis AF2122/97
caucucccgaccgccgagc

SEQ ID NO: 3120767 - RNA, 21 nt, Mycobacterium bovis subsp bovis AF2122/97
caucucccgaccgccgagcgg

SEQ ID NO: 3120768 - RNA, 13 nt, Mycobacterium bovis subsp bovis AF2122/97
caucuccgccguc

SEQ ID NO: 3120769 - RNA, 19 nt, Mycobacterium bovis subsp bovis AF2122/97
caucuccgccgucgccacc

SEQ ID NO: 3120770 - RNA, 16 nt, Mycobacterium bovis subsp bovis AF2122/97
caucuccgucggccag

SEQ ID NO: 3120771 - RNA, 15 nt, Mycobacterium bovis subsp bovis AF2122/97
caucuccucgccugc

SEQ ID NO: 3120772 - RNA, 14 nt, Mycobacterium bovis subsp bovis AF2122/97
caucuccucggcga

SEQ ID NO: 3120773 - RNA, 15 nt, Mycobacterium bovis subsp bovis AF2122/97
caucucgacggugac

SEQ ID NO: 3120774 - RNA, 15 nt, Mycobacterium bovis subsp bovis AF2122/97
caucucgacgucggu

SEQ ID NO: 3120775 - RNA, 19 nt, Mycobacterium bovis subsp bovis AF2122/97
caucucgagcaugcccagc

SEQ ID NO: 3120776 - RNA, 16 nt, Mycobacterium bovis subsp bovis AF2122/97
caucucggcgcagccg

SEQ ID NO: 3120777 - RNA, 13 nt, Mycobacterium bovis subsp bovis AF2122/97
caucucggcggcc

SEQ ID NO: 3120778 - RNA, 22 nt, Mycobacterium bovis subsp bovis AF2122/97
caucucggcggccaacagcacc

SEQ ID NO: 3120779 - RNA, 23 nt, Mycobacterium bovis subsp bovis AF2122/97
caucucggcggccaacagcaccc

SEQ ID NO: 3120780 - RNA, 22 nt, Mycobacterium bovis subsp bovis AF2122/97
caucucggcuacgccucggcgu

SEQ ID NO: 3120781 - RNA, 19 nt, Mycobacterium bovis subsp bovis AF2122/97
caucucggucagaugcgcg

SEQ ID NO: 3120782 - RNA, 14 nt, Mycobacterium bovis subsp bovis AF2122/97
caucucgucgaucu

SEQ ID NO: 3120783 - RNA, 16 nt, Mycobacterium bovis subsp bovis AF2122/97
caucucgucgucgcgg

SEQ ID NO: 3120784 - RNA, 19 nt, Mycobacterium bovis subsp bovis AF2122/97
caucucgucgucgcggccg

SEQ ID NO: 3120785 - RNA, 15 nt, Mycobacterium bovis subsp bovis AF2122/97
caucucgucgucggg

SEQ ID NO: 3120786 - RNA, 22 nt, Mycobacterium bovis subsp bovis AF2122/97
caucucuugcaaccuggacugc

SEQ ID NO: 3120787 - RNA, 15 nt, Mycobacterium bovis subsp bovis AF2122/97
caucugacagcuggg

SEQ ID NO: 3120788 - RNA, 22 nt, Mycobacterium bovis subsp bovis AF2122/97
caucugaggcuuccagcucggg

SEQ ID NO: 3120789 - RNA, 16 nt, Mycobacterium bovis subsp bovis AF2122/97
caucugaugacggugu

SEQ ID NO: 3120790 - RNA, 19 nt, Mycobacterium bovis subsp bovis AF2122/97
caucugaugacggugugga

SEQ ID NO: 3120791 - RNA, 24 nt, Mycobacterium bovis subsp bovis AF2122/97
caucugccaaucugcacgcgcucg

SEQ ID NO: 3120792 - RNA, 13 nt, Mycobacterium bovis subsp bovis AF2122/97
caucugccggucg

SEQ ID NO: 3120793 - RNA, 16 nt, Mycobacterium bovis subsp bovis AF2122/97
caucugccggucgaug

SEQ ID NO: 3120794 - RNA, 13 nt, Mycobacterium bovis subsp bovis AF2122/97
caucugcgggacg

SEQ ID NO: 3120795 - RNA, 22 nt, Mycobacterium bovis subsp bovis AF2122/97
caucugcuguggaucgacaccg

SEQ ID NO: 3120796 - RNA, 12 nt, Mycobacterium bovis subsp bovis AF2122/97
caucuggccggc

SEQ ID NO: 3120797 - RNA, 14 nt, Mycobacterium bovis subsp bovis AF2122/97
caucuggccggcgg

SEQ ID NO: 3120798 - RNA, 15 nt, Mycobacterium bovis subsp bovis AF2122/97
caucuggccggcggu

SEQ ID NO: 3120799 - RNA, 13 nt, Mycobacterium bovis subsp bovis AF2122/97
caucuggcgccgu

SEQ ID NO: 3120800 - RNA, 19 nt, Mycobacterium bovis subsp bovis AF2122/97
caucuggcgccguuagcgu

SEQ ID NO: 3120801 - RNA, 13 nt, Mycobacterium bovis subsp bovis AF2122/97
caucuggcgcgcc

SEQ ID NO: 3120802 - RNA, 20 nt, Mycobacterium bovis subsp bovis AF2122/97
caucuggcgcgccguucuga

SEQ ID NO: 3120803 - RNA, 15 nt, Mycobacterium bovis subsp bovis AF2122/97
caucuggcgcugcug

SEQ ID NO: 3120804 - RNA, 18 nt, Mycobacterium bovis subsp bovis AF2122/97
caucuggcgcugcuggca

SEQ ID NO: 3120805 - RNA, 19 nt, Mycobacterium bovis subsp bovis AF2122/97
caucuggggguagccgccg

SEQ ID NO: 3120806 - RNA, 22 nt, Mycobacterium bovis subsp bovis AF2122/97
caucuggggguagccgccggcg

SEQ ID NO: 3120807 - RNA, 20 nt, Mycobacterium bovis subsp bovis AF2122/97
caucugguauggguccucga

SEQ ID NO: 3120808 - RNA, 19 nt, Mycobacterium bovis subsp bovis AF2122/97
caucugguggaccuccgga

SEQ ID NO: 3120809 - RNA, 18 nt, Mycobacterium bovis subsp bovis AF2122/97
caucuguaaccuccucga

SEQ ID NO: 3120810 - RNA, 21 nt, Mycobacterium bovis subsp bovis AF2122/97
caucuguuccgugccagcugc

SEQ ID NO: 3120811 - RNA, 18 nt, Mycobacterium bovis subsp bovis AF2122/97
caucuucaccacgccgua

SEQ ID NO: 3120812 - RNA, 20 nt, Mycobacterium bovis subsp bovis AF2122/97
caucuucgcgcagccgccgc

SEQ ID NO: 3120813 - RNA, 16 nt, Mycobacterium bovis subsp bovis AF2122/97
caucuucggacgccag

SEQ ID NO: 3120814 - RNA, 19 nt, Mycobacterium bovis subsp bovis AF2122/97
caucuucggacgccagcuc

SEQ ID NO: 3120815 - RNA, 12 nt, Mycobacterium bovis subsp bovis AF2122/97
caucuugaccaa

SEQ ID NO: 3120816 - RNA, 13 nt, Mycobacterium bovis subsp bovis AF2122/97
caucuugccaccg

SEQ ID NO: 3120817 - RNA, 15 nt, Mycobacterium bovis subsp bovis AF2122/97
caucuugcggcagcg

SEQ ID NO: 3120818 - RNA, 21 nt, Mycobacterium bovis subsp bovis AF2122/97
caucuugucgagcaccucgaa

SEQ ID NO: 3120819 - RNA, 14 nt, Mycobacterium bovis subsp bovis AF2122/97
caucuugucgaucu

SEQ ID NO: 3120820 - RNA, 17 nt, Mycobacterium bovis subsp bovis AF2122/97
caucuuuggcggccgca

SEQ ID NO: 3120821 - RNA, 18 nt, Mycobacterium bovis subsp bovis AF2122/97
caugaacaucggccgggu

SEQ ID NO: 3120822 - RNA, 20 nt, Mycobacterium bovis subsp bovis AF2122/97
caugaacgaucggaccacca

SEQ ID NO: 3120823 - RNA, 18 nt, Mycobacterium bovis subsp bovis AF2122/97
caugaacgcaagcagcgc

SEQ ID NO: 3120824 - RNA, 19 nt, Mycobacterium bovis subsp bovis AF2122/97
caugaacgcaagcagcgcg

SEQ ID NO: 3120825 - RNA, 19 nt, Mycobacterium bovis subsp bovis AF2122/97
caugaacucgaacuggguc

SEQ ID NO: 3120826 - RNA, 16 nt, Mycobacterium bovis subsp bovis AF2122/97
caugaacugcucgccg

SEQ ID NO: 3120827 - RNA, 13 nt, Mycobacterium bovis subsp bovis AF2122/97
caugaagauccag

SEQ ID NO: 3120828 - RNA, 14 nt, Mycobacterium bovis subsp bovis AF2122/97
caugaagccgggcg

SEQ ID NO: 3120829 - RNA, 23 nt, Mycobacterium bovis subsp bovis AF2122/97
caugaaggagaucccccaggcga

SEQ ID NO: 3120830 - RNA, 22 nt, Mycobacterium bovis subsp bovis AF2122/97
caugaaucgcgcuucaggcauc

SEQ ID NO: 3120831 - RNA, 14 nt, Mycobacterium bovis subsp bovis AF2122/97
caugacaccggcca

SEQ ID NO: 3120832 - RNA, 20 nt, Mycobacterium bovis subsp bovis AF2122/97
caugacaccggccaccagcc

SEQ ID NO: 3120833 - RNA, 19 nt, Mycobacterium bovis subsp bovis AF2122/97
caugacagccccgccgccc

SEQ ID NO: 3120834 - RNA, 15 nt, Mycobacterium bovis subsp bovis AF2122/97
caugaccgcucggag

SEQ ID NO: 3120835 - RNA, 15 nt, Mycobacterium bovis subsp bovis AF2122/97
caugaccggccgcca

SEQ ID NO: 3120836 - RNA, 23 nt, Mycobacterium bovis subsp bovis AF2122/97
caugaccgggcuggccagcgcgc

SEQ ID NO: 3120837 - RNA, 13 nt, Mycobacterium bovis subsp bovis AF2122/97
caugacgaucgcg

SEQ ID NO: 3120838 - RNA, 14 nt, Mycobacterium bovis subsp bovis AF2122/97
caugacgaucgcgg

SEQ ID NO: 3120839 - RNA, 12 nt, Mycobacterium bovis subsp bovis AF2122/97
caugacggcucc

SEQ ID NO: 3120840 - RNA, 15 nt, Mycobacterium bovis subsp bovis AF2122/97
caugagccgcugcgc

SEQ ID NO: 3120841 - RNA, 17 nt, Mycobacterium bovis subsp bovis AF2122/97
caugagccgcugcgcca

SEQ ID NO: 3120842 - RNA, 20 nt, Mycobacterium bovis subsp bovis AF2122/97
caugagccgcugcgccaggu

SEQ ID NO: 3120843 - RNA, 21 nt, Mycobacterium bovis subsp bovis AF2122/97
caugagcgaccgcgagggcca

SEQ ID NO: 3120844 - RNA, 15 nt, Mycobacterium bovis subsp bovis AF2122/97
caugagcgcgcccaa

SEQ ID NO: 3120845 - RNA, 16 nt, Mycobacterium bovis subsp bovis AF2122/97
caugagcguucagcac

SEQ ID NO: 3120846 - RNA, 18 nt, Mycobacterium bovis subsp bovis AF2122/97
caugagggcaucgagacg

SEQ ID NO: 3120847 - RNA, 14 nt, Mycobacterium bovis subsp bovis AF2122/97
caugaggugagcug

SEQ ID NO: 3120848 - RNA, 21 nt, Mycobacterium bovis subsp bovis AF2122/97
caugaguacaaaccucgguuu

SEQ ID NO: 3120849 - RNA, 14 nt, Mycobacterium bovis subsp bovis AF2122/97
caugaucacaccga

SEQ ID NO: 3120850 - RNA, 20 nt, Mycobacterium bovis subsp bovis AF2122/97
caugaucgcaccgagguugc

SEQ ID NO: 3120851 - RNA, 13 nt, Mycobacterium bovis subsp bovis AF2122/97
caugaucggcaga

SEQ ID NO: 3120852 - RNA, 13 nt, Mycobacterium bovis subsp bovis AF2122/97
caugaucucggcg

SEQ ID NO: 3120853 - RNA, 15 nt, Mycobacterium bovis subsp bovis AF2122/97
caugaugaugacauc

SEQ ID NO: 3120854 - RNA, 15 nt, Mycobacterium bovis subsp bovis AF2122/97
caugaugccggacgc

SEQ ID NO: 3120855 - RNA, 20 nt, Mycobacterium bovis subsp bovis AF2122/97
caugaugccuaccgggcccg

SEQ ID NO: 3120856 - RNA, 12 nt, Mycobacterium bovis subsp bovis AF2122/97
caugauggccgc

SEQ ID NO: 3120857 - RNA, 19 nt, Mycobacterium bovis subsp bovis AF2122/97
caugauguagcggcguucc

SEQ ID NO: 3120858 - RNA, 17 nt, Mycobacterium bovis subsp bovis AF2122/97
caugaugugcagcgagu

SEQ ID NO: 3120859 - RNA, 15 nt, Mycobacterium bovis subsp bovis AF2122/97
caugauucgcugcgc

SEQ ID NO: 3120860 - RNA, 20 nt, Mycobacterium bovis subsp bovis AF2122/97
caugauugccaggaccgcgc

SEQ ID NO: 3120861 - RNA, 15 nt, Mycobacterium bovis subsp bovis AF2122/97
caugauuggcucggg

SEQ ID NO: 3120862 - RNA, 16 nt, Mycobacterium bovis subsp bovis AF2122/97
caugcaaaagccgcga

SEQ ID NO: 3120863 - RNA, 14 nt, Mycobacterium bovis subsp bovis AF2122/97
caugcaacacaccg

SEQ ID NO: 3120864 - RNA, 19 nt, Mycobacterium bovis subsp bovis AF2122/97
caugcaagccgacaucggc

SEQ ID NO: 3120865 - RNA, 14 nt, Mycobacterium bovis subsp bovis AF2122/97
caugcaccgaugcc

SEQ ID NO: 3120866 - RNA, 23 nt, Mycobacterium bovis subsp bovis AF2122/97
caugcaccgaugccgaagccccc

SEQ ID NO: 3120867 - RNA, 14 nt, Mycobacterium bovis subsp bovis AF2122/97
caugcacgucaucg

SEQ ID NO: 3120868 - RNA, 21 nt, Mycobacterium bovis subsp bovis AF2122/97
caugcacgucaucggcuggcc

SEQ ID NO: 3120869 - RNA, 18 nt, Mycobacterium bovis subsp bovis AF2122/97
caugcagcgcgucgccga

SEQ ID NO: 3120870 - RNA, 23 nt, Mycobacterium bovis subsp bovis AF2122/97
caugccaagcuccaaccaugcgg

SEQ ID NO: 3120871 - RNA, 15 nt, Mycobacterium bovis subsp bovis AF2122/97
caugccacacacugc

SEQ ID NO: 3120872 - RNA, 14 nt, Mycobacterium bovis subsp bovis AF2122/97
caugccacagcggc

SEQ ID NO: 3120873 - RNA, 19 nt, Mycobacterium bovis subsp bovis AF2122/97
caugccauagaugcccgcg

SEQ ID NO: 3120874 - RNA, 19 nt, Mycobacterium bovis subsp bovis AF2122/97
caugccauggcccgugcgg

SEQ ID NO: 3120875 - RNA, 17 nt, Mycobacterium bovis subsp bovis AF2122/97
caugcccacgcugccgc

SEQ ID NO: 3120876 - RNA, 21 nt, Mycobacterium bovis subsp bovis AF2122/97
caugcccagaaaaccgccgca

SEQ ID NO: 3120877 - RNA, 16 nt, Mycobacterium bovis subsp bovis AF2122/97
caugcccagcgcacgg

SEQ ID NO: 3120878 - RNA, 22 nt, Mycobacterium bovis subsp bovis AF2122/97
caugcccaggugcguccaggcc

SEQ ID NO: 3120879 - RNA, 17 nt, Mycobacterium bovis subsp bovis AF2122/97
caugcccaucuccaaca

SEQ ID NO: 3120880 - RNA, 18 nt, Mycobacterium bovis subsp bovis AF2122/97
caugcccaucuccaacag

SEQ ID NO: 3120881 - RNA, 22 nt, Mycobacterium bovis subsp bovis AF2122/97
caugcccaugauggccgcggcu

SEQ ID NO: 3120882 - RNA, 16 nt, Mycobacterium bovis subsp bovis AF2122/97
caugcccggacgaugg

SEQ ID NO: 3120883 - RNA, 21 nt, Mycobacterium bovis subsp bovis AF2122/97
caugcccggacgauggcgucg

SEQ ID NO: 3120884 - RNA, 23 nt, Mycobacterium bovis subsp bovis AF2122/97
caugcccgggaugacugggcaaa

SEQ ID NO: 3120885 - RNA, 19 nt, Mycobacterium bovis subsp bovis AF2122/97
caugcccgucagcggacag

SEQ ID NO: 3120886 - RNA, 23 nt, Mycobacterium bovis subsp bovis AF2122/97
caugcccgugggugcgucugggc

SEQ ID NO: 3120887 - RNA, 16 nt, Mycobacterium bovis subsp bovis AF2122/97
caugcccugcgcucgg

SEQ ID NO: 3120888 - RNA, 15 nt, Mycobacterium bovis subsp bovis AF2122/97
caugcccuggaccag

SEQ ID NO: 3120889 - RNA, 16 nt, Mycobacterium bovis subsp bovis AF2122/97
caugccgacccgggcg

SEQ ID NO: 3120890 - RNA, 14 nt, Mycobacterium bovis subsp bovis AF2122/97
caugccgaccggca

SEQ ID NO: 3120891 - RNA, 17 nt, Mycobacterium bovis subsp bovis AF2122/97
caugccgacgacaacag

SEQ ID NO: 3120892 - RNA, 13 nt, Mycobacterium bovis subsp bovis AF2122/97
caugccgacgacg

SEQ ID NO: 3120893 - RNA, 19 nt, Mycobacterium bovis subsp bovis AF2122/97
caugccgccaugcgcacca

SEQ ID NO: 3120894 - RNA, 12 nt, Mycobacterium bovis subsp bovis AF2122/97
caugccgcccau

SEQ ID NO: 3120895 - RNA, 19 nt, Mycobacterium bovis subsp bovis AF2122/97
caugccgcccaucaccccg

SEQ ID NO: 3120896 - RNA, 19 nt, Mycobacterium bovis subsp bovis AF2122/97
caugccgcccgcgccgccg

SEQ ID NO: 3120897 - RNA, 20 nt, Mycobacterium bovis subsp bovis AF2122/97
caugccgcccgcgccgccgg

SEQ ID NO: 3120898 - RNA, 12 nt, Mycobacterium bovis subsp bovis AF2122/97
caugccgcggcg

SEQ ID NO: 3120899 - RNA, 14 nt, Mycobacterium bovis subsp bovis AF2122/97
caugccgcggcgga

SEQ ID NO: 3120900 - RNA, 12 nt, Mycobacterium bovis subsp bovis AF2122/97
caugccgcucgg

SEQ ID NO: 3120901 - RNA, 15 nt, Mycobacterium bovis subsp bovis AF2122/97
caugccgcucggcaa

SEQ ID NO: 3120902 - RNA, 20 nt, Mycobacterium bovis subsp bovis AF2122/97
caugccggauaggucgggca

SEQ ID NO: 3120903 - RNA, 11 nt, Mycobacterium bovis subsp bovis AF2122/97
caugccggcga

SEQ ID NO: 3120904 - RNA, 21 nt, Mycobacterium bovis subsp bovis AF2122/97
caugccggcgaacucgcgccg

SEQ ID NO: 3120905 - RNA, 20 nt, Mycobacterium bovis subsp bovis AF2122/97
caugccggcgaagccggccg

SEQ ID NO: 3120906 - RNA, 19 nt, Mycobacterium bovis subsp bovis AF2122/97
caugccggcuagcucggcg

SEQ ID NO: 3120907 - RNA, 21 nt, Mycobacterium bovis subsp bovis AF2122/97
caugccggcuagcucggcggc

SEQ ID NO: 3120908 - RNA, 23 nt, Mycobacterium bovis subsp bovis AF2122/97
caugccggucauccgggcgacca

SEQ ID NO: 3120909 - RNA, 12 nt, Mycobacterium bovis subsp bovis AF2122/97
caugccgguguu

SEQ ID NO: 3120910 - RNA, 21 nt, Mycobacterium bovis subsp bovis AF2122/97
caugccgucggguaggccgcc

SEQ ID NO: 3120911 - RNA, 20 nt, Mycobacterium bovis subsp bovis AF2122/97
caugccgugugugcgaucca

SEQ ID NO: 3120912 - RNA, 22 nt, Mycobacterium bovis subsp bovis AF2122/97
caugccgugugugcgauccagg

SEQ ID NO: 3120913 - RNA, 19 nt, Mycobacterium bovis subsp bovis AF2122/97
caugccguugcgaucgcgu

SEQ ID NO: 3120914 - RNA, 13 nt, Mycobacterium bovis subsp bovis AF2122/97
caugccuccagaa

SEQ ID NO: 3120915 - RNA, 20 nt, Mycobacterium bovis subsp bovis AF2122/97
caugccuucggccaaccaug

SEQ ID NO: 3120916 - RNA, 22 nt, Mycobacterium bovis subsp bovis AF2122/97
caugccuucggccaaccaugcu

SEQ ID NO: 3120917 - RNA, 19 nt, Mycobacterium bovis subsp bovis AF2122/97
caugcgacuucaucuucga

SEQ ID NO: 3120918 - RNA, 17 nt, Mycobacterium bovis subsp bovis AF2122/97
caugcgagucgucccag

SEQ ID NO: 3120919 - RNA, 16 nt, Mycobacterium bovis subsp bovis AF2122/97
caugcgauacacggcg

SEQ ID NO: 3120920 - RNA, 19 nt, Mycobacterium bovis subsp bovis AF2122/97
caugcgauacacggcggcg

SEQ ID NO: 3120921 - RNA, 17 nt, Mycobacterium bovis subsp bovis AF2122/97
caugcgauucugcgucc

SEQ ID NO: 3120922 - RNA, 17 nt, Mycobacterium bovis subsp bovis AF2122/97
caugcgcaccaguccag

SEQ ID NO: 3120923 - RNA, 19 nt, Mycobacterium bovis subsp bovis AF2122/97
caugcgcagaaacgccgag

SEQ ID NO: 3120924 - RNA, 17 nt, Mycobacterium bovis subsp bovis AF2122/97
caugcgccaacccggcc

SEQ ID NO: 3120925 - RNA, 18 nt, Mycobacterium bovis subsp bovis AF2122/97
caugcgcgcgccggugcu

SEQ ID NO: 3120926 - RNA, 16 nt, Mycobacterium bovis subsp bovis AF2122/97
caugcgcguccagcug

SEQ ID NO: 3120927 - RNA, 18 nt, Mycobacterium bovis subsp bovis AF2122/97
caugcgcguccagcuggc

SEQ ID NO: 3120928 - RNA, 13 nt, Mycobacterium bovis subsp bovis AF2122/97
caugcgcuccggc

SEQ ID NO: 3120929 - RNA, 20 nt, Mycobacterium bovis subsp bovis AF2122/97
caugcgcuccggcgcgacgc

SEQ ID NO: 3120930 - RNA, 12 nt, Mycobacterium bovis subsp bovis AF2122/97
caugcgcucgcg

SEQ ID NO: 3120931 - RNA, 19 nt, Mycobacterium bovis subsp bovis AF2122/97
caugcgcuggaaugcgguc

SEQ ID NO: 3120932 - RNA, 20 nt, Mycobacterium bovis subsp bovis AF2122/97
caugcggaauuugcuugggc

SEQ ID NO: 3120933 - RNA, 21 nt, Mycobacterium bovis subsp bovis AF2122/97
caugcggaucacaucggccau

SEQ ID NO: 3120934 - RNA, 19 nt, Mycobacterium bovis subsp bovis AF2122/97
caugcggaucggcggaccg

SEQ ID NO: 3120935 - RNA, 13 nt, Mycobacterium bovis subsp bovis AF2122/97
caugcggccaugg

SEQ ID NO: 3120936 - RNA, 22 nt, Mycobacterium bovis subsp bovis AF2122/97
caugcggcugccucccuuccgc

SEQ ID NO: 3120937 - RNA, 16 nt, Mycobacterium bovis subsp bovis AF2122/97
caugcgggcagcacuc

SEQ ID NO: 3120938 - RNA, 20 nt, Mycobacterium bovis subsp bovis AF2122/97
caugcgguuagcagccgcug

SEQ ID NO: 3120939 - RNA, 20 nt, Mycobacterium bovis subsp bovis AF2122/97
caugcgguuugccggugcgg

SEQ ID NO: 3120940 - RNA, 21 nt, Mycobacterium bovis subsp bovis AF2122/97
caugcgguuugccggugcggu

SEQ ID NO: 3120941 - RNA, 18 nt, Mycobacterium bovis subsp bovis AF2122/97
caugcgguuuggaucacc

SEQ ID NO: 3120942 - RNA, 23 nt, Mycobacterium bovis subsp bovis AF2122/97
caugcgguuuggaucacccgccg

SEQ ID NO: 3120943 - RNA, 16 nt, Mycobacterium bovis subsp bovis AF2122/97
caugcguaugcccacg

SEQ ID NO: 3120944 - RNA, 13 nt, Mycobacterium bovis subsp bovis AF2122/97
caugcgugccggc

SEQ ID NO: 3120945 - RNA, 22 nt, Mycobacterium bovis subsp bovis AF2122/97
caugcguuggggcacgacgccg

SEQ ID NO: 3120946 - RNA, 15 nt, Mycobacterium bovis subsp bovis AF2122/97
caugcuaggaccacc

SEQ ID NO: 3120947 - RNA, 22 nt, Mycobacterium bovis subsp bovis AF2122/97
caugcuaggaccaccagcgcuc

SEQ ID NO: 3120948 - RNA, 22 nt, Mycobacterium bovis subsp bovis AF2122/97
caugcuaggcaugccacacacu

SEQ ID NO: 3120949 - RNA, 21 nt, Mycobacterium bovis subsp bovis AF2122/97
caugcucaccgaaacgaugcg

SEQ ID NO: 3120950 - RNA, 23 nt, Mycobacterium bovis subsp bovis AF2122/97
caugcucaccgaaacgaugcggc

SEQ ID NO: 3120951 - RNA, 21 nt, Mycobacterium bovis subsp bovis AF2122/97
caugcucacgaucacccgcac

SEQ ID NO: 3120952 - RNA, 14 nt, Mycobacterium bovis subsp bovis AF2122/97
caugcucagggcag

SEQ ID NO: 3120953 - RNA, 17 nt, Mycobacterium bovis subsp bovis AF2122/97
caugcuccuaucacugg

SEQ ID NO: 3120954 - RNA, 19 nt, Mycobacterium bovis subsp bovis AF2122/97
caugcucgacgcccgccac

SEQ ID NO: 3120955 - RNA, 22 nt, Mycobacterium bovis subsp bovis AF2122/97
caugcucgacgcccgccaccgg

SEQ ID NO: 3120956 - RNA, 23 nt, Mycobacterium bovis subsp bovis AF2122/97
caugcucgagugggugaggccaa

SEQ ID NO: 3120957 - RNA, 14 nt, Mycobacterium bovis subsp bovis AF2122/97
caugcucgaucgcg

SEQ ID NO: 3120958 - RNA, 21 nt, Mycobacterium bovis subsp bovis AF2122/97
caugcucgucuugggccggga

SEQ ID NO: 3120959 - RNA, 21 nt, Mycobacterium bovis subsp bovis AF2122/97
caugcuggaaguugugcgcac

SEQ ID NO: 3120960 - RNA, 23 nt, Mycobacterium bovis subsp bovis AF2122/97
caugcuggaaguugugcgcacuc

SEQ ID NO: 3120961 - RNA, 16 nt, Mycobacterium bovis subsp bovis AF2122/97
caugcuggucagcggc

SEQ ID NO: 3120962 - RNA, 19 nt, Mycobacterium bovis subsp bovis AF2122/97
caugcugucguagcgcgag

SEQ ID NO: 3120963 - RNA, 15 nt, Mycobacterium bovis subsp bovis AF2122/97
cauggaacucacccu

SEQ ID NO: 3120964 - RNA, 20 nt, Mycobacterium bovis subsp bovis AF2122/97
cauggacggauaguucacca

SEQ ID NO: 3120965 - RNA, 17 nt, Mycobacterium bovis subsp bovis AF2122/97
cauggcacugccggcac

SEQ ID NO: 3120966 - RNA, 18 nt, Mycobacterium bovis subsp bovis AF2122/97
cauggcagcgcgcugagg

SEQ ID NO: 3120967 - RNA, 21 nt, Mycobacterium bovis subsp bovis AF2122/97
cauggcauggcgaacacgucg

SEQ ID NO: 3120968 - RNA, 12 nt, Mycobacterium bovis subsp bovis AF2122/97
cauggcauuccg

SEQ ID NO: 3120969 - RNA, 12 nt, Mycobacterium bovis subsp bovis AF2122/97
cauggccaccga

SEQ ID NO: 3120970 - RNA, 15 nt, Mycobacterium bovis subsp bovis AF2122/97
cauggccagcgcuuc

SEQ ID NO: 3120971 - RNA, 23 nt, Mycobacterium bovis subsp bovis AF2122/97
cauggccagcgcuucgucggccg

SEQ ID NO: 3120972 - RNA, 20 nt, Mycobacterium bovis subsp bovis AF2122/97
cauggcccgaucgaccgcug

SEQ ID NO: 3120973 - RNA, 15 nt, Mycobacterium bovis subsp bovis AF2122/97
cauggcccgcucgua

SEQ ID NO: 3120974 - RNA, 22 nt, Mycobacterium bovis subsp bovis AF2122/97
cauggcccgcucguaggaccuc

SEQ ID NO: 3120975 - RNA, 20 nt, Mycobacterium bovis subsp bovis AF2122/97
cauggcccguuggcagcaca

SEQ ID NO: 3120976 - RNA, 17 nt, Mycobacterium bovis subsp bovis AF2122/97
cauggcccuggcgacca

SEQ ID NO: 3120977 - RNA, 14 nt, Mycobacterium bovis subsp bovis AF2122/97
cauggccgccaggu

SEQ ID NO: 3120978 - RNA, 18 nt, Mycobacterium bovis subsp bovis AF2122/97
cauggccggccaucgccc

SEQ ID NO: 3120979 - RNA, 18 nt, Mycobacterium bovis subsp bovis AF2122/97
cauggccucccacucacc

SEQ ID NO: 3120980 - RNA, 18 nt, Mycobacterium bovis subsp bovis AF2122/97
cauggcgaacacgucggc

SEQ ID NO: 3120981 - RNA, 21 nt, Mycobacterium bovis subsp bovis AF2122/97
cauggcgaacacgucggccag

SEQ ID NO: 3120982 - RNA, 17 nt, Mycobacterium bovis subsp bovis AF2122/97
cauggcgaaccgucagc

SEQ ID NO: 3120983 - RNA, 21 nt, Mycobacterium bovis subsp bovis AF2122/97
cauggcgaaccgucagcgcgc

SEQ ID NO: 3120984 - RNA, 23 nt, Mycobacterium bovis subsp bovis AF2122/97
cauggcgaaccgucagcgcgccg

SEQ ID NO: 3120985 - RNA, 23 nt, Mycobacterium bovis subsp bovis AF2122/97
cauggcgacggucgugaucggcg

SEQ ID NO: 3120986 - RNA, 21 nt, Mycobacterium bovis subsp bovis AF2122/97
cauggcgaguacggccugccg

SEQ ID NO: 3120987 - RNA, 18 nt, Mycobacterium bovis subsp bovis AF2122/97
cauggcgccguugccggc

SEQ ID NO: 3120988 - RNA, 14 nt, Mycobacterium bovis subsp bovis AF2122/97
cauggcgcgcaacc

SEQ ID NO: 3120989 - RNA, 16 nt, Mycobacterium bovis subsp bovis AF2122/97
cauggcgcggguccag

SEQ ID NO: 3120990 - RNA, 21 nt, Mycobacterium bovis subsp bovis AF2122/97
cauggcgcggguccagccacc

SEQ ID NO: 3120991 - RNA, 12 nt, Mycobacterium bovis subsp bovis AF2122/97
cauggcggcccg

SEQ ID NO: 3120992 - RNA, 14 nt, Mycobacterium bovis subsp bovis AF2122/97
cauggcggcccggu

SEQ ID NO: 3120993 - RNA, 20 nt, Mycobacterium bovis subsp bovis AF2122/97
cauggcggcuccgcccggcg

SEQ ID NO: 3120994 - RNA, 14 nt, Mycobacterium bovis subsp bovis AF2122/97
cauggcgugcccca

SEQ ID NO: 3120995 - RNA, 22 nt, Mycobacterium bovis subsp bovis AF2122/97
cauggcguucugcgcccguccg

SEQ ID NO: 3120996 - RNA, 19 nt, Mycobacterium bovis subsp bovis AF2122/97
cauggcuagggcgaugagg

SEQ ID NO: 3120997 - RNA, 20 nt, Mycobacterium bovis subsp bovis AF2122/97
caugggaaccgacaucccaa

SEQ ID NO: 3120998 - RNA, 19 nt, Mycobacterium bovis subsp bovis AF2122/97
caugggagcgggauucugg

SEQ ID NO: 3120999 - RNA, 21 nt, Mycobacterium bovis subsp bovis AF2122/97
caugggaucaggcugggcaga

SEQ ID NO: 3121000 - RNA, 19 nt, Mycobacterium bovis subsp bovis AF2122/97
caugggcccugcacagcag

SEQ ID NO: 3121001 - RNA, 13 nt, Mycobacterium bovis subsp bovis AF2122/97
caugggccggcgc

SEQ ID NO: 3121002 - RNA, 17 nt, Mycobacterium bovis subsp bovis AF2122/97
caugggccggcgccgca

SEQ ID NO: 3121003 - RNA, 19 nt, Mycobacterium bovis subsp bovis AF2122/97
caugggcgccaucccgccg

SEQ ID NO: 3121004 - RNA, 16 nt, Mycobacterium bovis subsp bovis AF2122/97
caugggcgcugccaau

SEQ ID NO: 3121005 - RNA, 21 nt, Mycobacterium bovis subsp bovis AF2122/97
caugggggaacccccucgcga

SEQ ID NO: 3121006 - RNA, 20 nt, Mycobacterium bovis subsp bovis AF2122/97
caugggggcguuggcgggcu

SEQ ID NO: 3121007 - RNA, 12 nt, Mycobacterium bovis subsp bovis AF2122/97
caugggguagau

SEQ ID NO: 3121008 - RNA, 16 nt, Mycobacterium bovis subsp bovis AF2122/97
cauggguagccgccca

SEQ ID NO: 3121009 - RNA, 16 nt, Mycobacterium bovis subsp bovis AF2122/97
caugggucauggcgcu

SEQ ID NO: 3121010 - RNA, 21 nt, Mycobacterium bovis subsp bovis AF2122/97
caugggucuggcaggccagca

SEQ ID NO: 3121011 - RNA, 19 nt, Mycobacterium bovis subsp bovis AF2122/97
caugggugaaucgacaggu

SEQ ID NO: 3121012 - RNA, 22 nt, Mycobacterium bovis subsp bovis AF2122/97
caugggugaugcaacgcggcga

SEQ ID NO: 3121013 - RNA, 20 nt, Mycobacterium bovis subsp bovis AF2122/97
caugguagcgccccgaugcu

SEQ ID NO: 3121014 - RNA, 20 nt, Mycobacterium bovis subsp bovis AF2122/97
cauggucauguucggggcgc

SEQ ID NO: 3121015 - RNA, 21 nt, Mycobacterium bovis subsp bovis AF2122/97
caugguccaagugggccggcg

SEQ ID NO: 3121016 - RNA, 14 nt, Mycobacterium bovis subsp bovis AF2122/97
caugguccggccgc

SEQ ID NO: 3121017 - RNA, 17 nt, Mycobacterium bovis subsp bovis AF2122/97
cauggucgacgaacacc

SEQ ID NO: 3121018 - RNA, 12 nt, Mycobacterium bovis subsp bovis AF2122/97
cauggucgcgcc

SEQ ID NO: 3121019 - RNA, 16 nt, Mycobacterium bovis subsp bovis AF2122/97
cauggucgcgccaccc

SEQ ID NO: 3121020 - RNA, 13 nt, Mycobacterium bovis subsp bovis AF2122/97
cauggugagcugu

SEQ ID NO: 3121021 - RNA, 15 nt, Mycobacterium bovis subsp bovis AF2122/97
cauggugcggcggcg

SEQ ID NO: 3121022 - RNA, 23 nt, Mycobacterium bovis subsp bovis AF2122/97
cauggugcggcggcguccgggug

SEQ ID NO: 3121023 - RNA, 15 nt, Mycobacterium bovis subsp bovis AF2122/97
caugguggcgccgac

SEQ ID NO: 3121024 - RNA, 16 nt, Mycobacterium bovis subsp bovis AF2122/97
caugguggcgccgacc

SEQ ID NO: 3121025 - RNA, 17 nt, Mycobacterium bovis subsp bovis AF2122/97
cauggugggccuuccuc

SEQ ID NO: 3121026 - RNA, 16 nt, Mycobacterium bovis subsp bovis AF2122/97
cauggugggucgacga

SEQ ID NO: 3121027 - RNA, 16 nt, Mycobacterium bovis subsp bovis AF2122/97
cauggugggugccggc

SEQ ID NO: 3121028 - RNA, 19 nt, Mycobacterium bovis subsp bovis AF2122/97
cauggugucuccuuguugu

SEQ ID NO: 3121029 - RNA, 15 nt, Mycobacterium bovis subsp bovis AF2122/97
caugguuggugucgu

SEQ ID NO: 3121030 - RNA, 15 nt, Mycobacterium bovis subsp bovis AF2122/97
cauguagaguaucga

SEQ ID NO: 3121031 - RNA, 17 nt, Mycobacterium bovis subsp bovis AF2122/97
cauguauuuguuguaaa

SEQ ID NO: 3121032 - RNA, 18 nt, Mycobacterium bovis subsp bovis AF2122/97
caugucaagcgauguccc

SEQ ID NO: 3121033 - RNA, 16 nt, Mycobacterium bovis subsp bovis AF2122/97
caugucagcggccugc

SEQ ID NO: 3121034 - RNA, 14 nt, Mycobacterium bovis subsp bovis AF2122/97
cauguccaccagcg

SEQ ID NO: 3121035 - RNA, 16 nt, Mycobacterium bovis subsp bovis AF2122/97
cauguccauagccggc

SEQ ID NO: 3121036 - RNA, 17 nt, Mycobacterium bovis subsp bovis AF2122/97
cauguccauguuuugcu

SEQ ID NO: 3121037 - RNA, 17 nt, Mycobacterium bovis subsp bovis AF2122/97
cauguccgaccucugcg

SEQ ID NO: 3121038 - RNA, 19 nt, Mycobacterium bovis subsp bovis AF2122/97
cauguccgcagcggugcgc

SEQ ID NO: 3121039 - RNA, 16 nt, Mycobacterium bovis subsp bovis AF2122/97
cauguccguccgcgac

SEQ ID NO: 3121040 - RNA, 17 nt, Mycobacterium bovis subsp bovis AF2122/97
cauguccguccgcgaca

SEQ ID NO: 3121041 - RNA, 22 nt, Mycobacterium bovis subsp bovis AF2122/97
cauguccugggccgccgcccug

SEQ ID NO: 3121042 - RNA, 18 nt, Mycobacterium bovis subsp bovis AF2122/97
cauguccuuggagauguc

SEQ ID NO: 3121043 - RNA, 22 nt, Mycobacterium bovis subsp bovis AF2122/97
caugucgaagaaccggccgacg

SEQ ID NO: 3121044 - RNA, 23 nt, Mycobacterium bovis subsp bovis AF2122/97
caugucgaagaaccggccgacga

SEQ ID NO: 3121045 - RNA, 14 nt, Mycobacterium bovis subsp bovis AF2122/97
caugucgagcacgc

SEQ ID NO: 3121046 - RNA, 15 nt, Mycobacterium bovis subsp bovis AF2122/97
caugucgagcacgcc

SEQ ID NO: 3121047 - RNA, 19 nt, Mycobacterium bovis subsp bovis AF2122/97
caugucgagcacgccaacg

SEQ ID NO: 3121048 - RNA, 11 nt, Mycobacterium bovis subsp bovis AF2122/97
caugucgagga

SEQ ID NO: 3121049 - RNA, 19 nt, Mycobacterium bovis subsp bovis AF2122/97
caugucgaucagcgcgacg

SEQ ID NO: 3121050 - RNA, 17 nt, Mycobacterium bovis subsp bovis AF2122/97
caugucgauccggcgcc

SEQ ID NO: 3121051 - RNA, 20 nt, Mycobacterium bovis subsp bovis AF2122/97
caugucgccgaacgccacca

SEQ ID NO: 3121052 - RNA, 21 nt, Mycobacterium bovis subsp bovis AF2122/97
caugucgccgaacgccaccac

SEQ ID NO: 3121053 - RNA, 15 nt, Mycobacterium bovis subsp bovis AF2122/97
caugucgcgccaggc

SEQ ID NO: 3121054 - RNA, 16 nt, Mycobacterium bovis subsp bovis AF2122/97
caugucgcggacccgc

SEQ ID NO: 3121055 - RNA, 14 nt, Mycobacterium bovis subsp bovis AF2122/97
caugucgcugccgc

SEQ ID NO: 3121056 - RNA, 15 nt, Mycobacterium bovis subsp bovis AF2122/97
caugucgcugccgcc

SEQ ID NO: 3121057 - RNA, 19 nt, Mycobacterium bovis subsp bovis AF2122/97
caugucgcugccgccgccg

SEQ ID NO: 3121058 - RNA, 21 nt, Mycobacterium bovis subsp bovis AF2122/97
caugucgcugccgccgccggc

SEQ ID NO: 3121059 - RNA, 13 nt, Mycobacterium bovis subsp bovis AF2122/97
caugucggccacc

SEQ ID NO: 3121060 - RNA, 14 nt, Mycobacterium bovis subsp bovis AF2122/97
caugucggccaccc

SEQ ID NO: 3121061 - RNA, 16 nt, Mycobacterium bovis subsp bovis AF2122/97
caugucggccacccgg

SEQ ID NO: 3121062 - RNA, 15 nt, Mycobacterium bovis subsp bovis AF2122/97
caugucggccaccgg

SEQ ID NO: 3121063 - RNA, 14 nt, Mycobacterium bovis subsp bovis AF2122/97
caugucggccgggg

SEQ ID NO: 3121064 - RNA, 16 nt, Mycobacterium bovis subsp bovis AF2122/97
caugucggccggggcc

SEQ ID NO: 3121065 - RNA, 13 nt, Mycobacterium bovis subsp bovis AF2122/97
caugucggugagg

SEQ ID NO: 3121066 - RNA, 18 nt, Mycobacterium bovis subsp bovis AF2122/97
caugucucgggcgcgggu

SEQ ID NO: 3121067 - RNA, 14 nt, Mycobacterium bovis subsp bovis AF2122/97
caugucuuguggug

SEQ ID NO: 3121068 - RNA, 22 nt, Mycobacterium bovis subsp bovis AF2122/97
caugugacaucgggccgccgag

SEQ ID NO: 3121069 - RNA, 14 nt, Mycobacterium bovis subsp bovis AF2122/97
caugugaccggcga

SEQ ID NO: 3121070 - RNA, 16 nt, Mycobacterium bovis subsp bovis AF2122/97
caugugcccaggucuc

SEQ ID NO: 3121071 - RNA, 21 nt, Mycobacterium bovis subsp bovis AF2122/97
caugugcccaggucuccauca

SEQ ID NO: 3121072 - RNA, 18 nt, Mycobacterium bovis subsp bovis AF2122/97
cauguggccgccgucgac

SEQ ID NO: 3121073 - RNA, 16 nt, Mycobacterium bovis subsp bovis AF2122/97
caugugggugaacacc

SEQ ID NO: 3121074 - RNA, 18 nt, Mycobacterium bovis subsp bovis AF2122/97
caugugguggcgccggcc

SEQ ID NO: 3121075 - RNA, 15 nt, Mycobacterium bovis subsp bovis AF2122/97
cauguuccacccggu

SEQ ID NO: 3121076 - RNA, 17 nt, Mycobacterium bovis subsp bovis AF2122/97
cauguuccuugcggccg

SEQ ID NO: 3121077 - RNA, 18 nt, Mycobacterium bovis subsp bovis AF2122/97
cauguuccuugcggccgc

SEQ ID NO: 3121078 - RNA, 19 nt, Mycobacterium bovis subsp bovis AF2122/97
cauguuccuugcggccgcu

SEQ ID NO: 3121079 - RNA, 13 nt, Mycobacterium bovis subsp bovis AF2122/97
cauguucggccac

SEQ ID NO: 3121080 - RNA, 15 nt, Mycobacterium bovis subsp bovis AF2122/97
cauguucggccacca

SEQ ID NO: 3121081 - RNA, 20 nt, Mycobacterium bovis subsp bovis AF2122/97
cauguucuccacgccgaucu

SEQ ID NO: 3121082 - RNA, 22 nt, Mycobacterium bovis subsp bovis AF2122/97
cauguucuuuugcgucugcugg

SEQ ID NO: 3121083 - RNA, 17 nt, Mycobacterium bovis subsp bovis AF2122/97
cauguugaaaaggcgcu

SEQ ID NO: 3121084 - RNA, 12 nt, Mycobacterium bovis subsp bovis AF2122/97
cauguugaccuc

SEQ ID NO: 3121085 - RNA, 16 nt, Mycobacterium bovis subsp bovis AF2122/97
cauguugcggaccagu

SEQ ID NO: 3121086 - RNA, 22 nt, Mycobacterium bovis subsp bovis AF2122/97
cauguuuugcugcaugccgacc

SEQ ID NO: 3121087 - RNA, 19 nt, Mycobacterium bovis subsp bovis AF2122/97
cauuaaugcggccccgcgc

SEQ ID NO: 3121088 - RNA, 15 nt, Mycobacterium bovis subsp bovis AF2122/97
cauuagcagcacccg

SEQ ID NO: 3121089 - RNA, 12 nt, Mycobacterium bovis subsp bovis AF2122/97
cauuagccggac

SEQ ID NO: 3121090 - RNA, 15 nt, Mycobacterium bovis subsp bovis AF2122/97
cauucauaggcccgc

SEQ ID NO: 3121091 - RNA, 21 nt, Mycobacterium bovis subsp bovis AF2122/97
cauuccagcaggccacugcgu

SEQ ID NO: 3121092 - RNA, 13 nt, Mycobacterium bovis subsp bovis AF2122/97
cauucccagaggc

SEQ ID NO: 3121093 - RNA, 18 nt, Mycobacterium bovis subsp bovis AF2122/97
cauucccauaucgaucgg

SEQ ID NO: 3121094 - RNA, 16 nt, Mycobacterium bovis subsp bovis AF2122/97
cauucccgaguugccc

SEQ ID NO: 3121095 - RNA, 17 nt, Mycobacterium bovis subsp bovis AF2122/97
cauucccgcucgcaggc

SEQ ID NO: 3121096 - RNA, 20 nt, Mycobacterium bovis subsp bovis AF2122/97
cauucccgcucgcaggccgg

SEQ ID NO: 3121097 - RNA, 21 nt, Mycobacterium bovis subsp bovis AF2122/97
cauucccgcucgcaggccggc

SEQ ID NO: 3121098 - RNA, 18 nt, Mycobacterium bovis subsp bovis AF2122/97
cauucccggacccaccaa

SEQ ID NO: 3121099 - RNA, 20 nt, Mycobacterium bovis subsp bovis AF2122/97
cauucccggacccaccaauc

SEQ ID NO: 3121100 - RNA, 23 nt, Mycobacterium bovis subsp bovis AF2122/97
cauuccgaacaacaucacugccu

SEQ ID NO: 3121101 - RNA, 13 nt, Mycobacterium bovis subsp bovis AF2122/97
cauuccggcgcca

SEQ ID NO: 3121102 - RNA, 18 nt, Mycobacterium bovis subsp bovis AF2122/97
cauuccggucagguacau

SEQ ID NO: 3121103 - RNA, 22 nt, Mycobacterium bovis subsp bovis AF2122/97
cauuccggucagguacaucccg

SEQ ID NO: 3121104 - RNA, 16 nt, Mycobacterium bovis subsp bovis AF2122/97
cauuccguaggccaca

SEQ ID NO: 3121105 - RNA, 19 nt, Mycobacterium bovis subsp bovis AF2122/97
cauuccguaggccacagcc

SEQ ID NO: 3121106 - RNA, 20 nt, Mycobacterium bovis subsp bovis AF2122/97
cauuccguuuuuguugaccc

SEQ ID NO: 3121107 - RNA, 21 nt, Mycobacterium bovis subsp bovis AF2122/97
cauuccuugauaacgacccuc

SEQ ID NO: 3121108 - RNA, 14 nt, Mycobacterium bovis subsp bovis AF2122/97
cauucgauaccgca

SEQ ID NO: 3121109 - RNA, 11 nt, Mycobacterium bovis subsp bovis AF2122/97
cauucgccggg

SEQ ID NO: 3121110 - RNA, 17 nt, Mycobacterium bovis subsp bovis AF2122/97
cauucgcgacaacucgc

SEQ ID NO: 3121111 - RNA, 16 nt, Mycobacterium bovis subsp bovis AF2122/97
cauucggcgagccgcg

SEQ ID NO: 3121112 - RNA, 13 nt, Mycobacterium bovis subsp bovis AF2122/97
cauucggcggcgg

SEQ ID NO: 3121113 - RNA, 18 nt, Mycobacterium bovis subsp bovis AF2122/97
cauucgggcgugcucgcc

SEQ ID NO: 3121114 - RNA, 19 nt, Mycobacterium bovis subsp bovis AF2122/97
cauucggucagccagccca

SEQ ID NO: 3121115 - RNA, 14 nt, Mycobacterium bovis subsp bovis AF2122/97
cauucgguguggcc

SEQ ID NO: 3121116 - RNA, 15 nt, Mycobacterium bovis subsp bovis AF2122/97
cauucgguguggccg

SEQ ID NO: 3121117 - RNA, 16 nt, Mycobacterium bovis subsp bovis AF2122/97
cauucguccgcggucu

SEQ ID NO: 3121118 - RNA, 16 nt, Mycobacterium bovis subsp bovis AF2122/97
cauucguggagccggc

SEQ ID NO: 3121119 - RNA, 22 nt, Mycobacterium bovis subsp bovis AF2122/97
cauucgugggaaccaccagcac

SEQ ID NO: 3121120 - RNA, 16 nt, Mycobacterium bovis subsp bovis AF2122/97
cauucucgccgacggc

SEQ ID NO: 3121121 - RNA, 20 nt, Mycobacterium bovis subsp bovis AF2122/97
cauucucggccggcggcgcc

SEQ ID NO: 3121122 - RNA, 19 nt, Mycobacterium bovis subsp bovis AF2122/97
cauucugcagcgucuccuu

SEQ ID NO: 3121123 - RNA, 13 nt, Mycobacterium bovis subsp bovis AF2122/97
cauugaccaggug

SEQ ID NO: 3121124 - RNA, 20 nt, Mycobacterium bovis subsp bovis AF2122/97
cauugaccaggugcccgccc

SEQ ID NO: 3121125 - RNA, 17 nt, Mycobacterium bovis subsp bovis AF2122/97
cauugacgaggcgagcg

SEQ ID NO: 3121126 - RNA, 16 nt, Mycobacterium bovis subsp bovis AF2122/97
cauugaguucggccac

SEQ ID NO: 3121127 - RNA, 19 nt, Mycobacterium bovis subsp bovis AF2122/97
cauugaucgacggccagcc

SEQ ID NO: 3121128 - RNA, 20 nt, Mycobacterium bovis subsp bovis AF2122/97
cauugaucgacggccagccc

SEQ ID NO: 3121129 - RNA, 15 nt, Mycobacterium bovis subsp bovis AF2122/97
cauugcagaaccgcc

SEQ ID NO: 3121130 - RNA, 15 nt, Mycobacterium bovis subsp bovis AF2122/97
cauugcaucugccaa

SEQ ID NO: 3121131 - RNA, 22 nt, Mycobacterium bovis subsp bovis AF2122/97
cauugcaugguuucguuccucg

SEQ ID NO: 3121132 - RNA, 23 nt, Mycobacterium bovis subsp bovis AF2122/97
cauugccauacagcaccccgccg

SEQ ID NO: 3121133 - RNA, 14 nt, Mycobacterium bovis subsp bovis AF2122/97
cauugcccauagcc

SEQ ID NO: 3121134 - RNA, 18 nt, Mycobacterium bovis subsp bovis AF2122/97
cauugcccauagccaggu

SEQ ID NO: 3121135 - RNA, 19 nt, Mycobacterium bovis subsp bovis AF2122/97
cauugcccgagcccagcgc

SEQ ID NO: 3121136 - RNA, 11 nt, Mycobacterium bovis subsp bovis AF2122/97
cauugcccuug

SEQ ID NO: 3121137 - RNA, 18 nt, Mycobacterium bovis subsp bovis AF2122/97
cauugccgacgcgcggcc

SEQ ID NO: 3121138 - RNA, 20 nt, Mycobacterium bovis subsp bovis AF2122/97
cauugccgacgcgcggccag

SEQ ID NO: 3121139 - RNA, 14 nt, Mycobacterium bovis subsp bovis AF2122/97
cauugccgaugguc

SEQ ID NO: 3121140 - RNA, 15 nt, Mycobacterium bovis subsp bovis AF2122/97
cauugccgaugguca

SEQ ID NO: 3121141 - RNA, 20 nt, Mycobacterium bovis subsp bovis AF2122/97
cauugccgauuacgacuugg

SEQ ID NO: 3121142 - RNA, 20 nt, Mycobacterium bovis subsp bovis AF2122/97
cauugccgcaugcucagcau

SEQ ID NO: 3121143 - RNA, 15 nt, Mycobacterium bovis subsp bovis AF2122/97
cauugccgccagccc

SEQ ID NO: 3121144 - RNA, 14 nt, Mycobacterium bovis subsp bovis AF2122/97
cauugccgccggcg

SEQ ID NO: 3121145 - RNA, 16 nt, Mycobacterium bovis subsp bovis AF2122/97
cauugccgccggcgcc

SEQ ID NO: 3121146 - RNA, 20 nt, Mycobacterium bovis subsp bovis AF2122/97
cauugccgccggcgccgccg

SEQ ID NO: 3121147 - RNA, 14 nt, Mycobacterium bovis subsp bovis AF2122/97
cauugccgccggug

SEQ ID NO: 3121148 - RNA, 13 nt, Mycobacterium bovis subsp bovis AF2122/97
cauugccgccguc

SEQ ID NO: 3121149 - RNA, 20 nt, Mycobacterium bovis subsp bovis AF2122/97
cauugccgccgucgccgccg

SEQ ID NO: 3121150 - RNA, 13 nt, Mycobacterium bovis subsp bovis AF2122/97
cauugccgccguu

SEQ ID NO: 3121151 - RNA, 19 nt, Mycobacterium bovis subsp bovis AF2122/97
cauugccgccguugccgcc

SEQ ID NO: 3121152 - RNA, 22 nt, Mycobacterium bovis subsp bovis AF2122/97
cauugccggccaccagccuggc

SEQ ID NO: 3121153 - RNA, 14 nt, Mycobacterium bovis subsp bovis AF2122/97
cauugccggcgacg

SEQ ID NO: 3121154 - RNA, 16 nt, Mycobacterium bovis subsp bovis AF2122/97
cauugccguucucguc

SEQ ID NO: 3121155 - RNA, 18 nt, Mycobacterium bovis subsp bovis AF2122/97
cauugccguucucgucga

SEQ ID NO: 3121156 - RNA, 20 nt, Mycobacterium bovis subsp bovis AF2122/97
cauugccucccgcgccggcg

SEQ ID NO: 3121157 - RNA, 19 nt, Mycobacterium bovis subsp bovis AF2122/97
cauugcgcccagcgacccg

SEQ ID NO: 3121158 - RNA, 19 nt, Mycobacterium bovis subsp bovis AF2122/97
cauugcuagguucgcgacg

SEQ ID NO: 3121159 - RNA, 13 nt, Mycobacterium bovis subsp bovis AF2122/97
cauugcugcucgu

SEQ ID NO: 3121160 - RNA, 19 nt, Mycobacterium bovis subsp bovis AF2122/97
cauugcugcucgugagccc

SEQ ID NO: 3121161 - RNA, 22 nt, Mycobacterium bovis subsp bovis AF2122/97
cauugcugcucgugagccccag

SEQ ID NO: 3121162 - RNA, 21 nt, Mycobacterium bovis subsp bovis AF2122/97
cauugcuguguugcacccgaa

SEQ ID NO: 3121163 - RNA, 16 nt, Mycobacterium bovis subsp bovis AF2122/97
cauuggccaggucggc

SEQ ID NO: 3121164 - RNA, 19 nt, Mycobacterium bovis subsp bovis AF2122/97
cauuggccaggucggccac

SEQ ID NO: 3121165 - RNA, 18 nt, Mycobacterium bovis subsp bovis AF2122/97
cauuggccuaggacaccg

SEQ ID NO: 3121166 - RNA, 20 nt, Mycobacterium bovis subsp bovis AF2122/97
cauuggccuaggacaccggc

SEQ ID NO: 3121167 - RNA, 21 nt, Mycobacterium bovis subsp bovis AF2122/97
cauuggccuaggacaccggca

SEQ ID NO: 3121168 - RNA, 22 nt, Mycobacterium bovis subsp bovis AF2122/97
cauuggccuaggacaccggcac

SEQ ID NO: 3121169 - RNA, 23 nt, Mycobacterium bovis subsp bovis AF2122/97
cauuggccuaggacaccggcacc

SEQ ID NO: 3121170 - RNA, 20 nt, Mycobacterium bovis subsp bovis AF2122/97
cauuggccuguucaacuccg

SEQ ID NO: 3121171 - RNA, 22 nt, Mycobacterium bovis subsp bovis AF2122/97
cauuggcgaucagcagccgccg

SEQ ID NO: 3121172 - RNA, 13 nt, Mycobacterium bovis subsp bovis AF2122/97
cauuggcgccgcc

SEQ ID NO: 3121173 - RNA, 14 nt, Mycobacterium bovis subsp bovis AF2122/97
cauuggcgccgccg

SEQ ID NO: 3121174 - RNA, 13 nt, Mycobacterium bovis subsp bovis AF2122/97
cauuggcuccgaa

SEQ ID NO: 3121175 - RNA, 17 nt, Mycobacterium bovis subsp bovis AF2122/97
cauugggguggcaucga

SEQ ID NO: 3121176 - RNA, 22 nt, Mycobacterium bovis subsp bovis AF2122/97
cauugggguggcaucgaacgcc

SEQ ID NO: 3121177 - RNA, 17 nt, Mycobacterium bovis subsp bovis AF2122/97
cauuggguaaccagcgc

SEQ ID NO: 3121178 - RNA, 17 nt, Mycobacterium bovis subsp bovis AF2122/97
cauugguaccggcuucg

SEQ ID NO: 3121179 - RNA, 17 nt, Mycobacterium bovis subsp bovis AF2122/97
cauugguguccaccacc

SEQ ID NO: 3121180 - RNA, 22 nt, Mycobacterium bovis subsp bovis AF2122/97
cauugguguccaccaccggcac

SEQ ID NO: 3121181 - RNA, 22 nt, Mycobacterium bovis subsp bovis AF2122/97
cauugguguggaauacgcugcu

SEQ ID NO: 3121182 - RNA, 21 nt, Mycobacterium bovis subsp bovis AF2122/97
cauuguccugaaaacaccgca

SEQ ID NO: 3121183 - RNA, 15 nt, Mycobacterium bovis subsp bovis AF2122/97
cauugucgccggaug

SEQ ID NO: 3121184 - RNA, 13 nt, Mycobacterium bovis subsp bovis AF2122/97
cauugugcucgcc

SEQ ID NO: 3121185 - RNA, 22 nt, Mycobacterium bovis subsp bovis AF2122/97
cauuucaacguauccccgacca

SEQ ID NO: 3121186 - RNA, 21 nt, Mycobacterium bovis subsp bovis AF2122/97
cauuuccacauccaacgaccu

SEQ ID NO: 3121187 - RNA, 20 nt, Mycobacterium bovis subsp bovis AF2122/97
cauuucgucgucgcagugca

SEQ ID NO: 3121188 - RNA, 19 nt, Mycobacterium bovis subsp bovis AF2122/97
cauuucuuugggcggccca

SEQ ID NO: 3121189 - RNA, 13 nt, Mycobacterium bovis subsp bovis AF2122/97
ccaaaagcccggu

SEQ ID NO: 3121190 - RNA, 12 nt, Mycobacterium bovis subsp bovis AF2122/97
ccaaaagcgcgg

SEQ ID NO: 3121191 - RNA, 19 nt, Mycobacterium bovis subsp bovis AF2122/97
ccaaaauuuugucggccgc

SEQ ID NO: 3121192 - RNA, 21 nt, Mycobacterium bovis subsp bovis AF2122/97
ccaaaauuuugucggccgccu

SEQ ID NO: 3121193 - RNA, 14 nt, Mycobacterium bovis subsp bovis AF2122/97
ccaaacaccccggc

SEQ ID NO: 3121194 - RNA, 21 nt, Mycobacterium bovis subsp bovis AF2122/97
ccaaacacccuugcccacggc

SEQ ID NO: 3121195 - RNA, 23 nt, Mycobacterium bovis subsp bovis AF2122/97
ccaaacccaugucggcgcgccgc

SEQ ID NO: 3121196 - RNA, 17 nt, Mycobacterium bovis subsp bovis AF2122/97
ccaaacccggcgggccc

SEQ ID NO: 3121197 - RNA, 21 nt, Mycobacterium bovis subsp bovis AF2122/97
ccaaacccggcgggcccgccg

SEQ ID NO: 3121198 - RNA, 16 nt, Mycobacterium bovis subsp bovis AF2122/97
ccaaaccgacgcgggc

SEQ ID NO: 3121199 - RNA, 21 nt, Mycobacterium bovis subsp bovis AF2122/97
ccaaaccggcccgcagcagca

SEQ ID NO: 3121200 - RNA, 15 nt, Mycobacterium bovis subsp bovis AF2122/97
ccaaaccgucaacuu

SEQ ID NO: 3121201 - RNA, 13 nt, Mycobacterium bovis subsp bovis AF2122/97
ccaaacgccauca

SEQ ID NO: 3121202 - RNA, 16 nt, Mycobacterium bovis subsp bovis AF2122/97
ccaaacgcugcuggca

SEQ ID NO: 3121203 - RNA, 17 nt, Mycobacterium bovis subsp bovis AF2122/97
ccaaacuaacggcagcc

SEQ ID NO: 3121204 - RNA, 21 nt, Mycobacterium bovis subsp bovis AF2122/97
ccaaacuaacggcagccaccg

SEQ ID NO: 3121205 - RNA, 13 nt, Mycobacterium bovis subsp bovis AF2122/97
ccaaagacccggc

SEQ ID NO: 3121206 - RNA, 22 nt, Mycobacterium bovis subsp bovis AF2122/97
ccaaagcacuucacgaguagcg

SEQ ID NO: 3121207 - RNA, 19 nt, Mycobacterium bovis subsp bovis AF2122/97
ccaaagccgggauugccgc

SEQ ID NO: 3121208 - RNA, 22 nt, Mycobacterium bovis subsp bovis AF2122/97
ccaaagccgggauugccgccac

SEQ ID NO: 3121209 - RNA, 16 nt, Mycobacterium bovis subsp bovis AF2122/97
ccaaagccgugccagc

SEQ ID NO: 3121210 - RNA, 18 nt, Mycobacterium bovis subsp bovis AF2122/97
ccaaagcgacgagcagca

SEQ ID NO: 3121211 - RNA, 15 nt, Mycobacterium bovis subsp bovis AF2122/97
ccaaaggacgacacc

SEQ ID NO: 3121212 - RNA, 16 nt, Mycobacterium bovis subsp bovis AF2122/97
ccaaaggacgacaccg

SEQ ID NO: 3121213 - RNA, 18 nt, Mycobacterium bovis subsp bovis AF2122/97
ccaaaggacgacaccgcg

SEQ ID NO: 3121214 - RNA, 21 nt, Mycobacterium bovis subsp bovis AF2122/97
ccaaaggacgacaccgcgaau

SEQ ID NO: 3121215 - RNA, 18 nt, Mycobacterium bovis subsp bovis AF2122/97
ccaaauccggugcccgca

SEQ ID NO: 3121216 - RNA, 16 nt, Mycobacterium bovis subsp bovis AF2122/97
ccaaaucggcaucggc

SEQ ID NO: 3121217 - RNA, 13 nt, Mycobacterium bovis subsp bovis AF2122/97
ccaaaucggccaa

SEQ ID NO: 3121218 - RNA, 20 nt, Mycobacterium bovis subsp bovis AF2122/97
ccaaaugccccgaaccgcgc

SEQ ID NO: 3121219 - RNA, 18 nt, Mycobacterium bovis subsp bovis AF2122/97
ccaacaaaggccgggugg

SEQ ID NO: 3121220 - RNA, 15 nt, Mycobacterium bovis subsp bovis AF2122/97
ccaacaacaucagcg

SEQ ID NO: 3121221 - RNA, 20 nt, Mycobacterium bovis subsp bovis AF2122/97
ccaacaacccaacaaaaggc

SEQ ID NO: 3121222 - RNA, 17 nt, Mycobacterium bovis subsp bovis AF2122/97
ccaacaacuccagcagg

SEQ ID NO: 3121223 - RNA, 17 nt, Mycobacterium bovis subsp bovis AF2122/97
ccaacacagccgucgca

SEQ ID NO: 3121224 - RNA, 23 nt, Mycobacterium bovis subsp bovis AF2122/97
ccaacacauugccggccaccagc

SEQ ID NO: 3121225 - RNA, 12 nt, Mycobacterium bovis subsp bovis AF2122/97
ccaacaccaacc

SEQ ID NO: 3121226 - RNA, 12 nt, Mycobacterium bovis subsp bovis AF2122/97
ccaacaccagca

SEQ ID NO: 3121227 - RNA, 14 nt, Mycobacterium bovis subsp bovis AF2122/97
ccaacaccagcagc

SEQ ID NO: 3121228 - RNA, 15 nt, Mycobacterium bovis subsp bovis AF2122/97
ccaacaccagcagca

SEQ ID NO: 3121229 - RNA, 13 nt, Mycobacterium bovis subsp bovis AF2122/97
ccaacaccagcgc

SEQ ID NO: 3121230 - RNA, 22 nt, Mycobacterium bovis subsp bovis AF2122/97
ccaacacccacugcacggagcc

SEQ ID NO: 3121231 - RNA, 13 nt, Mycobacterium bovis subsp bovis AF2122/97
ccaacaccgccag

SEQ ID NO: 3121232 - RNA, 15 nt, Mycobacterium bovis subsp bovis AF2122/97
ccaacaccgccagca

SEQ ID NO: 3121233 - RNA, 12 nt, Mycobacterium bovis subsp bovis AF2122/97
ccaacaccgcgc

SEQ ID NO: 3121234 - RNA, 15 nt, Mycobacterium bovis subsp bovis AF2122/97
ccaacaccgcgccga

SEQ ID NO: 3121235 - RNA, 20 nt, Mycobacterium bovis subsp bovis AF2122/97
ccaacaccgcgccgacgaaa

SEQ ID NO: 3121236 - RNA, 17 nt, Mycobacterium bovis subsp bovis AF2122/97
ccaacaccgcggcgcug

SEQ ID NO: 3121237 - RNA, 14 nt, Mycobacterium bovis subsp bovis AF2122/97
ccaacaccgguggc

SEQ ID NO: 3121238 - RNA, 21 nt, Mycobacterium bovis subsp bovis AF2122/97
ccaacaccuguuugagcgcac

SEQ ID NO: 3121239 - RNA, 12 nt, Mycobacterium bovis subsp bovis AF2122/97
ccaacacgucga

SEQ ID NO: 3121240 - RNA, 16 nt, Mycobacterium bovis subsp bovis AF2122/97
ccaacacgucgagcag

SEQ ID NO: 3121241 - RNA, 18 nt, Mycobacterium bovis subsp bovis AF2122/97
ccaacacgucgagcagcc

SEQ ID NO: 3121242 - RNA, 17 nt, Mycobacterium bovis subsp bovis AF2122/97
ccaacagcaacccgccg

SEQ ID NO: 3121243 - RNA, 17 nt, Mycobacterium bovis subsp bovis AF2122/97
ccaacagcacccgggcc

SEQ ID NO: 3121244 - RNA, 16 nt, Mycobacterium bovis subsp bovis AF2122/97
ccaacaggaacaggca

SEQ ID NO: 3121245 - RNA, 14 nt, Mycobacterium bovis subsp bovis AF2122/97
ccaacagggcggca

SEQ ID NO: 3121246 - RNA, 19 nt, Mycobacterium bovis subsp bovis AF2122/97
ccaacagucgcagcacggc

SEQ ID NO: 3121247 - RNA, 23 nt, Mycobacterium bovis subsp bovis AF2122/97
ccaacauguugucgucgccgccg

SEQ ID NO: 3121248 - RNA, 22 nt, Mycobacterium bovis subsp bovis AF2122/97
ccaaccacuuuccggccgaugc

SEQ ID NO: 3121249 - RNA, 13 nt, Mycobacterium bovis subsp bovis AF2122/97
ccaaccagcacca

SEQ ID NO: 3121250 - RNA, 15 nt, Mycobacterium bovis subsp bovis AF2122/97
ccaaccagcccggcc

SEQ ID NO: 3121251 - RNA, 19 nt, Mycobacterium bovis subsp bovis AF2122/97
ccaaccagucgcacgacgu

SEQ ID NO: 3121252 - RNA, 20 nt, Mycobacterium bovis subsp bovis AF2122/97
ccaaccaugcgguuagcagc

SEQ ID NO: 3121253 - RNA, 15 nt, Mycobacterium bovis subsp bovis AF2122/97
ccaaccaugcugucg

SEQ ID NO: 3121254 - RNA, 21 nt, Mycobacterium bovis subsp bovis AF2122/97
ccaaccaugcugucggugccg

SEQ ID NO: 3121255 - RNA, 23 nt, Mycobacterium bovis subsp bovis AF2122/97
ccaaccaugcugucggugccguc

SEQ ID NO: 3121256 - RNA, 22 nt, Mycobacterium bovis subsp bovis AF2122/97
ccaacccaccccccagcgccgc

SEQ ID NO: 3121257 - RNA, 20 nt, Mycobacterium bovis subsp bovis AF2122/97
ccaacccacucgcagcagca

SEQ ID NO: 3121258 - RNA, 20 nt, Mycobacterium bovis subsp bovis AF2122/97
ccaacccaggguggcgacgu

SEQ ID NO: 3121259 - RNA, 16 nt, Mycobacterium bovis subsp bovis AF2122/97
ccaaccccauggccag

SEQ ID NO: 3121260 - RNA, 17 nt, Mycobacterium bovis subsp bovis AF2122/97
ccaaccccauggccagc

SEQ ID NO: 3121261 - RNA, 14 nt, Mycobacterium bovis subsp bovis AF2122/97
ccaaccccgccggc

SEQ ID NO: 3121262 - RNA, 12 nt, Mycobacterium bovis subsp bovis AF2122/97
ccaacccggcgg

SEQ ID NO: 3121263 - RNA, 13 nt, Mycobacterium bovis subsp bovis AF2122/97
ccaacccggcucg

SEQ ID NO: 3121264 - RNA, 14 nt, Mycobacterium bovis subsp bovis AF2122/97
ccaacccggcucgg

SEQ ID NO: 3121265 - RNA, 14 nt, Mycobacterium bovis subsp bovis AF2122/97
ccaacccgggccgc

SEQ ID NO: 3121266 - RNA, 16 nt, Mycobacterium bovis subsp bovis AF2122/97
ccaacccgggccgcca

SEQ ID NO: 3121267 - RNA, 18 nt, Mycobacterium bovis subsp bovis AF2122/97
ccaacccgggccgccagg

SEQ ID NO: 3121268 - RNA, 22 nt, Mycobacterium bovis subsp bovis AF2122/97
ccaacccgucuuaucggcgucg

SEQ ID NO: 3121269 - RNA, 15 nt, Mycobacterium bovis subsp bovis AF2122/97
ccaacccguguggca

SEQ ID NO: 3121270 - RNA, 19 nt, Mycobacterium bovis subsp bovis AF2122/97
ccaacccuaaaccagccac

SEQ ID NO: 3121271 - RNA, 19 nt, Mycobacterium bovis subsp bovis AF2122/97
ccaacccucgccggucagc

SEQ ID NO: 3121272 - RNA, 16 nt, Mycobacterium bovis subsp bovis AF2122/97
ccaacccugcggcguc

SEQ ID NO: 3121273 - RNA, 17 nt, Mycobacterium bovis subsp bovis AF2122/97
ccaaccgccggccagca

SEQ ID NO: 3121274 - RNA, 12 nt, Mycobacterium bovis subsp bovis AF2122/97
ccaaccgcgcga

SEQ ID NO: 3121275 - RNA, 16 nt, Mycobacterium bovis subsp bovis AF2122/97
ccaaccgcgcgagccu

SEQ ID NO: 3121276 - RNA, 14 nt, Mycobacterium bovis subsp bovis AF2122/97
ccaaccgcuuccaa

SEQ ID NO: 3121277 - RNA, 21 nt, Mycobacterium bovis subsp bovis AF2122/97
ccaaccgggacaaccccuugc

SEQ ID NO: 3121278 - RNA, 13 nt, Mycobacterium bovis subsp bovis AF2122/97
ccaaccgggccgg

SEQ ID NO: 3121279 - RNA, 14 nt, Mycobacterium bovis subsp bovis AF2122/97
ccaaccgggccggc

SEQ ID NO: 3121280 - RNA, 15 nt, Mycobacterium bovis subsp bovis AF2122/97
ccaaccgggccggcu

SEQ ID NO: 3121281 - RNA, 16 nt, Mycobacterium bovis subsp bovis AF2122/97
ccaaccgggccggcua

SEQ ID NO: 3121282 - RNA, 19 nt, Mycobacterium bovis subsp bovis AF2122/97
ccaaccgguacuccugggu

SEQ ID NO: 3121283 - RNA, 20 nt, Mycobacterium bovis subsp bovis AF2122/97
ccaaccggucaaacgcgcgc

SEQ ID NO: 3121284 - RNA, 16 nt, Mycobacterium bovis subsp bovis AF2122/97
ccaaccggucacgucg

SEQ ID NO: 3121285 - RNA, 20 nt, Mycobacterium bovis subsp bovis AF2122/97
ccaaccggucacgucgauga

SEQ ID NO: 3121286 - RNA, 12 nt, Mycobacterium bovis subsp bovis AF2122/97
ccaaccggucgu

SEQ ID NO: 3121287 - RNA, 13 nt, Mycobacterium bovis subsp bovis AF2122/97
ccaaccggucguc

SEQ ID NO: 3121288 - RNA, 14 nt, Mycobacterium bovis subsp bovis AF2122/97
ccaaccgguggccg

SEQ ID NO: 3121289 - RNA, 16 nt, Mycobacterium bovis subsp bovis AF2122/97
ccaaccgguggccggu

SEQ ID NO: 3121290 - RNA, 17 nt, Mycobacterium bovis subsp bovis AF2122/97
ccaaccgguucgucgaa

SEQ ID NO: 3121291 - RNA, 14 nt, Mycobacterium bovis subsp bovis AF2122/97
ccaaccuacccuga

SEQ ID NO: 3121292 - RNA, 21 nt, Mycobacterium bovis subsp bovis AF2122/97
ccaaccucggaucgccaggcc

SEQ ID NO: 3121293 - RNA, 23 nt, Mycobacterium bovis subsp bovis AF2122/97
ccaaccucggaucgccaggccgu

SEQ ID NO: 3121294 - RNA, 18 nt, Mycobacterium bovis subsp bovis AF2122/97
ccaaccugaagccagcgc

SEQ ID NO: 3121295 - RNA, 13 nt, Mycobacterium bovis subsp bovis AF2122/97
ccaaccugggcca

SEQ ID NO: 3121296 - RNA, 21 nt, Mycobacterium bovis subsp bovis AF2122/97
ccaacgaacgugccccggcgg

SEQ ID NO: 3121297 - RNA, 13 nt, Mycobacterium bovis subsp bovis AF2122/97
ccaacgacagcga

SEQ ID NO: 3121298 - RNA, 15 nt, Mycobacterium bovis subsp bovis AF2122/97
ccaacgacagcgacg

SEQ ID NO: 3121299 - RNA, 19 nt, Mycobacterium bovis subsp bovis AF2122/97
ccaacgacagcgacggucc

SEQ ID NO: 3121300 - RNA, 13 nt, Mycobacterium bovis subsp bovis AF2122/97
ccaacgaccacca

SEQ ID NO: 3121301 - RNA, 16 nt, Mycobacterium bovis subsp bovis AF2122/97
ccaacgaccaccacca

SEQ ID NO: 3121302 - RNA, 19 nt, Mycobacterium bovis subsp bovis AF2122/97
ccaacgaccaccaccaacg

SEQ ID NO: 3121303 - RNA, 12 nt, Mycobacterium bovis subsp bovis AF2122/97
ccaacgaccucc

SEQ ID NO: 3121304 - RNA, 19 nt, Mycobacterium bovis subsp bovis AF2122/97
ccaacgacuguggcgccgc

SEQ ID NO: 3121305 - RNA, 23 nt, Mycobacterium bovis subsp bovis AF2122/97
ccaacgacuguggcgccgccggc

SEQ ID NO: 3121306 - RNA, 19 nt, Mycobacterium bovis subsp bovis AF2122/97
ccaacgagaugugagcaca

SEQ ID NO: 3121307 - RNA, 16 nt, Mycobacterium bovis subsp bovis AF2122/97
ccaacgagcgcgcugc

SEQ ID NO: 3121308 - RNA, 14 nt, Mycobacterium bovis subsp bovis AF2122/97
ccaacgagucagug

SEQ ID NO: 3121309 - RNA, 20 nt, Mycobacterium bovis subsp bovis AF2122/97
ccaacgaucagucgucuuga

SEQ ID NO: 3121310 - RNA, 19 nt, Mycobacterium bovis subsp bovis AF2122/97
ccaacgcaacggugaucag

SEQ ID NO: 3121311 - RNA, 21 nt, Mycobacterium bovis subsp bovis AF2122/97
ccaacgcagaucaggguggcg

SEQ ID NO: 3121312 - RNA, 23 nt, Mycobacterium bovis subsp bovis AF2122/97
ccaacgccaaaacggucgaccgu

SEQ ID NO: 3121313 - RNA, 15 nt, Mycobacterium bovis subsp bovis AF2122/97
ccaacgccaccgucg

SEQ ID NO: 3121314 - RNA, 16 nt, Mycobacterium bovis subsp bovis AF2122/97
ccaacgccaccgucgc

SEQ ID NO: 3121315 - RNA, 14 nt, Mycobacterium bovis subsp bovis AF2122/97
ccaacgcccgggcg

SEQ ID NO: 3121316 - RNA, 23 nt, Mycobacterium bovis subsp bovis AF2122/97
ccaacgcgcaccuggcgcgcgca

SEQ ID NO: 3121317 - RNA, 19 nt, Mycobacterium bovis subsp bovis AF2122/97
ccaacgcgggugccgggca

SEQ ID NO: 3121318 - RNA, 19 nt, Mycobacterium bovis subsp bovis AF2122/97
ccaacgcgguaaagccccg

SEQ ID NO: 3121319 - RNA, 15 nt, Mycobacterium bovis subsp bovis AF2122/97
ccaacgcggugacga

SEQ ID NO: 3121320 - RNA, 16 nt, Mycobacterium bovis subsp bovis AF2122/97
ccaacgcggugacgau

SEQ ID NO: 3121321 - RNA, 22 nt, Mycobacterium bovis subsp bovis AF2122/97
ccaacgcggugggcacagccag

SEQ ID NO: 3121322 - RNA, 21 nt, Mycobacterium bovis subsp bovis AF2122/97
ccaacgcgucccgccgcaccg

SEQ ID NO: 3121323 - RNA, 22 nt, Mycobacterium bovis subsp bovis AF2122/97
ccaacgcgucccgccgcaccgc

SEQ ID NO: 3121324 - RNA, 22 nt, Mycobacterium bovis subsp bovis AF2122/97
ccaacgcucccuacgagcccac

SEQ ID NO: 3121325 - RNA, 15 nt, Mycobacterium bovis subsp bovis AF2122/97
ccaacggcgcugccg

SEQ ID NO: 3121326 - RNA, 17 nt, Mycobacterium bovis subsp bovis AF2122/97
ccaacggcuccgggcgc

SEQ ID NO: 3121327 - RNA, 21 nt, Mycobacterium bovis subsp bovis AF2122/97
ccaacggcuccgggcgcucgg

SEQ ID NO: 3121328 - RNA, 17 nt, Mycobacterium bovis subsp bovis AF2122/97
ccaacgggaacaacggc

SEQ ID NO: 3121329 - RNA, 23 nt, Mycobacterium bovis subsp bovis AF2122/97
ccaacggggcagucaacucccga

SEQ ID NO: 3121330 - RNA, 21 nt, Mycobacterium bovis subsp bovis AF2122/97
ccaacggugggugggcgccgc

SEQ ID NO: 3121331 - RNA, 20 nt, Mycobacterium bovis subsp bovis AF2122/97
ccaacgucgacuucagcggc

SEQ ID NO: 3121332 - RNA, 16 nt, Mycobacterium bovis subsp bovis AF2122/97
ccaacguugcgccagc

SEQ ID NO: 3121333 - RNA, 18 nt, Mycobacterium bovis subsp bovis AF2122/97
ccaacguuuugggcgccg

SEQ ID NO: 3121334 - RNA, 15 nt, Mycobacterium bovis subsp bovis AF2122/97
ccaacuacgccagcc

SEQ ID NO: 3121335 - RNA, 19 nt, Mycobacterium bovis subsp bovis AF2122/97
ccaacucaagcaauggugc

SEQ ID NO: 3121336 - RNA, 15 nt, Mycobacterium bovis subsp bovis AF2122/97
ccaacucaugggcca

SEQ ID NO: 3121337 - RNA, 18 nt, Mycobacterium bovis subsp bovis AF2122/97
ccaacucaugggccaacu

SEQ ID NO: 3121338 - RNA, 17 nt, Mycobacterium bovis subsp bovis AF2122/97
ccaacuccagcacccgc

SEQ ID NO: 3121339 - RNA, 20 nt, Mycobacterium bovis subsp bovis AF2122/97
ccaacuccagcacccgcugc

SEQ ID NO: 3121340 - RNA, 13 nt, Mycobacterium bovis subsp bovis AF2122/97
ccaacucccgcgg

SEQ ID NO: 3121341 - RNA, 18 nt, Mycobacterium bovis subsp bovis AF2122/97
ccaacuccucagccgccu

SEQ ID NO: 3121342 - RNA, 13 nt, Mycobacterium bovis subsp bovis AF2122/97
ccaacucgaccga

SEQ ID NO: 3121343 - RNA, 13 nt, Mycobacterium bovis subsp bovis AF2122/97
ccaacucggccaa

SEQ ID NO: 3121344 - RNA, 20 nt, Mycobacterium bovis subsp bovis AF2122/97
ccaacucggccaacgacggc

SEQ ID NO: 3121345 - RNA, 12 nt, Mycobacterium bovis subsp bovis AF2122/97
ccaacucggccc

SEQ ID NO: 3121346 - RNA, 15 nt, Mycobacterium bovis subsp bovis AF2122/97
ccaacucggcggcca

SEQ ID NO: 3121347 - RNA, 17 nt, Mycobacterium bovis subsp bovis AF2122/97
ccaacucggcggccagc

SEQ ID NO: 3121348 - RNA, 18 nt, Mycobacterium bovis subsp bovis AF2122/97
ccaacucggcggccagcg

SEQ ID NO: 3121349 - RNA, 18 nt, Mycobacterium bovis subsp bovis AF2122/97
ccaacucgguucgccccu

SEQ ID NO: 3121350 - RNA, 23 nt, Mycobacterium bovis subsp bovis AF2122/97
ccaacucguggaacuccguccgc

SEQ ID NO: 3121351 - RNA, 16 nt, Mycobacterium bovis subsp bovis AF2122/97
ccaacugaaccgagug

SEQ ID NO: 3121352 - RNA, 18 nt, Mycobacterium bovis subsp bovis AF2122/97
ccaacugaauggcaccga

SEQ ID NO: 3121353 - RNA, 20 nt, Mycobacterium bovis subsp bovis AF2122/97
ccaacugaauggcaccgagg

SEQ ID NO: 3121354 - RNA, 22 nt, Mycobacterium bovis subsp bovis AF2122/97
ccaacugaauggcaccgaggcc

SEQ ID NO: 3121355 - RNA, 16 nt, Mycobacterium bovis subsp bovis AF2122/97
ccaacugggccgagcg

SEQ ID NO: 3121356 - RNA, 17 nt, Mycobacterium bovis subsp bovis AF2122/97
ccaacuggucgccaacg

SEQ ID NO: 3121357 - RNA, 13 nt, Mycobacterium bovis subsp bovis AF2122/97
ccaacuucaccac

SEQ ID NO: 3121358 - RNA, 18 nt, Mycobacterium bovis subsp bovis AF2122/97
ccaacuucaccacccugu

SEQ ID NO: 3121359 - RNA, 14 nt, Mycobacterium bovis subsp bovis AF2122/97
ccaacuuggcggcc

SEQ ID NO: 3121360 - RNA, 20 nt, Mycobacterium bovis subsp bovis AF2122/97
ccaagaacggaugccggucg

SEQ ID NO: 3121361 - RNA, 15 nt, Mycobacterium bovis subsp bovis AF2122/97
ccaagaaggacauca

SEQ ID NO: 3121362 - RNA, 16 nt, Mycobacterium bovis subsp bovis AF2122/97
ccaagaaggacaucac

SEQ ID NO: 3121363 - RNA, 14 nt, Mycobacterium bovis subsp bovis AF2122/97
ccaagacaccggcc

SEQ ID NO: 3121364 - RNA, 19 nt, Mycobacterium bovis subsp bovis AF2122/97
ccaagacagccugcgccac

SEQ ID NO: 3121365 - RNA, 16 nt, Mycobacterium bovis subsp bovis AF2122/97
ccaagacgucggcgug

SEQ ID NO: 3121366 - RNA, 17 nt, Mycobacterium bovis subsp bovis AF2122/97
ccaagacuucuccgcgu

SEQ ID NO: 3121367 - RNA, 21 nt, Mycobacterium bovis subsp bovis AF2122/97
ccaagacuucuccgcguccgc

SEQ ID NO: 3121368 - RNA, 15 nt, Mycobacterium bovis subsp bovis AF2122/97
ccaagagcgcgcagc

SEQ ID NO: 3121369 - RNA, 18 nt, Mycobacterium bovis subsp bovis AF2122/97
ccaagaucggcgccccug

SEQ ID NO: 3121370 - RNA, 18 nt, Mycobacterium bovis subsp bovis AF2122/97
ccaagaucggguggcggg

SEQ ID NO: 3121371 - RNA, 12 nt, Mycobacterium bovis subsp bovis AF2122/97
ccaagauggcgc

SEQ ID NO: 3121372 - RNA, 13 nt, Mycobacterium bovis subsp bovis AF2122/97
ccaagauggcgcg

SEQ ID NO: 3121373 - RNA, 15 nt, Mycobacterium bovis subsp bovis AF2122/97
ccaagauggcgcgcu

SEQ ID NO: 3121374 - RNA, 17 nt, Mycobacterium bovis subsp bovis AF2122/97
ccaagcagcgaccagca

SEQ ID NO: 3121375 - RNA, 12 nt, Mycobacterium bovis subsp bovis AF2122/97
ccaagcagcugg

SEQ ID NO: 3121376 - RNA, 22 nt, Mycobacterium bovis subsp bovis AF2122/97
ccaagcccaggcgaucgcccgg

SEQ ID NO: 3121377 - RNA, 20 nt, Mycobacterium bovis subsp bovis AF2122/97
ccaagcccgauucagcgccc

SEQ ID NO: 3121378 - RNA, 13 nt, Mycobacterium bovis subsp bovis AF2122/97
ccaagcccgccgg

SEQ ID NO: 3121379 - RNA, 22 nt, Mycobacterium bovis subsp bovis AF2122/97
ccaagcccgucgucgugcacga

SEQ ID NO: 3121380 - RNA, 13 nt, Mycobacterium bovis subsp bovis AF2122/97
ccaagccgccggc

SEQ ID NO: 3121381 - RNA, 12 nt, Mycobacterium bovis subsp bovis AF2122/97
ccaagccgcggc

SEQ ID NO: 3121382 - RNA, 16 nt, Mycobacterium bovis subsp bovis AF2122/97
ccaagccgcggcuagg

SEQ ID NO: 3121383 - RNA, 21 nt, Mycobacterium bovis subsp bovis AF2122/97
ccaagccgcggcuaggccagc

SEQ ID NO: 3121384 - RNA, 16 nt, Mycobacterium bovis subsp bovis AF2122/97
ccaagccggagcccgg

SEQ ID NO: 3121385 - RNA, 19 nt, Mycobacterium bovis subsp bovis AF2122/97
ccaagccggcugcauccuc

SEQ ID NO: 3121386 - RNA, 16 nt, Mycobacterium bovis subsp bovis AF2122/97
ccaagccguggccgga

SEQ ID NO: 3121387 - RNA, 19 nt, Mycobacterium bovis subsp bovis AF2122/97
ccaagcgagcggucgacgu

SEQ ID NO: 3121388 - RNA, 13 nt, Mycobacterium bovis subsp bovis AF2122/97
ccaagcguccgcu

SEQ ID NO: 3121389 - RNA, 16 nt, Mycobacterium bovis subsp bovis AF2122/97
ccaagcgugcugccgc

SEQ ID NO: 3121390 - RNA, 23 nt, Mycobacterium bovis subsp bovis AF2122/97
ccaagcuaccccgacggcgacca

SEQ ID NO: 3121391 - RNA, 14 nt, Mycobacterium bovis subsp bovis AF2122/97
ccaagcucagggug

SEQ ID NO: 3121392 - RNA, 14 nt, Mycobacterium bovis subsp bovis AF2122/97
ccaagcucggccac

SEQ ID NO: 3121393 - RNA, 19 nt, Mycobacterium bovis subsp bovis AF2122/97
ccaagcucggccaccagcg

SEQ ID NO: 3121394 - RNA, 16 nt, Mycobacterium bovis subsp bovis AF2122/97
ccaagcucggccagca

SEQ ID NO: 3121395 - RNA, 19 nt, Mycobacterium bovis subsp bovis AF2122/97
ccaagcucggccagcacgc

SEQ ID NO: 3121396 - RNA, 21 nt, Mycobacterium bovis subsp bovis AF2122/97
ccaagcucggccagcacgccg

SEQ ID NO: 3121397 - RNA, 22 nt, Mycobacterium bovis subsp bovis AF2122/97
ccaagcucggccagcacgccgc

SEQ ID NO: 3121398 - RNA, 15 nt, Mycobacterium bovis subsp bovis AF2122/97
ccaagcucggcccag

SEQ ID NO: 3121399 - RNA, 16 nt, Mycobacterium bovis subsp bovis AF2122/97
ccaagcucggcccagc

SEQ ID NO: 3121400 - RNA, 14 nt, Mycobacterium bovis subsp bovis AF2122/97
ccaagcucugcguc

SEQ ID NO: 3121401 - RNA, 18 nt, Mycobacterium bovis subsp bovis AF2122/97
ccaaggacgaacgcgccg

SEQ ID NO: 3121402 - RNA, 19 nt, Mycobacterium bovis subsp bovis AF2122/97
ccaaggacgaacgcgccgg

SEQ ID NO: 3121403 - RNA, 21 nt, Mycobacterium bovis subsp bovis AF2122/97
ccaaggcgacgaaucggcaac

SEQ ID NO: 3121404 - RNA, 21 nt, Mycobacterium bovis subsp bovis AF2122/97
ccaaggcguugguagccaggg

SEQ ID NO: 3121405 - RNA, 13 nt, Mycobacterium bovis subsp bovis AF2122/97
ccaaggcucagca

SEQ ID NO: 3121406 - RNA, 18 nt, Mycobacterium bovis subsp bovis AF2122/97
ccaaggcucagcagcgcc

SEQ ID NO: 3121407 - RNA, 19 nt, Mycobacterium bovis subsp bovis AF2122/97
ccaaggcucagcagcgccg

SEQ ID NO: 3121408 - RNA, 14 nt, Mycobacterium bovis subsp bovis AF2122/97
ccaaggcuuccucc

SEQ ID NO: 3121409 - RNA, 21 nt, Mycobacterium bovis subsp bovis AF2122/97
ccaaggggcagcgacggcagc

SEQ ID NO: 3121410 - RNA, 15 nt, Mycobacterium bovis subsp bovis AF2122/97
ccaagguccgcacga

SEQ ID NO: 3121411 - RNA, 13 nt, Mycobacterium bovis subsp bovis AF2122/97
ccaaggucggcga

SEQ ID NO: 3121412 - RNA, 19 nt, Mycobacterium bovis subsp bovis AF2122/97
ccaaggucuucaggccgcg

SEQ ID NO: 3121413 - RNA, 21 nt, Mycobacterium bovis subsp bovis AF2122/97
ccaaggucuucaggccgcgca

SEQ ID NO: 3121414 - RNA, 20 nt, Mycobacterium bovis subsp bovis AF2122/97
ccaaggugagcagcaagacc

SEQ ID NO: 3121415 - RNA, 21 nt, Mycobacterium bovis subsp bovis AF2122/97
ccaaggugagcagcaagaccg

SEQ ID NO: 3121416 - RNA, 12 nt, Mycobacterium bovis subsp bovis AF2122/97
ccaagguggcgg

SEQ ID NO: 3121417 - RNA, 22 nt, Mycobacterium bovis subsp bovis AF2122/97
ccaagguggcggccaguucggc

SEQ ID NO: 3121418 - RNA, 15 nt, Mycobacterium bovis subsp bovis AF2122/97
ccaagguguccagca

SEQ ID NO: 3121419 - RNA, 20 nt, Mycobacterium bovis subsp bovis AF2122/97
ccaagguguggccuugcguc

SEQ ID NO: 3121420 - RNA, 15 nt, Mycobacterium bovis subsp bovis AF2122/97
ccaaguacugggcca

SEQ ID NO: 3121421 - RNA, 14 nt, Mycobacterium bovis subsp bovis AF2122/97
ccaaguccagcagc

SEQ ID NO: 3121422 - RNA, 18 nt, Mycobacterium bovis subsp bovis AF2122/97
ccaagucgacgguggcgc

SEQ ID NO: 3121423 - RNA, 18 nt, Mycobacterium bovis subsp bovis AF2122/97
ccaagucucgggcuuacu

SEQ ID NO: 3121424 - RNA, 14 nt, Mycobacterium bovis subsp bovis AF2122/97
ccaagugcagggcu

SEQ ID NO: 3121425 - RNA, 16 nt, Mycobacterium bovis subsp bovis AF2122/97
ccaaguugaccuucac

SEQ ID NO: 3121426 - RNA, 15 nt, Mycobacterium bovis subsp bovis AF2122/97
ccaaguugcagcggg

SEQ ID NO: 3121427 - RNA, 22 nt, Mycobacterium bovis subsp bovis AF2122/97
ccaaguugcagcgggccacuga

SEQ ID NO: 3121428 - RNA, 16 nt, Mycobacterium bovis subsp bovis AF2122/97
ccaauaccgcacccgc

SEQ ID NO: 3121429 - RNA, 14 nt, Mycobacterium bovis subsp bovis AF2122/97
ccaauacgugaugu

SEQ ID NO: 3121430 - RNA, 22 nt, Mycobacterium bovis subsp bovis AF2122/97
ccaauaggcgaaaauugcucca

SEQ ID NO: 3121431 - RNA, 23 nt, Mycobacterium bovis subsp bovis AF2122/97
ccaauaggcgaaaauugcuccac

SEQ ID NO: 3121432 - RNA, 15 nt, Mycobacterium bovis subsp bovis AF2122/97
ccaauaguccuugcg

SEQ ID NO: 3121433 - RNA, 21 nt, Mycobacterium bovis subsp bovis AF2122/97
ccaaucagugcagcgugggca

SEQ ID NO: 3121434 - RNA, 15 nt, Mycobacterium bovis subsp bovis AF2122/97
ccaaucaugugccag

SEQ ID NO: 3121435 - RNA, 20 nt, Mycobacterium bovis subsp bovis AF2122/97
ccaauccacgguugccggcg

SEQ ID NO: 3121436 - RNA, 19 nt, Mycobacterium bovis subsp bovis AF2122/97
ccaauccgcaacagcucgg

SEQ ID NO: 3121437 - RNA, 23 nt, Mycobacterium bovis subsp bovis AF2122/97
ccaauccggaauagcaacgcugc

SEQ ID NO: 3121438 - RNA, 16 nt, Mycobacterium bovis subsp bovis AF2122/97
ccaauccggcggcgac

SEQ ID NO: 3121439 - RNA, 21 nt, Mycobacterium bovis subsp bovis AF2122/97
ccaaucgccgggugcaggcga

SEQ ID NO: 3121440 - RNA, 17 nt, Mycobacterium bovis subsp bovis AF2122/97
ccaaucgggaucgcugc

SEQ ID NO: 3121441 - RNA, 18 nt, Mycobacterium bovis subsp bovis AF2122/97
ccaaucgggaucgcugcc

SEQ ID NO: 3121442 - RNA, 15 nt, Mycobacterium bovis subsp bovis AF2122/97
ccaaucggguccacg

SEQ ID NO: 3121443 - RNA, 20 nt, Mycobacterium bovis subsp bovis AF2122/97
ccaaucugcgcgaggggccg

SEQ ID NO: 3121444 - RNA, 18 nt, Mycobacterium bovis subsp bovis AF2122/97
ccaaugacuuggccagca

SEQ ID NO: 3121445 - RNA, 15 nt, Mycobacterium bovis subsp bovis AF2122/97
ccaaugcccaggugu

SEQ ID NO: 3121446 - RNA, 17 nt, Mycobacterium bovis subsp bovis AF2122/97
ccaaugcccuuggccag

SEQ ID NO: 3121447 - RNA, 12 nt, Mycobacterium bovis subsp bovis AF2122/97
ccaaugccgcgg

SEQ ID NO: 3121448 - RNA, 18 nt, Mycobacterium bovis subsp bovis AF2122/97
ccaaugccgcggaggcgg

SEQ ID NO: 3121449 - RNA, 22 nt, Mycobacterium bovis subsp bovis AF2122/97
ccaaugccgcggaggcggccag

SEQ ID NO: 3121450 - RNA, 19 nt, Mycobacterium bovis subsp bovis AF2122/97
ccaaugccuugagcaaaau

SEQ ID NO: 3121451 - RNA, 19 nt, Mycobacterium bovis subsp bovis AF2122/97
ccaaugcggugacaaccgc

SEQ ID NO: 3121452 - RNA, 18 nt, Mycobacterium bovis subsp bovis AF2122/97
ccaauggagccgcgacca

SEQ ID NO: 3121453 - RNA, 20 nt, Mycobacterium bovis subsp bovis AF2122/97
ccaauggugggcgagcugcu

SEQ ID NO: 3121454 - RNA, 16 nt, Mycobacterium bovis subsp bovis AF2122/97
ccaauucccgcgcggc

SEQ ID NO: 3121455 - RNA, 17 nt, Mycobacterium bovis subsp bovis AF2122/97
ccaauucgaccgcgcgg

SEQ ID NO: 3121456 - RNA, 17 nt, Mycobacterium bovis subsp bovis AF2122/97
ccaauucgacugcaacu

SEQ ID NO: 3121457 - RNA, 23 nt, Mycobacterium bovis subsp bovis AF2122/97
ccaauucgacugcaacucuuccc

SEQ ID NO: 3121458 - RNA, 14 nt, Mycobacterium bovis subsp bovis AF2122/97
ccaauugcgccgag

SEQ ID NO: 3121459 - RNA, 15 nt, Mycobacterium bovis subsp bovis AF2122/97
ccaauugcgccgcca

SEQ ID NO: 3121460 - RNA, 22 nt, Mycobacterium bovis subsp bovis AF2122/97
ccaauuggcgucgucggcggcg

SEQ ID NO: 3121461 - RNA, 21 nt, Mycobacterium bovis subsp bovis AF2122/97
ccaauugggcgaugcggcguc

SEQ ID NO: 3121462 - RNA, 20 nt, Mycobacterium bovis subsp bovis AF2122/97
ccaauugugcugaccggucc

SEQ ID NO: 3121463 - RNA, 16 nt, Mycobacterium bovis subsp bovis AF2122/97
ccacaaauccaaaccu

SEQ ID NO: 3121464 - RNA, 17 nt, Mycobacterium bovis subsp bovis AF2122/97
ccacaaccgaauccauc

SEQ ID NO: 3121465 - RNA, 22 nt, Mycobacterium bovis subsp bovis AF2122/97
ccacaacgucggcaccgguuuu

SEQ ID NO: 3121466 - RNA, 14 nt, Mycobacterium bovis subsp bovis AF2122/97
ccacaacucggcau

SEQ ID NO: 3121467 - RNA, 23 nt, Mycobacterium bovis subsp bovis AF2122/97
ccacaacucggcauucaccgcgg

SEQ ID NO: 3121468 - RNA, 15 nt, Mycobacterium bovis subsp bovis AF2122/97
ccacaagcgauggca

SEQ ID NO: 3121469 - RNA, 17 nt, Mycobacterium bovis subsp bovis AF2122/97
ccacaaggguuggccga

SEQ ID NO: 3121470 - RNA, 15 nt, Mycobacterium bovis subsp bovis AF2122/97
ccacaaguagccgac

SEQ ID NO: 3121471 - RNA, 16 nt, Mycobacterium bovis subsp bovis AF2122/97
ccacaaucagcccgac

SEQ ID NO: 3121472 - RNA, 19 nt, Mycobacterium bovis subsp bovis AF2122/97
ccacaaucagcccgacacc

SEQ ID NO: 3121473 - RNA, 13 nt, Mycobacterium bovis subsp bovis AF2122/97
ccacaauccacgc

SEQ ID NO: 3121474 - RNA, 15 nt, Mycobacterium bovis subsp bovis AF2122/97
ccacaauccgcucgg

SEQ ID NO: 3121475 - RNA, 13 nt, Mycobacterium bovis subsp bovis AF2122/97
ccacaaucgcaga

SEQ ID NO: 3121476 - RNA, 19 nt, Mycobacterium bovis subsp bovis AF2122/97
ccacaaugacucggccgca

SEQ ID NO: 3121477 - RNA, 14 nt, Mycobacterium bovis subsp bovis AF2122/97
ccacacacagccgg

SEQ ID NO: 3121478 - RNA, 18 nt, Mycobacterium bovis subsp bovis AF2122/97
ccacacaccgagcacggg

SEQ ID NO: 3121479 - RNA, 14 nt, Mycobacterium bovis subsp bovis AF2122/97
ccacacacugugcu

SEQ ID NO: 3121480 - RNA, 23 nt, Mycobacterium bovis subsp bovis AF2122/97
ccacacagaucuugugccaggcg

SEQ ID NO: 3121481 - RNA, 17 nt, Mycobacterium bovis subsp bovis AF2122/97
ccacacagccgcgcugc

SEQ ID NO: 3121482 - RNA, 19 nt, Mycobacterium bovis subsp bovis AF2122/97
ccacacagucacggaccgc

SEQ ID NO: 3121483 - RNA, 19 nt, Mycobacterium bovis subsp bovis AF2122/97
ccacacagucggugcagcg

SEQ ID NO: 3121484 - RNA, 14 nt, Mycobacterium bovis subsp bovis AF2122/97
ccacaccaaggccg

SEQ ID NO: 3121485 - RNA, 15 nt, Mycobacterium bovis subsp bovis AF2122/97
ccacaccacgauggc

SEQ ID NO: 3121486 - RNA, 16 nt, Mycobacterium bovis subsp bovis AF2122/97
ccacaccacgauggcg

SEQ ID NO: 3121487 - RNA, 20 nt, Mycobacterium bovis subsp bovis AF2122/97
ccacaccacgauggcggcca

SEQ ID NO: 3121488 - RNA, 22 nt, Mycobacterium bovis subsp bovis AF2122/97
ccacaccacgguggccgcugcc

SEQ ID NO: 3121489 - RNA, 11 nt, Mycobacterium bovis subsp bovis AF2122/97
ccacaccagcg

SEQ ID NO: 3121490 - RNA, 12 nt, Mycobacterium bovis subsp bovis AF2122/97
ccacaccagcgc

SEQ ID NO: 3121491 - RNA, 15 nt, Mycobacterium bovis subsp bovis AF2122/97
ccacaccagcgcagc

SEQ ID NO: 3121492 - RNA, 16 nt, Mycobacterium bovis subsp bovis AF2122/97
ccacaccagcgcagca

SEQ ID NO: 3121493 - RNA, 13 nt, Mycobacterium bovis subsp bovis AF2122/97
ccacaccaggccg

SEQ ID NO: 3121494 - RNA, 14 nt, Mycobacterium bovis subsp bovis AF2122/97
ccacaccaggccga

SEQ ID NO: 3121495 - RNA, 17 nt, Mycobacterium bovis subsp bovis AF2122/97
ccacaccaggccgagcc

SEQ ID NO: 3121496 - RNA, 17 nt, Mycobacterium bovis subsp bovis AF2122/97
ccacacccaaaccggcc

SEQ ID NO: 3121497 - RNA, 15 nt, Mycobacterium bovis subsp bovis AF2122/97
ccacacccagcgugc

SEQ ID NO: 3121498 - RNA, 21 nt, Mycobacterium bovis subsp bovis AF2122/97
ccacacccagcgugcccgcca

SEQ ID NO: 3121499 - RNA, 15 nt, Mycobacterium bovis subsp bovis AF2122/97
ccacacccaguugau

SEQ ID NO: 3121500 - RNA, 11 nt, Mycobacterium bovis subsp bovis AF2122/97
ccacacccgcg

SEQ ID NO: 3121501 - RNA, 15 nt, Mycobacterium bovis subsp bovis AF2122/97
ccacacccgcgaacg

SEQ ID NO: 3121502 - RNA, 16 nt, Mycobacterium bovis subsp bovis AF2122/97
ccacaccgcggcggcg

SEQ ID NO: 3121503 - RNA, 18 nt, Mycobacterium bovis subsp bovis AF2122/97
ccacaccgggaugggagc

SEQ ID NO: 3121504 - RNA, 17 nt, Mycobacterium bovis subsp bovis AF2122/97
ccacaccggggcggccg

SEQ ID NO: 3121505 - RNA, 19 nt, Mycobacterium bovis subsp bovis AF2122/97
ccacaccgucacgccaccg

SEQ ID NO: 3121506 - RNA, 14 nt, Mycobacterium bovis subsp bovis AF2122/97
ccacaccgugacca

SEQ ID NO: 3121507 - RNA, 19 nt, Mycobacterium bovis subsp bovis AF2122/97
ccacaccgugaccagccgg

SEQ ID NO: 3121508 - RNA, 21 nt, Mycobacterium bovis subsp bovis AF2122/97
ccacaccgugggcgacggcgg

SEQ ID NO: 3121509 - RNA, 22 nt, Mycobacterium bovis subsp bovis AF2122/97
ccacaccgugggcgacggcggc

SEQ ID NO: 3121510 - RNA, 16 nt, Mycobacterium bovis subsp bovis AF2122/97
ccacaccuuggccgcc

SEQ ID NO: 3121511 - RNA, 17 nt, Mycobacterium bovis subsp bovis AF2122/97
ccacaccuuggccgccg

SEQ ID NO: 3121512 - RNA, 22 nt, Mycobacterium bovis subsp bovis AF2122/97
ccacaccuuggccgccggccgc

SEQ ID NO: 3121513 - RNA, 13 nt, Mycobacterium bovis subsp bovis AF2122/97
ccacacgaagugg

SEQ ID NO: 3121514 - RNA, 20 nt, Mycobacterium bovis subsp bovis AF2122/97
ccacacgcccucgacgccgc

SEQ ID NO: 3121515 - RNA, 23 nt, Mycobacterium bovis subsp bovis AF2122/97
ccacacgcccucgacgccgcgca

SEQ ID NO: 3121516 - RNA, 20 nt, Mycobacterium bovis subsp bovis AF2122/97
ccacacggggccgccagcug

SEQ ID NO: 3121517 - RNA, 14 nt, Mycobacterium bovis subsp bovis AF2122/97
ccacacggugcgau

SEQ ID NO: 3121518 - RNA, 22 nt, Mycobacterium bovis subsp bovis AF2122/97
ccacacggugcgauuccgcguc

SEQ ID NO: 3121519 - RNA, 22 nt, Mycobacterium bovis subsp bovis AF2122/97
ccacacucccgcgcccgacgca

SEQ ID NO: 3121520 - RNA, 14 nt, Mycobacterium bovis subsp bovis AF2122/97
ccacacuggcagug

SEQ ID NO: 3121521 - RNA, 17 nt, Mycobacterium bovis subsp bovis AF2122/97
ccacagaccgaacagca

SEQ ID NO: 3121522 - RNA, 15 nt, Mycobacterium bovis subsp bovis AF2122/97
ccacagacugcgcgg

SEQ ID NO: 3121523 - RNA, 15 nt, Mycobacterium bovis subsp bovis AF2122/97
ccacagcaacgacau

SEQ ID NO: 3121524 - RNA, 17 nt, Mycobacterium bovis subsp bovis AF2122/97
ccacagcacccacgccg

SEQ ID NO: 3121525 - RNA, 14 nt, Mycobacterium bovis subsp bovis AF2122/97
ccacagcccggcga

SEQ ID NO: 3121526 - RNA, 14 nt, Mycobacterium bovis subsp bovis AF2122/97
ccacagcgacagcg

SEQ ID NO: 3121527 - RNA, 19 nt, Mycobacterium bovis subsp bovis AF2122/97
ccacagcgacagcgugccg

SEQ ID NO: 3121528 - RNA, 13 nt, Mycobacterium bovis subsp bovis AF2122/97
ccacagcggcgau

SEQ ID NO: 3121529 - RNA, 13 nt, Mycobacterium bovis subsp bovis AF2122/97
ccacagcgugcgg

SEQ ID NO: 3121530 - RNA, 23 nt, Mycobacterium bovis subsp bovis AF2122/97
ccacagcucgccgugaccaggug

SEQ ID NO: 3121531 - RNA, 20 nt, Mycobacterium bovis subsp bovis AF2122/97
ccacagcuugcccgagccca

SEQ ID NO: 3121532 - RNA, 21 nt, Mycobacterium bovis subsp bovis AF2122/97
ccacagcuugcccgagcccag

SEQ ID NO: 3121533 - RNA, 13 nt, Mycobacterium bovis subsp bovis AF2122/97
ccacaggaagcga

SEQ ID NO: 3121534 - RNA, 21 nt, Mycobacterium bovis subsp bovis AF2122/97
ccacaggacaauggacaccaa

SEQ ID NO: 3121535 - RNA, 22 nt, Mycobacterium bovis subsp bovis AF2122/97
ccacaggggcagcgcggccacc

SEQ ID NO: 3121536 - RNA, 23 nt, Mycobacterium bovis subsp bovis AF2122/97
ccacaggggcagcgcggccaccc

SEQ ID NO: 3121537 - RNA, 14 nt, Mycobacterium bovis subsp bovis AF2122/97
ccacaggugaccuu

SEQ ID NO: 3121538 - RNA, 17 nt, Mycobacterium bovis subsp bovis AF2122/97
ccacagguuugcgccgc

SEQ ID NO: 3121539 - RNA, 23 nt, Mycobacterium bovis subsp bovis AF2122/97
ccacagguuugcgccgcgcagcg

SEQ ID NO: 3121540 - RNA, 18 nt, Mycobacterium bovis subsp bovis AF2122/97
ccacagucgccggccggc

SEQ ID NO: 3121541 - RNA, 17 nt, Mycobacterium bovis subsp bovis AF2122/97
ccacagucgucgagcgc

SEQ ID NO: 3121542 - RNA, 18 nt, Mycobacterium bovis subsp bovis AF2122/97
ccacagucgucgagcgcu

SEQ ID NO: 3121543 - RNA, 22 nt, Mycobacterium bovis subsp bovis AF2122/97
ccacagugaaauccgagccgcg

SEQ ID NO: 3121544 - RNA, 20 nt, Mycobacterium bovis subsp bovis AF2122/97
ccacagugcauacgguugau

SEQ ID NO: 3121545 - RNA, 23 nt, Mycobacterium bovis subsp bovis AF2122/97
ccacagugccaauuccagccccc

SEQ ID NO: 3121546 - RNA, 17 nt, Mycobacterium bovis subsp bovis AF2122/97
ccacauacaggcccgcc

SEQ ID NO: 3121547 - RNA, 17 nt, Mycobacterium bovis subsp bovis AF2122/97
ccacaucaaaacggcgg

SEQ ID NO: 3121548 - RNA, 18 nt, Mycobacterium bovis subsp bovis AF2122/97
ccacaucaacuugccgcc

SEQ ID NO: 3121549 - RNA, 15 nt, Mycobacterium bovis subsp bovis AF2122/97
ccacaucaccaaaaa

SEQ ID NO: 3121550 - RNA, 15 nt, Mycobacterium bovis subsp bovis AF2122/97
ccacaucagccgcac

SEQ ID NO: 3121551 - RNA, 19 nt, Mycobacterium bovis subsp bovis AF2122/97
ccacaucagccgcaccagu

SEQ ID NO: 3121552 - RNA, 14 nt, Mycobacterium bovis subsp bovis AF2122/97
ccacaucaggucgg

SEQ ID NO: 3121553 - RNA, 18 nt, Mycobacterium bovis subsp bovis AF2122/97
ccacaucaggucggcgaa

SEQ ID NO: 3121554 - RNA, 16 nt, Mycobacterium bovis subsp bovis AF2122/97
ccacaucaugccagcc

SEQ ID NO: 3121555 - RNA, 18 nt, Mycobacterium bovis subsp bovis AF2122/97
ccacauccaucuccaugu

SEQ ID NO: 3121556 - RNA, 20 nt, Mycobacterium bovis subsp bovis AF2122/97
ccacauccuggcggcugcag

SEQ ID NO: 3121557 - RNA, 22 nt, Mycobacterium bovis subsp bovis AF2122/97
ccacauccuggcggcugcagcc

SEQ ID NO: 3121558 - RNA, 20 nt, Mycobacterium bovis subsp bovis AF2122/97
ccacaucgaaggugcuggug

SEQ ID NO: 3121559 - RNA, 17 nt, Mycobacterium bovis subsp bovis AF2122/97
ccacaucgaugucggcu

SEQ ID NO: 3121560 - RNA, 19 nt, Mycobacterium bovis subsp bovis AF2122/97
ccacaucgaugucggcucg

SEQ ID NO: 3121561 - RNA, 13 nt, Mycobacterium bovis subsp bovis AF2122/97
ccacaucgccagc

SEQ ID NO: 3121562 - RNA, 12 nt, Mycobacterium bovis subsp bovis AF2122/97
ccacaucgggcc

SEQ ID NO: 3121563 - RNA, 15 nt, Mycobacterium bovis subsp bovis AF2122/97
ccacaucguggcguc

SEQ ID NO: 3121564 - RNA, 22 nt, Mycobacterium bovis subsp bovis AF2122/97
ccacaugacgaucgcggcgggc

SEQ ID NO: 3121565 - RNA, 17 nt, Mycobacterium bovis subsp bovis AF2122/97
ccacaugaucgagcagu

SEQ ID NO: 3121566 - RNA, 21 nt, Mycobacterium bovis subsp bovis AF2122/97
ccacaugaucgagcaguucca

SEQ ID NO: 3121567 - RNA, 14 nt, Mycobacterium bovis subsp bovis AF2122/97
ccacauggcccgga

SEQ ID NO: 3121568 - RNA, 14 nt, Mycobacterium bovis subsp bovis AF2122/97
ccacauggcggccc

SEQ ID NO: 3121569 - RNA, 18 nt, Mycobacterium bovis subsp bovis AF2122/97
ccacauggcggcccggug

SEQ ID NO: 3121570 - RNA, 19 nt, Mycobacterium bovis subsp bovis AF2122/97
ccacaugggagccguucgg

SEQ ID NO: 3121571 - RNA, 23 nt, Mycobacterium bovis subsp bovis AF2122/97
ccacauguucuccucgucgcggg

SEQ ID NO: 3121572 - RNA, 14 nt, Mycobacterium bovis subsp bovis AF2122/97
ccacauuccgcagu

SEQ ID NO: 3121573 - RNA, 18 nt, Mycobacterium bovis subsp bovis AF2122/97
ccacauuccgcagucccg

SEQ ID NO: 3121574 - RNA, 21 nt, Mycobacterium bovis subsp bovis AF2122/97
ccacauuccguagccggcggu

SEQ ID NO: 3121575 - RNA, 22 nt, Mycobacterium bovis subsp bovis AF2122/97
ccacauuggcgaucagcagccg

SEQ ID NO: 3121576 - RNA, 20 nt, Mycobacterium bovis subsp bovis AF2122/97
ccacauuggugauggccgac

SEQ ID NO: 3121577 - RNA, 16 nt, Mycobacterium bovis subsp bovis AF2122/97
ccaccaaacgcugcug

SEQ ID NO: 3121578 - RNA, 23 nt, Mycobacterium bovis subsp bovis AF2122/97
ccaccaaauccgcaaggaccugu

SEQ ID NO: 3121579 - RNA, 19 nt, Mycobacterium bovis subsp bovis AF2122/97
ccaccaaccucaucgcggu

SEQ ID NO: 3121580 - RNA, 23 nt, Mycobacterium bovis subsp bovis AF2122/97
ccaccaaccucaucgcggucgcc

SEQ ID NO: 3121581 - RNA, 16 nt, Mycobacterium bovis subsp bovis AF2122/97
ccaccaacgagucagu

SEQ ID NO: 3121582 - RNA, 19 nt, Mycobacterium bovis subsp bovis AF2122/97
ccaccaagcucgcaaccga

SEQ ID NO: 3121583 - RNA, 20 nt, Mycobacterium bovis subsp bovis AF2122/97
ccaccaagcucggccagcac

SEQ ID NO: 3121584 - RNA, 12 nt, Mycobacterium bovis subsp bovis AF2122/97
ccaccacacagc

SEQ ID NO: 3121585 - RNA, 15 nt, Mycobacterium bovis subsp bovis AF2122/97
ccaccacacagccgc

SEQ ID NO: 3121586 - RNA, 15 nt, Mycobacterium bovis subsp bovis AF2122/97
ccaccacaccugcgg

SEQ ID NO: 3121587 - RNA, 22 nt, Mycobacterium bovis subsp bovis AF2122/97
ccaccacaucgcgggcgugccg

SEQ ID NO: 3121588 - RNA, 13 nt, Mycobacterium bovis subsp bovis AF2122/97
ccaccaccacggc

SEQ ID NO: 3121589 - RNA, 15 nt, Mycobacterium bovis subsp bovis AF2122/97
ccaccaccacggcca

SEQ ID NO: 3121590 - RNA, 13 nt, Mycobacterium bovis subsp bovis AF2122/97
ccaccacccggcg

SEQ ID NO: 3121591 - RNA, 14 nt, Mycobacterium bovis subsp bovis AF2122/97
ccaccacccggcgc

SEQ ID NO: 3121592 - RNA, 15 nt, Mycobacterium bovis subsp bovis AF2122/97
ccaccaccgacgagg

SEQ ID NO: 3121593 - RNA, 14 nt, Mycobacterium bovis subsp bovis AF2122/97
ccaccaccgccgac

SEQ ID NO: 3121594 - RNA, 15 nt, Mycobacterium bovis subsp bovis AF2122/97
ccaccaccgccggug

SEQ ID NO: 3121595 - RNA, 18 nt, Mycobacterium bovis subsp bovis AF2122/97
ccaccaccgccggugccg

SEQ ID NO: 3121596 - RNA, 14 nt, Mycobacterium bovis subsp bovis AF2122/97
ccaccaccgcgccg

SEQ ID NO: 3121597 - RNA, 12 nt, Mycobacterium bovis subsp bovis AF2122/97
ccaccaccgcuc

SEQ ID NO: 3121598 - RNA, 12 nt, Mycobacterium bovis subsp bovis AF2122/97
ccaccaccggca

SEQ ID NO: 3121599 - RNA, 23 nt, Mycobacterium bovis subsp bovis AF2122/97
ccaccaccggcacccgcuggcgg

SEQ ID NO: 3121600 - RNA, 15 nt, Mycobacterium bovis subsp bovis AF2122/97
ccaccaccggcgccu

SEQ ID NO: 3121601 - RNA, 13 nt, Mycobacterium bovis subsp bovis AF2122/97
ccaccaccgguga

SEQ ID NO: 3121602 - RNA, 23 nt, Mycobacterium bovis subsp bovis AF2122/97
ccaccaccgucgagccggacagg

SEQ ID NO: 3121603 - RNA, 13 nt, Mycobacterium bovis subsp bovis AF2122/97
ccaccaccgugaa

SEQ ID NO: 3121604 - RNA, 13 nt, Mycobacterium bovis subsp bovis AF2122/97
ccaccaccuccgc

SEQ ID NO: 3121605 - RNA, 14 nt, Mycobacterium bovis subsp bovis AF2122/97
ccaccaccuccgcg

SEQ ID NO: 3121606 - RNA, 17 nt, Mycobacterium bovis subsp bovis AF2122/97
ccaccaccuccgcgucg

SEQ ID NO: 3121607 - RNA, 11 nt, Mycobacterium bovis subsp bovis AF2122/97
ccaccacgcau

SEQ ID NO: 3121608 - RNA, 19 nt, Mycobacterium bovis subsp bovis AF2122/97
ccaccacgccgucgacaac

SEQ ID NO: 3121609 - RNA, 14 nt, Mycobacterium bovis subsp bovis AF2122/97
ccaccacgcgccgc

SEQ ID NO: 3121610 - RNA, 14 nt, Mycobacterium bovis subsp bovis AF2122/97
ccaccacggccaga

SEQ ID NO: 3121611 - RNA, 23 nt, Mycobacterium bovis subsp bovis AF2122/97
ccaccacggucaagccggcgccc

SEQ ID NO: 3121612 - RNA, 23 nt, Mycobacterium bovis subsp bovis AF2122/97
ccaccacgucgggaugcccgcug

SEQ ID NO: 3121613 - RNA, 19 nt, Mycobacterium bovis subsp bovis AF2122/97
ccaccacguggcccuccuc

SEQ ID NO: 3121614 - RNA, 14 nt, Mycobacterium bovis subsp bovis AF2122/97
ccaccacugcgccc

SEQ ID NO: 3121615 - RNA, 16 nt, Mycobacterium bovis subsp bovis AF2122/97
ccaccacugcgcccgc

SEQ ID NO: 3121616 - RNA, 18 nt, Mycobacterium bovis subsp bovis AF2122/97
ccaccacugcgcccgcca

SEQ ID NO: 3121617 - RNA, 19 nt, Mycobacterium bovis subsp bovis AF2122/97
ccaccacugcgcccgccac

SEQ ID NO: 3121618 - RNA, 21 nt, Mycobacterium bovis subsp bovis AF2122/97
ccaccacuucggcgccgcgcc

SEQ ID NO: 3121619 - RNA, 22 nt, Mycobacterium bovis subsp bovis AF2122/97
ccaccacuucggcgccgcgccg

SEQ ID NO: 3121620 - RNA, 23 nt, Mycobacterium bovis subsp bovis AF2122/97
ccaccacuucggcgccgcgccgu

SEQ ID NO: 3121621 - RNA, 13 nt, Mycobacterium bovis subsp bovis AF2122/97
ccaccagaaacac

SEQ ID NO: 3121622 - RNA, 12 nt, Mycobacterium bovis subsp bovis AF2122/97
ccaccagaacca

SEQ ID NO: 3121623 - RNA, 14 nt, Mycobacterium bovis subsp bovis AF2122/97
ccaccagaaccacu

SEQ ID NO: 3121624 - RNA, 17 nt, Mycobacterium bovis subsp bovis AF2122/97
ccaccagaaccagcgac

SEQ ID NO: 3121625 - RNA, 16 nt, Mycobacterium bovis subsp bovis AF2122/97
ccaccagacaacgccg

SEQ ID NO: 3121626 - RNA, 15 nt, Mycobacterium bovis subsp bovis AF2122/97
ccaccagcaccgccg

SEQ ID NO: 3121627 - RNA, 16 nt, Mycobacterium bovis subsp bovis AF2122/97
ccaccagccgguccag

SEQ ID NO: 3121628 - RNA, 21 nt, Mycobacterium bovis subsp bovis AF2122/97
ccaccagccgguuggcugccg

SEQ ID NO: 3121629 - RNA, 20 nt, Mycobacterium bovis subsp bovis AF2122/97
ccaccagcgacgaccacacc

SEQ ID NO: 3121630 - RNA, 12 nt, Mycobacterium bovis subsp bovis AF2122/97
ccaccagcgccc

SEQ ID NO: 3121631 - RNA, 15 nt, Mycobacterium bovis subsp bovis AF2122/97
ccaccagcgcccggc

SEQ ID NO: 3121632 - RNA, 18 nt, Mycobacterium bovis subsp bovis AF2122/97
ccaccagcgcccggcccg

SEQ ID NO: 3121633 - RNA, 22 nt, Mycobacterium bovis subsp bovis AF2122/97
ccaccagcgcccggcccgccac

SEQ ID NO: 3121634 - RNA, 14 nt, Mycobacterium bovis subsp bovis AF2122/97
ccaccagcgcccgu

SEQ ID NO: 3121635 - RNA, 12 nt, Mycobacterium bovis subsp bovis AF2122/97
ccaccagcgccu

SEQ ID NO: 3121636 - RNA, 16 nt, Mycobacterium bovis subsp bovis AF2122/97
ccaccagcgccuugac

SEQ ID NO: 3121637 - RNA, 19 nt, Mycobacterium bovis subsp bovis AF2122/97
ccaccagcgcuccagcacc

SEQ ID NO: 3121638 - RNA, 14 nt, Mycobacterium bovis subsp bovis AF2122/97
ccaccagcggcaua

SEQ ID NO: 3121639 - RNA, 22 nt, Mycobacterium bovis subsp bovis AF2122/97
ccaccagcggcggcaacggugg

SEQ ID NO: 3121640 - RNA, 18 nt, Mycobacterium bovis subsp bovis AF2122/97
ccaccaggacguggucgg

SEQ ID NO: 3121641 - RNA, 13 nt, Mycobacterium bovis subsp bovis AF2122/97
ccaccaggcuguc

SEQ ID NO: 3121642 - RNA, 19 nt, Mycobacterium bovis subsp bovis AF2122/97
ccaccagggcaacggccgc

SEQ ID NO: 3121643 - RNA, 18 nt, Mycobacterium bovis subsp bovis AF2122/97
ccaccaggggaccgcggc

SEQ ID NO: 3121644 - RNA, 20 nt, Mycobacterium bovis subsp bovis AF2122/97
ccaccaggggaccgcggcgc

SEQ ID NO: 3121645 - RNA, 16 nt, Mycobacterium bovis subsp bovis AF2122/97
ccaccagguccacccc

SEQ ID NO: 3121646 - RNA, 12 nt, Mycobacterium bovis subsp bovis AF2122/97
ccaccaggucga

SEQ ID NO: 3121647 - RNA, 12 nt, Mycobacterium bovis subsp bovis AF2122/97
ccaccaggucgg

SEQ ID NO: 3121648 - RNA, 15 nt, Mycobacterium bovis subsp bovis AF2122/97
ccaccaggugccgug

SEQ ID NO: 3121649 - RNA, 17 nt, Mycobacterium bovis subsp bovis AF2122/97
ccaccaggugccgugau

SEQ ID NO: 3121650 - RNA, 20 nt, Mycobacterium bovis subsp bovis AF2122/97
ccaccaggugcgcacaggug

SEQ ID NO: 3121651 - RNA, 18 nt, Mycobacterium bovis subsp bovis AF2122/97
ccaccaguaccaccggca

SEQ ID NO: 3121652 - RNA, 15 nt, Mycobacterium bovis subsp bovis AF2122/97
ccaccagucacgccc

SEQ ID NO: 3121653 - RNA, 22 nt, Mycobacterium bovis subsp bovis AF2122/97
ccaccaguccgaugggaaucag

SEQ ID NO: 3121654 - RNA, 20 nt, Mycobacterium bovis subsp bovis AF2122/97
ccaccagugcaucgaucacc

SEQ ID NO: 3121655 - RNA, 13 nt, Mycobacterium bovis subsp bovis AF2122/97
ccaccagugcccc

SEQ ID NO: 3121656 - RNA, 21 nt, Mycobacterium bovis subsp bovis AF2122/97
ccaccagugccccgccgagcg

SEQ ID NO: 3121657 - RNA, 21 nt, Mycobacterium bovis subsp bovis AF2122/97
ccaccaguggcgcgugcagcg

SEQ ID NO: 3121658 - RNA, 15 nt, Mycobacterium bovis subsp bovis AF2122/97
ccaccaucaccgccu

SEQ ID NO: 3121659 - RNA, 16 nt, Mycobacterium bovis subsp bovis AF2122/97
ccaccaucaccgccuu

SEQ ID NO: 3121660 - RNA, 17 nt, Mycobacterium bovis subsp bovis AF2122/97
ccaccaucccgcucagc

SEQ ID NO: 3121661 - RNA, 23 nt, Mycobacterium bovis subsp bovis AF2122/97
ccaccaucgccgccguugccgcc

SEQ ID NO: 3121662 - RNA, 14 nt, Mycobacterium bovis subsp bovis AF2122/97
ccaccaucgccucg

SEQ ID NO: 3121663 - RNA, 15 nt, Mycobacterium bovis subsp bovis AF2122/97
ccaccaucgccucgg

SEQ ID NO: 3121664 - RNA, 23 nt, Mycobacterium bovis subsp bovis AF2122/97
ccaccaucgccucggcgcugcgc

SEQ ID NO: 3121665 - RNA, 23 nt, Mycobacterium bovis subsp bovis AF2122/97
ccaccaucuguuccgugccagcu

SEQ ID NO: 3121666 - RNA, 18 nt, Mycobacterium bovis subsp bovis AF2122/97
ccaccauucgcgggccga

SEQ ID NO: 3121667 - RNA, 17 nt, Mycobacterium bovis subsp bovis AF2122/97
ccacccaacagcccacc

SEQ ID NO: 3121668 - RNA, 15 nt, Mycobacterium bovis subsp bovis AF2122/97
ccacccaacagcgcu

SEQ ID NO: 3121669 - RNA, 24 nt, Mycobacterium bovis subsp bovis AF2122/97
ccacccaacgcggugggcacagcc

SEQ ID NO: 3121670 - RNA, 14 nt, Mycobacterium bovis subsp bovis AF2122/97
ccacccaagcucgg

SEQ ID NO: 3121671 - RNA, 17 nt, Mycobacterium bovis subsp bovis AF2122/97
ccacccaagcucgguca

SEQ ID NO: 3121672 - RNA, 23 nt, Mycobacterium bovis subsp bovis AF2122/97
ccacccacauggcggcccggugg

SEQ ID NO: 3121673 - RNA, 12 nt, Mycobacterium bovis subsp bovis AF2122/97
ccacccacccgc

SEQ ID NO: 3121674 - RNA, 13 nt, Mycobacterium bovis subsp bovis AF2122/97
ccacccaccgaca

SEQ ID NO: 3121675 - RNA, 16 nt, Mycobacterium bovis subsp bovis AF2122/97
ccacccacgaucagca

SEQ ID NO: 3121676 - RNA, 14 nt, Mycobacterium bovis subsp bovis AF2122/97
ccacccacgccgac

SEQ ID NO: 3121677 - RNA, 13 nt, Mycobacterium bovis subsp bovis AF2122/97
ccacccagggccu

SEQ ID NO: 3121678 - RNA, 13 nt, Mycobacterium bovis subsp bovis AF2122/97
ccacccagugcca

SEQ ID NO: 3121679 - RNA, 23 nt, Mycobacterium bovis subsp bovis AF2122/97
ccacccagugccacgccugagcc

SEQ ID NO: 3121680 - RNA, 22 nt, Mycobacterium bovis subsp bovis AF2122/97
ccacccauggccucccacucac

SEQ ID NO: 3121681 - RNA, 22 nt, Mycobacterium bovis subsp bovis AF2122/97
ccaccccagcggccaccgaggc

SEQ ID NO: 3121682 - RNA, 19 nt, Mycobacterium bovis subsp bovis AF2122/97
ccaccccccagcgccgccg

SEQ ID NO: 3121683 - RNA, 18 nt, Mycobacterium bovis subsp bovis AF2122/97
ccaccccgagcucaccaa

SEQ ID NO: 3121684 - RNA, 20 nt, Mycobacterium bovis subsp bovis AF2122/97
ccaccccgauccgccacgaa

SEQ ID NO: 3121685 - RNA, 13 nt, Mycobacterium bovis subsp bovis AF2122/97
ccaccccgcgcgc

SEQ ID NO: 3121686 - RNA, 20 nt, Mycobacterium bovis subsp bovis AF2122/97
ccaccccgcguaugccagga

SEQ ID NO: 3121687 - RNA, 14 nt, Mycobacterium bovis subsp bovis AF2122/97
ccaccccggccaac

SEQ ID NO: 3121688 - RNA, 14 nt, Mycobacterium bovis subsp bovis AF2122/97
ccaccccguagcgg

SEQ ID NO: 3121689 - RNA, 15 nt, Mycobacterium bovis subsp bovis AF2122/97
ccaccccgucugcag

SEQ ID NO: 3121690 - RNA, 13 nt, Mycobacterium bovis subsp bovis AF2122/97
ccaccccugagcu

SEQ ID NO: 3121691 - RNA, 19 nt, Mycobacterium bovis subsp bovis AF2122/97
ccacccgacaugcgccgag

SEQ ID NO: 3121692 - RNA, 14 nt, Mycobacterium bovis subsp bovis AF2122/97
ccacccgaccgcca

SEQ ID NO: 3121693 - RNA, 19 nt, Mycobacterium bovis subsp bovis AF2122/97
ccacccgauauucggccau

SEQ ID NO: 3121694 - RNA, 19 nt, Mycobacterium bovis subsp bovis AF2122/97
ccacccgauuggccaaccc

SEQ ID NO: 3121695 - RNA, 15 nt, Mycobacterium bovis subsp bovis AF2122/97
ccacccgcaccgccg

SEQ ID NO: 3121696 - RNA, 23 nt, Mycobacterium bovis subsp bovis AF2122/97
ccacccgcacuccaagucacagc

SEQ ID NO: 3121697 - RNA, 15 nt, Mycobacterium bovis subsp bovis AF2122/97
ccacccgcagaccgg

SEQ ID NO: 3121698 - RNA, 14 nt, Mycobacterium bovis subsp bovis AF2122/97
ccacccgccaacgc

SEQ ID NO: 3121699 - RNA, 14 nt, Mycobacterium bovis subsp bovis AF2122/97
ccacccgccgcagc

SEQ ID NO: 3121700 - RNA, 12 nt, Mycobacterium bovis subsp bovis AF2122/97
ccacccgcgccg

SEQ ID NO: 3121701 - RNA, 15 nt, Mycobacterium bovis subsp bovis AF2122/97
ccacccgcgccgccc

SEQ ID NO: 3121702 - RNA, 13 nt, Mycobacterium bovis subsp bovis AF2122/97
ccacccggccagg

SEQ ID NO: 3121703 - RNA, 22 nt, Mycobacterium bovis subsp bovis AF2122/97
ccacccggccucaacacccggc

SEQ ID NO: 3121704 - RNA, 14 nt, Mycobacterium bovis subsp bovis AF2122/97
ccacccggcgcagc

SEQ ID NO: 3121705 - RNA, 16 nt, Mycobacterium bovis subsp bovis AF2122/97
ccacccggcgggcggu

SEQ ID NO: 3121706 - RNA, 23 nt, Mycobacterium bovis subsp bovis AF2122/97
ccacccggcgggcggugggcagc

SEQ ID NO: 3121707 - RNA, 14 nt, Mycobacterium bovis subsp bovis AF2122/97
ccacccgggccucg

SEQ ID NO: 3121708 - RNA, 20 nt, Mycobacterium bovis subsp bovis AF2122/97
ccacccgggccucggcgccg

SEQ ID NO: 3121709 - RNA, 15 nt, Mycobacterium bovis subsp bovis AF2122/97
ccacccgggugggcc

SEQ ID NO: 3121710 - RNA, 19 nt, Mycobacterium bovis subsp bovis AF2122/97
ccacccgggugggccagug

SEQ ID NO: 3121711 - RNA, 14 nt, Mycobacterium bovis subsp bovis AF2122/97
ccacccgguccugc

SEQ ID NO: 3121712 - RNA, 13 nt, Mycobacterium bovis subsp bovis AF2122/97
ccacccggugccg

SEQ ID NO: 3121713 - RNA, 17 nt, Mycobacterium bovis subsp bovis AF2122/97
ccacccggugccgcagc

SEQ ID NO: 3121714 - RNA, 16 nt, Mycobacterium bovis subsp bovis AF2122/97
ccacccgucggcccgc

SEQ ID NO: 3121715 - RNA, 23 nt, Mycobacterium bovis subsp bovis AF2122/97
ccacccuaaucguuccgcagucu

SEQ ID NO: 3121716 - RNA, 15 nt, Mycobacterium bovis subsp bovis AF2122/97
ccacccucgggucca

SEQ ID NO: 3121717 - RNA, 20 nt, Mycobacterium bovis subsp bovis AF2122/97
ccacccuguuguugccccgg

SEQ ID NO: 3121718 - RNA, 12 nt, Mycobacterium bovis subsp bovis AF2122/97
ccacccuugccg

SEQ ID NO: 3121719 - RNA, 13 nt, Mycobacterium bovis subsp bovis AF2122/97
ccacccuugccgc

SEQ ID NO: 3121720 - RNA, 16 nt, Mycobacterium bovis subsp bovis AF2122/97
ccacccuugccgccgg

SEQ ID NO: 3121721 - RNA, 17 nt, Mycobacterium bovis subsp bovis AF2122/97
ccacccuugccgccggu

SEQ ID NO: 3121722 - RNA, 14 nt, Mycobacterium bovis subsp bovis AF2122/97
ccacccuugccgcu

SEQ ID NO: 3121723 - RNA, 21 nt, Mycobacterium bovis subsp bovis AF2122/97
ccaccgaaauacccagcgcag

SEQ ID NO: 3121724 - RNA, 17 nt, Mycobacterium bovis subsp bovis AF2122/97
ccaccgaaauugcccua

SEQ ID NO: 3121725 - RNA, 20 nt, Mycobacterium bovis subsp bovis AF2122/97
ccaccgaaauugcccuagca

SEQ ID NO: 3121726 - RNA, 16 nt, Mycobacterium bovis subsp bovis AF2122/97
ccaccgaacgcggcca

SEQ ID NO: 3121727 - RNA, 18 nt, Mycobacterium bovis subsp bovis AF2122/97
ccaccgaacgcggccacc

SEQ ID NO: 3121728 - RNA, 15 nt, Mycobacterium bovis subsp bovis AF2122/97
ccaccgaagccccuc

SEQ ID NO: 3121729 - RNA, 16 nt, Mycobacterium bovis subsp bovis AF2122/97
ccaccgaagccgccgg

SEQ ID NO: 3121730 - RNA, 20 nt, Mycobacterium bovis subsp bovis AF2122/97
ccaccgaagcggugacccac

SEQ ID NO: 3121731 - RNA, 21 nt, Mycobacterium bovis subsp bovis AF2122/97
ccaccgacaagaauggccgcc

SEQ ID NO: 3121732 - RNA, 15 nt, Mycobacterium bovis subsp bovis AF2122/97
ccaccgacagcaccc

SEQ ID NO: 3121733 - RNA, 17 nt, Mycobacterium bovis subsp bovis AF2122/97
ccaccgacagcacccgg

SEQ ID NO: 3121734 - RNA, 14 nt, Mycobacterium bovis subsp bovis AF2122/97
ccaccgacagcccc

SEQ ID NO: 3121735 - RNA, 14 nt, Mycobacterium bovis subsp bovis AF2122/97
ccaccgaccgcaug

SEQ ID NO: 3121736 - RNA, 14 nt, Mycobacterium bovis subsp bovis AF2122/97
ccaccgaccucgac

SEQ ID NO: 3121737 - RNA, 17 nt, Mycobacterium bovis subsp bovis AF2122/97
ccaccgacguggccagc

SEQ ID NO: 3121738 - RNA, 14 nt, Mycobacterium bovis subsp bovis AF2122/97
ccaccgacuccugu

SEQ ID NO: 3121739 - RNA, 17 nt, Mycobacterium bovis subsp bovis AF2122/97
ccaccgagaucaugccg

SEQ ID NO: 3121740 - RNA, 21 nt, Mycobacterium bovis subsp bovis AF2122/97
ccaccgagaucaugccggcga

SEQ ID NO: 3121741 - RNA, 18 nt, Mycobacterium bovis subsp bovis AF2122/97
ccaccgagcccuccaggg

SEQ ID NO: 3121742 - RNA, 13 nt, Mycobacterium bovis subsp bovis AF2122/97
ccaccgagucgau

SEQ ID NO: 3121743 - RNA, 16 nt, Mycobacterium bovis subsp bovis AF2122/97
ccaccgauacccccgg

SEQ ID NO: 3121744 - RNA, 16 nt, Mycobacterium bovis subsp bovis AF2122/97
ccaccgauaccgucag

SEQ ID NO: 3121745 - RNA, 20 nt, Mycobacterium bovis subsp bovis AF2122/97
ccaccgauaccgucagcgcc

SEQ ID NO: 3121746 - RNA, 21 nt, Mycobacterium bovis subsp bovis AF2122/97
ccaccgauaccgucagcgccg

SEQ ID NO: 3121747 - RNA, 17 nt, Mycobacterium bovis subsp bovis AF2122/97
ccaccgauauggccggg

SEQ ID NO: 3121748 - RNA, 23 nt, Mycobacterium bovis subsp bovis AF2122/97
ccaccgauauggccggguccagc

SEQ ID NO: 3121749 - RNA, 17 nt, Mycobacterium bovis subsp bovis AF2122/97
ccaccgauucggcgacg

SEQ ID NO: 3121750 - RNA, 16 nt, Mycobacterium bovis subsp bovis AF2122/97
ccaccgcaagaaucag

SEQ ID NO: 3121751 - RNA, 13 nt, Mycobacterium bovis subsp bovis AF2122/97
ccaccgcaccugc

SEQ ID NO: 3121752 - RNA, 19 nt, Mycobacterium bovis subsp bovis AF2122/97
ccaccgcacgcuggcgggc

SEQ ID NO: 3121753 - RNA, 20 nt, Mycobacterium bovis subsp bovis AF2122/97
ccaccgcacggaugucgccc

SEQ ID NO: 3121754 - RNA, 17 nt, Mycobacterium bovis subsp bovis AF2122/97
ccaccgcagacgccguc

SEQ ID NO: 3121755 - RNA, 18 nt, Mycobacterium bovis subsp bovis AF2122/97
ccaccgcauaacgccagu

SEQ ID NO: 3121756 - RNA, 21 nt, Mycobacterium bovis subsp bovis AF2122/97
ccaccgcauaacgccaguccc

SEQ ID NO: 3121757 - RNA, 23 nt, Mycobacterium bovis subsp bovis AF2122/97
ccaccgcaucggugucuuccucc

SEQ ID NO: 3121758 - RNA, 18 nt, Mycobacterium bovis subsp bovis AF2122/97
ccaccgccaccacgguca

SEQ ID NO: 3121759 - RNA, 21 nt, Mycobacterium bovis subsp bovis AF2122/97
ccaccgcccacagcaacgaca

SEQ ID NO: 3121760 - RNA, 14 nt, Mycobacterium bovis subsp bovis AF2122/97
ccaccgcccgcacg

SEQ ID NO: 3121761 - RNA, 12 nt, Mycobacterium bovis subsp bovis AF2122/97
ccaccgccgaca

SEQ ID NO: 3121762 - RNA, 19 nt, Mycobacterium bovis subsp bovis AF2122/97
ccaccgccgacaggccggc

SEQ ID NO: 3121763 - RNA, 23 nt, Mycobacterium bovis subsp bovis AF2122/97
ccaccgccgacaggccggccacc

SEQ ID NO: 3121764 - RNA, 14 nt, Mycobacterium bovis subsp bovis AF2122/97
ccaccgccgacaug

SEQ ID NO: 3121765 - RNA, 14 nt, Mycobacterium bovis subsp bovis AF2122/97
ccaccgccgacccu

SEQ ID NO: 3121766 - RNA, 14 nt, Mycobacterium bovis subsp bovis AF2122/97
ccaccgccgacgcc

SEQ ID NO: 3121767 - RNA, 14 nt, Mycobacterium bovis subsp bovis AF2122/97
ccaccgccgagaug

SEQ ID NO: 3121768 - RNA, 23 nt, Mycobacterium bovis subsp bovis AF2122/97
ccaccgccgagaugcuggucggc

SEQ ID NO: 3121769 - RNA, 16 nt, Mycobacterium bovis subsp bovis AF2122/97
ccaccgccgccgccac

SEQ ID NO: 3121770 - RNA, 22 nt, Mycobacterium bovis subsp bovis AF2122/97
ccaccgccgccgccaccggcgc

SEQ ID NO: 3121771 - RNA, 21 nt, Mycobacterium bovis subsp bovis AF2122/97
ccaccgccgccgccgacgccg

SEQ ID NO: 3121772 - RNA, 13 nt, Mycobacterium bovis subsp bovis AF2122/97
ccaccgccgccgg

SEQ ID NO: 3121773 - RNA, 12 nt, Mycobacterium bovis subsp bovis AF2122/97
ccaccgccgccu

SEQ ID NO: 3121774 - RNA, 19 nt, Mycobacterium bovis subsp bovis AF2122/97
ccaccgccgccugcccggc

SEQ ID NO: 3121775 - RNA, 15 nt, Mycobacterium bovis subsp bovis AF2122/97
ccaccgccgcugccg

SEQ ID NO: 3121776 - RNA, 16 nt, Mycobacterium bovis subsp bovis AF2122/97
ccaccgccgcugccgg

SEQ ID NO: 3121777 - RNA, 12 nt, Mycobacterium bovis subsp bovis AF2122/97
ccaccgccggca

SEQ ID NO: 3121778 - RNA, 13 nt, Mycobacterium bovis subsp bovis AF2122/97
ccaccgccggcag

SEQ ID NO: 3121779 - RNA, 13 nt, Mycobacterium bovis subsp bovis AF2122/97
ccaccgccggccc

SEQ ID NO: 3121780 - RNA, 15 nt, Mycobacterium bovis subsp bovis AF2122/97
ccaccgccggcccgc

SEQ ID NO: 3121781 - RNA, 19 nt, Mycobacterium bovis subsp bovis AF2122/97
ccaccgccggugccgccau

SEQ ID NO: 3121782 - RNA, 23 nt, Mycobacterium bovis subsp bovis AF2122/97
ccaccgccggugccgccaucgcc

SEQ ID NO: 3121783 - RNA, 21 nt, Mycobacterium bovis subsp bovis AF2122/97
ccaccgccguugggccgcgcc

SEQ ID NO: 3121784 - RNA, 18 nt, Mycobacterium bovis subsp bovis AF2122/97
ccaccgccuggaucagcg

SEQ ID NO: 3121785 - RNA, 16 nt, Mycobacterium bovis subsp bovis AF2122/97
ccaccgccugggcggc

SEQ ID NO: 3121786 - RNA, 19 nt, Mycobacterium bovis subsp bovis AF2122/97
ccaccgccugggcggccag

SEQ ID NO: 3121787 - RNA, 17 nt, Mycobacterium bovis subsp bovis AF2122/97
ccaccgcgacaccccgg

SEQ ID NO: 3121788 - RNA, 13 nt, Mycobacterium bovis subsp bovis AF2122/97
ccaccgcgaccuc

SEQ ID NO: 3121789 - RNA, 16 nt, Mycobacterium bovis subsp bovis AF2122/97
ccaccgcgaccucgcg

SEQ ID NO: 3121790 - RNA, 15 nt, Mycobacterium bovis subsp bovis AF2122/97
ccaccgcgacuuugc

SEQ ID NO: 3121791 - RNA, 14 nt, Mycobacterium bovis subsp bovis AF2122/97
ccaccgcgaugccc

SEQ ID NO: 3121792 - RNA, 14 nt, Mycobacterium bovis subsp bovis AF2122/97
ccaccgcgcaaccc

SEQ ID NO: 3121793 - RNA, 14 nt, Mycobacterium bovis subsp bovis AF2122/97
ccaccgcgcaggug

SEQ ID NO: 3121794 - RNA, 15 nt, Mycobacterium bovis subsp bovis AF2122/97
ccaccgcgccgagca

SEQ ID NO: 3121795 - RNA, 17 nt, Mycobacterium bovis subsp bovis AF2122/97
ccaccgcgccgagcaga

SEQ ID NO: 3121796 - RNA, 18 nt, Mycobacterium bovis subsp bovis AF2122/97
ccaccgcgcggcgcagca

SEQ ID NO: 3121797 - RNA, 13 nt, Mycobacterium bovis subsp bovis AF2122/97
ccaccgcggccgc

SEQ ID NO: 3121798 - RNA, 20 nt, Mycobacterium bovis subsp bovis AF2122/97
ccaccgcggccgcggucgau

SEQ ID NO: 3121799 - RNA, 12 nt, Mycobacterium bovis subsp bovis AF2122/97
ccaccgcggcga

SEQ ID NO: 3121800 - RNA, 16 nt, Mycobacterium bovis subsp bovis AF2122/97
ccaccgcggcugcucc

SEQ ID NO: 3121801 - RNA, 24 nt, Mycobacterium bovis subsp bovis AF2122/97
ccaccgcggcugcuccgucgccga

SEQ ID NO: 3121802 - RNA, 19 nt, Mycobacterium bovis subsp bovis AF2122/97
ccaccgcggucaccgacgc

SEQ ID NO: 3121803 - RNA, 20 nt, Mycobacterium bovis subsp bovis AF2122/97
ccaccgcggucaccgacgca

SEQ ID NO: 3121804 - RNA, 14 nt, Mycobacterium bovis subsp bovis AF2122/97
ccaccgcggucagc

SEQ ID NO: 3121805 - RNA, 21 nt, Mycobacterium bovis subsp bovis AF2122/97
ccaccgcggucagcucggcag

SEQ ID NO: 3121806 - RNA, 17 nt, Mycobacterium bovis subsp bovis AF2122/97
ccaccgcgucgggccgc

SEQ ID NO: 3121807 - RNA, 17 nt, Mycobacterium bovis subsp bovis AF2122/97
ccaccgcguuggccaca

SEQ ID NO: 3121808 - RNA, 18 nt, Mycobacterium bovis subsp bovis AF2122/97
ccaccgcguuggccacac

SEQ ID NO: 3121809 - RNA, 20 nt, Mycobacterium bovis subsp bovis AF2122/97
ccaccgcucgucguccggcc

SEQ ID NO: 3121810 - RNA, 21 nt, Mycobacterium bovis subsp bovis AF2122/97
ccaccgcucgucguccggcca

SEQ ID NO: 3121811 - RNA, 19 nt, Mycobacterium bovis subsp bovis AF2122/97
ccaccgcugccggcacgca

SEQ ID NO: 3121812 - RNA, 18 nt, Mycobacterium bovis subsp bovis AF2122/97
ccaccgcugccggcagcg

SEQ ID NO: 3121813 - RNA, 21 nt, Mycobacterium bovis subsp bovis AF2122/97
ccaccgcugccggcagcgucc

SEQ ID NO: 3121814 - RNA, 12 nt, Mycobacterium bovis subsp bovis AF2122/97
ccaccgcugcga

SEQ ID NO: 3121815 - RNA, 13 nt, Mycobacterium bovis subsp bovis AF2122/97
ccaccgcuggauc

SEQ ID NO: 3121816 - RNA, 16 nt, Mycobacterium bovis subsp bovis AF2122/97
ccaccgcuggcccggc

SEQ ID NO: 3121817 - RNA, 18 nt, Mycobacterium bovis subsp bovis AF2122/97
ccaccgcuggcccggcgc

SEQ ID NO: 3121818 - RNA, 13 nt, Mycobacterium bovis subsp bovis AF2122/97
ccaccgcuuccag

SEQ ID NO: 3121819 - RNA, 16 nt, Mycobacterium bovis subsp bovis AF2122/97
ccaccgcuugaccccu

SEQ ID NO: 3121820 - RNA, 22 nt, Mycobacterium bovis subsp bovis AF2122/97
ccaccgcuugaccccuggccgc

SEQ ID NO: 3121821 - RNA, 18 nt, Mycobacterium bovis subsp bovis AF2122/97
ccaccggaauacgcgccg

SEQ ID NO: 3121822 - RNA, 19 nt, Mycobacterium bovis subsp bovis AF2122/97
ccaccggaauacgcgccgc

SEQ ID NO: 3121823 - RNA, 22 nt, Mycobacterium bovis subsp bovis AF2122/97
ccaccggaauacgcgccgccgg

SEQ ID NO: 3121824 - RNA, 19 nt, Mycobacterium bovis subsp bovis AF2122/97
ccaccggaauccuggccgc

SEQ ID NO: 3121825 - RNA, 20 nt, Mycobacterium bovis subsp bovis AF2122/97
ccaccggaauccuggccgcc

SEQ ID NO: 3121826 - RNA, 15 nt, Mycobacterium bovis subsp bovis AF2122/97
ccaccggaccaccgc

SEQ ID NO: 3121827 - RNA, 17 nt, Mycobacterium bovis subsp bovis AF2122/97
ccaccggaccaccgccg

SEQ ID NO: 3121828 - RNA, 18 nt, Mycobacterium bovis subsp bovis AF2122/97
ccaccggaccaccgccga

SEQ ID NO: 3121829 - RNA, 16 nt, Mycobacterium bovis subsp bovis AF2122/97
ccaccggaccgaccac

SEQ ID NO: 3121830 - RNA, 15 nt, Mycobacterium bovis subsp bovis AF2122/97
ccaccggaucgucga

SEQ ID NO: 3121831 - RNA, 17 nt, Mycobacterium bovis subsp bovis AF2122/97
ccaccggcaacaucagc

SEQ ID NO: 3121832 - RNA, 12 nt, Mycobacterium bovis subsp bovis AF2122/97
ccaccggcaccc

SEQ ID NO: 3121833 - RNA, 21 nt, Mycobacterium bovis subsp bovis AF2122/97
ccaccggcacccccgucgcca

SEQ ID NO: 3121834 - RNA, 20 nt, Mycobacterium bovis subsp bovis AF2122/97
ccaccggcacccgcuggcgg

SEQ ID NO: 3121835 - RNA, 20 nt, Mycobacterium bovis subsp bovis AF2122/97
ccaccggcaccgccugcgcc

SEQ ID NO: 3121836 - RNA, 14 nt, Mycobacterium bovis subsp bovis AF2122/97
ccaccggcaccggc

SEQ ID NO: 3121837 - RNA, 16 nt, Mycobacterium bovis subsp bovis AF2122/97
ccaccggcaccggccg

SEQ ID NO: 3121838 - RNA, 17 nt, Mycobacterium bovis subsp bovis AF2122/97
ccaccggcaccggccgu

SEQ ID NO: 3121839 - RNA, 22 nt, Mycobacterium bovis subsp bovis AF2122/97
ccaccggcaccggccgugccgc

SEQ ID NO: 3121840 - RNA, 19 nt, Mycobacterium bovis subsp bovis AF2122/97
ccaccggcagaugagucaa

SEQ ID NO: 3121841 - RNA, 12 nt, Mycobacterium bovis subsp bovis AF2122/97
ccaccggccacc

SEQ ID NO: 3121842 - RNA, 13 nt, Mycobacterium bovis subsp bovis AF2122/97
ccaccggccacca

SEQ ID NO: 3121843 - RNA, 13 nt, Mycobacterium bovis subsp bovis AF2122/97
ccaccggccagug

SEQ ID NO: 3121844 - RNA, 13 nt, Mycobacterium bovis subsp bovis AF2122/97
ccaccggcccucg

SEQ ID NO: 3121845 - RNA, 13 nt, Mycobacterium bovis subsp bovis AF2122/97
ccaccggccgcgc

SEQ ID NO: 3121846 - RNA, 15 nt, Mycobacterium bovis subsp bovis AF2122/97
ccaccggccgcggcg

SEQ ID NO: 3121847 - RNA, 14 nt, Mycobacterium bovis subsp bovis AF2122/97
ccaccggccggcgc

SEQ ID NO: 3121848 - RNA, 22 nt, Mycobacterium bovis subsp bovis AF2122/97
ccaccggccgucccgcgagcag

SEQ ID NO: 3121849 - RNA, 13 nt, Mycobacterium bovis subsp bovis AF2122/97
ccaccggcgccgc

SEQ ID NO: 3121850 - RNA, 17 nt, Mycobacterium bovis subsp bovis AF2122/97
ccaccggcgccgcccgc

SEQ ID NO: 3121851 - RNA, 20 nt, Mycobacterium bovis subsp bovis AF2122/97
ccaccggcgccgcccgcgcc

SEQ ID NO: 3121852 - RNA, 15 nt, Mycobacterium bovis subsp bovis AF2122/97
ccaccggcgccgccg

SEQ ID NO: 3121853 - RNA, 19 nt, Mycobacterium bovis subsp bovis AF2122/97
ccaccggcgccgccggcac

SEQ ID NO: 3121854 - RNA, 21 nt, Mycobacterium bovis subsp bovis AF2122/97
ccaccggcgccggaguugaag

SEQ ID NO: 3121855 - RNA, 17 nt, Mycobacterium bovis subsp bovis AF2122/97
ccaccggcgccguguca

SEQ ID NO: 3121856 - RNA, 16 nt, Mycobacterium bovis subsp bovis AF2122/97
ccaccggcggugccgg

SEQ ID NO: 3121857 - RNA, 15 nt, Mycobacterium bovis subsp bovis AF2122/97
ccaccggcguccagu

SEQ ID NO: 3121858 - RNA, 16 nt, Mycobacterium bovis subsp bovis AF2122/97
ccaccggcgucgacgu

SEQ ID NO: 3121859 - RNA, 19 nt, Mycobacterium bovis subsp bovis AF2122/97
ccaccggcgucgacgucgg

SEQ ID NO: 3121860 - RNA, 20 nt, Mycobacterium bovis subsp bovis AF2122/97
ccaccggcgucugcccgccc

SEQ ID NO: 3121861 - RNA, 23 nt, Mycobacterium bovis subsp bovis AF2122/97
ccaccggcgucugcccgcccagc

SEQ ID NO: 3121862 - RNA, 16 nt, Mycobacterium bovis subsp bovis AF2122/97
ccaccggcuaugcugg

SEQ ID NO: 3121863 - RNA, 18 nt, Mycobacterium bovis subsp bovis AF2122/97
ccaccggcuaugcuggcg

SEQ ID NO: 3121864 - RNA, 20 nt, Mycobacterium bovis subsp bovis AF2122/97
ccaccggcugauucgagcca

SEQ ID NO: 3121865 - RNA, 12 nt, Mycobacterium bovis subsp bovis AF2122/97
ccaccggcuggu

SEQ ID NO: 3121866 - RNA, 21 nt, Mycobacterium bovis subsp bovis AF2122/97
ccaccggcuggugccuuacca

SEQ ID NO: 3121867 - RNA, 21 nt, Mycobacterium bovis subsp bovis AF2122/97
ccaccgggauagccgcgacca

SEQ ID NO: 3121868 - RNA, 15 nt, Mycobacterium bovis subsp bovis AF2122/97
ccaccgggcccgccg

SEQ ID NO: 3121869 - RNA, 20 nt, Mycobacterium bovis subsp bovis AF2122/97
ccaccgggcccgccggcccc

SEQ ID NO: 3121870 - RNA, 21 nt, Mycobacterium bovis subsp bovis AF2122/97
ccaccgggcccgccggccccg

SEQ ID NO: 3121871 - RNA, 23 nt, Mycobacterium bovis subsp bovis AF2122/97
ccaccgggcgcugcuugaggucc

SEQ ID NO: 3121872 - RNA, 20 nt, Mycobacterium bovis subsp bovis AF2122/97
ccaccgggcgucgucgguga

SEQ ID NO: 3121873 - RNA, 21 nt, Mycobacterium bovis subsp bovis AF2122/97
ccaccggggaagaucucggcc

SEQ ID NO: 3121874 - RNA, 23 nt, Mycobacterium bovis subsp bovis AF2122/97
ccaccggggaagaucucggccag

SEQ ID NO: 3121875 - RNA, 15 nt, Mycobacterium bovis subsp bovis AF2122/97
ccaccgguaccgccg

SEQ ID NO: 3121876 - RNA, 16 nt, Mycobacterium bovis subsp bovis AF2122/97
ccaccgguaccggcga

SEQ ID NO: 3121877 - RNA, 13 nt, Mycobacterium bovis subsp bovis AF2122/97
ccaccgguccagc

SEQ ID NO: 3121878 - RNA, 14 nt, Mycobacterium bovis subsp bovis AF2122/97
ccaccggucgccgc

SEQ ID NO: 3121879 - RNA, 21 nt, Mycobacterium bovis subsp bovis AF2122/97
ccaccggugagcgcagcuuga

SEQ ID NO: 3121880 - RNA, 15 nt, Mycobacterium bovis subsp bovis AF2122/97
ccaccggugccgccc

SEQ ID NO: 3121881 - RNA, 16 nt, Mycobacterium bovis subsp bovis AF2122/97
ccaccggugccgccgu

SEQ ID NO: 3121882 - RNA, 21 nt, Mycobacterium bovis subsp bovis AF2122/97
ccaccggugccgccguugcca

SEQ ID NO: 3121883 - RNA, 14 nt, Mycobacterium bovis subsp bovis AF2122/97
ccaccggugccggc

SEQ ID NO: 3121884 - RNA, 15 nt, Mycobacterium bovis subsp bovis AF2122/97
ccaccggugccggcg

SEQ ID NO: 3121885 - RNA, 16 nt, Mycobacterium bovis subsp bovis AF2122/97
ccaccggugccggcga

SEQ ID NO: 3121886 - RNA, 18 nt, Mycobacterium bovis subsp bovis AF2122/97
ccaccggugccggcgacg

SEQ ID NO: 3121887 - RNA, 20 nt, Mycobacterium bovis subsp bovis AF2122/97
ccaccguaaacagcgcgccg

SEQ ID NO: 3121888 - RNA, 17 nt, Mycobacterium bovis subsp bovis AF2122/97
ccaccguagccgagggu

SEQ ID NO: 3121889 - RNA, 15 nt, Mycobacterium bovis subsp bovis AF2122/97
ccaccgucacccccg

SEQ ID NO: 3121890 - RNA, 16 nt, Mycobacterium bovis subsp bovis AF2122/97
ccaccgucaccgccgg

SEQ ID NO: 3121891 - RNA, 18 nt, Mycobacterium bovis subsp bovis AF2122/97
ccaccgucacggucgcgg

SEQ ID NO: 3121892 - RNA, 20 nt, Mycobacterium bovis subsp bovis AF2122/97
ccaccgucaugccgacgaca

SEQ ID NO: 3121893 - RNA, 21 nt, Mycobacterium bovis subsp bovis AF2122/97
ccaccgucauggcgggugcgg

SEQ ID NO: 3121894 - RNA, 17 nt, Mycobacterium bovis subsp bovis AF2122/97
ccaccgucccugugucg

SEQ ID NO: 3121895 - RNA, 22 nt, Mycobacterium bovis subsp bovis AF2122/97
ccaccgucgaaccaugguugau

SEQ ID NO: 3121896 - RNA, 13 nt, Mycobacterium bovis subsp bovis AF2122/97
ccaccgucgccgc

SEQ ID NO: 3121897 - RNA, 15 nt, Mycobacterium bovis subsp bovis AF2122/97
ccaccgucgccgccg

SEQ ID NO: 3121898 - RNA, 16 nt, Mycobacterium bovis subsp bovis AF2122/97
ccaccgucgccgccgg

SEQ ID NO: 3121899 - RNA, 19 nt, Mycobacterium bovis subsp bovis AF2122/97
ccaccgucgccgccggucc

SEQ ID NO: 3121900 - RNA, 14 nt, Mycobacterium bovis subsp bovis AF2122/97
ccaccgucgccgua

SEQ ID NO: 3121901 - RNA, 16 nt, Mycobacterium bovis subsp bovis AF2122/97
ccaccgucgccguaca

SEQ ID NO: 3121902 - RNA, 17 nt, Mycobacterium bovis subsp bovis AF2122/97
ccaccgucgcggcggca

SEQ ID NO: 3121903 - RNA, 16 nt, Mycobacterium bovis subsp bovis AF2122/97
ccaccgucuccggcgc

SEQ ID NO: 3121904 - RNA, 17 nt, Mycobacterium bovis subsp bovis AF2122/97
ccaccgucuccggcgcc

SEQ ID NO: 3121905 - RNA, 19 nt, Mycobacterium bovis subsp bovis AF2122/97
ccaccgucuccggcgccac

SEQ ID NO: 3121906 - RNA, 23 nt, Mycobacterium bovis subsp bovis AF2122/97
ccaccgucuccggcgccaccgcc

SEQ ID NO: 3121907 - RNA, 17 nt, Mycobacterium bovis subsp bovis AF2122/97
ccaccgucucgccgcgc

SEQ ID NO: 3121908 - RNA, 18 nt, Mycobacterium bovis subsp bovis AF2122/97
ccaccgucucgccgcgca

SEQ ID NO: 3121909 - RNA, 22 nt, Mycobacterium bovis subsp bovis AF2122/97
ccaccgugaagcccuggccagc

SEQ ID NO: 3121910 - RNA, 12 nt, Mycobacterium bovis subsp bovis AF2122/97
ccaccgugccgg

SEQ ID NO: 3121911 - RNA, 16 nt, Mycobacterium bovis subsp bovis AF2122/97
ccaccgugccgggcga

SEQ ID NO: 3121912 - RNA, 14 nt, Mycobacterium bovis subsp bovis AF2122/97
ccaccguggcgccc

SEQ ID NO: 3121913 - RNA, 16 nt, Mycobacterium bovis subsp bovis AF2122/97
ccaccguggcgcccgc

SEQ ID NO: 3121914 - RNA, 22 nt, Mycobacterium bovis subsp bovis AF2122/97
ccaccgugguggacgaccgcgc

SEQ ID NO: 3121915 - RNA, 17 nt, Mycobacterium bovis subsp bovis AF2122/97
ccaccguuagccagguc

SEQ ID NO: 3121916 - RNA, 18 nt, Mycobacterium bovis subsp bovis AF2122/97
ccaccguuagccaggucg

SEQ ID NO: 3121917 - RNA, 24 nt, Mycobacterium bovis subsp bovis AF2122/97
ccaccguugccgaaccacgcgccc

SEQ ID NO: 3121918 - RNA, 15 nt, Mycobacterium bovis subsp bovis AF2122/97
ccaccguugccgccg

SEQ ID NO: 3121919 - RNA, 20 nt, Mycobacterium bovis subsp bovis AF2122/97
ccaccguugggccgacuggg

SEQ ID NO: 3121920 - RNA, 19 nt, Mycobacterium bovis subsp bovis AF2122/97
ccaccguuugagcggccac

SEQ ID NO: 3121921 - RNA, 20 nt, Mycobacterium bovis subsp bovis AF2122/97
ccaccguuugagcggccacc

SEQ ID NO: 3121922 - RNA, 23 nt, Mycobacterium bovis subsp bovis AF2122/97
ccaccguuugagcggccaccgua

SEQ ID NO: 3121923 - RNA, 19 nt, Mycobacterium bovis subsp bovis AF2122/97
ccaccguuugcgcaccggu

SEQ ID NO: 3121924 - RNA, 20 nt, Mycobacterium bovis subsp bovis AF2122/97
ccaccguuugcgcaccgguc

SEQ ID NO: 3121925 - RNA, 21 nt, Mycobacterium bovis subsp bovis AF2122/97
ccaccucaccgaucucgacca

SEQ ID NO: 3121926 - RNA, 17 nt, Mycobacterium bovis subsp bovis AF2122/97
ccaccucccgcagccgg

SEQ ID NO: 3121927 - RNA, 17 nt, Mycobacterium bovis subsp bovis AF2122/97
ccaccuccgaggccgcc

SEQ ID NO: 3121928 - RNA, 20 nt, Mycobacterium bovis subsp bovis AF2122/97
ccaccucgacgcaccuaugg

SEQ ID NO: 3121929 - RNA, 15 nt, Mycobacterium bovis subsp bovis AF2122/97
ccaccucgacgguga

SEQ ID NO: 3121930 - RNA, 18 nt, Mycobacterium bovis subsp bovis AF2122/97
ccaccucgaucgcgccgu

SEQ ID NO: 3121931 - RNA, 18 nt, Mycobacterium bovis subsp bovis AF2122/97
ccaccucggugaccaggc

SEQ ID NO: 3121932 - RNA, 21 nt, Mycobacterium bovis subsp bovis AF2122/97
ccaccucggugaccaggccgg

SEQ ID NO: 3121933 - RNA, 22 nt, Mycobacterium bovis subsp bovis AF2122/97
ccaccucggugaccaggccggc

SEQ ID NO: 3121934 - RNA, 16 nt, Mycobacterium bovis subsp bovis AF2122/97
ccaccucuaccggugg

SEQ ID NO: 3121935 - RNA, 14 nt, Mycobacterium bovis subsp bovis AF2122/97
ccaccugcuccgcu

SEQ ID NO: 3121936 - RNA, 18 nt, Mycobacterium bovis subsp bovis AF2122/97
ccaccugcuggccguaac

SEQ ID NO: 3121937 - RNA, 12 nt, Mycobacterium bovis subsp bovis AF2122/97
ccaccugggcgg

SEQ ID NO: 3121938 - RNA, 15 nt, Mycobacterium bovis subsp bovis AF2122/97
ccaccuggggccgca

SEQ ID NO: 3121939 - RNA, 17 nt, Mycobacterium bovis subsp bovis AF2122/97
ccaccuguucacccacu

SEQ ID NO: 3121940 - RNA, 23 nt, Mycobacterium bovis subsp bovis AF2122/97
ccaccuguucacccacuccgccg

SEQ ID NO: 3121941 - RNA, 19 nt, Mycobacterium bovis subsp bovis AF2122/97
ccaccuguuggcaugccgc

SEQ ID NO: 3121942 - RNA, 23 nt, Mycobacterium bovis subsp bovis AF2122/97
ccaccuguuggcaugccgcccgc

SEQ ID NO: 3121943 - RNA, 19 nt, Mycobacterium bovis subsp bovis AF2122/97
ccaccuucggguagccccg

SEQ ID NO: 3121944 - RNA, 22 nt, Mycobacterium bovis subsp bovis AF2122/97
ccaccuucugguccagcaccgg

SEQ ID NO: 3121945 - RNA, 14 nt, Mycobacterium bovis subsp bovis AF2122/97
ccaccuugccgaac

SEQ ID NO: 3121946 - RNA, 14 nt, Mycobacterium bovis subsp bovis AF2122/97
ccaccuuggccaga

SEQ ID NO: 3121947 - RNA, 20 nt, Mycobacterium bovis subsp bovis AF2122/97
ccaccuuggccagacccacc

SEQ ID NO: 3121948 - RNA, 20 nt, Mycobacterium bovis subsp bovis AF2122/97
ccaccuuggcugggcccgcc

SEQ ID NO: 3121949 - RNA, 20 nt, Mycobacterium bovis subsp bovis AF2122/97
ccaccuuggucuucgccguc

SEQ ID NO: 3121950 - RNA, 22 nt, Mycobacterium bovis subsp bovis AF2122/97
ccaccuuggucuucgccgucgg

SEQ ID NO: 3121951 - RNA, 17 nt, Mycobacterium bovis subsp bovis AF2122/97
ccaccuugugcaggccc

SEQ ID NO: 3121952 - RNA, 17 nt, Mycobacterium bovis subsp bovis AF2122/97
ccacgaacacguucggg

SEQ ID NO: 3121953 - RNA, 17 nt, Mycobacterium bovis subsp bovis AF2122/97
ccacgaacccucagccg

SEQ ID NO: 3121954 - RNA, 21 nt, Mycobacterium bovis subsp bovis AF2122/97
ccacgaacccucagccgcgcc

SEQ ID NO: 3121955 - RNA, 19 nt, Mycobacterium bovis subsp bovis AF2122/97
ccacgaaccgugcugggca

SEQ ID NO: 3121956 - RNA, 15 nt, Mycobacterium bovis subsp bovis AF2122/97
ccacgaacgcgcgca

SEQ ID NO: 3121957 - RNA, 21 nt, Mycobacterium bovis subsp bovis AF2122/97
ccacgaacgcuuccagcgugu

SEQ ID NO: 3121958 - RNA, 22 nt, Mycobacterium bovis subsp bovis AF2122/97
ccacgaacugaucgaccgccuc

SEQ ID NO: 3121959 - RNA, 17 nt, Mycobacterium bovis subsp bovis AF2122/97
ccacgaaucgcccaucg

SEQ ID NO: 3121960 - RNA, 23 nt, Mycobacterium bovis subsp bovis AF2122/97
ccacgaaugaucgucccgcggcg

SEQ ID NO: 3121961 - RNA, 14 nt, Mycobacterium bovis subsp bovis AF2122/97
ccacgaaugcaaga

SEQ ID NO: 3121962 - RNA, 16 nt, Mycobacterium bovis subsp bovis AF2122/97
ccacgaaugcaagacc

SEQ ID NO: 3121963 - RNA, 14 nt, Mycobacterium bovis subsp bovis AF2122/97
ccacgacagcagag

SEQ ID NO: 3121964 - RNA, 15 nt, Mycobacterium bovis subsp bovis AF2122/97
ccacgacaggucgcc

SEQ ID NO: 3121965 - RNA, 13 nt, Mycobacterium bovis subsp bovis AF2122/97
ccacgaccgccga

SEQ ID NO: 3121966 - RNA, 16 nt, Mycobacterium bovis subsp bovis AF2122/97
ccacgaccgccgauac

SEQ ID NO: 3121967 - RNA, 20 nt, Mycobacterium bovis subsp bovis AF2122/97
ccacgaccucgggaucggcg

SEQ ID NO: 3121968 - RNA, 18 nt, Mycobacterium bovis subsp bovis AF2122/97
ccacgacgaacaccagcg

SEQ ID NO: 3121969 - RNA, 21 nt, Mycobacterium bovis subsp bovis AF2122/97
ccacgacgaacaccagcgcgc

SEQ ID NO: 3121970 - RNA, 16 nt, Mycobacterium bovis subsp bovis AF2122/97
ccacgacgcccaccgu

SEQ ID NO: 3121971 - RNA, 13 nt, Mycobacterium bovis subsp bovis AF2122/97
ccacgacgucguc

SEQ ID NO: 3121972 - RNA, 19 nt, Mycobacterium bovis subsp bovis AF2122/97
ccacgacguugcgaggccg

SEQ ID NO: 3121973 - RNA, 15 nt, Mycobacterium bovis subsp bovis AF2122/97
ccacgaggcuugcgg

SEQ ID NO: 3121974 - RNA, 14 nt, Mycobacterium bovis subsp bovis AF2122/97
ccacgaguccgcgg

SEQ ID NO: 3121975 - RNA, 15 nt, Mycobacterium bovis subsp bovis AF2122/97
ccacgaguuggccaa

SEQ ID NO: 3121976 - RNA, 16 nt, Mycobacterium bovis subsp bovis AF2122/97
ccacgaguuggccaag

SEQ ID NO: 3121977 - RNA, 22 nt, Mycobacterium bovis subsp bovis AF2122/97
ccacgaucaacucgugcgggca

SEQ ID NO: 3121978 - RNA, 15 nt, Mycobacterium bovis subsp bovis AF2122/97
ccacgaucagcagcg

SEQ ID NO: 3121979 - RNA, 14 nt, Mycobacterium bovis subsp bovis AF2122/97
ccacgauccgcggu

SEQ ID NO: 3121980 - RNA, 13 nt, Mycobacterium bovis subsp bovis AF2122/97
ccacgauccuugg

SEQ ID NO: 3121981 - RNA, 16 nt, Mycobacterium bovis subsp bovis AF2122/97
ccacgauccuuggcgu

SEQ ID NO: 3121982 - RNA, 13 nt, Mycobacterium bovis subsp bovis AF2122/97
ccacgaucgcagu

SEQ ID NO: 3121983 - RNA, 14 nt, Mycobacterium bovis subsp bovis AF2122/97
ccacgaucgcgucg

SEQ ID NO: 3121984 - RNA, 16 nt, Mycobacterium bovis subsp bovis AF2122/97
ccacgaucgcgucgga

SEQ ID NO: 3121985 - RNA, 16 nt, Mycobacterium bovis subsp bovis AF2122/97
ccacgaucggcccagc

SEQ ID NO: 3121986 - RNA, 19 nt, Mycobacterium bovis subsp bovis AF2122/97
ccacgaucggcccagcccu

SEQ ID NO: 3121987 - RNA, 15 nt, Mycobacterium bovis subsp bovis AF2122/97
ccacgaucggcucac

SEQ ID NO: 3121988 - RNA, 20 nt, Mycobacterium bovis subsp bovis AF2122/97
ccacgaucuguggaagcccg

SEQ ID NO: 3121989 - RNA, 23 nt, Mycobacterium bovis subsp bovis AF2122/97
ccacgaugaccaugaugaccggc

SEQ ID NO: 3121990 - RNA, 18 nt, Mycobacterium bovis subsp bovis AF2122/97
ccacgaugaucccaagcg

SEQ ID NO: 3121991 - RNA, 22 nt, Mycobacterium bovis subsp bovis AF2122/97
ccacgaugaucuugccgcggcg

SEQ ID NO: 3121992 - RNA, 13 nt, Mycobacterium bovis subsp bovis AF2122/97
ccacgaugccggc

SEQ ID NO: 3121993 - RNA, 20 nt, Mycobacterium bovis subsp bovis AF2122/97
ccacgaugcgcacaccgacc

SEQ ID NO: 3121994 - RNA, 17 nt, Mycobacterium bovis subsp bovis AF2122/97
ccacgauggcggccacc

SEQ ID NO: 3121995 - RNA, 20 nt, Mycobacterium bovis subsp bovis AF2122/97
ccacgauggcggccaccguc

SEQ ID NO: 3121996 - RNA, 20 nt, Mycobacterium bovis subsp bovis AF2122/97
ccacgcaaaguucgucacca

SEQ ID NO: 3121997 - RNA, 19 nt, Mycobacterium bovis subsp bovis AF2122/97
ccacgcacaauacggucag

SEQ ID NO: 3121998 - RNA, 22 nt, Mycobacterium bovis subsp bovis AF2122/97
ccacgcacaauacggucagcag

SEQ ID NO: 3121999 - RNA, 13 nt, Mycobacterium bovis subsp bovis AF2122/97
ccacgcacccggc

SEQ ID NO: 3122000 - RNA, 14 nt, Mycobacterium bovis subsp bovis AF2122/97
ccacgcacccggca

SEQ ID NO: 3122001 - RNA, 15 nt, Mycobacterium bovis subsp bovis AF2122/97
ccacgcaccgccccg

SEQ ID NO: 3122002 - RNA, 18 nt, Mycobacterium bovis subsp bovis AF2122/97
ccacgcaccgggugcagg

SEQ ID NO: 3122003 - RNA, 21 nt, Mycobacterium bovis subsp bovis AF2122/97
ccacgcaccgggugcagguga

SEQ ID NO: 3122004 - RNA, 17 nt, Mycobacterium bovis subsp bovis AF2122/97
ccacgcacucacuaccg

SEQ ID NO: 3122005 - RNA, 22 nt, Mycobacterium bovis subsp bovis AF2122/97
ccacgcacucgucgggguugau

SEQ ID NO: 3122006 - RNA, 16 nt, Mycobacterium bovis subsp bovis AF2122/97
ccacgcagaaguugau

SEQ ID NO: 3122007 - RNA, 14 nt, Mycobacterium bovis subsp bovis AF2122/97
ccacgcagcacggc

SEQ ID NO: 3122008 - RNA, 15 nt, Mycobacterium bovis subsp bovis AF2122/97
ccacgcagcacggca

SEQ ID NO: 3122009 - RNA, 21 nt, Mycobacterium bovis subsp bovis AF2122/97
ccacgcaugcgcgcgccggug

SEQ ID NO: 3122010 - RNA, 22 nt, Mycobacterium bovis subsp bovis AF2122/97
ccacgcaugggccaggucagcc

SEQ ID NO: 3122011 - RNA, 13 nt, Mycobacterium bovis subsp bovis AF2122/97
ccacgccaccgcg

SEQ ID NO: 3122012 - RNA, 22 nt, Mycobacterium bovis subsp bovis AF2122/97
ccacgccacguccaacucggcc

SEQ ID NO: 3122013 - RNA, 15 nt, Mycobacterium bovis subsp bovis AF2122/97
ccacgccagcccguc

SEQ ID NO: 3122014 - RNA, 18 nt, Mycobacterium bovis subsp bovis AF2122/97
ccacgccagcccguccgg

SEQ ID NO: 3122015 - RNA, 13 nt, Mycobacterium bovis subsp bovis AF2122/97
ccacgccagcucg

SEQ ID NO: 3122016 - RNA, 17 nt, Mycobacterium bovis subsp bovis AF2122/97
ccacgccagcucgccgg

SEQ ID NO: 3122017 - RNA, 18 nt, Mycobacterium bovis subsp bovis AF2122/97
ccacgccagcucgccggc

SEQ ID NO: 3122018 - RNA, 21 nt, Mycobacterium bovis subsp bovis AF2122/97
ccacgccagcucgccggccgg

SEQ ID NO: 3122019 - RNA, 12 nt, Mycobacterium bovis subsp bovis AF2122/97
ccacgccaggag

SEQ ID NO: 3122020 - RNA, 20 nt, Mycobacterium bovis subsp bovis AF2122/97
ccacgccaggagcgugucgg

SEQ ID NO: 3122021 - RNA, 17 nt, Mycobacterium bovis subsp bovis AF2122/97
ccacgcccaauguccag

SEQ ID NO: 3122022 - RNA, 19 nt, Mycobacterium bovis subsp bovis AF2122/97
ccacgcccacaggggcagc

SEQ ID NO: 3122023 - RNA, 23 nt, Mycobacterium bovis subsp bovis AF2122/97
ccacgcccacaggggcagcgcgg

SEQ ID NO: 3122024 - RNA, 21 nt, Mycobacterium bovis subsp bovis AF2122/97
ccacgcccagcgcccgcgcgg

SEQ ID NO: 3122025 - RNA, 13 nt, Mycobacterium bovis subsp bovis AF2122/97
ccacgcccgacga

SEQ ID NO: 3122026 - RNA, 17 nt, Mycobacterium bovis subsp bovis AF2122/97
ccacgcccgacgccagc

SEQ ID NO: 3122027 - RNA, 15 nt, Mycobacterium bovis subsp bovis AF2122/97
ccacgcccggccccg

SEQ ID NO: 3122028 - RNA, 23 nt, Mycobacterium bovis subsp bovis AF2122/97
ccacgcccggccccgcggccagc

SEQ ID NO: 3122029 - RNA, 21 nt, Mycobacterium bovis subsp bovis AF2122/97
ccacgccgaccaucucaccgg

SEQ ID NO: 3122030 - RNA, 13 nt, Mycobacterium bovis subsp bovis AF2122/97
ccacgccgacgaa

SEQ ID NO: 3122031 - RNA, 21 nt, Mycobacterium bovis subsp bovis AF2122/97
ccacgccgacuaguccgaggg

SEQ ID NO: 3122032 - RNA, 15 nt, Mycobacterium bovis subsp bovis AF2122/97
ccacgccgcaucggc

SEQ ID NO: 3122033 - RNA, 12 nt, Mycobacterium bovis subsp bovis AF2122/97
ccacgccgccgg

SEQ ID NO: 3122034 - RNA, 18 nt, Mycobacterium bovis subsp bovis AF2122/97
ccacgccgccguugccga

SEQ ID NO: 3122035 - RNA, 23 nt, Mycobacterium bovis subsp bovis AF2122/97
ccacgccggcaucgucgacgccc

SEQ ID NO: 3122036 - RNA, 12 nt, Mycobacterium bovis subsp bovis AF2122/97
ccacgccgggca

SEQ ID NO: 3122037 - RNA, 19 nt, Mycobacterium bovis subsp bovis AF2122/97
ccacgccggggcaacgaau

SEQ ID NO: 3122038 - RNA, 21 nt, Mycobacterium bovis subsp bovis AF2122/97
ccacgccguagcgcagcgccu

SEQ ID NO: 3122039 - RNA, 22 nt, Mycobacterium bovis subsp bovis AF2122/97
ccacgccguagcgcagcgccuc

SEQ ID NO: 3122040 - RNA, 12 nt, Mycobacterium bovis subsp bovis AF2122/97
ccacgccgugcu

SEQ ID NO: 3122041 - RNA, 20 nt, Mycobacterium bovis subsp bovis AF2122/97
ccacgccguggagaucuccu

SEQ ID NO: 3122042 - RNA, 23 nt, Mycobacterium bovis subsp bovis AF2122/97
ccacgccguggagaucuccucga

SEQ ID NO: 3122043 - RNA, 19 nt, Mycobacterium bovis subsp bovis AF2122/97
ccacgcgcacucgacgcca

SEQ ID NO: 3122044 - RNA, 22 nt, Mycobacterium bovis subsp bovis AF2122/97
ccacgcgcagaaagucgcgcgc

SEQ ID NO: 3122045 - RNA, 13 nt, Mycobacterium bovis subsp bovis AF2122/97
ccacgcgcccgca

SEQ ID NO: 3122046 - RNA, 14 nt, Mycobacterium bovis subsp bovis AF2122/97
ccacgcgcccgcac

SEQ ID NO: 3122047 - RNA, 16 nt, Mycobacterium bovis subsp bovis AF2122/97
ccacgcgcccgcacca

SEQ ID NO: 3122048 - RNA, 17 nt, Mycobacterium bovis subsp bovis AF2122/97
ccacgcgcccgcaccac

SEQ ID NO: 3122049 - RNA, 15 nt, Mycobacterium bovis subsp bovis AF2122/97
ccacgcggaccucga

SEQ ID NO: 3122050 - RNA, 23 nt, Mycobacterium bovis subsp bovis AF2122/97
ccacgcggauaucuugcgcaugu

SEQ ID NO: 3122051 - RNA, 20 nt, Mycobacterium bovis subsp bovis AF2122/97
ccacgcgucuucggucgcgg

SEQ ID NO: 3122052 - RNA, 19 nt, Mycobacterium bovis subsp bovis AF2122/97
ccacgcucgggcgcgcucg

SEQ ID NO: 3122053 - RNA, 19 nt, Mycobacterium bovis subsp bovis AF2122/97
ccacgcucggugcugcgcc

SEQ ID NO: 3122054 - RNA, 22 nt, Mycobacterium bovis subsp bovis AF2122/97
ccacgcugcccacgggccggcc

SEQ ID NO: 3122055 - RNA, 15 nt, Mycobacterium bovis subsp bovis AF2122/97
ccacgcugccgcagu

SEQ ID NO: 3122056 - RNA, 16 nt, Mycobacterium bovis subsp bovis AF2122/97
ccacgcuggccucguc

SEQ ID NO: 3122057 - RNA, 14 nt, Mycobacterium bovis subsp bovis AF2122/97
ccacgcuggcgcgu

SEQ ID NO: 3122058 - RNA, 18 nt, Mycobacterium bovis subsp bovis AF2122/97
ccacgcugucccgcgggc

SEQ ID NO: 3122059 - RNA, 20 nt, Mycobacterium bovis subsp bovis AF2122/97
ccacgcuucuuccgcgcgcc

SEQ ID NO: 3122060 - RNA, 18 nt, Mycobacterium bovis subsp bovis AF2122/97
ccacggaaguaucgccgg

SEQ ID NO: 3122061 - RNA, 22 nt, Mycobacterium bovis subsp bovis AF2122/97
ccacggaaguaucgccggccgc

SEQ ID NO: 3122062 - RNA, 13 nt, Mycobacterium bovis subsp bovis AF2122/97
ccacggaccagcg

SEQ ID NO: 3122063 - RNA, 14 nt, Mycobacterium bovis subsp bovis AF2122/97
ccacggaccagcgc

SEQ ID NO: 3122064 - RNA, 16 nt, Mycobacterium bovis subsp bovis AF2122/97
ccacggaccagcgccg

SEQ ID NO: 3122065 - RNA, 17 nt, Mycobacterium bovis subsp bovis AF2122/97
ccacggacgugacgucg

SEQ ID NO: 3122066 - RNA, 15 nt, Mycobacterium bovis subsp bovis AF2122/97
ccacggagggcagga

SEQ ID NO: 3122067 - RNA, 20 nt, Mycobacterium bovis subsp bovis AF2122/97
ccacggaggguugccgccga

SEQ ID NO: 3122068 - RNA, 22 nt, Mycobacterium bovis subsp bovis AF2122/97
ccacggaggguugccgccgacu

SEQ ID NO: 3122069 - RNA, 15 nt, Mycobacterium bovis subsp bovis AF2122/97
ccacggaucgcggcg

SEQ ID NO: 3122070 - RNA, 20 nt, Mycobacterium bovis subsp bovis AF2122/97
ccacggaucgcggcggcgug

SEQ ID NO: 3122071 - RNA, 20 nt, Mycobacterium bovis subsp bovis AF2122/97
ccacggcaagccaaccagcc

SEQ ID NO: 3122072 - RNA, 23 nt, Mycobacterium bovis subsp bovis AF2122/97
ccacggcaagccaaccagcccgg

SEQ ID NO: 3122073 - RNA, 21 nt, Mycobacterium bovis subsp bovis AF2122/97
ccacggcaagcgugacccgcc

SEQ ID NO: 3122074 - RNA, 22 nt, Mycobacterium bovis subsp bovis AF2122/97
ccacggcaagcgugacccgccg

SEQ ID NO: 3122075 - RNA, 16 nt, Mycobacterium bovis subsp bovis AF2122/97
ccacggcaccgaucaa

SEQ ID NO: 3122076 - RNA, 22 nt, Mycobacterium bovis subsp bovis AF2122/97
ccacggcacuggguccacgcgc

SEQ ID NO: 3122077 - RNA, 16 nt, Mycobacterium bovis subsp bovis AF2122/97
ccacggcagccaaccg

SEQ ID NO: 3122078 - RNA, 21 nt, Mycobacterium bovis subsp bovis AF2122/97
ccacggcagccaaccggcgca

SEQ ID NO: 3122079 - RNA, 14 nt, Mycobacterium bovis subsp bovis AF2122/97
ccacggcagcgccc

SEQ ID NO: 3122080 - RNA, 18 nt, Mycobacterium bovis subsp bovis AF2122/97
ccacggcagcgccggucg

SEQ ID NO: 3122081 - RNA, 21 nt, Mycobacterium bovis subsp bovis AF2122/97
ccacggcaggcagggcagccc

SEQ ID NO: 3122082 - RNA, 16 nt, Mycobacterium bovis subsp bovis AF2122/97
ccacggcaucggccac

SEQ ID NO: 3122083 - RNA, 17 nt, Mycobacterium bovis subsp bovis AF2122/97
ccacggcaucggccacc

SEQ ID NO: 3122084 - RNA, 15 nt, Mycobacterium bovis subsp bovis AF2122/97
ccacggccagaaacc

SEQ ID NO: 3122085 - RNA, 19 nt, Mycobacterium bovis subsp bovis AF2122/97
ccacggccagaaacccggc

SEQ ID NO: 3122086 - RNA, 13 nt, Mycobacterium bovis subsp bovis AF2122/97
ccacggccgccga

SEQ ID NO: 3122087 - RNA, 13 nt, Mycobacterium bovis subsp bovis AF2122/97
ccacggccgccgc

SEQ ID NO: 3122088 - RNA, 15 nt, Mycobacterium bovis subsp bovis AF2122/97
ccacggccgccgcgu

SEQ ID NO: 3122089 - RNA, 14 nt, Mycobacterium bovis subsp bovis AF2122/97
ccacggccggccgc

SEQ ID NO: 3122090 - RNA, 15 nt, Mycobacterium bovis subsp bovis AF2122/97
ccacggccggccgcu

SEQ ID NO: 3122091 - RNA, 18 nt, Mycobacterium bovis subsp bovis AF2122/97
ccacggccggccgcugcc

SEQ ID NO: 3122092 - RNA, 16 nt, Mycobacterium bovis subsp bovis AF2122/97
ccacggcgaccacgcc

SEQ ID NO: 3122093 - RNA, 17 nt, Mycobacterium bovis subsp bovis AF2122/97
ccacggcgaccacgccg

SEQ ID NO: 3122094 - RNA, 20 nt, Mycobacterium bovis subsp bovis AF2122/97
ccacggcgaccacgccgccg

SEQ ID NO: 3122095 - RNA, 22 nt, Mycobacterium bovis subsp bovis AF2122/97
ccacggcgaccacgccgccggc

SEQ ID NO: 3122096 - RNA, 23 nt, Mycobacterium bovis subsp bovis AF2122/97
ccacggcgaccaggagccuccag

SEQ ID NO: 3122097 - RNA, 17 nt, Mycobacterium bovis subsp bovis AF2122/97
ccacggcgauccggucg

SEQ ID NO: 3122098 - RNA, 22 nt, Mycobacterium bovis subsp bovis AF2122/97
ccacggcgauccggucggccag

SEQ ID NO: 3122099 - RNA, 23 nt, Mycobacterium bovis subsp bovis AF2122/97
ccacggcgauccggucggccagg

SEQ ID NO: 3122100 - RNA, 12 nt, Mycobacterium bovis subsp bovis AF2122/97
ccacggcgcagu

SEQ ID NO: 3122101 - RNA, 19 nt, Mycobacterium bovis subsp bovis AF2122/97
ccacggcgccuacaccggc

SEQ ID NO: 3122102 - RNA, 22 nt, Mycobacterium bovis subsp bovis AF2122/97
ccacggcgccuacaccggcgcu

SEQ ID NO: 3122103 - RNA, 15 nt, Mycobacterium bovis subsp bovis AF2122/97
ccacggcgcgcgcgc

SEQ ID NO: 3122104 - RNA, 19 nt, Mycobacterium bovis subsp bovis AF2122/97
ccacggcgcgcgcgccggc

SEQ ID NO: 3122105 - RNA, 12 nt, Mycobacterium bovis subsp bovis AF2122/97
ccacggcggcca

SEQ ID NO: 3122106 - RNA, 13 nt, Mycobacterium bovis subsp bovis AF2122/97
ccacggcggccac

SEQ ID NO: 3122107 - RNA, 21 nt, Mycobacterium bovis subsp bovis AF2122/97
ccacggcggccaccugcuggc

SEQ ID NO: 3122108 - RNA, 13 nt, Mycobacterium bovis subsp bovis AF2122/97
ccacggcggcggc

SEQ ID NO: 3122109 - RNA, 15 nt, Mycobacterium bovis subsp bovis AF2122/97
ccacggcgggcgagc

SEQ ID NO: 3122110 - RNA, 17 nt, Mycobacterium bovis subsp bovis AF2122/97
ccacggcgggcgagcca

SEQ ID NO: 3122111 - RNA, 16 nt, Mycobacterium bovis subsp bovis AF2122/97
ccacggcggugccgug

SEQ ID NO: 3122112 - RNA, 24 nt, Mycobacterium bovis subsp bovis AF2122/97
ccacggcgguugccccgaccgccg

SEQ ID NO: 3122113 - RNA, 13 nt, Mycobacterium bovis subsp bovis AF2122/97
ccacggcgugguc

SEQ ID NO: 3122114 - RNA, 14 nt, Mycobacterium bovis subsp bovis AF2122/97
ccacggcguggucg

SEQ ID NO: 3122115 - RNA, 16 nt, Mycobacterium bovis subsp bovis AF2122/97
ccacggcguugccgcc

SEQ ID NO: 3122116 - RNA, 17 nt, Mycobacterium bovis subsp bovis AF2122/97
ccacggcguugccgccg

SEQ ID NO: 3122117 - RNA, 20 nt, Mycobacterium bovis subsp bovis AF2122/97
ccacggcguugccgccggcu

SEQ ID NO: 3122118 - RNA, 19 nt, Mycobacterium bovis subsp bovis AF2122/97
ccacggcugaccggggucg

SEQ ID NO: 3122119 - RNA, 19 nt, Mycobacterium bovis subsp bovis AF2122/97
ccacggcugcccauggugg

SEQ ID NO: 3122120 - RNA, 22 nt, Mycobacterium bovis subsp bovis AF2122/97
ccacggcugcccaugguggcga

SEQ ID NO: 3122121 - RNA, 19 nt, Mycobacterium bovis subsp bovis AF2122/97
ccacggcuucgccgcggga

SEQ ID NO: 3122122 - RNA, 21 nt, Mycobacterium bovis subsp bovis AF2122/97
ccacggcuuugcggcgcgacc

SEQ ID NO: 3122123 - RNA, 22 nt, Mycobacterium bovis subsp bovis AF2122/97
ccacgggaguacgggagccggc

SEQ ID NO: 3122124 - RNA, 15 nt, Mycobacterium bovis subsp bovis AF2122/97
ccacgggaucugcgg

SEQ ID NO: 3122125 - RNA, 15 nt, Mycobacterium bovis subsp bovis AF2122/97
ccacgggcggccacc

SEQ ID NO: 3122126 - RNA, 16 nt, Mycobacterium bovis subsp bovis AF2122/97
ccacgggcggccaccg

SEQ ID NO: 3122127 - RNA, 21 nt, Mycobacterium bovis subsp bovis AF2122/97
ccacgggcggccaccgcacgc

SEQ ID NO: 3122128 - RNA, 22 nt, Mycobacterium bovis subsp bovis AF2122/97
ccacgggcggccaccgcacgcu

SEQ ID NO: 3122129 - RNA, 14 nt, Mycobacterium bovis subsp bovis AF2122/97
ccacggggcagguc

SEQ ID NO: 3122130 - RNA, 21 nt, Mycobacterium bovis subsp bovis AF2122/97
ccacggggcgugacagggcgg

SEQ ID NO: 3122131 - RNA, 17 nt, Mycobacterium bovis subsp bovis AF2122/97
ccacggguagcugccgc

SEQ ID NO: 3122132 - RNA, 18 nt, Mycobacterium bovis subsp bovis AF2122/97
ccacggucaagccggcgc

SEQ ID NO: 3122133 - RNA, 21 nt, Mycobacterium bovis subsp bovis AF2122/97
ccacggucaagccggcgcccg

SEQ ID NO: 3122134 - RNA, 16 nt, Mycobacterium bovis subsp bovis AF2122/97
ccacggucagcacgcu

SEQ ID NO: 3122135 - RNA, 19 nt, Mycobacterium bovis subsp bovis AF2122/97
ccacgguccggcccaccag

SEQ ID NO: 3122136 - RNA, 22 nt, Mycobacterium bovis subsp bovis AF2122/97
ccacgguccggcccaccagcgc

SEQ ID NO: 3122137 - RNA, 15 nt, Mycobacterium bovis subsp bovis AF2122/97
ccacggucgaccagg

SEQ ID NO: 3122138 - RNA, 18 nt, Mycobacterium bovis subsp bovis AF2122/97
ccacggucgccgaccacu

SEQ ID NO: 3122139 - RNA, 20 nt, Mycobacterium bovis subsp bovis AF2122/97
ccacggugacccugguggug

SEQ ID NO: 3122140 - RNA, 18 nt, Mycobacterium bovis subsp bovis AF2122/97
ccacggugccgacgauga

SEQ ID NO: 3122141 - RNA, 20 nt, Mycobacterium bovis subsp bovis AF2122/97
ccacggugcggugauauccg

SEQ ID NO: 3122142 - RNA, 19 nt, Mycobacterium bovis subsp bovis AF2122/97
ccacgguggccgcugccag

SEQ ID NO: 3122143 - RNA, 22 nt, Mycobacterium bovis subsp bovis AF2122/97
ccacgguggccgcugccagccg

SEQ ID NO: 3122144 - RNA, 13 nt, Mycobacterium bovis subsp bovis AF2122/97
ccacgguggcgca

SEQ ID NO: 3122145 - RNA, 23 nt, Mycobacterium bovis subsp bovis AF2122/97
ccacgguggcgcaagugauuucg

SEQ ID NO: 3122146 - RNA, 16 nt, Mycobacterium bovis subsp bovis AF2122/97
ccacgguggugggcua

SEQ ID NO: 3122147 - RNA, 21 nt, Mycobacterium bovis subsp bovis AF2122/97
ccacggugucccgcgaggcaa

SEQ ID NO: 3122148 - RNA, 15 nt, Mycobacterium bovis subsp bovis AF2122/97
ccacgguucugccgg

SEQ ID NO: 3122149 - RNA, 14 nt, Mycobacterium bovis subsp bovis AF2122/97
ccacgguugccggc

SEQ ID NO: 3122150 - RNA, 15 nt, Mycobacterium bovis subsp bovis AF2122/97
ccacgguugccggcg

SEQ ID NO: 3122151 - RNA, 17 nt, Mycobacterium bovis subsp bovis AF2122/97
ccacgguugccggcggc

SEQ ID NO: 3122152 - RNA, 19 nt, Mycobacterium bovis subsp bovis AF2122/97
ccacgguugccggcggcga

SEQ ID NO: 3122153 - RNA, 23 nt, Mycobacterium bovis subsp bovis AF2122/97
ccacgguuggccaccagcuggcg

SEQ ID NO: 3122154 - RNA, 20 nt, Mycobacterium bovis subsp bovis AF2122/97
ccacguaagcgguuguccgg

SEQ ID NO: 3122155 - RNA, 17 nt, Mycobacterium bovis subsp bovis AF2122/97
ccacguacuccaccgcg

SEQ ID NO: 3122156 - RNA, 19 nt, Mycobacterium bovis subsp bovis AF2122/97
ccacguacuccaccgcgcc

SEQ ID NO: 3122157 - RNA, 21 nt, Mycobacterium bovis subsp bovis AF2122/97
ccacguacuuggacgacccgg

SEQ ID NO: 3122158 - RNA, 22 nt, Mycobacterium bovis subsp bovis AF2122/97
ccacguacuuggacgacccggg

SEQ ID NO: 3122159 - RNA, 14 nt, Mycobacterium bovis subsp bovis AF2122/97
ccacguagacaagg

SEQ ID NO: 3122160 - RNA, 14 nt, Mycobacterium bovis subsp bovis AF2122/97
ccacguagcagcag

SEQ ID NO: 3122161 - RNA, 22 nt, Mycobacterium bovis subsp bovis AF2122/97
ccacguagcagcgccggcaccg

SEQ ID NO: 3122162 - RNA, 23 nt, Mycobacterium bovis subsp bovis AF2122/97
ccacguagcagcgccggcaccga

SEQ ID NO: 3122163 - RNA, 23 nt, Mycobacterium bovis subsp bovis AF2122/97
ccacgucaucuggcgcugcuggc

SEQ ID NO: 3122164 - RNA, 23 nt, Mycobacterium bovis subsp bovis AF2122/97
ccacguccgcaaccucgccgucg

SEQ ID NO: 3122165 - RNA, 16 nt, Mycobacterium bovis subsp bovis AF2122/97
ccacgucgacggucug

SEQ ID NO: 3122166 - RNA, 15 nt, Mycobacterium bovis subsp bovis AF2122/97
ccacgucgagcaccc

SEQ ID NO: 3122167 - RNA, 19 nt, Mycobacterium bovis subsp bovis AF2122/97
ccacgucgagcacccgcuc

SEQ ID NO: 3122168 - RNA, 21 nt, Mycobacterium bovis subsp bovis AF2122/97
ccacgucgagcacccgcucca

SEQ ID NO: 3122169 - RNA, 15 nt, Mycobacterium bovis subsp bovis AF2122/97
ccacgucgcggcguu

SEQ ID NO: 3122170 - RNA, 12 nt, Mycobacterium bovis subsp bovis AF2122/97
ccacgucggcga

SEQ ID NO: 3122171 - RNA, 14 nt, Mycobacterium bovis subsp bovis AF2122/97
ccacgucggcgaac

SEQ ID NO: 3122172 - RNA, 21 nt, Mycobacterium bovis subsp bovis AF2122/97
ccacgucggcgaacgcgucca

SEQ ID NO: 3122173 - RNA, 16 nt, Mycobacterium bovis subsp bovis AF2122/97
ccacgucgucgcccag

SEQ ID NO: 3122174 - RNA, 18 nt, Mycobacterium bovis subsp bovis AF2122/97
ccacgucuccuucggcga

SEQ ID NO: 3122175 - RNA, 14 nt, Mycobacterium bovis subsp bovis AF2122/97
ccacgugaucagau

SEQ ID NO: 3122176 - RNA, 15 nt, Mycobacterium bovis subsp bovis AF2122/97
ccacgugaucgacga

SEQ ID NO: 3122177 - RNA, 18 nt, Mycobacterium bovis subsp bovis AF2122/97
ccacgugaucgacgaccg

SEQ ID NO: 3122178 - RNA, 13 nt, Mycobacterium bovis subsp bovis AF2122/97
ccacgugcgccac

SEQ ID NO: 3122179 - RNA, 17 nt, Mycobacterium bovis subsp bovis AF2122/97
ccacguucgcggccaac

SEQ ID NO: 3122180 - RNA, 15 nt, Mycobacterium bovis subsp bovis AF2122/97
ccacguucgcgggcg

SEQ ID NO: 3122181 - RNA, 16 nt, Mycobacterium bovis subsp bovis AF2122/97
ccacguucgcgggcgu

SEQ ID NO: 3122182 - RNA, 22 nt, Mycobacterium bovis subsp bovis AF2122/97
ccacguucgcgggcgucccgca

SEQ ID NO: 3122183 - RNA, 19 nt, Mycobacterium bovis subsp bovis AF2122/97
ccacguugaugaugccggc

SEQ ID NO: 3122184 - RNA, 20 nt, Mycobacterium bovis subsp bovis AF2122/97
ccacguugaugaugccggcg

SEQ ID NO: 3122185 - RNA, 24 nt, Mycobacterium bovis subsp bovis AF2122/97
ccacguugcgcauaggcgaucguc

SEQ ID NO: 3122186 - RNA, 15 nt, Mycobacterium bovis subsp bovis AF2122/97
ccacguuggccaggc

SEQ ID NO: 3122187 - RNA, 15 nt, Mycobacterium bovis subsp bovis AF2122/97
ccacguuggccccgc

SEQ ID NO: 3122188 - RNA, 17 nt, Mycobacterium bovis subsp bovis AF2122/97
ccacguuguccgcgacg

SEQ ID NO: 3122189 - RNA, 17 nt, Mycobacterium bovis subsp bovis AF2122/97
ccacuagcauugucgcc

SEQ ID NO: 3122190 - RNA, 21 nt, Mycobacterium bovis subsp bovis AF2122/97
ccacuaggaagguggcccgcg

SEQ ID NO: 3122191 - RNA, 17 nt, Mycobacterium bovis subsp bovis AF2122/97
ccacuaggucgccggcc

SEQ ID NO: 3122192 - RNA, 20 nt, Mycobacterium bovis subsp bovis AF2122/97
ccacucaacgaccugggaca

SEQ ID NO: 3122193 - RNA, 21 nt, Mycobacterium bovis subsp bovis AF2122/97
ccacucacacaaccgacgggu

SEQ ID NO: 3122194 - RNA, 20 nt, Mycobacterium bovis subsp bovis AF2122/97
ccacucacauuggccagguc

SEQ ID NO: 3122195 - RNA, 17 nt, Mycobacterium bovis subsp bovis AF2122/97
ccacuccagcagcucgc

SEQ ID NO: 3122196 - RNA, 11 nt, Mycobacterium bovis subsp bovis AF2122/97
ccacuccagcg

SEQ ID NO: 3122197 - RNA, 13 nt, Mycobacterium bovis subsp bovis AF2122/97
ccacuccagcgaa

SEQ ID NO: 3122198 - RNA, 16 nt, Mycobacterium bovis subsp bovis AF2122/97
ccacuccaggagccga

SEQ ID NO: 3122199 - RNA, 13 nt, Mycobacterium bovis subsp bovis AF2122/97
ccacuccccagcc

SEQ ID NO: 3122200 - RNA, 16 nt, Mycobacterium bovis subsp bovis AF2122/97
ccacuccccagcccca

SEQ ID NO: 3122201 - RNA, 13 nt, Mycobacterium bovis subsp bovis AF2122/97
ccacucccgcccc

SEQ ID NO: 3122202 - RNA, 16 nt, Mycobacterium bovis subsp bovis AF2122/97
ccacucccgccccgcu

SEQ ID NO: 3122203 - RNA, 16 nt, Mycobacterium bovis subsp bovis AF2122/97
ccacuccgccaacauc

SEQ ID NO: 3122204 - RNA, 15 nt, Mycobacterium bovis subsp bovis AF2122/97
ccacuccgguggcca

SEQ ID NO: 3122205 - RNA, 16 nt, Mycobacterium bovis subsp bovis AF2122/97
ccacucgagcgcucac

SEQ ID NO: 3122206 - RNA, 14 nt, Mycobacterium bovis subsp bovis AF2122/97
ccacucgcccgcug

SEQ ID NO: 3122207 - RNA, 14 nt, Mycobacterium bovis subsp bovis AF2122/97
ccacucgccgagcu

SEQ ID NO: 3122208 - RNA, 14 nt, Mycobacterium bovis subsp bovis AF2122/97
ccacucgccgcgac

SEQ ID NO: 3122209 - RNA, 15 nt, Mycobacterium bovis subsp bovis AF2122/97
ccacucgccggcgga

SEQ ID NO: 3122210 - RNA, 17 nt, Mycobacterium bovis subsp bovis AF2122/97
ccacucgccggcggacg

SEQ ID NO: 3122211 - RNA, 22 nt, Mycobacterium bovis subsp bovis AF2122/97
ccacucgcgcacauaggcgauc

SEQ ID NO: 3122212 - RNA, 16 nt, Mycobacterium bovis subsp bovis AF2122/97
ccacucgcggauccgg

SEQ ID NO: 3122213 - RNA, 18 nt, Mycobacterium bovis subsp bovis AF2122/97
ccacucgcucaggaacaa

SEQ ID NO: 3122214 - RNA, 13 nt, Mycobacterium bovis subsp bovis AF2122/97
ccacucggacccg

SEQ ID NO: 3122215 - RNA, 20 nt, Mycobacterium bovis subsp bovis AF2122/97
ccacucggucguugccgcgg

SEQ ID NO: 3122216 - RNA, 19 nt, Mycobacterium bovis subsp bovis AF2122/97
ccacucuucgggcggcguc

SEQ ID NO: 3122217 - RNA, 17 nt, Mycobacterium bovis subsp bovis AF2122/97
ccacugaacaggccggu

SEQ ID NO: 3122218 - RNA, 20 nt, Mycobacterium bovis subsp bovis AF2122/97
ccacugcaugaacugcucgc

SEQ ID NO: 3122219 - RNA, 14 nt, Mycobacterium bovis subsp bovis AF2122/97
ccacugccaccgcg

SEQ ID NO: 3122220 - RNA, 15 nt, Mycobacterium bovis subsp bovis AF2122/97
ccacugccacuccug

SEQ ID NO: 3122221 - RNA, 15 nt, Mycobacterium bovis subsp bovis AF2122/97
ccacugccagccgug

SEQ ID NO: 3122222 - RNA, 16 nt, Mycobacterium bovis subsp bovis AF2122/97
ccacugcccgccgacg

SEQ ID NO: 3122223 - RNA, 19 nt, Mycobacterium bovis subsp bovis AF2122/97
ccacugcccgccgacgcca

SEQ ID NO: 3122224 - RNA, 13 nt, Mycobacterium bovis subsp bovis AF2122/97
ccacugccgcgcg

SEQ ID NO: 3122225 - RNA, 16 nt, Mycobacterium bovis subsp bovis AF2122/97
ccacugccgcgcgccc

SEQ ID NO: 3122226 - RNA, 20 nt, Mycobacterium bovis subsp bovis AF2122/97
ccacugccgcgcgcccgccu

SEQ ID NO: 3122227 - RNA, 21 nt, Mycobacterium bovis subsp bovis AF2122/97
ccacugccgcgcgcccgccuc

SEQ ID NO: 3122228 - RNA, 22 nt, Mycobacterium bovis subsp bovis AF2122/97
ccacugccgcgcgcccgccuca

SEQ ID NO: 3122229 - RNA, 18 nt, Mycobacterium bovis subsp bovis AF2122/97
ccacugccggcagcgccc

SEQ ID NO: 3122230 - RNA, 20 nt, Mycobacterium bovis subsp bovis AF2122/97
ccacugccggcagcgccccc

SEQ ID NO: 3122231 - RNA, 21 nt, Mycobacterium bovis subsp bovis AF2122/97
ccacugccgugccgguguguc

SEQ ID NO: 3122232 - RNA, 18 nt, Mycobacterium bovis subsp bovis AF2122/97
ccacugccguugccgccg

SEQ ID NO: 3122233 - RNA, 20 nt, Mycobacterium bovis subsp bovis AF2122/97
ccacugccguugccgccggu

SEQ ID NO: 3122234 - RNA, 18 nt, Mycobacterium bovis subsp bovis AF2122/97
ccacugcgagcgccggcu

SEQ ID NO: 3122235 - RNA, 12 nt, Mycobacterium bovis subsp bovis AF2122/97
ccacugcgccac

SEQ ID NO: 3122236 - RNA, 18 nt, Mycobacterium bovis subsp bovis AF2122/97
ccacugcgccgugaccca

SEQ ID NO: 3122237 - RNA, 19 nt, Mycobacterium bovis subsp bovis AF2122/97
ccacugcggcauggcaggc

SEQ ID NO: 3122238 - RNA, 21 nt, Mycobacterium bovis subsp bovis AF2122/97
ccacugcggcauggcaggcga

SEQ ID NO: 3122239 - RNA, 14 nt, Mycobacterium bovis subsp bovis AF2122/97
ccacugcucgaugu

SEQ ID NO: 3122240 - RNA, 23 nt, Mycobacterium bovis subsp bovis AF2122/97
ccacugcucgauguccucgaucc

SEQ ID NO: 3122241 - RNA, 21 nt, Mycobacterium bovis subsp bovis AF2122/97
ccacuggacccgcccaggcgu

SEQ ID NO: 3122242 - RNA, 21 nt, Mycobacterium bovis subsp bovis AF2122/97
ccacuggacucuucagcuacc

SEQ ID NO: 3122243 - RNA, 13 nt, Mycobacterium bovis subsp bovis AF2122/97
ccacugggccggu

SEQ ID NO: 3122244 - RNA, 17 nt, Mycobacterium bovis subsp bovis AF2122/97
ccacuggugaucugguc

SEQ ID NO: 3122245 - RNA, 21 nt, Mycobacterium bovis subsp bovis AF2122/97
ccacuggugaucugguccggc

SEQ ID NO: 3122246 - RNA, 15 nt, Mycobacterium bovis subsp bovis AF2122/97
ccacuggugcagcgc

SEQ ID NO: 3122247 - RNA, 16 nt, Mycobacterium bovis subsp bovis AF2122/97
ccacuggugcagcgcc

SEQ ID NO: 3122248 - RNA, 21 nt, Mycobacterium bovis subsp bovis AF2122/97
ccacuggugcagcgccgacag

SEQ ID NO: 3122249 - RNA, 17 nt, Mycobacterium bovis subsp bovis AF2122/97
ccacuguuacggccaca

SEQ ID NO: 3122250 - RNA, 18 nt, Mycobacterium bovis subsp bovis AF2122/97
ccacuguugaagaagccc

SEQ ID NO: 3122251 - RNA, 21 nt, Mycobacterium bovis subsp bovis AF2122/97
ccacuguuggugccgccacca

SEQ ID NO: 3122252 - RNA, 18 nt, Mycobacterium bovis subsp bovis AF2122/97
ccacuguuucugagcgcg

SEQ ID NO: 3122253 - RNA, 20 nt, Mycobacterium bovis subsp bovis AF2122/97
ccacuguuucugagcgcgcu

SEQ ID NO: 3122254 - RNA, 17 nt, Mycobacterium bovis subsp bovis AF2122/97
ccacuuagcuggcgggg

SEQ ID NO: 3122255 - RNA, 17 nt, Mycobacterium bovis subsp bovis AF2122/97
ccacuucagaucggcga

SEQ ID NO: 3122256 - RNA, 16 nt, Mycobacterium bovis subsp bovis AF2122/97
ccacuuccacggcgug

SEQ ID NO: 3122257 - RNA, 19 nt, Mycobacterium bovis subsp bovis AF2122/97
ccacuuccacggcgugguc

SEQ ID NO: 3122258 - RNA, 17 nt, Mycobacterium bovis subsp bovis AF2122/97
ccacuucccgcuugagc

SEQ ID NO: 3122259 - RNA, 13 nt, Mycobacterium bovis subsp bovis AF2122/97
ccacuuccgggcg

SEQ ID NO: 3122260 - RNA, 23 nt, Mycobacterium bovis subsp bovis AF2122/97
ccacuucgcuuucccgucggcgg

SEQ ID NO: 3122261 - RNA, 12 nt, Mycobacterium bovis subsp bovis AF2122/97
ccacuucggcgc

SEQ ID NO: 3122262 - RNA, 13 nt, Mycobacterium bovis subsp bovis AF2122/97
ccacuucggcguc

SEQ ID NO: 3122263 - RNA, 11 nt, Mycobacterium bovis subsp bovis AF2122/97
ccacuucuuca

SEQ ID NO: 3122264 - RNA, 18 nt, Mycobacterium bovis subsp bovis AF2122/97
ccacuucuucacuggcga

SEQ ID NO: 3122265 - RNA, 13 nt, Mycobacterium bovis subsp bovis AF2122/97
ccacuugcagcac

SEQ ID NO: 3122266 - RNA, 22 nt, Mycobacterium bovis subsp bovis AF2122/97
ccagaaaacauugcggcccucg

SEQ ID NO: 3122267 - RNA, 14 nt, Mycobacterium bovis subsp bovis AF2122/97
ccagaaaaccgccg

SEQ ID NO: 3122268 - RNA, 15 nt, Mycobacterium bovis subsp bovis AF2122/97
ccagaaaaccgccgc

SEQ ID NO: 3122269 - RNA, 20 nt, Mycobacterium bovis subsp bovis AF2122/97
ccagaaacgcgaugguggcc

SEQ ID NO: 3122270 - RNA, 18 nt, Mycobacterium bovis subsp bovis AF2122/97
ccagaaaugguucgcaca

SEQ ID NO: 3122271 - RNA, 21 nt, Mycobacterium bovis subsp bovis AF2122/97
ccagaaaugguucgcacaccu

SEQ ID NO: 3122272 - RNA, 16 nt, Mycobacterium bovis subsp bovis AF2122/97
ccagaacccggacagg

SEQ ID NO: 3122273 - RNA, 21 nt, Mycobacterium bovis subsp bovis AF2122/97
ccagaaccuggagccgugcgg

SEQ ID NO: 3122274 - RNA, 15 nt, Mycobacterium bovis subsp bovis AF2122/97
ccagaacgacgccgc

SEQ ID NO: 3122275 - RNA, 19 nt, Mycobacterium bovis subsp bovis AF2122/97
ccagaacggcgaucaccga

SEQ ID NO: 3122276 - RNA, 15 nt, Mycobacterium bovis subsp bovis AF2122/97
ccagaacggcgucga

SEQ ID NO: 3122277 - RNA, 17 nt, Mycobacterium bovis subsp bovis AF2122/97
ccagaacggcgucgaau

SEQ ID NO: 3122278 - RNA, 13 nt, Mycobacterium bovis subsp bovis AF2122/97
ccagaacguggcc

SEQ ID NO: 3122279 - RNA, 21 nt, Mycobacterium bovis subsp bovis AF2122/97
ccagaagacgaauuggcccga

SEQ ID NO: 3122280 - RNA, 13 nt, Mycobacterium bovis subsp bovis AF2122/97
ccagaaggccgca

SEQ ID NO: 3122281 - RNA, 18 nt, Mycobacterium bovis subsp bovis AF2122/97
ccagaaggccgcaccgcc

SEQ ID NO: 3122282 - RNA, 17 nt, Mycobacterium bovis subsp bovis AF2122/97
ccagaaguaggcgaccg

SEQ ID NO: 3122283 - RNA, 21 nt, Mycobacterium bovis subsp bovis AF2122/97
ccagaaguaggcgaccgccau

SEQ ID NO: 3122284 - RNA, 22 nt, Mycobacterium bovis subsp bovis AF2122/97
ccagaaguagguuuucggcggc

SEQ ID NO: 3122285 - RNA, 18 nt, Mycobacterium bovis subsp bovis AF2122/97
ccagaaucucgccgggcu

SEQ ID NO: 3122286 - RNA, 23 nt, Mycobacterium bovis subsp bovis AF2122/97
ccagaaugacaucgucgccaggg

SEQ ID NO: 3122287 - RNA, 16 nt, Mycobacterium bovis subsp bovis AF2122/97
ccagaauuccggcgga

SEQ ID NO: 3122288 - RNA, 22 nt, Mycobacterium bovis subsp bovis AF2122/97
ccagaauuccggcggagcgggc

SEQ ID NO: 3122289 - RNA, 17 nt, Mycobacterium bovis subsp bovis AF2122/97
ccagacaauccgccgcc

SEQ ID NO: 3122290 - RNA, 19 nt, Mycobacterium bovis subsp bovis AF2122/97
ccagacaauccgccgccgg

SEQ ID NO: 3122291 - RNA, 21 nt, Mycobacterium bovis subsp bovis AF2122/97
ccagacaauccgccgccgggu

SEQ ID NO: 3122292 - RNA, 15 nt, Mycobacterium bovis subsp bovis AF2122/97
ccagacacaaccgcu

SEQ ID NO: 3122293 - RNA, 19 nt, Mycobacterium bovis subsp bovis AF2122/97
ccagacacaaccgcuuuga

SEQ ID NO: 3122294 - RNA, 15 nt, Mycobacterium bovis subsp bovis AF2122/97
ccagacacuggccgu

SEQ ID NO: 3122295 - RNA, 19 nt, Mycobacterium bovis subsp bovis AF2122/97
ccagacacuggccgucggc

SEQ ID NO: 3122296 - RNA, 19 nt, Mycobacterium bovis subsp bovis AF2122/97
ccagacaucagugcgccgg

SEQ ID NO: 3122297 - RNA, 18 nt, Mycobacterium bovis subsp bovis AF2122/97
ccagaccaccgugaccga

SEQ ID NO: 3122298 - RNA, 14 nt, Mycobacterium bovis subsp bovis AF2122/97
ccagaccagggcag

SEQ ID NO: 3122299 - RNA, 15 nt, Mycobacterium bovis subsp bovis AF2122/97
ccagaccagggcagc

SEQ ID NO: 3122300 - RNA, 15 nt, Mycobacterium bovis subsp bovis AF2122/97
ccagacccaccaccg

SEQ ID NO: 3122301 - RNA, 15 nt, Mycobacterium bovis subsp bovis AF2122/97
ccagacccacgaugg

SEQ ID NO: 3122302 - RNA, 15 nt, Mycobacterium bovis subsp bovis AF2122/97
ccagacccagcucgu

SEQ ID NO: 3122303 - RNA, 22 nt, Mycobacterium bovis subsp bovis AF2122/97
ccagacccagcucgucgacguc

SEQ ID NO: 3122304 - RNA, 22 nt, Mycobacterium bovis subsp bovis AF2122/97
ccagacccuggccgucccacca

SEQ ID NO: 3122305 - RNA, 15 nt, Mycobacterium bovis subsp bovis AF2122/97
ccagaccgacccgca

SEQ ID NO: 3122306 - RNA, 12 nt, Mycobacterium bovis subsp bovis AF2122/97
ccagaccgccga

SEQ ID NO: 3122307 - RNA, 18 nt, Mycobacterium bovis subsp bovis AF2122/97
ccagaccgccgacgccgu

SEQ ID NO: 3122308 - RNA, 14 nt, Mycobacterium bovis subsp bovis AF2122/97
ccagaccgcggcgg

SEQ ID NO: 3122309 - RNA, 18 nt, Mycobacterium bovis subsp bovis AF2122/97
ccagaccgcggcggccga

SEQ ID NO: 3122310 - RNA, 13 nt, Mycobacterium bovis subsp bovis AF2122/97
ccagaccggccga

SEQ ID NO: 3122311 - RNA, 19 nt, Mycobacterium bovis subsp bovis AF2122/97
ccagaccggccgacgugac

SEQ ID NO: 3122312 - RNA, 13 nt, Mycobacterium bovis subsp bovis AF2122/97
ccagaccggcggc

SEQ ID NO: 3122313 - RNA, 14 nt, Mycobacterium bovis subsp bovis AF2122/97
ccagaccggcggcu

SEQ ID NO: 3122314 - RNA, 20 nt, Mycobacterium bovis subsp bovis AF2122/97
ccagaccggcucgucgggca

SEQ ID NO: 3122315 - RNA, 12 nt, Mycobacterium bovis subsp bovis AF2122/97
ccagacgauggc

SEQ ID NO: 3122316 - RNA, 16 nt, Mycobacterium bovis subsp bovis AF2122/97
ccagacgccacugcca

SEQ ID NO: 3122317 - RNA, 18 nt, Mycobacterium bovis subsp bovis AF2122/97
ccagacggugcagcuccc

SEQ ID NO: 3122318 - RNA, 23 nt, Mycobacterium bovis subsp bovis AF2122/97
ccagacggugcagcuccccgccg

SEQ ID NO: 3122319 - RNA, 19 nt, Mycobacterium bovis subsp bovis AF2122/97
ccagacguuccaucacgga

SEQ ID NO: 3122320 - RNA, 22 nt, Mycobacterium bovis subsp bovis AF2122/97
ccagagacagcgccaugcccuc

SEQ ID NO: 3122321 - RNA, 23 nt, Mycobacterium bovis subsp bovis AF2122/97
ccagagacaugucgcugccgccg

SEQ ID NO: 3122322 - RNA, 11 nt, Mycobacterium bovis subsp bovis AF2122/97
ccagagaucga

SEQ ID NO: 3122323 - RNA, 16 nt, Mycobacterium bovis subsp bovis AF2122/97
ccagagccgcgcgccg

SEQ ID NO: 3122324 - RNA, 17 nt, Mycobacterium bovis subsp bovis AF2122/97
ccagagccgcgcgccgg

SEQ ID NO: 3122325 - RNA, 23 nt, Mycobacterium bovis subsp bovis AF2122/97
ccagagccgcgcgccgguuggcc

SEQ ID NO: 3122326 - RNA, 19 nt, Mycobacterium bovis subsp bovis AF2122/97
ccagagcgaacccccgccg

SEQ ID NO: 3122327 - RNA, 22 nt, Mycobacterium bovis subsp bovis AF2122/97
ccagagcuggcuacgggccgcu

SEQ ID NO: 3122328 - RNA, 15 nt, Mycobacterium bovis subsp bovis AF2122/97
ccagagcuucgccgc

SEQ ID NO: 3122329 - RNA, 17 nt, Mycobacterium bovis subsp bovis AF2122/97
ccagagcuucgccgcgc

SEQ ID NO: 3122330 - RNA, 18 nt, Mycobacterium bovis subsp bovis AF2122/97
ccagagcuucgccgcgca

SEQ ID NO: 3122331 - RNA, 20 nt, Mycobacterium bovis subsp bovis AF2122/97
ccagagcuucgccgcgcagc

SEQ ID NO: 3122332 - RNA, 22 nt, Mycobacterium bovis subsp bovis AF2122/97
ccagagcuucgccgcgcagccu

SEQ ID NO: 3122333 - RNA, 19 nt, Mycobacterium bovis subsp bovis AF2122/97
ccagaggaugucgaugggg

SEQ ID NO: 3122334 - RNA, 16 nt, Mycobacterium bovis subsp bovis AF2122/97
ccagaggcgugucgac

SEQ ID NO: 3122335 - RNA, 20 nt, Mycobacterium bovis subsp bovis AF2122/97
ccagaggucacgcagcaccc

SEQ ID NO: 3122336 - RNA, 13 nt, Mycobacterium bovis subsp bovis AF2122/97
ccagagucgcccg

SEQ ID NO: 3122337 - RNA, 18 nt, Mycobacterium bovis subsp bovis AF2122/97
ccagagucgcccgcacac

SEQ ID NO: 3122338 - RNA, 16 nt, Mycobacterium bovis subsp bovis AF2122/97
ccagagucggagaccc

SEQ ID NO: 3122339 - RNA, 12 nt, Mycobacterium bovis subsp bovis AF2122/97
ccagaguggugg

SEQ ID NO: 3122340 - RNA, 20 nt, Mycobacterium bovis subsp bovis AF2122/97
ccagagugguguucuccugc

SEQ ID NO: 3122341 - RNA, 19 nt, Mycobacterium bovis subsp bovis AF2122/97
ccagaguucccgaaacccg

SEQ ID NO: 3122342 - RNA, 15 nt, Mycobacterium bovis subsp bovis AF2122/97
ccagauaccaccgcc

SEQ ID NO: 3122343 - RNA, 17 nt, Mycobacterium bovis subsp bovis AF2122/97
ccagauaccaccgccgc

SEQ ID NO: 3122344 - RNA, 23 nt, Mycobacterium bovis subsp bovis AF2122/97
ccagauaccaccgccgcugccgg

SEQ ID NO: 3122345 - RNA, 14 nt, Mycobacterium bovis subsp bovis AF2122/97
ccagauacccgcgu

SEQ ID NO: 3122346 - RNA, 22 nt, Mycobacterium bovis subsp bovis AF2122/97
ccagauacccgcguaccacggu

SEQ ID NO: 3122347 - RNA, 19 nt, Mycobacterium bovis subsp bovis AF2122/97
ccagauagagcuggugcag

SEQ ID NO: 3122348 - RNA, 15 nt, Mycobacterium bovis subsp bovis AF2122/97
ccagauagaucguga

SEQ ID NO: 3122349 - RNA, 23 nt, Mycobacterium bovis subsp bovis AF2122/97
ccagauagguuccaccgggcguc

SEQ ID NO: 3122350 - RNA, 22 nt, Mycobacterium bovis subsp bovis AF2122/97
ccagaucaacgcgucgcccgca

SEQ ID NO: 3122351 - RNA, 17 nt, Mycobacterium bovis subsp bovis AF2122/97
ccagaucagcaccgaca

SEQ ID NO: 3122352 - RNA, 16 nt, Mycobacterium bovis subsp bovis AF2122/97
ccagaucagccgccgc

SEQ ID NO: 3122353 - RNA, 18 nt, Mycobacterium bovis subsp bovis AF2122/97
ccagaucagccgccgccu

SEQ ID NO: 3122354 - RNA, 14 nt, Mycobacterium bovis subsp bovis AF2122/97
ccagauccacgccg

SEQ ID NO: 3122355 - RNA, 17 nt, Mycobacterium bovis subsp bovis AF2122/97
ccagauccacgccgacc

SEQ ID NO: 3122356 - RNA, 21 nt, Mycobacterium bovis subsp bovis AF2122/97
ccagaucgaacgcagccagcg

SEQ ID NO: 3122357 - RNA, 18 nt, Mycobacterium bovis subsp bovis AF2122/97
ccagaucgaagcgcagca

SEQ ID NO: 3122358 - RNA, 16 nt, Mycobacterium bovis subsp bovis AF2122/97
ccagaucgcacaccaa

SEQ ID NO: 3122359 - RNA, 17 nt, Mycobacterium bovis subsp bovis AF2122/97
ccagaucgcacaccaac

SEQ ID NO: 3122360 - RNA, 18 nt, Mycobacterium bovis subsp bovis AF2122/97
ccagaucgcuaggaccgc

SEQ ID NO: 3122361 - RNA, 21 nt, Mycobacterium bovis subsp bovis AF2122/97
ccagaucgcuaggaccgcggu

SEQ ID NO: 3122362 - RNA, 15 nt, Mycobacterium bovis subsp bovis AF2122/97
ccagaucggucggcc

SEQ ID NO: 3122363 - RNA, 19 nt, Mycobacterium bovis subsp bovis AF2122/97
ccagaucgguugaucggcc

SEQ ID NO: 3122364 - RNA, 16 nt, Mycobacterium bovis subsp bovis AF2122/97
ccagaucgucgggcac

SEQ ID NO: 3122365 - RNA, 19 nt, Mycobacterium bovis subsp bovis AF2122/97
ccagaucguuccaggccgc

SEQ ID NO: 3122366 - RNA, 15 nt, Mycobacterium bovis subsp bovis AF2122/97
ccagaucucgcgcgc

SEQ ID NO: 3122367 - RNA, 19 nt, Mycobacterium bovis subsp bovis AF2122/97
ccagaucuugcagugcgcc

SEQ ID NO: 3122368 - RNA, 14 nt, Mycobacterium bovis subsp bovis AF2122/97
ccagaugaaccccg

SEQ ID NO: 3122369 - RNA, 20 nt, Mycobacterium bovis subsp bovis AF2122/97
ccagaugaggacgguucauc

SEQ ID NO: 3122370 - RNA, 12 nt, Mycobacterium bovis subsp bovis AF2122/97
ccagaugcacgu

SEQ ID NO: 3122371 - RNA, 13 nt, Mycobacterium bovis subsp bovis AF2122/97
ccagaugcaggcu

SEQ ID NO: 3122372 - RNA, 18 nt, Mycobacterium bovis subsp bovis AF2122/97
ccagaugcugguguugau

SEQ ID NO: 3122373 - RNA, 15 nt, Mycobacterium bovis subsp bovis AF2122/97
ccagauggcucucgg

SEQ ID NO: 3122374 - RNA, 15 nt, Mycobacterium bovis subsp bovis AF2122/97
ccagauucgccgccc

SEQ ID NO: 3122375 - RNA, 22 nt, Mycobacterium bovis subsp bovis AF2122/97
ccagauugaggcuggucugcag

SEQ ID NO: 3122376 - RNA, 21 nt, Mycobacterium bovis subsp bovis AF2122/97
ccagauugcccaacacccacu

SEQ ID NO: 3122377 - RNA, 16 nt, Mycobacterium bovis subsp bovis AF2122/97
ccagauugccugggcg

SEQ ID NO: 3122378 - RNA, 20 nt, Mycobacterium bovis subsp bovis AF2122/97
ccagauugccugggcggccg

SEQ ID NO: 3122379 - RNA, 14 nt, Mycobacterium bovis subsp bovis AF2122/97
ccagauugguugau

SEQ ID NO: 3122380 - RNA, 23 nt, Mycobacterium bovis subsp bovis AF2122/97
ccagauugguugauagcguggua

SEQ ID NO: 3122381 - RNA, 19 nt, Mycobacterium bovis subsp bovis AF2122/97
ccagauuuaggagcuuuug

SEQ ID NO: 3122382 - RNA, 19 nt, Mycobacterium bovis subsp bovis AF2122/97
ccagcaaaccuucgauaac

SEQ ID NO: 3122383 - RNA, 17 nt, Mycobacterium bovis subsp bovis AF2122/97
ccagcaaaugcggcgcg

SEQ ID NO: 3122384 - RNA, 13 nt, Mycobacterium bovis subsp bovis AF2122/97
ccagcaacaccag

SEQ ID NO: 3122385 - RNA, 14 nt, Mycobacterium bovis subsp bovis AF2122/97
ccagcaacaccaga

SEQ ID NO: 3122386 - RNA, 15 nt, Mycobacterium bovis subsp bovis AF2122/97
ccagcaacaccagau

SEQ ID NO: 3122387 - RNA, 15 nt, Mycobacterium bovis subsp bovis AF2122/97
ccagcaacagcccga

SEQ ID NO: 3122388 - RNA, 21 nt, Mycobacterium bovis subsp bovis AF2122/97
ccagcaacagcgagcgguuga

SEQ ID NO: 3122389 - RNA, 19 nt, Mycobacterium bovis subsp bovis AF2122/97
ccagcaaccaccccagggc

SEQ ID NO: 3122390 - RNA, 15 nt, Mycobacterium bovis subsp bovis AF2122/97
ccagcaacccugcgg

SEQ ID NO: 3122391 - RNA, 17 nt, Mycobacterium bovis subsp bovis AF2122/97
ccagcaaccgcucggcg

SEQ ID NO: 3122392 - RNA, 22 nt, Mycobacterium bovis subsp bovis AF2122/97
ccagcaaccucgguugguccuc

SEQ ID NO: 3122393 - RNA, 14 nt, Mycobacterium bovis subsp bovis AF2122/97
ccagcaacuaccug

SEQ ID NO: 3122394 - RNA, 14 nt, Mycobacterium bovis subsp bovis AF2122/97
ccagcaacugccgc

SEQ ID NO: 3122395 - RNA, 18 nt, Mycobacterium bovis subsp bovis AF2122/97
ccagcaacuuugagcaga

SEQ ID NO: 3122396 - RNA, 15 nt, Mycobacterium bovis subsp bovis AF2122/97
ccagcaaggccagca

SEQ ID NO: 3122397 - RNA, 18 nt, Mycobacterium bovis subsp bovis AF2122/97
ccagcaagugugagcaga

SEQ ID NO: 3122398 - RNA, 17 nt, Mycobacterium bovis subsp bovis AF2122/97
ccagcaauaccugagcg

SEQ ID NO: 3122399 - RNA, 15 nt, Mycobacterium bovis subsp bovis AF2122/97
ccagcaaugcccgca

SEQ ID NO: 3122400 - RNA, 14 nt, Mycobacterium bovis subsp bovis AF2122/97
ccagcacacccaga

SEQ ID NO: 3122401 - RNA, 14 nt, Mycobacterium bovis subsp bovis AF2122/97
ccagcacaccgccc

SEQ ID NO: 3122402 - RNA, 12 nt, Mycobacterium bovis subsp bovis AF2122/97
ccagcacaccgu

SEQ ID NO: 3122403 - RNA, 15 nt, Mycobacterium bovis subsp bovis AF2122/97
ccagcacaccgucga

SEQ ID NO: 3122404 - RNA, 19 nt, Mycobacterium bovis subsp bovis AF2122/97
ccagcacaccgucgacgac

SEQ ID NO: 3122405 - RNA, 15 nt, Mycobacterium bovis subsp bovis AF2122/97
ccagcacaucggcga

SEQ ID NO: 3122406 - RNA, 22 nt, Mycobacterium bovis subsp bovis AF2122/97
ccagcacauucugcagcgucuc

SEQ ID NO: 3122407 - RNA, 17 nt, Mycobacterium bovis subsp bovis AF2122/97
ccagcaccaccacccga

SEQ ID NO: 3122408 - RNA, 15 nt, Mycobacterium bovis subsp bovis AF2122/97
ccagcaccaccggcu

SEQ ID NO: 3122409 - RNA, 13 nt, Mycobacterium bovis subsp bovis AF2122/97
ccagcaccacggc

SEQ ID NO: 3122410 - RNA, 15 nt, Mycobacterium bovis subsp bovis AF2122/97
ccagcaccacggcca

SEQ ID NO: 3122411 - RNA, 16 nt, Mycobacterium bovis subsp bovis AF2122/97
ccagcaccacggccag

SEQ ID NO: 3122412 - RNA, 15 nt, Mycobacterium bovis subsp bovis AF2122/97
ccagcaccacggcgc

SEQ ID NO: 3122413 - RNA, 19 nt, Mycobacterium bovis subsp bovis AF2122/97
ccagcaccacggcgcgcgc

SEQ ID NO: 3122414 - RNA, 15 nt, Mycobacterium bovis subsp bovis AF2122/97
ccagcaccacgucga

SEQ ID NO: 3122415 - RNA, 21 nt, Mycobacterium bovis subsp bovis AF2122/97
ccagcaccacgucgacgaugu

SEQ ID NO: 3122416 - RNA, 12 nt, Mycobacterium bovis subsp bovis AF2122/97
ccagcaccagcg

SEQ ID NO: 3122417 - RNA, 18 nt, Mycobacterium bovis subsp bovis AF2122/97
ccagcaccagcgucgcgg

SEQ ID NO: 3122418 - RNA, 23 nt, Mycobacterium bovis subsp bovis AF2122/97
ccagcaccagcgucgcggccacg

SEQ ID NO: 3122419 - RNA, 15 nt, Mycobacterium bovis subsp bovis AF2122/97
ccagcacccccugca

SEQ ID NO: 3122420 - RNA, 12 nt, Mycobacterium bovis subsp bovis AF2122/97
ccagcaccccga

SEQ ID NO: 3122421 - RNA, 20 nt, Mycobacterium bovis subsp bovis AF2122/97
ccagcaccccgaucuggcgu

SEQ ID NO: 3122422 - RNA, 16 nt, Mycobacterium bovis subsp bovis AF2122/97
ccagcacccgagcgau

SEQ ID NO: 3122423 - RNA, 19 nt, Mycobacterium bovis subsp bovis AF2122/97
ccagcacccgcagccgcga

SEQ ID NO: 3122424 - RNA, 13 nt, Mycobacterium bovis subsp bovis AF2122/97
ccagcacccgcgc

SEQ ID NO: 3122425 - RNA, 15 nt, Mycobacterium bovis subsp bovis AF2122/97
ccagcacccgcgcga

SEQ ID NO: 3122426 - RNA, 20 nt, Mycobacterium bovis subsp bovis AF2122/97
ccagcacccgcuccagcucg

SEQ ID NO: 3122427 - RNA, 22 nt, Mycobacterium bovis subsp bovis AF2122/97
ccagcacccgcuccagcucggc

SEQ ID NO: 3122428 - RNA, 17 nt, Mycobacterium bovis subsp bovis AF2122/97
ccagcacccgcucggcc

SEQ ID NO: 3122429 - RNA, 19 nt, Mycobacterium bovis subsp bovis AF2122/97
ccagcacccgcucggccgc

SEQ ID NO: 3122430 - RNA, 14 nt, Mycobacterium bovis subsp bovis AF2122/97
ccagcacccgcugc

SEQ ID NO: 3122431 - RNA, 17 nt, Mycobacterium bovis subsp bovis AF2122/97
ccagcacccgcugcacg

SEQ ID NO: 3122432 - RNA, 18 nt, Mycobacterium bovis subsp bovis AF2122/97
ccagcacccgcugcacgc

SEQ ID NO: 3122433 - RNA, 22 nt, Mycobacterium bovis subsp bovis AF2122/97
ccagcacccgcugcacgccguc

SEQ ID NO: 3122434 - RNA, 12 nt, Mycobacterium bovis subsp bovis AF2122/97
ccagcacccggc

SEQ ID NO: 3122435 - RNA, 17 nt, Mycobacterium bovis subsp bovis AF2122/97
ccagcacccggcuucgc

SEQ ID NO: 3122436 - RNA, 23 nt, Mycobacterium bovis subsp bovis AF2122/97
ccagcacccggcuucgccgcgcu

SEQ ID NO: 3122437 - RNA, 19 nt, Mycobacterium bovis subsp bovis AF2122/97
ccagcacccucaggcaauc

SEQ ID NO: 3122438 - RNA, 12 nt, Mycobacterium bovis subsp bovis AF2122/97
ccagcaccgccg

SEQ ID NO: 3122439 - RNA, 18 nt, Mycobacterium bovis subsp bovis AF2122/97
ccagcaccgccgcgccgg

SEQ ID NO: 3122440 - RNA, 19 nt, Mycobacterium bovis subsp bovis AF2122/97
ccagcaccgccgcgccggc

SEQ ID NO: 3122441 - RNA, 21 nt, Mycobacterium bovis subsp bovis AF2122/97
ccagcaccgugacccugaugg

SEQ ID NO: 3122442 - RNA, 22 nt, Mycobacterium bovis subsp bovis AF2122/97
ccagcaccuagucgcggccgug

SEQ ID NO: 3122443 - RNA, 17 nt, Mycobacterium bovis subsp bovis AF2122/97
ccagcaccucgaccgcc

SEQ ID NO: 3122444 - RNA, 14 nt, Mycobacterium bovis subsp bovis AF2122/97
ccagcacgccgccg

SEQ ID NO: 3122445 - RNA, 21 nt, Mycobacterium bovis subsp bovis AF2122/97
ccagcacgccgccggccgcca

SEQ ID NO: 3122446 - RNA, 17 nt, Mycobacterium bovis subsp bovis AF2122/97
ccagcacgcgcgcgacc

SEQ ID NO: 3122447 - RNA, 12 nt, Mycobacterium bovis subsp bovis AF2122/97
ccagcacgcugg

SEQ ID NO: 3122448 - RNA, 13 nt, Mycobacterium bovis subsp bovis AF2122/97
ccagcacgcuggc

SEQ ID NO: 3122449 - RNA, 14 nt, Mycobacterium bovis subsp bovis AF2122/97
ccagcacgcuggcg

SEQ ID NO: 3122450 - RNA, 15 nt, Mycobacterium bovis subsp bovis AF2122/97
ccagcacgcuggcgu

SEQ ID NO: 3122451 - RNA, 14 nt, Mycobacterium bovis subsp bovis AF2122/97
ccagcacggcgauc

SEQ ID NO: 3122452 - RNA, 20 nt, Mycobacterium bovis subsp bovis AF2122/97
ccagcacuccaccgcuggcc

SEQ ID NO: 3122453 - RNA, 16 nt, Mycobacterium bovis subsp bovis AF2122/97
ccagcacuccgcgggg

SEQ ID NO: 3122454 - RNA, 18 nt, Mycobacterium bovis subsp bovis AF2122/97
ccagcacugccaucgcgg

SEQ ID NO: 3122455 - RNA, 22 nt, Mycobacterium bovis subsp bovis AF2122/97
ccagcacugccaucgcggcguu

SEQ ID NO: 3122456 - RNA, 22 nt, Mycobacterium bovis subsp bovis AF2122/97
ccagcagacgccguagccggcc

SEQ ID NO: 3122457 - RNA, 19 nt, Mycobacterium bovis subsp bovis AF2122/97
ccagcagaucagguccuag

SEQ ID NO: 3122458 - RNA, 23 nt, Mycobacterium bovis subsp bovis AF2122/97
ccagcagaucagguccuaggugu

SEQ ID NO: 3122459 - RNA, 17 nt, Mycobacterium bovis subsp bovis AF2122/97
ccagcagauccaggcgu

SEQ ID NO: 3122460 - RNA, 20 nt, Mycobacterium bovis subsp bovis AF2122/97
ccagcagauuaccgagcugg

SEQ ID NO: 3122461 - RNA, 12 nt, Mycobacterium bovis subsp bovis AF2122/97
ccagcagcaacc

SEQ ID NO: 3122462 - RNA, 16 nt, Mycobacterium bovis subsp bovis AF2122/97
ccagcagcaaccgcca

SEQ ID NO: 3122463 - RNA, 17 nt, Mycobacterium bovis subsp bovis AF2122/97
ccagcagcaacgacccg

SEQ ID NO: 3122464 - RNA, 14 nt, Mycobacterium bovis subsp bovis AF2122/97
ccagcagcagcgcc

SEQ ID NO: 3122465 - RNA, 16 nt, Mycobacterium bovis subsp bovis AF2122/97
ccagcagcagcgccgc

SEQ ID NO: 3122466 - RNA, 21 nt, Mycobacterium bovis subsp bovis AF2122/97
ccagcagcagcgccgcguggc

SEQ ID NO: 3122467 - RNA, 14 nt, Mycobacterium bovis subsp bovis AF2122/97
ccagcagcagcgcu

SEQ ID NO: 3122468 - RNA, 16 nt, Mycobacterium bovis subsp bovis AF2122/97
ccagcagcagcgcuuc

SEQ ID NO: 3122469 - RNA, 13 nt, Mycobacterium bovis subsp bovis AF2122/97
ccagcagccgcga

SEQ ID NO: 3122470 - RNA, 14 nt, Mycobacterium bovis subsp bovis AF2122/97
ccagcagccgcgac

SEQ ID NO: 3122471 - RNA, 15 nt, Mycobacterium bovis subsp bovis AF2122/97
ccagcagcgacgcug

SEQ ID NO: 3122472 - RNA, 21 nt, Mycobacterium bovis subsp bovis AF2122/97
ccagcagcgacgcugccgcca

SEQ ID NO: 3122473 - RNA, 15 nt, Mycobacterium bovis subsp bovis AF2122/97
ccagcagcgacgguc

SEQ ID NO: 3122474 - RNA, 19 nt, Mycobacterium bovis subsp bovis AF2122/97
ccagcagcgacuccagcgc

SEQ ID NO: 3122475 - RNA, 22 nt, Mycobacterium bovis subsp bovis AF2122/97
ccagcagcgacuccagcgcccg

SEQ ID NO: 3122476 - RNA, 13 nt, Mycobacterium bovis subsp bovis AF2122/97
ccagcagcgcaac

SEQ ID NO: 3122477 - RNA, 16 nt, Mycobacterium bovis subsp bovis AF2122/97
ccagcagcgcaaccag

SEQ ID NO: 3122478 - RNA, 13 nt, Mycobacterium bovis subsp bovis AF2122/97
ccagcagcggcga

SEQ ID NO: 3122479 - RNA, 17 nt, Mycobacterium bovis subsp bovis AF2122/97
ccagcagcucgccggca

SEQ ID NO: 3122480 - RNA, 24 nt, Mycobacterium bovis subsp bovis AF2122/97
ccagcagcucgccggcacgcagcc

SEQ ID NO: 3122481 - RNA, 23 nt, Mycobacterium bovis subsp bovis AF2122/97
ccagcagcucggggcgaugagcc

SEQ ID NO: 3122482 - RNA, 12 nt, Mycobacterium bovis subsp bovis AF2122/97
ccagcagcugaa

SEQ ID NO: 3122483 - RNA, 18 nt, Mycobacterium bovis subsp bovis AF2122/97
ccagcagcugaaaauagg

SEQ ID NO: 3122484 - RNA, 23 nt, Mycobacterium bovis subsp bovis AF2122/97
ccagcagcuugacaucggucagc

SEQ ID NO: 3122485 - RNA, 23 nt, Mycobacterium bovis subsp bovis AF2122/97
ccagcaggaugaugaccgccauc

SEQ ID NO: 3122486 - RNA, 19 nt, Mycobacterium bovis subsp bovis AF2122/97
ccagcaggcccuggccacc

SEQ ID NO: 3122487 - RNA, 21 nt, Mycobacterium bovis subsp bovis AF2122/97
ccagcaggcccuggccaccca

SEQ ID NO: 3122488 - RNA, 12 nt, Mycobacterium bovis subsp bovis AF2122/97
ccagcaggccga

SEQ ID NO: 3122489 - RNA, 13 nt, Mycobacterium bovis subsp bovis AF2122/97
ccagcaggccgaa

SEQ ID NO: 3122490 - RNA, 12 nt, Mycobacterium bovis subsp bovis AF2122/97
ccagcaggccgg

SEQ ID NO: 3122491 - RNA, 17 nt, Mycobacterium bovis subsp bovis AF2122/97
ccagcaggccgggacag

SEQ ID NO: 3122492 - RNA, 21 nt, Mycobacterium bovis subsp bovis AF2122/97
ccagcaggccgggcgcaagca

SEQ ID NO: 3122493 - RNA, 13 nt, Mycobacterium bovis subsp bovis AF2122/97
ccagcaggcggcu

SEQ ID NO: 3122494 - RNA, 14 nt, Mycobacterium bovis subsp bovis AF2122/97
ccagcaggcggcuc

SEQ ID NO: 3122495 - RNA, 17 nt, Mycobacterium bovis subsp bovis AF2122/97
ccagcagggccaccacc

SEQ ID NO: 3122496 - RNA, 14 nt, Mycobacterium bovis subsp bovis AF2122/97
ccagcagggccaga

SEQ ID NO: 3122497 - RNA, 21 nt, Mycobacterium bovis subsp bovis AF2122/97
ccagcaggggacgggcggcca

SEQ ID NO: 3122498 - RNA, 12 nt, Mycobacterium bovis subsp bovis AF2122/97
ccagcagggugu

SEQ ID NO: 3122499 - RNA, 16 nt, Mycobacterium bovis subsp bovis AF2122/97
ccagcagguccgcggc

SEQ ID NO: 3122500 - RNA, 20 nt, Mycobacterium bovis subsp bovis AF2122/97
ccagcagguccgcggccgcg

SEQ ID NO: 3122501 - RNA, 21 nt, Mycobacterium bovis subsp bovis AF2122/97
ccagcagguccgcggccgcgg

SEQ ID NO: 3122502 - RNA, 19 nt, Mycobacterium bovis subsp bovis AF2122/97
ccagcaggucgucggcguc

SEQ ID NO: 3122503 - RNA, 19 nt, Mycobacterium bovis subsp bovis AF2122/97
ccagcagguuccacggcca

SEQ ID NO: 3122504 - RNA, 20 nt, Mycobacterium bovis subsp bovis AF2122/97
ccagcagguuccacggccag

SEQ ID NO: 3122505 - RNA, 21 nt, Mycobacterium bovis subsp bovis AF2122/97
ccagcagguuggucaccaccu

SEQ ID NO: 3122506 - RNA, 19 nt, Mycobacterium bovis subsp bovis AF2122/97
ccagcaguacaccgcccgg

SEQ ID NO: 3122507 - RNA, 23 nt, Mycobacterium bovis subsp bovis AF2122/97
ccagcagugcgguaaagaucuug

SEQ ID NO: 3122508 - RNA, 17 nt, Mycobacterium bovis subsp bovis AF2122/97
ccagcaguucgccgcgc

SEQ ID NO: 3122509 - RNA, 18 nt, Mycobacterium bovis subsp bovis AF2122/97
ccagcaguucgccgcgca

SEQ ID NO: 3122510 - RNA, 19 nt, Mycobacterium bovis subsp bovis AF2122/97
ccagcaguucgccgcgcag

SEQ ID NO: 3122511 - RNA, 20 nt, Mycobacterium bovis subsp bovis AF2122/97
ccagcaguucgccgcgcagc

SEQ ID NO: 3122512 - RNA, 18 nt, Mycobacterium bovis subsp bovis AF2122/97
ccagcaucagcccggcgc

SEQ ID NO: 3122513 - RNA, 17 nt, Mycobacterium bovis subsp bovis AF2122/97
ccagcaucagcgccagc

SEQ ID NO: 3122514 - RNA, 19 nt, Mycobacterium bovis subsp bovis AF2122/97
ccagcaucagcucgaugcc

SEQ ID NO: 3122515 - RNA, 19 nt, Mycobacterium bovis subsp bovis AF2122/97
ccagcaucaguuugacgcc

SEQ ID NO: 3122516 - RNA, 20 nt, Mycobacterium bovis subsp bovis AF2122/97
ccagcaucaguuugacgccg

SEQ ID NO: 3122517 - RNA, 19 nt, Mycobacterium bovis subsp bovis AF2122/97
ccagcaucgagcaguggcc

SEQ ID NO: 3122518 - RNA, 21 nt, Mycobacterium bovis subsp bovis AF2122/97
ccagcaucgagcaguggccgc

SEQ ID NO: 3122519 - RNA, 20 nt, Mycobacterium bovis subsp bovis AF2122/97
ccagcaucgcggugguuggg

SEQ ID NO: 3122520 - RNA, 22 nt, Mycobacterium bovis subsp bovis AF2122/97
ccagcaucggcagcagcgcaac

SEQ ID NO: 3122521 - RNA, 14 nt, Mycobacterium bovis subsp bovis AF2122/97
ccagcaucggugcg

SEQ ID NO: 3122522 - RNA, 19 nt, Mycobacterium bovis subsp bovis AF2122/97
ccagcaucggugcgggcgc

SEQ ID NO: 3122523 - RNA, 19 nt, Mycobacterium bovis subsp bovis AF2122/97
ccagcaucuuuggcggccg

SEQ ID NO: 3122524 - RNA, 20 nt, Mycobacterium bovis subsp bovis AF2122/97
ccagcaucuuuggcggccgc

SEQ ID NO: 3122525 - RNA, 19 nt, Mycobacterium bovis subsp bovis AF2122/97
ccagcaugaagucccggau

SEQ ID NO: 3122526 - RNA, 20 nt, Mycobacterium bovis subsp bovis AF2122/97
ccagcaugacaccggccacc

SEQ ID NO: 3122527 - RNA, 23 nt, Mycobacterium bovis subsp bovis AF2122/97
ccagcaugacaccggccaccagc

SEQ ID NO: 3122528 - RNA, 15 nt, Mycobacterium bovis subsp bovis AF2122/97
ccagcaugcccgcca

SEQ ID NO: 3122529 - RNA, 17 nt, Mycobacterium bovis subsp bovis AF2122/97
ccagcaugcccgccauc

SEQ ID NO: 3122530 - RNA, 17 nt, Mycobacterium bovis subsp bovis AF2122/97
ccagcauuagccaggcc

SEQ ID NO: 3122531 - RNA, 19 nt, Mycobacterium bovis subsp bovis AF2122/97
ccagcauuagccaggcccg

SEQ ID NO: 3122532 - RNA, 19 nt, Mycobacterium bovis subsp bovis AF2122/97
ccagcauucucgccgacgg

SEQ ID NO: 3122533 - RNA, 14 nt, Mycobacterium bovis subsp bovis AF2122/97
ccagcauugacccg

SEQ ID NO: 3122534 - RNA, 18 nt, Mycobacterium bovis subsp bovis AF2122/97
ccagccaaaacgagcaga

SEQ ID NO: 3122535 - RNA, 16 nt, Mycobacterium bovis subsp bovis AF2122/97
ccagccaaccguccgg

SEQ ID NO: 3122536 - RNA, 20 nt, Mycobacterium bovis subsp bovis AF2122/97
ccagccaaccguccggggcc

SEQ ID NO: 3122537 - RNA, 14 nt, Mycobacterium bovis subsp bovis AF2122/97
ccagccaacgcguc

SEQ ID NO: 3122538 - RNA, 18 nt, Mycobacterium bovis subsp bovis AF2122/97
ccagccacagcccggcgg

SEQ ID NO: 3122539 - RNA, 13 nt, Mycobacterium bovis subsp bovis AF2122/97
ccagccacagccg

SEQ ID NO: 3122540 - RNA, 14 nt, Mycobacterium bovis subsp bovis AF2122/97
ccagccaccccugc

SEQ ID NO: 3122541 - RNA, 21 nt, Mycobacterium bovis subsp bovis AF2122/97
ccagccaccccugcgguccgc

SEQ ID NO: 3122542 - RNA, 13 nt, Mycobacterium bovis subsp bovis AF2122/97
ccagccaccgacc

SEQ ID NO: 3122543 - RNA, 14 nt, Mycobacterium bovis subsp bovis AF2122/97
ccagccaccgaccc

SEQ ID NO: 3122544 - RNA, 19 nt, Mycobacterium bovis subsp bovis AF2122/97
ccagccacgccagccaggc

SEQ ID NO: 3122545 - RNA, 14 nt, Mycobacterium bovis subsp bovis AF2122/97
ccagccagaugccg

SEQ ID NO: 3122546 - RNA, 19 nt, Mycobacterium bovis subsp bovis AF2122/97
ccagccagcagcggcgagc

SEQ ID NO: 3122547 - RNA, 20 nt, Mycobacterium bovis subsp bovis AF2122/97
ccagccagcagcggcgagcc

SEQ ID NO: 3122548 - RNA, 16 nt, Mycobacterium bovis subsp bovis AF2122/97
ccagccagccugcugg

SEQ ID NO: 3122549 - RNA, 16 nt, Mycobacterium bovis subsp bovis AF2122/97
ccagccagcgggcgau

SEQ ID NO: 3122550 - RNA, 20 nt, Mycobacterium bovis subsp bovis AF2122/97
ccagccagcuggacuccggu

SEQ ID NO: 3122551 - RNA, 23 nt, Mycobacterium bovis subsp bovis AF2122/97
ccagccagcuggacuccggucag

SEQ ID NO: 3122552 - RNA, 23 nt, Mycobacterium bovis subsp bovis AF2122/97
ccagccauagugcggcagcggug

SEQ ID NO: 3122553 - RNA, 13 nt, Mycobacterium bovis subsp bovis AF2122/97
ccagccaugcucg

SEQ ID NO: 3122554 - RNA, 17 nt, Mycobacterium bovis subsp bovis AF2122/97
ccagccauggcagcgcc

SEQ ID NO: 3122555 - RNA, 18 nt, Mycobacterium bovis subsp bovis AF2122/97
ccagccauggcagcgccg

SEQ ID NO: 3122556 - RNA, 14 nt, Mycobacterium bovis subsp bovis AF2122/97
ccagccauggccgc

SEQ ID NO: 3122557 - RNA, 20 nt, Mycobacterium bovis subsp bovis AF2122/97
ccagcccaacucggccagcu

SEQ ID NO: 3122558 - RNA, 15 nt, Mycobacterium bovis subsp bovis AF2122/97
ccagcccaccggcgc

SEQ ID NO: 3122559 - RNA, 17 nt, Mycobacterium bovis subsp bovis AF2122/97
ccagcccagauccagca

SEQ ID NO: 3122560 - RNA, 23 nt, Mycobacterium bovis subsp bovis AF2122/97
ccagcccagauccagcaacgcgg

SEQ ID NO: 3122561 - RNA, 14 nt, Mycobacterium bovis subsp bovis AF2122/97
ccagcccagccgcc

SEQ ID NO: 3122562 - RNA, 18 nt, Mycobacterium bovis subsp bovis AF2122/97
ccagcccagccgccagcc

SEQ ID NO: 3122563 - RNA, 13 nt, Mycobacterium bovis subsp bovis AF2122/97
ccagcccagccgg

SEQ ID NO: 3122564 - RNA, 18 nt, Mycobacterium bovis subsp bovis AF2122/97
ccagcccaucccgauccu

SEQ ID NO: 3122565 - RNA, 13 nt, Mycobacterium bovis subsp bovis AF2122/97
ccagccccaaccc

SEQ ID NO: 3122566 - RNA, 23 nt, Mycobacterium bovis subsp bovis AF2122/97
ccagccccaacccuaaaccagcc

SEQ ID NO: 3122567 - RNA, 14 nt, Mycobacterium bovis subsp bovis AF2122/97
ccagccccacccgc

SEQ ID NO: 3122568 - RNA, 15 nt, Mycobacterium bovis subsp bovis AF2122/97
ccagccccacccgca

SEQ ID NO: 3122569 - RNA, 16 nt, Mycobacterium bovis subsp bovis AF2122/97
ccagccccacccgccg

SEQ ID NO: 3122570 - RNA, 17 nt, Mycobacterium bovis subsp bovis AF2122/97
ccagccccacccgccgc

SEQ ID NO: 3122571 - RNA, 19 nt, Mycobacterium bovis subsp bovis AF2122/97
ccagccccacccgccgccg

SEQ ID NO: 3122572 - RNA, 22 nt, Mycobacterium bovis subsp bovis AF2122/97
ccagccccacccgccgccgccc

SEQ ID NO: 3122573 - RNA, 16 nt, Mycobacterium bovis subsp bovis AF2122/97
ccagccccccggcgac

SEQ ID NO: 3122574 - RNA, 14 nt, Mycobacterium bovis subsp bovis AF2122/97
ccagccccgacuga

SEQ ID NO: 3122575 - RNA, 17 nt, Mycobacterium bovis subsp bovis AF2122/97
ccagccccgacugacag

SEQ ID NO: 3122576 - RNA, 20 nt, Mycobacterium bovis subsp bovis AF2122/97
ccagccccgcgcccaccccg

SEQ ID NO: 3122577 - RNA, 22 nt, Mycobacterium bovis subsp bovis AF2122/97
ccagccccgcgcccaccccggc

SEQ ID NO: 3122578 - RNA, 14 nt, Mycobacterium bovis subsp bovis AF2122/97
ccagccccgcuggu

SEQ ID NO: 3122579 - RNA, 14 nt, Mycobacterium bovis subsp bovis AF2122/97
ccagcccgcccaga

SEQ ID NO: 3122580 - RNA, 20 nt, Mycobacterium bovis subsp bovis AF2122/97
ccagcccgcccgguguguuc

SEQ ID NO: 3122581 - RNA, 19 nt, Mycobacterium bovis subsp bovis AF2122/97
ccagcccgccgaucgggcu

SEQ ID NO: 3122582 - RNA, 20 nt, Mycobacterium bovis subsp bovis AF2122/97
ccagcccggaacccgagccg

SEQ ID NO: 3122583 - RNA, 17 nt, Mycobacterium bovis subsp bovis AF2122/97
ccagcccggcccagugg

SEQ ID NO: 3122584 - RNA, 13 nt, Mycobacterium bovis subsp bovis AF2122/97
ccagcccggccgc

SEQ ID NO: 3122585 - RNA, 14 nt, Mycobacterium bovis subsp bovis AF2122/97
ccagcccggccgcc

SEQ ID NO: 3122586 - RNA, 23 nt, Mycobacterium bovis subsp bovis AF2122/97
ccagcccggccggucgagacgcu

SEQ ID NO: 3122587 - RNA, 19 nt, Mycobacterium bovis subsp bovis AF2122/97
ccagcccggcggcggucac

SEQ ID NO: 3122588 - RNA, 14 nt, Mycobacterium bovis subsp bovis AF2122/97
ccagcccggcgugc

SEQ ID NO: 3122589 - RNA, 23 nt, Mycobacterium bovis subsp bovis AF2122/97
ccagcccggucauggucagcaga

SEQ ID NO: 3122590 - RNA, 18 nt, Mycobacterium bovis subsp bovis AF2122/97
ccagcccgucaucgcgua

SEQ ID NO: 3122591 - RNA, 16 nt, Mycobacterium bovis subsp bovis AF2122/97
ccagcccguccggccc

SEQ ID NO: 3122592 - RNA, 24 nt, Mycobacterium bovis subsp bovis AF2122/97
ccagcccguccggcccccgaggcu

SEQ ID NO: 3122593 - RNA, 20 nt, Mycobacterium bovis subsp bovis AF2122/97
ccagcccguugcaggacgcc

SEQ ID NO: 3122594 - RNA, 19 nt, Mycobacterium bovis subsp bovis AF2122/97
ccagcccuucagcguccug

SEQ ID NO: 3122595 - RNA, 16 nt, Mycobacterium bovis subsp bovis AF2122/97
ccagccgaagaaccgg

SEQ ID NO: 3122596 - RNA, 22 nt, Mycobacterium bovis subsp bovis AF2122/97
ccagccgaccgauggcucacca

SEQ ID NO: 3122597 - RNA, 13 nt, Mycobacterium bovis subsp bovis AF2122/97
ccagccgacgccu

SEQ ID NO: 3122598 - RNA, 16 nt, Mycobacterium bovis subsp bovis AF2122/97
ccagccgacgccuucc

SEQ ID NO: 3122599 - RNA, 13 nt, Mycobacterium bovis subsp bovis AF2122/97
ccagccgaucacg

SEQ ID NO: 3122600 - RNA, 12 nt, Mycobacterium bovis subsp bovis AF2122/97
ccagccgaucau

SEQ ID NO: 3122601 - RNA, 20 nt, Mycobacterium bovis subsp bovis AF2122/97
ccagccgaucaucaccggca

SEQ ID NO: 3122602 - RNA, 19 nt, Mycobacterium bovis subsp bovis AF2122/97
ccagccgcaacaccccccg

SEQ ID NO: 3122603 - RNA, 12 nt, Mycobacterium bovis subsp bovis AF2122/97
ccagccgcacgg

SEQ ID NO: 3122604 - RNA, 16 nt, Mycobacterium bovis subsp bovis AF2122/97
ccagccgcaucgggca

SEQ ID NO: 3122605 - RNA, 15 nt, Mycobacterium bovis subsp bovis AF2122/97
ccagccgccagcccg

SEQ ID NO: 3122606 - RNA, 12 nt, Mycobacterium bovis subsp bovis AF2122/97
ccagccgccccg

SEQ ID NO: 3122607 - RNA, 13 nt, Mycobacterium bovis subsp bovis AF2122/97
ccagccgccccgg

SEQ ID NO: 3122608 - RNA, 13 nt, Mycobacterium bovis subsp bovis AF2122/97
ccagccgcccucg

SEQ ID NO: 3122609 - RNA, 20 nt, Mycobacterium bovis subsp bovis AF2122/97
ccagccgcgaaauuacuucg

SEQ ID NO: 3122610 - RNA, 20 nt, Mycobacterium bovis subsp bovis AF2122/97
ccagccgcgagccggugauc

SEQ ID NO: 3122611 - RNA, 13 nt, Mycobacterium bovis subsp bovis AF2122/97
ccagccgcgccag

SEQ ID NO: 3122612 - RNA, 21 nt, Mycobacterium bovis subsp bovis AF2122/97
ccagccgcgccagcuccgugu

SEQ ID NO: 3122613 - RNA, 17 nt, Mycobacterium bovis subsp bovis AF2122/97
ccagccgcgcgccggcc

SEQ ID NO: 3122614 - RNA, 12 nt, Mycobacterium bovis subsp bovis AF2122/97
ccagccgcgcgu

SEQ ID NO: 3122615 - RNA, 14 nt, Mycobacterium bovis subsp bovis AF2122/97
ccagccgcgcgucc

SEQ ID NO: 3122616 - RNA, 21 nt, Mycobacterium bovis subsp bovis AF2122/97
ccagccgcgcguccgggcagc

SEQ ID NO: 3122617 - RNA, 16 nt, Mycobacterium bovis subsp bovis AF2122/97
ccagccgcggcccucg

SEQ ID NO: 3122618 - RNA, 21 nt, Mycobacterium bovis subsp bovis AF2122/97
ccagccgcggcccucgaugcc

SEQ ID NO: 3122619 - RNA, 14 nt, Mycobacterium bovis subsp bovis AF2122/97
ccagccgcggcgcc

SEQ ID NO: 3122620 - RNA, 23 nt, Mycobacterium bovis subsp bovis AF2122/97
ccagccgcggcgccuccgcucgg

SEQ ID NO: 3122621 - RNA, 16 nt, Mycobacterium bovis subsp bovis AF2122/97
ccagccgcgggccgcg

SEQ ID NO: 3122622 - RNA, 17 nt, Mycobacterium bovis subsp bovis AF2122/97
ccagccgcugccacagg

SEQ ID NO: 3122623 - RNA, 16 nt, Mycobacterium bovis subsp bovis AF2122/97
ccagccggaccgcgac

SEQ ID NO: 3122624 - RNA, 18 nt, Mycobacterium bovis subsp bovis AF2122/97
ccagccggaccgcgacgg

SEQ ID NO: 3122625 - RNA, 14 nt, Mycobacterium bovis subsp bovis AF2122/97
ccagccggcagcag

SEQ ID NO: 3122626 - RNA, 16 nt, Mycobacterium bovis subsp bovis AF2122/97
ccagccggcagcagcg

SEQ ID NO: 3122627 - RNA, 17 nt, Mycobacterium bovis subsp bovis AF2122/97
ccagccggcagcagcgg

SEQ ID NO: 3122628 - RNA, 20 nt, Mycobacterium bovis subsp bovis AF2122/97
ccagccggcagcagcgggcg

SEQ ID NO: 3122629 - RNA, 12 nt, Mycobacterium bovis subsp bovis AF2122/97
ccagccggccgc

SEQ ID NO: 3122630 - RNA, 14 nt, Mycobacterium bovis subsp bovis AF2122/97
ccagccggccgcga

SEQ ID NO: 3122631 - RNA, 15 nt, Mycobacterium bovis subsp bovis AF2122/97
ccagccggccgcgac

SEQ ID NO: 3122632 - RNA, 12 nt, Mycobacterium bovis subsp bovis AF2122/97
ccagccggccug

SEQ ID NO: 3122633 - RNA, 23 nt, Mycobacterium bovis subsp bovis AF2122/97
ccagccggcgagaaacacgacag

SEQ ID NO: 3122634 - RNA, 11 nt, Mycobacterium bovis subsp bovis AF2122/97
ccagccggcgc

SEQ ID NO: 3122635 - RNA, 13 nt, Mycobacterium bovis subsp bovis AF2122/97
ccagccggcgcac

SEQ ID NO: 3122636 - RNA, 15 nt, Mycobacterium bovis subsp bovis AF2122/97
ccagccggcgcgccg

SEQ ID NO: 3122637 - RNA, 15 nt, Mycobacterium bovis subsp bovis AF2122/97
ccagccgggagucgu

SEQ ID NO: 3122638 - RNA, 20 nt, Mycobacterium bovis subsp bovis AF2122/97
ccagccgguagagcgggcca

SEQ ID NO: 3122639 - RNA, 13 nt, Mycobacterium bovis subsp bovis AF2122/97
ccagccgguccag

SEQ ID NO: 3122640 - RNA, 18 nt, Mycobacterium bovis subsp bovis AF2122/97
ccagccgguccagaccca

SEQ ID NO: 3122641 - RNA, 21 nt, Mycobacterium bovis subsp bovis AF2122/97
ccagccgguccagacccagcu

SEQ ID NO: 3122642 - RNA, 23 nt, Mycobacterium bovis subsp bovis AF2122/97
ccagccgguccagacccagcucg

SEQ ID NO: 3122643 - RNA, 15 nt, Mycobacterium bovis subsp bovis AF2122/97
ccagccggucgucgc

SEQ ID NO: 3122644 - RNA, 13 nt, Mycobacterium bovis subsp bovis AF2122/97
ccagccggugagc

SEQ ID NO: 3122645 - RNA, 21 nt, Mycobacterium bovis subsp bovis AF2122/97
ccagccggugagcgagcgcgc

SEQ ID NO: 3122646 - RNA, 13 nt, Mycobacterium bovis subsp bovis AF2122/97
ccagccggugccg

SEQ ID NO: 3122647 - RNA, 21 nt, Mycobacterium bovis subsp bovis AF2122/97
ccagccgguuggcugccggca

SEQ ID NO: 3122648 - RNA, 16 nt, Mycobacterium bovis subsp bovis AF2122/97
ccagccgucaccgcga

SEQ ID NO: 3122649 - RNA, 17 nt, Mycobacterium bovis subsp bovis AF2122/97
ccagccgucaccgcgac

SEQ ID NO: 3122650 - RNA, 17 nt, Mycobacterium bovis subsp bovis AF2122/97
ccagccgucgucaggug

SEQ ID NO: 3122651 - RNA, 13 nt, Mycobacterium bovis subsp bovis AF2122/97
ccagccgugccgg

SEQ ID NO: 3122652 - RNA, 22 nt, Mycobacterium bovis subsp bovis AF2122/97
ccagccgugcuuguugcgcgac

SEQ ID NO: 3122653 - RNA, 12 nt, Mycobacterium bovis subsp bovis AF2122/97
ccagccguggcg

SEQ ID NO: 3122654 - RNA, 14 nt, Mycobacterium bovis subsp bovis AF2122/97
ccagccguggcggc

SEQ ID NO: 3122655 - RNA, 17 nt, Mycobacterium bovis subsp bovis AF2122/97
ccagccguggcggcggg

SEQ ID NO: 3122656 - RNA, 21 nt, Mycobacterium bovis subsp bovis AF2122/97
ccagccguggcggcgggccuc

SEQ ID NO: 3122657 - RNA, 22 nt, Mycobacterium bovis subsp bovis AF2122/97
ccagccguggugguugaucagc

SEQ ID NO: 3122658 - RNA, 13 nt, Mycobacterium bovis subsp bovis AF2122/97
ccagccugcuggc

SEQ ID NO: 3122659 - RNA, 23 nt, Mycobacterium bovis subsp bovis AF2122/97
ccagccugcuggccgcggccucg

SEQ ID NO: 3122660 - RNA, 21 nt, Mycobacterium bovis subsp bovis AF2122/97
ccagccuggccaucgagggca

SEQ ID NO: 3122661 - RNA, 12 nt, Mycobacterium bovis subsp bovis AF2122/97
ccagccugugcu

SEQ ID NO: 3122662 - RNA, 20 nt, Mycobacterium bovis subsp bovis AF2122/97
ccagccuuaugcagugacag

SEQ ID NO: 3122663 - RNA, 22 nt, Mycobacterium bovis subsp bovis AF2122/97
ccagccuuggacgugcgcgcca

SEQ ID NO: 3122664 - RNA, 18 nt, Mycobacterium bovis subsp bovis AF2122/97
ccagccuuuuucgacaag

SEQ ID NO: 3122665 - RNA, 17 nt, Mycobacterium bovis subsp bovis AF2122/97
ccagccuuuuucggcga

SEQ ID NO: 3122666 - RNA, 21 nt, Mycobacterium bovis subsp bovis AF2122/97
ccagccuuuuucggcgagucg

SEQ ID NO: 3122667 - RNA, 19 nt, Mycobacterium bovis subsp bovis AF2122/97
ccagcgaaaauucggucuc

SEQ ID NO: 3122668 - RNA, 18 nt, Mycobacterium bovis subsp bovis AF2122/97
ccagcgaaccgacccggc

SEQ ID NO: 3122669 - RNA, 22 nt, Mycobacterium bovis subsp bovis AF2122/97
ccagcgaaccgacccggccgcu

SEQ ID NO: 3122670 - RNA, 18 nt, Mycobacterium bovis subsp bovis AF2122/97
ccagcgaaucacccgcga

SEQ ID NO: 3122671 - RNA, 17 nt, Mycobacterium bovis subsp bovis AF2122/97
ccagcgaauccagccgc

SEQ ID NO: 3122672 - RNA, 19 nt, Mycobacterium bovis subsp bovis AF2122/97
ccagcgaauccagccgcgc

SEQ ID NO: 3122673 - RNA, 16 nt, Mycobacterium bovis subsp bovis AF2122/97
ccagcgaauccaggcc

SEQ ID NO: 3122674 - RNA, 18 nt, Mycobacterium bovis subsp bovis AF2122/97
ccagcgaauccaggccgu

SEQ ID NO: 3122675 - RNA, 14 nt, Mycobacterium bovis subsp bovis AF2122/97
ccagcgacaacacc

SEQ ID NO: 3122676 - RNA, 17 nt, Mycobacterium bovis subsp bovis AF2122/97
ccagcgacaacaccacg

SEQ ID NO: 3122677 - RNA, 15 nt, Mycobacterium bovis subsp bovis AF2122/97
ccagcgaccaggucg

SEQ ID NO: 3122678 - RNA, 23 nt, Mycobacterium bovis subsp bovis AF2122/97
ccagcgaccaggucgccagcucg

SEQ ID NO: 3122679 - RNA, 14 nt, Mycobacterium bovis subsp bovis AF2122/97
ccagcgaccagugg

SEQ ID NO: 3122680 - RNA, 14 nt, Mycobacterium bovis subsp bovis AF2122/97
ccagcgacccggcc

SEQ ID NO: 3122681 - RNA, 20 nt, Mycobacterium bovis subsp bovis AF2122/97
ccagcgacccggccagcggc

SEQ ID NO: 3122682 - RNA, 15 nt, Mycobacterium bovis subsp bovis AF2122/97
ccagcgacgccaugu

SEQ ID NO: 3122683 - RNA, 19 nt, Mycobacterium bovis subsp bovis AF2122/97
ccagcgacgccaugucgau

SEQ ID NO: 3122684 - RNA, 17 nt, Mycobacterium bovis subsp bovis AF2122/97
ccagcgacgcggccagc

SEQ ID NO: 3122685 - RNA, 14 nt, Mycobacterium bovis subsp bovis AF2122/97
ccagcgacgcgguc

SEQ ID NO: 3122686 - RNA, 17 nt, Mycobacterium bovis subsp bovis AF2122/97
ccagcgacgcggucauc

SEQ ID NO: 3122687 - RNA, 15 nt, Mycobacterium bovis subsp bovis AF2122/97
ccagcgacucggcca

SEQ ID NO: 3122688 - RNA, 16 nt, Mycobacterium bovis subsp bovis AF2122/97
ccagcgagaucagcau

SEQ ID NO: 3122689 - RNA, 20 nt, Mycobacterium bovis subsp bovis AF2122/97
ccagcgagaucagcaugccc

SEQ ID NO: 3122690 - RNA, 19 nt, Mycobacterium bovis subsp bovis AF2122/97
ccagcgagcauaccgccgc

SEQ ID NO: 3122691 - RNA, 15 nt, Mycobacterium bovis subsp bovis AF2122/97
ccagcgagcccagcu

SEQ ID NO: 3122692 - RNA, 16 nt, Mycobacterium bovis subsp bovis AF2122/97
ccagcgagcccagcug

SEQ ID NO: 3122693 - RNA, 20 nt, Mycobacterium bovis subsp bovis AF2122/97
ccagcgagccguaucggacg

SEQ ID NO: 3122694 - RNA, 20 nt, Mycobacterium bovis subsp bovis AF2122/97
ccagcgagcgcaaaucgauu

SEQ ID NO: 3122695 - RNA, 14 nt, Mycobacterium bovis subsp bovis AF2122/97
ccagcgagcgccag

SEQ ID NO: 3122696 - RNA, 22 nt, Mycobacterium bovis subsp bovis AF2122/97
ccagcgagcgccaggucagcuc

SEQ ID NO: 3122697 - RNA, 13 nt, Mycobacterium bovis subsp bovis AF2122/97
ccagcgaggagca

SEQ ID NO: 3122698 - RNA, 15 nt, Mycobacterium bovis subsp bovis AF2122/97
ccagcgaggagcagg

SEQ ID NO: 3122699 - RNA, 15 nt, Mycobacterium bovis subsp bovis AF2122/97
ccagcgaggccagcg

SEQ ID NO: 3122700 - RNA, 22 nt, Mycobacterium bovis subsp bovis AF2122/97
ccagcgaggugggcgucaucga

SEQ ID NO: 3122701 - RNA, 17 nt, Mycobacterium bovis subsp bovis AF2122/97
ccagcgaguugagcaug

SEQ ID NO: 3122702 - RNA, 22 nt, Mycobacterium bovis subsp bovis AF2122/97
ccagcgauggguguugcuggcc

SEQ ID NO: 3122703 - RNA, 19 nt, Mycobacterium bovis subsp bovis AF2122/97
ccagcgcaagguugccaac

SEQ ID NO: 3122704 - RNA, 12 nt, Mycobacterium bovis subsp bovis AF2122/97
ccagcgcaccgc

SEQ ID NO: 3122705 - RNA, 14 nt, Mycobacterium bovis subsp bovis AF2122/97
ccagcgcaccggcg

SEQ ID NO: 3122706 - RNA, 18 nt, Mycobacterium bovis subsp bovis AF2122/97
ccagcgcacgcucggcac

SEQ ID NO: 3122707 - RNA, 20 nt, Mycobacterium bovis subsp bovis AF2122/97
ccagcgcacggaccaucgcc

SEQ ID NO: 3122708 - RNA, 22 nt, Mycobacterium bovis subsp bovis AF2122/97
ccagcgcacggaccaucgccag

SEQ ID NO: 3122709 - RNA, 22 nt, Mycobacterium bovis subsp bovis AF2122/97
ccagcgcacuacucgaacaacc

SEQ ID NO: 3122710 - RNA, 23 nt, Mycobacterium bovis subsp bovis AF2122/97
ccagcgcacuacucgaacaaccc

SEQ ID NO: 3122711 - RNA, 14 nt, Mycobacterium bovis subsp bovis AF2122/97
ccagcgcagcaccg

SEQ ID NO: 3122712 - RNA, 13 nt, Mycobacterium bovis subsp bovis AF2122/97
ccagcgcagcagc

SEQ ID NO: 3122713 - RNA, 16 nt, Mycobacterium bovis subsp bovis AF2122/97
ccagcgcaucggccag

SEQ ID NO: 3122714 - RNA, 20 nt, Mycobacterium bovis subsp bovis AF2122/97
ccagcgcaucggccagcagc

SEQ ID NO: 3122715 - RNA, 23 nt, Mycobacterium bovis subsp bovis AF2122/97
ccagcgcaucuuugaacgccauc

SEQ ID NO: 3122716 - RNA, 13 nt, Mycobacterium bovis subsp bovis AF2122/97
ccagcgccaccgu

SEQ ID NO: 3122717 - RNA, 21 nt, Mycobacterium bovis subsp bovis AF2122/97
ccagcgccaccguuaccgccg

SEQ ID NO: 3122718 - RNA, 21 nt, Mycobacterium bovis subsp bovis AF2122/97
ccagcgccaccguuugcgcac

SEQ ID NO: 3122719 - RNA, 15 nt, Mycobacterium bovis subsp bovis AF2122/97
ccagcgccagugccu

SEQ ID NO: 3122720 - RNA, 20 nt, Mycobacterium bovis subsp bovis AF2122/97
ccagcgccagugccucgcgg

SEQ ID NO: 3122721 - RNA, 18 nt, Mycobacterium bovis subsp bovis AF2122/97
ccagcgcccccagcagcu

SEQ ID NO: 3122722 - RNA, 13 nt, Mycobacterium bovis subsp bovis AF2122/97
ccagcgccccggc

SEQ ID NO: 3122723 - RNA, 13 nt, Mycobacterium bovis subsp bovis AF2122/97
ccagcgcccgccg

SEQ ID NO: 3122724 - RNA, 15 nt, Mycobacterium bovis subsp bovis AF2122/97
ccagcgcccgccggc

SEQ ID NO: 3122725 - RNA, 16 nt, Mycobacterium bovis subsp bovis AF2122/97
ccagcgcccgccggca

SEQ ID NO: 3122726 - RNA, 16 nt, Mycobacterium bovis subsp bovis AF2122/97
ccagcgcccgcgcggc

SEQ ID NO: 3122727 - RNA, 12 nt, Mycobacterium bovis subsp bovis AF2122/97
ccagcgcccggc

SEQ ID NO: 3122728 - RNA, 16 nt, Mycobacterium bovis subsp bovis AF2122/97
ccagcgcccggcccgc

SEQ ID NO: 3122729 - RNA, 19 nt, Mycobacterium bovis subsp bovis AF2122/97
ccagcgcccgucgcuggga

SEQ ID NO: 3122730 - RNA, 11 nt, Mycobacterium bovis subsp bovis AF2122/97
ccagcgccgac

SEQ ID NO: 3122731 - RNA, 16 nt, Mycobacterium bovis subsp bovis AF2122/97
ccagcgccgaccuccu

SEQ ID NO: 3122732 - RNA, 12 nt, Mycobacterium bovis subsp bovis AF2122/97
ccagcgccgcac

SEQ ID NO: 3122733 - RNA, 14 nt, Mycobacterium bovis subsp bovis AF2122/97
ccagcgccgcacag

SEQ ID NO: 3122734 - RNA, 20 nt, Mycobacterium bovis subsp bovis AF2122/97
ccagcgccgcaguggaugca

SEQ ID NO: 3122735 - RNA, 13 nt, Mycobacterium bovis subsp bovis AF2122/97
ccagcgccgccac

SEQ ID NO: 3122736 - RNA, 15 nt, Mycobacterium bovis subsp bovis AF2122/97
ccagcgccgccaggu

SEQ ID NO: 3122737 - RNA, 12 nt, Mycobacterium bovis subsp bovis AF2122/97
ccagcgccgccg

SEQ ID NO: 3122738 - RNA, 21 nt, Mycobacterium bovis subsp bovis AF2122/97
ccagcgccgccgccgacgaag

SEQ ID NO: 3122739 - RNA, 13 nt, Mycobacterium bovis subsp bovis AF2122/97
ccagcgccgccgg

SEQ ID NO: 3122740 - RNA, 16 nt, Mycobacterium bovis subsp bovis AF2122/97
ccagcgccgccggcgc

SEQ ID NO: 3122741 - RNA, 13 nt, Mycobacterium bovis subsp bovis AF2122/97
ccagcgccgcggc

SEQ ID NO: 3122742 - RNA, 17 nt, Mycobacterium bovis subsp bovis AF2122/97
ccagcgccgcggcccgc

SEQ ID NO: 3122743 - RNA, 20 nt, Mycobacterium bovis subsp bovis AF2122/97
ccagcgccgcggcuacaucg

SEQ ID NO: 3122744 - RNA, 14 nt, Mycobacterium bovis subsp bovis AF2122/97
ccagcgccggaagc

SEQ ID NO: 3122745 - RNA, 16 nt, Mycobacterium bovis subsp bovis AF2122/97
ccagcgccucggcauc

SEQ ID NO: 3122746 - RNA, 15 nt, Mycobacterium bovis subsp bovis AF2122/97
ccagcgccugcgccc

SEQ ID NO: 3122747 - RNA, 14 nt, Mycobacterium bovis subsp bovis AF2122/97
ccagcgccugcgcg

SEQ ID NO: 3122748 - RNA, 22 nt, Mycobacterium bovis subsp bovis AF2122/97
ccagcgccuugacgccaguugc

SEQ ID NO: 3122749 - RNA, 23 nt, Mycobacterium bovis subsp bovis AF2122/97
ccagcgcgacguccaccagccgg

SEQ ID NO: 3122750 - RNA, 14 nt, Mycobacterium bovis subsp bovis AF2122/97
ccagcgcgagcccg

SEQ ID NO: 3122751 - RNA, 23 nt, Mycobacterium bovis subsp bovis AF2122/97
ccagcgcgagcccgaaccaccgc

SEQ ID NO: 3122752 - RNA, 17 nt, Mycobacterium bovis subsp bovis AF2122/97
ccagcgcgccacgagca

SEQ ID NO: 3122753 - RNA, 19 nt, Mycobacterium bovis subsp bovis AF2122/97
ccagcgcgcccgcggccgc

SEQ ID NO: 3122754 - RNA, 21 nt, Mycobacterium bovis subsp bovis AF2122/97
ccagcgcgcccgcggccgcca

SEQ ID NO: 3122755 - RNA, 12 nt, Mycobacterium bovis subsp bovis AF2122/97
ccagcgcgccga

SEQ ID NO: 3122756 - RNA, 15 nt, Mycobacterium bovis subsp bovis AF2122/97
ccagcgcgccguaga

SEQ ID NO: 3122757 - RNA, 13 nt, Mycobacterium bovis subsp bovis AF2122/97
ccagcgcgcgccg

SEQ ID NO: 3122758 - RNA, 14 nt, Mycobacterium bovis subsp bovis AF2122/97
ccagcgcgcgccga

SEQ ID NO: 3122759 - RNA, 15 nt, Mycobacterium bovis subsp bovis AF2122/97
ccagcgcgcgccgca

SEQ ID NO: 3122760 - RNA, 13 nt, Mycobacterium bovis subsp bovis AF2122/97
ccagcgcgcgcgg

SEQ ID NO: 3122761 - RNA, 18 nt, Mycobacterium bovis subsp bovis AF2122/97
ccagcgcgcgcugagccg

SEQ ID NO: 3122762 - RNA, 19 nt, Mycobacterium bovis subsp bovis AF2122/97
ccagcgcgcgcugagccgu

SEQ ID NO: 3122763 - RNA, 17 nt, Mycobacterium bovis subsp bovis AF2122/97
ccagcgcgcugcgcgac

SEQ ID NO: 3122764 - RNA, 17 nt, Mycobacterium bovis subsp bovis AF2122/97
ccagcgcggcaacuccg

SEQ ID NO: 3122765 - RNA, 14 nt, Mycobacterium bovis subsp bovis AF2122/97
ccagcgcggccuug

SEQ ID NO: 3122766 - RNA, 12 nt, Mycobacterium bovis subsp bovis AF2122/97
ccagcgcggcgc

SEQ ID NO: 3122767 - RNA, 16 nt, Mycobacterium bovis subsp bovis AF2122/97
ccagcgcggcgcgcgg

SEQ ID NO: 3122768 - RNA, 13 nt, Mycobacterium bovis subsp bovis AF2122/97
ccagcgcggcguc

SEQ ID NO: 3122769 - RNA, 14 nt, Mycobacterium bovis subsp bovis AF2122/97
ccagcgcggcgucg

SEQ ID NO: 3122770 - RNA, 15 nt, Mycobacterium bovis subsp bovis AF2122/97
ccagcgcggugucgg

SEQ ID NO: 3122771 - RNA, 16 nt, Mycobacterium bovis subsp bovis AF2122/97
ccagcgcgucgggaug

SEQ ID NO: 3122772 - RNA, 17 nt, Mycobacterium bovis subsp bovis AF2122/97
ccagcgcgucucguuga

SEQ ID NO: 3122773 - RNA, 16 nt, Mycobacterium bovis subsp bovis AF2122/97
ccagcgcuagccgggc

SEQ ID NO: 3122774 - RNA, 23 nt, Mycobacterium bovis subsp bovis AF2122/97
ccagcgcuagccgggcgcgccgg

SEQ ID NO: 3122775 - RNA, 15 nt, Mycobacterium bovis subsp bovis AF2122/97
ccagcgcucaccggc

SEQ ID NO: 3122776 - RNA, 16 nt, Mycobacterium bovis subsp bovis AF2122/97
ccagcgcuccagcacc

SEQ ID NO: 3122777 - RNA, 17 nt, Mycobacterium bovis subsp bovis AF2122/97
ccagcgcuccagcaccc

SEQ ID NO: 3122778 - RNA, 16 nt, Mycobacterium bovis subsp bovis AF2122/97
ccagcgcugcugccga

SEQ ID NO: 3122779 - RNA, 17 nt, Mycobacterium bovis subsp bovis AF2122/97
ccagcgcuucgucggcc

SEQ ID NO: 3122780 - RNA, 18 nt, Mycobacterium bovis subsp bovis AF2122/97
ccagcgcuuugaugccga

SEQ ID NO: 3122781 - RNA, 16 nt, Mycobacterium bovis subsp bovis AF2122/97
ccagcggaaucaccga

SEQ ID NO: 3122782 - RNA, 15 nt, Mycobacterium bovis subsp bovis AF2122/97
ccagcggagcgcccu

SEQ ID NO: 3122783 - RNA, 21 nt, Mycobacterium bovis subsp bovis AF2122/97
ccagcggaguaaacaaaccca

SEQ ID NO: 3122784 - RNA, 19 nt, Mycobacterium bovis subsp bovis AF2122/97
ccagcggauuugccccguu

SEQ ID NO: 3122785 - RNA, 17 nt, Mycobacterium bovis subsp bovis AF2122/97
ccagcggcaauggccag

SEQ ID NO: 3122786 - RNA, 19 nt, Mycobacterium bovis subsp bovis AF2122/97
ccagcggcaauggccagca

SEQ ID NO: 3122787 - RNA, 21 nt, Mycobacterium bovis subsp bovis AF2122/97
ccagcggcaauggccagcacc

SEQ ID NO: 3122788 - RNA, 17 nt, Mycobacterium bovis subsp bovis AF2122/97
ccagcggcaccgcgccg

SEQ ID NO: 3122789 - RNA, 19 nt, Mycobacterium bovis subsp bovis AF2122/97
ccagcggcaccgcgccggc

SEQ ID NO: 3122790 - RNA, 15 nt, Mycobacterium bovis subsp bovis AF2122/97
ccagcggcaccgcgg

SEQ ID NO: 3122791 - RNA, 16 nt, Mycobacterium bovis subsp bovis AF2122/97
ccagcggcaccgcggc

SEQ ID NO: 3122792 - RNA, 20 nt, Mycobacterium bovis subsp bovis AF2122/97
ccagcggcaccgcggccagc

SEQ ID NO: 3122793 - RNA, 21 nt, Mycobacterium bovis subsp bovis AF2122/97
ccagcggcaccgcggccagcg

SEQ ID NO: 3122794 - RNA, 17 nt, Mycobacterium bovis subsp bovis AF2122/97
ccagcggccaccgaggc

SEQ ID NO: 3122795 - RNA, 14 nt, Mycobacterium bovis subsp bovis AF2122/97
ccagcggcccguca

SEQ ID NO: 3122796 - RNA, 18 nt, Mycobacterium bovis subsp bovis AF2122/97
ccagcggcccgucaccgc

SEQ ID NO: 3122797 - RNA, 21 nt, Mycobacterium bovis subsp bovis AF2122/97
ccagcggcccgucaccgcggg

SEQ ID NO: 3122798 - RNA, 18 nt, Mycobacterium bovis subsp bovis AF2122/97
ccagcggccgccgcggcu

SEQ ID NO: 3122799 - RNA, 13 nt, Mycobacterium bovis subsp bovis AF2122/97
ccagcggccgcga

SEQ ID NO: 3122800 - RNA, 15 nt, Mycobacterium bovis subsp bovis AF2122/97
ccagcggcgagucca

SEQ ID NO: 3122801 - RNA, 15 nt, Mycobacterium bovis subsp bovis AF2122/97
ccagcggcgccacgu

SEQ ID NO: 3122802 - RNA, 13 nt, Mycobacterium bovis subsp bovis AF2122/97
ccagcggcgcgac

SEQ ID NO: 3122803 - RNA, 17 nt, Mycobacterium bovis subsp bovis AF2122/97
ccagcggcggcaacggu

SEQ ID NO: 3122804 - RNA, 19 nt, Mycobacterium bovis subsp bovis AF2122/97
ccagcggcggcaacggugg

SEQ ID NO: 3122805 - RNA, 12 nt, Mycobacterium bovis subsp bovis AF2122/97
ccagcggcggcc

SEQ ID NO: 3122806 - RNA, 13 nt, Mycobacterium bovis subsp bovis AF2122/97
ccagcggcggccc

SEQ ID NO: 3122807 - RNA, 17 nt, Mycobacterium bovis subsp bovis AF2122/97
ccagcggcugaccgggc

SEQ ID NO: 3122808 - RNA, 23 nt, Mycobacterium bovis subsp bovis AF2122/97
ccagcggcugcccaucggugauc

SEQ ID NO: 3122809 - RNA, 23 nt, Mycobacterium bovis subsp bovis AF2122/97
ccagcgggacaaaaucagcagcc

SEQ ID NO: 3122810 - RNA, 19 nt, Mycobacterium bovis subsp bovis AF2122/97
ccagcgggcauaacccgca

SEQ ID NO: 3122811 - RNA, 19 nt, Mycobacterium bovis subsp bovis AF2122/97
ccagcgggcgaugagcgcg

SEQ ID NO: 3122812 - RNA, 13 nt, Mycobacterium bovis subsp bovis AF2122/97
ccagcggggucuu

SEQ ID NO: 3122813 - RNA, 14 nt, Mycobacterium bovis subsp bovis AF2122/97
ccagcgggucgcgg

SEQ ID NO: 3122814 - RNA, 18 nt, Mycobacterium bovis subsp bovis AF2122/97
ccagcgggucgcgggugc

SEQ ID NO: 3122815 - RNA, 21 nt, Mycobacterium bovis subsp bovis AF2122/97
ccagcgggucggcggugccgu

SEQ ID NO: 3122816 - RNA, 16 nt, Mycobacterium bovis subsp bovis AF2122/97
ccagcgggugagguca

SEQ ID NO: 3122817 - RNA, 24 nt, Mycobacterium bovis subsp bovis AF2122/97
ccagcgguaaugccagcggcacac

SEQ ID NO: 3122818 - RNA, 17 nt, Mycobacterium bovis subsp bovis AF2122/97
ccagcgguagccgagcu

SEQ ID NO: 3122819 - RNA, 18 nt, Mycobacterium bovis subsp bovis AF2122/97
ccagcggucagccggcca

SEQ ID NO: 3122820 - RNA, 22 nt, Mycobacterium bovis subsp bovis AF2122/97
ccagcggucggcgaccaccagc

SEQ ID NO: 3122821 - RNA, 23 nt, Mycobacterium bovis subsp bovis AF2122/97
ccagcggucggcgaccaccagcg

SEQ ID NO: 3122822 - RNA, 17 nt, Mycobacterium bovis subsp bovis AF2122/97
ccagcgguggaccaccg

SEQ ID NO: 3122823 - RNA, 22 nt, Mycobacterium bovis subsp bovis AF2122/97
ccagcgguucggugaucgggca

SEQ ID NO: 3122824 - RNA, 22 nt, Mycobacterium bovis subsp bovis AF2122/97
ccagcguaaauagcgcccugcc

SEQ ID NO: 3122825 - RNA, 17 nt, Mycobacterium bovis subsp bovis AF2122/97
ccagcguaucggccggc

SEQ ID NO: 3122826 - RNA, 18 nt, Mycobacterium bovis subsp bovis AF2122/97
ccagcguaucggccggca

SEQ ID NO: 3122827 - RNA, 16 nt, Mycobacterium bovis subsp bovis AF2122/97
ccagcgucaccucacc

SEQ ID NO: 3122828 - RNA, 15 nt, Mycobacterium bovis subsp bovis AF2122/97
ccagcguccaaccca

SEQ ID NO: 3122829 - RNA, 22 nt, Mycobacterium bovis subsp bovis AF2122/97
ccagcguccauggucgcgccac

SEQ ID NO: 3122830 - RNA, 16 nt, Mycobacterium bovis subsp bovis AF2122/97
ccagcgucgacacacc

SEQ ID NO: 3122831 - RNA, 15 nt, Mycobacterium bovis subsp bovis AF2122/97
ccagcgucgcaaggc

SEQ ID NO: 3122832 - RNA, 18 nt, Mycobacterium bovis subsp bovis AF2122/97
ccagcgucgcacgcgcgc

SEQ ID NO: 3122833 - RNA, 14 nt, Mycobacterium bovis subsp bovis AF2122/97
ccagcgucgccgcc

SEQ ID NO: 3122834 - RNA, 15 nt, Mycobacterium bovis subsp bovis AF2122/97
ccagcgucgccgcca

SEQ ID NO: 3122835 - RNA, 18 nt, Mycobacterium bovis subsp bovis AF2122/97
ccagcgucgccgccaggu

SEQ ID NO: 3122836 - RNA, 20 nt, Mycobacterium bovis subsp bovis AF2122/97
ccagcgucgccgccagguug

SEQ ID NO: 3122837 - RNA, 20 nt, Mycobacterium bovis subsp bovis AF2122/97
ccagcgucgcgauugccgcg

SEQ ID NO: 3122838 - RNA, 23 nt, Mycobacterium bovis subsp bovis AF2122/97
ccagcgucgcggccacggucagc

SEQ ID NO: 3122839 - RNA, 15 nt, Mycobacterium bovis subsp bovis AF2122/97
ccagcgucucaaggc

SEQ ID NO: 3122840 - RNA, 21 nt, Mycobacterium bovis subsp bovis AF2122/97
ccagcgucucaaggccuuuca

SEQ ID NO: 3122841 - RNA, 17 nt, Mycobacterium bovis subsp bovis AF2122/97
ccagcgucucgaucacc

SEQ ID NO: 3122842 - RNA, 21 nt, Mycobacterium bovis subsp bovis AF2122/97
ccagcgugaacugagggcgga

SEQ ID NO: 3122843 - RNA, 15 nt, Mycobacterium bovis subsp bovis AF2122/97
ccagcgugcccgcca

SEQ ID NO: 3122844 - RNA, 21 nt, Mycobacterium bovis subsp bovis AF2122/97
ccagcgugcccgccaccggcg

SEQ ID NO: 3122845 - RNA, 15 nt, Mycobacterium bovis subsp bovis AF2122/97
ccagcguggggccgc

SEQ ID NO: 3122846 - RNA, 16 nt, Mycobacterium bovis subsp bovis AF2122/97
ccagcguggggccgcc

SEQ ID NO: 3122847 - RNA, 17 nt, Mycobacterium bovis subsp bovis AF2122/97
ccagcguggggccgcca

SEQ ID NO: 3122848 - RNA, 21 nt, Mycobacterium bovis subsp bovis AF2122/97
ccagcguggugaagucggugc

SEQ ID NO: 3122849 - RNA, 23 nt, Mycobacterium bovis subsp bovis AF2122/97
ccagcguggugaagucggugccg

SEQ ID NO: 3122850 - RNA, 19 nt, Mycobacterium bovis subsp bovis AF2122/97
ccagcguguagcgaugccg

SEQ ID NO: 3122851 - RNA, 14 nt, Mycobacterium bovis subsp bovis AF2122/97
ccagcguguccgcc

SEQ ID NO: 3122852 - RNA, 22 nt, Mycobacterium bovis subsp bovis AF2122/97
ccagcgugucuugucgcgcagc

SEQ ID NO: 3122853 - RNA, 17 nt, Mycobacterium bovis subsp bovis AF2122/97
ccagcguucccgccggc

SEQ ID NO: 3122854 - RNA, 18 nt, Mycobacterium bovis subsp bovis AF2122/97
ccagcguucccgccggcu

SEQ ID NO: 3122855 - RNA, 19 nt, Mycobacterium bovis subsp bovis AF2122/97
ccagcguuggcggcgaucc

SEQ ID NO: 3122856 - RNA, 20 nt, Mycobacterium bovis subsp bovis AF2122/97
ccagcguuggcggcgaucca

SEQ ID NO: 3122857 - RNA, 21 nt, Mycobacterium bovis subsp bovis AF2122/97
ccagcguuugaacgcaugcga

SEQ ID NO: 3122858 - RNA, 14 nt, Mycobacterium bovis subsp bovis AF2122/97
ccagcguuugcugg

SEQ ID NO: 3122859 - RNA, 15 nt, Mycobacterium bovis subsp bovis AF2122/97
ccagcuagguccgaa

SEQ ID NO: 3122860 - RNA, 22 nt, Mycobacterium bovis subsp bovis AF2122/97
ccagcuauugcuauuccgcggc

SEQ ID NO: 3122861 - RNA, 22 nt, Mycobacterium bovis subsp bovis AF2122/97
ccagcucacccggagcacccgg

SEQ ID NO: 3122862 - RNA, 23 nt, Mycobacterium bovis subsp bovis AF2122/97
ccagcucacccggagcacccggg

SEQ ID NO: 3122863 - RNA, 14 nt, Mycobacterium bovis subsp bovis AF2122/97
ccagcucacccugc

SEQ ID NO: 3122864 - RNA, 16 nt, Mycobacterium bovis subsp bovis AF2122/97
ccagcucacgaugucg

SEQ ID NO: 3122865 - RNA, 20 nt, Mycobacterium bovis subsp bovis AF2122/97
ccagcucacggacgcugggc

SEQ ID NO: 3122866 - RNA, 16 nt, Mycobacterium bovis subsp bovis AF2122/97
ccagcucagcugcgga

SEQ ID NO: 3122867 - RNA, 15 nt, Mycobacterium bovis subsp bovis AF2122/97
ccagcuccacaagua

SEQ ID NO: 3122868 - RNA, 20 nt, Mycobacterium bovis subsp bovis AF2122/97
ccagcucccgggcggcggcc

SEQ ID NO: 3122869 - RNA, 16 nt, Mycobacterium bovis subsp bovis AF2122/97
ccagcuccgccugccg

SEQ ID NO: 3122870 - RNA, 20 nt, Mycobacterium bovis subsp bovis AF2122/97
ccagcuccgggucgacgacg

SEQ ID NO: 3122871 - RNA, 20 nt, Mycobacterium bovis subsp bovis AF2122/97
ccagcuccucagccaccgcg

SEQ ID NO: 3122872 - RNA, 21 nt, Mycobacterium bovis subsp bovis AF2122/97
ccagcuccucagccaccgcgg

SEQ ID NO: 3122873 - RNA, 15 nt, Mycobacterium bovis subsp bovis AF2122/97
ccagcucgaacaggu

SEQ ID NO: 3122874 - RNA, 20 nt, Mycobacterium bovis subsp bovis AF2122/97
ccagcucgaacagguuggcc

SEQ ID NO: 3122875 - RNA, 14 nt, Mycobacterium bovis subsp bovis AF2122/97
ccagcucgcgcacc

SEQ ID NO: 3122876 - RNA, 15 nt, Mycobacterium bovis subsp bovis AF2122/97
ccagcucgcgcaccc

SEQ ID NO: 3122877 - RNA, 19 nt, Mycobacterium bovis subsp bovis AF2122/97
ccagcucgcgcacccagcc

SEQ ID NO: 3122878 - RNA, 20 nt, Mycobacterium bovis subsp bovis AF2122/97
ccagcucgcgcacccagccc

SEQ ID NO: 3122879 - RNA, 14 nt, Mycobacterium bovis subsp bovis AF2122/97
ccagcucgcgggcc

SEQ ID NO: 3122880 - RNA, 19 nt, Mycobacterium bovis subsp bovis AF2122/97
ccagcucgcgggccgcguc

SEQ ID NO: 3122881 - RNA, 18 nt, Mycobacterium bovis subsp bovis AF2122/97
ccagcucgcugcgcgccc

SEQ ID NO: 3122882 - RNA, 12 nt, Mycobacterium bovis subsp bovis AF2122/97
ccagcucggcac

SEQ ID NO: 3122883 - RNA, 17 nt, Mycobacterium bovis subsp bovis AF2122/97
ccagcucggcacccgcc

SEQ ID NO: 3122884 - RNA, 18 nt, Mycobacterium bovis subsp bovis AF2122/97
ccagcucggcacccgccg

SEQ ID NO: 3122885 - RNA, 19 nt, Mycobacterium bovis subsp bovis AF2122/97
ccagcucggcacccgccgg

SEQ ID NO: 3122886 - RNA, 15 nt, Mycobacterium bovis subsp bovis AF2122/97
ccagcucggccagug

SEQ ID NO: 3122887 - RNA, 17 nt, Mycobacterium bovis subsp bovis AF2122/97
ccagcucggcggcagcg

SEQ ID NO: 3122888 - RNA, 13 nt, Mycobacterium bovis subsp bovis AF2122/97
ccagcucggcggg

SEQ ID NO: 3122889 - RNA, 15 nt, Mycobacterium bovis subsp bovis AF2122/97
ccagcucggcgggcu

SEQ ID NO: 3122890 - RNA, 17 nt, Mycobacterium bovis subsp bovis AF2122/97
ccagcucggcgggcucg

SEQ ID NO: 3122891 - RNA, 19 nt, Mycobacterium bovis subsp bovis AF2122/97
ccagcucgggggcgccggc

SEQ ID NO: 3122892 - RNA, 22 nt, Mycobacterium bovis subsp bovis AF2122/97
ccagcucgggggcgccggcgcc

SEQ ID NO: 3122893 - RNA, 20 nt, Mycobacterium bovis subsp bovis AF2122/97
ccagcucggugcuguugcgc

SEQ ID NO: 3122894 - RNA, 16 nt, Mycobacterium bovis subsp bovis AF2122/97
ccagcucgucgacguc

SEQ ID NO: 3122895 - RNA, 20 nt, Mycobacterium bovis subsp bovis AF2122/97
ccagcucgucgagcugaucc

SEQ ID NO: 3122896 - RNA, 18 nt, Mycobacterium bovis subsp bovis AF2122/97
ccagcucgucgucggcgu

SEQ ID NO: 3122897 - RNA, 17 nt, Mycobacterium bovis subsp bovis AF2122/97
ccagcugacggcgcaac

SEQ ID NO: 3122898 - RNA, 14 nt, Mycobacterium bovis subsp bovis AF2122/97
ccagcugagccguc

SEQ ID NO: 3122899 - RNA, 15 nt, Mycobacterium bovis subsp bovis AF2122/97
ccagcugagccgucg

SEQ ID NO: 3122900 - RNA, 17 nt, Mycobacterium bovis subsp bovis AF2122/97
ccagcugagccgucggc

SEQ ID NO: 3122901 - RNA, 17 nt, Mycobacterium bovis subsp bovis AF2122/97
ccagcugagcggccggc

SEQ ID NO: 3122902 - RNA, 18 nt, Mycobacterium bovis subsp bovis AF2122/97
ccagcugagcggccggca

SEQ ID NO: 3122903 - RNA, 14 nt, Mycobacterium bovis subsp bovis AF2122/97
ccagcugagcuggc

SEQ ID NO: 3122904 - RNA, 15 nt, Mycobacterium bovis subsp bovis AF2122/97
ccagcugagcuggca

SEQ ID NO: 3122905 - RNA, 18 nt, Mycobacterium bovis subsp bovis AF2122/97
ccagcugcagcagacccg

SEQ ID NO: 3122906 - RNA, 20 nt, Mycobacterium bovis subsp bovis AF2122/97
ccagcugcagcagacccggu

SEQ ID NO: 3122907 - RNA, 15 nt, Mycobacterium bovis subsp bovis AF2122/97
ccagcugccggcgac

SEQ ID NO: 3122908 - RNA, 14 nt, Mycobacterium bovis subsp bovis AF2122/97
ccagcugcgagucg

SEQ ID NO: 3122909 - RNA, 22 nt, Mycobacterium bovis subsp bovis AF2122/97
ccagcugcgccgaacgcuccag

SEQ ID NO: 3122910 - RNA, 15 nt, Mycobacterium bovis subsp bovis AF2122/97
ccagcugcgcgaugu

SEQ ID NO: 3122911 - RNA, 13 nt, Mycobacterium bovis subsp bovis AF2122/97
ccagcugcucguc

SEQ ID NO: 3122912 - RNA, 21 nt, Mycobacterium bovis subsp bovis AF2122/97
ccagcugcucgucgucgaucc

SEQ ID NO: 3122913 - RNA, 19 nt, Mycobacterium bovis subsp bovis AF2122/97
ccagcuggccgggugcgug

SEQ ID NO: 3122914 - RNA, 14 nt, Mycobacterium bovis subsp bovis AF2122/97
ccagcugggcagcc

SEQ ID NO: 3122915 - RNA, 18 nt, Mycobacterium bovis subsp bovis AF2122/97
ccagcuguacaacgccgu

SEQ ID NO: 3122916 - RNA, 18 nt, Mycobacterium bovis subsp bovis AF2122/97
ccagcugucauccccggc

SEQ ID NO: 3122917 - RNA, 13 nt, Mycobacterium bovis subsp bovis AF2122/97
ccaggcccagccg

SEQ ID NO: 3122918 - RNA, 18 nt, Mycobacterium bovis subsp bovis AF2122/97
ccaggcccagccgagcgg

SEQ ID NO: 3122919 - RNA, 20 nt, Mycobacterium bovis subsp bovis AF2122/97
ccaggcccauacgugccgcc

SEQ ID NO: 3122920 - RNA, 19 nt, Mycobacterium bovis subsp bovis AF2122/97
ccaggcccaucucgggcag

SEQ ID NO: 3122921 - RNA, 18 nt, Mycobacterium bovis subsp bovis AF2122/97
ccaggcccccucggcgug

SEQ ID NO: 3122922 - RNA, 20 nt, Mycobacterium bovis subsp bovis AF2122/97
ccaggcccccucggcgugau

SEQ ID NO: 3122923 - RNA, 23 nt, Mycobacterium bovis subsp bovis AF2122/97
ccaggcccccucggcgugaucac

SEQ ID NO: 3122924 - RNA, 16 nt, Mycobacterium bovis subsp bovis AF2122/97
ccaggcccgacacggc

SEQ ID NO: 3122925 - RNA, 16 nt, Mycobacterium bovis subsp bovis AF2122/97
ccaggcccucgacggc

SEQ ID NO: 3122926 - RNA, 19 nt, Mycobacterium bovis subsp bovis AF2122/97
ccaggcccucgacggcguc

SEQ ID NO: 3122927 - RNA, 23 nt, Mycobacterium bovis subsp bovis AF2122/97
ccaggcccucgacggcgucgacu

SEQ ID NO: 3122928 - RNA, 15 nt, Mycobacterium bovis subsp bovis AF2122/97
ccaggcccuggccag

SEQ ID NO: 3122929 - RNA, 13 nt, Mycobacterium bovis subsp bovis AF2122/97
ccaggccgagccg

SEQ ID NO: 3122930 - RNA, 14 nt, Mycobacterium bovis subsp bovis AF2122/97
ccaggccgagccgc

SEQ ID NO: 3122931 - RNA, 14 nt, Mycobacterium bovis subsp bovis AF2122/97
ccaggccgagcucg

SEQ ID NO: 3122932 - RNA, 16 nt, Mycobacterium bovis subsp bovis AF2122/97
ccaggccgagcucguu

SEQ ID NO: 3122933 - RNA, 17 nt, Mycobacterium bovis subsp bovis AF2122/97
ccaggccgaucagcgcg

SEQ ID NO: 3122934 - RNA, 21 nt, Mycobacterium bovis subsp bovis AF2122/97
ccaggccgaucagcgcggcgc

SEQ ID NO: 3122935 - RNA, 24 nt, Mycobacterium bovis subsp bovis AF2122/97
ccaggccgcaaugcguugaccgau

SEQ ID NO: 3122936 - RNA, 15 nt, Mycobacterium bovis subsp bovis AF2122/97
ccaggccgcacagca

SEQ ID NO: 3122937 - RNA, 14 nt, Mycobacterium bovis subsp bovis AF2122/97
ccaggccgccgcca

SEQ ID NO: 3122938 - RNA, 20 nt, Mycobacterium bovis subsp bovis AF2122/97
ccaggccgcgacaauggugc

SEQ ID NO: 3122939 - RNA, 13 nt, Mycobacterium bovis subsp bovis AF2122/97
ccaggccgcgcga

SEQ ID NO: 3122940 - RNA, 14 nt, Mycobacterium bovis subsp bovis AF2122/97
ccaggccgcgcgac

SEQ ID NO: 3122941 - RNA, 20 nt, Mycobacterium bovis subsp bovis AF2122/97
ccaggccgcgcgacaacccg

SEQ ID NO: 3122942 - RNA, 14 nt, Mycobacterium bovis subsp bovis AF2122/97
ccaggccgcgcgca

SEQ ID NO: 3122943 - RNA, 13 nt, Mycobacterium bovis subsp bovis AF2122/97
ccaggccggcagc

SEQ ID NO: 3122944 - RNA, 14 nt, Mycobacterium bovis subsp bovis AF2122/97
ccaggccggugacg

SEQ ID NO: 3122945 - RNA, 17 nt, Mycobacterium bovis subsp bovis AF2122/97
ccaggccguacgacggc

SEQ ID NO: 3122946 - RNA, 19 nt, Mycobacterium bovis subsp bovis AF2122/97
ccaggccguaguggccggc

SEQ ID NO: 3122947 - RNA, 20 nt, Mycobacterium bovis subsp bovis AF2122/97
ccaggccguccucggucagc

SEQ ID NO: 3122948 - RNA, 22 nt, Mycobacterium bovis subsp bovis AF2122/97
ccaggccguugcuauucgccag

SEQ ID NO: 3122949 - RNA, 15 nt, Mycobacterium bovis subsp bovis AF2122/97
ccaggccuaguccgg

SEQ ID NO: 3122950 - RNA, 23 nt, Mycobacterium bovis subsp bovis AF2122/97
ccaggccuaguccggcacugcgg

SEQ ID NO: 3122951 - RNA, 15 nt, Mycobacterium bovis subsp bovis AF2122/97
ccaggccucgcaccg

SEQ ID NO: 3122952 - RNA, 16 nt, Mycobacterium bovis subsp bovis AF2122/97
ccaggccucgcaccgg

SEQ ID NO: 3122953 - RNA, 17 nt, Mycobacterium bovis subsp bovis AF2122/97
ccaggcgaacagggcug

SEQ ID NO: 3122954 - RNA, 22 nt, Mycobacterium bovis subsp bovis AF2122/97
ccaggcgaagucgacucgccac

SEQ ID NO: 3122955 - RNA, 16 nt, Mycobacterium bovis subsp bovis AF2122/97
ccaggcgagccgccac

SEQ ID NO: 3122956 - RNA, 15 nt, Mycobacterium bovis subsp bovis AF2122/97
ccaggcgagccggcg

SEQ ID NO: 3122957 - RNA, 19 nt, Mycobacterium bovis subsp bovis AF2122/97
ccaggcgagccggcgcgca

SEQ ID NO: 3122958 - RNA, 21 nt, Mycobacterium bovis subsp bovis AF2122/97
ccaggcgagugaacucguccu

SEQ ID NO: 3122959 - RNA, 18 nt, Mycobacterium bovis subsp bovis AF2122/97
ccaggcgauaaagccgcu

SEQ ID NO: 3122960 - RNA, 20 nt, Mycobacterium bovis subsp bovis AF2122/97
ccaggcgauaaagccgcuga

SEQ ID NO: 3122961 - RNA, 13 nt, Mycobacterium bovis subsp bovis AF2122/97
ccaggcgcagcug

SEQ ID NO: 3122962 - RNA, 23 nt, Mycobacterium bovis subsp bovis AF2122/97
ccaggcgcauagggccaccgccg

SEQ ID NO: 3122963 - RNA, 18 nt, Mycobacterium bovis subsp bovis AF2122/97
ccaggcgcgaucgcgccc

SEQ ID NO: 3122964 - RNA, 18 nt, Mycobacterium bovis subsp bovis AF2122/97
ccaggcgcgcaccaccgc

SEQ ID NO: 3122965 - RNA, 19 nt, Mycobacterium bovis subsp bovis AF2122/97
ccaggcgcgcaccaccgcg

SEQ ID NO: 3122966 - RNA, 23 nt, Mycobacterium bovis subsp bovis AF2122/97
ccaggcgcgcaccaccgcggcgg

SEQ ID NO: 3122967 - RNA, 12 nt, Mycobacterium bovis subsp bovis AF2122/97
ccaggcgcgccg

SEQ ID NO: 3122968 - RNA, 13 nt, Mycobacterium bovis subsp bovis AF2122/97
ccaggcgcgccgc

SEQ ID NO: 3122969 - RNA, 14 nt, Mycobacterium bovis subsp bovis AF2122/97
ccaggcgcgccgca

SEQ ID NO: 3122970 - RNA, 15 nt, Mycobacterium bovis subsp bovis AF2122/97
ccaggcgcgccgcac

SEQ ID NO: 3122971 - RNA, 21 nt, Mycobacterium bovis subsp bovis AF2122/97
ccaggcgcgcuaccagcucac

SEQ ID NO: 3122972 - RNA, 16 nt, Mycobacterium bovis subsp bovis AF2122/97
ccaggcgcucagcgcg

SEQ ID NO: 3122973 - RNA, 17 nt, Mycobacterium bovis subsp bovis AF2122/97
ccaggcgcucagcgcgg

SEQ ID NO: 3122974 - RNA, 23 nt, Mycobacterium bovis subsp bovis AF2122/97
ccaggcgcucagcgcggccacgc

SEQ ID NO: 3122975 - RNA, 13 nt, Mycobacterium bovis subsp bovis AF2122/97
ccaggcgcugcag

SEQ ID NO: 3122976 - RNA, 20 nt, Mycobacterium bovis subsp bovis AF2122/97
ccaggcgcugcagcauggcu

SEQ ID NO: 3122977 - RNA, 22 nt, Mycobacterium bovis subsp bovis AF2122/97
ccaggcgcugcagcauggcucc

SEQ ID NO: 3122978 - RNA, 17 nt, Mycobacterium bovis subsp bovis AF2122/97
ccaggcgcuuggccgga

SEQ ID NO: 3122979 - RNA, 15 nt, Mycobacterium bovis subsp bovis AF2122/97
ccaggcggacgccgc

SEQ ID NO: 3122980 - RNA, 20 nt, Mycobacterium bovis subsp bovis AF2122/97
ccaggcggcaauucgggcau

SEQ ID NO: 3122981 - RNA, 22 nt, Mycobacterium bovis subsp bovis AF2122/97
ccaggcggcgcgggucggcgac

SEQ ID NO: 3122982 - RNA, 15 nt, Mycobacterium bovis subsp bovis AF2122/97
ccaggcguccaucag

SEQ ID NO: 3122983 - RNA, 22 nt, Mycobacterium bovis subsp bovis AF2122/97
ccaggcgugcacaggucagcgc

SEQ ID NO: 3122984 - RNA, 15 nt, Mycobacterium bovis subsp bovis AF2122/97
ccaggcgugcaucgc

SEQ ID NO: 3122985 - RNA, 22 nt, Mycobacterium bovis subsp bovis AF2122/97
ccaggcgugucgucgcggccgg

SEQ ID NO: 3122986 - RNA, 13 nt, Mycobacterium bovis subsp bovis AF2122/97
ccaggcguucgac

SEQ ID NO: 3122987 - RNA, 21 nt, Mycobacterium bovis subsp bovis AF2122/97
ccaggcguuuggcgugccguc

SEQ ID NO: 3122988 - RNA, 21 nt, Mycobacterium bovis subsp bovis AF2122/97
ccaggcuaauagcucgccggc

SEQ ID NO: 3122989 - RNA, 16 nt, Mycobacterium bovis subsp bovis AF2122/97
ccaggcuccggccggc

SEQ ID NO: 3122990 - RNA, 21 nt, Mycobacterium bovis subsp bovis AF2122/97
ccaggcuccggccggccagca

SEQ ID NO: 3122991 - RNA, 22 nt, Mycobacterium bovis subsp bovis AF2122/97
ccaggcucgauguccucgagcc

SEQ ID NO: 3122992 - RNA, 23 nt, Mycobacterium bovis subsp bovis AF2122/97
ccaggcugaaaccuugcggcaga

SEQ ID NO: 3122993 - RNA, 19 nt, Mycobacterium bovis subsp bovis AF2122/97
ccaggcugaagaacgcguc

SEQ ID NO: 3122994 - RNA, 19 nt, Mycobacterium bovis subsp bovis AF2122/97
ccaggcuggcgucaccgcg

SEQ ID NO: 3122995 - RNA, 20 nt, Mycobacterium bovis subsp bovis AF2122/97
ccaggcuggcgucaccgcgg

SEQ ID NO: 3122996 - RNA, 17 nt, Mycobacterium bovis subsp bovis AF2122/97
ccaggcugguccgggug

SEQ ID NO: 3122997 - RNA, 14 nt, Mycobacterium bovis subsp bovis AF2122/97
ccaggcugucgcgg

SEQ ID NO: 3122998 - RNA, 23 nt, Mycobacterium bovis subsp bovis AF2122/97
ccaggcuguggccagcaucauca

SEQ ID NO: 3122999 - RNA, 20 nt, Mycobacterium bovis subsp bovis AF2122/97
ccaggcuugcggcacccagu

SEQ ID NO: 3123000 - RNA, 21 nt, Mycobacterium bovis subsp bovis AF2122/97
ccaggcuugcggcacccaguc

SEQ ID NO: 3123001 - RNA, 13 nt, Mycobacterium bovis subsp bovis AF2122/97
ccagggagcggcu

SEQ ID NO: 3123002 - RNA, 16 nt, Mycobacterium bovis subsp bovis AF2122/97
ccagggagcggcugca

SEQ ID NO: 3123003 - RNA, 16 nt, Mycobacterium bovis subsp bovis AF2122/97
ccaggucgugcccggg

SEQ ID NO: 3123004 - RNA, 22 nt, Mycobacterium bovis subsp bovis AF2122/97
ccaggucuccaucaaccgcgcu

SEQ ID NO: 3123005 - RNA, 16 nt, Mycobacterium bovis subsp bovis AF2122/97
ccaggucuucgaccac

SEQ ID NO: 3123006 - RNA, 15 nt, Mycobacterium bovis subsp bovis AF2122/97
ccaggugcagcacca

SEQ ID NO: 3123007 - RNA, 19 nt, Mycobacterium bovis subsp bovis AF2122/97
ccaggugcagcaccagcca

SEQ ID NO: 3123008 - RNA, 22 nt, Mycobacterium bovis subsp bovis AF2122/97
ccaggugcagcaccagccacgc

SEQ ID NO: 3123009 - RNA, 13 nt, Mycobacterium bovis subsp bovis AF2122/97
ccaggugcaggcu

SEQ ID NO: 3123010 - RNA, 17 nt, Mycobacterium bovis subsp bovis AF2122/97
ccaggugcccaagcagu

SEQ ID NO: 3123011 - RNA, 14 nt, Mycobacterium bovis subsp bovis AF2122/97
ccaggugcgccgug

SEQ ID NO: 3123012 - RNA, 18 nt, Mycobacterium bovis subsp bovis AF2122/97
ccaggugcguccaggcca

SEQ ID NO: 3123013 - RNA, 14 nt, Mycobacterium bovis subsp bovis AF2122/97
ccagguggaccggc

SEQ ID NO: 3123014 - RNA, 15 nt, Mycobacterium bovis subsp bovis AF2122/97
ccagguggaccggcc

SEQ ID NO: 3123015 - RNA, 16 nt, Mycobacterium bovis subsp bovis AF2122/97
ccagguggaccggccu

SEQ ID NO: 3123016 - RNA, 22 nt, Mycobacterium bovis subsp bovis AF2122/97
ccagguggaccggccuggcucg

SEQ ID NO: 3123017 - RNA, 14 nt, Mycobacterium bovis subsp bovis AF2122/97
ccagguggccaggc

SEQ ID NO: 3123018 - RNA, 15 nt, Mycobacterium bovis subsp bovis AF2122/97
ccagguggccgcucu

SEQ ID NO: 3123019 - RNA, 20 nt, Mycobacterium bovis subsp bovis AF2122/97
ccagguggccgcucuccacc

SEQ ID NO: 3123020 - RNA, 14 nt, Mycobacterium bovis subsp bovis AF2122/97
ccaggugggcagca

SEQ ID NO: 3123021 - RNA, 22 nt, Mycobacterium bovis subsp bovis AF2122/97
ccaggugggcagcaggcccacc

SEQ ID NO: 3123022 - RNA, 19 nt, Mycobacterium bovis subsp bovis AF2122/97
ccaggugggugaacgccug

SEQ ID NO: 3123023 - RNA, 20 nt, Mycobacterium bovis subsp bovis AF2122/97
ccaggugggugaacgccugc

SEQ ID NO: 3123024 - RNA, 22 nt, Mycobacterium bovis subsp bovis AF2122/97
ccagguguucgccggagacccg

SEQ ID NO: 3123025 - RNA, 23 nt, Mycobacterium bovis subsp bovis AF2122/97
ccagguguucgccggagacccgg

SEQ ID NO: 3123026 - RNA, 17 nt, Mycobacterium bovis subsp bovis AF2122/97
ccagguucaugcaaaag

SEQ ID NO: 3123027 - RNA, 23 nt, Mycobacterium bovis subsp bovis AF2122/97
ccagguucuucuccaccaccguc

SEQ ID NO: 3123028 - RNA, 17 nt, Mycobacterium bovis subsp bovis AF2122/97
ccagguugaucguggcg

SEQ ID NO: 3123029 - RNA, 23 nt, Mycobacterium bovis subsp bovis AF2122/97
ccagguugcaaccuugggcgccg

SEQ ID NO: 3123030 - RNA, 22 nt, Mycobacterium bovis subsp bovis AF2122/97
ccagguugccgucggccucggc

SEQ ID NO: 3123031 - RNA, 20 nt, Mycobacterium bovis subsp bovis AF2122/97
ccagguugccuuggcggcca

SEQ ID NO: 3123032 - RNA, 17 nt, Mycobacterium bovis subsp bovis AF2122/97
ccagguuggagcccgag

SEQ ID NO: 3123033 - RNA, 23 nt, Mycobacterium bovis subsp bovis AF2122/97
ccagguuguagacggcacccccg

SEQ ID NO: 3123034 - RNA, 21 nt, Mycobacterium bovis subsp bovis AF2122/97
ccagguugugauccugggugu

SEQ ID NO: 3123035 - RNA, 19 nt, Mycobacterium bovis subsp bovis AF2122/97
ccagguugugugacagccc

SEQ ID NO: 3123036 - RNA, 22 nt, Mycobacterium bovis subsp bovis AF2122/97
ccagguugugugacagcccgcu

SEQ ID NO: 3123037 - RNA, 16 nt, Mycobacterium bovis subsp bovis AF2122/97
ccagguuuugccgcgu

SEQ ID NO: 3123038 - RNA, 19 nt, Mycobacterium bovis subsp bovis AF2122/97
ccaguaccaccggcaccgg

SEQ ID NO: 3123039 - RNA, 21 nt, Mycobacterium bovis subsp bovis AF2122/97
ccaguaccaccggcaccggcc

SEQ ID NO: 3123040 - RNA, 22 nt, Mycobacterium bovis subsp bovis AF2122/97
ccaguaccacuguuacggccac

SEQ ID NO: 3123041 - RNA, 18 nt, Mycobacterium bovis subsp bovis AF2122/97
ccaguaccgucaucgcgg

SEQ ID NO: 3123042 - RNA, 20 nt, Mycobacterium bovis subsp bovis AF2122/97
ccaguagccggugccggcgc

SEQ ID NO: 3123043 - RNA, 21 nt, Mycobacterium bovis subsp bovis AF2122/97
ccaguagccggugccggcgca

SEQ ID NO: 3123044 - RNA, 23 nt, Mycobacterium bovis subsp bovis AF2122/97
ccaguaggcaagcauuuccgcga

SEQ ID NO: 3123045 - RNA, 13 nt, Mycobacterium bovis subsp bovis AF2122/97
ccaguaggcuucg

SEQ ID NO: 3123046 - RNA, 16 nt, Mycobacterium bovis subsp bovis AF2122/97
ccaguaugcggugccc

SEQ ID NO: 3123047 - RNA, 15 nt, Mycobacterium bovis subsp bovis AF2122/97
ccaguauggccgcca

SEQ ID NO: 3123048 - RNA, 18 nt, Mycobacterium bovis subsp bovis AF2122/97
ccaguauggccgccaccg

SEQ ID NO: 3123049 - RNA, 21 nt, Mycobacterium bovis subsp bovis AF2122/97
ccaguauggccgccaccgcga

SEQ ID NO: 3123050 - RNA, 16 nt, Mycobacterium bovis subsp bovis AF2122/97
ccagucacgcccacca

SEQ ID NO: 3123051 - RNA, 14 nt, Mycobacterium bovis subsp bovis AF2122/97
ccaguccaagcugu

SEQ ID NO: 3123052 - RNA, 22 nt, Mycobacterium bovis subsp bovis AF2122/97
ccaguccaaucuucucgagccg

SEQ ID NO: 3123053 - RNA, 14 nt, Mycobacterium bovis subsp bovis AF2122/97
ccaguccagcgcgc

SEQ ID NO: 3123054 - RNA, 16 nt, Mycobacterium bovis subsp bovis AF2122/97
ccaguccaugugccca

SEQ ID NO: 3123055 - RNA, 19 nt, Mycobacterium bovis subsp bovis AF2122/97
ccaguccaugugcccaggu

SEQ ID NO: 3123056 - RNA, 14 nt, Mycobacterium bovis subsp bovis AF2122/97
ccaguccccgccgg

SEQ ID NO: 3123057 - RNA, 16 nt, Mycobacterium bovis subsp bovis AF2122/97
ccaguccccgccggcc

SEQ ID NO: 3123058 - RNA, 15 nt, Mycobacterium bovis subsp bovis AF2122/97
ccagucccgcgucgg

SEQ ID NO: 3123059 - RNA, 17 nt, Mycobacterium bovis subsp bovis AF2122/97
ccaguccgaugggaauc

SEQ ID NO: 3123060 - RNA, 23 nt, Mycobacterium bovis subsp bovis AF2122/97
ccaguccgcgcgcaagucgaugu

SEQ ID NO: 3123061 - RNA, 16 nt, Mycobacterium bovis subsp bovis AF2122/97
ccaguccguccagguc

SEQ ID NO: 3123062 - RNA, 14 nt, Mycobacterium bovis subsp bovis AF2122/97
ccaguccucgggca

SEQ ID NO: 3123063 - RNA, 18 nt, Mycobacterium bovis subsp bovis AF2122/97
ccagucgaagaagacccg

SEQ ID NO: 3123064 - RNA, 20 nt, Mycobacterium bovis subsp bovis AF2122/97
ccagucgaagaagacccgug

SEQ ID NO: 3123065 - RNA, 14 nt, Mycobacterium bovis subsp bovis AF2122/97
ccagucgaaucguc

SEQ ID NO: 3123066 - RNA, 14 nt, Mycobacterium bovis subsp bovis AF2122/97
ccagucgaucgcgg

SEQ ID NO: 3123067 - RNA, 17 nt, Mycobacterium bovis subsp bovis AF2122/97
ccagucgaucgcggccc

SEQ ID NO: 3123068 - RNA, 16 nt, Mycobacterium bovis subsp bovis AF2122/97
ccagucgauguccugc

SEQ ID NO: 3123069 - RNA, 16 nt, Mycobacterium bovis subsp bovis AF2122/97
ccagucgcacgacguc

SEQ ID NO: 3123070 - RNA, 22 nt, Mycobacterium bovis subsp bovis AF2122/97
ccagucgcacgacgucaaucuc

SEQ ID NO: 3123071 - RNA, 20 nt, Mycobacterium bovis subsp bovis AF2122/97
ccagucgccccaagcgccug

SEQ ID NO: 3123072 - RNA, 15 nt, Mycobacterium bovis subsp bovis AF2122/97
ccagucgcgcagcgu

SEQ ID NO: 3123073 - RNA, 16 nt, Mycobacterium bovis subsp bovis AF2122/97
ccagucgcgcagcguc

SEQ ID NO: 3123074 - RNA, 13 nt, Mycobacterium bovis subsp bovis AF2122/97
ccagucgcggcgc

SEQ ID NO: 3123075 - RNA, 14 nt, Mycobacterium bovis subsp bovis AF2122/97
ccagucgcggcguu

SEQ ID NO: 3123076 - RNA, 12 nt, Mycobacterium bovis subsp bovis AF2122/97
ccagucggccac

SEQ ID NO: 3123077 - RNA, 21 nt, Mycobacterium bovis subsp bovis AF2122/97
ccagucggccaccuggucggc

SEQ ID NO: 3123078 - RNA, 12 nt, Mycobacterium bovis subsp bovis AF2122/97
ccagucggcgcc

SEQ ID NO: 3123079 - RNA, 14 nt, Mycobacterium bovis subsp bovis AF2122/97
ccagucggcgccgc

SEQ ID NO: 3123080 - RNA, 16 nt, Mycobacterium bovis subsp bovis AF2122/97
ccagucggcgccgccg

SEQ ID NO: 3123081 - RNA, 20 nt, Mycobacterium bovis subsp bovis AF2122/97
ccagucggcgccgccgucca

SEQ ID NO: 3123082 - RNA, 22 nt, Mycobacterium bovis subsp bovis AF2122/97
ccagucguacucccaggccgcc

SEQ ID NO: 3123083 - RNA, 23 nt, Mycobacterium bovis subsp bovis AF2122/97
ccagucuuguugugcugcaccgu

SEQ ID NO: 3123084 - RNA, 19 nt, Mycobacterium bovis subsp bovis AF2122/97
ccagugaaaccaccggccg

SEQ ID NO: 3123085 - RNA, 21 nt, Mycobacterium bovis subsp bovis AF2122/97
ccagugaaucggaccgaccgg

SEQ ID NO: 3123086 - RNA, 22 nt, Mycobacterium bovis subsp bovis AF2122/97
ccagugaccgcagucccagcac

SEQ ID NO: 3123087 - RNA, 19 nt, Mycobacterium bovis subsp bovis AF2122/97
ccagugaccguauuucguc

SEQ ID NO: 3123088 - RNA, 15 nt, Mycobacterium bovis subsp bovis AF2122/97
ccagugacucaccgu

SEQ ID NO: 3123089 - RNA, 20 nt, Mycobacterium bovis subsp bovis AF2122/97
ccaucaacauugugcucgcc

SEQ ID NO: 3123090 - RNA, 21 nt, Mycobacterium bovis subsp bovis AF2122/97
ccaucaacauugugcucgccg

SEQ ID NO: 3123091 - RNA, 12 nt, Mycobacterium bovis subsp bovis AF2122/97
ccaucaaccgcg

SEQ ID NO: 3123092 - RNA, 17 nt, Mycobacterium bovis subsp bovis AF2122/97
ccaucaacgccggcgac

SEQ ID NO: 3123093 - RNA, 15 nt, Mycobacterium bovis subsp bovis AF2122/97
ccaucaacugcauca

SEQ ID NO: 3123094 - RNA, 19 nt, Mycobacterium bovis subsp bovis AF2122/97
ccaucaacugcaucaccac

SEQ ID NO: 3123095 - RNA, 20 nt, Mycobacterium bovis subsp bovis AF2122/97
ccaucaacugcaucaccacu

SEQ ID NO: 3123096 - RNA, 16 nt, Mycobacterium bovis subsp bovis AF2122/97
ccaucaaggccaccuc

SEQ ID NO: 3123097 - RNA, 13 nt, Mycobacterium bovis subsp bovis AF2122/97
ccaucaaggucau

SEQ ID NO: 3123098 - RNA, 16 nt, Mycobacterium bovis subsp bovis AF2122/97
ccaucacauccacgca

SEQ ID NO: 3123099 - RNA, 18 nt, Mycobacterium bovis subsp bovis AF2122/97
ccaucacaucggccucug

SEQ ID NO: 3123100 - RNA, 20 nt, Mycobacterium bovis subsp bovis AF2122/97
ccaucaccacaccggcagcu

SEQ ID NO: 3123101 - RNA, 15 nt, Mycobacterium bovis subsp bovis AF2122/97
ccaucaccaccggca

SEQ ID NO: 3123102 - RNA, 19 nt, Mycobacterium bovis subsp bovis AF2122/97
ccaucaccaccggcaccgc

SEQ ID NO: 3123103 - RNA, 15 nt, Mycobacterium bovis subsp bovis AF2122/97
ccaucaccccggccu

SEQ ID NO: 3123104 - RNA, 17 nt, Mycobacterium bovis subsp bovis AF2122/97
ccaucaccccggccuug

SEQ ID NO: 3123105 - RNA, 21 nt, Mycobacterium bovis subsp bovis AF2122/97
ccaucacccuguuugcccaac

SEQ ID NO: 3123106 - RNA, 13 nt, Mycobacterium bovis subsp bovis AF2122/97
ccaucaccgcaag

SEQ ID NO: 3123107 - RNA, 12 nt, Mycobacterium bovis subsp bovis AF2122/97
ccaucaccgcca

SEQ ID NO: 3123108 - RNA, 13 nt, Mycobacterium bovis subsp bovis AF2122/97
ccaucaccgccag

SEQ ID NO: 3123109 - RNA, 14 nt, Mycobacterium bovis subsp bovis AF2122/97
ccaucaccgccagc

SEQ ID NO: 3123110 - RNA, 19 nt, Mycobacterium bovis subsp bovis AF2122/97
ccaucaccgccagccccgc

SEQ ID NO: 3123111 - RNA, 21 nt, Mycobacterium bovis subsp bovis AF2122/97
ccaucaccgcgccagccucca

SEQ ID NO: 3123112 - RNA, 14 nt, Mycobacterium bovis subsp bovis AF2122/97
ccaucaccggcggc

SEQ ID NO: 3123113 - RNA, 16 nt, Mycobacterium bovis subsp bovis AF2122/97
ccaucaccggcggccc

SEQ ID NO: 3123114 - RNA, 20 nt, Mycobacterium bovis subsp bovis AF2122/97
ccaucacgacucccccggcu

SEQ ID NO: 3123115 - RNA, 12 nt, Mycobacterium bovis subsp bovis AF2122/97
ccaucacgcccu

SEQ ID NO: 3123116 - RNA, 15 nt, Mycobacterium bovis subsp bovis AF2122/97
ccaucacggaccagg

SEQ ID NO: 3123117 - RNA, 16 nt, Mycobacterium bovis subsp bovis AF2122/97
ccaucacggaccaggc

SEQ ID NO: 3123118 - RNA, 17 nt, Mycobacterium bovis subsp bovis AF2122/97
ccaucacggucagcucg

SEQ ID NO: 3123119 - RNA, 14 nt, Mycobacterium bovis subsp bovis AF2122/97
ccaucacgguggcc

SEQ ID NO: 3123120 - RNA, 16 nt, Mycobacterium bovis subsp bovis AF2122/97
ccaucagaaccuccuc

SEQ ID NO: 3123121 - RNA, 22 nt, Mycobacterium bovis subsp bovis AF2122/97
ccaucagaaugccuggcccguc

SEQ ID NO: 3123122 - RNA, 13 nt, Mycobacterium bovis subsp bovis AF2122/97
ccaucagcccggc

SEQ ID NO: 3123123 - RNA, 14 nt, Mycobacterium bovis subsp bovis AF2122/97
ccaucagcccggcg

SEQ ID NO: 3123124 - RNA, 21 nt, Mycobacterium bovis subsp bovis AF2122/97
ccaucagccgcugcguagugu

SEQ ID NO: 3123125 - RNA, 14 nt, Mycobacterium bovis subsp bovis AF2122/97
ccaucagcgcgacc

SEQ ID NO: 3123126 - RNA, 14 nt, Mycobacterium bovis subsp bovis AF2122/97
ccaucagcgucgac

SEQ ID NO: 3123127 - RNA, 15 nt, Mycobacterium bovis subsp bovis AF2122/97
ccaucaucaccucuc

SEQ ID NO: 3123128 - RNA, 17 nt, Mycobacterium bovis subsp bovis AF2122/97
ccaucauggcggcccgg

SEQ ID NO: 3123129 - RNA, 15 nt, Mycobacterium bovis subsp bovis AF2122/97
ccaucaugugcgcga

SEQ ID NO: 3123130 - RNA, 22 nt, Mycobacterium bovis subsp bovis AF2122/97
ccaucaugugcgcgaccacccg

SEQ ID NO: 3123131 - RNA, 22 nt, Mycobacterium bovis subsp bovis AF2122/97
ccauccccuugguggccagcca

SEQ ID NO: 3123132 - RNA, 16 nt, Mycobacterium bovis subsp bovis AF2122/97
ccaucccgaucccggc

SEQ ID NO: 3123133 - RNA, 15 nt, Mycobacterium bovis subsp bovis AF2122/97
ccaucccgauccugc

SEQ ID NO: 3123134 - RNA, 22 nt, Mycobacterium bovis subsp bovis AF2122/97
ccaucccgauccugcccaccau

SEQ ID NO: 3123135 - RNA, 19 nt, Mycobacterium bovis subsp bovis AF2122/97
ccaucccgauccuggccac

SEQ ID NO: 3123136 - RNA, 21 nt, Mycobacterium bovis subsp bovis AF2122/97
ccaucccgccgcccgcaucgc

SEQ ID NO: 3123137 - RNA, 13 nt, Mycobacterium bovis subsp bovis AF2122/97
ccaucccggccga

SEQ ID NO: 3123138 - RNA, 14 nt, Mycobacterium bovis subsp bovis AF2122/97
ccaucccggcgccg

SEQ ID NO: 3123139 - RNA, 15 nt, Mycobacterium bovis subsp bovis AF2122/97
ccaucccggcgccgc

SEQ ID NO: 3123140 - RNA, 16 nt, Mycobacterium bovis subsp bovis AF2122/97
ccaucccguucagcga

SEQ ID NO: 3123141 - RNA, 22 nt, Mycobacterium bovis subsp bovis AF2122/97
ccaucccugaaauaccaguccg

SEQ ID NO: 3123142 - RNA, 13 nt, Mycobacterium bovis subsp bovis AF2122/97
ccauccgaguugu

SEQ ID NO: 3123143 - RNA, 22 nt, Mycobacterium bovis subsp bovis AF2122/97
ccauccgauggcccggcucaca

SEQ ID NO: 3123144 - RNA, 21 nt, Mycobacterium bovis subsp bovis AF2122/97
ccauccggccgucgggcagca

SEQ ID NO: 3123145 - RNA, 13 nt, Mycobacterium bovis subsp bovis AF2122/97
ccauccggcggcg

SEQ ID NO: 3123146 - RNA, 22 nt, Mycobacterium bovis subsp bovis AF2122/97
ccauccggcggcggccaggaug

SEQ ID NO: 3123147 - RNA, 17 nt, Mycobacterium bovis subsp bovis AF2122/97
ccauccgggccgcggcc

SEQ ID NO: 3123148 - RNA, 18 nt, Mycobacterium bovis subsp bovis AF2122/97
ccauccgggccgcggcca

SEQ ID NO: 3123149 - RNA, 12 nt, Mycobacterium bovis subsp bovis AF2122/97
ccauccggucga

SEQ ID NO: 3123150 - RNA, 16 nt, Mycobacterium bovis subsp bovis AF2122/97
ccauccggucggucuc

SEQ ID NO: 3123151 - RNA, 20 nt, Mycobacterium bovis subsp bovis AF2122/97
ccauccggucggucucggcg

SEQ ID NO: 3123152 - RNA, 22 nt, Mycobacterium bovis subsp bovis AF2122/97
ccauccucgagcugcuggcgcg

SEQ ID NO: 3123153 - RNA, 17 nt, Mycobacterium bovis subsp bovis AF2122/97
ccauccucgcggugcgc

SEQ ID NO: 3123154 - RNA, 16 nt, Mycobacterium bovis subsp bovis AF2122/97
ccauccuuaugcgcgg

SEQ ID NO: 3123155 - RNA, 22 nt, Mycobacterium bovis subsp bovis AF2122/97
ccaucgaaaaaccucgacgccc

SEQ ID NO: 3123156 - RNA, 17 nt, Mycobacterium bovis subsp bovis AF2122/97
ccaucgacccgaucacg

SEQ ID NO: 3123157 - RNA, 19 nt, Mycobacterium bovis subsp bovis AF2122/97
ccaucgacccgaucacgcu

SEQ ID NO: 3123158 - RNA, 13 nt, Mycobacterium bovis subsp bovis AF2122/97
ccaucgaccgccc

SEQ ID NO: 3123159 - RNA, 14 nt, Mycobacterium bovis subsp bovis AF2122/97
ccaucgaccgcccg

SEQ ID NO: 3123160 - RNA, 17 nt, Mycobacterium bovis subsp bovis AF2122/97
ccaucgaccgcccgcca

SEQ ID NO: 3123161 - RNA, 17 nt, Mycobacterium bovis subsp bovis AF2122/97
ccaucgaggcgaucacc

SEQ ID NO: 3123162 - RNA, 19 nt, Mycobacterium bovis subsp bovis AF2122/97
ccaucgaggcgaucaccgc

SEQ ID NO: 3123163 - RNA, 22 nt, Mycobacterium bovis subsp bovis AF2122/97
ccaucgaggcgaucaccgcgcc

SEQ ID NO: 3123164 - RNA, 15 nt, Mycobacterium bovis subsp bovis AF2122/97
ccaucgaguccacca

SEQ ID NO: 3123165 - RNA, 18 nt, Mycobacterium bovis subsp bovis AF2122/97
ccaucgaguccaccaccu

SEQ ID NO: 3123166 - RNA, 12 nt, Mycobacterium bovis subsp bovis AF2122/97
ccaucgaucgag

SEQ ID NO: 3123167 - RNA, 12 nt, Mycobacterium bovis subsp bovis AF2122/97
ccaucgcaucuc

SEQ ID NO: 3123168 - RNA, 21 nt, Mycobacterium bovis subsp bovis AF2122/97
ccaucgccaacaccaaccagu

SEQ ID NO: 3123169 - RNA, 16 nt, Mycobacterium bovis subsp bovis AF2122/97
ccaucgccaugaugga

SEQ ID NO: 3123170 - RNA, 13 nt, Mycobacterium bovis subsp bovis AF2122/97
ccaucgcccggug

SEQ ID NO: 3123171 - RNA, 15 nt, Mycobacterium bovis subsp bovis AF2122/97
ccaucgccgacgccc

SEQ ID NO: 3123172 - RNA, 16 nt, Mycobacterium bovis subsp bovis AF2122/97
ccaucgccgccgcgcg

SEQ ID NO: 3123173 - RNA, 22 nt, Mycobacterium bovis subsp bovis AF2122/97
ccaucgccgccgcgcguucggc

SEQ ID NO: 3123174 - RNA, 16 nt, Mycobacterium bovis subsp bovis AF2122/97
ccaucgccuccagccg

SEQ ID NO: 3123175 - RNA, 17 nt, Mycobacterium bovis subsp bovis AF2122/97
ccaucgccuccagccgg

SEQ ID NO: 3123176 - RNA, 17 nt, Mycobacterium bovis subsp bovis AF2122/97
ccaugcgguuagcagcc

SEQ ID NO: 3123177 - RNA, 20 nt, Mycobacterium bovis subsp bovis AF2122/97
ccaugcgguuagcagccgcu

SEQ ID NO: 3123178 - RNA, 17 nt, Mycobacterium bovis subsp bovis AF2122/97
ccaugcuaggaccacca

SEQ ID NO: 3123179 - RNA, 18 nt, Mycobacterium bovis subsp bovis AF2122/97
ccaugcuaggaccaccag

SEQ ID NO: 3123180 - RNA, 22 nt, Mycobacterium bovis subsp bovis AF2122/97
ccaugcuaggaccaccagcgcu

SEQ ID NO: 3123181 - RNA, 11 nt, Mycobacterium bovis subsp bovis AF2122/97
ccaugcugcgc

SEQ ID NO: 3123182 - RNA, 14 nt, Mycobacterium bovis subsp bovis AF2122/97
ccaugcugcgcaac

SEQ ID NO: 3123183 - RNA, 20 nt, Mycobacterium bovis subsp bovis AF2122/97
ccaugcuggucagcggcgcg

SEQ ID NO: 3123184 - RNA, 15 nt, Mycobacterium bovis subsp bovis AF2122/97
ccauggacggccagg

SEQ ID NO: 3123185 - RNA, 15 nt, Mycobacterium bovis subsp bovis AF2122/97
ccauggcacugccgg

SEQ ID NO: 3123186 - RNA, 16 nt, Mycobacterium bovis subsp bovis AF2122/97
ccauggcagcgccgca

SEQ ID NO: 3123187 - RNA, 12 nt, Mycobacterium bovis subsp bovis AF2122/97
ccauggccacca

SEQ ID NO: 3123188 - RNA, 20 nt, Mycobacterium bovis subsp bovis AF2122/97
ccauggccaccgaacgcggc

SEQ ID NO: 3123189 - RNA, 23 nt, Mycobacterium bovis subsp bovis AF2122/97
ccauggccaccgaacgcggccac

SEQ ID NO: 3123190 - RNA, 14 nt, Mycobacterium bovis subsp bovis AF2122/97
ccauggcccgcucg

SEQ ID NO: 3123191 - RNA, 15 nt, Mycobacterium bovis subsp bovis AF2122/97
ccauggcccguuggc

SEQ ID NO: 3123192 - RNA, 17 nt, Mycobacterium bovis subsp bovis AF2122/97
ccauggcgccgcgccga

SEQ ID NO: 3123193 - RNA, 13 nt, Mycobacterium bovis subsp bovis AF2122/97
ccauggcggcgcc

SEQ ID NO: 3123194 - RNA, 22 nt, Mycobacterium bovis subsp bovis AF2122/97
ccaugggacacaauccacgucg

SEQ ID NO: 3123195 - RNA, 21 nt, Mycobacterium bovis subsp bovis AF2122/97
ccaugggaguucaucgcacga

SEQ ID NO: 3123196 - RNA, 16 nt, Mycobacterium bovis subsp bovis AF2122/97
ccaugggcaauggugg

SEQ ID NO: 3123197 - RNA, 23 nt, Mycobacterium bovis subsp bovis AF2122/97
ccaugggcgauaaggaccgcgcc

SEQ ID NO: 3123198 - RNA, 17 nt, Mycobacterium bovis subsp bovis AF2122/97
ccauggguagccgccca

SEQ ID NO: 3123199 - RNA, 17 nt, Mycobacterium bovis subsp bovis AF2122/97
ccaugggucuggcaggc

SEQ ID NO: 3123200 - RNA, 20 nt, Mycobacterium bovis subsp bovis AF2122/97
ccaugggucuggcaggccag

SEQ ID NO: 3123201 - RNA, 22 nt, Mycobacterium bovis subsp bovis AF2122/97
ccauggucauguucggggcgca

SEQ ID NO: 3123202 - RNA, 21 nt, Mycobacterium bovis subsp bovis AF2122/97
ccaugguccaagugggccggc

SEQ ID NO: 3123203 - RNA, 16 nt, Mycobacterium bovis subsp bovis AF2122/97
ccauggucgauucguc

SEQ ID NO: 3123204 - RNA, 13 nt, Mycobacterium bovis subsp bovis AF2122/97
ccauggucgcgcc

SEQ ID NO: 3123205 - RNA, 19 nt, Mycobacterium bovis subsp bovis AF2122/97
ccauggucgcgccacccgc

SEQ ID NO: 3123206 - RNA, 14 nt, Mycobacterium bovis subsp bovis AF2122/97
ccauggucggucaa

SEQ ID NO: 3123207 - RNA, 16 nt, Mycobacterium bovis subsp bovis AF2122/97
ccaugguggcgccgac

SEQ ID NO: 3123208 - RNA, 21 nt, Mycobacterium bovis subsp bovis AF2122/97
ccaugguggcgccgacguaca

SEQ ID NO: 3123209 - RNA, 22 nt, Mycobacterium bovis subsp bovis AF2122/97
ccaugguggcgccgacguacag

SEQ ID NO: 3123210 - RNA, 12 nt, Mycobacterium bovis subsp bovis AF2122/97
ccauggugggcc

SEQ ID NO: 3123211 - RNA, 17 nt, Mycobacterium bovis subsp bovis AF2122/97
ccaugguguucggcagc

SEQ ID NO: 3123212 - RNA, 21 nt, Mycobacterium bovis subsp bovis AF2122/97
ccaugguguucggcagcgcgg

SEQ ID NO: 3123213 - RNA, 22 nt, Mycobacterium bovis subsp bovis AF2122/97
ccauguccgcaguucggucguc

SEQ ID NO: 3123214 - RNA, 15 nt, Mycobacterium bovis subsp bovis AF2122/97
ccaugucgagcacgc

SEQ ID NO: 3123215 - RNA, 12 nt, Mycobacterium bovis subsp bovis AF2122/97
ccaugucgcgcc

SEQ ID NO: 3123216 - RNA, 12 nt, Mycobacterium bovis subsp bovis AF2122/97
ccaugucggcca

SEQ ID NO: 3123217 - RNA, 15 nt, Mycobacterium bovis subsp bovis AF2122/97
ccaugucggccaccc

SEQ ID NO: 3123218 - RNA, 13 nt, Mycobacterium bovis subsp bovis AF2122/97
ccaugucggccag

SEQ ID NO: 3123219 - RNA, 14 nt, Mycobacterium bovis subsp bovis AF2122/97
ccaugucggcgcgc

SEQ ID NO: 3123220 - RNA, 22 nt, Mycobacterium bovis subsp bovis AF2122/97
ccaugucggcgcgccgcacacg

SEQ ID NO: 3123221 - RNA, 21 nt, Mycobacterium bovis subsp bovis AF2122/97
ccaugucggugaccguucggc

SEQ ID NO: 3123222 - RNA, 22 nt, Mycobacterium bovis subsp bovis AF2122/97
ccaugucuccgacauuggccgu

SEQ ID NO: 3123223 - RNA, 23 nt, Mycobacterium bovis subsp bovis AF2122/97
ccaugucuccgacauuggccguc

SEQ ID NO: 3123224 - RNA, 14 nt, Mycobacterium bovis subsp bovis AF2122/97
ccaugugcccaggu

SEQ ID NO: 3123225 - RNA, 22 nt, Mycobacterium bovis subsp bovis AF2122/97
ccaugugcgacauuggucaccu

SEQ ID NO: 3123226 - RNA, 19 nt, Mycobacterium bovis subsp bovis AF2122/97
ccauguggcgucgcucguc

SEQ ID NO: 3123227 - RNA, 17 nt, Mycobacterium bovis subsp bovis AF2122/97
ccaugugucccggacca

SEQ ID NO: 3123228 - RNA, 22 nt, Mycobacterium bovis subsp bovis AF2122/97
ccauguugaagcgaagccagau

SEQ ID NO: 3123229 - RNA, 18 nt, Mycobacterium bovis subsp bovis AF2122/97
ccauguuuugcugcaugc

SEQ ID NO: 3123230 - RNA, 21 nt, Mycobacterium bovis subsp bovis AF2122/97
ccauguuuugcugcaugccga

SEQ ID NO: 3123231 - RNA, 17 nt, Mycobacterium bovis subsp bovis AF2122/97
ccauuaccgugggugga

SEQ ID NO: 3123232 - RNA, 23 nt, Mycobacterium bovis subsp bovis AF2122/97
ccauucagugucgccuuuggcgu

SEQ ID NO: 3123233 - RNA, 21 nt, Mycobacterium bovis subsp bovis AF2122/97
ccauuccaucgcgcaccgcau

SEQ ID NO: 3123234 - RNA, 17 nt, Mycobacterium bovis subsp bovis AF2122/97
ccauucccaacacagcc

SEQ ID NO: 3123235 - RNA, 17 nt, Mycobacterium bovis subsp bovis AF2122/97
ccauuccggucagguac

SEQ ID NO: 3123236 - RNA, 22 nt, Mycobacterium bovis subsp bovis AF2122/97
ccauucgcgggccgaggccguc

SEQ ID NO: 3123237 - RNA, 20 nt, Mycobacterium bovis subsp bovis AF2122/97
ccauucgcgguccaucagca

SEQ ID NO: 3123238 - RNA, 16 nt, Mycobacterium bovis subsp bovis AF2122/97
ccauucggcgagaaca

SEQ ID NO: 3123239 - RNA, 13 nt, Mycobacterium bovis subsp bovis AF2122/97
ccauucucggccg

SEQ ID NO: 3123240 - RNA, 16 nt, Mycobacterium bovis subsp bovis AF2122/97
ccauucuuggugaucg

SEQ ID NO: 3123241 - RNA, 14 nt, Mycobacterium bovis subsp bovis AF2122/97
ccauugacgccguu

SEQ ID NO: 3123242 - RNA, 23 nt, Mycobacterium bovis subsp bovis AF2122/97
ccauugacguagaccgucgaucc

SEQ ID NO: 3123243 - RNA, 18 nt, Mycobacterium bovis subsp bovis AF2122/97
ccauugagcucccgcaac

SEQ ID NO: 3123244 - RNA, 22 nt, Mycobacterium bovis subsp bovis AF2122/97
ccauugccauacagcaccccgc

SEQ ID NO: 3123245 - RNA, 13 nt, Mycobacterium bovis subsp bovis AF2122/97
ccauugcccgacg

SEQ ID NO: 3123246 - RNA, 16 nt, Mycobacterium bovis subsp bovis AF2122/97
ccauugccgccggcgc

SEQ ID NO: 3123247 - RNA, 20 nt, Mycobacterium bovis subsp bovis AF2122/97
ccauugccgccggugccgcc

SEQ ID NO: 3123248 - RNA, 15 nt, Mycobacterium bovis subsp bovis AF2122/97
ccauugccgccgucg

SEQ ID NO: 3123249 - RNA, 18 nt, Mycobacterium bovis subsp bovis AF2122/97
ccauugccgccgucgccg

SEQ ID NO: 3123250 - RNA, 19 nt, Mycobacterium bovis subsp bovis AF2122/97
ccauugccgccgucgccga

SEQ ID NO: 3123251 - RNA, 22 nt, Mycobacterium bovis subsp bovis AF2122/97
ccauugccgccgucgccgccgc

SEQ ID NO: 3123252 - RNA, 16 nt, Mycobacterium bovis subsp bovis AF2122/97
ccauugccucccgcgc

SEQ ID NO: 3123253 - RNA, 18 nt, Mycobacterium bovis subsp bovis AF2122/97
ccauugccucccgcgccg

SEQ ID NO: 3123254 - RNA, 19 nt, Mycobacterium bovis subsp bovis AF2122/97
ccauugccucccgcgccgg

SEQ ID NO: 3123255 - RNA, 18 nt, Mycobacterium bovis subsp bovis AF2122/97
ccauugcgaacucgcugc

SEQ ID NO: 3123256 - RNA, 22 nt, Mycobacterium bovis subsp bovis AF2122/97
ccauuggaccgagacuugcugg

SEQ ID NO: 3123257 - RNA, 19 nt, Mycobacterium bovis subsp bovis AF2122/97
ccauuggccaagucagccc

SEQ ID NO: 3123258 - RNA, 21 nt, Mycobacterium bovis subsp bovis AF2122/97
ccauuggccaagucagcccga

SEQ ID NO: 3123259 - RNA, 15 nt, Mycobacterium bovis subsp bovis AF2122/97
ccauuggcgccgccg

SEQ ID NO: 3123260 - RNA, 14 nt, Mycobacterium bovis subsp bovis AF2122/97
ccauuggcgccguc

SEQ ID NO: 3123261 - RNA, 15 nt, Mycobacterium bovis subsp bovis AF2122/97
ccauugugggacgcg

SEQ ID NO: 3123262 - RNA, 18 nt, Mycobacterium bovis subsp bovis AF2122/97
cccacaugcgcucgcgga

SEQ ID NO: 3123263 - RNA, 22 nt, Mycobacterium bovis subsp bovis AF2122/97
cccacauggcccggaggccgcu

SEQ ID NO: 3123264 - RNA, 20 nt, Mycobacterium bovis subsp bovis AF2122/97
cccacauuccguagccggcg

SEQ ID NO: 3123265 - RNA, 12 nt, Mycobacterium bovis subsp bovis AF2122/97
cccaccacacag

SEQ ID NO: 3123266 - RNA, 16 nt, Mycobacterium bovis subsp bovis AF2122/97
cccaccacacagccgc

SEQ ID NO: 3123267 - RNA, 14 nt, Mycobacterium bovis subsp bovis AF2122/97
cccaccacaccaag

SEQ ID NO: 3123268 - RNA, 22 nt, Mycobacterium bovis subsp bovis AF2122/97
cccaccacaccaaggccgagcg

SEQ ID NO: 3123269 - RNA, 13 nt, Mycobacterium bovis subsp bovis AF2122/97
cccaccaccaccg

SEQ ID NO: 3123270 - RNA, 22 nt, Mycobacterium bovis subsp bovis AF2122/97
cccaccacgaacucggccgggc

SEQ ID NO: 3123271 - RNA, 14 nt, Mycobacterium bovis subsp bovis AF2122/97
cccaccacgcgacg

SEQ ID NO: 3123272 - RNA, 23 nt, Mycobacterium bovis subsp bovis AF2122/97
cccaccacuagcuucgcuugccg

SEQ ID NO: 3123273 - RNA, 14 nt, Mycobacterium bovis subsp bovis AF2122/97
cccaccagcgcagc

SEQ ID NO: 3123274 - RNA, 16 nt, Mycobacterium bovis subsp bovis AF2122/97
cccaccagcgcagccg

SEQ ID NO: 3123275 - RNA, 15 nt, Mycobacterium bovis subsp bovis AF2122/97
cccaccagcggcggc

SEQ ID NO: 3123276 - RNA, 18 nt, Mycobacterium bovis subsp bovis AF2122/97
cccaccagcggcggcaac

SEQ ID NO: 3123277 - RNA, 16 nt, Mycobacterium bovis subsp bovis AF2122/97
cccaccagcggcggcc

SEQ ID NO: 3123278 - RNA, 17 nt, Mycobacterium bovis subsp bovis AF2122/97
cccaccagcggcggccc

SEQ ID NO: 3123279 - RNA, 12 nt, Mycobacterium bovis subsp bovis AF2122/97
cccaccagugca

SEQ ID NO: 3123280 - RNA, 16 nt, Mycobacterium bovis subsp bovis AF2122/97
cccacccauggccucc

SEQ ID NO: 3123281 - RNA, 20 nt, Mycobacterium bovis subsp bovis AF2122/97
cccaccccccagcgccgccg

SEQ ID NO: 3123282 - RNA, 19 nt, Mycobacterium bovis subsp bovis AF2122/97
cccacccccgguucaccuc

SEQ ID NO: 3123283 - RNA, 14 nt, Mycobacterium bovis subsp bovis AF2122/97
cccaccccggccgc

SEQ ID NO: 3123284 - RNA, 17 nt, Mycobacterium bovis subsp bovis AF2122/97
cccacccgcaccaccgg

SEQ ID NO: 3123285 - RNA, 18 nt, Mycobacterium bovis subsp bovis AF2122/97
cccacccgcaccaccggc

SEQ ID NO: 3123286 - RNA, 21 nt, Mycobacterium bovis subsp bovis AF2122/97
cccacccgcaccaccggcccc

SEQ ID NO: 3123287 - RNA, 13 nt, Mycobacterium bovis subsp bovis AF2122/97
cccacccgcaccg

SEQ ID NO: 3123288 - RNA, 16 nt, Mycobacterium bovis subsp bovis AF2122/97
cccacccgcaccgccg

SEQ ID NO: 3123289 - RNA, 18 nt, Mycobacterium bovis subsp bovis AF2122/97
cccacccgcaccgccggc

SEQ ID NO: 3123290 - RNA, 15 nt, Mycobacterium bovis subsp bovis AF2122/97
cccacccgcaccgcg

SEQ ID NO: 3123291 - RNA, 15 nt, Mycobacterium bovis subsp bovis AF2122/97
cccacccgcggcgcc

SEQ ID NO: 3123292 - RNA, 19 nt, Mycobacterium bovis subsp bovis AF2122/97
cccacccucggguccaacc

SEQ ID NO: 3123293 - RNA, 15 nt, Mycobacterium bovis subsp bovis AF2122/97
cccaccgaaccgagg

SEQ ID NO: 3123294 - RNA, 14 nt, Mycobacterium bovis subsp bovis AF2122/97
cccaccgccccggc

SEQ ID NO: 3123295 - RNA, 14 nt, Mycobacterium bovis subsp bovis AF2122/97
cccaccgccguugg

SEQ ID NO: 3123296 - RNA, 15 nt, Mycobacterium bovis subsp bovis AF2122/97
cccaccgccguuggg

SEQ ID NO: 3123297 - RNA, 21 nt, Mycobacterium bovis subsp bovis AF2122/97
cccaccgccguugggccgcgc

SEQ ID NO: 3123298 - RNA, 21 nt, Mycobacterium bovis subsp bovis AF2122/97
cccaccgccugggcggccagc

SEQ ID NO: 3123299 - RNA, 16 nt, Mycobacterium bovis subsp bovis AF2122/97
cccaccgcugcggcac

SEQ ID NO: 3123300 - RNA, 18 nt, Mycobacterium bovis subsp bovis AF2122/97
cccaccggaccaccgccg

SEQ ID NO: 3123301 - RNA, 22 nt, Mycobacterium bovis subsp bovis AF2122/97
cccaccggaccaccgccgaagc

SEQ ID NO: 3123302 - RNA, 13 nt, Mycobacterium bovis subsp bovis AF2122/97
cccaccggccacc

SEQ ID NO: 3123303 - RNA, 13 nt, Mycobacterium bovis subsp bovis AF2122/97
cccaccggccacu

SEQ ID NO: 3123304 - RNA, 16 nt, Mycobacterium bovis subsp bovis AF2122/97
cccaccggcgccgccg

SEQ ID NO: 3123305 - RNA, 18 nt, Mycobacterium bovis subsp bovis AF2122/97
cccaccggcgccgccggc

SEQ ID NO: 3123306 - RNA, 14 nt, Mycobacterium bovis subsp bovis AF2122/97
cccaccgggcggcg

SEQ ID NO: 3123307 - RNA, 13 nt, Mycobacterium bovis subsp bovis AF2122/97
cccaccgguaccg

SEQ ID NO: 3123308 - RNA, 15 nt, Mycobacterium bovis subsp bovis AF2122/97
cccaccgguaccgcc

SEQ ID NO: 3123309 - RNA, 16 nt, Mycobacterium bovis subsp bovis AF2122/97
cccaccgguaccgcca

SEQ ID NO: 3123310 - RNA, 14 nt, Mycobacterium bovis subsp bovis AF2122/97
cccaccggucgccg

SEQ ID NO: 3123311 - RNA, 14 nt, Mycobacterium bovis subsp bovis AF2122/97
cccaccggugccgc

SEQ ID NO: 3123312 - RNA, 16 nt, Mycobacterium bovis subsp bovis AF2122/97
cccaccggugccgccc

SEQ ID NO: 3123313 - RNA, 18 nt, Mycobacterium bovis subsp bovis AF2122/97
cccaccggugccgcccgc

SEQ ID NO: 3123314 - RNA, 20 nt, Mycobacterium bovis subsp bovis AF2122/97
cccaccggugccgccguugc

SEQ ID NO: 3123315 - RNA, 13 nt, Mycobacterium bovis subsp bovis AF2122/97
cccaccgucaccc

SEQ ID NO: 3123316 - RNA, 16 nt, Mycobacterium bovis subsp bovis AF2122/97
cccaccgucacccccg

SEQ ID NO: 3123317 - RNA, 12 nt, Mycobacterium bovis subsp bovis AF2122/97
cccaccgugccg

SEQ ID NO: 3123318 - RNA, 14 nt, Mycobacterium bovis subsp bovis AF2122/97
cccaccgugccggg

SEQ ID NO: 3123319 - RNA, 15 nt, Mycobacterium bovis subsp bovis AF2122/97
cccaccgugccgggc

SEQ ID NO: 3123320 - RNA, 21 nt, Mycobacterium bovis subsp bovis AF2122/97
cccaccguuugggcgccggug

SEQ ID NO: 3123321 - RNA, 22 nt, Mycobacterium bovis subsp bovis AF2122/97
cccaccucguauacccgggcgg

SEQ ID NO: 3123322 - RNA, 18 nt, Mycobacterium bovis subsp bovis AF2122/97
cccaccuggggccgcacg

SEQ ID NO: 3123323 - RNA, 22 nt, Mycobacterium bovis subsp bovis AF2122/97
cccaccuucaucaacgacacca

SEQ ID NO: 3123324 - RNA, 12 nt, Mycobacterium bovis subsp bovis AF2122/97
cccacgagagcg

SEQ ID NO: 3123325 - RNA, 14 nt, Mycobacterium bovis subsp bovis AF2122/97
cccacgaucagcag

SEQ ID NO: 3123326 - RNA, 20 nt, Mycobacterium bovis subsp bovis AF2122/97
cccacgaucagcagcgucgg

SEQ ID NO: 3123327 - RNA, 13 nt, Mycobacterium bovis subsp bovis AF2122/97
cccacgcacagca

SEQ ID NO: 3123328 - RNA, 16 nt, Mycobacterium bovis subsp bovis AF2122/97
cccacgcacagcaacg

SEQ ID NO: 3123329 - RNA, 19 nt, Mycobacterium bovis subsp bovis AF2122/97
cccacgcacagcaacgccc

SEQ ID NO: 3123330 - RNA, 22 nt, Mycobacterium bovis subsp bovis AF2122/97
cccacgcacagcaacgcccaac

SEQ ID NO: 3123331 - RNA, 14 nt, Mycobacterium bovis subsp bovis AF2122/97
cccacgcccggccc

SEQ ID NO: 3123332 - RNA, 13 nt, Mycobacterium bovis subsp bovis AF2122/97
cccacgccgccgu

SEQ ID NO: 3123333 - RNA, 16 nt, Mycobacterium bovis subsp bovis AF2122/97
cccacgccgguggcac

SEQ ID NO: 3123334 - RNA, 22 nt, Mycobacterium bovis subsp bovis AF2122/97
cccacgccugccgaaacgccga

SEQ ID NO: 3123335 - RNA, 21 nt, Mycobacterium bovis subsp bovis AF2122/97
cccacgcgcacucgaccagga

SEQ ID NO: 3123336 - RNA, 22 nt, Mycobacterium bovis subsp bovis AF2122/97
cccacgcgcagaaagucgcgcg

SEQ ID NO: 3123337 - RNA, 16 nt, Mycobacterium bovis subsp bovis AF2122/97
cccacggagggcagga

SEQ ID NO: 3123338 - RNA, 16 nt, Mycobacterium bovis subsp bovis AF2122/97
cccacggccggccgcu

SEQ ID NO: 3123339 - RNA, 18 nt, Mycobacterium bovis subsp bovis AF2122/97
cccacggccggccgcugc

SEQ ID NO: 3123340 - RNA, 20 nt, Mycobacterium bovis subsp bovis AF2122/97
cccacggccggccgcugcca

SEQ ID NO: 3123341 - RNA, 22 nt, Mycobacterium bovis subsp bovis AF2122/97
cccacggccggccgcugccacu

SEQ ID NO: 3123342 - RNA, 15 nt, Mycobacterium bovis subsp bovis AF2122/97
cccacggcgaccacg

SEQ ID NO: 3123343 - RNA, 20 nt, Mycobacterium bovis subsp bovis AF2122/97
cccacggcgaccacgccgcc

SEQ ID NO: 3123344 - RNA, 13 nt, Mycobacterium bovis subsp bovis AF2122/97
cccacggcgggcg

SEQ ID NO: 3123345 - RNA, 17 nt, Mycobacterium bovis subsp bovis AF2122/97
cccacggcgggcgagcc

SEQ ID NO: 3123346 - RNA, 13 nt, Mycobacterium bovis subsp bovis AF2122/97
cccacgggccggc

SEQ ID NO: 3123347 - RNA, 14 nt, Mycobacterium bovis subsp bovis AF2122/97
cccacgggccggcc

SEQ ID NO: 3123348 - RNA, 15 nt, Mycobacterium bovis subsp bovis AF2122/97
cccacgggccggccg

SEQ ID NO: 3123349 - RNA, 19 nt, Mycobacterium bovis subsp bovis AF2122/97
cccagccggguggacaccu

SEQ ID NO: 3123350 - RNA, 17 nt, Mycobacterium bovis subsp bovis AF2122/97
cccagccgugcccaagc

SEQ ID NO: 3123351 - RNA, 17 nt, Mycobacterium bovis subsp bovis AF2122/97
cccagcgaaucacccgc

SEQ ID NO: 3123352 - RNA, 18 nt, Mycobacterium bovis subsp bovis AF2122/97
cccagcgaaucacccgcg

SEQ ID NO: 3123353 - RNA, 16 nt, Mycobacterium bovis subsp bovis AF2122/97
cccagcgacaacacca

SEQ ID NO: 3123354 - RNA, 18 nt, Mycobacterium bovis subsp bovis AF2122/97
cccagcgacccggccagc

SEQ ID NO: 3123355 - RNA, 20 nt, Mycobacterium bovis subsp bovis AF2122/97
cccagcgacccggccagcgg

SEQ ID NO: 3123356 - RNA, 23 nt, Mycobacterium bovis subsp bovis AF2122/97
cccagcgacgcggccagcggcaa

SEQ ID NO: 3123357 - RNA, 15 nt, Mycobacterium bovis subsp bovis AF2122/97
cccagcgacucggcc

SEQ ID NO: 3123358 - RNA, 17 nt, Mycobacterium bovis subsp bovis AF2122/97
cccagcgacucggccag

SEQ ID NO: 3123359 - RNA, 14 nt, Mycobacterium bovis subsp bovis AF2122/97
cccagcgagcgcca

SEQ ID NO: 3123360 - RNA, 21 nt, Mycobacterium bovis subsp bovis AF2122/97
cccagcgagcgccaggucagc

SEQ ID NO: 3123361 - RNA, 23 nt, Mycobacterium bovis subsp bovis AF2122/97
cccagcgagcgccaggucagcuc

SEQ ID NO: 3123362 - RNA, 14 nt, Mycobacterium bovis subsp bovis AF2122/97
cccagcgagguggg

SEQ ID NO: 3123363 - RNA, 21 nt, Mycobacterium bovis subsp bovis AF2122/97
cccagcgaugcgcucacugca

SEQ ID NO: 3123364 - RNA, 14 nt, Mycobacterium bovis subsp bovis AF2122/97
cccagcgauucagc

SEQ ID NO: 3123365 - RNA, 23 nt, Mycobacterium bovis subsp bovis AF2122/97
cccagcgcacggaccaucgccag

SEQ ID NO: 3123366 - RNA, 14 nt, Mycobacterium bovis subsp bovis AF2122/97
cccagcgcagcagc

SEQ ID NO: 3123367 - RNA, 12 nt, Mycobacterium bovis subsp bovis AF2122/97
cccagcgcagcg

SEQ ID NO: 3123368 - RNA, 16 nt, Mycobacterium bovis subsp bovis AF2122/97
cccagcgcagcggacg

SEQ ID NO: 3123369 - RNA, 16 nt, Mycobacterium bovis subsp bovis AF2122/97
cccagcgcccccagca

SEQ ID NO: 3123370 - RNA, 22 nt, Mycobacterium bovis subsp bovis AF2122/97
cccagcgcccccagcagcugcg

SEQ ID NO: 3123371 - RNA, 15 nt, Mycobacterium bovis subsp bovis AF2122/97
cccagcgcccgccgg

SEQ ID NO: 3123372 - RNA, 18 nt, Mycobacterium bovis subsp bovis AF2122/97
cccagcgcccgccggcau

SEQ ID NO: 3123373 - RNA, 15 nt, Mycobacterium bovis subsp bovis AF2122/97
cccagcgcccggcca

SEQ ID NO: 3123374 - RNA, 13 nt, Mycobacterium bovis subsp bovis AF2122/97
cccagcgccgccg

SEQ ID NO: 3123375 - RNA, 16 nt, Mycobacterium bovis subsp bovis AF2122/97
cccagcgccuccagca

SEQ ID NO: 3123376 - RNA, 21 nt, Mycobacterium bovis subsp bovis AF2122/97
cccagcgcgcugggaagcucg

SEQ ID NO: 3123377 - RNA, 23 nt, Mycobacterium bovis subsp bovis AF2122/97
cccagcgcuagccgggcgcgccg

SEQ ID NO: 3123378 - RNA, 24 nt, Mycobacterium bovis subsp bovis AF2122/97
cccagcgcuagccgggcgcgccgg

SEQ ID NO: 3123379 - RNA, 18 nt, Mycobacterium bovis subsp bovis AF2122/97
cccagcgcugucguaccg

SEQ ID NO: 3123380 - RNA, 23 nt, Mycobacterium bovis subsp bovis AF2122/97
cccagcggagccacucggcccgg

SEQ ID NO: 3123381 - RNA, 12 nt, Mycobacterium bovis subsp bovis AF2122/97
cccagcggccac

SEQ ID NO: 3123382 - RNA, 12 nt, Mycobacterium bovis subsp bovis AF2122/97
cccagcggccgc

SEQ ID NO: 3123383 - RNA, 15 nt, Mycobacterium bovis subsp bovis AF2122/97
cccagcggccgcgau

SEQ ID NO: 3123384 - RNA, 16 nt, Mycobacterium bovis subsp bovis AF2122/97
cccagcggccgcgaug

SEQ ID NO: 3123385 - RNA, 21 nt, Mycobacterium bovis subsp bovis AF2122/97
cccagcggcgccacguggucg

SEQ ID NO: 3123386 - RNA, 19 nt, Mycobacterium bovis subsp bovis AF2122/97
cccagcgggucgcgggugc

SEQ ID NO: 3123387 - RNA, 20 nt, Mycobacterium bovis subsp bovis AF2122/97
cccagcgggucgcgggugcc

SEQ ID NO: 3123388 - RNA, 19 nt, Mycobacterium bovis subsp bovis AF2122/97
cccagcgguaucccccagc

SEQ ID NO: 3123389 - RNA, 14 nt, Mycobacterium bovis subsp bovis AF2122/97
cccagcgguugacc

SEQ ID NO: 3123390 - RNA, 19 nt, Mycobacterium bovis subsp bovis AF2122/97
cccagcgguugacccucgg

SEQ ID NO: 3123391 - RNA, 18 nt, Mycobacterium bovis subsp bovis AF2122/97
cccagcgugcccgccacc

SEQ ID NO: 3123392 - RNA, 19 nt, Mycobacterium bovis subsp bovis AF2122/97
cccagcgugcccgccaccg

SEQ ID NO: 3123393 - RNA, 22 nt, Mycobacterium bovis subsp bovis AF2122/97
cccagcgugucuugucgcgcag

SEQ ID NO: 3123394 - RNA, 16 nt, Mycobacterium bovis subsp bovis AF2122/97
cccagcguucccgccg

SEQ ID NO: 3123395 - RNA, 15 nt, Mycobacterium bovis subsp bovis AF2122/97
cccagcucgcgcacc

SEQ ID NO: 3123396 - RNA, 16 nt, Mycobacterium bovis subsp bovis AF2122/97
cccagcucgucgacgu

SEQ ID NO: 3123397 - RNA, 15 nt, Mycobacterium bovis subsp bovis AF2122/97
cccagcugaccagcg

SEQ ID NO: 3123398 - RNA, 21 nt, Mycobacterium bovis subsp bovis AF2122/97
cccagcugaccagcguccagc

SEQ ID NO: 3123399 - RNA, 15 nt, Mycobacterium bovis subsp bovis AF2122/97
cccagcugaccugaa

SEQ ID NO: 3123400 - RNA, 13 nt, Mycobacterium bovis subsp bovis AF2122/97
cccagcugcaggg

SEQ ID NO: 3123401 - RNA, 12 nt, Mycobacterium bovis subsp bovis AF2122/97
cccagcugcgcc

SEQ ID NO: 3123402 - RNA, 13 nt, Mycobacterium bovis subsp bovis AF2122/97
cccagcugcgccg

SEQ ID NO: 3123403 - RNA, 17 nt, Mycobacterium bovis subsp bovis AF2122/97
cccagcugcggucgcgg

SEQ ID NO: 3123404 - RNA, 22 nt, Mycobacterium bovis subsp bovis AF2122/97
cccagcugcggucgcggcugac

SEQ ID NO: 3123405 - RNA, 23 nt, Mycobacterium bovis subsp bovis AF2122/97
cccagcugucauccccggccagc

SEQ ID NO: 3123406 - RNA, 22 nt, Mycobacterium bovis subsp bovis AF2122/97
cccagcuugcggugaucccacg

SEQ ID NO: 3123407 - RNA, 15 nt, Mycobacterium bovis subsp bovis AF2122/97
cccagcuuggcgucg

SEQ ID NO: 3123408 - RNA, 18 nt, Mycobacterium bovis subsp bovis AF2122/97
cccagcuuucgcgucacc

SEQ ID NO: 3123409 - RNA, 21 nt, Mycobacterium bovis subsp bovis AF2122/97
cccagcuuucgcgucacccgg

SEQ ID NO: 3123410 - RNA, 17 nt, Mycobacterium bovis subsp bovis AF2122/97
cccaggaacgggacgcc

SEQ ID NO: 3123411 - RNA, 17 nt, Mycobacterium bovis subsp bovis AF2122/97
cccaggaagccgagacc

SEQ ID NO: 3123412 - RNA, 18 nt, Mycobacterium bovis subsp bovis AF2122/97
cccaggaaggcgacgccg

SEQ ID NO: 3123413 - RNA, 16 nt, Mycobacterium bovis subsp bovis AF2122/97
cccaggacagcagccg

SEQ ID NO: 3123414 - RNA, 19 nt, Mycobacterium bovis subsp bovis AF2122/97
cccaggacagcagccgccg

SEQ ID NO: 3123415 - RNA, 23 nt, Mycobacterium bovis subsp bovis AF2122/97
cccaggacagcagccgccggccg

SEQ ID NO: 3123416 - RNA, 17 nt, Mycobacterium bovis subsp bovis AF2122/97
cccaggacuccggccgc

SEQ ID NO: 3123417 - RNA, 22 nt, Mycobacterium bovis subsp bovis AF2122/97
cccaggacuccggccgcacgcc

SEQ ID NO: 3123418 - RNA, 22 nt, Mycobacterium bovis subsp bovis AF2122/97
cccaggcaaguugugagggagg

SEQ ID NO: 3123419 - RNA, 17 nt, Mycobacterium bovis subsp bovis AF2122/97
cccaggccaagguggcc

SEQ ID NO: 3123420 - RNA, 19 nt, Mycobacterium bovis subsp bovis AF2122/97
cccaggccaagguggccac

SEQ ID NO: 3123421 - RNA, 12 nt, Mycobacterium bovis subsp bovis AF2122/97
cccaggccgccg

SEQ ID NO: 3123422 - RNA, 18 nt, Mycobacterium bovis subsp bovis AF2122/97
cccaggccgcuugccccg

SEQ ID NO: 3123423 - RNA, 14 nt, Mycobacterium bovis subsp bovis AF2122/97
cccaggcgaacagg

SEQ ID NO: 3123424 - RNA, 20 nt, Mycobacterium bovis subsp bovis AF2122/97
cccaggcgaucgcccggccc

SEQ ID NO: 3123425 - RNA, 19 nt, Mycobacterium bovis subsp bovis AF2122/97
cccaggcgcucagcgcggc

SEQ ID NO: 3123426 - RNA, 22 nt, Mycobacterium bovis subsp bovis AF2122/97
cccaggcgcucagcgcggccac

SEQ ID NO: 3123427 - RNA, 20 nt, Mycobacterium bovis subsp bovis AF2122/97
cccaggcgcucaucacccag

SEQ ID NO: 3123428 - RNA, 14 nt, Mycobacterium bovis subsp bovis AF2122/97
cccaggcgcugccg

SEQ ID NO: 3123429 - RNA, 23 nt, Mycobacterium bovis subsp bovis AF2122/97
cccaggcguuuggcgugccgucg

SEQ ID NO: 3123430 - RNA, 15 nt, Mycobacterium bovis subsp bovis AF2122/97
cccaggcucgcaccg

SEQ ID NO: 3123431 - RNA, 22 nt, Mycobacterium bovis subsp bovis AF2122/97
cccagggcacaucgggcguggu

SEQ ID NO: 3123432 - RNA, 17 nt, Mycobacterium bovis subsp bovis AF2122/97
cccagggcguuggcggc

SEQ ID NO: 3123433 - RNA, 14 nt, Mycobacterium bovis subsp bovis AF2122/97
cccagggcucggcg

SEQ ID NO: 3123434 - RNA, 18 nt, Mycobacterium bovis subsp bovis AF2122/97
cccagggcucggcggccc

SEQ ID NO: 3123435 - RNA, 17 nt, Mycobacterium bovis subsp bovis AF2122/97
cccaugggguauggugu

SEQ ID NO: 3123436 - RNA, 15 nt, Mycobacterium bovis subsp bovis AF2122/97
cccauggugagcugu

SEQ ID NO: 3123437 - RNA, 19 nt, Mycobacterium bovis subsp bovis AF2122/97
cccauggugagcugugacu

SEQ ID NO: 3123438 - RNA, 13 nt, Mycobacterium bovis subsp bovis AF2122/97
cccaugucggcgc

SEQ ID NO: 3123439 - RNA, 16 nt, Mycobacterium bovis subsp bovis AF2122/97
cccaugucggcgcgcc

SEQ ID NO: 3123440 - RNA, 17 nt, Mycobacterium bovis subsp bovis AF2122/97
cccaugucggcgcgccg

SEQ ID NO: 3123441 - RNA, 12 nt, Mycobacterium bovis subsp bovis AF2122/97
cccaugucggug

SEQ ID NO: 3123442 - RNA, 20 nt, Mycobacterium bovis subsp bovis AF2122/97
cccauucaucuugcggcagc

SEQ ID NO: 3123443 - RNA, 16 nt, Mycobacterium bovis subsp bovis AF2122/97
cccauucccaacacag

SEQ ID NO: 3123444 - RNA, 23 nt, Mycobacterium bovis subsp bovis AF2122/97
cccauucccaacacagccgucgc

SEQ ID NO: 3123445 - RNA, 12 nt, Mycobacterium bovis subsp bovis AF2122/97
cccauucggcgg

SEQ ID NO: 3123446 - RNA, 13 nt, Mycobacterium bovis subsp bovis AF2122/97
cccauucucggcc

SEQ ID NO: 3123447 - RNA, 16 nt, Mycobacterium bovis subsp bovis AF2122/97
cccauucucggccggc

SEQ ID NO: 3123448 - RNA, 18 nt, Mycobacterium bovis subsp bovis AF2122/97
cccauucucggccggcgg

SEQ ID NO: 3123449 - RNA, 19 nt, Mycobacterium bovis subsp bovis AF2122/97
cccauucucggccggcggc

SEQ ID NO: 3123450 - RNA, 22 nt, Mycobacterium bovis subsp bovis AF2122/97
cccauucucggccggcggcgcc

SEQ ID NO: 3123451 - RNA, 23 nt, Mycobacterium bovis subsp bovis AF2122/97
cccauucucggccggcggcgccc

SEQ ID NO: 3123452 - RNA, 14 nt, Mycobacterium bovis subsp bovis AF2122/97
cccauugccgccgu

SEQ ID NO: 3123453 - RNA, 16 nt, Mycobacterium bovis subsp bovis AF2122/97
cccauugccgccgucg

SEQ ID NO: 3123454 - RNA, 14 nt, Mycobacterium bovis subsp bovis AF2122/97
cccauugccgucgc

SEQ ID NO: 3123455 - RNA, 19 nt, Mycobacterium bovis subsp bovis AF2122/97
cccauuggccagguggcga

SEQ ID NO: 3123456 - RNA, 21 nt, Mycobacterium bovis subsp bovis AF2122/97
cccauuuaaacgggccggugc

SEQ ID NO: 3123457 - RNA, 20 nt, Mycobacterium bovis subsp bovis AF2122/97
cccauuugccuugagccgcc

SEQ ID NO: 3123458 - RNA, 14 nt, Mycobacterium bovis subsp bovis AF2122/97
ccccaaaccggcgg

SEQ ID NO: 3123459 - RNA, 23 nt, Mycobacterium bovis subsp bovis AF2122/97
ccccaaacuccgaaaucgucagu

SEQ ID NO: 3123460 - RNA, 23 nt, Mycobacterium bovis subsp bovis AF2122/97
ccccaacagggcggcaggguguu

SEQ ID NO: 3123461 - RNA, 22 nt, Mycobacterium bovis subsp bovis AF2122/97
ccccaacccuaaaccagccacc

SEQ ID NO: 3123462 - RNA, 23 nt, Mycobacterium bovis subsp bovis AF2122/97
ccccaagcgccugagcggccucg

SEQ ID NO: 3123463 - RNA, 18 nt, Mycobacterium bovis subsp bovis AF2122/97
ccccaagcgugcugccgc

SEQ ID NO: 3123464 - RNA, 16 nt, Mycobacterium bovis subsp bovis AF2122/97
ccccaaucagugcagc

SEQ ID NO: 3123465 - RNA, 20 nt, Mycobacterium bovis subsp bovis AF2122/97
ccccaauccuugggcuucga

SEQ ID NO: 3123466 - RNA, 21 nt, Mycobacterium bovis subsp bovis AF2122/97
ccccacaaucagcccgacacc

SEQ ID NO: 3123467 - RNA, 13 nt, Mycobacterium bovis subsp bovis AF2122/97
ccccacacagucg

SEQ ID NO: 3123468 - RNA, 20 nt, Mycobacterium bovis subsp bovis AF2122/97
ccccaccauucgcgggccga

SEQ ID NO: 3123469 - RNA, 17 nt, Mycobacterium bovis subsp bovis AF2122/97
ccccacccaccacagga

SEQ ID NO: 3123470 - RNA, 13 nt, Mycobacterium bovis subsp bovis AF2122/97
ccccacccgcggc

SEQ ID NO: 3123471 - RNA, 18 nt, Mycobacterium bovis subsp bovis AF2122/97
ccccacccuaaucguucc

SEQ ID NO: 3123472 - RNA, 13 nt, Mycobacterium bovis subsp bovis AF2122/97
ccccaccgacagc

SEQ ID NO: 3123473 - RNA, 12 nt, Mycobacterium bovis subsp bovis AF2122/97
ccccaccggcac

SEQ ID NO: 3123474 - RNA, 17 nt, Mycobacterium bovis subsp bovis AF2122/97
ccccaccggccgaaggc

SEQ ID NO: 3123475 - RNA, 16 nt, Mycobacterium bovis subsp bovis AF2122/97
ccccaccgguaccgcc

SEQ ID NO: 3123476 - RNA, 19 nt, Mycobacterium bovis subsp bovis AF2122/97
ccccaccgguaccgccacu

SEQ ID NO: 3123477 - RNA, 14 nt, Mycobacterium bovis subsp bovis AF2122/97
ccccaccggugccg

SEQ ID NO: 3123478 - RNA, 16 nt, Mycobacterium bovis subsp bovis AF2122/97
ccccaccggugccgcc

SEQ ID NO: 3123479 - RNA, 12 nt, Mycobacterium bovis subsp bovis AF2122/97
ccccaccgguua

SEQ ID NO: 3123480 - RNA, 12 nt, Mycobacterium bovis subsp bovis AF2122/97
ccccacggccag

SEQ ID NO: 3123481 - RNA, 14 nt, Mycobacterium bovis subsp bovis AF2122/97
ccccacggugcggu

SEQ ID NO: 3123482 - RNA, 11 nt, Mycobacterium bovis subsp bovis AF2122/97
ccccacugccg

SEQ ID NO: 3123483 - RNA, 15 nt, Mycobacterium bovis subsp bovis AF2122/97
ccccacuggugcagc

SEQ ID NO: 3123484 - RNA, 22 nt, Mycobacterium bovis subsp bovis AF2122/97
ccccacuggugcagcgccgaca

SEQ ID NO: 3123485 - RNA, 15 nt, Mycobacterium bovis subsp bovis AF2122/97
ccccagaccggcggc

SEQ ID NO: 3123486 - RNA, 12 nt, Mycobacterium bovis subsp bovis AF2122/97
ccccagagcugg

SEQ ID NO: 3123487 - RNA, 19 nt, Mycobacterium bovis subsp bovis AF2122/97
ccccagcaaaggggugugu

SEQ ID NO: 3123488 - RNA, 17 nt, Mycobacterium bovis subsp bovis AF2122/97
ccccagcaccacgguga

SEQ ID NO: 3123489 - RNA, 14 nt, Mycobacterium bovis subsp bovis AF2122/97
ccccagcacccggc

SEQ ID NO: 3123490 - RNA, 22 nt, Mycobacterium bovis subsp bovis AF2122/97
ccccagcacccggcuucgccgc

SEQ ID NO: 3123491 - RNA, 14 nt, Mycobacterium bovis subsp bovis AF2122/97
ccccagcagggugu

SEQ ID NO: 3123492 - RNA, 17 nt, Mycobacterium bovis subsp bovis AF2122/97
ccccagcaguucgccgc

SEQ ID NO: 3123493 - RNA, 22 nt, Mycobacterium bovis subsp bovis AF2122/97
ccccagcaguucgccgcgcagc

SEQ ID NO: 3123494 - RNA, 21 nt, Mycobacterium bovis subsp bovis AF2122/97
ccccagcaucuuuggcggccg

SEQ ID NO: 3123495 - RNA, 21 nt, Mycobacterium bovis subsp bovis AF2122/97
ccccagccgcggcgccuccgc

SEQ ID NO: 3123496 - RNA, 18 nt, Mycobacterium bovis subsp bovis AF2122/97
ccccagccggcagcagcg

SEQ ID NO: 3123497 - RNA, 15 nt, Mycobacterium bovis subsp bovis AF2122/97
ccccagcgccaccgu

SEQ ID NO: 3123498 - RNA, 13 nt, Mycobacterium bovis subsp bovis AF2122/97
ccccagcgccgcc

SEQ ID NO: 3123499 - RNA, 18 nt, Mycobacterium bovis subsp bovis AF2122/97
ccccagcggccaccgagg

SEQ ID NO: 3123500 - RNA, 15 nt, Mycobacterium bovis subsp bovis AF2122/97
ccccagcguucccgc

SEQ ID NO: 3123501 - RNA, 19 nt, Mycobacterium bovis subsp bovis AF2122/97
ccccagcguucccgccggc

SEQ ID NO: 3123502 - RNA, 13 nt, Mycobacterium bovis subsp bovis AF2122/97
ccccagcuuggcg

SEQ ID NO: 3123503 - RNA, 11 nt, Mycobacterium bovis subsp bovis AF2122/97
ccccaggcacc

SEQ ID NO: 3123504 - RNA, 20 nt, Mycobacterium bovis subsp bovis AF2122/97
ccccaggccgcuugccccgc

SEQ ID NO: 3123505 - RNA, 20 nt, Mycobacterium bovis subsp bovis AF2122/97
ccccaggcgcucagcgcggc

SEQ ID NO: 3123506 - RNA, 18 nt, Mycobacterium bovis subsp bovis AF2122/97
ccccaggcgcugccggug

SEQ ID NO: 3123507 - RNA, 15 nt, Mycobacterium bovis subsp bovis AF2122/97
ccccaggggaggcga

SEQ ID NO: 3123508 - RNA, 17 nt, Mycobacterium bovis subsp bovis AF2122/97
ccccagggggcgugccg

SEQ ID NO: 3123509 - RNA, 15 nt, Mycobacterium bovis subsp bovis AF2122/97
ccccagguagugcac

SEQ ID NO: 3123510 - RNA, 17 nt, Mycobacterium bovis subsp bovis AF2122/97
ccccagguagugcacac

SEQ ID NO: 3123511 - RNA, 13 nt, Mycobacterium bovis subsp bovis AF2122/97
ccccaggugggca

SEQ ID NO: 3123512 - RNA, 19 nt, Mycobacterium bovis subsp bovis AF2122/97
ccccaggugggcagcaggc

SEQ ID NO: 3123513 - RNA, 24 nt, Mycobacterium bovis subsp bovis AF2122/97
ccccaggugggcagcaggcccacc

SEQ ID NO: 3123514 - RNA, 23 nt, Mycobacterium bovis subsp bovis AF2122/97
ccccagugcagacaggcggcggc

SEQ ID NO: 3123515 - RNA, 12 nt, Mycobacterium bovis subsp bovis AF2122/97
ccccaguucggc

SEQ ID NO: 3123516 - RNA, 13 nt, Mycobacterium bovis subsp bovis AF2122/97
ccccaguucggcg

SEQ ID NO: 3123517 - RNA, 15 nt, Mycobacterium bovis subsp bovis AF2122/97
ccccaguucggcguc

SEQ ID NO: 3123518 - RNA, 18 nt, Mycobacterium bovis subsp bovis AF2122/97
ccccaguugugcggccag

SEQ ID NO: 3123519 - RNA, 20 nt, Mycobacterium bovis subsp bovis AF2122/97
ccccaguugugcggccaggc

SEQ ID NO: 3123520 - RNA, 14 nt, Mycobacterium bovis subsp bovis AF2122/97
ccccauacucggcg

SEQ ID NO: 3123521 - RNA, 16 nt, Mycobacterium bovis subsp bovis AF2122/97
ccccauacucggcggc

SEQ ID NO: 3123522 - RNA, 12 nt, Mycobacterium bovis subsp bovis AF2122/97
ccccgucgccga

SEQ ID NO: 3123523 - RNA, 19 nt, Mycobacterium bovis subsp bovis AF2122/97
ccccgugggguguggcggc

SEQ ID NO: 3123524 - RNA, 16 nt, Mycobacterium bovis subsp bovis AF2122/97
ccccguuccacgauca

SEQ ID NO: 3123525 - RNA, 14 nt, Mycobacterium bovis subsp bovis AF2122/97
ccccguucgccagg

SEQ ID NO: 3123526 - RNA, 18 nt, Mycobacterium bovis subsp bovis AF2122/97
ccccguucgccaggccgu

SEQ ID NO: 3123527 - RNA, 21 nt, Mycobacterium bovis subsp bovis AF2122/97
ccccguucuggaaccccgagc

SEQ ID NO: 3123528 - RNA, 20 nt, Mycobacterium bovis subsp bovis AF2122/97
ccccguugacccagaccggc

SEQ ID NO: 3123529 - RNA, 15 nt, Mycobacterium bovis subsp bovis AF2122/97
ccccguugagcagca

SEQ ID NO: 3123530 - RNA, 16 nt, Mycobacterium bovis subsp bovis AF2122/97
ccccguugagcagcac

SEQ ID NO: 3123531 - RNA, 18 nt, Mycobacterium bovis subsp bovis AF2122/97
ccccguugagcagcaccc

SEQ ID NO: 3123532 - RNA, 22 nt, Mycobacterium bovis subsp bovis AF2122/97
ccccguugccgccugucccgcc

SEQ ID NO: 3123533 - RNA, 15 nt, Mycobacterium bovis subsp bovis AF2122/97
ccccguuggcggugg

SEQ ID NO: 3123534 - RNA, 16 nt, Mycobacterium bovis subsp bovis AF2122/97
ccccuaaaccggcagg

SEQ ID NO: 3123535 - RNA, 18 nt, Mycobacterium bovis subsp bovis AF2122/97
ccccuccgaucacgcugu

SEQ ID NO: 3123536 - RNA, 12 nt, Mycobacterium bovis subsp bovis AF2122/97
ccccuccgcgcc

SEQ ID NO: 3123537 - RNA, 13 nt, Mycobacterium bovis subsp bovis AF2122/97
ccccuccggccac

SEQ ID NO: 3123538 - RNA, 15 nt, Mycobacterium bovis subsp bovis AF2122/97
ccccuccgggcgcac

SEQ ID NO: 3123539 - RNA, 16 nt, Mycobacterium bovis subsp bovis AF2122/97
ccccucggccgcccgu

SEQ ID NO: 3123540 - RNA, 22 nt, Mycobacterium bovis subsp bovis AF2122/97
ccccucggugccacugccggug

SEQ ID NO: 3123541 - RNA, 20 nt, Mycobacterium bovis subsp bovis AF2122/97
ccccucguccugcgagaggu

SEQ ID NO: 3123542 - RNA, 15 nt, Mycobacterium bovis subsp bovis AF2122/97
ccccucuagcgccuc

SEQ ID NO: 3123543 - RNA, 18 nt, Mycobacterium bovis subsp bovis AF2122/97
ccccucuagcgccucgcc

SEQ ID NO: 3123544 - RNA, 22 nt, Mycobacterium bovis subsp bovis AF2122/97
ccccucuugucuagcggucgcu

SEQ ID NO: 3123545 - RNA, 14 nt, Mycobacterium bovis subsp bovis AF2122/97
ccccugccacagcg

SEQ ID NO: 3123546 - RNA, 17 nt, Mycobacterium bovis subsp bovis AF2122/97
ccccugcgguccgcugc

SEQ ID NO: 3123547 - RNA, 13 nt, Mycobacterium bovis subsp bovis AF2122/97
ccccuggccagca

SEQ ID NO: 3123548 - RNA, 14 nt, Mycobacterium bovis subsp bovis AF2122/97
ccccuggccgccgg

SEQ ID NO: 3123549 - RNA, 18 nt, Mycobacterium bovis subsp bovis AF2122/97
ccccuggccgccggcgcc

SEQ ID NO: 3123550 - RNA, 22 nt, Mycobacterium bovis subsp bovis AF2122/97
ccccuggccgccggcgccgcca

SEQ ID NO: 3123551 - RNA, 22 nt, Mycobacterium bovis subsp bovis AF2122/97
ccccugucauguccugggccgc

SEQ ID NO: 3123552 - RNA, 21 nt, Mycobacterium bovis subsp bovis AF2122/97
ccccuguggacacggcgcugc

SEQ ID NO: 3123553 - RNA, 23 nt, Mycobacterium bovis subsp bovis AF2122/97
ccccuguggacacggcgcugccc

SEQ ID NO: 3123554 - RNA, 15 nt, Mycobacterium bovis subsp bovis AF2122/97
ccccuguugccccuc

SEQ ID NO: 3123555 - RNA, 18 nt, Mycobacterium bovis subsp bovis AF2122/97
ccccuucaaagcggccuc

SEQ ID NO: 3123556 - RNA, 23 nt, Mycobacterium bovis subsp bovis AF2122/97
ccccuucaaagcggccucgaccu

SEQ ID NO: 3123557 - RNA, 13 nt, Mycobacterium bovis subsp bovis AF2122/97
ccccuugaccgcu

SEQ ID NO: 3123558 - RNA, 17 nt, Mycobacterium bovis subsp bovis AF2122/97
ccccuugaccgcugccc

SEQ ID NO: 3123559 - RNA, 18 nt, Mycobacterium bovis subsp bovis AF2122/97
cccgaaaacugacccccu

SEQ ID NO: 3123560 - RNA, 22 nt, Mycobacterium bovis subsp bovis AF2122/97
cccgaaacgccggguucgccgg

SEQ ID NO: 3123561 - RNA, 21 nt, Mycobacterium bovis subsp bovis AF2122/97
cccgaaaugccgggcccgacg

SEQ ID NO: 3123562 - RNA, 17 nt, Mycobacterium bovis subsp bovis AF2122/97
cccgaacaauucacgca

SEQ ID NO: 3123563 - RNA, 19 nt, Mycobacterium bovis subsp bovis AF2122/97
cccgaacaauucacgcacc

SEQ ID NO: 3123564 - RNA, 18 nt, Mycobacterium bovis subsp bovis AF2122/97
cccgaacauccgccgccc

SEQ ID NO: 3123565 - RNA, 19 nt, Mycobacterium bovis subsp bovis AF2122/97
cccgaacauugcgcccagc

SEQ ID NO: 3123566 - RNA, 15 nt, Mycobacterium bovis subsp bovis AF2122/97
cccgaaccaccgcgu

SEQ ID NO: 3123567 - RNA, 20 nt, Mycobacterium bovis subsp bovis AF2122/97
cccgaaccgcaaggcccaca

SEQ ID NO: 3123568 - RNA, 12 nt, Mycobacterium bovis subsp bovis AF2122/97
cccgaaccgcgc

SEQ ID NO: 3123569 - RNA, 13 nt, Mycobacterium bovis subsp bovis AF2122/97
cccgaaccgcgcu

SEQ ID NO: 3123570 - RNA, 18 nt, Mycobacterium bovis subsp bovis AF2122/97
cccgaagaugaccucggc

SEQ ID NO: 3123571 - RNA, 19 nt, Mycobacterium bovis subsp bovis AF2122/97
cccgaagaugaccucggcg

SEQ ID NO: 3123572 - RNA, 23 nt, Mycobacterium bovis subsp bovis AF2122/97
cccgaagaugaccucggcgacga

SEQ ID NO: 3123573 - RNA, 14 nt, Mycobacterium bovis subsp bovis AF2122/97
cccgaagccgaccg

SEQ ID NO: 3123574 - RNA, 19 nt, Mycobacterium bovis subsp bovis AF2122/97
cccgaagccggugccggcg

SEQ ID NO: 3123575 - RNA, 21 nt, Mycobacterium bovis subsp bovis AF2122/97
cccgaagccggugccggcguu

SEQ ID NO: 3123576 - RNA, 17 nt, Mycobacterium bovis subsp bovis AF2122/97
cccgaagcgggcggaaa

SEQ ID NO: 3123577 - RNA, 21 nt, Mycobacterium bovis subsp bovis AF2122/97
cccgaaguagaagcccaggac

SEQ ID NO: 3123578 - RNA, 13 nt, Mycobacterium bovis subsp bovis AF2122/97
cccgaagucucgg

SEQ ID NO: 3123579 - RNA, 19 nt, Mycobacterium bovis subsp bovis AF2122/97
cccgaaguggugaccgacg

SEQ ID NO: 3123580 - RNA, 21 nt, Mycobacterium bovis subsp bovis AF2122/97
cccgaauagucggcaucgcga

SEQ ID NO: 3123581 - RNA, 23 nt, Mycobacterium bovis subsp bovis AF2122/97
cccgaauagucggcaucgcgagc

SEQ ID NO: 3123582 - RNA, 15 nt, Mycobacterium bovis subsp bovis AF2122/97
cccgaauccaccagc

SEQ ID NO: 3123583 - RNA, 14 nt, Mycobacterium bovis subsp bovis AF2122/97
cccgaaucgugcgg

SEQ ID NO: 3123584 - RNA, 15 nt, Mycobacterium bovis subsp bovis AF2122/97
cccgaauggcaucag

SEQ ID NO: 3123585 - RNA, 16 nt, Mycobacterium bovis subsp bovis AF2122/97
cccgaauggcaucagu

SEQ ID NO: 3123586 - RNA, 20 nt, Mycobacterium bovis subsp bovis AF2122/97
cccgaauucccuacgccgcc

SEQ ID NO: 3123587 - RNA, 14 nt, Mycobacterium bovis subsp bovis AF2122/97
cccgacaacggcgg

SEQ ID NO: 3123588 - RNA, 20 nt, Mycobacterium bovis subsp bovis AF2122/97
cccgacaauggcgccagccg

SEQ ID NO: 3123589 - RNA, 13 nt, Mycobacterium bovis subsp bovis AF2122/97
cccgacacccgca

SEQ ID NO: 3123590 - RNA, 19 nt, Mycobacterium bovis subsp bovis AF2122/97
cccgacaccguccagcagc

SEQ ID NO: 3123591 - RNA, 16 nt, Mycobacterium bovis subsp bovis AF2122/97
cccgacacggcggcug

SEQ ID NO: 3123592 - RNA, 16 nt, Mycobacterium bovis subsp bovis AF2122/97
cccgacaguggucccg

SEQ ID NO: 3123593 - RNA, 20 nt, Mycobacterium bovis subsp bovis AF2122/97
cccgacauacgucggggccg

SEQ ID NO: 3123594 - RNA, 16 nt, Mycobacterium bovis subsp bovis AF2122/97
cccgacaucgugaucc

SEQ ID NO: 3123595 - RNA, 22 nt, Mycobacterium bovis subsp bovis AF2122/97
cccgacaugguccgaccagcgg

SEQ ID NO: 3123596 - RNA, 13 nt, Mycobacterium bovis subsp bovis AF2122/97
cccgaccacugau

SEQ ID NO: 3123597 - RNA, 18 nt, Mycobacterium bovis subsp bovis AF2122/97
cccgaccacugaucggca

SEQ ID NO: 3123598 - RNA, 12 nt, Mycobacterium bovis subsp bovis AF2122/97
cccgaccagcac

SEQ ID NO: 3123599 - RNA, 14 nt, Mycobacterium bovis subsp bovis AF2122/97
cccgaccagcacca

SEQ ID NO: 3123600 - RNA, 14 nt, Mycobacterium bovis subsp bovis AF2122/97
cccgacccaucacc

SEQ ID NO: 3123601 - RNA, 20 nt, Mycobacterium bovis subsp bovis AF2122/97
cccgacccgccgacgccgcc

SEQ ID NO: 3123602 - RNA, 17 nt, Mycobacterium bovis subsp bovis AF2122/97
cccgacccugcugcagg

SEQ ID NO: 3123603 - RNA, 11 nt, Mycobacterium bovis subsp bovis AF2122/97
cccgaccgccg

SEQ ID NO: 3123604 - RNA, 13 nt, Mycobacterium bovis subsp bovis AF2122/97
cccgaccgccgag

SEQ ID NO: 3123605 - RNA, 17 nt, Mycobacterium bovis subsp bovis AF2122/97
cccgaccgccgagcggg

SEQ ID NO: 3123606 - RNA, 16 nt, Mycobacterium bovis subsp bovis AF2122/97
cccgaccgccguggcc

SEQ ID NO: 3123607 - RNA, 14 nt, Mycobacterium bovis subsp bovis AF2122/97
cccgaccgcugguu

SEQ ID NO: 3123608 - RNA, 20 nt, Mycobacterium bovis subsp bovis AF2122/97
cccgaccgguccagccaacg

SEQ ID NO: 3123609 - RNA, 23 nt, Mycobacterium bovis subsp bovis AF2122/97
cccgaucgaagaaacggcgucga

SEQ ID NO: 3123610 - RNA, 13 nt, Mycobacterium bovis subsp bovis AF2122/97
cccgaucggcaac

SEQ ID NO: 3123611 - RNA, 14 nt, Mycobacterium bovis subsp bovis AF2122/97
cccgaucggccacc

SEQ ID NO: 3123612 - RNA, 16 nt, Mycobacterium bovis subsp bovis AF2122/97
cccgaucucugcggcg

SEQ ID NO: 3123613 - RNA, 18 nt, Mycobacterium bovis subsp bovis AF2122/97
cccgaucucugcggcggu

SEQ ID NO: 3123614 - RNA, 19 nt, Mycobacterium bovis subsp bovis AF2122/97
cccgaugacccacugcagg

SEQ ID NO: 3123615 - RNA, 14 nt, Mycobacterium bovis subsp bovis AF2122/97
cccgaugaccgccu

SEQ ID NO: 3123616 - RNA, 22 nt, Mycobacterium bovis subsp bovis AF2122/97
cccgaugaggacauccggcgcc

SEQ ID NO: 3123617 - RNA, 23 nt, Mycobacterium bovis subsp bovis AF2122/97
cccgaugaggacauccggcgccg

SEQ ID NO: 3123618 - RNA, 15 nt, Mycobacterium bovis subsp bovis AF2122/97
cccgaugaucccgcc

SEQ ID NO: 3123619 - RNA, 16 nt, Mycobacterium bovis subsp bovis AF2122/97
cccgaugaucccgcca

SEQ ID NO: 3123620 - RNA, 21 nt, Mycobacterium bovis subsp bovis AF2122/97
cccgaugccgugccgggccag

SEQ ID NO: 3123621 - RNA, 23 nt, Mycobacterium bovis subsp bovis AF2122/97
cccgaugccgugccgggccagau

SEQ ID NO: 3123622 - RNA, 22 nt, Mycobacterium bovis subsp bovis AF2122/97
cccgauggcgucgccggccccg

SEQ ID NO: 3123623 - RNA, 14 nt, Mycobacterium bovis subsp bovis AF2122/97
cccgauggugccga

SEQ ID NO: 3123624 - RNA, 16 nt, Mycobacterium bovis subsp bovis AF2122/97
cccgauggugccgacc

SEQ ID NO: 3123625 - RNA, 20 nt, Mycobacterium bovis subsp bovis AF2122/97
cccgauggugccgacccgcc

SEQ ID NO: 3123626 - RNA, 21 nt, Mycobacterium bovis subsp bovis AF2122/97
cccgaugguggccgcgcgguc

SEQ ID NO: 3123627 - RNA, 16 nt, Mycobacterium bovis subsp bovis AF2122/97
cccgaugguggugccg

SEQ ID NO: 3123628 - RNA, 21 nt, Mycobacterium bovis subsp bovis AF2122/97
cccgaugguggugccgaccug

SEQ ID NO: 3123629 - RNA, 18 nt, Mycobacterium bovis subsp bovis AF2122/97
cccgauguaccccagcgc

SEQ ID NO: 3123630 - RNA, 23 nt, Mycobacterium bovis subsp bovis AF2122/97
cccgauguaccccagcgccacca

SEQ ID NO: 3123631 - RNA, 17 nt, Mycobacterium bovis subsp bovis AF2122/97
cccgaugucgucgacga

SEQ ID NO: 3123632 - RNA, 17 nt, Mycobacterium bovis subsp bovis AF2122/97
cccgauguuacggcccc

SEQ ID NO: 3123633 - RNA, 17 nt, Mycobacterium bovis subsp bovis AF2122/97
cccgauucagcgcccca

SEQ ID NO: 3123634 - RNA, 11 nt, Mycobacterium bovis subsp bovis AF2122/97
cccgauucugg

SEQ ID NO: 3123635 - RNA, 18 nt, Mycobacterium bovis subsp bovis AF2122/97
cccgauugaguucggcgg

SEQ ID NO: 3123636 - RNA, 21 nt, Mycobacterium bovis subsp bovis AF2122/97
cccgauugaguucggcggcca

SEQ ID NO: 3123637 - RNA, 21 nt, Mycobacterium bovis subsp bovis AF2122/97
cccgauuggccaaccccaugg

SEQ ID NO: 3123638 - RNA, 18 nt, Mycobacterium bovis subsp bovis AF2122/97
cccgcaaaaucgucagcg

SEQ ID NO: 3123639 - RNA, 19 nt, Mycobacterium bovis subsp bovis AF2122/97
cccgcaaaaucgucagcgc

SEQ ID NO: 3123640 - RNA, 20 nt, Mycobacterium bovis subsp bovis AF2122/97
cccgcaaaaucgucagcgcc

SEQ ID NO: 3123641 - RNA, 21 nt, Mycobacterium bovis subsp bovis AF2122/97
cccgcaaaaucgucagcgccg

SEQ ID NO: 3123642 - RNA, 23 nt, Mycobacterium bovis subsp bovis AF2122/97
cccgcaaaaucgucagcgccgcc

SEQ ID NO: 3123643 - RNA, 13 nt, Mycobacterium bovis subsp bovis AF2122/97
cccgcaacacuga

SEQ ID NO: 3123644 - RNA, 23 nt, Mycobacterium bovis subsp bovis AF2122/97
cccgcaacaucgggucgcugccg

SEQ ID NO: 3123645 - RNA, 23 nt, Mycobacterium bovis subsp bovis AF2122/97
cccgcaacgacugaucaagugcc

SEQ ID NO: 3123646 - RNA, 13 nt, Mycobacterium bovis subsp bovis AF2122/97
cccgcaacgccaa

SEQ ID NO: 3123647 - RNA, 16 nt, Mycobacterium bovis subsp bovis AF2122/97
cccgcaacgccaacac

SEQ ID NO: 3123648 - RNA, 22 nt, Mycobacterium bovis subsp bovis AF2122/97
cccgcaacgccaacacgcguug

SEQ ID NO: 3123649 - RNA, 15 nt, Mycobacterium bovis subsp bovis AF2122/97
cccgcaaugcgagcg

SEQ ID NO: 3123650 - RNA, 16 nt, Mycobacterium bovis subsp bovis AF2122/97
cccgcaaugcgagcgc

SEQ ID NO: 3123651 - RNA, 17 nt, Mycobacterium bovis subsp bovis AF2122/97
cccgcaauucgcggucc

SEQ ID NO: 3123652 - RNA, 20 nt, Mycobacterium bovis subsp bovis AF2122/97
cccgcacacagaccgugacg

SEQ ID NO: 3123653 - RNA, 13 nt, Mycobacterium bovis subsp bovis AF2122/97
cccgcaccacacc

SEQ ID NO: 3123654 - RNA, 22 nt, Mycobacterium bovis subsp bovis AF2122/97
cccgcaccacaccgugggcgac

SEQ ID NO: 3123655 - RNA, 15 nt, Mycobacterium bovis subsp bovis AF2122/97
cccgcaccaccggcc

SEQ ID NO: 3123656 - RNA, 15 nt, Mycobacterium bovis subsp bovis AF2122/97
cccgcaccccggccg

SEQ ID NO: 3123657 - RNA, 17 nt, Mycobacterium bovis subsp bovis AF2122/97
cccgcaccccggccgcg

SEQ ID NO: 3123658 - RNA, 15 nt, Mycobacterium bovis subsp bovis AF2122/97
cccgcacccggccca

SEQ ID NO: 3123659 - RNA, 13 nt, Mycobacterium bovis subsp bovis AF2122/97
cccgcaccgcggu

SEQ ID NO: 3123660 - RNA, 16 nt, Mycobacterium bovis subsp bovis AF2122/97
cccgcaccgcgguacg

SEQ ID NO: 3123661 - RNA, 21 nt, Mycobacterium bovis subsp bovis AF2122/97
cccgcaccgcguucugguugu

SEQ ID NO: 3123662 - RNA, 14 nt, Mycobacterium bovis subsp bovis AF2122/97
cccgcaccggaucg

SEQ ID NO: 3123663 - RNA, 12 nt, Mycobacterium bovis subsp bovis AF2122/97
cccgcaccggug

SEQ ID NO: 3123664 - RNA, 16 nt, Mycobacterium bovis subsp bovis AF2122/97
cccgcaccggugacgc

SEQ ID NO: 3123665 - RNA, 17 nt, Mycobacterium bovis subsp bovis AF2122/97
cccgcaccggugacgca

SEQ ID NO: 3123666 - RNA, 22 nt, Mycobacterium bovis subsp bovis AF2122/97
cccgcaccggugacgcacagca

SEQ ID NO: 3123667 - RNA, 18 nt, Mycobacterium bovis subsp bovis AF2122/97
cccgcaccuacccugcgc

SEQ ID NO: 3123668 - RNA, 14 nt, Mycobacterium bovis subsp bovis AF2122/97
cccgcaccucaccg

SEQ ID NO: 3123669 - RNA, 18 nt, Mycobacterium bovis subsp bovis AF2122/97
cccgcacgaagccggcuu

SEQ ID NO: 3123670 - RNA, 21 nt, Mycobacterium bovis subsp bovis AF2122/97
cccgcacgacgaauccccgac

SEQ ID NO: 3123671 - RNA, 23 nt, Mycobacterium bovis subsp bovis AF2122/97
cccgcacgaguuaccgguggugc

SEQ ID NO: 3123672 - RNA, 20 nt, Mycobacterium bovis subsp bovis AF2122/97
cccgcacgcacggcgugucg

SEQ ID NO: 3123673 - RNA, 14 nt, Mycobacterium bovis subsp bovis AF2122/97
cccgcacgcucgcc

SEQ ID NO: 3123674 - RNA, 13 nt, Mycobacterium bovis subsp bovis AF2122/97
cccgcacgcucgg

SEQ ID NO: 3123675 - RNA, 18 nt, Mycobacterium bovis subsp bovis AF2122/97
cccgcacgcucggcgggg

SEQ ID NO: 3123676 - RNA, 20 nt, Mycobacterium bovis subsp bovis AF2122/97
cccgcacgcucggcgugucg

SEQ ID NO: 3123677 - RNA, 17 nt, Mycobacterium bovis subsp bovis AF2122/97
cccgcacggccuccgga

SEQ ID NO: 3123678 - RNA, 13 nt, Mycobacterium bovis subsp bovis AF2122/97
cccgcacggugua

SEQ ID NO: 3123679 - RNA, 17 nt, Mycobacterium bovis subsp bovis AF2122/97
cccgcacguucacgcgc

SEQ ID NO: 3123680 - RNA, 13 nt, Mycobacterium bovis subsp bovis AF2122/97
cccgcacugccgc

SEQ ID NO: 3123681 - RNA, 21 nt, Mycobacterium bovis subsp bovis AF2122/97
cccgcacugccgccgguuccg

SEQ ID NO: 3123682 - RNA, 15 nt, Mycobacterium bovis subsp bovis AF2122/97
cccgcagaauccggc

SEQ ID NO: 3123683 - RNA, 23 nt, Mycobacterium bovis subsp bovis AF2122/97
cccgcagaccgguuucuucggcc

SEQ ID NO: 3123684 - RNA, 13 nt, Mycobacterium bovis subsp bovis AF2122/97
cccgcagcagcau

SEQ ID NO: 3123685 - RNA, 14 nt, Mycobacterium bovis subsp bovis AF2122/97
cccgcagcccgccg

SEQ ID NO: 3123686 - RNA, 15 nt, Mycobacterium bovis subsp bovis AF2122/97
cccgcagcccgccgg

SEQ ID NO: 3123687 - RNA, 17 nt, Mycobacterium bovis subsp bovis AF2122/97
cccgcagcccgccgggc

SEQ ID NO: 3123688 - RNA, 20 nt, Mycobacterium bovis subsp bovis AF2122/97
cccgcagccgggcaccaccc

SEQ ID NO: 3123689 - RNA, 12 nt, Mycobacterium bovis subsp bovis AF2122/97
cccgcagcucga

SEQ ID NO: 3123690 - RNA, 13 nt, Mycobacterium bovis subsp bovis AF2122/97
cccgcaggacgcu

SEQ ID NO: 3123691 - RNA, 15 nt, Mycobacterium bovis subsp bovis AF2122/97
cccgcaggacgcugc

SEQ ID NO: 3123692 - RNA, 16 nt, Mycobacterium bovis subsp bovis AF2122/97
cccgcaggcuuccccg

SEQ ID NO: 3123693 - RNA, 19 nt, Mycobacterium bovis subsp bovis AF2122/97
cccgcagguagucgucgac

SEQ ID NO: 3123694 - RNA, 21 nt, Mycobacterium bovis subsp bovis AF2122/97
cccgcaggucgaucugcgcca

SEQ ID NO: 3123695 - RNA, 13 nt, Mycobacterium bovis subsp bovis AF2122/97
cccgccgccggug

SEQ ID NO: 3123696 - RNA, 22 nt, Mycobacterium bovis subsp bovis AF2122/97
cccgccgcgaacuccagcagcc

SEQ ID NO: 3123697 - RNA, 11 nt, Mycobacterium bovis subsp bovis AF2122/97
cccgccgcgac

SEQ ID NO: 3123698 - RNA, 21 nt, Mycobacterium bovis subsp bovis AF2122/97
cccgccgcgaccacgcaccgc

SEQ ID NO: 3123699 - RNA, 12 nt, Mycobacterium bovis subsp bovis AF2122/97
cccgccgcgccc

SEQ ID NO: 3123700 - RNA, 16 nt, Mycobacterium bovis subsp bovis AF2122/97
cccgccgcgcccggcg

SEQ ID NO: 3123701 - RNA, 13 nt, Mycobacterium bovis subsp bovis AF2122/97
cccgccgcgugcu

SEQ ID NO: 3123702 - RNA, 14 nt, Mycobacterium bovis subsp bovis AF2122/97
cccgccgcugccgc

SEQ ID NO: 3123703 - RNA, 19 nt, Mycobacterium bovis subsp bovis AF2122/97
cccgccggaacugcgcaac

SEQ ID NO: 3123704 - RNA, 22 nt, Mycobacterium bovis subsp bovis AF2122/97
cccgccggaacugcgcaacacc

SEQ ID NO: 3123705 - RNA, 16 nt, Mycobacterium bovis subsp bovis AF2122/97
cccgccggauccgcca

SEQ ID NO: 3123706 - RNA, 17 nt, Mycobacterium bovis subsp bovis AF2122/97
cccgccggauucgcccg

SEQ ID NO: 3123707 - RNA, 12 nt, Mycobacterium bovis subsp bovis AF2122/97
cccgccggcacg

SEQ ID NO: 3123708 - RNA, 13 nt, Mycobacterium bovis subsp bovis AF2122/97
cccgccggcagug

SEQ ID NO: 3123709 - RNA, 15 nt, Mycobacterium bovis subsp bovis AF2122/97
cccgccggcagugag

SEQ ID NO: 3123710 - RNA, 12 nt, Mycobacterium bovis subsp bovis AF2122/97
cccgccggcccc

SEQ ID NO: 3123711 - RNA, 13 nt, Mycobacterium bovis subsp bovis AF2122/97
cccgccggccccg

SEQ ID NO: 3123712 - RNA, 14 nt, Mycobacterium bovis subsp bovis AF2122/97
cccgccggccccgc

SEQ ID NO: 3123713 - RNA, 21 nt, Mycobacterium bovis subsp bovis AF2122/97
cccgccggccccgccggcccc

SEQ ID NO: 3123714 - RNA, 22 nt, Mycobacterium bovis subsp bovis AF2122/97
cccgccggccccgccggccccg

SEQ ID NO: 3123715 - RNA, 18 nt, Mycobacterium bovis subsp bovis AF2122/97
cccgccggccccgccguu

SEQ ID NO: 3123716 - RNA, 13 nt, Mycobacterium bovis subsp bovis AF2122/97
cccgccggcgggu

SEQ ID NO: 3123717 - RNA, 15 nt, Mycobacterium bovis subsp bovis AF2122/97
cccgccggcuccgcc

SEQ ID NO: 3123718 - RNA, 16 nt, Mycobacterium bovis subsp bovis AF2122/97
cccgccggcuccgcca

SEQ ID NO: 3123719 - RNA, 21 nt, Mycobacterium bovis subsp bovis AF2122/97
cccgccggcuccgccacuggc

SEQ ID NO: 3123720 - RNA, 17 nt, Mycobacterium bovis subsp bovis AF2122/97
cccgccgggcuccacgu

SEQ ID NO: 3123721 - RNA, 18 nt, Mycobacterium bovis subsp bovis AF2122/97
cccgccgggcuccacguc

SEQ ID NO: 3123722 - RNA, 20 nt, Mycobacterium bovis subsp bovis AF2122/97
cccgccggucacgacguccg

SEQ ID NO: 3123723 - RNA, 16 nt, Mycobacterium bovis subsp bovis AF2122/97
cccgccggugaucggc

SEQ ID NO: 3123724 - RNA, 17 nt, Mycobacterium bovis subsp bovis AF2122/97
cccgccggugaucggcg

SEQ ID NO: 3123725 - RNA, 22 nt, Mycobacterium bovis subsp bovis AF2122/97
cccgccggugaucggcggcaac

SEQ ID NO: 3123726 - RNA, 14 nt, Mycobacterium bovis subsp bovis AF2122/97
cccgccgguggccg

SEQ ID NO: 3123727 - RNA, 14 nt, Mycobacterium bovis subsp bovis AF2122/97
cccgccguagacca

SEQ ID NO: 3123728 - RNA, 13 nt, Mycobacterium bovis subsp bovis AF2122/97
cccgccgucaccc

SEQ ID NO: 3123729 - RNA, 16 nt, Mycobacterium bovis subsp bovis AF2122/97
cccgccgucacccccg

SEQ ID NO: 3123730 - RNA, 16 nt, Mycobacterium bovis subsp bovis AF2122/97
cccgccguccggcgcc

SEQ ID NO: 3123731 - RNA, 18 nt, Mycobacterium bovis subsp bovis AF2122/97
cccgccguccggcgccca

SEQ ID NO: 3123732 - RNA, 13 nt, Mycobacterium bovis subsp bovis AF2122/97
cccgccgucgcca

SEQ ID NO: 3123733 - RNA, 16 nt, Mycobacterium bovis subsp bovis AF2122/97
cccgccgucgccacca

SEQ ID NO: 3123734 - RNA, 13 nt, Mycobacterium bovis subsp bovis AF2122/97
cccgccgucgccg

SEQ ID NO: 3123735 - RNA, 16 nt, Mycobacterium bovis subsp bovis AF2122/97
cccgccgucgccgccg

SEQ ID NO: 3123736 - RNA, 20 nt, Mycobacterium bovis subsp bovis AF2122/97
cccgccgucuuggcccgguc

SEQ ID NO: 3123737 - RNA, 12 nt, Mycobacterium bovis subsp bovis AF2122/97
cccgccgugccg

SEQ ID NO: 3123738 - RNA, 13 nt, Mycobacterium bovis subsp bovis AF2122/97
cccgccgugccgc

SEQ ID NO: 3123739 - RNA, 15 nt, Mycobacterium bovis subsp bovis AF2122/97
cccgccgugccgcgg

SEQ ID NO: 3123740 - RNA, 20 nt, Mycobacterium bovis subsp bovis AF2122/97
cccgccgugccgcggcgacg

SEQ ID NO: 3123741 - RNA, 21 nt, Mycobacterium bovis subsp bovis AF2122/97
cccgccguugaacggcaccag

SEQ ID NO: 3123742 - RNA, 14 nt, Mycobacterium bovis subsp bovis AF2122/97
cccgccguugccgc

SEQ ID NO: 3123743 - RNA, 16 nt, Mycobacterium bovis subsp bovis AF2122/97
cccgccguugccgccg

SEQ ID NO: 3123744 - RNA, 19 nt, Mycobacterium bovis subsp bovis AF2122/97
cccgccguugccgccgacg

SEQ ID NO: 3123745 - RNA, 22 nt, Mycobacterium bovis subsp bovis AF2122/97
cccgccguugccgccgacgccg

SEQ ID NO: 3123746 - RNA, 23 nt, Mycobacterium bovis subsp bovis AF2122/97
cccgccguugccgccgucaccgc

SEQ ID NO: 3123747 - RNA, 19 nt, Mycobacterium bovis subsp bovis AF2122/97
cccgccguuuccgccgccg

SEQ ID NO: 3123748 - RNA, 21 nt, Mycobacterium bovis subsp bovis AF2122/97
cccgccuaaagcgugucgccc

SEQ ID NO: 3123749 - RNA, 16 nt, Mycobacterium bovis subsp bovis AF2122/97
cccgccuacgacgcag

SEQ ID NO: 3123750 - RNA, 17 nt, Mycobacterium bovis subsp bovis AF2122/97
cccgccucaucuccugu

SEQ ID NO: 3123751 - RNA, 16 nt, Mycobacterium bovis subsp bovis AF2122/97
cccgccucgaccgcca

SEQ ID NO: 3123752 - RNA, 20 nt, Mycobacterium bovis subsp bovis AF2122/97
cccgccucgaccgccagccc

SEQ ID NO: 3123753 - RNA, 17 nt, Mycobacterium bovis subsp bovis AF2122/97
cccgccucggcggcggc

SEQ ID NO: 3123754 - RNA, 18 nt, Mycobacterium bovis subsp bovis AF2122/97
cccgccugaccgccaccg

SEQ ID NO: 3123755 - RNA, 17 nt, Mycobacterium bovis subsp bovis AF2122/97
cccgccuguaccggcgu

SEQ ID NO: 3123756 - RNA, 13 nt, Mycobacterium bovis subsp bovis AF2122/97
cccgccuuggcca

SEQ ID NO: 3123757 - RNA, 14 nt, Mycobacterium bovis subsp bovis AF2122/97
cccgccuuggccac

SEQ ID NO: 3123758 - RNA, 22 nt, Mycobacterium bovis subsp bovis AF2122/97
cccgcgaaauauuggcccguca

SEQ ID NO: 3123759 - RNA, 19 nt, Mycobacterium bovis subsp bovis AF2122/97
cccgcgaaccgcggaucga

SEQ ID NO: 3123760 - RNA, 22 nt, Mycobacterium bovis subsp bovis AF2122/97
cccgcgaacgcgacagccaccu

SEQ ID NO: 3123761 - RNA, 23 nt, Mycobacterium bovis subsp bovis AF2122/97
cccgcgaacgcgacagccaccuc

SEQ ID NO: 3123762 - RNA, 15 nt, Mycobacterium bovis subsp bovis AF2122/97
cccgcgaagccgcca

SEQ ID NO: 3123763 - RNA, 21 nt, Mycobacterium bovis subsp bovis AF2122/97
cccgcgaagcgggaaggcuca

SEQ ID NO: 3123764 - RNA, 22 nt, Mycobacterium bovis subsp bovis AF2122/97
cccgcgagaucgggccggccgc

SEQ ID NO: 3123765 - RNA, 13 nt, Mycobacterium bovis subsp bovis AF2122/97
cccgcgagcagcc

SEQ ID NO: 3123766 - RNA, 17 nt, Mycobacterium bovis subsp bovis AF2122/97
cccgcgagcagcccggc

SEQ ID NO: 3123767 - RNA, 21 nt, Mycobacterium bovis subsp bovis AF2122/97
cccgcgagguugaccaccagc

SEQ ID NO: 3123768 - RNA, 22 nt, Mycobacterium bovis subsp bovis AF2122/97
cccgcgagguugaccaccagcg

SEQ ID NO: 3123769 - RNA, 16 nt, Mycobacterium bovis subsp bovis AF2122/97
cccgcgaugcgcacca

SEQ ID NO: 3123770 - RNA, 13 nt, Mycobacterium bovis subsp bovis AF2122/97
cccgcgcagcacu

SEQ ID NO: 3123771 - RNA, 16 nt, Mycobacterium bovis subsp bovis AF2122/97
cccgcgcagcgguccg

SEQ ID NO: 3123772 - RNA, 13 nt, Mycobacterium bovis subsp bovis AF2122/97
cccgcgccaccag

SEQ ID NO: 3123773 - RNA, 18 nt, Mycobacterium bovis subsp bovis AF2122/97
cccgcgccaccggcaccg

SEQ ID NO: 3123774 - RNA, 20 nt, Mycobacterium bovis subsp bovis AF2122/97
cccgcgccaccggcaccgcc

SEQ ID NO: 3123775 - RNA, 12 nt, Mycobacterium bovis subsp bovis AF2122/97
cccgcgcccaac

SEQ ID NO: 3123776 - RNA, 18 nt, Mycobacterium bovis subsp bovis AF2122/97
cccgcgcccccggugccg

SEQ ID NO: 3123777 - RNA, 12 nt, Mycobacterium bovis subsp bovis AF2122/97
cccgcgccgccc

SEQ ID NO: 3123778 - RNA, 20 nt, Mycobacterium bovis subsp bovis AF2122/97
cccgcgccgcccgcgccccc

SEQ ID NO: 3123779 - RNA, 13 nt, Mycobacterium bovis subsp bovis AF2122/97
cccgcgccgccgc

SEQ ID NO: 3123780 - RNA, 14 nt, Mycobacterium bovis subsp bovis AF2122/97
cccgcgccgccgcc

SEQ ID NO: 3123781 - RNA, 15 nt, Mycobacterium bovis subsp bovis AF2122/97
cccgcgccgccgcca

SEQ ID NO: 3123782 - RNA, 19 nt, Mycobacterium bovis subsp bovis AF2122/97
cccgcucggcgcgcggguu

SEQ ID NO: 3123783 - RNA, 18 nt, Mycobacterium bovis subsp bovis AF2122/97
cccgcucgggguugcucg

SEQ ID NO: 3123784 - RNA, 21 nt, Mycobacterium bovis subsp bovis AF2122/97
cccgcucgggguugcucgcga

SEQ ID NO: 3123785 - RNA, 14 nt, Mycobacterium bovis subsp bovis AF2122/97
cccgcugaccauca

SEQ ID NO: 3123786 - RNA, 16 nt, Mycobacterium bovis subsp bovis AF2122/97
cccgcugccacccauc

SEQ ID NO: 3123787 - RNA, 23 nt, Mycobacterium bovis subsp bovis AF2122/97
cccgcugccauugccugggcgac

SEQ ID NO: 3123788 - RNA, 15 nt, Mycobacterium bovis subsp bovis AF2122/97
cccgcugcggcggcu

SEQ ID NO: 3123789 - RNA, 14 nt, Mycobacterium bovis subsp bovis AF2122/97
cccgcuggcccgcc

SEQ ID NO: 3123790 - RNA, 15 nt, Mycobacterium bovis subsp bovis AF2122/97
cccgcuggcccgcca

SEQ ID NO: 3123791 - RNA, 16 nt, Mycobacterium bovis subsp bovis AF2122/97
cccgcuggccuccugg

SEQ ID NO: 3123792 - RNA, 15 nt, Mycobacterium bovis subsp bovis AF2122/97
cccgcuggcgguaag

SEQ ID NO: 3123793 - RNA, 21 nt, Mycobacterium bovis subsp bovis AF2122/97
cccgcugggcuuggggccgga

SEQ ID NO: 3123794 - RNA, 17 nt, Mycobacterium bovis subsp bovis AF2122/97
cccgcuggucgaccggc

SEQ ID NO: 3123795 - RNA, 13 nt, Mycobacterium bovis subsp bovis AF2122/97
cccgcugguggug

SEQ ID NO: 3123796 - RNA, 13 nt, Mycobacterium bovis subsp bovis AF2122/97
cccgcuguaccuc

SEQ ID NO: 3123797 - RNA, 15 nt, Mycobacterium bovis subsp bovis AF2122/97
cccgcuguaccucca

SEQ ID NO: 3123798 - RNA, 19 nt, Mycobacterium bovis subsp bovis AF2122/97
cccgcuguuuggcaacauc

SEQ ID NO: 3123799 - RNA, 15 nt, Mycobacterium bovis subsp bovis AF2122/97
cccgcuucagcacgg

SEQ ID NO: 3123800 - RNA, 19 nt, Mycobacterium bovis subsp bovis AF2122/97
cccgcuuggaccguugccg

SEQ ID NO: 3123801 - RNA, 20 nt, Mycobacterium bovis subsp bovis AF2122/97
cccgcuuggcgagccacggc

SEQ ID NO: 3123802 - RNA, 17 nt, Mycobacterium bovis subsp bovis AF2122/97
cccgcuuuuucccggcg

SEQ ID NO: 3123803 - RNA, 19 nt, Mycobacterium bovis subsp bovis AF2122/97
cccgcuuuuucccggcggc

SEQ ID NO: 3123804 - RNA, 23 nt, Mycobacterium bovis subsp bovis AF2122/97
cccgcuuuuucccggcggcgcgc

SEQ ID NO: 3123805 - RNA, 14 nt, Mycobacterium bovis subsp bovis AF2122/97
cccggaaccagccg

SEQ ID NO: 3123806 - RNA, 15 nt, Mycobacterium bovis subsp bovis AF2122/97
cccggaaccagccgc

SEQ ID NO: 3123807 - RNA, 16 nt, Mycobacterium bovis subsp bovis AF2122/97
cccggaacccgagccg

SEQ ID NO: 3123808 - RNA, 20 nt, Mycobacterium bovis subsp bovis AF2122/97
cccggaacccgagccgguaa

SEQ ID NO: 3123809 - RNA, 14 nt, Mycobacterium bovis subsp bovis AF2122/97
cccggaaccggcgu

SEQ ID NO: 3123810 - RNA, 15 nt, Mycobacterium bovis subsp bovis AF2122/97
cccggaaccggcgug

SEQ ID NO: 3123811 - RNA, 21 nt, Mycobacterium bovis subsp bovis AF2122/97
cccggaacgaaugucaccccg

SEQ ID NO: 3123812 - RNA, 18 nt, Mycobacterium bovis subsp bovis AF2122/97
cccggacagggcggcgag

SEQ ID NO: 3123813 - RNA, 21 nt, Mycobacterium bovis subsp bovis AF2122/97
cccggacagggugggggcauc

SEQ ID NO: 3123814 - RNA, 21 nt, Mycobacterium bovis subsp bovis AF2122/97
cccggacaugcgggcagcacu

SEQ ID NO: 3123815 - RNA, 14 nt, Mycobacterium bovis subsp bovis AF2122/97
cccggaccacuguu

SEQ ID NO: 3123816 - RNA, 18 nt, Mycobacterium bovis subsp bovis AF2122/97
cccggaccgucguggcgg

SEQ ID NO: 3123817 - RNA, 14 nt, Mycobacterium bovis subsp bovis AF2122/97
cccggaccuucggc

SEQ ID NO: 3123818 - RNA, 16 nt, Mycobacterium bovis subsp bovis AF2122/97
cccggaccuucggcgg

SEQ ID NO: 3123819 - RNA, 16 nt, Mycobacterium bovis subsp bovis AF2122/97
cccggacgauggcguc

SEQ ID NO: 3123820 - RNA, 17 nt, Mycobacterium bovis subsp bovis AF2122/97
cccggacgauggcgucg

SEQ ID NO: 3123821 - RNA, 21 nt, Mycobacterium bovis subsp bovis AF2122/97
cccggacgauggcgucggcca

SEQ ID NO: 3123822 - RNA, 16 nt, Mycobacterium bovis subsp bovis AF2122/97
cccggacgcaacaccc

SEQ ID NO: 3123823 - RNA, 18 nt, Mycobacterium bovis subsp bovis AF2122/97
cccggacguaggcacccc

SEQ ID NO: 3123824 - RNA, 12 nt, Mycobacterium bovis subsp bovis AF2122/97
cccggacgucgg

SEQ ID NO: 3123825 - RNA, 22 nt, Mycobacterium bovis subsp bovis AF2122/97
cccggacuccaaagccgugcca

SEQ ID NO: 3123826 - RNA, 23 nt, Mycobacterium bovis subsp bovis AF2122/97
cccggacucuccccuggccccca

SEQ ID NO: 3123827 - RNA, 15 nt, Mycobacterium bovis subsp bovis AF2122/97
cccggagcacccggg

SEQ ID NO: 3123828 - RNA, 17 nt, Mycobacterium bovis subsp bovis AF2122/97
cccggagccgccaggug

SEQ ID NO: 3123829 - RNA, 18 nt, Mycobacterium bovis subsp bovis AF2122/97
cccggagcggucagcgga

SEQ ID NO: 3123830 - RNA, 15 nt, Mycobacterium bovis subsp bovis AF2122/97
cccggauagacggcg

SEQ ID NO: 3123831 - RNA, 16 nt, Mycobacterium bovis subsp bovis AF2122/97
cccggauaucgaccac

SEQ ID NO: 3123832 - RNA, 12 nt, Mycobacterium bovis subsp bovis AF2122/97
cccggauccguc

SEQ ID NO: 3123833 - RNA, 22 nt, Mycobacterium bovis subsp bovis AF2122/97
cccggaugccgaccuagcucgc

SEQ ID NO: 3123834 - RNA, 18 nt, Mycobacterium bovis subsp bovis AF2122/97
cccggauguccgccgacg

SEQ ID NO: 3123835 - RNA, 19 nt, Mycobacterium bovis subsp bovis AF2122/97
cccggaugucgugcgggcg

SEQ ID NO: 3123836 - RNA, 21 nt, Mycobacterium bovis subsp bovis AF2122/97
cccggaugucgugcgggcgca

SEQ ID NO: 3123837 - RNA, 14 nt, Mycobacterium bovis subsp bovis AF2122/97
cccggcacacccuc

SEQ ID NO: 3123838 - RNA, 17 nt, Mycobacterium bovis subsp bovis AF2122/97
cccggcacacggccuug

SEQ ID NO: 3123839 - RNA, 21 nt, Mycobacterium bovis subsp bovis AF2122/97
cccggcacccaguuccacccg

SEQ ID NO: 3123840 - RNA, 19 nt, Mycobacterium bovis subsp bovis AF2122/97
cccggcaccccuuugacgc

SEQ ID NO: 3123841 - RNA, 18 nt, Mycobacterium bovis subsp bovis AF2122/97
cccggcacccggugagaa

SEQ ID NO: 3123842 - RNA, 13 nt, Mycobacterium bovis subsp bovis AF2122/97
cccggcaccgccg

SEQ ID NO: 3123843 - RNA, 15 nt, Mycobacterium bovis subsp bovis AF2122/97
cccggcacggugucg

SEQ ID NO: 3123844 - RNA, 15 nt, Mycobacterium bovis subsp bovis AF2122/97
cccggcacugaccgc

SEQ ID NO: 3123845 - RNA, 17 nt, Mycobacterium bovis subsp bovis AF2122/97
cccggcagagcacgcgc

SEQ ID NO: 3123846 - RNA, 23 nt, Mycobacterium bovis subsp bovis AF2122/97
cccggcagagcacgcgcggcguc

SEQ ID NO: 3123847 - RNA, 22 nt, Mycobacterium bovis subsp bovis AF2122/97
cccggcagauguguccggcauc

SEQ ID NO: 3123848 - RNA, 16 nt, Mycobacterium bovis subsp bovis AF2122/97
cccggcagcacgugga

SEQ ID NO: 3123849 - RNA, 13 nt, Mycobacterium bovis subsp bovis AF2122/97
cccggcagcaucg

SEQ ID NO: 3123850 - RNA, 21 nt, Mycobacterium bovis subsp bovis AF2122/97
cccggcagcaucggucacacc

SEQ ID NO: 3123851 - RNA, 15 nt, Mycobacterium bovis subsp bovis AF2122/97
cccggcagcccggcg

SEQ ID NO: 3123852 - RNA, 17 nt, Mycobacterium bovis subsp bovis AF2122/97
cccggcagcccggcggc

SEQ ID NO: 3123853 - RNA, 18 nt, Mycobacterium bovis subsp bovis AF2122/97
cccggcagcuggucggug

SEQ ID NO: 3123854 - RNA, 21 nt, Mycobacterium bovis subsp bovis AF2122/97
cccggcauacaacuggugggc

SEQ ID NO: 3123855 - RNA, 23 nt, Mycobacterium bovis subsp bovis AF2122/97
cccggcauacaacuggugggcca

SEQ ID NO: 3123856 - RNA, 16 nt, Mycobacterium bovis subsp bovis AF2122/97
cccggcauacucuuug

SEQ ID NO: 3123857 - RNA, 21 nt, Mycobacterium bovis subsp bovis AF2122/97
cccggcauagccacgcaagca

SEQ ID NO: 3123858 - RNA, 14 nt, Mycobacterium bovis subsp bovis AF2122/97
cccggccaaaaugg

SEQ ID NO: 3123859 - RNA, 14 nt, Mycobacterium bovis subsp bovis AF2122/97
cccggccaaccacc

SEQ ID NO: 3123860 - RNA, 15 nt, Mycobacterium bovis subsp bovis AF2122/97
cccggccaaccacca

SEQ ID NO: 3123861 - RNA, 16 nt, Mycobacterium bovis subsp bovis AF2122/97
cccggccaaccaccaa

SEQ ID NO: 3123862 - RNA, 17 nt, Mycobacterium bovis subsp bovis AF2122/97
cccggccaaccaccaac

SEQ ID NO: 3123863 - RNA, 13 nt, Mycobacterium bovis subsp bovis AF2122/97
cccggccaacccg

SEQ ID NO: 3123864 - RNA, 13 nt, Mycobacterium bovis subsp bovis AF2122/97
cccggccaagccg

SEQ ID NO: 3123865 - RNA, 17 nt, Mycobacterium bovis subsp bovis AF2122/97
cccggccaccagcaugc

SEQ ID NO: 3123866 - RNA, 12 nt, Mycobacterium bovis subsp bovis AF2122/97
cccggccagccg

SEQ ID NO: 3123867 - RNA, 13 nt, Mycobacterium bovis subsp bovis AF2122/97
cccggccagcggc

SEQ ID NO: 3123868 - RNA, 15 nt, Mycobacterium bovis subsp bovis AF2122/97
cccggccagcuccuc

SEQ ID NO: 3123869 - RNA, 22 nt, Mycobacterium bovis subsp bovis AF2122/97
cccggcggugccgucagcggcg

SEQ ID NO: 3123870 - RNA, 21 nt, Mycobacterium bovis subsp bovis AF2122/97
cccggcguauugcaccgccag

SEQ ID NO: 3123871 - RNA, 22 nt, Mycobacterium bovis subsp bovis AF2122/97
cccggcguauugcaccgccagg

SEQ ID NO: 3123872 - RNA, 20 nt, Mycobacterium bovis subsp bovis AF2122/97
cccggcguggcuucacccaa

SEQ ID NO: 3123873 - RNA, 22 nt, Mycobacterium bovis subsp bovis AF2122/97
cccggcguggcuucacccaacc

SEQ ID NO: 3123874 - RNA, 21 nt, Mycobacterium bovis subsp bovis AF2122/97
cccggcguggugagccucggc

SEQ ID NO: 3123875 - RNA, 18 nt, Mycobacterium bovis subsp bovis AF2122/97
cccggcgugucgccgcca

SEQ ID NO: 3123876 - RNA, 15 nt, Mycobacterium bovis subsp bovis AF2122/97
cccggcguugccgcc

SEQ ID NO: 3123877 - RNA, 16 nt, Mycobacterium bovis subsp bovis AF2122/97
cccggcguugccgccg

SEQ ID NO: 3123878 - RNA, 17 nt, Mycobacterium bovis subsp bovis AF2122/97
cccggcuacgacggcgc

SEQ ID NO: 3123879 - RNA, 18 nt, Mycobacterium bovis subsp bovis AF2122/97
cccggcuaggagaucagc

SEQ ID NO: 3123880 - RNA, 12 nt, Mycobacterium bovis subsp bovis AF2122/97
cccggcuccagc

SEQ ID NO: 3123881 - RNA, 14 nt, Mycobacterium bovis subsp bovis AF2122/97
cccggcuccagcac

SEQ ID NO: 3123882 - RNA, 14 nt, Mycobacterium bovis subsp bovis AF2122/97
cccggcuccgcaac

SEQ ID NO: 3123883 - RNA, 16 nt, Mycobacterium bovis subsp bovis AF2122/97
cccggcuccuccccgg

SEQ ID NO: 3123884 - RNA, 19 nt, Mycobacterium bovis subsp bovis AF2122/97
cccggcuccuccccggccc

SEQ ID NO: 3123885 - RNA, 20 nt, Mycobacterium bovis subsp bovis AF2122/97
cccggcucgagcucggcgau

SEQ ID NO: 3123886 - RNA, 13 nt, Mycobacterium bovis subsp bovis AF2122/97
cccggcucgaugg

SEQ ID NO: 3123887 - RNA, 13 nt, Mycobacterium bovis subsp bovis AF2122/97
cccggcucggcag

SEQ ID NO: 3123888 - RNA, 15 nt, Mycobacterium bovis subsp bovis AF2122/97
cccggcucggccagc

SEQ ID NO: 3123889 - RNA, 21 nt, Mycobacterium bovis subsp bovis AF2122/97
cccggcucggccagccagcgg

SEQ ID NO: 3123890 - RNA, 19 nt, Mycobacterium bovis subsp bovis AF2122/97
cccggcucggguggccagc

SEQ ID NO: 3123891 - RNA, 17 nt, Mycobacterium bovis subsp bovis AF2122/97
cccggcucggugcgcca

SEQ ID NO: 3123892 - RNA, 18 nt, Mycobacterium bovis subsp bovis AF2122/97
cccggcucucuucgcgcg

SEQ ID NO: 3123893 - RNA, 19 nt, Mycobacterium bovis subsp bovis AF2122/97
cccggcucucuucgcgcgc

SEQ ID NO: 3123894 - RNA, 20 nt, Mycobacterium bovis subsp bovis AF2122/97
cccggcucucuucgcgcgcu

SEQ ID NO: 3123895 - RNA, 19 nt, Mycobacterium bovis subsp bovis AF2122/97
cccggcugccagcgccgcc

SEQ ID NO: 3123896 - RNA, 16 nt, Mycobacterium bovis subsp bovis AF2122/97
cccggcuggggccgcu

SEQ ID NO: 3123897 - RNA, 15 nt, Mycobacterium bovis subsp bovis AF2122/97
cccggcuggucaccc

SEQ ID NO: 3123898 - RNA, 21 nt, Mycobacterium bovis subsp bovis AF2122/97
cccggcuggucacccguaucg

SEQ ID NO: 3123899 - RNA, 14 nt, Mycobacterium bovis subsp bovis AF2122/97
cccggcugucgguc

SEQ ID NO: 3123900 - RNA, 15 nt, Mycobacterium bovis subsp bovis AF2122/97
cccggcuucgccgcg

SEQ ID NO: 3123901 - RNA, 16 nt, Mycobacterium bovis subsp bovis AF2122/97
cccggcuucgccgcgc

SEQ ID NO: 3123902 - RNA, 21 nt, Mycobacterium bovis subsp bovis AF2122/97
cccggcuucuugaccacgaac

SEQ ID NO: 3123903 - RNA, 17 nt, Mycobacterium bovis subsp bovis AF2122/97
cccggcuuucccaccgc

SEQ ID NO: 3123904 - RNA, 17 nt, Mycobacterium bovis subsp bovis AF2122/97
cccggcuuuugcgccca

SEQ ID NO: 3123905 - RNA, 19 nt, Mycobacterium bovis subsp bovis AF2122/97
cccggcuuuugcgcccagc

SEQ ID NO: 3123906 - RNA, 17 nt, Mycobacterium bovis subsp bovis AF2122/97
cccgggaaggaaccggg

SEQ ID NO: 3123907 - RNA, 18 nt, Mycobacterium bovis subsp bovis AF2122/97
cccgggaaggaaccgggc

SEQ ID NO: 3123908 - RNA, 21 nt, Mycobacterium bovis subsp bovis AF2122/97
cccgggacguuguccaccgcc

SEQ ID NO: 3123909 - RNA, 22 nt, Mycobacterium bovis subsp bovis AF2122/97
cccgggacguuguccaccgcca

SEQ ID NO: 3123910 - RNA, 23 nt, Mycobacterium bovis subsp bovis AF2122/97
cccgggacguuguccaccgccac

SEQ ID NO: 3123911 - RNA, 20 nt, Mycobacterium bovis subsp bovis AF2122/97
cccgggauaguuuucggccg

SEQ ID NO: 3123912 - RNA, 13 nt, Mycobacterium bovis subsp bovis AF2122/97
cccgggaugcucc

SEQ ID NO: 3123913 - RNA, 14 nt, Mycobacterium bovis subsp bovis AF2122/97
cccgggcaccgucg

SEQ ID NO: 3123914 - RNA, 13 nt, Mycobacterium bovis subsp bovis AF2122/97
cccgggcagcccc

SEQ ID NO: 3123915 - RNA, 22 nt, Mycobacterium bovis subsp bovis AF2122/97
cccgggcagccccuccgcgccg

SEQ ID NO: 3123916 - RNA, 17 nt, Mycobacterium bovis subsp bovis AF2122/97
cccgggcagccugcugc

SEQ ID NO: 3123917 - RNA, 18 nt, Mycobacterium bovis subsp bovis AF2122/97
cccgggcagccugcugca

SEQ ID NO: 3123918 - RNA, 16 nt, Mycobacterium bovis subsp bovis AF2122/97
cccgggccaccaguug

SEQ ID NO: 3123919 - RNA, 12 nt, Mycobacterium bovis subsp bovis AF2122/97
cccgggccaccg

SEQ ID NO: 3123920 - RNA, 13 nt, Mycobacterium bovis subsp bovis AF2122/97
cccgggccaccgg

SEQ ID NO: 3123921 - RNA, 13 nt, Mycobacterium bovis subsp bovis AF2122/97
cccgggcccgccg

SEQ ID NO: 3123922 - RNA, 17 nt, Mycobacterium bovis subsp bovis AF2122/97
cccgggcccgcgggauc

SEQ ID NO: 3123923 - RNA, 12 nt, Mycobacterium bovis subsp bovis AF2122/97
cccgggcccgcu

SEQ ID NO: 3123924 - RNA, 13 nt, Mycobacterium bovis subsp bovis AF2122/97
cccgggcccgucg

SEQ ID NO: 3123925 - RNA, 22 nt, Mycobacterium bovis subsp bovis AF2122/97
cccgggccgccagggcccuagc

SEQ ID NO: 3123926 - RNA, 12 nt, Mycobacterium bovis subsp bovis AF2122/97
cccgggccgccg

SEQ ID NO: 3123927 - RNA, 15 nt, Mycobacterium bovis subsp bovis AF2122/97
cccgggccgccgcga

SEQ ID NO: 3123928 - RNA, 13 nt, Mycobacterium bovis subsp bovis AF2122/97
cccgggccgcggc

SEQ ID NO: 3123929 - RNA, 20 nt, Mycobacterium bovis subsp bovis AF2122/97
cccgggccgcggcggccagc

SEQ ID NO: 3123930 - RNA, 22 nt, Mycobacterium bovis subsp bovis AF2122/97
cccgggccggucggugagccgu

SEQ ID NO: 3123931 - RNA, 17 nt, Mycobacterium bovis subsp bovis AF2122/97
cccgggccucggcgccg

SEQ ID NO: 3123932 - RNA, 15 nt, Mycobacterium bovis subsp bovis AF2122/97
cccgggccugaacca

SEQ ID NO: 3123933 - RNA, 18 nt, Mycobacterium bovis subsp bovis AF2122/97
cccgggccugggacggcg

SEQ ID NO: 3123934 - RNA, 20 nt, Mycobacterium bovis subsp bovis AF2122/97
cccgggcgagcgcggccugc

SEQ ID NO: 3123935 - RNA, 16 nt, Mycobacterium bovis subsp bovis AF2122/97
cccgggcgccgaucac

SEQ ID NO: 3123936 - RNA, 12 nt, Mycobacterium bovis subsp bovis AF2122/97
cccgggcggaac

SEQ ID NO: 3123937 - RNA, 19 nt, Mycobacterium bovis subsp bovis AF2122/97
cccgggcggaacgccggca

SEQ ID NO: 3123938 - RNA, 14 nt, Mycobacterium bovis subsp bovis AF2122/97
cccgggcggccagc

SEQ ID NO: 3123939 - RNA, 17 nt, Mycobacterium bovis subsp bovis AF2122/97
cccgggcggccagcugc

SEQ ID NO: 3123940 - RNA, 20 nt, Mycobacterium bovis subsp bovis AF2122/97
cccgggcggccagcugcagc

SEQ ID NO: 3123941 - RNA, 20 nt, Mycobacterium bovis subsp bovis AF2122/97
cccgggcggcggccugggcc

SEQ ID NO: 3123942 - RNA, 23 nt, Mycobacterium bovis subsp bovis AF2122/97
cccgggcggcggccugggccagc

SEQ ID NO: 3123943 - RNA, 18 nt, Mycobacterium bovis subsp bovis AF2122/97
cccgggcgggagucgucg

SEQ ID NO: 3123944 - RNA, 20 nt, Mycobacterium bovis subsp bovis AF2122/97
cccgggcgggauccacccag

SEQ ID NO: 3123945 - RNA, 12 nt, Mycobacterium bovis subsp bovis AF2122/97
cccgggcggucg

SEQ ID NO: 3123946 - RNA, 23 nt, Mycobacterium bovis subsp bovis AF2122/97
cccgggcggugaggcagcgaccg

SEQ ID NO: 3123947 - RNA, 18 nt, Mycobacterium bovis subsp bovis AF2122/97
cccgggcgucaagccaca

SEQ ID NO: 3123948 - RNA, 18 nt, Mycobacterium bovis subsp bovis AF2122/97
cccgggcgucccaaucgg

SEQ ID NO: 3123949 - RNA, 17 nt, Mycobacterium bovis subsp bovis AF2122/97
cccgggcgugggcaccc

SEQ ID NO: 3123950 - RNA, 13 nt, Mycobacterium bovis subsp bovis AF2122/97
cccgggcguggua

SEQ ID NO: 3123951 - RNA, 22 nt, Mycobacterium bovis subsp bovis AF2122/97
cccgggcguugggaucgcgcag

SEQ ID NO: 3123952 - RNA, 23 nt, Mycobacterium bovis subsp bovis AF2122/97
cccgggcguugggaucgcgcagc

SEQ ID NO: 3123953 - RNA, 13 nt, Mycobacterium bovis subsp bovis AF2122/97
cccgggcucggcg

SEQ ID NO: 3123954 - RNA, 21 nt, Mycobacterium bovis subsp bovis AF2122/97
cccgggcugccgcccaugccg

SEQ ID NO: 3123955 - RNA, 17 nt, Mycobacterium bovis subsp bovis AF2122/97
cccggggcgcacagcug

SEQ ID NO: 3123956 - RNA, 22 nt, Mycobacterium bovis subsp bovis AF2122/97
cccgguucugcgcccacccgcg

SEQ ID NO: 3123957 - RNA, 14 nt, Mycobacterium bovis subsp bovis AF2122/97
cccgguugacgccg

SEQ ID NO: 3123958 - RNA, 12 nt, Mycobacterium bovis subsp bovis AF2122/97
cccgguugacuc

SEQ ID NO: 3123959 - RNA, 19 nt, Mycobacterium bovis subsp bovis AF2122/97
cccgguugggguggcggug

SEQ ID NO: 3123960 - RNA, 19 nt, Mycobacterium bovis subsp bovis AF2122/97
cccgguuguggaaccacgg

SEQ ID NO: 3123961 - RNA, 20 nt, Mycobacterium bovis subsp bovis AF2122/97
cccgguuguggaaccacggc

SEQ ID NO: 3123962 - RNA, 22 nt, Mycobacterium bovis subsp bovis AF2122/97
cccgguuguggaaccacggcgc

SEQ ID NO: 3123963 - RNA, 14 nt, Mycobacterium bovis subsp bovis AF2122/97
cccguaaaccgaua

SEQ ID NO: 3123964 - RNA, 16 nt, Mycobacterium bovis subsp bovis AF2122/97
cccguaaaccgauauc

SEQ ID NO: 3123965 - RNA, 22 nt, Mycobacterium bovis subsp bovis AF2122/97
cccguacccacgacgggccgag

SEQ ID NO: 3123966 - RNA, 18 nt, Mycobacterium bovis subsp bovis AF2122/97
cccguagauggugguggc

SEQ ID NO: 3123967 - RNA, 20 nt, Mycobacterium bovis subsp bovis AF2122/97
cccguaggugcacaacccgu

SEQ ID NO: 3123968 - RNA, 16 nt, Mycobacterium bovis subsp bovis AF2122/97
cccguauaaccggcca

SEQ ID NO: 3123969 - RNA, 15 nt, Mycobacterium bovis subsp bovis AF2122/97
cccguauggcggcuc

SEQ ID NO: 3123970 - RNA, 20 nt, Mycobacterium bovis subsp bovis AF2122/97
cccgucacaaugcccaggcu

SEQ ID NO: 3123971 - RNA, 12 nt, Mycobacterium bovis subsp bovis AF2122/97
cccgucaccgcg

SEQ ID NO: 3123972 - RNA, 17 nt, Mycobacterium bovis subsp bovis AF2122/97
cccguccaacuacgcca

SEQ ID NO: 3123973 - RNA, 21 nt, Mycobacterium bovis subsp bovis AF2122/97
cccguccaacuacgccagccg

SEQ ID NO: 3123974 - RNA, 12 nt, Mycobacterium bovis subsp bovis AF2122/97
cccguccaggcc

SEQ ID NO: 3123975 - RNA, 15 nt, Mycobacterium bovis subsp bovis AF2122/97
cccguccaggcgcug

SEQ ID NO: 3123976 - RNA, 13 nt, Mycobacterium bovis subsp bovis AF2122/97
cccguccgccgca

SEQ ID NO: 3123977 - RNA, 13 nt, Mycobacterium bovis subsp bovis AF2122/97
cccguccgcgcgc

SEQ ID NO: 3123978 - RNA, 13 nt, Mycobacterium bovis subsp bovis AF2122/97
cccguccggcccc

SEQ ID NO: 3123979 - RNA, 23 nt, Mycobacterium bovis subsp bovis AF2122/97
cccguccugcggguaggugacga

SEQ ID NO: 3123980 - RNA, 16 nt, Mycobacterium bovis subsp bovis AF2122/97
cccgucgaacgcgcgc

SEQ ID NO: 3123981 - RNA, 14 nt, Mycobacterium bovis subsp bovis AF2122/97
cccgucgaccucca

SEQ ID NO: 3123982 - RNA, 19 nt, Mycobacterium bovis subsp bovis AF2122/97
cccgucgaccuccaccaau

SEQ ID NO: 3123983 - RNA, 12 nt, Mycobacterium bovis subsp bovis AF2122/97
cccgucgagcag

SEQ ID NO: 3123984 - RNA, 14 nt, Mycobacterium bovis subsp bovis AF2122/97
cccgucgagcagca

SEQ ID NO: 3123985 - RNA, 17 nt, Mycobacterium bovis subsp bovis AF2122/97
cccgucgagcagcaugu

SEQ ID NO: 3123986 - RNA, 12 nt, Mycobacterium bovis subsp bovis AF2122/97
cccgucgagccg

SEQ ID NO: 3123987 - RNA, 18 nt, Mycobacterium bovis subsp bovis AF2122/97
cccgucgagccgugccuc

SEQ ID NO: 3123988 - RNA, 13 nt, Mycobacterium bovis subsp bovis AF2122/97
cccgucgccaccg

SEQ ID NO: 3123989 - RNA, 11 nt, Mycobacterium bovis subsp bovis AF2122/97
cccgucgccgc

SEQ ID NO: 3123990 - RNA, 13 nt, Mycobacterium bovis subsp bovis AF2122/97
cccgucgccgccc

SEQ ID NO: 3123991 - RNA, 19 nt, Mycobacterium bovis subsp bovis AF2122/97
cccgucgcggccggcggcc

SEQ ID NO: 3123992 - RNA, 23 nt, Mycobacterium bovis subsp bovis AF2122/97
cccgucgcggccggcggccgccc

SEQ ID NO: 3123993 - RNA, 15 nt, Mycobacterium bovis subsp bovis AF2122/97
cccgucggcgccgaa

SEQ ID NO: 3123994 - RNA, 11 nt, Mycobacterium bovis subsp bovis AF2122/97
cccgucggcgg

SEQ ID NO: 3123995 - RNA, 13 nt, Mycobacterium bovis subsp bovis AF2122/97
cccgucggcggcg

SEQ ID NO: 3123996 - RNA, 14 nt, Mycobacterium bovis subsp bovis AF2122/97
cccgucggcgugcg

SEQ ID NO: 3123997 - RNA, 16 nt, Mycobacterium bovis subsp bovis AF2122/97
cccgucggcguggcug

SEQ ID NO: 3123998 - RNA, 20 nt, Mycobacterium bovis subsp bovis AF2122/97
cccgucgggcacaccgacgc

SEQ ID NO: 3123999 - RNA, 22 nt, Mycobacterium bovis subsp bovis AF2122/97
cccgucgggcacaccgacgccg

SEQ ID NO: 3124000 - RNA, 16 nt, Mycobacterium bovis subsp bovis AF2122/97
cccgucgggugcugau

SEQ ID NO: 3124001 - RNA, 23 nt, Mycobacterium bovis subsp bovis AF2122/97
cccgucgucggcaaccaaccgcg

SEQ ID NO: 3124002 - RNA, 20 nt, Mycobacterium bovis subsp bovis AF2122/97
cccgucgugaccgaccgcca

SEQ ID NO: 3124003 - RNA, 22 nt, Mycobacterium bovis subsp bovis AF2122/97
cccgucucguugaccaacgucg

SEQ ID NO: 3124004 - RNA, 23 nt, Mycobacterium bovis subsp bovis AF2122/97
cccgucuggcaugaccgcugccg

SEQ ID NO: 3124005 - RNA, 18 nt, Mycobacterium bovis subsp bovis AF2122/97
cccgucuuccagccaggc

SEQ ID NO: 3124006 - RNA, 22 nt, Mycobacterium bovis subsp bovis AF2122/97
cccgugagauccuccaauugcg

SEQ ID NO: 3124007 - RNA, 18 nt, Mycobacterium bovis subsp bovis AF2122/97
cccgugagcucgucgagg

SEQ ID NO: 3124008 - RNA, 15 nt, Mycobacterium bovis subsp bovis AF2122/97
cccgugauccgccga

SEQ ID NO: 3124009 - RNA, 13 nt, Mycobacterium bovis subsp bovis AF2122/97
cccgugccacagc

SEQ ID NO: 3124010 - RNA, 18 nt, Mycobacterium bovis subsp bovis AF2122/97
cccgugccgcccgcgccg

SEQ ID NO: 3124011 - RNA, 20 nt, Mycobacterium bovis subsp bovis AF2122/97
cccgugccgcccgcgccgcc

SEQ ID NO: 3124012 - RNA, 21 nt, Mycobacterium bovis subsp bovis AF2122/97
cccgugccgcccgcgccgccc

SEQ ID NO: 3124013 - RNA, 22 nt, Mycobacterium bovis subsp bovis AF2122/97
cccgugccgucaacgauggugg

SEQ ID NO: 3124014 - RNA, 12 nt, Mycobacterium bovis subsp bovis AF2122/97
cccgugccgucg

SEQ ID NO: 3124015 - RNA, 15 nt, Mycobacterium bovis subsp bovis AF2122/97
cccgugccgucgccc

SEQ ID NO: 3124016 - RNA, 15 nt, Mycobacterium bovis subsp bovis AF2122/97
cccgugcgcgcgcag

SEQ ID NO: 3124017 - RNA, 16 nt, Mycobacterium bovis subsp bovis AF2122/97
cccgugcgcgcgcagc

SEQ ID NO: 3124018 - RNA, 15 nt, Mycobacterium bovis subsp bovis AF2122/97
cccgugcggcucgcc

SEQ ID NO: 3124019 - RNA, 16 nt, Mycobacterium bovis subsp bovis AF2122/97
cccgugcggcucgccg

SEQ ID NO: 3124020 - RNA, 15 nt, Mycobacterium bovis subsp bovis AF2122/97
cccgugcuggcgccg

SEQ ID NO: 3124021 - RNA, 20 nt, Mycobacterium bovis subsp bovis AF2122/97
cccgugggguguggcggcgg

SEQ ID NO: 3124022 - RNA, 22 nt, Mycobacterium bovis subsp bovis AF2122/97
cccguggugauggucgugaucu

SEQ ID NO: 3124023 - RNA, 15 nt, Mycobacterium bovis subsp bovis AF2122/97
cccgugguggcgcca

SEQ ID NO: 3124024 - RNA, 24 nt, Mycobacterium bovis subsp bovis AF2122/97
cccgugguggcgccaugaagccgg

SEQ ID NO: 3124025 - RNA, 20 nt, Mycobacterium bovis subsp bovis AF2122/97
cccguguuaaagaagccuga

SEQ ID NO: 3124026 - RNA, 16 nt, Mycobacterium bovis subsp bovis AF2122/97
cccguuaugcgccgcc

SEQ ID NO: 3124027 - RNA, 15 nt, Mycobacterium bovis subsp bovis AF2122/97
cccguucacgcucgu

SEQ ID NO: 3124028 - RNA, 19 nt, Mycobacterium bovis subsp bovis AF2122/97
cccguucagcgacggccgc

SEQ ID NO: 3124029 - RNA, 20 nt, Mycobacterium bovis subsp bovis AF2122/97
cccguucaugcggcggcgcu

SEQ ID NO: 3124030 - RNA, 13 nt, Mycobacterium bovis subsp bovis AF2122/97
cccguuccacgau

SEQ ID NO: 3124031 - RNA, 19 nt, Mycobacterium bovis subsp bovis AF2122/97
cccguuccacgccggcauc

SEQ ID NO: 3124032 - RNA, 14 nt, Mycobacterium bovis subsp bovis AF2122/97
cccguucgaacugg

SEQ ID NO: 3124033 - RNA, 16 nt, Mycobacterium bovis subsp bovis AF2122/97
cccguucgccaggccg

SEQ ID NO: 3124034 - RNA, 12 nt, Mycobacterium bovis subsp bovis AF2122/97
cccguucgccgu

SEQ ID NO: 3124035 - RNA, 14 nt, Mycobacterium bovis subsp bovis AF2122/97
cccguucgccgucg

SEQ ID NO: 3124036 - RNA, 20 nt, Mycobacterium bovis subsp bovis AF2122/97
cccguucggggccccgcggc

SEQ ID NO: 3124037 - RNA, 20 nt, Mycobacterium bovis subsp bovis AF2122/97
cccguucgugagcggccagg

SEQ ID NO: 3124038 - RNA, 14 nt, Mycobacterium bovis subsp bovis AF2122/97
cccguucuucgcga

SEQ ID NO: 3124039 - RNA, 19 nt, Mycobacterium bovis subsp bovis AF2122/97
cccguugacccagaccggc

SEQ ID NO: 3124040 - RNA, 12 nt, Mycobacterium bovis subsp bovis AF2122/97
cccguugacguu

SEQ ID NO: 3124041 - RNA, 22 nt, Mycobacterium bovis subsp bovis AF2122/97
cccguugagcauaugacgucgc

SEQ ID NO: 3124042 - RNA, 13 nt, Mycobacterium bovis subsp bovis AF2122/97
cccguugccgccg

SEQ ID NO: 3124043 - RNA, 17 nt, Mycobacterium bovis subsp bovis AF2122/97
cccugccagagaucagc

SEQ ID NO: 3124044 - RNA, 12 nt, Mycobacterium bovis subsp bovis AF2122/97
cccugcccggcc

SEQ ID NO: 3124045 - RNA, 14 nt, Mycobacterium bovis subsp bovis AF2122/97
cccugcccggcccg

SEQ ID NO: 3124046 - RNA, 16 nt, Mycobacterium bovis subsp bovis AF2122/97
cccugccgccggcccc

SEQ ID NO: 3124047 - RNA, 17 nt, Mycobacterium bovis subsp bovis AF2122/97
cccugccgccggccccg

SEQ ID NO: 3124048 - RNA, 19 nt, Mycobacterium bovis subsp bovis AF2122/97
cccugccgccggccccgcc

SEQ ID NO: 3124049 - RNA, 13 nt, Mycobacterium bovis subsp bovis AF2122/97
cccugcgccgcca

SEQ ID NO: 3124050 - RNA, 14 nt, Mycobacterium bovis subsp bovis AF2122/97
cccugcgccgccac

SEQ ID NO: 3124051 - RNA, 15 nt, Mycobacterium bovis subsp bovis AF2122/97
cccugcgccgccaca

SEQ ID NO: 3124052 - RNA, 19 nt, Mycobacterium bovis subsp bovis AF2122/97
cccugcgccgccacagcac

SEQ ID NO: 3124053 - RNA, 20 nt, Mycobacterium bovis subsp bovis AF2122/97
cccugcgccucggcggccag

SEQ ID NO: 3124054 - RNA, 14 nt, Mycobacterium bovis subsp bovis AF2122/97
cccugcgcggccac

SEQ ID NO: 3124055 - RNA, 17 nt, Mycobacterium bovis subsp bovis AF2122/97
cccugcgcggccaccuc

SEQ ID NO: 3124056 - RNA, 21 nt, Mycobacterium bovis subsp bovis AF2122/97
cccugcgcgugcuuggcagcg

SEQ ID NO: 3124057 - RNA, 13 nt, Mycobacterium bovis subsp bovis AF2122/97
cccugcggccacg

SEQ ID NO: 3124058 - RNA, 16 nt, Mycobacterium bovis subsp bovis AF2122/97
cccugcggccacggug

SEQ ID NO: 3124059 - RNA, 21 nt, Mycobacterium bovis subsp bovis AF2122/97
cccugcggccacgguggcgca

SEQ ID NO: 3124060 - RNA, 23 nt, Mycobacterium bovis subsp bovis AF2122/97
cccugcgggccgagaucacgccg

SEQ ID NO: 3124061 - RNA, 17 nt, Mycobacterium bovis subsp bovis AF2122/97
cccugcuccucgcgggc

SEQ ID NO: 3124062 - RNA, 12 nt, Mycobacterium bovis subsp bovis AF2122/97
cccugcucggcc

SEQ ID NO: 3124063 - RNA, 16 nt, Mycobacterium bovis subsp bovis AF2122/97
cccugcugcagggccu

SEQ ID NO: 3124064 - RNA, 14 nt, Mycobacterium bovis subsp bovis AF2122/97
cccugcuggcccaa

SEQ ID NO: 3124065 - RNA, 16 nt, Mycobacterium bovis subsp bovis AF2122/97
cccugcuugcaggcga

SEQ ID NO: 3124066 - RNA, 18 nt, Mycobacterium bovis subsp bovis AF2122/97
cccuggaaagggccgccg

SEQ ID NO: 3124067 - RNA, 17 nt, Mycobacterium bovis subsp bovis AF2122/97
cccuggaaugccgccac

SEQ ID NO: 3124068 - RNA, 17 nt, Mycobacterium bovis subsp bovis AF2122/97
cccuggacauaccggcc

SEQ ID NO: 3124069 - RNA, 15 nt, Mycobacterium bovis subsp bovis AF2122/97
cccuggacgucggcg

SEQ ID NO: 3124070 - RNA, 15 nt, Mycobacterium bovis subsp bovis AF2122/97
cccuggauggcgccc

SEQ ID NO: 3124071 - RNA, 22 nt, Mycobacterium bovis subsp bovis AF2122/97
cccuggauggcgcccugcgcca

SEQ ID NO: 3124072 - RNA, 14 nt, Mycobacterium bovis subsp bovis AF2122/97
cccuggccagcaga

SEQ ID NO: 3124073 - RNA, 13 nt, Mycobacterium bovis subsp bovis AF2122/97
cccuggccagccc

SEQ ID NO: 3124074 - RNA, 15 nt, Mycobacterium bovis subsp bovis AF2122/97
cccuggccagcccga

SEQ ID NO: 3124075 - RNA, 22 nt, Mycobacterium bovis subsp bovis AF2122/97
cccuggccagcccgagcucggg

SEQ ID NO: 3124076 - RNA, 20 nt, Mycobacterium bovis subsp bovis AF2122/97
cccuggccgcccagaccgcc

SEQ ID NO: 3124077 - RNA, 15 nt, Mycobacterium bovis subsp bovis AF2122/97
cccuggccgccggcg

SEQ ID NO: 3124078 - RNA, 19 nt, Mycobacterium bovis subsp bovis AF2122/97
cccuggccgccggcgccgc

SEQ ID NO: 3124079 - RNA, 20 nt, Mycobacterium bovis subsp bovis AF2122/97
cccuggccgccggcgccgcc

SEQ ID NO: 3124080 - RNA, 13 nt, Mycobacterium bovis subsp bovis AF2122/97
cccuggccgcgcc

SEQ ID NO: 3124081 - RNA, 11 nt, Mycobacterium bovis subsp bovis AF2122/97
cccuggccggu

SEQ ID NO: 3124082 - RNA, 17 nt, Mycobacterium bovis subsp bovis AF2122/97
cccuggcgaccagccga

SEQ ID NO: 3124083 - RNA, 12 nt, Mycobacterium bovis subsp bovis AF2122/97
cccuggcggccc

SEQ ID NO: 3124084 - RNA, 14 nt, Mycobacterium bovis subsp bovis AF2122/97
cccuggcggcccgg

SEQ ID NO: 3124085 - RNA, 17 nt, Mycobacterium bovis subsp bovis AF2122/97
cccuggcggcccggguu

SEQ ID NO: 3124086 - RNA, 15 nt, Mycobacterium bovis subsp bovis AF2122/97
cccugggcgucgacc

SEQ ID NO: 3124087 - RNA, 22 nt, Mycobacterium bovis subsp bovis AF2122/97
cccugggcgucgaccacgcaag

SEQ ID NO: 3124088 - RNA, 13 nt, Mycobacterium bovis subsp bovis AF2122/97
cccugggcuggcu

SEQ ID NO: 3124089 - RNA, 18 nt, Mycobacterium bovis subsp bovis AF2122/97
cccuggggccguccggcu

SEQ ID NO: 3124090 - RNA, 18 nt, Mycobacterium bovis subsp bovis AF2122/97
cccuggguauccaccgcg

SEQ ID NO: 3124091 - RNA, 20 nt, Mycobacterium bovis subsp bovis AF2122/97
cccugggugauggccgcgcc

SEQ ID NO: 3124092 - RNA, 13 nt, Mycobacterium bovis subsp bovis AF2122/97
cccugguccaccc

SEQ ID NO: 3124093 - RNA, 15 nt, Mycobacterium bovis subsp bovis AF2122/97
cccugguccacccgu

SEQ ID NO: 3124094 - RNA, 15 nt, Mycobacterium bovis subsp bovis AF2122/97
cccugguccaggccc

SEQ ID NO: 3124095 - RNA, 17 nt, Mycobacterium bovis subsp bovis AF2122/97
cccuggugugccgcguu

SEQ ID NO: 3124096 - RNA, 16 nt, Mycobacterium bovis subsp bovis AF2122/97
cccugucaacgccgcg

SEQ ID NO: 3124097 - RNA, 19 nt, Mycobacterium bovis subsp bovis AF2122/97
cccugucauguccugggcc

SEQ ID NO: 3124098 - RNA, 22 nt, Mycobacterium bovis subsp bovis AF2122/97
cccugucauguccugggccgcc

SEQ ID NO: 3124099 - RNA, 17 nt, Mycobacterium bovis subsp bovis AF2122/97
cccuguccggcgccgag

SEQ ID NO: 3124100 - RNA, 14 nt, Mycobacterium bovis subsp bovis AF2122/97
cccugucgcgcacc

SEQ ID NO: 3124101 - RNA, 20 nt, Mycobacterium bovis subsp bovis AF2122/97
cccugucgcgcaccggaucg

SEQ ID NO: 3124102 - RNA, 14 nt, Mycobacterium bovis subsp bovis AF2122/97
cccugugccagcag

SEQ ID NO: 3124103 - RNA, 21 nt, Mycobacterium bovis subsp bovis AF2122/97
cccugugucgccgucgcggca

SEQ ID NO: 3124104 - RNA, 22 nt, Mycobacterium bovis subsp bovis AF2122/97
cccuguucggcccgaggugccg

SEQ ID NO: 3124105 - RNA, 22 nt, Mycobacterium bovis subsp bovis AF2122/97
cccuguugcagaaaacccucgc

SEQ ID NO: 3124106 - RNA, 22 nt, Mycobacterium bovis subsp bovis AF2122/97
cccuguuguugccccggucggc

SEQ ID NO: 3124107 - RNA, 23 nt, Mycobacterium bovis subsp bovis AF2122/97
cccuuaagccggcgcggcggcgu

SEQ ID NO: 3124108 - RNA, 18 nt, Mycobacterium bovis subsp bovis AF2122/97
cccuucagcgaagccggg

SEQ ID NO: 3124109 - RNA, 14 nt, Mycobacterium bovis subsp bovis AF2122/97
cccuucgcggugug

SEQ ID NO: 3124110 - RNA, 22 nt, Mycobacterium bovis subsp bovis AF2122/97
cccuucgguggggucgcugccg

SEQ ID NO: 3124111 - RNA, 13 nt, Mycobacterium bovis subsp bovis AF2122/97
cccuucgucacau

SEQ ID NO: 3124112 - RNA, 16 nt, Mycobacterium bovis subsp bovis AF2122/97
cccuugaccgcugccc

SEQ ID NO: 3124113 - RNA, 20 nt, Mycobacterium bovis subsp bovis AF2122/97
cccuugccgcagaaucccaa

SEQ ID NO: 3124114 - RNA, 11 nt, Mycobacterium bovis subsp bovis AF2122/97
cccuugccgcc

SEQ ID NO: 3124115 - RNA, 14 nt, Mycobacterium bovis subsp bovis AF2122/97
cccuugccgccauu

SEQ ID NO: 3124116 - RNA, 15 nt, Mycobacterium bovis subsp bovis AF2122/97
cccuugccgcccgcu

SEQ ID NO: 3124117 - RNA, 16 nt, Mycobacterium bovis subsp bovis AF2122/97
cccuugccgcccgcuc

SEQ ID NO: 3124118 - RNA, 16 nt, Mycobacterium bovis subsp bovis AF2122/97
cccuugccgccggccc

SEQ ID NO: 3124119 - RNA, 20 nt, Mycobacterium bovis subsp bovis AF2122/97
cccuugccgccggccccgcc

SEQ ID NO: 3124120 - RNA, 21 nt, Mycobacterium bovis subsp bovis AF2122/97
cccuugccgccggccccgccg

SEQ ID NO: 3124121 - RNA, 18 nt, Mycobacterium bovis subsp bovis AF2122/97
cccuugccuuccgaccca

SEQ ID NO: 3124122 - RNA, 18 nt, Mycobacterium bovis subsp bovis AF2122/97
cccuuggacugucccacc

SEQ ID NO: 3124123 - RNA, 13 nt, Mycobacterium bovis subsp bovis AF2122/97
cccuuggccagca

SEQ ID NO: 3124124 - RNA, 20 nt, Mycobacterium bovis subsp bovis AF2122/97
cccuuggccagcagggccac

SEQ ID NO: 3124125 - RNA, 15 nt, Mycobacterium bovis subsp bovis AF2122/97
cccuugggcaccacc

SEQ ID NO: 3124126 - RNA, 18 nt, Mycobacterium bovis subsp bovis AF2122/97
cccuugggcaccacccga

SEQ ID NO: 3124127 - RNA, 13 nt, Mycobacterium bovis subsp bovis AF2122/97
cccuugguggcca

SEQ ID NO: 3124128 - RNA, 14 nt, Mycobacterium bovis subsp bovis AF2122/97
cccuugucggucga

SEQ ID NO: 3124129 - RNA, 22 nt, Mycobacterium bovis subsp bovis AF2122/97
cccuuguggucugccagcaccc

SEQ ID NO: 3124130 - RNA, 14 nt, Mycobacterium bovis subsp bovis AF2122/97
ccgaacgcaacgcc

SEQ ID NO: 3124131 - RNA, 22 nt, Mycobacterium bovis subsp bovis AF2122/97
ccgaacgcaccgaaacgccgac

SEQ ID NO: 3124132 - RNA, 12 nt, Mycobacterium bovis subsp bovis AF2122/97
ccgaacgcacgu

SEQ ID NO: 3124133 - RNA, 21 nt, Mycobacterium bovis subsp bovis AF2122/97
ccgaacgcacgucgaggcggc

SEQ ID NO: 3124134 - RNA, 15 nt, Mycobacterium bovis subsp bovis AF2122/97
ccgaacgccaccacc

SEQ ID NO: 3124135 - RNA, 17 nt, Mycobacterium bovis subsp bovis AF2122/97
ccgaacgccucgccggc

SEQ ID NO: 3124136 - RNA, 15 nt, Mycobacterium bovis subsp bovis AF2122/97
ccgaacgccucugcg

SEQ ID NO: 3124137 - RNA, 13 nt, Mycobacterium bovis subsp bovis AF2122/97
ccgaacgcgaggu

SEQ ID NO: 3124138 - RNA, 15 nt, Mycobacterium bovis subsp bovis AF2122/97
ccgaacgcgaugcgc

SEQ ID NO: 3124139 - RNA, 21 nt, Mycobacterium bovis subsp bovis AF2122/97
ccgaacgcggccaccgaccgc

SEQ ID NO: 3124140 - RNA, 14 nt, Mycobacterium bovis subsp bovis AF2122/97
ccgaacgcuccagg

SEQ ID NO: 3124141 - RNA, 17 nt, Mycobacterium bovis subsp bovis AF2122/97
ccgaacgguugcucguc

SEQ ID NO: 3124142 - RNA, 16 nt, Mycobacterium bovis subsp bovis AF2122/97
ccgaacguggcucggc

SEQ ID NO: 3124143 - RNA, 18 nt, Mycobacterium bovis subsp bovis AF2122/97
ccgaacguguugaccagg

SEQ ID NO: 3124144 - RNA, 19 nt, Mycobacterium bovis subsp bovis AF2122/97
ccgaacuaccgacgcaccu

SEQ ID NO: 3124145 - RNA, 22 nt, Mycobacterium bovis subsp bovis AF2122/97
ccgaacuaccgacgcaccucgg

SEQ ID NO: 3124146 - RNA, 17 nt, Mycobacterium bovis subsp bovis AF2122/97
ccgaacucaacgacacc

SEQ ID NO: 3124147 - RNA, 13 nt, Mycobacterium bovis subsp bovis AF2122/97
ccgaacuccgcgg

SEQ ID NO: 3124148 - RNA, 22 nt, Mycobacterium bovis subsp bovis AF2122/97
ccgaacuccuuaucgucgacgc

SEQ ID NO: 3124149 - RNA, 14 nt, Mycobacterium bovis subsp bovis AF2122/97
ccgaacugggcgau

SEQ ID NO: 3124150 - RNA, 23 nt, Mycobacterium bovis subsp bovis AF2122/97
ccgaacugggcgaucgacaccgu

SEQ ID NO: 3124151 - RNA, 16 nt, Mycobacterium bovis subsp bovis AF2122/97
ccgaacuggucgacgc

SEQ ID NO: 3124152 - RNA, 19 nt, Mycobacterium bovis subsp bovis AF2122/97
ccgaacuucugguaggcgg

SEQ ID NO: 3124153 - RNA, 23 nt, Mycobacterium bovis subsp bovis AF2122/97
ccgaacuugacgaacucgccguc

SEQ ID NO: 3124154 - RNA, 18 nt, Mycobacterium bovis subsp bovis AF2122/97
ccgaacuugcggaccugg

SEQ ID NO: 3124155 - RNA, 15 nt, Mycobacterium bovis subsp bovis AF2122/97
ccgaagaaaacgaac

SEQ ID NO: 3124156 - RNA, 22 nt, Mycobacterium bovis subsp bovis AF2122/97
ccgaagaaaacgaacccacugc

SEQ ID NO: 3124157 - RNA, 16 nt, Mycobacterium bovis subsp bovis AF2122/97
ccgaagaaggugacga

SEQ ID NO: 3124158 - RNA, 14 nt, Mycobacterium bovis subsp bovis AF2122/97
ccgaagagccagca

SEQ ID NO: 3124159 - RNA, 15 nt, Mycobacterium bovis subsp bovis AF2122/97
ccgaagagcgcgcgc

SEQ ID NO: 3124160 - RNA, 16 nt, Mycobacterium bovis subsp bovis AF2122/97
ccgaagagcgcgcgca

SEQ ID NO: 3124161 - RNA, 17 nt, Mycobacterium bovis subsp bovis AF2122/97
ccgaagagcuccgucgc

SEQ ID NO: 3124162 - RNA, 22 nt, Mycobacterium bovis subsp bovis AF2122/97
ccgaagagcuccgucgcggccg

SEQ ID NO: 3124163 - RNA, 17 nt, Mycobacterium bovis subsp bovis AF2122/97
ccgaagaggagaacgag

SEQ ID NO: 3124164 - RNA, 18 nt, Mycobacterium bovis subsp bovis AF2122/97
ccgaagagucgugccgcc

SEQ ID NO: 3124165 - RNA, 19 nt, Mycobacterium bovis subsp bovis AF2122/97
ccgaagagugugacggcgg

SEQ ID NO: 3124166 - RNA, 22 nt, Mycobacterium bovis subsp bovis AF2122/97
ccgaagagugugacggcggcca

SEQ ID NO: 3124167 - RNA, 15 nt, Mycobacterium bovis subsp bovis AF2122/97
ccgaagaugaccgcu

SEQ ID NO: 3124168 - RNA, 21 nt, Mycobacterium bovis subsp bovis AF2122/97
ccgaagaugaccucggcgacg

SEQ ID NO: 3124169 - RNA, 12 nt, Mycobacterium bovis subsp bovis AF2122/97
ccgaagaugccu

SEQ ID NO: 3124170 - RNA, 14 nt, Mycobacterium bovis subsp bovis AF2122/97
ccgaagauggccag

SEQ ID NO: 3124171 - RNA, 19 nt, Mycobacterium bovis subsp bovis AF2122/97
ccgaagauggccagcgcgg

SEQ ID NO: 3124172 - RNA, 19 nt, Mycobacterium bovis subsp bovis AF2122/97
ccgaagauuuugggcgccg

SEQ ID NO: 3124173 - RNA, 15 nt, Mycobacterium bovis subsp bovis AF2122/97
ccgaagcccccgacg

SEQ ID NO: 3124174 - RNA, 16 nt, Mycobacterium bovis subsp bovis AF2122/97
ccgaagccccgauuga

SEQ ID NO: 3124175 - RNA, 14 nt, Mycobacterium bovis subsp bovis AF2122/97
ccgaagcccgagcu

SEQ ID NO: 3124176 - RNA, 19 nt, Mycobacterium bovis subsp bovis AF2122/97
ccgaagccgaccggguuga

SEQ ID NO: 3124177 - RNA, 13 nt, Mycobacterium bovis subsp bovis AF2122/97
ccgaagccgcgca

SEQ ID NO: 3124178 - RNA, 23 nt, Mycobacterium bovis subsp bovis AF2122/97
ccgaagccggugccggcguugcc

SEQ ID NO: 3124179 - RNA, 14 nt, Mycobacterium bovis subsp bovis AF2122/97
ccgaagcgcccgga

SEQ ID NO: 3124180 - RNA, 14 nt, Mycobacterium bovis subsp bovis AF2122/97
ccgaagcgcccguu

SEQ ID NO: 3124181 - RNA, 20 nt, Mycobacterium bovis subsp bovis AF2122/97
ccgaagcgcccguuggccaa

SEQ ID NO: 3124182 - RNA, 22 nt, Mycobacterium bovis subsp bovis AF2122/97
ccgaagcgcccguuggccaaga

SEQ ID NO: 3124183 - RNA, 15 nt, Mycobacterium bovis subsp bovis AF2122/97
ccgaagcgcgcgcgu

SEQ ID NO: 3124184 - RNA, 14 nt, Mycobacterium bovis subsp bovis AF2122/97
ccgaagcggaucug

SEQ ID NO: 3124185 - RNA, 14 nt, Mycobacterium bovis subsp bovis AF2122/97
ccgaagcggccacc

SEQ ID NO: 3124186 - RNA, 16 nt, Mycobacterium bovis subsp bovis AF2122/97
ccgaagcggccaccgc

SEQ ID NO: 3124187 - RNA, 21 nt, Mycobacterium bovis subsp bovis AF2122/97
ccgaagcggccaccgccgccg

SEQ ID NO: 3124188 - RNA, 22 nt, Mycobacterium bovis subsp bovis AF2122/97
ccgaagcgggcccgcaggucgg

SEQ ID NO: 3124189 - RNA, 18 nt, Mycobacterium bovis subsp bovis AF2122/97
ccgaagcucaucaccggc

SEQ ID NO: 3124190 - RNA, 20 nt, Mycobacterium bovis subsp bovis AF2122/97
ccgaagcucaucaccggcgc

SEQ ID NO: 3124191 - RNA, 18 nt, Mycobacterium bovis subsp bovis AF2122/97
ccgaagcucaucgccgcu

SEQ ID NO: 3124192 - RNA, 19 nt, Mycobacterium bovis subsp bovis AF2122/97
ccgaagcucaucgccgcua

SEQ ID NO: 3124193 - RNA, 14 nt, Mycobacterium bovis subsp bovis AF2122/97
ccgaagcugcgggu

SEQ ID NO: 3124194 - RNA, 22 nt, Mycobacterium bovis subsp bovis AF2122/97
ccgaaggccgccacaaacccga

SEQ ID NO: 3124195 - RNA, 21 nt, Mycobacterium bovis subsp bovis AF2122/97
ccgaaggcggcuccaccgggc

SEQ ID NO: 3124196 - RNA, 16 nt, Mycobacterium bovis subsp bovis AF2122/97
ccgaaggcuugucggu

SEQ ID NO: 3124197 - RNA, 16 nt, Mycobacterium bovis subsp bovis AF2122/97
ccgaaguacuggccgc

SEQ ID NO: 3124198 - RNA, 18 nt, Mycobacterium bovis subsp bovis AF2122/97
ccgaaguacuggccgccg

SEQ ID NO: 3124199 - RNA, 19 nt, Mycobacterium bovis subsp bovis AF2122/97
ccgaaguagaagcccagga

SEQ ID NO: 3124200 - RNA, 18 nt, Mycobacterium bovis subsp bovis AF2122/97
ccgaaguagccgaccggc

SEQ ID NO: 3124201 - RNA, 18 nt, Mycobacterium bovis subsp bovis AF2122/97
ccgaaguugaugucgcgu

SEQ ID NO: 3124202 - RNA, 18 nt, Mycobacterium bovis subsp bovis AF2122/97
ccgaaguuuuggaagccc

SEQ ID NO: 3124203 - RNA, 16 nt, Mycobacterium bovis subsp bovis AF2122/97
ccgaauaacagcaggc

SEQ ID NO: 3124204 - RNA, 21 nt, Mycobacterium bovis subsp bovis AF2122/97
ccgaauaccacaccgugacca

SEQ ID NO: 3124205 - RNA, 16 nt, Mycobacterium bovis subsp bovis AF2122/97
ccgaauaccgccgcgc

SEQ ID NO: 3124206 - RNA, 17 nt, Mycobacterium bovis subsp bovis AF2122/97
ccgaauaccgguggcag

SEQ ID NO: 3124207 - RNA, 13 nt, Mycobacterium bovis subsp bovis AF2122/97
ccgaauagucggc

SEQ ID NO: 3124208 - RNA, 16 nt, Mycobacterium bovis subsp bovis AF2122/97
ccgaaucgcgggcuga

SEQ ID NO: 3124209 - RNA, 18 nt, Mycobacterium bovis subsp bovis AF2122/97
ccgaaucggcaccgugcg

SEQ ID NO: 3124210 - RNA, 17 nt, Mycobacterium bovis subsp bovis AF2122/97
ccgaaucgggucggccg

SEQ ID NO: 3124211 - RNA, 22 nt, Mycobacterium bovis subsp bovis AF2122/97
ccgaaucgugcggcgaccguca

SEQ ID NO: 3124212 - RNA, 15 nt, Mycobacterium bovis subsp bovis AF2122/97
ccgaaucugccggcc

SEQ ID NO: 3124213 - RNA, 17 nt, Mycobacterium bovis subsp bovis AF2122/97
ccgaaucugccggccgg

SEQ ID NO: 3124214 - RNA, 20 nt, Mycobacterium bovis subsp bovis AF2122/97
ccgaaucugccggccggcgg

SEQ ID NO: 3124215 - RNA, 14 nt, Mycobacterium bovis subsp bovis AF2122/97
ccgaauggccgauc

SEQ ID NO: 3124216 - RNA, 18 nt, Mycobacterium bovis subsp bovis AF2122/97
ccgaauuccucaaggucg

SEQ ID NO: 3124217 - RNA, 19 nt, Mycobacterium bovis subsp bovis AF2122/97
ccgaccaugguagcgcccc

SEQ ID NO: 3124218 - RNA, 15 nt, Mycobacterium bovis subsp bovis AF2122/97
ccgacccaacgacca

SEQ ID NO: 3124219 - RNA, 19 nt, Mycobacterium bovis subsp bovis AF2122/97
ccgacccaacgaccaccac

SEQ ID NO: 3124220 - RNA, 19 nt, Mycobacterium bovis subsp bovis AF2122/97
ccgacccaucaccagcggc

SEQ ID NO: 3124221 - RNA, 14 nt, Mycobacterium bovis subsp bovis AF2122/97
ccgaccccgacggc

SEQ ID NO: 3124222 - RNA, 12 nt, Mycobacterium bovis subsp bovis AF2122/97
ccgaccccgcgc

SEQ ID NO: 3124223 - RNA, 16 nt, Mycobacterium bovis subsp bovis AF2122/97
ccgacccgacgcuggu

SEQ ID NO: 3124224 - RNA, 14 nt, Mycobacterium bovis subsp bovis AF2122/97
ccgacccgcccgaa

SEQ ID NO: 3124225 - RNA, 14 nt, Mycobacterium bovis subsp bovis AF2122/97
ccgacccgccgacg

SEQ ID NO: 3124226 - RNA, 21 nt, Mycobacterium bovis subsp bovis AF2122/97
ccgacccgccgacgccgccgg

SEQ ID NO: 3124227 - RNA, 15 nt, Mycobacterium bovis subsp bovis AF2122/97
ccgacccgccgcgcc

SEQ ID NO: 3124228 - RNA, 18 nt, Mycobacterium bovis subsp bovis AF2122/97
ccgacccgccgcgcccgg

SEQ ID NO: 3124229 - RNA, 19 nt, Mycobacterium bovis subsp bovis AF2122/97
ccgacccgccgcgcccggc

SEQ ID NO: 3124230 - RNA, 23 nt, Mycobacterium bovis subsp bovis AF2122/97
ccgacccgccgcgcccggcgcaa

SEQ ID NO: 3124231 - RNA, 14 nt, Mycobacterium bovis subsp bovis AF2122/97
ccgacccgccgcgg

SEQ ID NO: 3124232 - RNA, 13 nt, Mycobacterium bovis subsp bovis AF2122/97
ccgacccgcgcgc

SEQ ID NO: 3124233 - RNA, 15 nt, Mycobacterium bovis subsp bovis AF2122/97
ccgacccgcgcgccg

SEQ ID NO: 3124234 - RNA, 17 nt, Mycobacterium bovis subsp bovis AF2122/97
ccgacccgcgcgccggc

SEQ ID NO: 3124235 - RNA, 19 nt, Mycobacterium bovis subsp bovis AF2122/97
ccgacccgcgcgccggcga

SEQ ID NO: 3124236 - RNA, 13 nt, Mycobacterium bovis subsp bovis AF2122/97
ccgacccggccgc

SEQ ID NO: 3124237 - RNA, 18 nt, Mycobacterium bovis subsp bovis AF2122/97
ccgacccggccgcugacg

SEQ ID NO: 3124238 - RNA, 14 nt, Mycobacterium bovis subsp bovis AF2122/97
ccgacccgggcgag

SEQ ID NO: 3124239 - RNA, 18 nt, Mycobacterium bovis subsp bovis AF2122/97
ccgacccgggggcgcccg

SEQ ID NO: 3124240 - RNA, 17 nt, Mycobacterium bovis subsp bovis AF2122/97
ccgacccguaccagccc

SEQ ID NO: 3124241 - RNA, 20 nt, Mycobacterium bovis subsp bovis AF2122/97
ccgacccguaccagcccguc

SEQ ID NO: 3124242 - RNA, 22 nt, Mycobacterium bovis subsp bovis AF2122/97
ccgacccuagauaugcacccgc

SEQ ID NO: 3124243 - RNA, 16 nt, Mycobacterium bovis subsp bovis AF2122/97
ccgaccgaaagccgca

SEQ ID NO: 3124244 - RNA, 18 nt, Mycobacterium bovis subsp bovis AF2122/97
ccgaccgaaagccgcacc

SEQ ID NO: 3124245 - RNA, 20 nt, Mycobacterium bovis subsp bovis AF2122/97
ccgaccgaaagccgcaccag

SEQ ID NO: 3124246 - RNA, 13 nt, Mycobacterium bovis subsp bovis AF2122/97
ccgaccgaaccgu

SEQ ID NO: 3124247 - RNA, 15 nt, Mycobacterium bovis subsp bovis AF2122/97
ccgaccgaaccguca

SEQ ID NO: 3124248 - RNA, 19 nt, Mycobacterium bovis subsp bovis AF2122/97
ccgaccgacaccaccaggu

SEQ ID NO: 3124249 - RNA, 14 nt, Mycobacterium bovis subsp bovis AF2122/97
ccgaccgaccgcac

SEQ ID NO: 3124250 - RNA, 16 nt, Mycobacterium bovis subsp bovis AF2122/97
ccgaccgaccuggucg

SEQ ID NO: 3124251 - RNA, 18 nt, Mycobacterium bovis subsp bovis AF2122/97
ccgaccgauaacacccgg

SEQ ID NO: 3124252 - RNA, 20 nt, Mycobacterium bovis subsp bovis AF2122/97
ccgaccgauaacacccgggc

SEQ ID NO: 3124253 - RNA, 22 nt, Mycobacterium bovis subsp bovis AF2122/97
ccgaccgauaacacccgggcca

SEQ ID NO: 3124254 - RNA, 22 nt, Mycobacterium bovis subsp bovis AF2122/97
ccgaccgauacaccgacgggau

SEQ ID NO: 3124255 - RNA, 22 nt, Mycobacterium bovis subsp bovis AF2122/97
ccgaccgauggcucaccagcuc

SEQ ID NO: 3124256 - RNA, 16 nt, Mycobacterium bovis subsp bovis AF2122/97
ccgaccgcaccgugcc

SEQ ID NO: 3124257 - RNA, 18 nt, Mycobacterium bovis subsp bovis AF2122/97
ccgaccgcacgaccagcu

SEQ ID NO: 3124258 - RNA, 21 nt, Mycobacterium bovis subsp bovis AF2122/97
ccgaccgcacgaccagcugag

SEQ ID NO: 3124259 - RNA, 18 nt, Mycobacterium bovis subsp bovis AF2122/97
ccgaccgcaugaucgcac

SEQ ID NO: 3124260 - RNA, 21 nt, Mycobacterium bovis subsp bovis AF2122/97
ccgaccgcaugaucgcaccga

SEQ ID NO: 3124261 - RNA, 14 nt, Mycobacterium bovis subsp bovis AF2122/97
ccgaccgccaccgc

SEQ ID NO: 3124262 - RNA, 18 nt, Mycobacterium bovis subsp bovis AF2122/97
ccgaccgccaccgccagc

SEQ ID NO: 3124263 - RNA, 11 nt, Mycobacterium bovis subsp bovis AF2122/97
ccgaccgccga

SEQ ID NO: 3124264 - RNA, 14 nt, Mycobacterium bovis subsp bovis AF2122/97
ccgaccgcgcccgc

SEQ ID NO: 3124265 - RNA, 20 nt, Mycobacterium bovis subsp bovis AF2122/97
ccgaccgcgcccgcgggcag

SEQ ID NO: 3124266 - RNA, 12 nt, Mycobacterium bovis subsp bovis AF2122/97
ccgaccgcgccg

SEQ ID NO: 3124267 - RNA, 14 nt, Mycobacterium bovis subsp bovis AF2122/97
ccgaccgcgccgca

SEQ ID NO: 3124268 - RNA, 21 nt, Mycobacterium bovis subsp bovis AF2122/97
ccgaccgcgggucgugccagc

SEQ ID NO: 3124269 - RNA, 17 nt, Mycobacterium bovis subsp bovis AF2122/97
ccgaccgcguacaggcc

SEQ ID NO: 3124270 - RNA, 19 nt, Mycobacterium bovis subsp bovis AF2122/97
ccgaccgcguacaggccgg

SEQ ID NO: 3124271 - RNA, 20 nt, Mycobacterium bovis subsp bovis AF2122/97
ccgaccgcguacaggccggc

SEQ ID NO: 3124272 - RNA, 20 nt, Mycobacterium bovis subsp bovis AF2122/97
ccgaccggcacccgcggcga

SEQ ID NO: 3124273 - RNA, 13 nt, Mycobacterium bovis subsp bovis AF2122/97
ccgaccggccacg

SEQ ID NO: 3124274 - RNA, 14 nt, Mycobacterium bovis subsp bovis AF2122/97
ccgaccggcccgca

SEQ ID NO: 3124275 - RNA, 20 nt, Mycobacterium bovis subsp bovis AF2122/97
ccgaccgguacccguagcac

SEQ ID NO: 3124276 - RNA, 20 nt, Mycobacterium bovis subsp bovis AF2122/97
ccgaccgguggcaccggcgg

SEQ ID NO: 3124277 - RNA, 12 nt, Mycobacterium bovis subsp bovis AF2122/97
ccgaccgguugg

SEQ ID NO: 3124278 - RNA, 17 nt, Mycobacterium bovis subsp bovis AF2122/97
ccgaccgucgucgugca

SEQ ID NO: 3124279 - RNA, 18 nt, Mycobacterium bovis subsp bovis AF2122/97
ccgaccgucgucgugcag

SEQ ID NO: 3124280 - RNA, 19 nt, Mycobacterium bovis subsp bovis AF2122/97
ccgaccgucgucgugcagg

SEQ ID NO: 3124281 - RNA, 16 nt, Mycobacterium bovis subsp bovis AF2122/97
ccgaccgugaucagcg

SEQ ID NO: 3124282 - RNA, 18 nt, Mycobacterium bovis subsp bovis AF2122/97
ccgaccgugaucagcgcg

SEQ ID NO: 3124283 - RNA, 19 nt, Mycobacterium bovis subsp bovis AF2122/97
ccgaccguuucuccgccgc

SEQ ID NO: 3124284 - RNA, 18 nt, Mycobacterium bovis subsp bovis AF2122/97
ccgaccuaccgucgacca

SEQ ID NO: 3124285 - RNA, 23 nt, Mycobacterium bovis subsp bovis AF2122/97
ccgaccuagucaccuugaccggg

SEQ ID NO: 3124286 - RNA, 16 nt, Mycobacterium bovis subsp bovis AF2122/97
ccgaccucacggcauc

SEQ ID NO: 3124287 - RNA, 15 nt, Mycobacterium bovis subsp bovis AF2122/97
ccgaccucgacgccc

SEQ ID NO: 3124288 - RNA, 13 nt, Mycobacterium bovis subsp bovis AF2122/97
ccgaccucgccgc

SEQ ID NO: 3124289 - RNA, 15 nt, Mycobacterium bovis subsp bovis AF2122/97
ccgaccucgccgcgc

SEQ ID NO: 3124290 - RNA, 16 nt, Mycobacterium bovis subsp bovis AF2122/97
ccgaccucgccgcgcg

SEQ ID NO: 3124291 - RNA, 15 nt, Mycobacterium bovis subsp bovis AF2122/97
ccgaccucggcaacg

SEQ ID NO: 3124292 - RNA, 19 nt, Mycobacterium bovis subsp bovis AF2122/97
ccgaccucguucgucacca

SEQ ID NO: 3124293 - RNA, 19 nt, Mycobacterium bovis subsp bovis AF2122/97
ccgaccugcaagacgccga

SEQ ID NO: 3124294 - RNA, 17 nt, Mycobacterium bovis subsp bovis AF2122/97
ccgaccugcgcgacggc

SEQ ID NO: 3124295 - RNA, 19 nt, Mycobacterium bovis subsp bovis AF2122/97
ccgaccuguaugccgcggu

SEQ ID NO: 3124296 - RNA, 16 nt, Mycobacterium bovis subsp bovis AF2122/97
ccgaccuucggcccgc

SEQ ID NO: 3124297 - RNA, 17 nt, Mycobacterium bovis subsp bovis AF2122/97
ccgaccuuuugcggcaa

SEQ ID NO: 3124298 - RNA, 19 nt, Mycobacterium bovis subsp bovis AF2122/97
ccgaccuuuugcggcaagc

SEQ ID NO: 3124299 - RNA, 22 nt, Mycobacterium bovis subsp bovis AF2122/97
ccgacgaacgaaccgccgccgc

SEQ ID NO: 3124300 - RNA, 16 nt, Mycobacterium bovis subsp bovis AF2122/97
ccgacgaacgacgggg

SEQ ID NO: 3124301 - RNA, 17 nt, Mycobacterium bovis subsp bovis AF2122/97
ccgacgaagaucgcugc

SEQ ID NO: 3124302 - RNA, 22 nt, Mycobacterium bovis subsp bovis AF2122/97
ccgacgaagaucgcugcgaagc

SEQ ID NO: 3124303 - RNA, 17 nt, Mycobacterium bovis subsp bovis AF2122/97
ccgacgacaucgguggc

SEQ ID NO: 3124304 - RNA, 18 nt, Mycobacterium bovis subsp bovis AF2122/97
ccgacggacuucccgcgc

SEQ ID NO: 3124305 - RNA, 15 nt, Mycobacterium bovis subsp bovis AF2122/97
ccgacggaguucgac

SEQ ID NO: 3124306 - RNA, 16 nt, Mycobacterium bovis subsp bovis AF2122/97
ccgacggaucgcccug

SEQ ID NO: 3124307 - RNA, 20 nt, Mycobacterium bovis subsp bovis AF2122/97
ccgacggcaaaccaguuggc

SEQ ID NO: 3124308 - RNA, 21 nt, Mycobacterium bovis subsp bovis AF2122/97
ccgacggcaaaccaguuggcg

SEQ ID NO: 3124309 - RNA, 15 nt, Mycobacterium bovis subsp bovis AF2122/97
ccgacggcagugcug

SEQ ID NO: 3124310 - RNA, 18 nt, Mycobacterium bovis subsp bovis AF2122/97
ccgacggcagugcugcag

SEQ ID NO: 3124311 - RNA, 22 nt, Mycobacterium bovis subsp bovis AF2122/97
ccgacggcaucaacgcgggcgc

SEQ ID NO: 3124312 - RNA, 17 nt, Mycobacterium bovis subsp bovis AF2122/97
ccgacggccagcaagac

SEQ ID NO: 3124313 - RNA, 15 nt, Mycobacterium bovis subsp bovis AF2122/97
ccgacggccagcagg

SEQ ID NO: 3124314 - RNA, 14 nt, Mycobacterium bovis subsp bovis AF2122/97
ccgacggcccggug

SEQ ID NO: 3124315 - RNA, 17 nt, Mycobacterium bovis subsp bovis AF2122/97
ccgacggcccggugagc

SEQ ID NO: 3124316 - RNA, 14 nt, Mycobacterium bovis subsp bovis AF2122/97
ccgacggccgcggc

SEQ ID NO: 3124317 - RNA, 15 nt, Mycobacterium bovis subsp bovis AF2122/97
ccgacggccgcggcg

SEQ ID NO: 3124318 - RNA, 16 nt, Mycobacterium bovis subsp bovis AF2122/97
ccgacggccgcggcgu

SEQ ID NO: 3124319 - RNA, 13 nt, Mycobacterium bovis subsp bovis AF2122/97
ccgacggcgacca

SEQ ID NO: 3124320 - RNA, 21 nt, Mycobacterium bovis subsp bovis AF2122/97
ccgacggcgaccaccgcggcu

SEQ ID NO: 3124321 - RNA, 18 nt, Mycobacterium bovis subsp bovis AF2122/97
ccgacggcgccccgcgcu

SEQ ID NO: 3124322 - RNA, 12 nt, Mycobacterium bovis subsp bovis AF2122/97
ccgacggcgccg

SEQ ID NO: 3124323 - RNA, 17 nt, Mycobacterium bovis subsp bovis AF2122/97
ccgacggcgccgaaccc

SEQ ID NO: 3124324 - RNA, 19 nt, Mycobacterium bovis subsp bovis AF2122/97
ccgacggcggauaaccggc

SEQ ID NO: 3124325 - RNA, 23 nt, Mycobacterium bovis subsp bovis AF2122/97
ccgacggcgggcgaucuuggcga

SEQ ID NO: 3124326 - RNA, 20 nt, Mycobacterium bovis subsp bovis AF2122/97
ccgacgggacaaggucaucg

SEQ ID NO: 3124327 - RNA, 23 nt, Mycobacterium bovis subsp bovis AF2122/97
ccgacgggauauccggucgcucc

SEQ ID NO: 3124328 - RNA, 21 nt, Mycobacterium bovis subsp bovis AF2122/97
ccgacgggccacgaugcgcac

SEQ ID NO: 3124329 - RNA, 13 nt, Mycobacterium bovis subsp bovis AF2122/97
ccgacgggccguc

SEQ ID NO: 3124330 - RNA, 16 nt, Mycobacterium bovis subsp bovis AF2122/97
ccgacgggccgucgcc

SEQ ID NO: 3124331 - RNA, 18 nt, Mycobacterium bovis subsp bovis AF2122/97
ccgacgggccgucgccgu

SEQ ID NO: 3124332 - RNA, 19 nt, Mycobacterium bovis subsp bovis AF2122/97
ccgacgggccgucgccguc

SEQ ID NO: 3124333 - RNA, 20 nt, Mycobacterium bovis subsp bovis AF2122/97
ccgacgggccgucgccgucc

SEQ ID NO: 3124334 - RNA, 12 nt, Mycobacterium bovis subsp bovis AF2122/97
ccgacgggcgca

SEQ ID NO: 3124335 - RNA, 14 nt, Mycobacterium bovis subsp bovis AF2122/97
ccgacgggcgcaac

SEQ ID NO: 3124336 - RNA, 15 nt, Mycobacterium bovis subsp bovis AF2122/97
ccgacgggcgcaacg

SEQ ID NO: 3124337 - RNA, 19 nt, Mycobacterium bovis subsp bovis AF2122/97
ccgacggguaucccguccc

SEQ ID NO: 3124338 - RNA, 22 nt, Mycobacterium bovis subsp bovis AF2122/97
ccgacggguaucccgucccagc

SEQ ID NO: 3124339 - RNA, 15 nt, Mycobacterium bovis subsp bovis AF2122/97
ccgacgggugcgcgg

SEQ ID NO: 3124340 - RNA, 19 nt, Mycobacterium bovis subsp bovis AF2122/97
ccgacggugaaccaccacu

SEQ ID NO: 3124341 - RNA, 12 nt, Mycobacterium bovis subsp bovis AF2122/97
ccgacggugaug

SEQ ID NO: 3124342 - RNA, 22 nt, Mycobacterium bovis subsp bovis AF2122/97
ccgacggugaugggggagccgg

SEQ ID NO: 3124343 - RNA, 16 nt, Mycobacterium bovis subsp bovis AF2122/97
ccgacguacaggacgg

SEQ ID NO: 3124344 - RNA, 18 nt, Mycobacterium bovis subsp bovis AF2122/97
ccgacguauagaccaggu

SEQ ID NO: 3124345 - RNA, 16 nt, Mycobacterium bovis subsp bovis AF2122/97
ccgacgucaggcagcu

SEQ ID NO: 3124346 - RNA, 22 nt, Mycobacterium bovis subsp bovis AF2122/97
ccgacgucaggcagcuccgccg

SEQ ID NO: 3124347 - RNA, 18 nt, Mycobacterium bovis subsp bovis AF2122/97
ccgacgucgaccacugcc

SEQ ID NO: 3124348 - RNA, 20 nt, Mycobacterium bovis subsp bovis AF2122/97
ccgacgucgaccacugcccg

SEQ ID NO: 3124349 - RNA, 15 nt, Mycobacterium bovis subsp bovis AF2122/97
ccgacgucgacgccg

SEQ ID NO: 3124350 - RNA, 17 nt, Mycobacterium bovis subsp bovis AF2122/97
ccgacgucgacgccggc

SEQ ID NO: 3124351 - RNA, 14 nt, Mycobacterium bovis subsp bovis AF2122/97
ccgacgucgccaag

SEQ ID NO: 3124352 - RNA, 15 nt, Mycobacterium bovis subsp bovis AF2122/97
ccgacgucgccgacg

SEQ ID NO: 3124353 - RNA, 16 nt, Mycobacterium bovis subsp bovis AF2122/97
ccgacgucgccgacgg

SEQ ID NO: 3124354 - RNA, 18 nt, Mycobacterium bovis subsp bovis AF2122/97
ccgacgucgccgacgguu

SEQ ID NO: 3124355 - RNA, 16 nt, Mycobacterium bovis subsp bovis AF2122/97
ccgacgucgccggacg

SEQ ID NO: 3124356 - RNA, 15 nt, Mycobacterium bovis subsp bovis AF2122/97
ccgacgucggugacc

SEQ ID NO: 3124357 - RNA, 19 nt, Mycobacterium bovis subsp bovis AF2122/97
ccgacgugaccagcuucgg

SEQ ID NO: 3124358 - RNA, 13 nt, Mycobacterium bovis subsp bovis AF2122/97
ccgacgugccccc

SEQ ID NO: 3124359 - RNA, 14 nt, Mycobacterium bovis subsp bovis AF2122/97
ccgacguggccagc

SEQ ID NO: 3124360 - RNA, 18 nt, Mycobacterium bovis subsp bovis AF2122/97
ccgacguggccagcccgc

SEQ ID NO: 3124361 - RNA, 13 nt, Mycobacterium bovis subsp bovis AF2122/97
ccgacguugaagc

SEQ ID NO: 3124362 - RNA, 21 nt, Mycobacterium bovis subsp bovis AF2122/97
ccgacguugccgaagccggau

SEQ ID NO: 3124363 - RNA, 23 nt, Mycobacterium bovis subsp bovis AF2122/97
ccgacuaguccgagggcgucgcc

SEQ ID NO: 3124364 - RNA, 14 nt, Mycobacterium bovis subsp bovis AF2122/97
ccgacuaucggccg

SEQ ID NO: 3124365 - RNA, 16 nt, Mycobacterium bovis subsp bovis AF2122/97
ccgacuaucggccgcc

SEQ ID NO: 3124366 - RNA, 21 nt, Mycobacterium bovis subsp bovis AF2122/97
ccgacuaucggccgccggauc

SEQ ID NO: 3124367 - RNA, 14 nt, Mycobacterium bovis subsp bovis AF2122/97
ccgacucaggucgg

SEQ ID NO: 3124368 - RNA, 22 nt, Mycobacterium bovis subsp bovis AF2122/97
ccgacucaggucggugcgguca

SEQ ID NO: 3124369 - RNA, 16 nt, Mycobacterium bovis subsp bovis AF2122/97
ccgacucaucggccgc

SEQ ID NO: 3124370 - RNA, 15 nt, Mycobacterium bovis subsp bovis AF2122/97
ccgacuccccgccgg

SEQ ID NO: 3124371 - RNA, 18 nt, Mycobacterium bovis subsp bovis AF2122/97
ccgacuccugugcggagc

SEQ ID NO: 3124372 - RNA, 21 nt, Mycobacterium bovis subsp bovis AF2122/97
ccgacuccugugcggagccgc

SEQ ID NO: 3124373 - RNA, 16 nt, Mycobacterium bovis subsp bovis AF2122/97
ccgacucggcaccgcg

SEQ ID NO: 3124374 - RNA, 19 nt, Mycobacterium bovis subsp bovis AF2122/97
ccgacucggcaccgcggcc

SEQ ID NO: 3124375 - RNA, 21 nt, Mycobacterium bovis subsp bovis AF2122/97
ccgacucggcaccgcggccgc

SEQ ID NO: 3124376 - RNA, 13 nt, Mycobacterium bovis subsp bovis AF2122/97
ccgacucggccgu

SEQ ID NO: 3124377 - RNA, 15 nt, Mycobacterium bovis subsp bovis AF2122/97
ccgacugcacuugaa

SEQ ID NO: 3124378 - RNA, 22 nt, Mycobacterium bovis subsp bovis AF2122/97
ccgacugccguucagcggcggg

SEQ ID NO: 3124379 - RNA, 22 nt, Mycobacterium bovis subsp bovis AF2122/97
ccgacugcgcccauagcugccg

SEQ ID NO: 3124380 - RNA, 19 nt, Mycobacterium bovis subsp bovis AF2122/97
ccgacugcggguucgccga

SEQ ID NO: 3124381 - RNA, 18 nt, Mycobacterium bovis subsp bovis AF2122/97
ccgacuggccccgccagc

SEQ ID NO: 3124382 - RNA, 21 nt, Mycobacterium bovis subsp bovis AF2122/97
ccgacuggccccgccagcggc

SEQ ID NO: 3124383 - RNA, 19 nt, Mycobacterium bovis subsp bovis AF2122/97
ccgacugggcgcgacccca

SEQ ID NO: 3124384 - RNA, 17 nt, Mycobacterium bovis subsp bovis AF2122/97
ccgacuguagaaaaccc

SEQ ID NO: 3124385 - RNA, 21 nt, Mycobacterium bovis subsp bovis AF2122/97
ccgacuguccccguugagaua

SEQ ID NO: 3124386 - RNA, 19 nt, Mycobacterium bovis subsp bovis AF2122/97
ccgacuuaagcgaacccga

SEQ ID NO: 3124387 - RNA, 16 nt, Mycobacterium bovis subsp bovis AF2122/97
ccgacuuccgcgucgc

SEQ ID NO: 3124388 - RNA, 21 nt, Mycobacterium bovis subsp bovis AF2122/97
ccgacuuccgcgucgccggcc

SEQ ID NO: 3124389 - RNA, 12 nt, Mycobacterium bovis subsp bovis AF2122/97
ccgacuucggaa

SEQ ID NO: 3124390 - RNA, 21 nt, Mycobacterium bovis subsp bovis AF2122/97
ccgagcccgaucgcggcccgg

SEQ ID NO: 3124391 - RNA, 18 nt, Mycobacterium bovis subsp bovis AF2122/97
ccgagcccgaugguggug

SEQ ID NO: 3124392 - RNA, 13 nt, Mycobacterium bovis subsp bovis AF2122/97
ccgagcccgccgg

SEQ ID NO: 3124393 - RNA, 15 nt, Mycobacterium bovis subsp bovis AF2122/97
ccgagcccgccgggu

SEQ ID NO: 3124394 - RNA, 15 nt, Mycobacterium bovis subsp bovis AF2122/97
ccgagcccgcugcgc

SEQ ID NO: 3124395 - RNA, 14 nt, Mycobacterium bovis subsp bovis AF2122/97
ccgagcccgggccu

SEQ ID NO: 3124396 - RNA, 16 nt, Mycobacterium bovis subsp bovis AF2122/97
ccgagcccuccagggc

SEQ ID NO: 3124397 - RNA, 20 nt, Mycobacterium bovis subsp bovis AF2122/97
ccgagccgaaguugaugucg

SEQ ID NO: 3124398 - RNA, 18 nt, Mycobacterium bovis subsp bovis AF2122/97
ccgagccgaccggcggca

SEQ ID NO: 3124399 - RNA, 20 nt, Mycobacterium bovis subsp bovis AF2122/97
ccgagccgauauaccagggc

SEQ ID NO: 3124400 - RNA, 15 nt, Mycobacterium bovis subsp bovis AF2122/97
ccgagccgcacagca

SEQ ID NO: 3124401 - RNA, 12 nt, Mycobacterium bovis subsp bovis AF2122/97
ccgagccgcagc

SEQ ID NO: 3124402 - RNA, 13 nt, Mycobacterium bovis subsp bovis AF2122/97
ccgagccgcagcu

SEQ ID NO: 3124403 - RNA, 15 nt, Mycobacterium bovis subsp bovis AF2122/97
ccgagccgcccgccc

SEQ ID NO: 3124404 - RNA, 19 nt, Mycobacterium bovis subsp bovis AF2122/97
ccgagccgcccgcccggac

SEQ ID NO: 3124405 - RNA, 12 nt, Mycobacterium bovis subsp bovis AF2122/97
ccgagccgcggu

SEQ ID NO: 3124406 - RNA, 17 nt, Mycobacterium bovis subsp bovis AF2122/97
ccgagccgcggucaccc

SEQ ID NO: 3124407 - RNA, 22 nt, Mycobacterium bovis subsp bovis AF2122/97
ccgagccgcuaggacggcgcga

SEQ ID NO: 3124408 - RNA, 15 nt, Mycobacterium bovis subsp bovis AF2122/97
ccgagccgcugcgac

SEQ ID NO: 3124409 - RNA, 16 nt, Mycobacterium bovis subsp bovis AF2122/97
ccgagccggcacgcgc

SEQ ID NO: 3124410 - RNA, 17 nt, Mycobacterium bovis subsp bovis AF2122/97
ccgagccgguaaccgcg

SEQ ID NO: 3124411 - RNA, 21 nt, Mycobacterium bovis subsp bovis AF2122/97
ccgagccgguauacccggccc

SEQ ID NO: 3124412 - RNA, 16 nt, Mycobacterium bovis subsp bovis AF2122/97
ccgagccguccaagcc

SEQ ID NO: 3124413 - RNA, 14 nt, Mycobacterium bovis subsp bovis AF2122/97
ccgagccguugcgc

SEQ ID NO: 3124414 - RNA, 13 nt, Mycobacterium bovis subsp bovis AF2122/97
ccgagccuggauc

SEQ ID NO: 3124415 - RNA, 15 nt, Mycobacterium bovis subsp bovis AF2122/97
ccgagcgaccguccc

SEQ ID NO: 3124416 - RNA, 18 nt, Mycobacterium bovis subsp bovis AF2122/97
ccgagcgaccgucccagc

SEQ ID NO: 3124417 - RNA, 23 nt, Mycobacterium bovis subsp bovis AF2122/97
ccgagcgaccgucccagcgccgc

SEQ ID NO: 3124418 - RNA, 17 nt, Mycobacterium bovis subsp bovis AF2122/97
ccgagcgcaacucccag

SEQ ID NO: 3124419 - RNA, 23 nt, Mycobacterium bovis subsp bovis AF2122/97
ccgagcgcaacucccagcacggu

SEQ ID NO: 3124420 - RNA, 23 nt, Mycobacterium bovis subsp bovis AF2122/97
ccgagcgcaagagccguccgacc

SEQ ID NO: 3124421 - RNA, 13 nt, Mycobacterium bovis subsp bovis AF2122/97
ccgagcgcccgca

SEQ ID NO: 3124422 - RNA, 13 nt, Mycobacterium bovis subsp bovis AF2122/97
ccgagcgcgauga

SEQ ID NO: 3124423 - RNA, 12 nt, Mycobacterium bovis subsp bovis AF2122/97
ccgagcgcgccg

SEQ ID NO: 3124424 - RNA, 20 nt, Mycobacterium bovis subsp bovis AF2122/97
ccgagcgcgccgaaggccgc

SEQ ID NO: 3124425 - RNA, 13 nt, Mycobacterium bovis subsp bovis AF2122/97
ccgagcgcgccgu

SEQ ID NO: 3124426 - RNA, 18 nt, Mycobacterium bovis subsp bovis AF2122/97
ccgagcgcgccguugccg

SEQ ID NO: 3124427 - RNA, 16 nt, Mycobacterium bovis subsp bovis AF2122/97
ccgagcgcggcggcgg

SEQ ID NO: 3124428 - RNA, 17 nt, Mycobacterium bovis subsp bovis AF2122/97
ccgagcgcggcggcgga

SEQ ID NO: 3124429 - RNA, 19 nt, Mycobacterium bovis subsp bovis AF2122/97
ccgagcgcucgaucacggc

SEQ ID NO: 3124430 - RNA, 15 nt, Mycobacterium bovis subsp bovis AF2122/97
ccgagcggaccaccg

SEQ ID NO: 3124431 - RNA, 18 nt, Mycobacterium bovis subsp bovis AF2122/97
ccgagcggaccaccgcuc

SEQ ID NO: 3124432 - RNA, 21 nt, Mycobacterium bovis subsp bovis AF2122/97
ccgagcggaccaccgcucgcc

SEQ ID NO: 3124433 - RNA, 16 nt, Mycobacterium bovis subsp bovis AF2122/97
ccgagcggagccgccg

SEQ ID NO: 3124434 - RNA, 17 nt, Mycobacterium bovis subsp bovis AF2122/97
ccgagcggagccgccga

SEQ ID NO: 3124435 - RNA, 21 nt, Mycobacterium bovis subsp bovis AF2122/97
ccgagcggagccgccgacucg

SEQ ID NO: 3124436 - RNA, 23 nt, Mycobacterium bovis subsp bovis AF2122/97
ccgagcggagccgccgacucggc

SEQ ID NO: 3124437 - RNA, 21 nt, Mycobacterium bovis subsp bovis AF2122/97
ccgagcggcaucggucaccgc

SEQ ID NO: 3124438 - RNA, 22 nt, Mycobacterium bovis subsp bovis AF2122/97
ccgagcggcaucggucaccgcg

SEQ ID NO: 3124439 - RNA, 23 nt, Mycobacterium bovis subsp bovis AF2122/97
ccgagcggcaucggucaccgcgg

SEQ ID NO: 3124440 - RNA, 14 nt, Mycobacterium bovis subsp bovis AF2122/97
ccgagcggcccuuc

SEQ ID NO: 3124441 - RNA, 22 nt, Mycobacterium bovis subsp bovis AF2122/97
ccgagcggcccuucaccagcca

SEQ ID NO: 3124442 - RNA, 13 nt, Mycobacterium bovis subsp bovis AF2122/97
ccgagcggcggca

SEQ ID NO: 3124443 - RNA, 15 nt, Mycobacterium bovis subsp bovis AF2122/97
ccgagcggcggcacu

SEQ ID NO: 3124444 - RNA, 18 nt, Mycobacterium bovis subsp bovis AF2122/97
ccgagcggcugagccgca

SEQ ID NO: 3124445 - RNA, 20 nt, Mycobacterium bovis subsp bovis AF2122/97
ccgagcggcugagccgcauc

SEQ ID NO: 3124446 - RNA, 23 nt, Mycobacterium bovis subsp bovis AF2122/97
ccgagcgggaacgagccacgcca

SEQ ID NO: 3124447 - RNA, 15 nt, Mycobacterium bovis subsp bovis AF2122/97
ccgagcggucgaucu

SEQ ID NO: 3124448 - RNA, 14 nt, Mycobacterium bovis subsp bovis AF2122/97
ccgagcggugccgg

SEQ ID NO: 3124449 - RNA, 15 nt, Mycobacterium bovis subsp bovis AF2122/97
ccgagcguccggugg

SEQ ID NO: 3124450 - RNA, 13 nt, Mycobacterium bovis subsp bovis AF2122/97
ccgagcgugaagu

SEQ ID NO: 3124451 - RNA, 19 nt, Mycobacterium bovis subsp bovis AF2122/97
ccgagcgugaagucacggc

SEQ ID NO: 3124452 - RNA, 20 nt, Mycobacterium bovis subsp bovis AF2122/97
ccgagcgugaagucacggcg

SEQ ID NO: 3124453 - RNA, 21 nt, Mycobacterium bovis subsp bovis AF2122/97
ccgagcgugcgcugguggcgg

SEQ ID NO: 3124454 - RNA, 22 nt, Mycobacterium bovis subsp bovis AF2122/97
ccgagcgugcgcugguggcggc

SEQ ID NO: 3124455 - RNA, 20 nt, Mycobacterium bovis subsp bovis AF2122/97
ccgagcguggccaauccggc

SEQ ID NO: 3124456 - RNA, 15 nt, Mycobacterium bovis subsp bovis AF2122/97
ccgagcuacgaccgu

SEQ ID NO: 3124457 - RNA, 23 nt, Mycobacterium bovis subsp bovis AF2122/97
ccgagcuagaucacggagcucuu

SEQ ID NO: 3124458 - RNA, 22 nt, Mycobacterium bovis subsp bovis AF2122/97
ccgagcucaccaaggucggcga

SEQ ID NO: 3124459 - RNA, 21 nt, Mycobacterium bovis subsp bovis AF2122/97
ccgagcucaccgcacaccugc

SEQ ID NO: 3124460 - RNA, 20 nt, Mycobacterium bovis subsp bovis AF2122/97
ccgagcucacuucacgccgc

SEQ ID NO: 3124461 - RNA, 21 nt, Mycobacterium bovis subsp bovis AF2122/97
ccgagcucacuucacgccgcc

SEQ ID NO: 3124462 - RNA, 24 nt, Mycobacterium bovis subsp bovis AF2122/97
ccgagcucaggucgacaggugcca

SEQ ID NO: 3124463 - RNA, 17 nt, Mycobacterium bovis subsp bovis AF2122/97
ccgagcuccgcggcgag

SEQ ID NO: 3124464 - RNA, 19 nt, Mycobacterium bovis subsp bovis AF2122/97
ccgagcuccgcggcgagcu

SEQ ID NO: 3124465 - RNA, 22 nt, Mycobacterium bovis subsp bovis AF2122/97
ccgagcuccgcggcgagcuccg

SEQ ID NO: 3124466 - RNA, 18 nt, Mycobacterium bovis subsp bovis AF2122/97
ccgagcuccuccaccaac

SEQ ID NO: 3124467 - RNA, 19 nt, Mycobacterium bovis subsp bovis AF2122/97
ccgagcuccuccaccaacu

SEQ ID NO: 3124468 - RNA, 15 nt, Mycobacterium bovis subsp bovis AF2122/97
ccgagcucgccgcag

SEQ ID NO: 3124469 - RNA, 16 nt, Mycobacterium bovis subsp bovis AF2122/97
ccgagcucgccgcagc

SEQ ID NO: 3124470 - RNA, 17 nt, Mycobacterium bovis subsp bovis AF2122/97
ccgagcucgccgcagcg

SEQ ID NO: 3124471 - RNA, 15 nt, Mycobacterium bovis subsp bovis AF2122/97
ccgagcucggcgccc

SEQ ID NO: 3124472 - RNA, 16 nt, Mycobacterium bovis subsp bovis AF2122/97
ccgagcucggcgccca

SEQ ID NO: 3124473 - RNA, 15 nt, Mycobacterium bovis subsp bovis AF2122/97
ccgagcucgggugcg

SEQ ID NO: 3124474 - RNA, 19 nt, Mycobacterium bovis subsp bovis AF2122/97
ccgagcucguugcuggcgg

SEQ ID NO: 3124475 - RNA, 21 nt, Mycobacterium bovis subsp bovis AF2122/97
ccgagcucguugcuggcggcc

SEQ ID NO: 3124476 - RNA, 15 nt, Mycobacterium bovis subsp bovis AF2122/97
ccgagugcggugugu

SEQ ID NO: 3124477 - RNA, 22 nt, Mycobacterium bovis subsp bovis AF2122/97
ccgagugcggugugugcaagcc

SEQ ID NO: 3124478 - RNA, 18 nt, Mycobacterium bovis subsp bovis AF2122/97
ccgaguggccggugggcc

SEQ ID NO: 3124479 - RNA, 21 nt, Mycobacterium bovis subsp bovis AF2122/97
ccgaguggccggugggccgcc

SEQ ID NO: 3124480 - RNA, 22 nt, Mycobacterium bovis subsp bovis AF2122/97
ccgaguggccggugggccgccc

SEQ ID NO: 3124481 - RNA, 17 nt, Mycobacterium bovis subsp bovis AF2122/97
ccgagugugaaucgcac

SEQ ID NO: 3124482 - RNA, 18 nt, Mycobacterium bovis subsp bovis AF2122/97
ccgaguuauagaagccga

SEQ ID NO: 3124483 - RNA, 20 nt, Mycobacterium bovis subsp bovis AF2122/97
ccgaguugaaggugccggcg

SEQ ID NO: 3124484 - RNA, 15 nt, Mycobacterium bovis subsp bovis AF2122/97
ccgaguugcccgggu

SEQ ID NO: 3124485 - RNA, 20 nt, Mycobacterium bovis subsp bovis AF2122/97
ccgaguugcccgggucggcc

SEQ ID NO: 3124486 - RNA, 17 nt, Mycobacterium bovis subsp bovis AF2122/97
ccgaguugcccucuggc

SEQ ID NO: 3124487 - RNA, 22 nt, Mycobacterium bovis subsp bovis AF2122/97
ccgaguugucgccggaguucug

SEQ ID NO: 3124488 - RNA, 20 nt, Mycobacterium bovis subsp bovis AF2122/97
ccgaguuguggacgcccgag

SEQ ID NO: 3124489 - RNA, 18 nt, Mycobacterium bovis subsp bovis AF2122/97
ccgaguuguucagcccgu

SEQ ID NO: 3124490 - RNA, 17 nt, Mycobacterium bovis subsp bovis AF2122/97
ccgaguuguugcugccc

SEQ ID NO: 3124491 - RNA, 18 nt, Mycobacterium bovis subsp bovis AF2122/97
ccgaguuucugaagcccg

SEQ ID NO: 3124492 - RNA, 21 nt, Mycobacterium bovis subsp bovis AF2122/97
ccgaguuucugaagcccgaca

SEQ ID NO: 3124493 - RNA, 17 nt, Mycobacterium bovis subsp bovis AF2122/97
ccgaguuugcgauaccc

SEQ ID NO: 3124494 - RNA, 18 nt, Mycobacterium bovis subsp bovis AF2122/97
ccgauaaaggucacuccu

SEQ ID NO: 3124495 - RNA, 14 nt, Mycobacterium bovis subsp bovis AF2122/97
ccgauaaauggccg

SEQ ID NO: 3124496 - RNA, 15 nt, Mycobacterium bovis subsp bovis AF2122/97
ccgauaaauggccga

SEQ ID NO: 3124497 - RNA, 17 nt, Mycobacterium bovis subsp bovis AF2122/97
ccgauaaauggccgaug

SEQ ID NO: 3124498 - RNA, 18 nt, Mycobacterium bovis subsp bovis AF2122/97
ccgauaacaaggccgccg

SEQ ID NO: 3124499 - RNA, 22 nt, Mycobacterium bovis subsp bovis AF2122/97
ccgauaacaaggccgccgccgu

SEQ ID NO: 3124500 - RNA, 17 nt, Mycobacterium bovis subsp bovis AF2122/97
ccgauaacacccgggcc

SEQ ID NO: 3124501 - RNA, 18 nt, Mycobacterium bovis subsp bovis AF2122/97
ccgauaagguucgugcgu

SEQ ID NO: 3124502 - RNA, 23 nt, Mycobacterium bovis subsp bovis AF2122/97
ccgauacagcacauccagcccug

SEQ ID NO: 3124503 - RNA, 20 nt, Mycobacterium bovis subsp bovis AF2122/97
ccgauacaggccacgcaccg

SEQ ID NO: 3124504 - RNA, 16 nt, Mycobacterium bovis subsp bovis AF2122/97
ccgauacccagcgggu

SEQ ID NO: 3124505 - RNA, 15 nt, Mycobacterium bovis subsp bovis AF2122/97
ccgauaccggcggcg

SEQ ID NO: 3124506 - RNA, 19 nt, Mycobacterium bovis subsp bovis AF2122/97
ccgauaccggcggcgagcg

SEQ ID NO: 3124507 - RNA, 19 nt, Mycobacterium bovis subsp bovis AF2122/97
ccgauaccgucagcgccgc

SEQ ID NO: 3124508 - RNA, 15 nt, Mycobacterium bovis subsp bovis AF2122/97
ccgauacggccggcc

SEQ ID NO: 3124509 - RNA, 17 nt, Mycobacterium bovis subsp bovis AF2122/97
ccgauacggccggccgu

SEQ ID NO: 3124510 - RNA, 20 nt, Mycobacterium bovis subsp bovis AF2122/97
ccgauacuaaacaggccgcc

SEQ ID NO: 3124511 - RNA, 22 nt, Mycobacterium bovis subsp bovis AF2122/97
ccgauacuaaacaggccgccac

SEQ ID NO: 3124512 - RNA, 20 nt, Mycobacterium bovis subsp bovis AF2122/97
ccgauacuucaucggcacag

SEQ ID NO: 3124513 - RNA, 21 nt, Mycobacterium bovis subsp bovis AF2122/97
ccgauagcgaccgcggccccg

SEQ ID NO: 3124514 - RNA, 19 nt, Mycobacterium bovis subsp bovis AF2122/97
ccgauagcgcggcaccagc

SEQ ID NO: 3124515 - RNA, 20 nt, Mycobacterium bovis subsp bovis AF2122/97
ccgauagugacuuggccaug

SEQ ID NO: 3124516 - RNA, 22 nt, Mycobacterium bovis subsp bovis AF2122/97
ccgauauaccagggcaucagca

SEQ ID NO: 3124517 - RNA, 16 nt, Mycobacterium bovis subsp bovis AF2122/97
ccgauaucgcugcgga

SEQ ID NO: 3124518 - RNA, 17 nt, Mycobacterium bovis subsp bovis AF2122/97
ccgauaucgcugcggaa

SEQ ID NO: 3124519 - RNA, 15 nt, Mycobacterium bovis subsp bovis AF2122/97
ccgauauucggccau

SEQ ID NO: 3124520 - RNA, 18 nt, Mycobacterium bovis subsp bovis AF2122/97
ccgaucaacagggccaga

SEQ ID NO: 3124521 - RNA, 21 nt, Mycobacterium bovis subsp bovis AF2122/97
ccgaucaacaugccggucauc

SEQ ID NO: 3124522 - RNA, 15 nt, Mycobacterium bovis subsp bovis AF2122/97
ccgaucaacggaaug

SEQ ID NO: 3124523 - RNA, 14 nt, Mycobacterium bovis subsp bovis AF2122/97
ccgaucaauccgcc

SEQ ID NO: 3124524 - RNA, 13 nt, Mycobacterium bovis subsp bovis AF2122/97
ccgaucaccaccg

SEQ ID NO: 3124525 - RNA, 15 nt, Mycobacterium bovis subsp bovis AF2122/97
ccgaucaccaccggc

SEQ ID NO: 3124526 - RNA, 12 nt, Mycobacterium bovis subsp bovis AF2122/97
ccgaucaccacg

SEQ ID NO: 3124527 - RNA, 14 nt, Mycobacterium bovis subsp bovis AF2122/97
ccgaucaccaucca

SEQ ID NO: 3124528 - RNA, 13 nt, Mycobacterium bovis subsp bovis AF2122/97
ccgaucaccccgg

SEQ ID NO: 3124529 - RNA, 14 nt, Mycobacterium bovis subsp bovis AF2122/97
ccgaucaccccggu

SEQ ID NO: 3124530 - RNA, 18 nt, Mycobacterium bovis subsp bovis AF2122/97
ccgaucaccccggucggc

SEQ ID NO: 3124531 - RNA, 21 nt, Mycobacterium bovis subsp bovis AF2122/97
ccgaucaccccggucggcccg

SEQ ID NO: 3124532 - RNA, 14 nt, Mycobacterium bovis subsp bovis AF2122/97
ccgaucacccgcac

SEQ ID NO: 3124533 - RNA, 20 nt, Mycobacterium bovis subsp bovis AF2122/97
ccgaucaccgcaucggugcc

SEQ ID NO: 3124534 - RNA, 13 nt, Mycobacterium bovis subsp bovis AF2122/97
ccgaucaccgccg

SEQ ID NO: 3124535 - RNA, 23 nt, Mycobacterium bovis subsp bovis AF2122/97
ccgaucaccgguucggugagcgg

SEQ ID NO: 3124536 - RNA, 17 nt, Mycobacterium bovis subsp bovis AF2122/97
ccgaucaccucggcgac

SEQ ID NO: 3124537 - RNA, 22 nt, Mycobacterium bovis subsp bovis AF2122/97
ccgaucaccucggcgacgucgg

SEQ ID NO: 3124538 - RNA, 16 nt, Mycobacterium bovis subsp bovis AF2122/97
ccgaucacgacguugc

SEQ ID NO: 3124539 - RNA, 15 nt, Mycobacterium bovis subsp bovis AF2122/97
ccgaucacgcuguuc

SEQ ID NO: 3124540 - RNA, 16 nt, Mycobacterium bovis subsp bovis AF2122/97
ccgaucacggugggcg

SEQ ID NO: 3124541 - RNA, 13 nt, Mycobacterium bovis subsp bovis AF2122/97
ccgaucagcaccg

SEQ ID NO: 3124542 - RNA, 16 nt, Mycobacterium bovis subsp bovis AF2122/97
ccgaucagcaccgacg

SEQ ID NO: 3124543 - RNA, 21 nt, Mycobacterium bovis subsp bovis AF2122/97
ccgaucagcaccgacggcgca

SEQ ID NO: 3124544 - RNA, 13 nt, Mycobacterium bovis subsp bovis AF2122/97
ccgaucagcagcu

SEQ ID NO: 3124545 - RNA, 13 nt, Mycobacterium bovis subsp bovis AF2122/97
ccgaucagcaggg

SEQ ID NO: 3124546 - RNA, 14 nt, Mycobacterium bovis subsp bovis AF2122/97
ccgaucagcagggc

SEQ ID NO: 3124547 - RNA, 13 nt, Mycobacterium bovis subsp bovis AF2122/97
ccgaucagcccgg

SEQ ID NO: 3124548 - RNA, 14 nt, Mycobacterium bovis subsp bovis AF2122/97
ccgaucagccgugg

SEQ ID NO: 3124549 - RNA, 15 nt, Mycobacterium bovis subsp bovis AF2122/97
ccgaucagcguggcg

SEQ ID NO: 3124550 - RNA, 16 nt, Mycobacterium bovis subsp bovis AF2122/97
ccgaucagcguggcgc

SEQ ID NO: 3124551 - RNA, 20 nt, Mycobacterium bovis subsp bovis AF2122/97
ccgaucagcguggcgcccgu

SEQ ID NO: 3124552 - RNA, 16 nt, Mycobacterium bovis subsp bovis AF2122/97
ccgaucaggccgacgu

SEQ ID NO: 3124553 - RNA, 21 nt, Mycobacterium bovis subsp bovis AF2122/97
ccgaucagguacgccaggugc

SEQ ID NO: 3124554 - RNA, 16 nt, Mycobacterium bovis subsp bovis AF2122/97
ccgaucaguccggcgu

SEQ ID NO: 3124555 - RNA, 13 nt, Mycobacterium bovis subsp bovis AF2122/97
ccgaucaucaccg

SEQ ID NO: 3124556 - RNA, 14 nt, Mycobacterium bovis subsp bovis AF2122/97
ccgaucaucaccgg

SEQ ID NO: 3124557 - RNA, 15 nt, Mycobacterium bovis subsp bovis AF2122/97
ccgaucaucaccggc

SEQ ID NO: 3124558 - RNA, 18 nt, Mycobacterium bovis subsp bovis AF2122/97
ccgaucaucauauccgcc

SEQ ID NO: 3124559 - RNA, 20 nt, Mycobacterium bovis subsp bovis AF2122/97
ccgaucaucauauccgcccc

SEQ ID NO: 3124560 - RNA, 21 nt, Mycobacterium bovis subsp bovis AF2122/97
ccgaucaucauauccgcccca

SEQ ID NO: 3124561 - RNA, 16 nt, Mycobacterium bovis subsp bovis AF2122/97
ccgaucaugucggccg

SEQ ID NO: 3124562 - RNA, 20 nt, Mycobacterium bovis subsp bovis AF2122/97
ccgaucaugucggccggggc

SEQ ID NO: 3124563 - RNA, 22 nt, Mycobacterium bovis subsp bovis AF2122/97
ccgaugacgauggccgccgcga

SEQ ID NO: 3124564 - RNA, 15 nt, Mycobacterium bovis subsp bovis AF2122/97
ccgaugacggucccc

SEQ ID NO: 3124565 - RNA, 21 nt, Mycobacterium bovis subsp bovis AF2122/97
ccgaugacuacuccugagaug

SEQ ID NO: 3124566 - RNA, 12 nt, Mycobacterium bovis subsp bovis AF2122/97
ccgaugagccca

SEQ ID NO: 3124567 - RNA, 18 nt, Mycobacterium bovis subsp bovis AF2122/97
ccgaugaucucacccagc

SEQ ID NO: 3124568 - RNA, 22 nt, Mycobacterium bovis subsp bovis AF2122/97
ccgaugaugcggcgcagcgacg

SEQ ID NO: 3124569 - RNA, 17 nt, Mycobacterium bovis subsp bovis AF2122/97
ccgaugauggacaccag

SEQ ID NO: 3124570 - RNA, 19 nt, Mycobacterium bovis subsp bovis AF2122/97
ccgaugauggacaccagcc

SEQ ID NO: 3124571 - RNA, 20 nt, Mycobacterium bovis subsp bovis AF2122/97
ccgaugauggacaccagcca

SEQ ID NO: 3124572 - RNA, 21 nt, Mycobacterium bovis subsp bovis AF2122/97
ccgaugauguuuuccccgccc

SEQ ID NO: 3124573 - RNA, 20 nt, Mycobacterium bovis subsp bovis AF2122/97
ccgaugcacuccaugaaucg

SEQ ID NO: 3124574 - RNA, 21 nt, Mycobacterium bovis subsp bovis AF2122/97
ccgaugcaucggugcagcccg

SEQ ID NO: 3124575 - RNA, 22 nt, Mycobacterium bovis subsp bovis AF2122/97
ccgaugcaucggugcagcccgc

SEQ ID NO: 3124576 - RNA, 18 nt, Mycobacterium bovis subsp bovis AF2122/97
ccgaugcccgacaccgcc

SEQ ID NO: 3124577 - RNA, 22 nt, Mycobacterium bovis subsp bovis AF2122/97
ccgaugcccucgauggccaggc

SEQ ID NO: 3124578 - RNA, 16 nt, Mycobacterium bovis subsp bovis AF2122/97
ccgaugccgaagcccc

SEQ ID NO: 3124579 - RNA, 20 nt, Mycobacterium bovis subsp bovis AF2122/97
ccgaugccgaagcccccgac

SEQ ID NO: 3124580 - RNA, 17 nt, Mycobacterium bovis subsp bovis AF2122/97
ccgaugccgaugcccag

SEQ ID NO: 3124581 - RNA, 13 nt, Mycobacterium bovis subsp bovis AF2122/97
ccgaugccgccgg

SEQ ID NO: 3124582 - RNA, 17 nt, Mycobacterium bovis subsp bovis AF2122/97
ccgaugccgccggcccc

SEQ ID NO: 3124583 - RNA, 13 nt, Mycobacterium bovis subsp bovis AF2122/97
ccgaugccggcga

SEQ ID NO: 3124584 - RNA, 21 nt, Mycobacterium bovis subsp bovis AF2122/97
ccgaugccgugcccggugcgg

SEQ ID NO: 3124585 - RNA, 19 nt, Mycobacterium bovis subsp bovis AF2122/97
ccgaugccuugaccgcggu

SEQ ID NO: 3124586 - RNA, 16 nt, Mycobacterium bovis subsp bovis AF2122/97
ccgaugcgcagugcac

SEQ ID NO: 3124587 - RNA, 21 nt, Mycobacterium bovis subsp bovis AF2122/97
ccgaugcgcagugcaccgcgu

SEQ ID NO: 3124588 - RNA, 22 nt, Mycobacterium bovis subsp bovis AF2122/97
ccgaugcgcagugcaccgcguc

SEQ ID NO: 3124589 - RNA, 14 nt, Mycobacterium bovis subsp bovis AF2122/97
ccgaugcggugcgg

SEQ ID NO: 3124590 - RNA, 14 nt, Mycobacterium bovis subsp bovis AF2122/97
ccgaugcugacgau

SEQ ID NO: 3124591 - RNA, 15 nt, Mycobacterium bovis subsp bovis AF2122/97
ccgaugcugccgccg

SEQ ID NO: 3124592 - RNA, 22 nt, Mycobacterium bovis subsp bovis AF2122/97
ccgaugcugccgccgccgccgg

SEQ ID NO: 3124593 - RNA, 14 nt, Mycobacterium bovis subsp bovis AF2122/97
ccgaugcugcgggc

SEQ ID NO: 3124594 - RNA, 17 nt, Mycobacterium bovis subsp bovis AF2122/97
ccgauggaugggcugcg

SEQ ID NO: 3124595 - RNA, 21 nt, Mycobacterium bovis subsp bovis AF2122/97
ccgauggaugggcugcgcguc

SEQ ID NO: 3124596 - RNA, 22 nt, Mycobacterium bovis subsp bovis AF2122/97
ccgauggaugggcugcgcgucg

SEQ ID NO: 3124597 - RNA, 15 nt, Mycobacterium bovis subsp bovis AF2122/97
ccgauggcgaugcgc

SEQ ID NO: 3124598 - RNA, 16 nt, Mycobacterium bovis subsp bovis AF2122/97
ccgauggcgcaccggc

SEQ ID NO: 3124599 - RNA, 16 nt, Mycobacterium bovis subsp bovis AF2122/97
ccgauggcgucgccgg

SEQ ID NO: 3124600 - RNA, 17 nt, Mycobacterium bovis subsp bovis AF2122/97
ccgauggcgucgccggc

SEQ ID NO: 3124601 - RNA, 21 nt, Mycobacterium bovis subsp bovis AF2122/97
ccgaugggaaucagugaagac

SEQ ID NO: 3124602 - RNA, 14 nt, Mycobacterium bovis subsp bovis AF2122/97
ccgaugguacccgc

SEQ ID NO: 3124603 - RNA, 16 nt, Mycobacterium bovis subsp bovis AF2122/97
ccgaugguacccgcgc

SEQ ID NO: 3124604 - RNA, 18 nt, Mycobacterium bovis subsp bovis AF2122/97
ccgaugguacccgcgccg

SEQ ID NO: 3124605 - RNA, 22 nt, Mycobacterium bovis subsp bovis AF2122/97
ccgaugguacccgcgccgcgca

SEQ ID NO: 3124606 - RNA, 22 nt, Mycobacterium bovis subsp bovis AF2122/97
ccgauggugaugggggagccgg

SEQ ID NO: 3124607 - RNA, 16 nt, Mycobacterium bovis subsp bovis AF2122/97
ccgauggugccgaccc

SEQ ID NO: 3124608 - RNA, 19 nt, Mycobacterium bovis subsp bovis AF2122/97
ccgauggugccgacccgcc

SEQ ID NO: 3124609 - RNA, 20 nt, Mycobacterium bovis subsp bovis AF2122/97
ccgauggugccgacccgccg

SEQ ID NO: 3124610 - RNA, 22 nt, Mycobacterium bovis subsp bovis AF2122/97
ccgauggugccgacccgccgcg

SEQ ID NO: 3124611 - RNA, 17 nt, Mycobacterium bovis subsp bovis AF2122/97
ccgaugguggccgcgcg

SEQ ID NO: 3124612 - RNA, 21 nt, Mycobacterium bovis subsp bovis AF2122/97
ccgaugguggugccaaccugg

SEQ ID NO: 3124613 - RNA, 15 nt, Mycobacterium bovis subsp bovis AF2122/97
ccgauggugugcacg

SEQ ID NO: 3124614 - RNA, 19 nt, Mycobacterium bovis subsp bovis AF2122/97
ccgauguagcgcugcgggu

SEQ ID NO: 3124615 - RNA, 19 nt, Mycobacterium bovis subsp bovis AF2122/97
ccgaugucgaugccgcgca

SEQ ID NO: 3124616 - RNA, 22 nt, Mycobacterium bovis subsp bovis AF2122/97
ccgaugucgucuuuggucagcc

SEQ ID NO: 3124617 - RNA, 21 nt, Mycobacterium bovis subsp bovis AF2122/97
ccgaugugccgauuggccugc

SEQ ID NO: 3124618 - RNA, 19 nt, Mycobacterium bovis subsp bovis AF2122/97
ccgauguggccggcgaugg

SEQ ID NO: 3124619 - RNA, 14 nt, Mycobacterium bovis subsp bovis AF2122/97
ccgauguggucggc

SEQ ID NO: 3124620 - RNA, 18 nt, Mycobacterium bovis subsp bovis AF2122/97
ccgauguuguugacgccc

SEQ ID NO: 3124621 - RNA, 19 nt, Mycobacterium bovis subsp bovis AF2122/97
ccgauuacggugaucgccg

SEQ ID NO: 3124622 - RNA, 18 nt, Mycobacterium bovis subsp bovis AF2122/97
ccgauuccaccgccgacg

SEQ ID NO: 3124623 - RNA, 14 nt, Mycobacterium bovis subsp bovis AF2122/97
ccgauuccagcgga

SEQ ID NO: 3124624 - RNA, 13 nt, Mycobacterium bovis subsp bovis AF2122/97
ccgauuccgcgcg

SEQ ID NO: 3124625 - RNA, 20 nt, Mycobacterium bovis subsp bovis AF2122/97
ccgauucggccagcgcccgc

SEQ ID NO: 3124626 - RNA, 13 nt, Mycobacterium bovis subsp bovis AF2122/97
ccgauucggcgac

SEQ ID NO: 3124627 - RNA, 19 nt, Mycobacterium bovis subsp bovis AF2122/97
ccgauucgugucggugcgc

SEQ ID NO: 3124628 - RNA, 14 nt, Mycobacterium bovis subsp bovis AF2122/97
ccgauucucgaucu

SEQ ID NO: 3124629 - RNA, 19 nt, Mycobacterium bovis subsp bovis AF2122/97
ccgauucugauaucgucgg

SEQ ID NO: 3124630 - RNA, 20 nt, Mycobacterium bovis subsp bovis AF2122/97
ccgauucugauaucgucggu

SEQ ID NO: 3124631 - RNA, 18 nt, Mycobacterium bovis subsp bovis AF2122/97
ccgauugaguucggcggc

SEQ ID NO: 3124632 - RNA, 16 nt, Mycobacterium bovis subsp bovis AF2122/97
ccgauuggccaacccc

SEQ ID NO: 3124633 - RNA, 14 nt, Mycobacterium bovis subsp bovis AF2122/97
ccgauuuugggauc

SEQ ID NO: 3124634 - RNA, 22 nt, Mycobacterium bovis subsp bovis AF2122/97
ccgauuuugggaucgugccggc

SEQ ID NO: 3124635 - RNA, 16 nt, Mycobacterium bovis subsp bovis AF2122/97
ccgauuuugugagcca

SEQ ID NO: 3124636 - RNA, 20 nt, Mycobacterium bovis subsp bovis AF2122/97
ccgcaaaaucgucagcgccg

SEQ ID NO: 3124637 - RNA, 17 nt, Mycobacterium bovis subsp bovis AF2122/97
ccgcaaacccgccgaca

SEQ ID NO: 3124638 - RNA, 19 nt, Mycobacterium bovis subsp bovis AF2122/97
ccgcaacaacgccgcgacg

SEQ ID NO: 3124639 - RNA, 13 nt, Mycobacterium bovis subsp bovis AF2122/97
ccgcaacagcucg

SEQ ID NO: 3124640 - RNA, 16 nt, Mycobacterium bovis subsp bovis AF2122/97
ccgcaacagcucggcc

SEQ ID NO: 3124641 - RNA, 17 nt, Mycobacterium bovis subsp bovis AF2122/97
ccgcaacagcucggcca

SEQ ID NO: 3124642 - RNA, 20 nt, Mycobacterium bovis subsp bovis AF2122/97
ccgcaacagcucggccaggc

SEQ ID NO: 3124643 - RNA, 22 nt, Mycobacterium bovis subsp bovis AF2122/97
ccgcaacagcucggccaggcug

SEQ ID NO: 3124644 - RNA, 13 nt, Mycobacterium bovis subsp bovis AF2122/97
ccgcaaccgagcu

SEQ ID NO: 3124645 - RNA, 12 nt, Mycobacterium bovis subsp bovis AF2122/97
ccgcaaccgccg

SEQ ID NO: 3124646 - RNA, 13 nt, Mycobacterium bovis subsp bovis AF2122/97
ccgcaacgacggc

SEQ ID NO: 3124647 - RNA, 16 nt, Mycobacterium bovis subsp bovis AF2122/97
ccgcaacgacggccgu

SEQ ID NO: 3124648 - RNA, 20 nt, Mycobacterium bovis subsp bovis AF2122/97
ccgcaacgccaacacgcguu

SEQ ID NO: 3124649 - RNA, 16 nt, Mycobacterium bovis subsp bovis AF2122/97
ccgcaccugggcggcg

SEQ ID NO: 3124650 - RNA, 17 nt, Mycobacterium bovis subsp bovis AF2122/97
ccgcacgaaccggucga

SEQ ID NO: 3124651 - RNA, 12 nt, Mycobacterium bovis subsp bovis AF2122/97
ccgcacgaccag

SEQ ID NO: 3124652 - RNA, 15 nt, Mycobacterium bovis subsp bovis AF2122/97
ccgcacgaccagcug

SEQ ID NO: 3124653 - RNA, 16 nt, Mycobacterium bovis subsp bovis AF2122/97
ccgcacgaucgcccgu

SEQ ID NO: 3124654 - RNA, 12 nt, Mycobacterium bovis subsp bovis AF2122/97
ccgcacgaugcc

SEQ ID NO: 3124655 - RNA, 18 nt, Mycobacterium bovis subsp bovis AF2122/97
ccgcacgauggccgucga

SEQ ID NO: 3124656 - RNA, 14 nt, Mycobacterium bovis subsp bovis AF2122/97
ccgcacgccgaccg

SEQ ID NO: 3124657 - RNA, 16 nt, Mycobacterium bovis subsp bovis AF2122/97
ccgcacgccggccagc

SEQ ID NO: 3124658 - RNA, 18 nt, Mycobacterium bovis subsp bovis AF2122/97
ccgcacgccggccagcga

SEQ ID NO: 3124659 - RNA, 13 nt, Mycobacterium bovis subsp bovis AF2122/97
ccgcacgccuacg

SEQ ID NO: 3124660 - RNA, 19 nt, Mycobacterium bovis subsp bovis AF2122/97
ccgcacgcuagccgacagc

SEQ ID NO: 3124661 - RNA, 13 nt, Mycobacterium bovis subsp bovis AF2122/97
ccgcacgcucggc

SEQ ID NO: 3124662 - RNA, 17 nt, Mycobacterium bovis subsp bovis AF2122/97
ccgcacgcucggcgugu

SEQ ID NO: 3124663 - RNA, 13 nt, Mycobacterium bovis subsp bovis AF2122/97
ccgcacgcuggcg

SEQ ID NO: 3124664 - RNA, 16 nt, Mycobacterium bovis subsp bovis AF2122/97
ccgcacgcuggcgggc

SEQ ID NO: 3124665 - RNA, 17 nt, Mycobacterium bovis subsp bovis AF2122/97
ccgcacggaaggucgac

SEQ ID NO: 3124666 - RNA, 22 nt, Mycobacterium bovis subsp bovis AF2122/97
ccgcacggaggcggaccaggcc

SEQ ID NO: 3124667 - RNA, 13 nt, Mycobacterium bovis subsp bovis AF2122/97
ccgcacggcgacg

SEQ ID NO: 3124668 - RNA, 16 nt, Mycobacterium bovis subsp bovis AF2122/97
ccgcacggcgacgcca

SEQ ID NO: 3124669 - RNA, 13 nt, Mycobacterium bovis subsp bovis AF2122/97
ccgcacgggaucg

SEQ ID NO: 3124670 - RNA, 12 nt, Mycobacterium bovis subsp bovis AF2122/97
ccgcacgggccc

SEQ ID NO: 3124671 - RNA, 20 nt, Mycobacterium bovis subsp bovis AF2122/97
ccgcacgggcccaggacagc

SEQ ID NO: 3124672 - RNA, 14 nt, Mycobacterium bovis subsp bovis AF2122/97
ccgcacggugacca

SEQ ID NO: 3124673 - RNA, 19 nt, Mycobacterium bovis subsp bovis AF2122/97
ccgcacggugaccacgccg

SEQ ID NO: 3124674 - RNA, 21 nt, Mycobacterium bovis subsp bovis AF2122/97
ccgcacggugaccacgccgug

SEQ ID NO: 3124675 - RNA, 16 nt, Mycobacterium bovis subsp bovis AF2122/97
ccgcacgguucgggug

SEQ ID NO: 3124676 - RNA, 19 nt, Mycobacterium bovis subsp bovis AF2122/97
ccgcacguauccacggucg

SEQ ID NO: 3124677 - RNA, 14 nt, Mycobacterium bovis subsp bovis AF2122/97
ccgcacguucacgc

SEQ ID NO: 3124678 - RNA, 17 nt, Mycobacterium bovis subsp bovis AF2122/97
ccgcacguucacgcgcg

SEQ ID NO: 3124679 - RNA, 18 nt, Mycobacterium bovis subsp bovis AF2122/97
ccgcacguucacgcgcgg

SEQ ID NO: 3124680 - RNA, 15 nt, Mycobacterium bovis subsp bovis AF2122/97
ccgcacguucggcga

SEQ ID NO: 3124681 - RNA, 12 nt, Mycobacterium bovis subsp bovis AF2122/97
ccgcacguuggc

SEQ ID NO: 3124682 - RNA, 12 nt, Mycobacterium bovis subsp bovis AF2122/97
ccgcacuccacg

SEQ ID NO: 3124683 - RNA, 13 nt, Mycobacterium bovis subsp bovis AF2122/97
ccgcacuccacga

SEQ ID NO: 3124684 - RNA, 20 nt, Mycobacterium bovis subsp bovis AF2122/97
ccgcacuccacgaucggccc

SEQ ID NO: 3124685 - RNA, 23 nt, Mycobacterium bovis subsp bovis AF2122/97
ccgcacucggcgguuccggcggu

SEQ ID NO: 3124686 - RNA, 15 nt, Mycobacterium bovis subsp bovis AF2122/97
ccgcacugccgccgg

SEQ ID NO: 3124687 - RNA, 16 nt, Mycobacterium bovis subsp bovis AF2122/97
ccgcacugccgccggu

SEQ ID NO: 3124688 - RNA, 22 nt, Mycobacterium bovis subsp bovis AF2122/97
ccgcacugccgccgguuccgcc

SEQ ID NO: 3124689 - RNA, 15 nt, Mycobacterium bovis subsp bovis AF2122/97
ccgcacugugcccuc

SEQ ID NO: 3124690 - RNA, 17 nt, Mycobacterium bovis subsp bovis AF2122/97
ccgcacugugcccucaa

SEQ ID NO: 3124691 - RNA, 19 nt, Mycobacterium bovis subsp bovis AF2122/97
ccgcacuugaucgacggcc

SEQ ID NO: 3124692 - RNA, 22 nt, Mycobacterium bovis subsp bovis AF2122/97
ccgcacuuucuuccucggggcu

SEQ ID NO: 3124693 - RNA, 17 nt, Mycobacterium bovis subsp bovis AF2122/97
ccgcagaauccggcaac

SEQ ID NO: 3124694 - RNA, 20 nt, Mycobacterium bovis subsp bovis AF2122/97
ccgcagaaugucguaggcgc

SEQ ID NO: 3124695 - RNA, 21 nt, Mycobacterium bovis subsp bovis AF2122/97
ccgcagaaugucguaggcgcc

SEQ ID NO: 3124696 - RNA, 17 nt, Mycobacterium bovis subsp bovis AF2122/97
ccgcagacgacaaccga

SEQ ID NO: 3124697 - RNA, 16 nt, Mycobacterium bovis subsp bovis AF2122/97
ccgcagacgccgucug

SEQ ID NO: 3124698 - RNA, 17 nt, Mycobacterium bovis subsp bovis AF2122/97
ccgcagacgccgucuga

SEQ ID NO: 3124699 - RNA, 19 nt, Mycobacterium bovis subsp bovis AF2122/97
ccgcagacgugguagccgg

SEQ ID NO: 3124700 - RNA, 21 nt, Mycobacterium bovis subsp bovis AF2122/97
ccgcagacgugguagccggcg

SEQ ID NO: 3124701 - RNA, 14 nt, Mycobacterium bovis subsp bovis AF2122/97
ccgcagagaccaag

SEQ ID NO: 3124702 - RNA, 15 nt, Mycobacterium bovis subsp bovis AF2122/97
ccgcagagcaccgcg

SEQ ID NO: 3124703 - RNA, 16 nt, Mycobacterium bovis subsp bovis AF2122/97
ccgcagagcaccgcga

SEQ ID NO: 3124704 - RNA, 23 nt, Mycobacterium bovis subsp bovis AF2122/97
ccgcagagcaccgcgaacagcac

SEQ ID NO: 3124705 - RNA, 16 nt, Mycobacterium bovis subsp bovis AF2122/97
ccgcagaucaccgcca

SEQ ID NO: 3124706 - RNA, 17 nt, Mycobacterium bovis subsp bovis AF2122/97
ccgcagaucaccgccag

SEQ ID NO: 3124707 - RNA, 20 nt, Mycobacterium bovis subsp bovis AF2122/97
ccgcagaucaccgccagcug

SEQ ID NO: 3124708 - RNA, 21 nt, Mycobacterium bovis subsp bovis AF2122/97
ccgcagaucaccgccagcugg

SEQ ID NO: 3124709 - RNA, 19 nt, Mycobacterium bovis subsp bovis AF2122/97
ccgcagauccccgccaccg

SEQ ID NO: 3124710 - RNA, 20 nt, Mycobacterium bovis subsp bovis AF2122/97
ccgcagaugcaccugcgagg

SEQ ID NO: 3124711 - RNA, 22 nt, Mycobacterium bovis subsp bovis AF2122/97
ccgcagaugcaccugcgaggug

SEQ ID NO: 3124712 - RNA, 13 nt, Mycobacterium bovis subsp bovis AF2122/97
ccgcagcaccguc

SEQ ID NO: 3124713 - RNA, 17 nt, Mycobacterium bovis subsp bovis AF2122/97
ccgcagcaccgucgggc

SEQ ID NO: 3124714 - RNA, 14 nt, Mycobacterium bovis subsp bovis AF2122/97
ccgcagcaccucgg

SEQ ID NO: 3124715 - RNA, 19 nt, Mycobacterium bovis subsp bovis AF2122/97
ccgcagcaccucgucgauc

SEQ ID NO: 3124716 - RNA, 23 nt, Mycobacterium bovis subsp bovis AF2122/97
ccgcagcaggugcaucgccacag

SEQ ID NO: 3124717 - RNA, 15 nt, Mycobacterium bovis subsp bovis AF2122/97
ccgcagccagaucuc

SEQ ID NO: 3124718 - RNA, 14 nt, Mycobacterium bovis subsp bovis AF2122/97
ccgcagccaggucu

SEQ ID NO: 3124719 - RNA, 22 nt, Mycobacterium bovis subsp bovis AF2122/97
ccgcagcccaaaucccagagca

SEQ ID NO: 3124720 - RNA, 20 nt, Mycobacterium bovis subsp bovis AF2122/97
ccgcagccccgacaguugug

SEQ ID NO: 3124721 - RNA, 13 nt, Mycobacterium bovis subsp bovis AF2122/97
ccgcagcccgccg

SEQ ID NO: 3124722 - RNA, 16 nt, Mycobacterium bovis subsp bovis AF2122/97
ccgcagcccgccgggc

SEQ ID NO: 3124723 - RNA, 21 nt, Mycobacterium bovis subsp bovis AF2122/97
ccgcagcccgccgggcuccac

SEQ ID NO: 3124724 - RNA, 21 nt, Mycobacterium bovis subsp bovis AF2122/97
ccgcagccgcgaguccaggcu

SEQ ID NO: 3124725 - RNA, 13 nt, Mycobacterium bovis subsp bovis AF2122/97
ccgcagccgcgcg

SEQ ID NO: 3124726 - RNA, 14 nt, Mycobacterium bovis subsp bovis AF2122/97
ccgcagccgcgcgg

SEQ ID NO: 3124727 - RNA, 14 nt, Mycobacterium bovis subsp bovis AF2122/97
ccgcagcgccaccc

SEQ ID NO: 3124728 - RNA, 19 nt, Mycobacterium bovis subsp bovis AF2122/97
ccgcagcgccuaccagcac

SEQ ID NO: 3124729 - RNA, 22 nt, Mycobacterium bovis subsp bovis AF2122/97
ccgcagcgcgaaggucagcgac

SEQ ID NO: 3124730 - RNA, 18 nt, Mycobacterium bovis subsp bovis AF2122/97
ccgcagcggaacugggcc

SEQ ID NO: 3124731 - RNA, 20 nt, Mycobacterium bovis subsp bovis AF2122/97
ccgcagcggaacugggcccc

SEQ ID NO: 3124732 - RNA, 16 nt, Mycobacterium bovis subsp bovis AF2122/97
ccgcagcggccagccc

SEQ ID NO: 3124733 - RNA, 22 nt, Mycobacterium bovis subsp bovis AF2122/97
ccgcagcggccagcccagccgg

SEQ ID NO: 3124734 - RNA, 23 nt, Mycobacterium bovis subsp bovis AF2122/97
ccgcagcggccagcccagccggg

SEQ ID NO: 3124735 - RNA, 13 nt, Mycobacterium bovis subsp bovis AF2122/97
ccgcagcggccug

SEQ ID NO: 3124736 - RNA, 13 nt, Mycobacterium bovis subsp bovis AF2122/97
ccgcauugccaac

SEQ ID NO: 3124737 - RNA, 15 nt, Mycobacterium bovis subsp bovis AF2122/97
ccgcauugccgucgg

SEQ ID NO: 3124738 - RNA, 15 nt, Mycobacterium bovis subsp bovis AF2122/97
ccgccaaccgcaggc

SEQ ID NO: 3124739 - RNA, 16 nt, Mycobacterium bovis subsp bovis AF2122/97
ccgccaacuccucagc

SEQ ID NO: 3124740 - RNA, 17 nt, Mycobacterium bovis subsp bovis AF2122/97
ccgccaacuccucagcc

SEQ ID NO: 3124741 - RNA, 18 nt, Mycobacterium bovis subsp bovis AF2122/97
ccgccaacuccucagccg

SEQ ID NO: 3124742 - RNA, 11 nt, Mycobacterium bovis subsp bovis AF2122/97
ccgccaacucg

SEQ ID NO: 3124743 - RNA, 21 nt, Mycobacterium bovis subsp bovis AF2122/97
ccgccaagcucggccaccagc

SEQ ID NO: 3124744 - RNA, 14 nt, Mycobacterium bovis subsp bovis AF2122/97
ccgccaaggaggcc

SEQ ID NO: 3124745 - RNA, 22 nt, Mycobacterium bovis subsp bovis AF2122/97
ccgccaaguacugggccaaagc

SEQ ID NO: 3124746 - RNA, 15 nt, Mycobacterium bovis subsp bovis AF2122/97
ccgccaauccaccgg

SEQ ID NO: 3124747 - RNA, 21 nt, Mycobacterium bovis subsp bovis AF2122/97
ccgccaauccaccggugccgc

SEQ ID NO: 3124748 - RNA, 16 nt, Mycobacterium bovis subsp bovis AF2122/97
ccgccaauggcgcgaa

SEQ ID NO: 3124749 - RNA, 16 nt, Mycobacterium bovis subsp bovis AF2122/97
ccgccacaacggcggc

SEQ ID NO: 3124750 - RNA, 18 nt, Mycobacterium bovis subsp bovis AF2122/97
ccgccacaacggcggcgc

SEQ ID NO: 3124751 - RNA, 14 nt, Mycobacterium bovis subsp bovis AF2122/97
ccgccacaccgccg

SEQ ID NO: 3124752 - RNA, 15 nt, Mycobacterium bovis subsp bovis AF2122/97
ccgccacacggggcc

SEQ ID NO: 3124753 - RNA, 12 nt, Mycobacterium bovis subsp bovis AF2122/97
ccgccacagcac

SEQ ID NO: 3124754 - RNA, 16 nt, Mycobacterium bovis subsp bovis AF2122/97
ccgccacagcacccac

SEQ ID NO: 3124755 - RNA, 13 nt, Mycobacterium bovis subsp bovis AF2122/97
ccgccaccaaauc

SEQ ID NO: 3124756 - RNA, 14 nt, Mycobacterium bovis subsp bovis AF2122/97
ccgccaccaccggc

SEQ ID NO: 3124757 - RNA, 16 nt, Mycobacterium bovis subsp bovis AF2122/97
ccgccaccaccggcgc

SEQ ID NO: 3124758 - RNA, 14 nt, Mycobacterium bovis subsp bovis AF2122/97
ccgccaccacgccg

SEQ ID NO: 3124759 - RNA, 17 nt, Mycobacterium bovis subsp bovis AF2122/97
ccgccaccacgccgucg

SEQ ID NO: 3124760 - RNA, 22 nt, Mycobacterium bovis subsp bovis AF2122/97
ccgccaccacgccgucgacaac

SEQ ID NO: 3124761 - RNA, 12 nt, Mycobacterium bovis subsp bovis AF2122/97
ccgccaccagcu

SEQ ID NO: 3124762 - RNA, 21 nt, Mycobacterium bovis subsp bovis AF2122/97
ccgccaccaucgccucggcgc

SEQ ID NO: 3124763 - RNA, 12 nt, Mycobacterium bovis subsp bovis AF2122/97
ccgccaccccgc

SEQ ID NO: 3124764 - RNA, 14 nt, Mycobacterium bovis subsp bovis AF2122/97
ccgccaccccgcgc

SEQ ID NO: 3124765 - RNA, 16 nt, Mycobacterium bovis subsp bovis AF2122/97
ccgccaccccgcgcgc

SEQ ID NO: 3124766 - RNA, 16 nt, Mycobacterium bovis subsp bovis AF2122/97
ccgccaccccggucgg

SEQ ID NO: 3124767 - RNA, 19 nt, Mycobacterium bovis subsp bovis AF2122/97
ccgccaccccggucggagc

SEQ ID NO: 3124768 - RNA, 11 nt, Mycobacterium bovis subsp bovis AF2122/97
ccgccacccgc

SEQ ID NO: 3124769 - RNA, 12 nt, Mycobacterium bovis subsp bovis AF2122/97
ccgccacccgcc

SEQ ID NO: 3124770 - RNA, 13 nt, Mycobacterium bovis subsp bovis AF2122/97
ccgccacccggcg

SEQ ID NO: 3124771 - RNA, 18 nt, Mycobacterium bovis subsp bovis AF2122/97
ccgccacccuuggcccgg

SEQ ID NO: 3124772 - RNA, 19 nt, Mycobacterium bovis subsp bovis AF2122/97
ccgccaccgaacgcaccga

SEQ ID NO: 3124773 - RNA, 17 nt, Mycobacterium bovis subsp bovis AF2122/97
ccgccaccgaagccgcc

SEQ ID NO: 3124774 - RNA, 14 nt, Mycobacterium bovis subsp bovis AF2122/97
ccgccaccgcacgc

SEQ ID NO: 3124775 - RNA, 14 nt, Mycobacterium bovis subsp bovis AF2122/97
ccgccaccgccacc

SEQ ID NO: 3124776 - RNA, 15 nt, Mycobacterium bovis subsp bovis AF2122/97
ccgccaccgccaccg

SEQ ID NO: 3124777 - RNA, 16 nt, Mycobacterium bovis subsp bovis AF2122/97
ccgccaccgccaccgc

SEQ ID NO: 3124778 - RNA, 18 nt, Mycobacterium bovis subsp bovis AF2122/97
ccgccaccgccaccgcgg

SEQ ID NO: 3124779 - RNA, 16 nt, Mycobacterium bovis subsp bovis AF2122/97
ccgccaccgccagcgu

SEQ ID NO: 3124780 - RNA, 12 nt, Mycobacterium bovis subsp bovis AF2122/97
ccgccaccgcga

SEQ ID NO: 3124781 - RNA, 14 nt, Mycobacterium bovis subsp bovis AF2122/97
ccgccaccgcgaca

SEQ ID NO: 3124782 - RNA, 16 nt, Mycobacterium bovis subsp bovis AF2122/97
ccgccaccgcgacacc

SEQ ID NO: 3124783 - RNA, 14 nt, Mycobacterium bovis subsp bovis AF2122/97
ccgccaccgcgacg

SEQ ID NO: 3124784 - RNA, 23 nt, Mycobacterium bovis subsp bovis AF2122/97
ccgccaccgcgacgagcggccgu

SEQ ID NO: 3124785 - RNA, 12 nt, Mycobacterium bovis subsp bovis AF2122/97
ccgccaccgcgg

SEQ ID NO: 3124786 - RNA, 13 nt, Mycobacterium bovis subsp bovis AF2122/97
ccgccaccggaca

SEQ ID NO: 3124787 - RNA, 16 nt, Mycobacterium bovis subsp bovis AF2122/97
ccgccaccggaggugc

SEQ ID NO: 3124788 - RNA, 19 nt, Mycobacterium bovis subsp bovis AF2122/97
ccgccaccggcgcgaccgc

SEQ ID NO: 3124789 - RNA, 13 nt, Mycobacterium bovis subsp bovis AF2122/97
ccgccaccggcgu

SEQ ID NO: 3124790 - RNA, 21 nt, Mycobacterium bovis subsp bovis AF2122/97
ccgccaccggcguccaguccg

SEQ ID NO: 3124791 - RNA, 13 nt, Mycobacterium bovis subsp bovis AF2122/97
ccgccaccgucac

SEQ ID NO: 3124792 - RNA, 16 nt, Mycobacterium bovis subsp bovis AF2122/97
ccgccaccgucaccgc

SEQ ID NO: 3124793 - RNA, 17 nt, Mycobacterium bovis subsp bovis AF2122/97
ccgccaccgucaccgcc

SEQ ID NO: 3124794 - RNA, 23 nt, Mycobacterium bovis subsp bovis AF2122/97
ccgccaccgucaccgccgucacc

SEQ ID NO: 3124795 - RNA, 18 nt, Mycobacterium bovis subsp bovis AF2122/97
ccgccaccucccagggcu

SEQ ID NO: 3124796 - RNA, 15 nt, Mycobacterium bovis subsp bovis AF2122/97
ccgccaccucgccgg

SEQ ID NO: 3124797 - RNA, 14 nt, Mycobacterium bovis subsp bovis AF2122/97
ccgccaccuuggcg

SEQ ID NO: 3124798 - RNA, 22 nt, Mycobacterium bovis subsp bovis AF2122/97
ccgccaccuuggcugggcccgc

SEQ ID NO: 3124799 - RNA, 18 nt, Mycobacterium bovis subsp bovis AF2122/97
ccgccacgcucaacccgu

SEQ ID NO: 3124800 - RNA, 15 nt, Mycobacterium bovis subsp bovis AF2122/97
ccgccacggcgggcg

SEQ ID NO: 3124801 - RNA, 13 nt, Mycobacterium bovis subsp bovis AF2122/97
ccgccacgggcgg

SEQ ID NO: 3124802 - RNA, 14 nt, Mycobacterium bovis subsp bovis AF2122/97
ccgccacgggcggc

SEQ ID NO: 3124803 - RNA, 16 nt, Mycobacterium bovis subsp bovis AF2122/97
ccgccacgggcggcca

SEQ ID NO: 3124804 - RNA, 20 nt, Mycobacterium bovis subsp bovis AF2122/97
ccgccacgggcggccaccgc

SEQ ID NO: 3124805 - RNA, 17 nt, Mycobacterium bovis subsp bovis AF2122/97
ccgccacguacuccacc

SEQ ID NO: 3124806 - RNA, 19 nt, Mycobacterium bovis subsp bovis AF2122/97
ccgccacguacuccaccgc

SEQ ID NO: 3124807 - RNA, 18 nt, Mycobacterium bovis subsp bovis AF2122/97
ccgccacguacuuggacg

SEQ ID NO: 3124808 - RNA, 23 nt, Mycobacterium bovis subsp bovis AF2122/97
ccgccacguguggugugucaccg

SEQ ID NO: 3124809 - RNA, 15 nt, Mycobacterium bovis subsp bovis AF2122/97
ccgccacucgcccgc

SEQ ID NO: 3124810 - RNA, 16 nt, Mycobacterium bovis subsp bovis AF2122/97
ccgccacucgcccgcu

SEQ ID NO: 3124811 - RNA, 14 nt, Mycobacterium bovis subsp bovis AF2122/97
ccgccacugccggc

SEQ ID NO: 3124812 - RNA, 13 nt, Mycobacterium bovis subsp bovis AF2122/97
ccgccacuggcgc

SEQ ID NO: 3124813 - RNA, 15 nt, Mycobacterium bovis subsp bovis AF2122/97
ccgccacuggcgccg

SEQ ID NO: 3124814 - RNA, 17 nt, Mycobacterium bovis subsp bovis AF2122/97
ccgccacuggcgccggu

SEQ ID NO: 3124815 - RNA, 21 nt, Mycobacterium bovis subsp bovis AF2122/97
ccgccacuggcgccggugccg

SEQ ID NO: 3124816 - RNA, 18 nt, Mycobacterium bovis subsp bovis AF2122/97
ccgccacuucccccgggu

SEQ ID NO: 3124817 - RNA, 21 nt, Mycobacterium bovis subsp bovis AF2122/97
ccgccagaccgcggcggccga

SEQ ID NO: 3124818 - RNA, 20 nt, Mycobacterium bovis subsp bovis AF2122/97
ccgccagauugccugacaac

SEQ ID NO: 3124819 - RNA, 15 nt, Mycobacterium bovis subsp bovis AF2122/97
ccgccagcaccaccg

SEQ ID NO: 3124820 - RNA, 17 nt, Mycobacterium bovis subsp bovis AF2122/97
ccgccagcaccaccggc

SEQ ID NO: 3124821 - RNA, 14 nt, Mycobacterium bovis subsp bovis AF2122/97
ccgccagcagcuuc

SEQ ID NO: 3124822 - RNA, 23 nt, Mycobacterium bovis subsp bovis AF2122/97
ccgccagcaugacaccggccacc

SEQ ID NO: 3124823 - RNA, 13 nt, Mycobacterium bovis subsp bovis AF2122/97
ccgccagccacca

SEQ ID NO: 3124824 - RNA, 20 nt, Mycobacterium bovis subsp bovis AF2122/97
ccgcccagagugaauccggc

SEQ ID NO: 3124825 - RNA, 13 nt, Mycobacterium bovis subsp bovis AF2122/97
ccgcccagcagca

SEQ ID NO: 3124826 - RNA, 17 nt, Mycobacterium bovis subsp bovis AF2122/97
ccgcccagcagcaccug

SEQ ID NO: 3124827 - RNA, 20 nt, Mycobacterium bovis subsp bovis AF2122/97
ccgcccagcagcaccugcac

SEQ ID NO: 3124828 - RNA, 14 nt, Mycobacterium bovis subsp bovis AF2122/97
ccgcccagcaucuc

SEQ ID NO: 3124829 - RNA, 20 nt, Mycobacterium bovis subsp bovis AF2122/97
ccgcccagcaucucggcggc

SEQ ID NO: 3124830 - RNA, 12 nt, Mycobacterium bovis subsp bovis AF2122/97
ccgcccagcccg

SEQ ID NO: 3124831 - RNA, 15 nt, Mycobacterium bovis subsp bovis AF2122/97
ccgcccagcccggcg

SEQ ID NO: 3124832 - RNA, 20 nt, Mycobacterium bovis subsp bovis AF2122/97
ccgcccagcgaccgcugcag

SEQ ID NO: 3124833 - RNA, 23 nt, Mycobacterium bovis subsp bovis AF2122/97
ccgcccagcugucauccccggcc

SEQ ID NO: 3124834 - RNA, 16 nt, Mycobacterium bovis subsp bovis AF2122/97
ccgcccaggagcaccu

SEQ ID NO: 3124835 - RNA, 17 nt, Mycobacterium bovis subsp bovis AF2122/97
ccgcccaggagcaccuc

SEQ ID NO: 3124836 - RNA, 13 nt, Mycobacterium bovis subsp bovis AF2122/97
ccgcccagugcca

SEQ ID NO: 3124837 - RNA, 22 nt, Mycobacterium bovis subsp bovis AF2122/97
ccgcccaguugggccucagcua

SEQ ID NO: 3124838 - RNA, 14 nt, Mycobacterium bovis subsp bovis AF2122/97
ccgcccaugccggg

SEQ ID NO: 3124839 - RNA, 15 nt, Mycobacterium bovis subsp bovis AF2122/97
ccgcccaugccucca

SEQ ID NO: 3124840 - RNA, 17 nt, Mycobacterium bovis subsp bovis AF2122/97
ccgcccaugccuccaga

SEQ ID NO: 3124841 - RNA, 22 nt, Mycobacterium bovis subsp bovis AF2122/97
ccgcccauucccagaggcccgc

SEQ ID NO: 3124842 - RNA, 22 nt, Mycobacterium bovis subsp bovis AF2122/97
ccgccccagcugcggucgcggc

SEQ ID NO: 3124843 - RNA, 14 nt, Mycobacterium bovis subsp bovis AF2122/97
ccgcccccagcggu

SEQ ID NO: 3124844 - RNA, 13 nt, Mycobacterium bovis subsp bovis AF2122/97
ccgcccccgccgg

SEQ ID NO: 3124845 - RNA, 16 nt, Mycobacterium bovis subsp bovis AF2122/97
ccgcccccgccggccg

SEQ ID NO: 3124846 - RNA, 18 nt, Mycobacterium bovis subsp bovis AF2122/97
ccgcccccgccggccgcg

SEQ ID NO: 3124847 - RNA, 14 nt, Mycobacterium bovis subsp bovis AF2122/97
ccgccccgccaacc

SEQ ID NO: 3124848 - RNA, 15 nt, Mycobacterium bovis subsp bovis AF2122/97
ccgccccgccguuga

SEQ ID NO: 3124849 - RNA, 13 nt, Mycobacterium bovis subsp bovis AF2122/97
ccgccccgcgccu

SEQ ID NO: 3124850 - RNA, 14 nt, Mycobacterium bovis subsp bovis AF2122/97
ccgccccggccagg

SEQ ID NO: 3124851 - RNA, 16 nt, Mycobacterium bovis subsp bovis AF2122/97
ccgccccggccaggac

SEQ ID NO: 3124852 - RNA, 18 nt, Mycobacterium bovis subsp bovis AF2122/97
ccgccccggccgcuggcg

SEQ ID NO: 3124853 - RNA, 13 nt, Mycobacterium bovis subsp bovis AF2122/97
ccgccccggcggc

SEQ ID NO: 3124854 - RNA, 16 nt, Mycobacterium bovis subsp bovis AF2122/97
ccgccccggcggcggc

SEQ ID NO: 3124855 - RNA, 15 nt, Mycobacterium bovis subsp bovis AF2122/97
ccgccccgggccacc

SEQ ID NO: 3124856 - RNA, 12 nt, Mycobacterium bovis subsp bovis AF2122/97
ccgccccguggg

SEQ ID NO: 3124857 - RNA, 23 nt, Mycobacterium bovis subsp bovis AF2122/97
ccgccccguugugucaccggcgu

SEQ ID NO: 3124858 - RNA, 17 nt, Mycobacterium bovis subsp bovis AF2122/97
ccgcccgacccaucacc

SEQ ID NO: 3124859 - RNA, 14 nt, Mycobacterium bovis subsp bovis AF2122/97
ccgcccgacgugaa

SEQ ID NO: 3124860 - RNA, 12 nt, Mycobacterium bovis subsp bovis AF2122/97
ccgcccgagccg

SEQ ID NO: 3124861 - RNA, 17 nt, Mycobacterium bovis subsp bovis AF2122/97
ccgcccgagccgcugcg

SEQ ID NO: 3124862 - RNA, 19 nt, Mycobacterium bovis subsp bovis AF2122/97
ccgcccgcacguucacgcg

SEQ ID NO: 3124863 - RNA, 23 nt, Mycobacterium bovis subsp bovis AF2122/97
ccgcccgcacguucacgcgcgga

SEQ ID NO: 3124864 - RNA, 19 nt, Mycobacterium bovis subsp bovis AF2122/97
ccgcccgcaucgcggcauc

SEQ ID NO: 3124865 - RNA, 12 nt, Mycobacterium bovis subsp bovis AF2122/97
ccgcccgccagc

SEQ ID NO: 3124866 - RNA, 13 nt, Mycobacterium bovis subsp bovis AF2122/97
ccgcccgccagcg

SEQ ID NO: 3124867 - RNA, 13 nt, Mycobacterium bovis subsp bovis AF2122/97
ccgcccgcccacc

SEQ ID NO: 3124868 - RNA, 14 nt, Mycobacterium bovis subsp bovis AF2122/97
ccgcccgcccaccu

SEQ ID NO: 3124869 - RNA, 13 nt, Mycobacterium bovis subsp bovis AF2122/97
ccgcccgcccgga

SEQ ID NO: 3124870 - RNA, 13 nt, Mycobacterium bovis subsp bovis AF2122/97
ccgcccgccgaac

SEQ ID NO: 3124871 - RNA, 13 nt, Mycobacterium bovis subsp bovis AF2122/97
ccgcccgccggug

SEQ ID NO: 3124872 - RNA, 17 nt, Mycobacterium bovis subsp bovis AF2122/97
ccgcccgcgccaccagc

SEQ ID NO: 3124873 - RNA, 12 nt, Mycobacterium bovis subsp bovis AF2122/97
ccgcccgcgccg

SEQ ID NO: 3124874 - RNA, 14 nt, Mycobacterium bovis subsp bovis AF2122/97
ccgcccgcgccgcc

SEQ ID NO: 3124875 - RNA, 15 nt, Mycobacterium bovis subsp bovis AF2122/97
ccgcccgcgccgccc

SEQ ID NO: 3124876 - RNA, 17 nt, Mycobacterium bovis subsp bovis AF2122/97
ccgcccgcgccgcccgc

SEQ ID NO: 3124877 - RNA, 16 nt, Mycobacterium bovis subsp bovis AF2122/97
ccgcccgcgccgccgc

SEQ ID NO: 3124878 - RNA, 17 nt, Mycobacterium bovis subsp bovis AF2122/97
ccgcccgcgccgccgcu

SEQ ID NO: 3124879 - RNA, 15 nt, Mycobacterium bovis subsp bovis AF2122/97
ccgcccgcgccuccg

SEQ ID NO: 3124880 - RNA, 21 nt, Mycobacterium bovis subsp bovis AF2122/97
ccgcccgcgccuccguugccc

SEQ ID NO: 3124881 - RNA, 12 nt, Mycobacterium bovis subsp bovis AF2122/97
ccgcccgcgcgg

SEQ ID NO: 3124882 - RNA, 12 nt, Mycobacterium bovis subsp bovis AF2122/97
ccgcccgcgggc

SEQ ID NO: 3124883 - RNA, 22 nt, Mycobacterium bovis subsp bovis AF2122/97
ccgcccgcuccgccgucgccgc

SEQ ID NO: 3124884 - RNA, 15 nt, Mycobacterium bovis subsp bovis AF2122/97
ccgcccgcuccuccg

SEQ ID NO: 3124885 - RNA, 19 nt, Mycobacterium bovis subsp bovis AF2122/97
ccgcccgcuccuccggcac

SEQ ID NO: 3124886 - RNA, 17 nt, Mycobacterium bovis subsp bovis AF2122/97
ccgcccgcugcggcggc

SEQ ID NO: 3124887 - RNA, 14 nt, Mycobacterium bovis subsp bovis AF2122/97
ccgcccggcgagca

SEQ ID NO: 3124888 - RNA, 22 nt, Mycobacterium bovis subsp bovis AF2122/97
ccgcccggcuaggagaucagca

SEQ ID NO: 3124889 - RNA, 12 nt, Mycobacterium bovis subsp bovis AF2122/97
ccgcccgggcgu

SEQ ID NO: 3124890 - RNA, 13 nt, Mycobacterium bovis subsp bovis AF2122/97
ccgcccggguuga

SEQ ID NO: 3124891 - RNA, 15 nt, Mycobacterium bovis subsp bovis AF2122/97
ccgcccggguugacc

SEQ ID NO: 3124892 - RNA, 21 nt, Mycobacterium bovis subsp bovis AF2122/97
ccgcccggugcuaaccgacgc

SEQ ID NO: 3124893 - RNA, 23 nt, Mycobacterium bovis subsp bovis AF2122/97
ccgcccggugcuaaccgacgcug

SEQ ID NO: 3124894 - RNA, 24 nt, Mycobacterium bovis subsp bovis AF2122/97
ccgcccguagacccacagucgccg

SEQ ID NO: 3124895 - RNA, 12 nt, Mycobacterium bovis subsp bovis AF2122/97
ccgcccguaucg

SEQ ID NO: 3124896 - RNA, 22 nt, Mycobacterium bovis subsp bovis AF2122/97
ccgcccgucuuccagccaggcc

SEQ ID NO: 3124897 - RNA, 12 nt, Mycobacterium bovis subsp bovis AF2122/97
ccgcccgugccg

SEQ ID NO: 3124898 - RNA, 13 nt, Mycobacterium bovis subsp bovis AF2122/97
ccgcccgugccgc

SEQ ID NO: 3124899 - RNA, 15 nt, Mycobacterium bovis subsp bovis AF2122/97
ccgcccgugccgccc

SEQ ID NO: 3124900 - RNA, 13 nt, Mycobacterium bovis subsp bovis AF2122/97
ccgcccgugccgu

SEQ ID NO: 3124901 - RNA, 15 nt, Mycobacterium bovis subsp bovis AF2122/97
ccgcccucaccgccu

SEQ ID NO: 3124902 - RNA, 23 nt, Mycobacterium bovis subsp bovis AF2122/97
ccgcccucaguucacguucggcg

SEQ ID NO: 3124903 - RNA, 19 nt, Mycobacterium bovis subsp bovis AF2122/97
ccgcccucccuggggccgu

SEQ ID NO: 3124904 - RNA, 15 nt, Mycobacterium bovis subsp bovis AF2122/97
ccgcccucggugaga

SEQ ID NO: 3124905 - RNA, 17 nt, Mycobacterium bovis subsp bovis AF2122/97
ccgcccucucacggcgg

SEQ ID NO: 3124906 - RNA, 21 nt, Mycobacterium bovis subsp bovis AF2122/97
ccgcccucucacggcgguagc

SEQ ID NO: 3124907 - RNA, 17 nt, Mycobacterium bovis subsp bovis AF2122/97
ccgcccuggcaacgaca

SEQ ID NO: 3124908 - RNA, 22 nt, Mycobacterium bovis subsp bovis AF2122/97
ccgcccuggcaacgacacgccg

SEQ ID NO: 3124909 - RNA, 14 nt, Mycobacterium bovis subsp bovis AF2122/97
ccgcccuggccgcc

SEQ ID NO: 3124910 - RNA, 15 nt, Mycobacterium bovis subsp bovis AF2122/97
ccgcccuggccgccg

SEQ ID NO: 3124911 - RNA, 17 nt, Mycobacterium bovis subsp bovis AF2122/97
ccgcccuggccgccggc

SEQ ID NO: 3124912 - RNA, 21 nt, Mycobacterium bovis subsp bovis AF2122/97
ccgccgccaguccggacggca

SEQ ID NO: 3124913 - RNA, 13 nt, Mycobacterium bovis subsp bovis AF2122/97
ccgccgccaucgc

SEQ ID NO: 3124914 - RNA, 15 nt, Mycobacterium bovis subsp bovis AF2122/97
ccgccgccaucgccg

SEQ ID NO: 3124915 - RNA, 13 nt, Mycobacterium bovis subsp bovis AF2122/97
ccgccgcccagcg

SEQ ID NO: 3124916 - RNA, 12 nt, Mycobacterium bovis subsp bovis AF2122/97
ccgccgcccccg

SEQ ID NO: 3124917 - RNA, 13 nt, Mycobacterium bovis subsp bovis AF2122/97
ccgccgcccccgc

SEQ ID NO: 3124918 - RNA, 14 nt, Mycobacterium bovis subsp bovis AF2122/97
ccgccgcccccgcc

SEQ ID NO: 3124919 - RNA, 15 nt, Mycobacterium bovis subsp bovis AF2122/97
ccgccgcccccgccg

SEQ ID NO: 3124920 - RNA, 15 nt, Mycobacterium bovis subsp bovis AF2122/97
ccgccgccccggcgc

SEQ ID NO: 3124921 - RNA, 16 nt, Mycobacterium bovis subsp bovis AF2122/97
ccgccgccccggcgcu

SEQ ID NO: 3124922 - RNA, 22 nt, Mycobacterium bovis subsp bovis AF2122/97
ccgccgcccguaucggcuucgu

SEQ ID NO: 3124923 - RNA, 15 nt, Mycobacterium bovis subsp bovis AF2122/97
ccgccgcccuggucc

SEQ ID NO: 3124924 - RNA, 12 nt, Mycobacterium bovis subsp bovis AF2122/97
ccgccgccgaca

SEQ ID NO: 3124925 - RNA, 12 nt, Mycobacterium bovis subsp bovis AF2122/97
ccgccgccgacg

SEQ ID NO: 3124926 - RNA, 15 nt, Mycobacterium bovis subsp bovis AF2122/97
ccgccgccgacgaag

SEQ ID NO: 3124927 - RNA, 14 nt, Mycobacterium bovis subsp bovis AF2122/97
ccgccgccgacgga

SEQ ID NO: 3124928 - RNA, 15 nt, Mycobacterium bovis subsp bovis AF2122/97
ccgccgccgccaccg

SEQ ID NO: 3124929 - RNA, 15 nt, Mycobacterium bovis subsp bovis AF2122/97
ccgccgccgccaucg

SEQ ID NO: 3124930 - RNA, 15 nt, Mycobacterium bovis subsp bovis AF2122/97
ccgccgccgccgacg

SEQ ID NO: 3124931 - RNA, 16 nt, Mycobacterium bovis subsp bovis AF2122/97
ccgccgccgccgcgua

SEQ ID NO: 3124932 - RNA, 13 nt, Mycobacterium bovis subsp bovis AF2122/97
ccgccgccgccgg

SEQ ID NO: 3124933 - RNA, 14 nt, Mycobacterium bovis subsp bovis AF2122/97
ccgccgccggaucg

SEQ ID NO: 3124934 - RNA, 12 nt, Mycobacterium bovis subsp bovis AF2122/97
ccgccgccggca

SEQ ID NO: 3124935 - RNA, 13 nt, Mycobacterium bovis subsp bovis AF2122/97
ccgccgccggcgg

SEQ ID NO: 3124936 - RNA, 14 nt, Mycobacterium bovis subsp bovis AF2122/97
ccgccgccggcggu

SEQ ID NO: 3124937 - RNA, 15 nt, Mycobacterium bovis subsp bovis AF2122/97
ccgccgccggugcgg

SEQ ID NO: 3124938 - RNA, 23 nt, Mycobacterium bovis subsp bovis AF2122/97
ccgccgccgucggcgagcagacg

SEQ ID NO: 3124939 - RNA, 15 nt, Mycobacterium bovis subsp bovis AF2122/97
ccgccgccuccgccg

SEQ ID NO: 3124940 - RNA, 15 nt, Mycobacterium bovis subsp bovis AF2122/97
ccgccgccucgucgu

SEQ ID NO: 3124941 - RNA, 16 nt, Mycobacterium bovis subsp bovis AF2122/97
ccgccgccugcccggc

SEQ ID NO: 3124942 - RNA, 17 nt, Mycobacterium bovis subsp bovis AF2122/97
ccgccgccugcccggcc

SEQ ID NO: 3124943 - RNA, 21 nt, Mycobacterium bovis subsp bovis AF2122/97
ccgccgccugcccggcccgcu

SEQ ID NO: 3124944 - RNA, 19 nt, Mycobacterium bovis subsp bovis AF2122/97
ccgccgccugugcgcggug

SEQ ID NO: 3124945 - RNA, 20 nt, Mycobacterium bovis subsp bovis AF2122/97
ccgccgccuuuuuucgccgc

SEQ ID NO: 3124946 - RNA, 19 nt, Mycobacterium bovis subsp bovis AF2122/97
ccgccgcgaccacgcaccg

SEQ ID NO: 3124947 - RNA, 22 nt, Mycobacterium bovis subsp bovis AF2122/97
ccgccgcgaccacgcaccgccc

SEQ ID NO: 3124948 - RNA, 18 nt, Mycobacterium bovis subsp bovis AF2122/97
ccgccgcgaccgccucgc

SEQ ID NO: 3124949 - RNA, 22 nt, Mycobacterium bovis subsp bovis AF2122/97
ccgccgcgacgcacugccccgc

SEQ ID NO: 3124950 - RNA, 12 nt, Mycobacterium bovis subsp bovis AF2122/97
ccgccgcgacgg

SEQ ID NO: 3124951 - RNA, 17 nt, Mycobacterium bovis subsp bovis AF2122/97
ccgccgcgagcgccggc

SEQ ID NO: 3124952 - RNA, 20 nt, Mycobacterium bovis subsp bovis AF2122/97
ccgccgcgaggaugcugagc

SEQ ID NO: 3124953 - RNA, 21 nt, Mycobacterium bovis subsp bovis AF2122/97
ccgccgcgaugacggugccga

SEQ ID NO: 3124954 - RNA, 17 nt, Mycobacterium bovis subsp bovis AF2122/97
ccgccgcgaugccaccc

SEQ ID NO: 3124955 - RNA, 14 nt, Mycobacterium bovis subsp bovis AF2122/97
ccgccgcgauggcc

SEQ ID NO: 3124956 - RNA, 18 nt, Mycobacterium bovis subsp bovis AF2122/97
ccgccgcgauggccccug

SEQ ID NO: 3124957 - RNA, 21 nt, Mycobacterium bovis subsp bovis AF2122/97
ccgccgcgauggccccuguca

SEQ ID NO: 3124958 - RNA, 14 nt, Mycobacterium bovis subsp bovis AF2122/97
ccgccgcgcaccgc

SEQ ID NO: 3124959 - RNA, 20 nt, Mycobacterium bovis subsp bovis AF2122/97
ccgccgcgcagccgcucgac

SEQ ID NO: 3124960 - RNA, 13 nt, Mycobacterium bovis subsp bovis AF2122/97
ccgccgcgccccg

SEQ ID NO: 3124961 - RNA, 14 nt, Mycobacterium bovis subsp bovis AF2122/97
ccgccgcgccccgc

SEQ ID NO: 3124962 - RNA, 15 nt, Mycobacterium bovis subsp bovis AF2122/97
ccgccgcgcccggcg

SEQ ID NO: 3124963 - RNA, 14 nt, Mycobacterium bovis subsp bovis AF2122/97
ccgccgcgccggug

SEQ ID NO: 3124964 - RNA, 16 nt, Mycobacterium bovis subsp bovis AF2122/97
ccgccgcgcgacaggc

SEQ ID NO: 3124965 - RNA, 13 nt, Mycobacterium bovis subsp bovis AF2122/97
ccgccgcgcgucg

SEQ ID NO: 3124966 - RNA, 17 nt, Mycobacterium bovis subsp bovis AF2122/97
ccgccgcgcguucggcg

SEQ ID NO: 3124967 - RNA, 17 nt, Mycobacterium bovis subsp bovis AF2122/97
ccgccgcggacaccagg

SEQ ID NO: 3124968 - RNA, 20 nt, Mycobacterium bovis subsp bovis AF2122/97
ccgccgcggacaccaggaug

SEQ ID NO: 3124969 - RNA, 15 nt, Mycobacterium bovis subsp bovis AF2122/97
ccgccgcggcagcau

SEQ ID NO: 3124970 - RNA, 13 nt, Mycobacterium bovis subsp bovis AF2122/97
ccgccgcggcagg

SEQ ID NO: 3124971 - RNA, 16 nt, Mycobacterium bovis subsp bovis AF2122/97
ccgccgcggcagggcg

SEQ ID NO: 3124972 - RNA, 14 nt, Mycobacterium bovis subsp bovis AF2122/97
ccgccgcggccaca

SEQ ID NO: 3124973 - RNA, 17 nt, Mycobacterium bovis subsp bovis AF2122/97
ccgccgcggccaccacc

SEQ ID NO: 3124974 - RNA, 19 nt, Mycobacterium bovis subsp bovis AF2122/97
ccgccgcggccaccaccgc

SEQ ID NO: 3124975 - RNA, 22 nt, Mycobacterium bovis subsp bovis AF2122/97
ccgccgcggccaccaccgccgc

SEQ ID NO: 3124976 - RNA, 17 nt, Mycobacterium bovis subsp bovis AF2122/97
ccgccgcggccgccguc

SEQ ID NO: 3124977 - RNA, 14 nt, Mycobacterium bovis subsp bovis AF2122/97
ccgccgcggccggc

SEQ ID NO: 3124978 - RNA, 16 nt, Mycobacterium bovis subsp bovis AF2122/97
ccgccgcggccggcgc

SEQ ID NO: 3124979 - RNA, 13 nt, Mycobacterium bovis subsp bovis AF2122/97
ccgccgcggcgcc

SEQ ID NO: 3124980 - RNA, 15 nt, Mycobacterium bovis subsp bovis AF2122/97
ccgccgcgggcgccg

SEQ ID NO: 3124981 - RNA, 21 nt, Mycobacterium bovis subsp bovis AF2122/97
ccgccgcgggcuccccggcaa

SEQ ID NO: 3124982 - RNA, 16 nt, Mycobacterium bovis subsp bovis AF2122/97
ccgccgcgggucgcgc

SEQ ID NO: 3124983 - RNA, 13 nt, Mycobacterium bovis subsp bovis AF2122/97
ccgccgcggucgg

SEQ ID NO: 3124984 - RNA, 21 nt, Mycobacterium bovis subsp bovis AF2122/97
ccgccgcguaccaauucccgc

SEQ ID NO: 3124985 - RNA, 13 nt, Mycobacterium bovis subsp bovis AF2122/97
ccgccgcguuucg

SEQ ID NO: 3124986 - RNA, 23 nt, Mycobacterium bovis subsp bovis AF2122/97
ccgccgcguuucggucguuggug

SEQ ID NO: 3124987 - RNA, 15 nt, Mycobacterium bovis subsp bovis AF2122/97
ccgccgcuaccgccc

SEQ ID NO: 3124988 - RNA, 16 nt, Mycobacterium bovis subsp bovis AF2122/97
ccgccgcuaccgcccg

SEQ ID NO: 3124989 - RNA, 13 nt, Mycobacterium bovis subsp bovis AF2122/97
ccgccgcuccagg

SEQ ID NO: 3124990 - RNA, 17 nt, Mycobacterium bovis subsp bovis AF2122/97
ccgccgcuccaggucga

SEQ ID NO: 3124991 - RNA, 12 nt, Mycobacterium bovis subsp bovis AF2122/97
ccgccgcugcca

SEQ ID NO: 3124992 - RNA, 12 nt, Mycobacterium bovis subsp bovis AF2122/97
ccgccgcugccg

SEQ ID NO: 3124993 - RNA, 14 nt, Mycobacterium bovis subsp bovis AF2122/97
ccgccgcugccgau

SEQ ID NO: 3124994 - RNA, 21 nt, Mycobacterium bovis subsp bovis AF2122/97
ccgccgcugccgaucaguccg

SEQ ID NO: 3124995 - RNA, 23 nt, Mycobacterium bovis subsp bovis AF2122/97
ccgccgcugccgaucaguccggc

SEQ ID NO: 3124996 - RNA, 15 nt, Mycobacterium bovis subsp bovis AF2122/97
ccgccgcugccgccg

SEQ ID NO: 3124997 - RNA, 17 nt, Mycobacterium bovis subsp bovis AF2122/97
ccgccgcugccgccgag

SEQ ID NO: 3124998 - RNA, 16 nt, Mycobacterium bovis subsp bovis AF2122/97
ccgccgcugccgccgg

SEQ ID NO: 3124999 - RNA, 22 nt, Mycobacterium bovis subsp bovis AF2122/97
ccgccgcugccgccggugccgc

SEQ ID NO: 3125000 - RNA, 14 nt, Mycobacterium bovis subsp bovis AF2122/97
ccgccggcucgccg

SEQ ID NO: 3125001 - RNA, 16 nt, Mycobacterium bovis subsp bovis AF2122/97
ccgccggcucgccggc

SEQ ID NO: 3125002 - RNA, 18 nt, Mycobacterium bovis subsp bovis AF2122/97
ccgccggcucgccggcga

SEQ ID NO: 3125003 - RNA, 12 nt, Mycobacterium bovis subsp bovis AF2122/97
ccgccggcugcg

SEQ ID NO: 3125004 - RNA, 19 nt, Mycobacterium bovis subsp bovis AF2122/97
ccgccggcugcggaggcgg

SEQ ID NO: 3125005 - RNA, 19 nt, Mycobacterium bovis subsp bovis AF2122/97
ccgccgggauaacccagca

SEQ ID NO: 3125006 - RNA, 20 nt, Mycobacterium bovis subsp bovis AF2122/97
ccgccgggauaacccagcac

SEQ ID NO: 3125007 - RNA, 20 nt, Mycobacterium bovis subsp bovis AF2122/97
ccgccgggauaucgucgacg

SEQ ID NO: 3125008 - RNA, 19 nt, Mycobacterium bovis subsp bovis AF2122/97
ccgccgggcagugugguca

SEQ ID NO: 3125009 - RNA, 14 nt, Mycobacterium bovis subsp bovis AF2122/97
ccgccgggccaggc

SEQ ID NO: 3125010 - RNA, 15 nt, Mycobacterium bovis subsp bovis AF2122/97
ccgccgggccaggcc

SEQ ID NO: 3125011 - RNA, 13 nt, Mycobacterium bovis subsp bovis AF2122/97
ccgccgggcccuc

SEQ ID NO: 3125012 - RNA, 13 nt, Mycobacterium bovis subsp bovis AF2122/97
ccgccgggcgccg

SEQ ID NO: 3125013 - RNA, 13 nt, Mycobacterium bovis subsp bovis AF2122/97
ccgccgggcucca

SEQ ID NO: 3125014 - RNA, 15 nt, Mycobacterium bovis subsp bovis AF2122/97
ccgccgggcuccacg

SEQ ID NO: 3125015 - RNA, 19 nt, Mycobacterium bovis subsp bovis AF2122/97
ccgccgggcuucagcacgc

SEQ ID NO: 3125016 - RNA, 12 nt, Mycobacterium bovis subsp bovis AF2122/97
ccgccggggccc

SEQ ID NO: 3125017 - RNA, 15 nt, Mycobacterium bovis subsp bovis AF2122/97
ccgccgggggcaccg

SEQ ID NO: 3125018 - RNA, 14 nt, Mycobacterium bovis subsp bovis AF2122/97
ccgccggguccgcc

SEQ ID NO: 3125019 - RNA, 18 nt, Mycobacterium bovis subsp bovis AF2122/97
ccgccggguccgccgggc

SEQ ID NO: 3125020 - RNA, 19 nt, Mycobacterium bovis subsp bovis AF2122/97
ccgccggguccgccgggcc

SEQ ID NO: 3125021 - RNA, 20 nt, Mycobacterium bovis subsp bovis AF2122/97
ccgccggguccgccgggccc

SEQ ID NO: 3125022 - RNA, 21 nt, Mycobacterium bovis subsp bovis AF2122/97
ccgccgggugcgccguugccg

SEQ ID NO: 3125023 - RNA, 14 nt, Mycobacterium bovis subsp bovis AF2122/97
ccgccgggugucgg

SEQ ID NO: 3125024 - RNA, 18 nt, Mycobacterium bovis subsp bovis AF2122/97
ccgccggguuggcgccgg

SEQ ID NO: 3125025 - RNA, 14 nt, Mycobacterium bovis subsp bovis AF2122/97
ccgccgguccaugg

SEQ ID NO: 3125026 - RNA, 14 nt, Mycobacterium bovis subsp bovis AF2122/97
ccgccggucccgcg

SEQ ID NO: 3125027 - RNA, 17 nt, Mycobacterium bovis subsp bovis AF2122/97
ccgccggucccgcgugc

SEQ ID NO: 3125028 - RNA, 18 nt, Mycobacterium bovis subsp bovis AF2122/97
ccgccggucccgcgugcc

SEQ ID NO: 3125029 - RNA, 16 nt, Mycobacterium bovis subsp bovis AF2122/97
ccgccggucccggacg

SEQ ID NO: 3125030 - RNA, 21 nt, Mycobacterium bovis subsp bovis AF2122/97
ccgccggucccggacgugccg

SEQ ID NO: 3125031 - RNA, 13 nt, Mycobacterium bovis subsp bovis AF2122/97
ccgccggugaucg

SEQ ID NO: 3125032 - RNA, 16 nt, Mycobacterium bovis subsp bovis AF2122/97
ccgccggugaucggcg

SEQ ID NO: 3125033 - RNA, 22 nt, Mycobacterium bovis subsp bovis AF2122/97
ccgccggugaucggcggcaacc

SEQ ID NO: 3125034 - RNA, 14 nt, Mycobacterium bovis subsp bovis AF2122/97
ccgccggugccacc

SEQ ID NO: 3125035 - RNA, 16 nt, Mycobacterium bovis subsp bovis AF2122/97
ccgccggugccaccga

SEQ ID NO: 3125036 - RNA, 18 nt, Mycobacterium bovis subsp bovis AF2122/97
ccgccggugccaccgacg

SEQ ID NO: 3125037 - RNA, 17 nt, Mycobacterium bovis subsp bovis AF2122/97
ccgccggugccaccggc

SEQ ID NO: 3125038 - RNA, 18 nt, Mycobacterium bovis subsp bovis AF2122/97
ccgccggugccaccggcu

SEQ ID NO: 3125039 - RNA, 13 nt, Mycobacterium bovis subsp bovis AF2122/97
ccgccggugccga

SEQ ID NO: 3125040 - RNA, 14 nt, Mycobacterium bovis subsp bovis AF2122/97
ccgccggugccgau

SEQ ID NO: 3125041 - RNA, 16 nt, Mycobacterium bovis subsp bovis AF2122/97
ccgccggugccgauca

SEQ ID NO: 3125042 - RNA, 19 nt, Mycobacterium bovis subsp bovis AF2122/97
ccgccggugccgaucagca

SEQ ID NO: 3125043 - RNA, 20 nt, Mycobacterium bovis subsp bovis AF2122/97
ccgccggugccgaucagcag

SEQ ID NO: 3125044 - RNA, 15 nt, Mycobacterium bovis subsp bovis AF2122/97
ccgccggugccgcca

SEQ ID NO: 3125045 - RNA, 16 nt, Mycobacterium bovis subsp bovis AF2122/97
ccgccggugccgcccg

SEQ ID NO: 3125046 - RNA, 16 nt, Mycobacterium bovis subsp bovis AF2122/97
ccgccggugccgccgc

SEQ ID NO: 3125047 - RNA, 17 nt, Mycobacterium bovis subsp bovis AF2122/97
ccgccggugccgccgcc

SEQ ID NO: 3125048 - RNA, 21 nt, Mycobacterium bovis subsp bovis AF2122/97
ccgccggugccgccggugccg

SEQ ID NO: 3125049 - RNA, 22 nt, Mycobacterium bovis subsp bovis AF2122/97
ccgccggugccgccggugccgc

SEQ ID NO: 3125050 - RNA, 21 nt, Mycobacterium bovis subsp bovis AF2122/97
ccgccggugccgccgucgccg

SEQ ID NO: 3125051 - RNA, 16 nt, Mycobacterium bovis subsp bovis AF2122/97
ccgccggugccgccug

SEQ ID NO: 3125052 - RNA, 21 nt, Mycobacterium bovis subsp bovis AF2122/97
ccgccggugccgccugcgccg

SEQ ID NO: 3125053 - RNA, 12 nt, Mycobacterium bovis subsp bovis AF2122/97
ccgccggugcgg

SEQ ID NO: 3125054 - RNA, 17 nt, Mycobacterium bovis subsp bovis AF2122/97
ccgccgguggccgcgcu

SEQ ID NO: 3125055 - RNA, 19 nt, Mycobacterium bovis subsp bovis AF2122/97
ccgccgguggccgcgcugg

SEQ ID NO: 3125056 - RNA, 22 nt, Mycobacterium bovis subsp bovis AF2122/97
ccgccgguggccgcgcugguca

SEQ ID NO: 3125057 - RNA, 19 nt, Mycobacterium bovis subsp bovis AF2122/97
ccgccgguggcgccggggc

SEQ ID NO: 3125058 - RNA, 12 nt, Mycobacterium bovis subsp bovis AF2122/97
ccgccgguggug

SEQ ID NO: 3125059 - RNA, 21 nt, Mycobacterium bovis subsp bovis AF2122/97
ccgccgguggugccggcgccg

SEQ ID NO: 3125060 - RNA, 15 nt, Mycobacterium bovis subsp bovis AF2122/97
ccgccggugucgggc

SEQ ID NO: 3125061 - RNA, 15 nt, Mycobacterium bovis subsp bovis AF2122/97
ccgccgguguuagcc

SEQ ID NO: 3125062 - RNA, 16 nt, Mycobacterium bovis subsp bovis AF2122/97
ccgccgguuugggggc

SEQ ID NO: 3125063 - RNA, 20 nt, Mycobacterium bovis subsp bovis AF2122/97
ccgccguaacggucgcuguc

SEQ ID NO: 3125064 - RNA, 22 nt, Mycobacterium bovis subsp bovis AF2122/97
ccgccguaacggucgcugucgg

SEQ ID NO: 3125065 - RNA, 23 nt, Mycobacterium bovis subsp bovis AF2122/97
ccgccguaacggucgcugucggc

SEQ ID NO: 3125066 - RNA, 22 nt, Mycobacterium bovis subsp bovis AF2122/97
ccgccguaccgaagcggaucug

SEQ ID NO: 3125067 - RNA, 19 nt, Mycobacterium bovis subsp bovis AF2122/97
ccgccguagaccagccguc

SEQ ID NO: 3125068 - RNA, 20 nt, Mycobacterium bovis subsp bovis AF2122/97
ccgccguagaccagccgucg

SEQ ID NO: 3125069 - RNA, 19 nt, Mycobacterium bovis subsp bovis AF2122/97
ccgccguaugccgccaacc

SEQ ID NO: 3125070 - RNA, 21 nt, Mycobacterium bovis subsp bovis AF2122/97
ccgccguaugccgccaaccgc

SEQ ID NO: 3125071 - RNA, 15 nt, Mycobacterium bovis subsp bovis AF2122/97
ccgccgucacccccg

SEQ ID NO: 3125072 - RNA, 19 nt, Mycobacterium bovis subsp bovis AF2122/97
ccgccgucaccccgauucg

SEQ ID NO: 3125073 - RNA, 13 nt, Mycobacterium bovis subsp bovis AF2122/97
ccgccgucaccgc

SEQ ID NO: 3125074 - RNA, 15 nt, Mycobacterium bovis subsp bovis AF2122/97
ccgccgucaccgccc

SEQ ID NO: 3125075 - RNA, 16 nt, Mycobacterium bovis subsp bovis AF2122/97
ccgccgucaccgccgu

SEQ ID NO: 3125076 - RNA, 13 nt, Mycobacterium bovis subsp bovis AF2122/97
ccgccguccagcg

SEQ ID NO: 3125077 - RNA, 15 nt, Mycobacterium bovis subsp bovis AF2122/97
ccgccguccagcgcc

SEQ ID NO: 3125078 - RNA, 16 nt, Mycobacterium bovis subsp bovis AF2122/97
ccgccguccagcgccg

SEQ ID NO: 3125079 - RNA, 17 nt, Mycobacterium bovis subsp bovis AF2122/97
ccgccguccagcgccgc

SEQ ID NO: 3125080 - RNA, 14 nt, Mycobacterium bovis subsp bovis AF2122/97
ccgccguccccgcc

SEQ ID NO: 3125081 - RNA, 15 nt, Mycobacterium bovis subsp bovis AF2122/97
ccgccguccccgccg

SEQ ID NO: 3125082 - RNA, 18 nt, Mycobacterium bovis subsp bovis AF2122/97
ccgccguccccgccgacg

SEQ ID NO: 3125083 - RNA, 21 nt, Mycobacterium bovis subsp bovis AF2122/97
ccgccguccccgccgucgcca

SEQ ID NO: 3125084 - RNA, 14 nt, Mycobacterium bovis subsp bovis AF2122/97
ccgccgucccggcu

SEQ ID NO: 3125085 - RNA, 13 nt, Mycobacterium bovis subsp bovis AF2122/97
ccgccgucgacgu

SEQ ID NO: 3125086 - RNA, 21 nt, Mycobacterium bovis subsp bovis AF2122/97
ccgccgucgacguugaugacc

SEQ ID NO: 3125087 - RNA, 14 nt, Mycobacterium bovis subsp bovis AF2122/97
ccgccucgccguag

SEQ ID NO: 3125088 - RNA, 22 nt, Mycobacterium bovis subsp bovis AF2122/97
ccgccucgcggaugagcucggc

SEQ ID NO: 3125089 - RNA, 18 nt, Mycobacterium bovis subsp bovis AF2122/97
ccgccucgggcaccuggu

SEQ ID NO: 3125090 - RNA, 14 nt, Mycobacterium bovis subsp bovis AF2122/97
ccgccucgggccgg

SEQ ID NO: 3125091 - RNA, 15 nt, Mycobacterium bovis subsp bovis AF2122/97
ccgccucgggccggc

SEQ ID NO: 3125092 - RNA, 18 nt, Mycobacterium bovis subsp bovis AF2122/97
ccgccucguacggaccgu

SEQ ID NO: 3125093 - RNA, 16 nt, Mycobacterium bovis subsp bovis AF2122/97
ccgccucugucuucag

SEQ ID NO: 3125094 - RNA, 22 nt, Mycobacterium bovis subsp bovis AF2122/97
ccgccucugucuucagcugcgg

SEQ ID NO: 3125095 - RNA, 16 nt, Mycobacterium bovis subsp bovis AF2122/97
ccgccugaccgccacc

SEQ ID NO: 3125096 - RNA, 23 nt, Mycobacterium bovis subsp bovis AF2122/97
ccgccugacgguaaaugucgaac

SEQ ID NO: 3125097 - RNA, 12 nt, Mycobacterium bovis subsp bovis AF2122/97
ccgccugcaccg

SEQ ID NO: 3125098 - RNA, 14 nt, Mycobacterium bovis subsp bovis AF2122/97
ccgccugcaccgcc

SEQ ID NO: 3125099 - RNA, 17 nt, Mycobacterium bovis subsp bovis AF2122/97
ccgccugcaccgccgcc

SEQ ID NO: 3125100 - RNA, 22 nt, Mycobacterium bovis subsp bovis AF2122/97
ccgccugccccacccgcggcgc

SEQ ID NO: 3125101 - RNA, 13 nt, Mycobacterium bovis subsp bovis AF2122/97
ccgccugcccggc

SEQ ID NO: 3125102 - RNA, 19 nt, Mycobacterium bovis subsp bovis AF2122/97
ccgccugcccggcccgcuc

SEQ ID NO: 3125103 - RNA, 14 nt, Mycobacterium bovis subsp bovis AF2122/97
ccgccugccgacgg

SEQ ID NO: 3125104 - RNA, 15 nt, Mycobacterium bovis subsp bovis AF2122/97
ccgccugcgccgcca

SEQ ID NO: 3125105 - RNA, 21 nt, Mycobacterium bovis subsp bovis AF2122/97
ccgccugcgccgccagcgccg

SEQ ID NO: 3125106 - RNA, 15 nt, Mycobacterium bovis subsp bovis AF2122/97
ccgccugcgccgccc

SEQ ID NO: 3125107 - RNA, 19 nt, Mycobacterium bovis subsp bovis AF2122/97
ccgccugcgccgcccgcgc

SEQ ID NO: 3125108 - RNA, 18 nt, Mycobacterium bovis subsp bovis AF2122/97
ccgccugcgcggcugccg

SEQ ID NO: 3125109 - RNA, 15 nt, Mycobacterium bovis subsp bovis AF2122/97
ccgccugcucggcga

SEQ ID NO: 3125110 - RNA, 19 nt, Mycobacterium bovis subsp bovis AF2122/97
ccgccugcuggccgcggcu

SEQ ID NO: 3125111 - RNA, 22 nt, Mycobacterium bovis subsp bovis AF2122/97
ccgccuggaaauuucaguucgg

SEQ ID NO: 3125112 - RNA, 21 nt, Mycobacterium bovis subsp bovis AF2122/97
ccgccuggaaggaaccgaucg

SEQ ID NO: 3125113 - RNA, 14 nt, Mycobacterium bovis subsp bovis AF2122/97
ccgccuggacgccg

SEQ ID NO: 3125114 - RNA, 16 nt, Mycobacterium bovis subsp bovis AF2122/97
ccgccuggacgccgcc

SEQ ID NO: 3125115 - RNA, 17 nt, Mycobacterium bovis subsp bovis AF2122/97
ccgccuggaucagcgcg

SEQ ID NO: 3125116 - RNA, 15 nt, Mycobacterium bovis subsp bovis AF2122/97
ccgccugggcggcca

SEQ ID NO: 3125117 - RNA, 16 nt, Mycobacterium bovis subsp bovis AF2122/97
ccgccugggcggccag

SEQ ID NO: 3125118 - RNA, 17 nt, Mycobacterium bovis subsp bovis AF2122/97
ccgccugggcggccagc

SEQ ID NO: 3125119 - RNA, 20 nt, Mycobacterium bovis subsp bovis AF2122/97
ccgccugggcggccagcacg

SEQ ID NO: 3125120 - RNA, 16 nt, Mycobacterium bovis subsp bovis AF2122/97
ccgccuggguugaccg

SEQ ID NO: 3125121 - RNA, 17 nt, Mycobacterium bovis subsp bovis AF2122/97
ccgccuggguugaccgc

SEQ ID NO: 3125122 - RNA, 22 nt, Mycobacterium bovis subsp bovis AF2122/97
ccgccuggguugaccgccaccc

SEQ ID NO: 3125123 - RNA, 23 nt, Mycobacterium bovis subsp bovis AF2122/97
ccgccuggguugaccgccacccc

SEQ ID NO: 3125124 - RNA, 16 nt, Mycobacterium bovis subsp bovis AF2122/97
ccgccuguacggcggc

SEQ ID NO: 3125125 - RNA, 15 nt, Mycobacterium bovis subsp bovis AF2122/97
ccgccugucccgccg

SEQ ID NO: 3125126 - RNA, 21 nt, Mycobacterium bovis subsp bovis AF2122/97
ccgccugucccgccggccccg

SEQ ID NO: 3125127 - RNA, 14 nt, Mycobacterium bovis subsp bovis AF2122/97
ccgccugugccgcc

SEQ ID NO: 3125128 - RNA, 17 nt, Mycobacterium bovis subsp bovis AF2122/97
ccgccugugccgccggc

SEQ ID NO: 3125129 - RNA, 19 nt, Mycobacterium bovis subsp bovis AF2122/97
ccgccugugccgccggcgc

SEQ ID NO: 3125130 - RNA, 16 nt, Mycobacterium bovis subsp bovis AF2122/97
ccgccuuacgcaccga

SEQ ID NO: 3125131 - RNA, 20 nt, Mycobacterium bovis subsp bovis AF2122/97
ccgccuuacgcaccgaugcc

SEQ ID NO: 3125132 - RNA, 14 nt, Mycobacterium bovis subsp bovis AF2122/97
ccgccuucucccgc

SEQ ID NO: 3125133 - RNA, 19 nt, Mycobacterium bovis subsp bovis AF2122/97
ccgccuucucccgcacggc

SEQ ID NO: 3125134 - RNA, 14 nt, Mycobacterium bovis subsp bovis AF2122/97
ccgccuucuccggc

SEQ ID NO: 3125135 - RNA, 14 nt, Mycobacterium bovis subsp bovis AF2122/97
ccgccuucuuggcg

SEQ ID NO: 3125136 - RNA, 18 nt, Mycobacterium bovis subsp bovis AF2122/97
ccgccuucuuggcggccu

SEQ ID NO: 3125137 - RNA, 16 nt, Mycobacterium bovis subsp bovis AF2122/97
ccgccuugcagcgcgu

SEQ ID NO: 3125138 - RNA, 22 nt, Mycobacterium bovis subsp bovis AF2122/97
ccgccuuggccaccaucgccgc

SEQ ID NO: 3125139 - RNA, 13 nt, Mycobacterium bovis subsp bovis AF2122/97
ccgccuuggcccc

SEQ ID NO: 3125140 - RNA, 16 nt, Mycobacterium bovis subsp bovis AF2122/97
ccgccuuggcccccgg

SEQ ID NO: 3125141 - RNA, 15 nt, Mycobacterium bovis subsp bovis AF2122/97
ccgccuuggcuucga

SEQ ID NO: 3125142 - RNA, 19 nt, Mycobacterium bovis subsp bovis AF2122/97
ccgccuuggcuucgacgcu

SEQ ID NO: 3125143 - RNA, 22 nt, Mycobacterium bovis subsp bovis AF2122/97
ccgccuuggucaccuucuuggc

SEQ ID NO: 3125144 - RNA, 23 nt, Mycobacterium bovis subsp bovis AF2122/97
ccgccuuggucaccuucuuggcg

SEQ ID NO: 3125145 - RNA, 18 nt, Mycobacterium bovis subsp bovis AF2122/97
ccgccuuggucgcgucgg

SEQ ID NO: 3125146 - RNA, 15 nt, Mycobacterium bovis subsp bovis AF2122/97
ccgccuuugcccgcc

SEQ ID NO: 3125147 - RNA, 17 nt, Mycobacterium bovis subsp bovis AF2122/97
ccgccuuugcccgccgc

SEQ ID NO: 3125148 - RNA, 16 nt, Mycobacterium bovis subsp bovis AF2122/97
ccgccuuugccgccgg

SEQ ID NO: 3125149 - RNA, 17 nt, Mycobacterium bovis subsp bovis AF2122/97
ccgccuuugccgccggc

SEQ ID NO: 3125150 - RNA, 18 nt, Mycobacterium bovis subsp bovis AF2122/97
ccgccuuugccgccggca

SEQ ID NO: 3125151 - RNA, 13 nt, Mycobacterium bovis subsp bovis AF2122/97
ccgcgaaacccau

SEQ ID NO: 3125152 - RNA, 18 nt, Mycobacterium bovis subsp bovis AF2122/97
ccgcgaaacccaugaccu

SEQ ID NO: 3125153 - RNA, 18 nt, Mycobacterium bovis subsp bovis AF2122/97
ccgcgaacaaccugccgg

SEQ ID NO: 3125154 - RNA, 13 nt, Mycobacterium bovis subsp bovis AF2122/97
ccgcgaacccgau

SEQ ID NO: 3125155 - RNA, 15 nt, Mycobacterium bovis subsp bovis AF2122/97
ccgcgaaccgcggau

SEQ ID NO: 3125156 - RNA, 19 nt, Mycobacterium bovis subsp bovis AF2122/97
ccgcgaacgcgacagccac

SEQ ID NO: 3125157 - RNA, 20 nt, Mycobacterium bovis subsp bovis AF2122/97
ccgcgaacgcgacagccacc

SEQ ID NO: 3125158 - RNA, 15 nt, Mycobacterium bovis subsp bovis AF2122/97
ccgcgaagccgaccg

SEQ ID NO: 3125159 - RNA, 19 nt, Mycobacterium bovis subsp bovis AF2122/97
ccgcgaagccgaccguacc

SEQ ID NO: 3125160 - RNA, 19 nt, Mycobacterium bovis subsp bovis AF2122/97
ccgcgaagcgcucggcagc

SEQ ID NO: 3125161 - RNA, 15 nt, Mycobacterium bovis subsp bovis AF2122/97
ccgcgaagcgggaag

SEQ ID NO: 3125162 - RNA, 13 nt, Mycobacterium bovis subsp bovis AF2122/97
ccgcgaagcugcg

SEQ ID NO: 3125163 - RNA, 16 nt, Mycobacterium bovis subsp bovis AF2122/97
ccgcgaagcugcgggu

SEQ ID NO: 3125164 - RNA, 23 nt, Mycobacterium bovis subsp bovis AF2122/97
ccgcgaagcugcgggucucgcug

SEQ ID NO: 3125165 - RNA, 22 nt, Mycobacterium bovis subsp bovis AF2122/97
ccgcgaaggggugcccggcggc

SEQ ID NO: 3125166 - RNA, 20 nt, Mycobacterium bovis subsp bovis AF2122/97
ccgcgaagugcuugggccgc

SEQ ID NO: 3125167 - RNA, 20 nt, Mycobacterium bovis subsp bovis AF2122/97
ccgcgaauacgaggacgacg

SEQ ID NO: 3125168 - RNA, 23 nt, Mycobacterium bovis subsp bovis AF2122/97
ccgcgaaucaacaggaccgggau

SEQ ID NO: 3125169 - RNA, 20 nt, Mycobacterium bovis subsp bovis AF2122/97
ccgcgaaugcugugccgaga

SEQ ID NO: 3125170 - RNA, 18 nt, Mycobacterium bovis subsp bovis AF2122/97
ccgcgaaugugaucaccc

SEQ ID NO: 3125171 - RNA, 19 nt, Mycobacterium bovis subsp bovis AF2122/97
ccgcgaaugugaucacccg

SEQ ID NO: 3125172 - RNA, 15 nt, Mycobacterium bovis subsp bovis AF2122/97
ccgcgaauucggcau

SEQ ID NO: 3125173 - RNA, 19 nt, Mycobacterium bovis subsp bovis AF2122/97
ccgcgcagcgguccgccgc

SEQ ID NO: 3125174 - RNA, 13 nt, Mycobacterium bovis subsp bovis AF2122/97
ccgcgcagcugcc

SEQ ID NO: 3125175 - RNA, 18 nt, Mycobacterium bovis subsp bovis AF2122/97
ccgcgcagcugccgcacc

SEQ ID NO: 3125176 - RNA, 18 nt, Mycobacterium bovis subsp bovis AF2122/97
ccgcgcaggggcggcgug

SEQ ID NO: 3125177 - RNA, 17 nt, Mycobacterium bovis subsp bovis AF2122/97
ccgcgcaucaucgccca

SEQ ID NO: 3125178 - RNA, 23 nt, Mycobacterium bovis subsp bovis AF2122/97
ccgcgccaacagaugccacccag

SEQ ID NO: 3125179 - RNA, 22 nt, Mycobacterium bovis subsp bovis AF2122/97
ccgcgccaccgauaccgucagc

SEQ ID NO: 3125180 - RNA, 15 nt, Mycobacterium bovis subsp bovis AF2122/97
ccgcgccaccggcac

SEQ ID NO: 3125181 - RNA, 11 nt, Mycobacterium bovis subsp bovis AF2122/97
ccgcgccaccu

SEQ ID NO: 3125182 - RNA, 20 nt, Mycobacterium bovis subsp bovis AF2122/97
ccgcgccaccucccacgccg

SEQ ID NO: 3125183 - RNA, 21 nt, Mycobacterium bovis subsp bovis AF2122/97
ccgcgccaccucccacgccgc

SEQ ID NO: 3125184 - RNA, 23 nt, Mycobacterium bovis subsp bovis AF2122/97
ccgcgccaccucccacgccgccg

SEQ ID NO: 3125185 - RNA, 14 nt, Mycobacterium bovis subsp bovis AF2122/97
ccgcgccaccuccg

SEQ ID NO: 3125186 - RNA, 20 nt, Mycobacterium bovis subsp bovis AF2122/97
ccgcgccaccuccgacgggc

SEQ ID NO: 3125187 - RNA, 22 nt, Mycobacterium bovis subsp bovis AF2122/97
ccgcgccaccuccgacgggcga

SEQ ID NO: 3125188 - RNA, 13 nt, Mycobacterium bovis subsp bovis AF2122/97
ccgcgccagccuc

SEQ ID NO: 3125189 - RNA, 17 nt, Mycobacterium bovis subsp bovis AF2122/97
ccgcgccagccuccacc

SEQ ID NO: 3125190 - RNA, 20 nt, Mycobacterium bovis subsp bovis AF2122/97
ccgcgccagccuccaccagg

SEQ ID NO: 3125191 - RNA, 14 nt, Mycobacterium bovis subsp bovis AF2122/97
ccgcgccagcuccg

SEQ ID NO: 3125192 - RNA, 13 nt, Mycobacterium bovis subsp bovis AF2122/97
ccgcgccaguggc

SEQ ID NO: 3125193 - RNA, 19 nt, Mycobacterium bovis subsp bovis AF2122/97
ccgcgccauagcagagccg

SEQ ID NO: 3125194 - RNA, 15 nt, Mycobacterium bovis subsp bovis AF2122/97
ccgcgcccaacgcgg

SEQ ID NO: 3125195 - RNA, 18 nt, Mycobacterium bovis subsp bovis AF2122/97
ccgcgcccaacgcgggug

SEQ ID NO: 3125196 - RNA, 13 nt, Mycobacterium bovis subsp bovis AF2122/97
ccgcgcccaccag

SEQ ID NO: 3125197 - RNA, 14 nt, Mycobacterium bovis subsp bovis AF2122/97
ccgcgcccaccagc

SEQ ID NO: 3125198 - RNA, 21 nt, Mycobacterium bovis subsp bovis AF2122/97
ccgcgcccaccagcggcggca

SEQ ID NO: 3125199 - RNA, 17 nt, Mycobacterium bovis subsp bovis AF2122/97
ccgcgccccgcggcaga

SEQ ID NO: 3125200 - RNA, 18 nt, Mycobacterium bovis subsp bovis AF2122/97
ccgcgccccgcggcagac

SEQ ID NO: 3125201 - RNA, 12 nt, Mycobacterium bovis subsp bovis AF2122/97
ccgcgcccgacg

SEQ ID NO: 3125202 - RNA, 14 nt, Mycobacterium bovis subsp bovis AF2122/97
ccgcgcccgagccg

SEQ ID NO: 3125203 - RNA, 13 nt, Mycobacterium bovis subsp bovis AF2122/97
ccgcgcccgccgc

SEQ ID NO: 3125204 - RNA, 15 nt, Mycobacterium bovis subsp bovis AF2122/97
ccgcgcccgccgcgg

SEQ ID NO: 3125205 - RNA, 23 nt, Mycobacterium bovis subsp bovis AF2122/97
ccgcgcccgcgggcaguggcagc

SEQ ID NO: 3125206 - RNA, 12 nt, Mycobacterium bovis subsp bovis AF2122/97
ccgcgcccggcg

SEQ ID NO: 3125207 - RNA, 16 nt, Mycobacterium bovis subsp bovis AF2122/97
ccgcgcccuucagcac

SEQ ID NO: 3125208 - RNA, 18 nt, Mycobacterium bovis subsp bovis AF2122/97
ccgcgcccuucagcacgg

SEQ ID NO: 3125209 - RNA, 14 nt, Mycobacterium bovis subsp bovis AF2122/97
ccgcgccgaacacg

SEQ ID NO: 3125210 - RNA, 17 nt, Mycobacterium bovis subsp bovis AF2122/97
ccgcgccgaacacgcac

SEQ ID NO: 3125211 - RNA, 22 nt, Mycobacterium bovis subsp bovis AF2122/97
ccgcgccgacacguugcagcuc

SEQ ID NO: 3125212 - RNA, 11 nt, Mycobacterium bovis subsp bovis AF2122/97
ccgcgccgacg

SEQ ID NO: 3125213 - RNA, 13 nt, Mycobacterium bovis subsp bovis AF2122/97
ccgcgccgagcag

SEQ ID NO: 3125214 - RNA, 12 nt, Mycobacterium bovis subsp bovis AF2122/97
ccgcgccgagcc

SEQ ID NO: 3125215 - RNA, 15 nt, Mycobacterium bovis subsp bovis AF2122/97
ccgcgccgagcccgg

SEQ ID NO: 3125216 - RNA, 17 nt, Mycobacterium bovis subsp bovis AF2122/97
ccgcgccgaucaccacc

SEQ ID NO: 3125217 - RNA, 20 nt, Mycobacterium bovis subsp bovis AF2122/97
ccgcgccgaucaccaccggc

SEQ ID NO: 3125218 - RNA, 20 nt, Mycobacterium bovis subsp bovis AF2122/97
ccgcgccgauuccaccgccg

SEQ ID NO: 3125219 - RNA, 22 nt, Mycobacterium bovis subsp bovis AF2122/97
ccgcgccgauuccaccgccgac

SEQ ID NO: 3125220 - RNA, 14 nt, Mycobacterium bovis subsp bovis AF2122/97
ccgcgccgccccgc

SEQ ID NO: 3125221 - RNA, 16 nt, Mycobacterium bovis subsp bovis AF2122/97
ccgcgccgccccgcuc

SEQ ID NO: 3125222 - RNA, 13 nt, Mycobacterium bovis subsp bovis AF2122/97
ccgcgccgcccgc

SEQ ID NO: 3125223 - RNA, 22 nt, Mycobacterium bovis subsp bovis AF2122/97
ccgcgccgcccgcuccuccggc

SEQ ID NO: 3125224 - RNA, 19 nt, Mycobacterium bovis subsp bovis AF2122/97
ccgcgccgccgccaccacc

SEQ ID NO: 3125225 - RNA, 20 nt, Mycobacterium bovis subsp bovis AF2122/97
ccgcgccgccgccaccaccc

SEQ ID NO: 3125226 - RNA, 20 nt, Mycobacterium bovis subsp bovis AF2122/97
ccgcgccgccggacccaccg

SEQ ID NO: 3125227 - RNA, 17 nt, Mycobacterium bovis subsp bovis AF2122/97
ccgcgccgccucgggca

SEQ ID NO: 3125228 - RNA, 20 nt, Mycobacterium bovis subsp bovis AF2122/97
ccgcgccgccucgggcaccu

SEQ ID NO: 3125229 - RNA, 13 nt, Mycobacterium bovis subsp bovis AF2122/97
ccgcgccgcgccg

SEQ ID NO: 3125230 - RNA, 15 nt, Mycobacterium bovis subsp bovis AF2122/97
ccgcgccgcgccgcc

SEQ ID NO: 3125231 - RNA, 19 nt, Mycobacterium bovis subsp bovis AF2122/97
ccgcgccgcgccgccucgg

SEQ ID NO: 3125232 - RNA, 18 nt, Mycobacterium bovis subsp bovis AF2122/97
ccgcgccgcgccgcgccg

SEQ ID NO: 3125233 - RNA, 17 nt, Mycobacterium bovis subsp bovis AF2122/97
ccgcgccgcggcccgcu

SEQ ID NO: 3125234 - RNA, 18 nt, Mycobacterium bovis subsp bovis AF2122/97
ccgcgccgcggcccgcuc

SEQ ID NO: 3125235 - RNA, 20 nt, Mycobacterium bovis subsp bovis AF2122/97
ccgcgccgcggcccgcucca

SEQ ID NO: 3125236 - RNA, 14 nt, Mycobacterium bovis subsp bovis AF2122/97
ccgcgccggacagc

SEQ ID NO: 3125237 - RNA, 14 nt, Mycobacterium bovis subsp bovis AF2122/97
ccgcgccggcacgg

SEQ ID NO: 3125238 - RNA, 17 nt, Mycobacterium bovis subsp bovis AF2122/97
ccgcgccggcacgggcg

SEQ ID NO: 3125239 - RNA, 18 nt, Mycobacterium bovis subsp bovis AF2122/97
ccgcgccggcacgggcgu

SEQ ID NO: 3125240 - RNA, 14 nt, Mycobacterium bovis subsp bovis AF2122/97
ccgcgccggccccg

SEQ ID NO: 3125241 - RNA, 13 nt, Mycobacterium bovis subsp bovis AF2122/97
ccgcgccggccgc

SEQ ID NO: 3125242 - RNA, 14 nt, Mycobacterium bovis subsp bovis AF2122/97
ccgcgccggccgca

SEQ ID NO: 3125243 - RNA, 14 nt, Mycobacterium bovis subsp bovis AF2122/97
ccgcgccggccgcu

SEQ ID NO: 3125244 - RNA, 16 nt, Mycobacterium bovis subsp bovis AF2122/97
ccgcgccggcggaagc

SEQ ID NO: 3125245 - RNA, 23 nt, Mycobacterium bovis subsp bovis AF2122/97
ccgcgccggcggaagcggcggcc

SEQ ID NO: 3125246 - RNA, 14 nt, Mycobacterium bovis subsp bovis AF2122/97
ccgcgccggcggca

SEQ ID NO: 3125247 - RNA, 15 nt, Mycobacterium bovis subsp bovis AF2122/97
ccgcgccggcggcca

SEQ ID NO: 3125248 - RNA, 14 nt, Mycobacterium bovis subsp bovis AF2122/97
ccgcgccggcgggc

SEQ ID NO: 3125249 - RNA, 17 nt, Mycobacterium bovis subsp bovis AF2122/97
ccgcgccggcguugccg

SEQ ID NO: 3125250 - RNA, 22 nt, Mycobacterium bovis subsp bovis AF2122/97
ccgcgccggugugcgcaccccg

SEQ ID NO: 3125251 - RNA, 12 nt, Mycobacterium bovis subsp bovis AF2122/97
ccgcgccgucgu

SEQ ID NO: 3125252 - RNA, 15 nt, Mycobacterium bovis subsp bovis AF2122/97
ccgcgccguggacga

SEQ ID NO: 3125253 - RNA, 12 nt, Mycobacterium bovis subsp bovis AF2122/97
ccgcgccuaccc

SEQ ID NO: 3125254 - RNA, 22 nt, Mycobacterium bovis subsp bovis AF2122/97
ccgcgccuacccuucgguaggc

SEQ ID NO: 3125255 - RNA, 16 nt, Mycobacterium bovis subsp bovis AF2122/97
ccgcgccugccucacc

SEQ ID NO: 3125256 - RNA, 20 nt, Mycobacterium bovis subsp bovis AF2122/97
ccgcgccugccucaccgccg

SEQ ID NO: 3125257 - RNA, 22 nt, Mycobacterium bovis subsp bovis AF2122/97
ccgcgccuggagcgaucuccgu

SEQ ID NO: 3125258 - RNA, 20 nt, Mycobacterium bovis subsp bovis AF2122/97
ccgcgccuugauggucucca

SEQ ID NO: 3125259 - RNA, 22 nt, Mycobacterium bovis subsp bovis AF2122/97
ccgcgccuugauggucuccacc

SEQ ID NO: 3125260 - RNA, 16 nt, Mycobacterium bovis subsp bovis AF2122/97
ccgcggacucgggcag

SEQ ID NO: 3125261 - RNA, 19 nt, Mycobacterium bovis subsp bovis AF2122/97
ccgcggacucgggcaggcc

SEQ ID NO: 3125262 - RNA, 18 nt, Mycobacterium bovis subsp bovis AF2122/97
ccgcggacuugcgagccg

SEQ ID NO: 3125263 - RNA, 19 nt, Mycobacterium bovis subsp bovis AF2122/97
ccgcggacuugcgagccgu

SEQ ID NO: 3125264 - RNA, 20 nt, Mycobacterium bovis subsp bovis AF2122/97
ccgcggacuugcgagccgua

SEQ ID NO: 3125265 - RNA, 23 nt, Mycobacterium bovis subsp bovis AF2122/97
ccgcggagcucaaccaccucgcc

SEQ ID NO: 3125266 - RNA, 15 nt, Mycobacterium bovis subsp bovis AF2122/97
ccgcggaggcggcca

SEQ ID NO: 3125267 - RNA, 21 nt, Mycobacterium bovis subsp bovis AF2122/97
ccgcggaggcggccagccuac

SEQ ID NO: 3125268 - RNA, 23 nt, Mycobacterium bovis subsp bovis AF2122/97
ccgcggaggcggccagccuaccg

SEQ ID NO: 3125269 - RNA, 18 nt, Mycobacterium bovis subsp bovis AF2122/97
ccgcggauaggccgcgcg

SEQ ID NO: 3125270 - RNA, 20 nt, Mycobacterium bovis subsp bovis AF2122/97
ccgcggauaggccgcgcggc

SEQ ID NO: 3125271 - RNA, 22 nt, Mycobacterium bovis subsp bovis AF2122/97
ccgcggauaggccgcgcggcgg

SEQ ID NO: 3125272 - RNA, 23 nt, Mycobacterium bovis subsp bovis AF2122/97
ccgcggauaggccgcgcggcggc

SEQ ID NO: 3125273 - RNA, 20 nt, Mycobacterium bovis subsp bovis AF2122/97
ccgcggaucaccaucgccgc

SEQ ID NO: 3125274 - RNA, 22 nt, Mycobacterium bovis subsp bovis AF2122/97
ccgcggaucaccaucgccgccg

SEQ ID NO: 3125275 - RNA, 21 nt, Mycobacterium bovis subsp bovis AF2122/97
ccgcggaucauccuucgccgg

SEQ ID NO: 3125276 - RNA, 15 nt, Mycobacterium bovis subsp bovis AF2122/97
ccgcggaucgaccgc

SEQ ID NO: 3125277 - RNA, 20 nt, Mycobacterium bovis subsp bovis AF2122/97
ccgcggaucgaccgccagcg

SEQ ID NO: 3125278 - RNA, 21 nt, Mycobacterium bovis subsp bovis AF2122/97
ccgcggaucgaccgccagcgc

SEQ ID NO: 3125279 - RNA, 23 nt, Mycobacterium bovis subsp bovis AF2122/97
ccgcggaucgaccgccagcgccg

SEQ ID NO: 3125280 - RNA, 16 nt, Mycobacterium bovis subsp bovis AF2122/97
ccgcggaucgacuucg

SEQ ID NO: 3125281 - RNA, 18 nt, Mycobacterium bovis subsp bovis AF2122/97
ccgcggauuccagcgcgu

SEQ ID NO: 3125282 - RNA, 16 nt, Mycobacterium bovis subsp bovis AF2122/97
ccgcggcaacaccacc

SEQ ID NO: 3125283 - RNA, 17 nt, Mycobacterium bovis subsp bovis AF2122/97
ccgcggcaacaccaccu

SEQ ID NO: 3125284 - RNA, 16 nt, Mycobacterium bovis subsp bovis AF2122/97
ccgcggcaacgcgguc

SEQ ID NO: 3125285 - RNA, 13 nt, Mycobacterium bovis subsp bovis AF2122/97
ccgcggcaccgcc

SEQ ID NO: 3125286 - RNA, 14 nt, Mycobacterium bovis subsp bovis AF2122/97
ccgcggcaccgccc

SEQ ID NO: 3125287 - RNA, 16 nt, Mycobacterium bovis subsp bovis AF2122/97
ccgcggcaccgccccg

SEQ ID NO: 3125288 - RNA, 10 nt, Mycobacterium bovis subsp bovis AF2122/97
ccgcggcacg

SEQ ID NO: 3125289 - RNA, 13 nt, Mycobacterium bovis subsp bovis AF2122/97
ccgcggcagcacg

SEQ ID NO: 3125290 - RNA, 14 nt, Mycobacterium bovis subsp bovis AF2122/97
ccgcggcagggcgg

SEQ ID NO: 3125291 - RNA, 17 nt, Mycobacterium bovis subsp bovis AF2122/97
ccgcggcaugcaaugcu

SEQ ID NO: 3125292 - RNA, 22 nt, Mycobacterium bovis subsp bovis AF2122/97
ccgcggcaugcaaugcuggcgg

SEQ ID NO: 3125293 - RNA, 21 nt, Mycobacterium bovis subsp bovis AF2122/97
ccgcggcauuggcgucgucgc

SEQ ID NO: 3125294 - RNA, 14 nt, Mycobacterium bovis subsp bovis AF2122/97
ccgcggccacaacc

SEQ ID NO: 3125295 - RNA, 21 nt, Mycobacterium bovis subsp bovis AF2122/97
ccgcggccacaucgccagcag

SEQ ID NO: 3125296 - RNA, 11 nt, Mycobacterium bovis subsp bovis AF2122/97
ccgcggccacc

SEQ ID NO: 3125297 - RNA, 15 nt, Mycobacterium bovis subsp bovis AF2122/97
ccgcggccaccaccg

SEQ ID NO: 3125298 - RNA, 17 nt, Mycobacterium bovis subsp bovis AF2122/97
ccgcggccaccaccgcc

SEQ ID NO: 3125299 - RNA, 18 nt, Mycobacterium bovis subsp bovis AF2122/97
ccgcggccaccaccgccg

SEQ ID NO: 3125300 - RNA, 19 nt, Mycobacterium bovis subsp bovis AF2122/97
ccgcggccaccaccgccgc

SEQ ID NO: 3125301 - RNA, 23 nt, Mycobacterium bovis subsp bovis AF2122/97
ccgcggccaccaccgccgccggc

SEQ ID NO: 3125302 - RNA, 14 nt, Mycobacterium bovis subsp bovis AF2122/97
ccgcggccaccgcc

SEQ ID NO: 3125303 - RNA, 16 nt, Mycobacterium bovis subsp bovis AF2122/97
ccgcggccaccgccgc

SEQ ID NO: 3125304 - RNA, 18 nt, Mycobacterium bovis subsp bovis AF2122/97
ccgcggccaccgccgccg

SEQ ID NO: 3125305 - RNA, 19 nt, Mycobacterium bovis subsp bovis AF2122/97
ccgcggccaccgccgccgc

SEQ ID NO: 3125306 - RNA, 16 nt, Mycobacterium bovis subsp bovis AF2122/97
ccgcggccagcaccgg

SEQ ID NO: 3125307 - RNA, 15 nt, Mycobacterium bovis subsp bovis AF2122/97
ccgcggccagcagca

SEQ ID NO: 3125308 - RNA, 12 nt, Mycobacterium bovis subsp bovis AF2122/97
ccgcggccagcg

SEQ ID NO: 3125309 - RNA, 14 nt, Mycobacterium bovis subsp bovis AF2122/97
ccgcggccagcggg

SEQ ID NO: 3125310 - RNA, 19 nt, Mycobacterium bovis subsp bovis AF2122/97
ccgcggccccgacugccgc

SEQ ID NO: 3125311 - RNA, 15 nt, Mycobacterium bovis subsp bovis AF2122/97
ccgcggcccgcgugc

SEQ ID NO: 3125312 - RNA, 18 nt, Mycobacterium bovis subsp bovis AF2122/97
ccgcggcccgcgugcgca

SEQ ID NO: 3125313 - RNA, 22 nt, Mycobacterium bovis subsp bovis AF2122/97
ccgcggcccgcuccacggucag

SEQ ID NO: 3125314 - RNA, 20 nt, Mycobacterium bovis subsp bovis AF2122/97
ccgcggcccgcucgaucggc

SEQ ID NO: 3125315 - RNA, 19 nt, Mycobacterium bovis subsp bovis AF2122/97
ccgcggcccggacgucggc

SEQ ID NO: 3125316 - RNA, 12 nt, Mycobacterium bovis subsp bovis AF2122/97
ccgcggccgccg

SEQ ID NO: 3125317 - RNA, 12 nt, Mycobacterium bovis subsp bovis AF2122/97
ccgcggccggcc

SEQ ID NO: 3125318 - RNA, 13 nt, Mycobacterium bovis subsp bovis AF2122/97
ccgcggccggccg

SEQ ID NO: 3125319 - RNA, 13 nt, Mycobacterium bovis subsp bovis AF2122/97
ccgcggccggcgc

SEQ ID NO: 3125320 - RNA, 13 nt, Mycobacterium bovis subsp bovis AF2122/97
ccgcggccggcgu

SEQ ID NO: 3125321 - RNA, 14 nt, Mycobacterium bovis subsp bovis AF2122/97
ccgcggccucccgc

SEQ ID NO: 3125322 - RNA, 23 nt, Mycobacterium bovis subsp bovis AF2122/97
ccgcggccuuggcggccgcgacc

SEQ ID NO: 3125323 - RNA, 18 nt, Mycobacterium bovis subsp bovis AF2122/97
ccgcggcgaaccagcgcg

SEQ ID NO: 3125324 - RNA, 20 nt, Mycobacterium bovis subsp bovis AF2122/97
ccgcggcgaaccagcgcguc

SEQ ID NO: 3125325 - RNA, 14 nt, Mycobacterium bovis subsp bovis AF2122/97
ccgcggcgaagaua

SEQ ID NO: 3125326 - RNA, 20 nt, Mycobacterium bovis subsp bovis AF2122/97
ccgcggcgaucuuggaucgg

SEQ ID NO: 3125327 - RNA, 14 nt, Mycobacterium bovis subsp bovis AF2122/97
ccgcggcgauuacg

SEQ ID NO: 3125328 - RNA, 14 nt, Mycobacterium bovis subsp bovis AF2122/97
ccgcggcgcagcac

SEQ ID NO: 3125329 - RNA, 17 nt, Mycobacterium bovis subsp bovis AF2122/97
ccgcggcgcagcacggc

SEQ ID NO: 3125330 - RNA, 19 nt, Mycobacterium bovis subsp bovis AF2122/97
ccgcggcgcagcacggcgg

SEQ ID NO: 3125331 - RNA, 21 nt, Mycobacterium bovis subsp bovis AF2122/97
ccgcggcgccauagccgcgac

SEQ ID NO: 3125332 - RNA, 19 nt, Mycobacterium bovis subsp bovis AF2122/97
ccgcggcgcccggcggauc

SEQ ID NO: 3125333 - RNA, 18 nt, Mycobacterium bovis subsp bovis AF2122/97
ccgcggcgccggugggcg

SEQ ID NO: 3125334 - RNA, 15 nt, Mycobacterium bovis subsp bovis AF2122/97
ccgcggcgcgacggc

SEQ ID NO: 3125335 - RNA, 14 nt, Mycobacterium bovis subsp bovis AF2122/97
ccgcggcgcgcaac

SEQ ID NO: 3125336 - RNA, 14 nt, Mycobacterium bovis subsp bovis AF2122/97
ccgcggcgcggaga

SEQ ID NO: 3125337 - RNA, 12 nt, Mycobacterium bovis subsp bovis AF2122/97
ccgcggcggaug

SEQ ID NO: 3125338 - RNA, 12 nt, Mycobacterium bovis subsp bovis AF2122/97
ccgcggcggcca

SEQ ID NO: 3125339 - RNA, 13 nt, Mycobacterium bovis subsp bovis AF2122/97
ccgcggcggcccc

SEQ ID NO: 3125340 - RNA, 17 nt, Mycobacterium bovis subsp bovis AF2122/97
ccgcggcggccccgcgc

SEQ ID NO: 3125341 - RNA, 11 nt, Mycobacterium bovis subsp bovis AF2122/97
ccgcggcggcg

SEQ ID NO: 3125342 - RNA, 13 nt, Mycobacterium bovis subsp bovis AF2122/97
ccgcggcggcgcg

SEQ ID NO: 3125343 - RNA, 14 nt, Mycobacterium bovis subsp bovis AF2122/97
ccgcggcggcgcgu

SEQ ID NO: 3125344 - RNA, 15 nt, Mycobacterium bovis subsp bovis AF2122/97
ccgcggcggcgcgug

SEQ ID NO: 3125345 - RNA, 22 nt, Mycobacterium bovis subsp bovis AF2122/97
ccgcggcggucagucccgugac

SEQ ID NO: 3125346 - RNA, 23 nt, Mycobacterium bovis subsp bovis AF2122/97
ccgcggcggucagucccgugacg

SEQ ID NO: 3125347 - RNA, 22 nt, Mycobacterium bovis subsp bovis AF2122/97
ccgcguagcuggucccacaccu

SEQ ID NO: 3125348 - RNA, 16 nt, Mycobacterium bovis subsp bovis AF2122/97
ccgcguagguggccag

SEQ ID NO: 3125349 - RNA, 18 nt, Mycobacterium bovis subsp bovis AF2122/97
ccgcguagguggccagcg

SEQ ID NO: 3125350 - RNA, 17 nt, Mycobacterium bovis subsp bovis AF2122/97
ccgcguaguccaggccg

SEQ ID NO: 3125351 - RNA, 17 nt, Mycobacterium bovis subsp bovis AF2122/97
ccgcguagugcuccguc

SEQ ID NO: 3125352 - RNA, 16 nt, Mycobacterium bovis subsp bovis AF2122/97
ccgcguagugguggaa

SEQ ID NO: 3125353 - RNA, 19 nt, Mycobacterium bovis subsp bovis AF2122/97
ccgcgucaaccgaucgguc

SEQ ID NO: 3125354 - RNA, 22 nt, Mycobacterium bovis subsp bovis AF2122/97
ccgcgucacccguagguaguug

SEQ ID NO: 3125355 - RNA, 12 nt, Mycobacterium bovis subsp bovis AF2122/97
ccgcgucaccgg

SEQ ID NO: 3125356 - RNA, 16 nt, Mycobacterium bovis subsp bovis AF2122/97
ccgcgucaccggaggc

SEQ ID NO: 3125357 - RNA, 20 nt, Mycobacterium bovis subsp bovis AF2122/97
ccgcgucaccggaggccgcc

SEQ ID NO: 3125358 - RNA, 22 nt, Mycobacterium bovis subsp bovis AF2122/97
ccgcgucaccggaggccgccgc

SEQ ID NO: 3125359 - RNA, 22 nt, Mycobacterium bovis subsp bovis AF2122/97
ccgcgucaguccucaucgagcg

SEQ ID NO: 3125360 - RNA, 23 nt, Mycobacterium bovis subsp bovis AF2122/97
ccgcgucaucaccgguacugcga

SEQ ID NO: 3125361 - RNA, 16 nt, Mycobacterium bovis subsp bovis AF2122/97
ccgcguccaaggcgcg

SEQ ID NO: 3125362 - RNA, 17 nt, Mycobacterium bovis subsp bovis AF2122/97
ccgcguccaaggcgcgc

SEQ ID NO: 3125363 - RNA, 14 nt, Mycobacterium bovis subsp bovis AF2122/97
ccgcguccagaccg

SEQ ID NO: 3125364 - RNA, 20 nt, Mycobacterium bovis subsp bovis AF2122/97
ccgcguccgccaauggcgcg

SEQ ID NO: 3125365 - RNA, 16 nt, Mycobacterium bovis subsp bovis AF2122/97
ccgcgucgaacugggc

SEQ ID NO: 3125366 - RNA, 21 nt, Mycobacterium bovis subsp bovis AF2122/97
ccgcgucgaacugggcgcccg

SEQ ID NO: 3125367 - RNA, 22 nt, Mycobacterium bovis subsp bovis AF2122/97
ccgcgucgaacugggcgcccgc

SEQ ID NO: 3125368 - RNA, 18 nt, Mycobacterium bovis subsp bovis AF2122/97
ccgcgucgaagccggggu

SEQ ID NO: 3125369 - RNA, 22 nt, Mycobacterium bovis subsp bovis AF2122/97
ccgcgucgacuacacauucauc

SEQ ID NO: 3125370 - RNA, 16 nt, Mycobacterium bovis subsp bovis AF2122/97
ccgcgucgagugccgc

SEQ ID NO: 3125371 - RNA, 21 nt, Mycobacterium bovis subsp bovis AF2122/97
ccgcgucgagugccgccaccg

SEQ ID NO: 3125372 - RNA, 15 nt, Mycobacterium bovis subsp bovis AF2122/97
ccgcgucgccggccu

SEQ ID NO: 3125373 - RNA, 13 nt, Mycobacterium bovis subsp bovis AF2122/97
ccgcgucgcgggu

SEQ ID NO: 3125374 - RNA, 12 nt, Mycobacterium bovis subsp bovis AF2122/97
ccgcgucggcgg

SEQ ID NO: 3125375 - RNA, 17 nt, Mycobacterium bovis subsp bovis AF2122/97
ccgcgucggcggccagu

SEQ ID NO: 3125376 - RNA, 14 nt, Mycobacterium bovis subsp bovis AF2122/97
ccgcgucggcggcg

SEQ ID NO: 3125377 - RNA, 20 nt, Mycobacterium bovis subsp bovis AF2122/97
ccgcgucggcggcgaccgcc

SEQ ID NO: 3125378 - RNA, 13 nt, Mycobacterium bovis subsp bovis AF2122/97
ccgcgucgggccg

SEQ ID NO: 3125379 - RNA, 14 nt, Mycobacterium bovis subsp bovis AF2122/97
ccgcgucgggccgc

SEQ ID NO: 3125380 - RNA, 15 nt, Mycobacterium bovis subsp bovis AF2122/97
ccgcgucgggccgca

SEQ ID NO: 3125381 - RNA, 17 nt, Mycobacterium bovis subsp bovis AF2122/97
ccgcgucguagccacgc

SEQ ID NO: 3125382 - RNA, 23 nt, Mycobacterium bovis subsp bovis AF2122/97
ccgcgucguagccacgcaugggc

SEQ ID NO: 3125383 - RNA, 14 nt, Mycobacterium bovis subsp bovis AF2122/97
ccgcgucgucgaga

SEQ ID NO: 3125384 - RNA, 22 nt, Mycobacterium bovis subsp bovis AF2122/97
ccgcgucuacgucguccagcac

SEQ ID NO: 3125385 - RNA, 18 nt, Mycobacterium bovis subsp bovis AF2122/97
ccgcgucucggugcagca

SEQ ID NO: 3125386 - RNA, 14 nt, Mycobacterium bovis subsp bovis AF2122/97
ccgcgucuggacgc

SEQ ID NO: 3125387 - RNA, 22 nt, Mycobacterium bovis subsp bovis AF2122/97
ccgcgucuuggugcgcgucagc

SEQ ID NO: 3125388 - RNA, 23 nt, Mycobacterium bovis subsp bovis AF2122/97
ccgcgucuuggugcgcgucagcc

SEQ ID NO: 3125389 - RNA, 13 nt, Mycobacterium bovis subsp bovis AF2122/97
ccgcgugaccgac

SEQ ID NO: 3125390 - RNA, 23 nt, Mycobacterium bovis subsp bovis AF2122/97
ccgcgugacgcuuggccaauaga

SEQ ID NO: 3125391 - RNA, 19 nt, Mycobacterium bovis subsp bovis AF2122/97
ccgcgugacguaccacggc

SEQ ID NO: 3125392 - RNA, 15 nt, Mycobacterium bovis subsp bovis AF2122/97
ccgcgugccgcccgc

SEQ ID NO: 3125393 - RNA, 18 nt, Mycobacterium bovis subsp bovis AF2122/97
ccgcgugcgcaucccgaa

SEQ ID NO: 3125394 - RNA, 14 nt, Mycobacterium bovis subsp bovis AF2122/97
ccgcgugcggggga

SEQ ID NO: 3125395 - RNA, 14 nt, Mycobacterium bovis subsp bovis AF2122/97
ccgcgugcgucagc

SEQ ID NO: 3125396 - RNA, 15 nt, Mycobacterium bovis subsp bovis AF2122/97
ccgcguggccgguca

SEQ ID NO: 3125397 - RNA, 15 nt, Mycobacterium bovis subsp bovis AF2122/97
ccgcguggcuggcgg

SEQ ID NO: 3125398 - RNA, 19 nt, Mycobacterium bovis subsp bovis AF2122/97
ccgcguggugcugaccgcg

SEQ ID NO: 3125399 - RNA, 22 nt, Mycobacterium bovis subsp bovis AF2122/97
ccgcguggugcugaccgcgccg

SEQ ID NO: 3125400 - RNA, 16 nt, Mycobacterium bovis subsp bovis AF2122/97
ccgcguguaccgcgac

SEQ ID NO: 3125401 - RNA, 16 nt, Mycobacterium bovis subsp bovis AF2122/97
ccgcguuaugccaggc

SEQ ID NO: 3125402 - RNA, 15 nt, Mycobacterium bovis subsp bovis AF2122/97
ccgcguucucggcac

SEQ ID NO: 3125403 - RNA, 23 nt, Mycobacterium bovis subsp bovis AF2122/97
ccgcguucugguuguugccgacg

SEQ ID NO: 3125404 - RNA, 13 nt, Mycobacterium bovis subsp bovis AF2122/97
ccgcguugaaggc

SEQ ID NO: 3125405 - RNA, 16 nt, Mycobacterium bovis subsp bovis AF2122/97
ccgcguugaaggcgcc

SEQ ID NO: 3125406 - RNA, 21 nt, Mycobacterium bovis subsp bovis AF2122/97
ccgcguugccaaagcccacac

SEQ ID NO: 3125407 - RNA, 15 nt, Mycobacterium bovis subsp bovis AF2122/97
ccgcguugccggggu

SEQ ID NO: 3125408 - RNA, 21 nt, Mycobacterium bovis subsp bovis AF2122/97
ccgcguuggacaauucgacga

SEQ ID NO: 3125409 - RNA, 13 nt, Mycobacterium bovis subsp bovis AF2122/97
ccgcguuggccac

SEQ ID NO: 3125410 - RNA, 13 nt, Mycobacterium bovis subsp bovis AF2122/97
ccgcguuguccgc

SEQ ID NO: 3125411 - RNA, 19 nt, Mycobacterium bovis subsp bovis AF2122/97
ccgcguuuauaccucgccg

SEQ ID NO: 3125412 - RNA, 20 nt, Mycobacterium bovis subsp bovis AF2122/97
ccgcguuuauaccucgccgc

SEQ ID NO: 3125413 - RNA, 22 nt, Mycobacterium bovis subsp bovis AF2122/97
ccgcguuucgcgacgucugcca

SEQ ID NO: 3125414 - RNA, 23 nt, Mycobacterium bovis subsp bovis AF2122/97
ccgcguuucgcgacgucugccag

SEQ ID NO: 3125415 - RNA, 13 nt, Mycobacterium bovis subsp bovis AF2122/97
ccgcguuugcgaa

SEQ ID NO: 3125416 - RNA, 13 nt, Mycobacterium bovis subsp bovis AF2122/97
ccgcuaacgcacc

SEQ ID NO: 3125417 - RNA, 22 nt, Mycobacterium bovis subsp bovis AF2122/97
ccgcuaacuggcccggacaugc

SEQ ID NO: 3125418 - RNA, 19 nt, Mycobacterium bovis subsp bovis AF2122/97
ccgcuaccaacgcaacacg

SEQ ID NO: 3125419 - RNA, 18 nt, Mycobacterium bovis subsp bovis AF2122/97
ccgcuaccagcugggcga

SEQ ID NO: 3125420 - RNA, 13 nt, Mycobacterium bovis subsp bovis AF2122/97
ccgcuaccccagc

SEQ ID NO: 3125421 - RNA, 20 nt, Mycobacterium bovis subsp bovis AF2122/97
ccgcuaccccagccggcagc

SEQ ID NO: 3125422 - RNA, 18 nt, Mycobacterium bovis subsp bovis AF2122/97
ccgcuaccgcccgcgcca

SEQ ID NO: 3125423 - RNA, 14 nt, Mycobacterium bovis subsp bovis AF2122/97
ccgcuaccgucagu

SEQ ID NO: 3125424 - RNA, 14 nt, Mycobacterium bovis subsp bovis AF2122/97
ccgcuacgccggcc

SEQ ID NO: 3125425 - RNA, 18 nt, Mycobacterium bovis subsp bovis AF2122/97
ccgcuacgcgcgcucgcu

SEQ ID NO: 3125426 - RNA, 19 nt, Mycobacterium bovis subsp bovis AF2122/97
ccgcuacgcgcgcucgcuc

SEQ ID NO: 3125427 - RNA, 21 nt, Mycobacterium bovis subsp bovis AF2122/97
ccgcuacgcgcgcucgcucac

SEQ ID NO: 3125428 - RNA, 16 nt, Mycobacterium bovis subsp bovis AF2122/97
ccgcuacggcagcccg

SEQ ID NO: 3125429 - RNA, 20 nt, Mycobacterium bovis subsp bovis AF2122/97
ccgcuacguuacgccgagau

SEQ ID NO: 3125430 - RNA, 15 nt, Mycobacterium bovis subsp bovis AF2122/97
ccgcuaggacggcgc

SEQ ID NO: 3125431 - RNA, 21 nt, Mycobacterium bovis subsp bovis AF2122/97
ccgcuaggacggcgcgagccg

SEQ ID NO: 3125432 - RNA, 23 nt, Mycobacterium bovis subsp bovis AF2122/97
ccgcuaggaucggauggcggcca

SEQ ID NO: 3125433 - RNA, 18 nt, Mycobacterium bovis subsp bovis AF2122/97
ccgcugaucugccgccgc

SEQ ID NO: 3125434 - RNA, 19 nt, Mycobacterium bovis subsp bovis AF2122/97
ccgcugaucugccgccgcg

SEQ ID NO: 3125435 - RNA, 20 nt, Mycobacterium bovis subsp bovis AF2122/97
ccgcugaucugccgccgcgg

SEQ ID NO: 3125436 - RNA, 16 nt, Mycobacterium bovis subsp bovis AF2122/97
ccgcugaugagccgca

SEQ ID NO: 3125437 - RNA, 23 nt, Mycobacterium bovis subsp bovis AF2122/97
ccgcugaugagccgcagaugcac

SEQ ID NO: 3125438 - RNA, 15 nt, Mycobacterium bovis subsp bovis AF2122/97
ccgcugcacgccguc

SEQ ID NO: 3125439 - RNA, 21 nt, Mycobacterium bovis subsp bovis AF2122/97
ccgcugcagacgccccuuccc

SEQ ID NO: 3125440 - RNA, 19 nt, Mycobacterium bovis subsp bovis AF2122/97
ccgcugcagcaccgcagcg

SEQ ID NO: 3125441 - RNA, 22 nt, Mycobacterium bovis subsp bovis AF2122/97
ccgcugcagugguaccggcgcc

SEQ ID NO: 3125442 - RNA, 15 nt, Mycobacterium bovis subsp bovis AF2122/97
ccgcugccagggugc

SEQ ID NO: 3125443 - RNA, 14 nt, Mycobacterium bovis subsp bovis AF2122/97
ccgcugccaucggc

SEQ ID NO: 3125444 - RNA, 17 nt, Mycobacterium bovis subsp bovis AF2122/97
ccgcugccaugcgggug

SEQ ID NO: 3125445 - RNA, 23 nt, Mycobacterium bovis subsp bovis AF2122/97
ccgcugccaugcgggugucgggc

SEQ ID NO: 3125446 - RNA, 18 nt, Mycobacterium bovis subsp bovis AF2122/97
ccgcugccauugccuggg

SEQ ID NO: 3125447 - RNA, 15 nt, Mycobacterium bovis subsp bovis AF2122/97
ccgcugccgaagcgg

SEQ ID NO: 3125448 - RNA, 18 nt, Mycobacterium bovis subsp bovis AF2122/97
ccgcugccgaagcggcca

SEQ ID NO: 3125449 - RNA, 21 nt, Mycobacterium bovis subsp bovis AF2122/97
ccgcugccgaagcggccaccg

SEQ ID NO: 3125450 - RNA, 12 nt, Mycobacterium bovis subsp bovis AF2122/97
ccgcugccgacg

SEQ ID NO: 3125451 - RNA, 21 nt, Mycobacterium bovis subsp bovis AF2122/97
ccgcugccgaucaguccggcg

SEQ ID NO: 3125452 - RNA, 12 nt, Mycobacterium bovis subsp bovis AF2122/97
ccgcugccgccc

SEQ ID NO: 3125453 - RNA, 14 nt, Mycobacterium bovis subsp bovis AF2122/97
ccgcugccgcccgc

SEQ ID NO: 3125454 - RNA, 16 nt, Mycobacterium bovis subsp bovis AF2122/97
ccgcugccgcccgcgc

SEQ ID NO: 3125455 - RNA, 19 nt, Mycobacterium bovis subsp bovis AF2122/97
ccgcugccgcccuugccgc

SEQ ID NO: 3125456 - RNA, 22 nt, Mycobacterium bovis subsp bovis AF2122/97
ccgcugccgcccuugccgcccg

SEQ ID NO: 3125457 - RNA, 13 nt, Mycobacterium bovis subsp bovis AF2122/97
ccgcugccgccgg

SEQ ID NO: 3125458 - RNA, 17 nt, Mycobacterium bovis subsp bovis AF2122/97
ccgcugccgccugcagg

SEQ ID NO: 3125459 - RNA, 13 nt, Mycobacterium bovis subsp bovis AF2122/97
ccgcugccgcgcg

SEQ ID NO: 3125460 - RNA, 17 nt, Mycobacterium bovis subsp bovis AF2122/97
ccgcugccgcgcggcga

SEQ ID NO: 3125461 - RNA, 14 nt, Mycobacterium bovis subsp bovis AF2122/97
ccgcugccggcacg

SEQ ID NO: 3125462 - RNA, 21 nt, Mycobacterium bovis subsp bovis AF2122/97
ccgcugccggcacgcaugccg

SEQ ID NO: 3125463 - RNA, 14 nt, Mycobacterium bovis subsp bovis AF2122/97
ccgcugccggcagc

SEQ ID NO: 3125464 - RNA, 11 nt, Mycobacterium bovis subsp bovis AF2122/97
ccgcugccggu

SEQ ID NO: 3125465 - RNA, 19 nt, Mycobacterium bovis subsp bovis AF2122/97
ccgcugccgguagcacagc

SEQ ID NO: 3125466 - RNA, 20 nt, Mycobacterium bovis subsp bovis AF2122/97
ccgcugccgguagcacagca

SEQ ID NO: 3125467 - RNA, 18 nt, Mycobacterium bovis subsp bovis AF2122/97
ccgcugccgguggcggcg

SEQ ID NO: 3125468 - RNA, 20 nt, Mycobacterium bovis subsp bovis AF2122/97
ccgcugccgguggcggcggc

SEQ ID NO: 3125469 - RNA, 19 nt, Mycobacterium bovis subsp bovis AF2122/97
ccgcugccggugucucccu

SEQ ID NO: 3125470 - RNA, 14 nt, Mycobacterium bovis subsp bovis AF2122/97
ccgcugccugccgc

SEQ ID NO: 3125471 - RNA, 13 nt, Mycobacterium bovis subsp bovis AF2122/97
ccgcugcgccagg

SEQ ID NO: 3125472 - RNA, 15 nt, Mycobacterium bovis subsp bovis AF2122/97
ccgcugcgccagguc

SEQ ID NO: 3125473 - RNA, 16 nt, Mycobacterium bovis subsp bovis AF2122/97
ccgcugcggcaccacc

SEQ ID NO: 3125474 - RNA, 19 nt, Mycobacterium bovis subsp bovis AF2122/97
ccgcugcggcaccacccgg

SEQ ID NO: 3125475 - RNA, 20 nt, Mycobacterium bovis subsp bovis AF2122/97
ccgcugcggcaccacccggc

SEQ ID NO: 3125476 - RNA, 22 nt, Mycobacterium bovis subsp bovis AF2122/97
ccgcugcggcggcuuuggccgc

SEQ ID NO: 3125477 - RNA, 19 nt, Mycobacterium bovis subsp bovis AF2122/97
ccgcugcggguagccgucg

SEQ ID NO: 3125478 - RNA, 17 nt, Mycobacterium bovis subsp bovis AF2122/97
ccgcugcggugccggcc

SEQ ID NO: 3125479 - RNA, 22 nt, Mycobacterium bovis subsp bovis AF2122/97
ccgcugcggugccggcccugcu

SEQ ID NO: 3125480 - RNA, 20 nt, Mycobacterium bovis subsp bovis AF2122/97
ccgcugcuagugcgggccgu

SEQ ID NO: 3125481 - RNA, 19 nt, Mycobacterium bovis subsp bovis AF2122/97
ccgcugcuccucgcgguag

SEQ ID NO: 3125482 - RNA, 15 nt, Mycobacterium bovis subsp bovis AF2122/97
ccgcugcugcugccc

SEQ ID NO: 3125483 - RNA, 20 nt, Mycobacterium bovis subsp bovis AF2122/97
ccgcugcuugucgaggcgca

SEQ ID NO: 3125484 - RNA, 16 nt, Mycobacterium bovis subsp bovis AF2122/97
ccgcuggacggaucug

SEQ ID NO: 3125485 - RNA, 18 nt, Mycobacterium bovis subsp bovis AF2122/97
ccgcuggagaucacgccg

SEQ ID NO: 3125486 - RNA, 21 nt, Mycobacterium bovis subsp bovis AF2122/97
ccgcuggagaucacgccgacg

SEQ ID NO: 3125487 - RNA, 15 nt, Mycobacterium bovis subsp bovis AF2122/97
ccgcuggaucgcgua

SEQ ID NO: 3125488 - RNA, 16 nt, Mycobacterium bovis subsp bovis AF2122/97
ccgcuggcaaucccgc

SEQ ID NO: 3125489 - RNA, 17 nt, Mycobacterium bovis subsp bovis AF2122/97
ccgcuggccagcacacc

SEQ ID NO: 3125490 - RNA, 13 nt, Mycobacterium bovis subsp bovis AF2122/97
ccgcuggcccgcc

SEQ ID NO: 3125491 - RNA, 15 nt, Mycobacterium bovis subsp bovis AF2122/97
ccgcuggcccgccag

SEQ ID NO: 3125492 - RNA, 20 nt, Mycobacterium bovis subsp bovis AF2122/97
ccgcuggcccgccagaacgg

SEQ ID NO: 3125493 - RNA, 23 nt, Mycobacterium bovis subsp bovis AF2122/97
ccgcuggccguauaggcccgggc

SEQ ID NO: 3125494 - RNA, 14 nt, Mycobacterium bovis subsp bovis AF2122/97
ccgcuggccuccug

SEQ ID NO: 3125495 - RNA, 19 nt, Mycobacterium bovis subsp bovis AF2122/97
ccgcuggcgguaagcgaaa

SEQ ID NO: 3125496 - RNA, 15 nt, Mycobacterium bovis subsp bovis AF2122/97
ccgcugggcucgcug

SEQ ID NO: 3125497 - RNA, 15 nt, Mycobacterium bovis subsp bovis AF2122/97
ccgcuggggcgcccg

SEQ ID NO: 3125498 - RNA, 16 nt, Mycobacterium bovis subsp bovis AF2122/97
ccgcuggggcgcccga

SEQ ID NO: 3125499 - RNA, 11 nt, Mycobacterium bovis subsp bovis AF2122/97
ccgcuggggcu

SEQ ID NO: 3125500 - RNA, 16 nt, Mycobacterium bovis subsp bovis AF2122/97
ccgcugggggcggucg

SEQ ID NO: 3125501 - RNA, 18 nt, Mycobacterium bovis subsp bovis AF2122/97
ccgcugggggcggucgcc

SEQ ID NO: 3125502 - RNA, 15 nt, Mycobacterium bovis subsp bovis AF2122/97
ccgcugggucgaccg

SEQ ID NO: 3125503 - RNA, 17 nt, Mycobacterium bovis subsp bovis AF2122/97
ccgcuggucgagcagug

SEQ ID NO: 3125504 - RNA, 20 nt, Mycobacterium bovis subsp bovis AF2122/97
ccgcuggucgagcagugccu

SEQ ID NO: 3125505 - RNA, 17 nt, Mycobacterium bovis subsp bovis AF2122/97
ccgcuggucgucgaguu

SEQ ID NO: 3125506 - RNA, 13 nt, Mycobacterium bovis subsp bovis AF2122/97
ccgcugguggcgc

SEQ ID NO: 3125507 - RNA, 16 nt, Mycobacterium bovis subsp bovis AF2122/97
ccgcugguggucagca

SEQ ID NO: 3125508 - RNA, 20 nt, Mycobacterium bovis subsp bovis AF2122/97
ccgcugguggucagcaccca

SEQ ID NO: 3125509 - RNA, 13 nt, Mycobacterium bovis subsp bovis AF2122/97
ccgcugguggugc

SEQ ID NO: 3125510 - RNA, 18 nt, Mycobacterium bovis subsp bovis AF2122/97
ccgcuggugguucccgac

SEQ ID NO: 3125511 - RNA, 23 nt, Mycobacterium bovis subsp bovis AF2122/97
ccgcuggugguucccgacaucgu

SEQ ID NO: 3125512 - RNA, 23 nt, Mycobacterium bovis subsp bovis AF2122/97
ccgcuggugugucccggggugaa

SEQ ID NO: 3125513 - RNA, 15 nt, Mycobacterium bovis subsp bovis AF2122/97
ccgcuguaccuccag

SEQ ID NO: 3125514 - RNA, 17 nt, Mycobacterium bovis subsp bovis AF2122/97
ccgcuguaccuccagga

SEQ ID NO: 3125515 - RNA, 14 nt, Mycobacterium bovis subsp bovis AF2122/97
ccgcugucgagccg

SEQ ID NO: 3125516 - RNA, 19 nt, Mycobacterium bovis subsp bovis AF2122/97
ccgcugucgagccggugcc

SEQ ID NO: 3125517 - RNA, 16 nt, Mycobacterium bovis subsp bovis AF2122/97
ccgcugugggucgauc

SEQ ID NO: 3125518 - RNA, 18 nt, Mycobacterium bovis subsp bovis AF2122/97
ccgcuguguucagcgcau

SEQ ID NO: 3125519 - RNA, 19 nt, Mycobacterium bovis subsp bovis AF2122/97
ccgcuguucuuggugacca

SEQ ID NO: 3125520 - RNA, 14 nt, Mycobacterium bovis subsp bovis AF2122/97
ccggaccgaccacc

SEQ ID NO: 3125521 - RNA, 16 nt, Mycobacterium bovis subsp bovis AF2122/97
ccggaccgaccaccgc

SEQ ID NO: 3125522 - RNA, 13 nt, Mycobacterium bovis subsp bovis AF2122/97
ccggaccgcgacg

SEQ ID NO: 3125523 - RNA, 15 nt, Mycobacterium bovis subsp bovis AF2122/97
ccggaccgcgacggc

SEQ ID NO: 3125524 - RNA, 22 nt, Mycobacterium bovis subsp bovis AF2122/97
ccggaccgggggaagcgguagc

SEQ ID NO: 3125525 - RNA, 22 nt, Mycobacterium bovis subsp bovis AF2122/97
ccggaccgguguggcgcaucag

SEQ ID NO: 3125526 - RNA, 16 nt, Mycobacterium bovis subsp bovis AF2122/97
ccggaccgucguggcg

SEQ ID NO: 3125527 - RNA, 14 nt, Mycobacterium bovis subsp bovis AF2122/97
ccggaccugaccgg

SEQ ID NO: 3125528 - RNA, 15 nt, Mycobacterium bovis subsp bovis AF2122/97
ccggaccugaccggu

SEQ ID NO: 3125529 - RNA, 19 nt, Mycobacterium bovis subsp bovis AF2122/97
ccggaccugaccgguggcc

SEQ ID NO: 3125530 - RNA, 17 nt, Mycobacterium bovis subsp bovis AF2122/97
ccggaccuggguggcgu

SEQ ID NO: 3125531 - RNA, 15 nt, Mycobacterium bovis subsp bovis AF2122/97
ccggaccuucggcgg

SEQ ID NO: 3125532 - RNA, 22 nt, Mycobacterium bovis subsp bovis AF2122/97
ccggaccuucggcggugccacc

SEQ ID NO: 3125533 - RNA, 23 nt, Mycobacterium bovis subsp bovis AF2122/97
ccggacgaaacgaucgcgccauc

SEQ ID NO: 3125534 - RNA, 19 nt, Mycobacterium bovis subsp bovis AF2122/97
ccggacgaaaucggcggcg

SEQ ID NO: 3125535 - RNA, 17 nt, Mycobacterium bovis subsp bovis AF2122/97
ccggacgaacgccgucg

SEQ ID NO: 3125536 - RNA, 14 nt, Mycobacterium bovis subsp bovis AF2122/97
ccggacgaccggaa

SEQ ID NO: 3125537 - RNA, 16 nt, Mycobacterium bovis subsp bovis AF2122/97
ccggacgaucagggug

SEQ ID NO: 3125538 - RNA, 17 nt, Mycobacterium bovis subsp bovis AF2122/97
ccggacgaucagggugu

SEQ ID NO: 3125539 - RNA, 12 nt, Mycobacterium bovis subsp bovis AF2122/97
ccggacgauggc

SEQ ID NO: 3125540 - RNA, 17 nt, Mycobacterium bovis subsp bovis AF2122/97
ccggacgcaacacccgg

SEQ ID NO: 3125541 - RNA, 15 nt, Mycobacterium bovis subsp bovis AF2122/97
ccggacgccaugccc

SEQ ID NO: 3125542 - RNA, 17 nt, Mycobacterium bovis subsp bovis AF2122/97
ccggacgccaugcccgc

SEQ ID NO: 3125543 - RNA, 20 nt, Mycobacterium bovis subsp bovis AF2122/97
ccggacgccaugcccgcacg

SEQ ID NO: 3125544 - RNA, 13 nt, Mycobacterium bovis subsp bovis AF2122/97
ccggacgcccuca

SEQ ID NO: 3125545 - RNA, 12 nt, Mycobacterium bovis subsp bovis AF2122/97
ccggacggcagc

SEQ ID NO: 3125546 - RNA, 14 nt, Mycobacterium bovis subsp bovis AF2122/97
ccggacggcagccg

SEQ ID NO: 3125547 - RNA, 15 nt, Mycobacterium bovis subsp bovis AF2122/97
ccggacggcagccgg

SEQ ID NO: 3125548 - RNA, 19 nt, Mycobacterium bovis subsp bovis AF2122/97
ccggacggcagccgggcgg

SEQ ID NO: 3125549 - RNA, 20 nt, Mycobacterium bovis subsp bovis AF2122/97
ccggacggcagccgggcggc

SEQ ID NO: 3125550 - RNA, 23 nt, Mycobacterium bovis subsp bovis AF2122/97
ccggacggcagccgggcggcagc

SEQ ID NO: 3125551 - RNA, 20 nt, Mycobacterium bovis subsp bovis AF2122/97
ccggacgggaguugaucucc

SEQ ID NO: 3125552 - RNA, 14 nt, Mycobacterium bovis subsp bovis AF2122/97
ccggacgggugcgg

SEQ ID NO: 3125553 - RNA, 19 nt, Mycobacterium bovis subsp bovis AF2122/97
ccggacgggugcgggccga

SEQ ID NO: 3125554 - RNA, 20 nt, Mycobacterium bovis subsp bovis AF2122/97
ccggacguaggcaccccggu

SEQ ID NO: 3125555 - RNA, 12 nt, Mycobacterium bovis subsp bovis AF2122/97
ccggacgucggc

SEQ ID NO: 3125556 - RNA, 18 nt, Mycobacterium bovis subsp bovis AF2122/97
ccggacgucggcggccgu

SEQ ID NO: 3125557 - RNA, 16 nt, Mycobacterium bovis subsp bovis AF2122/97
ccggacguucuggauc

SEQ ID NO: 3125558 - RNA, 14 nt, Mycobacterium bovis subsp bovis AF2122/97
ccggacuaccgccg

SEQ ID NO: 3125559 - RNA, 21 nt, Mycobacterium bovis subsp bovis AF2122/97
ccggacuccaaagccgugcca

SEQ ID NO: 3125560 - RNA, 23 nt, Mycobacterium bovis subsp bovis AF2122/97
ccggacugcgaaaauccgugccg

SEQ ID NO: 3125561 - RNA, 14 nt, Mycobacterium bovis subsp bovis AF2122/97
ccggacugcggccc

SEQ ID NO: 3125562 - RNA, 21 nt, Mycobacterium bovis subsp bovis AF2122/97
ccggacugcggcccgacccgg

SEQ ID NO: 3125563 - RNA, 14 nt, Mycobacterium bovis subsp bovis AF2122/97
ccggagacacccgc

SEQ ID NO: 3125564 - RNA, 14 nt, Mycobacterium bovis subsp bovis AF2122/97
ccggagacccgggu

SEQ ID NO: 3125565 - RNA, 17 nt, Mycobacterium bovis subsp bovis AF2122/97
ccggagacccgggugcu

SEQ ID NO: 3125566 - RNA, 16 nt, Mycobacterium bovis subsp bovis AF2122/97
ccggagacgucgccgc

SEQ ID NO: 3125567 - RNA, 12 nt, Mycobacterium bovis subsp bovis AF2122/97
ccggagagccgg

SEQ ID NO: 3125568 - RNA, 19 nt, Mycobacterium bovis subsp bovis AF2122/97
ccggagaucccggucccaa

SEQ ID NO: 3125569 - RNA, 22 nt, Mycobacterium bovis subsp bovis AF2122/97
ccggagaucuugcgcaaugccg

SEQ ID NO: 3125570 - RNA, 21 nt, Mycobacterium bovis subsp bovis AF2122/97
ccggagcccacacgcucacgg

SEQ ID NO: 3125571 - RNA, 19 nt, Mycobacterium bovis subsp bovis AF2122/97
ccggagccccugucaacgc

SEQ ID NO: 3125572 - RNA, 18 nt, Mycobacterium bovis subsp bovis AF2122/97
ccggagccgcccaagccg

SEQ ID NO: 3125573 - RNA, 22 nt, Mycobacterium bovis subsp bovis AF2122/97
ccggagccgcccaagccgccgg

SEQ ID NO: 3125574 - RNA, 17 nt, Mycobacterium bovis subsp bovis AF2122/97
ccggagccgccggcccc

SEQ ID NO: 3125575 - RNA, 23 nt, Mycobacterium bovis subsp bovis AF2122/97
ccggagccgccggccccgccagc

SEQ ID NO: 3125576 - RNA, 23 nt, Mycobacterium bovis subsp bovis AF2122/97
ccggagccgcuacguuacgccga

SEQ ID NO: 3125577 - RNA, 16 nt, Mycobacterium bovis subsp bovis AF2122/97
ccggagccggugccga

SEQ ID NO: 3125578 - RNA, 14 nt, Mycobacterium bovis subsp bovis AF2122/97
ccggagcgccgagc

SEQ ID NO: 3125579 - RNA, 20 nt, Mycobacterium bovis subsp bovis AF2122/97
ccggagcgccgagcucggcg

SEQ ID NO: 3125580 - RNA, 16 nt, Mycobacterium bovis subsp bovis AF2122/97
ccggagcggucagcgg

SEQ ID NO: 3125581 - RNA, 22 nt, Mycobacterium bovis subsp bovis AF2122/97
ccggagcgguguggucgcagga

SEQ ID NO: 3125582 - RNA, 19 nt, Mycobacterium bovis subsp bovis AF2122/97
ccggagcuuguugcagcgg

SEQ ID NO: 3125583 - RNA, 23 nt, Mycobacterium bovis subsp bovis AF2122/97
ccggaggcaagcaaccggugcgc

SEQ ID NO: 3125584 - RNA, 13 nt, Mycobacterium bovis subsp bovis AF2122/97
ccggaggcaaucc

SEQ ID NO: 3125585 - RNA, 20 nt, Mycobacterium bovis subsp bovis AF2122/97
ccggaggcaauccgaucugg

SEQ ID NO: 3125586 - RNA, 14 nt, Mycobacterium bovis subsp bovis AF2122/97
ccggaggccgccgc

SEQ ID NO: 3125587 - RNA, 17 nt, Mycobacterium bovis subsp bovis AF2122/97
ccggaggccgccgcgcc

SEQ ID NO: 3125588 - RNA, 18 nt, Mycobacterium bovis subsp bovis AF2122/97
ccggaggccgccgcgccg

SEQ ID NO: 3125589 - RNA, 19 nt, Mycobacterium bovis subsp bovis AF2122/97
ccggaggccgccgcgccgg

SEQ ID NO: 3125590 - RNA, 22 nt, Mycobacterium bovis subsp bovis AF2122/97
ccggaggguucggacggcuggu

SEQ ID NO: 3125591 - RNA, 13 nt, Mycobacterium bovis subsp bovis AF2122/97
ccggagucgacga

SEQ ID NO: 3125592 - RNA, 15 nt, Mycobacterium bovis subsp bovis AF2122/97
ccggagucgacgacg

SEQ ID NO: 3125593 - RNA, 20 nt, Mycobacterium bovis subsp bovis AF2122/97
ccggagucgcccgguccgcc

SEQ ID NO: 3125594 - RNA, 13 nt, Mycobacterium bovis subsp bovis AF2122/97
ccggagucggcgu

SEQ ID NO: 3125595 - RNA, 14 nt, Mycobacterium bovis subsp bovis AF2122/97
ccggagucggcguc

SEQ ID NO: 3125596 - RNA, 21 nt, Mycobacterium bovis subsp bovis AF2122/97
ccggaguucuguaccggcugg

SEQ ID NO: 3125597 - RNA, 20 nt, Mycobacterium bovis subsp bovis AF2122/97
ccggaguugucgacggccac

SEQ ID NO: 3125598 - RNA, 18 nt, Mycobacterium bovis subsp bovis AF2122/97
ccggaguuuaagacgccc

SEQ ID NO: 3125599 - RNA, 19 nt, Mycobacterium bovis subsp bovis AF2122/97
ccggaguuuaagacgcccg

SEQ ID NO: 3125600 - RNA, 14 nt, Mycobacterium bovis subsp bovis AF2122/97
ccggauaacccagc

SEQ ID NO: 3125601 - RNA, 14 nt, Mycobacterium bovis subsp bovis AF2122/97
ccggauacagccac

SEQ ID NO: 3125602 - RNA, 14 nt, Mycobacterium bovis subsp bovis AF2122/97
ccggauacgggcgu

SEQ ID NO: 3125603 - RNA, 13 nt, Mycobacterium bovis subsp bovis AF2122/97
ccggauagacggc

SEQ ID NO: 3125604 - RNA, 18 nt, Mycobacterium bovis subsp bovis AF2122/97
ccggauagacgugcacca

SEQ ID NO: 3125605 - RNA, 15 nt, Mycobacterium bovis subsp bovis AF2122/97
ccggauagcaccggc

SEQ ID NO: 3125606 - RNA, 17 nt, Mycobacterium bovis subsp bovis AF2122/97
ccggauagcgucuggcg

SEQ ID NO: 3125607 - RNA, 20 nt, Mycobacterium bovis subsp bovis AF2122/97
ccggcacauugaucgacggc

SEQ ID NO: 3125608 - RNA, 16 nt, Mycobacterium bovis subsp bovis AF2122/97
ccggcaccaacgccac

SEQ ID NO: 3125609 - RNA, 19 nt, Mycobacterium bovis subsp bovis AF2122/97
ccggcaccaacgccaccgu

SEQ ID NO: 3125610 - RNA, 22 nt, Mycobacterium bovis subsp bovis AF2122/97
ccggcaccaacgccaccgucgc

SEQ ID NO: 3125611 - RNA, 14 nt, Mycobacterium bovis subsp bovis AF2122/97
ccggcaccacgauc

SEQ ID NO: 3125612 - RNA, 16 nt, Mycobacterium bovis subsp bovis AF2122/97
ccggcaccagcggcac

SEQ ID NO: 3125613 - RNA, 17 nt, Mycobacterium bovis subsp bovis AF2122/97
ccggcaccagcggcacc

SEQ ID NO: 3125614 - RNA, 13 nt, Mycobacterium bovis subsp bovis AF2122/97
ccggcacccacca

SEQ ID NO: 3125615 - RNA, 18 nt, Mycobacterium bovis subsp bovis AF2122/97
ccggcacccaccagugca

SEQ ID NO: 3125616 - RNA, 18 nt, Mycobacterium bovis subsp bovis AF2122/97
ccggcaccccacggccag

SEQ ID NO: 3125617 - RNA, 21 nt, Mycobacterium bovis subsp bovis AF2122/97
ccggcacccccgucgccaccg

SEQ ID NO: 3125618 - RNA, 13 nt, Mycobacterium bovis subsp bovis AF2122/97
ccggcacccgcac

SEQ ID NO: 3125619 - RNA, 17 nt, Mycobacterium bovis subsp bovis AF2122/97
ccggcacccgccgugcc

SEQ ID NO: 3125620 - RNA, 14 nt, Mycobacterium bovis subsp bovis AF2122/97
ccggcacccgcugg

SEQ ID NO: 3125621 - RNA, 12 nt, Mycobacterium bovis subsp bovis AF2122/97
ccggcacccggu

SEQ ID NO: 3125622 - RNA, 14 nt, Mycobacterium bovis subsp bovis AF2122/97
ccggcacccgucgg

SEQ ID NO: 3125623 - RNA, 17 nt, Mycobacterium bovis subsp bovis AF2122/97
ccggcacccgucgggug

SEQ ID NO: 3125624 - RNA, 13 nt, Mycobacterium bovis subsp bovis AF2122/97
ccggcaccgacac

SEQ ID NO: 3125625 - RNA, 18 nt, Mycobacterium bovis subsp bovis AF2122/97
ccggcaccgccagugccc

SEQ ID NO: 3125626 - RNA, 12 nt, Mycobacterium bovis subsp bovis AF2122/97
ccggcaccgccg

SEQ ID NO: 3125627 - RNA, 15 nt, Mycobacterium bovis subsp bovis AF2122/97
ccggcaccgccgccc

SEQ ID NO: 3125628 - RNA, 13 nt, Mycobacterium bovis subsp bovis AF2122/97
ccggcaccgccgg

SEQ ID NO: 3125629 - RNA, 14 nt, Mycobacterium bovis subsp bovis AF2122/97
ccggcaccgccggc

SEQ ID NO: 3125630 - RNA, 15 nt, Mycobacterium bovis subsp bovis AF2122/97
ccggcaccgccggca

SEQ ID NO: 3125631 - RNA, 18 nt, Mycobacterium bovis subsp bovis AF2122/97
ccggcaccgccggcgcca

SEQ ID NO: 3125632 - RNA, 15 nt, Mycobacterium bovis subsp bovis AF2122/97
ccggcaccgccggcu

SEQ ID NO: 3125633 - RNA, 14 nt, Mycobacterium bovis subsp bovis AF2122/97
ccggcaccgccggu

SEQ ID NO: 3125634 - RNA, 17 nt, Mycobacterium bovis subsp bovis AF2122/97
ccggcaccgccgguggc

SEQ ID NO: 3125635 - RNA, 12 nt, Mycobacterium bovis subsp bovis AF2122/97
ccggcaccgcgu

SEQ ID NO: 3125636 - RNA, 19 nt, Mycobacterium bovis subsp bovis AF2122/97
ccggcaccgcugccgcugc

SEQ ID NO: 3125637 - RNA, 22 nt, Mycobacterium bovis subsp bovis AF2122/97
ccggcaccgcugccgcugccga

SEQ ID NO: 3125638 - RNA, 13 nt, Mycobacterium bovis subsp bovis AF2122/97
ccggcaccggaug

SEQ ID NO: 3125639 - RNA, 12 nt, Mycobacterium bovis subsp bovis AF2122/97
ccggcaccggcc

SEQ ID NO: 3125640 - RNA, 18 nt, Mycobacterium bovis subsp bovis AF2122/97
ccggcaccggccgugccg

SEQ ID NO: 3125641 - RNA, 19 nt, Mycobacterium bovis subsp bovis AF2122/97
ccggcaccggccgugccgc

SEQ ID NO: 3125642 - RNA, 14 nt, Mycobacterium bovis subsp bovis AF2122/97
ccggcaccggggcu

SEQ ID NO: 3125643 - RNA, 21 nt, Mycobacterium bovis subsp bovis AF2122/97
ccggcaccguagagcaugccg

SEQ ID NO: 3125644 - RNA, 17 nt, Mycobacterium bovis subsp bovis AF2122/97
ccggcaccuccagcacc

SEQ ID NO: 3125645 - RNA, 19 nt, Mycobacterium bovis subsp bovis AF2122/97
ccggcaccuccagcaccac

SEQ ID NO: 3125646 - RNA, 20 nt, Mycobacterium bovis subsp bovis AF2122/97
ccggcaccuccagcaccacc

SEQ ID NO: 3125647 - RNA, 18 nt, Mycobacterium bovis subsp bovis AF2122/97
ccggcacgaaucccccgg

SEQ ID NO: 3125648 - RNA, 18 nt, Mycobacterium bovis subsp bovis AF2122/97
ccggcacgaccaccggau

SEQ ID NO: 3125649 - RNA, 17 nt, Mycobacterium bovis subsp bovis AF2122/97
ccggcacgaccgcuccc

SEQ ID NO: 3125650 - RNA, 14 nt, Mycobacterium bovis subsp bovis AF2122/97
ccggcacgcagcca

SEQ ID NO: 3125651 - RNA, 15 nt, Mycobacterium bovis subsp bovis AF2122/97
ccggcacgcaugccg

SEQ ID NO: 3125652 - RNA, 19 nt, Mycobacterium bovis subsp bovis AF2122/97
ccggcacgccgaccggugg

SEQ ID NO: 3125653 - RNA, 13 nt, Mycobacterium bovis subsp bovis AF2122/97
ccggcacgccggc

SEQ ID NO: 3125654 - RNA, 15 nt, Mycobacterium bovis subsp bovis AF2122/97
ccggcacgccggcgg

SEQ ID NO: 3125655 - RNA, 20 nt, Mycobacterium bovis subsp bovis AF2122/97
ccggcacgccggcggcggag

SEQ ID NO: 3125656 - RNA, 14 nt, Mycobacterium bovis subsp bovis AF2122/97
ccggcacgcgcgcu

SEQ ID NO: 3125657 - RNA, 17 nt, Mycobacterium bovis subsp bovis AF2122/97
ccggcacgggcggggac

SEQ ID NO: 3125658 - RNA, 13 nt, Mycobacterium bovis subsp bovis AF2122/97
ccggcacgggcgu

SEQ ID NO: 3125659 - RNA, 19 nt, Mycobacterium bovis subsp bovis AF2122/97
ccggcacgggcgucgucgg

SEQ ID NO: 3125660 - RNA, 19 nt, Mycobacterium bovis subsp bovis AF2122/97
ccggcacggugucgcgcga

SEQ ID NO: 3125661 - RNA, 14 nt, Mycobacterium bovis subsp bovis AF2122/97
ccggcacgucgccc

SEQ ID NO: 3125662 - RNA, 20 nt, Mycobacterium bovis subsp bovis AF2122/97
ccggcacgucgcccccggcc

SEQ ID NO: 3125663 - RNA, 16 nt, Mycobacterium bovis subsp bovis AF2122/97
ccggcacugaccgcga

SEQ ID NO: 3125664 - RNA, 14 nt, Mycobacterium bovis subsp bovis AF2122/97
ccggcacugcccag

SEQ ID NO: 3125665 - RNA, 16 nt, Mycobacterium bovis subsp bovis AF2122/97
ccggcacugcccagca

SEQ ID NO: 3125666 - RNA, 17 nt, Mycobacterium bovis subsp bovis AF2122/97
ccggcacugcccagcag

SEQ ID NO: 3125667 - RNA, 21 nt, Mycobacterium bovis subsp bovis AF2122/97
ccggcacugcccagcagacca

SEQ ID NO: 3125668 - RNA, 16 nt, Mycobacterium bovis subsp bovis AF2122/97
ccggcacugccgagca

SEQ ID NO: 3125669 - RNA, 20 nt, Mycobacterium bovis subsp bovis AF2122/97
ccggcacugccgagcacgac

SEQ ID NO: 3125670 - RNA, 16 nt, Mycobacterium bovis subsp bovis AF2122/97
ccggcacugcggccag

SEQ ID NO: 3125671 - RNA, 14 nt, Mycobacterium bovis subsp bovis AF2122/97
ccggcagaccggug

SEQ ID NO: 3125672 - RNA, 14 nt, Mycobacterium bovis subsp bovis AF2122/97
ccggcagagcacgc

SEQ ID NO: 3125673 - RNA, 18 nt, Mycobacterium bovis subsp bovis AF2122/97
ccggcagaugcagcgggu

SEQ ID NO: 3125674 - RNA, 19 nt, Mycobacterium bovis subsp bovis AF2122/97
ccggcagaugcagcggguc

SEQ ID NO: 3125675 - RNA, 21 nt, Mycobacterium bovis subsp bovis AF2122/97
ccggcagaugcagcgggucgc

SEQ ID NO: 3125676 - RNA, 22 nt, Mycobacterium bovis subsp bovis AF2122/97
ccggcagaugcagcgggucgcc

SEQ ID NO: 3125677 - RNA, 18 nt, Mycobacterium bovis subsp bovis AF2122/97
ccggcagauguguccggc

SEQ ID NO: 3125678 - RNA, 22 nt, Mycobacterium bovis subsp bovis AF2122/97
ccggcagauguguccggcaucg

SEQ ID NO: 3125679 - RNA, 16 nt, Mycobacterium bovis subsp bovis AF2122/97
ccggcagcagccggcg

SEQ ID NO: 3125680 - RNA, 17 nt, Mycobacterium bovis subsp bovis AF2122/97
ccggcagcagccggcgg

SEQ ID NO: 3125681 - RNA, 20 nt, Mycobacterium bovis subsp bovis AF2122/97
ccggcagcagccggcgggcc

SEQ ID NO: 3125682 - RNA, 20 nt, Mycobacterium bovis subsp bovis AF2122/97
ccggcagcagcgggcgcgcu

SEQ ID NO: 3125683 - RNA, 21 nt, Mycobacterium bovis subsp bovis AF2122/97
ccggcagcaucggcaccccgg

SEQ ID NO: 3125684 - RNA, 14 nt, Mycobacterium bovis subsp bovis AF2122/97
ccggcagccagacu

SEQ ID NO: 3125685 - RNA, 19 nt, Mycobacterium bovis subsp bovis AF2122/97
ccggcagcccggcggccgc

SEQ ID NO: 3125686 - RNA, 18 nt, Mycobacterium bovis subsp bovis AF2122/97
ccggcagcgagacuucga

SEQ ID NO: 3125687 - RNA, 22 nt, Mycobacterium bovis subsp bovis AF2122/97
ccggcagcgagacuucgacgcg

SEQ ID NO: 3125688 - RNA, 24 nt, Mycobacterium bovis subsp bovis AF2122/97
ccggcagcgagacuucgacgcggc

SEQ ID NO: 3125689 - RNA, 15 nt, Mycobacterium bovis subsp bovis AF2122/97
ccggcagcgaugcgg

SEQ ID NO: 3125690 - RNA, 13 nt, Mycobacterium bovis subsp bovis AF2122/97
ccggcagcgcccu

SEQ ID NO: 3125691 - RNA, 20 nt, Mycobacterium bovis subsp bovis AF2122/97
ccggcagcgcgaucgauucc

SEQ ID NO: 3125692 - RNA, 20 nt, Mycobacterium bovis subsp bovis AF2122/97
ccggcagcgguaagcgcauc

SEQ ID NO: 3125693 - RNA, 13 nt, Mycobacterium bovis subsp bovis AF2122/97
ccggcagcguccg

SEQ ID NO: 3125694 - RNA, 20 nt, Mycobacterium bovis subsp bovis AF2122/97
ccggccacuacggccuggcc

SEQ ID NO: 3125695 - RNA, 16 nt, Mycobacterium bovis subsp bovis AF2122/97
ccggccacuccaguac

SEQ ID NO: 3125696 - RNA, 22 nt, Mycobacterium bovis subsp bovis AF2122/97
ccggccacuccaguacgguccg

SEQ ID NO: 3125697 - RNA, 19 nt, Mycobacterium bovis subsp bovis AF2122/97
ccggccacuccaugagccg

SEQ ID NO: 3125698 - RNA, 19 nt, Mycobacterium bovis subsp bovis AF2122/97
ccggccagacucgcggucg

SEQ ID NO: 3125699 - RNA, 13 nt, Mycobacterium bovis subsp bovis AF2122/97
ccggccagccagc

SEQ ID NO: 3125700 - RNA, 18 nt, Mycobacterium bovis subsp bovis AF2122/97
ccggccagccagcgaucc

SEQ ID NO: 3125701 - RNA, 13 nt, Mycobacterium bovis subsp bovis AF2122/97
ccggccagccgac

SEQ ID NO: 3125702 - RNA, 16 nt, Mycobacterium bovis subsp bovis AF2122/97
ccggccagccgcacgg

SEQ ID NO: 3125703 - RNA, 21 nt, Mycobacterium bovis subsp bovis AF2122/97
ccggccagccgcacgguugcc

SEQ ID NO: 3125704 - RNA, 15 nt, Mycobacterium bovis subsp bovis AF2122/97
ccggccagccgcggc

SEQ ID NO: 3125705 - RNA, 13 nt, Mycobacterium bovis subsp bovis AF2122/97
ccggccagccuca

SEQ ID NO: 3125706 - RNA, 16 nt, Mycobacterium bovis subsp bovis AF2122/97
ccggccagcggcccgu

SEQ ID NO: 3125707 - RNA, 19 nt, Mycobacterium bovis subsp bovis AF2122/97
ccggccagcggcccgucac

SEQ ID NO: 3125708 - RNA, 22 nt, Mycobacterium bovis subsp bovis AF2122/97
ccggccagcgucgcaaggcccg

SEQ ID NO: 3125709 - RNA, 23 nt, Mycobacterium bovis subsp bovis AF2122/97
ccggccagcuccucagccaccgc

SEQ ID NO: 3125710 - RNA, 17 nt, Mycobacterium bovis subsp bovis AF2122/97
ccggccagcugcguggc

SEQ ID NO: 3125711 - RNA, 13 nt, Mycobacterium bovis subsp bovis AF2122/97
ccggccaggccga

SEQ ID NO: 3125712 - RNA, 16 nt, Mycobacterium bovis subsp bovis AF2122/97
ccggccaggccgacaa

SEQ ID NO: 3125713 - RNA, 13 nt, Mycobacterium bovis subsp bovis AF2122/97
ccggccaggccgg

SEQ ID NO: 3125714 - RNA, 15 nt, Mycobacterium bovis subsp bovis AF2122/97
ccggccaggccggcg

SEQ ID NO: 3125715 - RNA, 20 nt, Mycobacterium bovis subsp bovis AF2122/97
ccggccaggccggcggcggc

SEQ ID NO: 3125716 - RNA, 17 nt, Mycobacterium bovis subsp bovis AF2122/97
ccggccaggggcgcagc

SEQ ID NO: 3125717 - RNA, 18 nt, Mycobacterium bovis subsp bovis AF2122/97
ccggccagguauguccgc

SEQ ID NO: 3125718 - RNA, 17 nt, Mycobacterium bovis subsp bovis AF2122/97
ccggccaggucgacacc

SEQ ID NO: 3125719 - RNA, 18 nt, Mycobacterium bovis subsp bovis AF2122/97
ccggccaggucgacaccg

SEQ ID NO: 3125720 - RNA, 22 nt, Mycobacterium bovis subsp bovis AF2122/97
ccggccaggucgacaccgcggu

SEQ ID NO: 3125721 - RNA, 15 nt, Mycobacterium bovis subsp bovis AF2122/97
ccggccaggucgcga

SEQ ID NO: 3125722 - RNA, 16 nt, Mycobacterium bovis subsp bovis AF2122/97
ccggccaggugacguu

SEQ ID NO: 3125723 - RNA, 16 nt, Mycobacterium bovis subsp bovis AF2122/97
ccggccaguccgcgcg

SEQ ID NO: 3125724 - RNA, 15 nt, Mycobacterium bovis subsp bovis AF2122/97
ccggccauacgcgcg

SEQ ID NO: 3125725 - RNA, 16 nt, Mycobacterium bovis subsp bovis AF2122/97
ccggccauacgcgcgc

SEQ ID NO: 3125726 - RNA, 14 nt, Mycobacterium bovis subsp bovis AF2122/97
ccggccaucgcccg

SEQ ID NO: 3125727 - RNA, 14 nt, Mycobacterium bovis subsp bovis AF2122/97
ccggccaucuugag

SEQ ID NO: 3125728 - RNA, 16 nt, Mycobacterium bovis subsp bovis AF2122/97
ccggccaugugcacgg

SEQ ID NO: 3125729 - RNA, 20 nt, Mycobacterium bovis subsp bovis AF2122/97
ccggccauucuuggugaucg

SEQ ID NO: 3125730 - RNA, 21 nt, Mycobacterium bovis subsp bovis AF2122/97
ccggccauugcgggcucaaca

SEQ ID NO: 3125731 - RNA, 12 nt, Mycobacterium bovis subsp bovis AF2122/97
ccggcccaagga

SEQ ID NO: 3125732 - RNA, 20 nt, Mycobacterium bovis subsp bovis AF2122/97
ccggcccaaggaacggcguc

SEQ ID NO: 3125733 - RNA, 21 nt, Mycobacterium bovis subsp bovis AF2122/97
ccggcccaaggaacggcgucg

SEQ ID NO: 3125734 - RNA, 12 nt, Mycobacterium bovis subsp bovis AF2122/97
ccggcccaccag

SEQ ID NO: 3125735 - RNA, 13 nt, Mycobacterium bovis subsp bovis AF2122/97
ccggcccaccagc

SEQ ID NO: 3125736 - RNA, 18 nt, Mycobacterium bovis subsp bovis AF2122/97
ccggcccaccagcgcagc

SEQ ID NO: 3125737 - RNA, 15 nt, Mycobacterium bovis subsp bovis AF2122/97
ccggcccaccaggcc

SEQ ID NO: 3125738 - RNA, 13 nt, Mycobacterium bovis subsp bovis AF2122/97
ccggcccaccgac

SEQ ID NO: 3125739 - RNA, 15 nt, Mycobacterium bovis subsp bovis AF2122/97
ccggcccaccggucg

SEQ ID NO: 3125740 - RNA, 16 nt, Mycobacterium bovis subsp bovis AF2122/97
ccggcccaccggucgc

SEQ ID NO: 3125741 - RNA, 24 nt, Mycobacterium bovis subsp bovis AF2122/97
ccggcccacucacacaaccgacgg

SEQ ID NO: 3125742 - RNA, 13 nt, Mycobacterium bovis subsp bovis AF2122/97
ccggcccagcgcc

SEQ ID NO: 3125743 - RNA, 12 nt, Mycobacterium bovis subsp bovis AF2122/97
ccggcccagugg

SEQ ID NO: 3125744 - RNA, 21 nt, Mycobacterium bovis subsp bovis AF2122/97
ccggcccaucuucggacgcca

SEQ ID NO: 3125745 - RNA, 23 nt, Mycobacterium bovis subsp bovis AF2122/97
ccggcccaucuucggacgccagc

SEQ ID NO: 3125746 - RNA, 21 nt, Mycobacterium bovis subsp bovis AF2122/97
ccggccccaccgacagcccca

SEQ ID NO: 3125747 - RNA, 14 nt, Mycobacterium bovis subsp bovis AF2122/97
ccggccccaccggc

SEQ ID NO: 3125748 - RNA, 21 nt, Mycobacterium bovis subsp bovis AF2122/97
ccggccccaccgguaccgcca

SEQ ID NO: 3125749 - RNA, 18 nt, Mycobacterium bovis subsp bovis AF2122/97
ccggcccccgacuccggc

SEQ ID NO: 3125750 - RNA, 13 nt, Mycobacterium bovis subsp bovis AF2122/97
ccggccccgacgg

SEQ ID NO: 3125751 - RNA, 17 nt, Mycobacterium bovis subsp bovis AF2122/97
ccggccccgcaagcgga

SEQ ID NO: 3125752 - RNA, 18 nt, Mycobacterium bovis subsp bovis AF2122/97
ccggccccgcaagcggau

SEQ ID NO: 3125753 - RNA, 16 nt, Mycobacterium bovis subsp bovis AF2122/97
ccggccccgccagcgc

SEQ ID NO: 3125754 - RNA, 18 nt, Mycobacterium bovis subsp bovis AF2122/97
ccggccccgccagcgccg

SEQ ID NO: 3125755 - RNA, 19 nt, Mycobacterium bovis subsp bovis AF2122/97
ccggccccgccagcgccgc

SEQ ID NO: 3125756 - RNA, 14 nt, Mycobacterium bovis subsp bovis AF2122/97
ccggccccgcccgc

SEQ ID NO: 3125757 - RNA, 13 nt, Mycobacterium bovis subsp bovis AF2122/97
ccggccccgccgc

SEQ ID NO: 3125758 - RNA, 16 nt, Mycobacterium bovis subsp bovis AF2122/97
ccggccccgccggccc

SEQ ID NO: 3125759 - RNA, 17 nt, Mycobacterium bovis subsp bovis AF2122/97
ccggccccgccggcccc

SEQ ID NO: 3125760 - RNA, 18 nt, Mycobacterium bovis subsp bovis AF2122/97
ccggccccgccggccccg

SEQ ID NO: 3125761 - RNA, 16 nt, Mycobacterium bovis subsp bovis AF2122/97
ccggccccgccggcgc

SEQ ID NO: 3125762 - RNA, 19 nt, Mycobacterium bovis subsp bovis AF2122/97
ccggccccgccggcgccgc

SEQ ID NO: 3125763 - RNA, 21 nt, Mycobacterium bovis subsp bovis AF2122/97
ccggccccgccggcgccgccc

SEQ ID NO: 3125764 - RNA, 14 nt, Mycobacterium bovis subsp bovis AF2122/97
ccggccccgccguc

SEQ ID NO: 3125765 - RNA, 20 nt, Mycobacterium bovis subsp bovis AF2122/97
ccggccccgccgucaccccc

SEQ ID NO: 3125766 - RNA, 21 nt, Mycobacterium bovis subsp bovis AF2122/97
ccggccccgccgucaccgccg

SEQ ID NO: 3125767 - RNA, 23 nt, Mycobacterium bovis subsp bovis AF2122/97
ccggccccgccgucgccgccggc

SEQ ID NO: 3125768 - RNA, 22 nt, Mycobacterium bovis subsp bovis AF2122/97
ccggccccgcggccagcaccgg

SEQ ID NO: 3125769 - RNA, 23 nt, Mycobacterium bovis subsp bovis AF2122/97
ccggccccgggggaagcgccaaa

SEQ ID NO: 3125770 - RNA, 14 nt, Mycobacterium bovis subsp bovis AF2122/97
ccggccccgucguc

SEQ ID NO: 3125771 - RNA, 12 nt, Mycobacterium bovis subsp bovis AF2122/97
ccggcccgacgg

SEQ ID NO: 3125772 - RNA, 14 nt, Mycobacterium bovis subsp bovis AF2122/97
ccggcccgaucggc

SEQ ID NO: 3125773 - RNA, 14 nt, Mycobacterium bovis subsp bovis AF2122/97
ccggcccgaugccg

SEQ ID NO: 3125774 - RNA, 15 nt, Mycobacterium bovis subsp bovis AF2122/97
ccggcccgcagcagc

SEQ ID NO: 3125775 - RNA, 19 nt, Mycobacterium bovis subsp bovis AF2122/97
ccggcccgcauccgcaccg

SEQ ID NO: 3125776 - RNA, 13 nt, Mycobacterium bovis subsp bovis AF2122/97
ccggcccgccacc

SEQ ID NO: 3125777 - RNA, 14 nt, Mycobacterium bovis subsp bovis AF2122/97
ccggcccgccaccc

SEQ ID NO: 3125778 - RNA, 16 nt, Mycobacterium bovis subsp bovis AF2122/97
ccggcccgccaccccg

SEQ ID NO: 3125779 - RNA, 13 nt, Mycobacterium bovis subsp bovis AF2122/97
ccggcccgcccgu

SEQ ID NO: 3125780 - RNA, 14 nt, Mycobacterium bovis subsp bovis AF2122/97
ccggcccggcucgg

SEQ ID NO: 3125781 - RNA, 20 nt, Mycobacterium bovis subsp bovis AF2122/97
ccggccucgccgaagcgggc

SEQ ID NO: 3125782 - RNA, 15 nt, Mycobacterium bovis subsp bovis AF2122/97
ccggccucgccgggg

SEQ ID NO: 3125783 - RNA, 15 nt, Mycobacterium bovis subsp bovis AF2122/97
ccggccucuggauca

SEQ ID NO: 3125784 - RNA, 12 nt, Mycobacterium bovis subsp bovis AF2122/97
ccggccugcacg

SEQ ID NO: 3125785 - RNA, 22 nt, Mycobacterium bovis subsp bovis AF2122/97
ccggccugcgcgaccgaccagc

SEQ ID NO: 3125786 - RNA, 23 nt, Mycobacterium bovis subsp bovis AF2122/97
ccggccugcgcgaccgaccagcc

SEQ ID NO: 3125787 - RNA, 15 nt, Mycobacterium bovis subsp bovis AF2122/97
ccggccugcucggcg

SEQ ID NO: 3125788 - RNA, 15 nt, Mycobacterium bovis subsp bovis AF2122/97
ccggccugucccgca

SEQ ID NO: 3125789 - RNA, 16 nt, Mycobacterium bovis subsp bovis AF2122/97
ccggccugucccgcac

SEQ ID NO: 3125790 - RNA, 22 nt, Mycobacterium bovis subsp bovis AF2122/97
ccggccuuauucacccgguagg

SEQ ID NO: 3125791 - RNA, 12 nt, Mycobacterium bovis subsp bovis AF2122/97
ccggccuucucg

SEQ ID NO: 3125792 - RNA, 16 nt, Mycobacterium bovis subsp bovis AF2122/97
ccggccuucucgccgu

SEQ ID NO: 3125793 - RNA, 16 nt, Mycobacterium bovis subsp bovis AF2122/97
ccggccuugccaccgg

SEQ ID NO: 3125794 - RNA, 14 nt, Mycobacterium bovis subsp bovis AF2122/97
ccggccuugccgcc

SEQ ID NO: 3125795 - RNA, 18 nt, Mycobacterium bovis subsp bovis AF2122/97
ccggccuugccgccggcc

SEQ ID NO: 3125796 - RNA, 20 nt, Mycobacterium bovis subsp bovis AF2122/97
ccggccuugccgccggcgcc

SEQ ID NO: 3125797 - RNA, 22 nt, Mycobacterium bovis subsp bovis AF2122/97
ccggccuugccgccggcgccgc

SEQ ID NO: 3125798 - RNA, 17 nt, Mycobacterium bovis subsp bovis AF2122/97
ccggccuuggcggcggc

SEQ ID NO: 3125799 - RNA, 19 nt, Mycobacterium bovis subsp bovis AF2122/97
ccggccuuuacccgggcgg

SEQ ID NO: 3125800 - RNA, 21 nt, Mycobacterium bovis subsp bovis AF2122/97
ccggccuuuacccgggcggcg

SEQ ID NO: 3125801 - RNA, 17 nt, Mycobacterium bovis subsp bovis AF2122/97
ccggccuuuccagcacc

SEQ ID NO: 3125802 - RNA, 22 nt, Mycobacterium bovis subsp bovis AF2122/97
ccggcgaaaagacugcgccgcc

SEQ ID NO: 3125803 - RNA, 19 nt, Mycobacterium bovis subsp bovis AF2122/97
ccggcgaacaggcgaccgg

SEQ ID NO: 3125804 - RNA, 15 nt, Mycobacterium bovis subsp bovis AF2122/97
ccggcgaaccccagc

SEQ ID NO: 3125805 - RNA, 17 nt, Mycobacterium bovis subsp bovis AF2122/97
ccggcgaacucgcgccg

SEQ ID NO: 3125806 - RNA, 15 nt, Mycobacterium bovis subsp bovis AF2122/97
ccggcgaacugcgau

SEQ ID NO: 3125807 - RNA, 19 nt, Mycobacterium bovis subsp bovis AF2122/97
ccggcgaagaccgccggga

SEQ ID NO: 3125808 - RNA, 15 nt, Mycobacterium bovis subsp bovis AF2122/97
ccggcgaagccggcc

SEQ ID NO: 3125809 - RNA, 16 nt, Mycobacterium bovis subsp bovis AF2122/97
ccggcgaaggccagca

SEQ ID NO: 3125810 - RNA, 15 nt, Mycobacterium bovis subsp bovis AF2122/97
ccggcgaauacgacc

SEQ ID NO: 3125811 - RNA, 20 nt, Mycobacterium bovis subsp bovis AF2122/97
ccggcgaauacgaccgucgc

SEQ ID NO: 3125812 - RNA, 22 nt, Mycobacterium bovis subsp bovis AF2122/97
ccggcgaauacgaccgucgcgc

SEQ ID NO: 3125813 - RNA, 23 nt, Mycobacterium bovis subsp bovis AF2122/97
ccggcgaauacgaccgucgcgcu

SEQ ID NO: 3125814 - RNA, 22 nt, Mycobacterium bovis subsp bovis AF2122/97
ccggcgaauccgcacagguccg

SEQ ID NO: 3125815 - RNA, 18 nt, Mycobacterium bovis subsp bovis AF2122/97
ccggcgaaugcgguccuc

SEQ ID NO: 3125816 - RNA, 15 nt, Mycobacterium bovis subsp bovis AF2122/97
ccggcgacaccgcag

SEQ ID NO: 3125817 - RNA, 17 nt, Mycobacterium bovis subsp bovis AF2122/97
ccggcgacaccgcaggu

SEQ ID NO: 3125818 - RNA, 19 nt, Mycobacterium bovis subsp bovis AF2122/97
ccggcgaccaaggccgacc

SEQ ID NO: 3125819 - RNA, 14 nt, Mycobacterium bovis subsp bovis AF2122/97
ccggcgaccacggc

SEQ ID NO: 3125820 - RNA, 13 nt, Mycobacterium bovis subsp bovis AF2122/97
ccggcgacccggg

SEQ ID NO: 3125821 - RNA, 14 nt, Mycobacterium bovis subsp bovis AF2122/97
ccggcgacccgggu

SEQ ID NO: 3125822 - RNA, 14 nt, Mycobacterium bovis subsp bovis AF2122/97
ccggcgaccgacgg

SEQ ID NO: 3125823 - RNA, 14 nt, Mycobacterium bovis subsp bovis AF2122/97
ccggcgaccgggau

SEQ ID NO: 3125824 - RNA, 13 nt, Mycobacterium bovis subsp bovis AF2122/97
ccggcgaccgggc

SEQ ID NO: 3125825 - RNA, 15 nt, Mycobacterium bovis subsp bovis AF2122/97
ccggcgacgacccgg

SEQ ID NO: 3125826 - RNA, 19 nt, Mycobacterium bovis subsp bovis AF2122/97
ccggcgacgacccgggucg

SEQ ID NO: 3125827 - RNA, 22 nt, Mycobacterium bovis subsp bovis AF2122/97
ccggcgacgauauagggcuccu

SEQ ID NO: 3125828 - RNA, 19 nt, Mycobacterium bovis subsp bovis AF2122/97
ccggcgacgaucucgccgc

SEQ ID NO: 3125829 - RNA, 21 nt, Mycobacterium bovis subsp bovis AF2122/97
ccggcgacgaucucgccgcca

SEQ ID NO: 3125830 - RNA, 20 nt, Mycobacterium bovis subsp bovis AF2122/97
ccggcgacgcuaccgccgga

SEQ ID NO: 3125831 - RNA, 17 nt, Mycobacterium bovis subsp bovis AF2122/97
ccggcgacgggucgggc

SEQ ID NO: 3125832 - RNA, 21 nt, Mycobacterium bovis subsp bovis AF2122/97
ccggcgacucugugacgggca

SEQ ID NO: 3125833 - RNA, 22 nt, Mycobacterium bovis subsp bovis AF2122/97
ccggcgagagcgucaaccacgg

SEQ ID NO: 3125834 - RNA, 22 nt, Mycobacterium bovis subsp bovis AF2122/97
ccggcgagcacccgcuggucga

SEQ ID NO: 3125835 - RNA, 13 nt, Mycobacterium bovis subsp bovis AF2122/97
ccggcgagcaggc

SEQ ID NO: 3125836 - RNA, 15 nt, Mycobacterium bovis subsp bovis AF2122/97
ccggcgagcaggccg

SEQ ID NO: 3125837 - RNA, 16 nt, Mycobacterium bovis subsp bovis AF2122/97
ccggcgagcaggccgu

SEQ ID NO: 3125838 - RNA, 14 nt, Mycobacterium bovis subsp bovis AF2122/97
ccggcgagcagggc

SEQ ID NO: 3125839 - RNA, 16 nt, Mycobacterium bovis subsp bovis AF2122/97
ccggcgagcagggcgu

SEQ ID NO: 3125840 - RNA, 23 nt, Mycobacterium bovis subsp bovis AF2122/97
ccggcgagcagggcgucgaccgc

SEQ ID NO: 3125841 - RNA, 14 nt, Mycobacterium bovis subsp bovis AF2122/97
ccggcgagcccgca

SEQ ID NO: 3125842 - RNA, 22 nt, Mycobacterium bovis subsp bovis AF2122/97
ccggcgagcccgcaucgcacca

SEQ ID NO: 3125843 - RNA, 19 nt, Mycobacterium bovis subsp bovis AF2122/97
ccggcgagggccacggcug

SEQ ID NO: 3125844 - RNA, 23 nt, Mycobacterium bovis subsp bovis AF2122/97
ccggcgauaaacccgaggcucgu

SEQ ID NO: 3125845 - RNA, 16 nt, Mycobacterium bovis subsp bovis AF2122/97
ccggcgaucaacgcgc

SEQ ID NO: 3125846 - RNA, 19 nt, Mycobacterium bovis subsp bovis AF2122/97
ccggcgaucaacgcgcacc

SEQ ID NO: 3125847 - RNA, 14 nt, Mycobacterium bovis subsp bovis AF2122/97
ccggcgaucaccgu

SEQ ID NO: 3125848 - RNA, 14 nt, Mycobacterium bovis subsp bovis AF2122/97
ccggcgaucguguc

SEQ ID NO: 3125849 - RNA, 17 nt, Mycobacterium bovis subsp bovis AF2122/97
ccggcgaucguguccac

SEQ ID NO: 3125850 - RNA, 17 nt, Mycobacterium bovis subsp bovis AF2122/97
ccggcgaucucgaccgu

SEQ ID NO: 3125851 - RNA, 14 nt, Mycobacterium bovis subsp bovis AF2122/97
ccggcgaugaccag

SEQ ID NO: 3125852 - RNA, 22 nt, Mycobacterium bovis subsp bovis AF2122/97
ccggcgaugagcaugcccagcg

SEQ ID NO: 3125853 - RNA, 14 nt, Mycobacterium bovis subsp bovis AF2122/97
ccggcgaugcagcc

SEQ ID NO: 3125854 - RNA, 22 nt, Mycobacterium bovis subsp bovis AF2122/97
ccggcgauggcccuuccggccg

SEQ ID NO: 3125855 - RNA, 17 nt, Mycobacterium bovis subsp bovis AF2122/97
ccggcgauuaccggcac

SEQ ID NO: 3125856 - RNA, 20 nt, Mycobacterium bovis subsp bovis AF2122/97
ccggcgauuaccggcacgcc

SEQ ID NO: 3125857 - RNA, 14 nt, Mycobacterium bovis subsp bovis AF2122/97
ccggcgcaacaacc

SEQ ID NO: 3125858 - RNA, 15 nt, Mycobacterium bovis subsp bovis AF2122/97
ccggcgcaacaaccg

SEQ ID NO: 3125859 - RNA, 14 nt, Mycobacterium bovis subsp bovis AF2122/97
ccggcgcaagcgcc

SEQ ID NO: 3125860 - RNA, 18 nt, Mycobacterium bovis subsp bovis AF2122/97
ccggcgcaagcgccgcgc

SEQ ID NO: 3125861 - RNA, 19 nt, Mycobacterium bovis subsp bovis AF2122/97
ccggcgcaagcgccgcgcu

SEQ ID NO: 3125862 - RNA, 21 nt, Mycobacterium bovis subsp bovis AF2122/97
ccggcgcaccaucgcggccgc

SEQ ID NO: 3125863 - RNA, 21 nt, Mycobacterium bovis subsp bovis AF2122/97
ccggcgcaccggagucgcccg

SEQ ID NO: 3125864 - RNA, 14 nt, Mycobacterium bovis subsp bovis AF2122/97
ccggcgcaccgucg

SEQ ID NO: 3125865 - RNA, 20 nt, Mycobacterium bovis subsp bovis AF2122/97
ccggcgcacgaaaccgcagc

SEQ ID NO: 3125866 - RNA, 23 nt, Mycobacterium bovis subsp bovis AF2122/97
ccggcgcacgaaaccgcagcgcg

SEQ ID NO: 3125867 - RNA, 14 nt, Mycobacterium bovis subsp bovis AF2122/97
ccggcgcgaucccc

SEQ ID NO: 3125868 - RNA, 15 nt, Mycobacterium bovis subsp bovis AF2122/97
ccggcgcgauccccg

SEQ ID NO: 3125869 - RNA, 20 nt, Mycobacterium bovis subsp bovis AF2122/97
ccggcgcgauccccgcgcug

SEQ ID NO: 3125870 - RNA, 15 nt, Mycobacterium bovis subsp bovis AF2122/97
ccggcgcgcaccccg

SEQ ID NO: 3125871 - RNA, 14 nt, Mycobacterium bovis subsp bovis AF2122/97
ccggcgcgcagccg

SEQ ID NO: 3125872 - RNA, 20 nt, Mycobacterium bovis subsp bovis AF2122/97
ccggcgcgccaaacaccccg

SEQ ID NO: 3125873 - RNA, 21 nt, Mycobacterium bovis subsp bovis AF2122/97
ccggcgcgccccaccgcgccg

SEQ ID NO: 3125874 - RNA, 16 nt, Mycobacterium bovis subsp bovis AF2122/97
ccggcgcgccccgccg

SEQ ID NO: 3125875 - RNA, 12 nt, Mycobacterium bovis subsp bovis AF2122/97
ccggcgcgccga

SEQ ID NO: 3125876 - RNA, 12 nt, Mycobacterium bovis subsp bovis AF2122/97
ccggcgcgccgg

SEQ ID NO: 3125877 - RNA, 19 nt, Mycobacterium bovis subsp bovis AF2122/97
ccggcgcgccgggcggcgc

SEQ ID NO: 3125878 - RNA, 17 nt, Mycobacterium bovis subsp bovis AF2122/97
ccggcgcggagugccca

SEQ ID NO: 3125879 - RNA, 21 nt, Mycobacterium bovis subsp bovis AF2122/97
ccggcgcggagugcccagggc

SEQ ID NO: 3125880 - RNA, 22 nt, Mycobacterium bovis subsp bovis AF2122/97
ccggcgcggagugcccagggcc

SEQ ID NO: 3125881 - RNA, 14 nt, Mycobacterium bovis subsp bovis AF2122/97
ccggcgcggccagc

SEQ ID NO: 3125882 - RNA, 22 nt, Mycobacterium bovis subsp bovis AF2122/97
ccggcgcggccgcaagccgcga

SEQ ID NO: 3125883 - RNA, 14 nt, Mycobacterium bovis subsp bovis AF2122/97
ccggcgcggccggc

SEQ ID NO: 3125884 - RNA, 15 nt, Mycobacterium bovis subsp bovis AF2122/97
ccggcgcggccggcc

SEQ ID NO: 3125885 - RNA, 22 nt, Mycobacterium bovis subsp bovis AF2122/97
ccggcgcggccggccgcucacc

SEQ ID NO: 3125886 - RNA, 17 nt, Mycobacterium bovis subsp bovis AF2122/97
ccggcgcggcggaccgu

SEQ ID NO: 3125887 - RNA, 13 nt, Mycobacterium bovis subsp bovis AF2122/97
ccggcgcggcgua

SEQ ID NO: 3125888 - RNA, 21 nt, Mycobacterium bovis subsp bovis AF2122/97
ccggcgcggucaucauggccg

SEQ ID NO: 3125889 - RNA, 14 nt, Mycobacterium bovis subsp bovis AF2122/97
ccggcgcgguggcc

SEQ ID NO: 3125890 - RNA, 20 nt, Mycobacterium bovis subsp bovis AF2122/97
ccggcgcguaguaaugcucg

SEQ ID NO: 3125891 - RNA, 22 nt, Mycobacterium bovis subsp bovis AF2122/97
ccggcgcguaguaaugcucgac

SEQ ID NO: 3125892 - RNA, 18 nt, Mycobacterium bovis subsp bovis AF2122/97
ccggcgcuagcgccgcgc

SEQ ID NO: 3125893 - RNA, 19 nt, Mycobacterium bovis subsp bovis AF2122/97
ccggcgcuagcgccgcgcu

SEQ ID NO: 3125894 - RNA, 19 nt, Mycobacterium bovis subsp bovis AF2122/97
ccggcgcuccaacgcacac

SEQ ID NO: 3125895 - RNA, 19 nt, Mycobacterium bovis subsp bovis AF2122/97
ccggcgcuccacugaccag

SEQ ID NO: 3125896 - RNA, 14 nt, Mycobacterium bovis subsp bovis AF2122/97
ccggcgcuccgcca

SEQ ID NO: 3125897 - RNA, 18 nt, Mycobacterium bovis subsp bovis AF2122/97
ccggcgcuccgccagaau

SEQ ID NO: 3125898 - RNA, 13 nt, Mycobacterium bovis subsp bovis AF2122/97
ccggcgcucgcgg

SEQ ID NO: 3125899 - RNA, 14 nt, Mycobacterium bovis subsp bovis AF2122/97
ccggcgcucgcggc

SEQ ID NO: 3125900 - RNA, 16 nt, Mycobacterium bovis subsp bovis AF2122/97
ccggcgcucgcggcgg

SEQ ID NO: 3125901 - RNA, 19 nt, Mycobacterium bovis subsp bovis AF2122/97
ccggcgcucgcggcggcgc

SEQ ID NO: 3125902 - RNA, 12 nt, Mycobacterium bovis subsp bovis AF2122/97
ccggcgcugccc

SEQ ID NO: 3125903 - RNA, 19 nt, Mycobacterium bovis subsp bovis AF2122/97
ccggcgcugcccgggcugc

SEQ ID NO: 3125904 - RNA, 20 nt, Mycobacterium bovis subsp bovis AF2122/97
ccggcgcugcccgggcugcc

SEQ ID NO: 3125905 - RNA, 14 nt, Mycobacterium bovis subsp bovis AF2122/97
ccggcgcuggagac

SEQ ID NO: 3125906 - RNA, 18 nt, Mycobacterium bovis subsp bovis AF2122/97
ccggcgcuggugcgccac

SEQ ID NO: 3125907 - RNA, 18 nt, Mycobacterium bovis subsp bovis AF2122/97
ccggcgcuuccgcugggu

SEQ ID NO: 3125908 - RNA, 15 nt, Mycobacterium bovis subsp bovis AF2122/97
ccggcggaagcggcg

SEQ ID NO: 3125909 - RNA, 14 nt, Mycobacterium bovis subsp bovis AF2122/97
ccggcggacaccuc

SEQ ID NO: 3125910 - RNA, 17 nt, Mycobacterium bovis subsp bovis AF2122/97
ccggcggacaccucggg

SEQ ID NO: 3125911 - RNA, 18 nt, Mycobacterium bovis subsp bovis AF2122/97
ccggcggacaccucgggc

SEQ ID NO: 3125912 - RNA, 17 nt, Mycobacterium bovis subsp bovis AF2122/97
ccggcggacccucgccg

SEQ ID NO: 3125913 - RNA, 21 nt, Mycobacterium bovis subsp bovis AF2122/97
ccggcggacgcccggcgcacc

SEQ ID NO: 3125914 - RNA, 21 nt, Mycobacterium bovis subsp bovis AF2122/97
ccggcggacgugaccagaucg

SEQ ID NO: 3125915 - RNA, 15 nt, Mycobacterium bovis subsp bovis AF2122/97
ccggcggagcgggcc

SEQ ID NO: 3125916 - RNA, 21 nt, Mycobacterium bovis subsp bovis AF2122/97
ccggcggagcgggccagcacc

SEQ ID NO: 3125917 - RNA, 20 nt, Mycobacterium bovis subsp bovis AF2122/97
ccggcggaucugaucggcgc

SEQ ID NO: 3125918 - RNA, 13 nt, Mycobacterium bovis subsp bovis AF2122/97
ccggcggaucugg

SEQ ID NO: 3125919 - RNA, 16 nt, Mycobacterium bovis subsp bovis AF2122/97
ccggcggauucggcgc

SEQ ID NO: 3125920 - RNA, 23 nt, Mycobacterium bovis subsp bovis AF2122/97
ccggcggcaaagaacagccggcc

SEQ ID NO: 3125921 - RNA, 16 nt, Mycobacterium bovis subsp bovis AF2122/97
ccggcggcagcggcgc

SEQ ID NO: 3125922 - RNA, 19 nt, Mycobacterium bovis subsp bovis AF2122/97
ccggcggcagcggcgccgc

SEQ ID NO: 3125923 - RNA, 21 nt, Mycobacterium bovis subsp bovis AF2122/97
ccggcggcagcggcgccgccu

SEQ ID NO: 3125924 - RNA, 12 nt, Mycobacterium bovis subsp bovis AF2122/97
ccggcggcagcu

SEQ ID NO: 3125925 - RNA, 15 nt, Mycobacterium bovis subsp bovis AF2122/97
ccggcggcaucgagu

SEQ ID NO: 3125926 - RNA, 11 nt, Mycobacterium bovis subsp bovis AF2122/97
ccggcggccaa

SEQ ID NO: 3125927 - RNA, 20 nt, Mycobacterium bovis subsp bovis AF2122/97
ccggcggccaucccgcguuc

SEQ ID NO: 3125928 - RNA, 15 nt, Mycobacterium bovis subsp bovis AF2122/97
ccggcggccauggug

SEQ ID NO: 3125929 - RNA, 16 nt, Mycobacterium bovis subsp bovis AF2122/97
ccggcggcccgcucga

SEQ ID NO: 3125930 - RNA, 20 nt, Mycobacterium bovis subsp bovis AF2122/97
ccggcggcccgcucgaaagc

SEQ ID NO: 3125931 - RNA, 23 nt, Mycobacterium bovis subsp bovis AF2122/97
ccggcggccgccaucagccgcug

SEQ ID NO: 3125932 - RNA, 13 nt, Mycobacterium bovis subsp bovis AF2122/97
ccggcggccgccc

SEQ ID NO: 3125933 - RNA, 15 nt, Mycobacterium bovis subsp bovis AF2122/97
ccggcggccgcccag

SEQ ID NO: 3125934 - RNA, 13 nt, Mycobacterium bovis subsp bovis AF2122/97
ccggcggccgcgg

SEQ ID NO: 3125935 - RNA, 22 nt, Mycobacterium bovis subsp bovis AF2122/97
ccggcggccgcuucggcgguca

SEQ ID NO: 3125936 - RNA, 11 nt, Mycobacterium bovis subsp bovis AF2122/97
ccggcggcgac

SEQ ID NO: 3125937 - RNA, 13 nt, Mycobacterium bovis subsp bovis AF2122/97
ccggcggcgacca

SEQ ID NO: 3125938 - RNA, 19 nt, Mycobacterium bovis subsp bovis AF2122/97
ccggcggcgaccagcucag

SEQ ID NO: 3125939 - RNA, 21 nt, Mycobacterium bovis subsp bovis AF2122/97
ccggcggcgaccagcucagcu

SEQ ID NO: 3125940 - RNA, 14 nt, Mycobacterium bovis subsp bovis AF2122/97
ccggcggcgacggc

SEQ ID NO: 3125941 - RNA, 18 nt, Mycobacterium bovis subsp bovis AF2122/97
ccggcggcgacggcggca

SEQ ID NO: 3125942 - RNA, 20 nt, Mycobacterium bovis subsp bovis AF2122/97
ccggcggcgacggcggcacg

SEQ ID NO: 3125943 - RNA, 21 nt, Mycobacterium bovis subsp bovis AF2122/97
ccggcggcgacggcggcacgg

SEQ ID NO: 3125944 - RNA, 14 nt, Mycobacterium bovis subsp bovis AF2122/97
ccggcggcgacggu

SEQ ID NO: 3125945 - RNA, 19 nt, Mycobacterium bovis subsp bovis AF2122/97
ccggcggcgacgucugcca

SEQ ID NO: 3125946 - RNA, 21 nt, Mycobacterium bovis subsp bovis AF2122/97
ccggcggcgcaucaccuccgc

SEQ ID NO: 3125947 - RNA, 22 nt, Mycobacterium bovis subsp bovis AF2122/97
ccggcggcgcccaucgcgacgg

SEQ ID NO: 3125948 - RNA, 14 nt, Mycobacterium bovis subsp bovis AF2122/97
ccggcggcgccgga

SEQ ID NO: 3125949 - RNA, 22 nt, Mycobacterium bovis subsp bovis AF2122/97
ccggcggcgccggaggcggcgc

SEQ ID NO: 3125950 - RNA, 14 nt, Mycobacterium bovis subsp bovis AF2122/97
ccggcggcgccggc

SEQ ID NO: 3125951 - RNA, 18 nt, Mycobacterium bovis subsp bovis AF2122/97
ccggcggcgccggccucg

SEQ ID NO: 3125952 - RNA, 21 nt, Mycobacterium bovis subsp bovis AF2122/97
ccggcggcgccggccucgccg

SEQ ID NO: 3125953 - RNA, 16 nt, Mycobacterium bovis subsp bovis AF2122/97
ccggcggcgcgcccgg

SEQ ID NO: 3125954 - RNA, 23 nt, Mycobacterium bovis subsp bovis AF2122/97
ccggcguggcuuguucggacuca

SEQ ID NO: 3125955 - RNA, 19 nt, Mycobacterium bovis subsp bovis AF2122/97
ccggcgugggcaccuugcc

SEQ ID NO: 3125956 - RNA, 17 nt, Mycobacterium bovis subsp bovis AF2122/97
ccggcgugguagacggc

SEQ ID NO: 3125957 - RNA, 18 nt, Mycobacterium bovis subsp bovis AF2122/97
ccggcgugucgccgccac

SEQ ID NO: 3125958 - RNA, 17 nt, Mycobacterium bovis subsp bovis AF2122/97
ccggcguucccacugga

SEQ ID NO: 3125959 - RNA, 18 nt, Mycobacterium bovis subsp bovis AF2122/97
ccggcguucccacuggag

SEQ ID NO: 3125960 - RNA, 23 nt, Mycobacterium bovis subsp bovis AF2122/97
ccggcguucccacuggaggucgu

SEQ ID NO: 3125961 - RNA, 22 nt, Mycobacterium bovis subsp bovis AF2122/97
ccggcguugacgaucaguccga

SEQ ID NO: 3125962 - RNA, 15 nt, Mycobacterium bovis subsp bovis AF2122/97
ccggcguugccgccg

SEQ ID NO: 3125963 - RNA, 16 nt, Mycobacterium bovis subsp bovis AF2122/97
ccggcguugccgccgu

SEQ ID NO: 3125964 - RNA, 20 nt, Mycobacterium bovis subsp bovis AF2122/97
ccggcguugccgccgucccc

SEQ ID NO: 3125965 - RNA, 19 nt, Mycobacterium bovis subsp bovis AF2122/97
ccggcguugccgccguugc

SEQ ID NO: 3125966 - RNA, 21 nt, Mycobacterium bovis subsp bovis AF2122/97
ccggcguugcguagacgaagg

SEQ ID NO: 3125967 - RNA, 12 nt, Mycobacterium bovis subsp bovis AF2122/97
ccggcguuggcc

SEQ ID NO: 3125968 - RNA, 17 nt, Mycobacterium bovis subsp bovis AF2122/97
ccggcguuggccauggc

SEQ ID NO: 3125969 - RNA, 19 nt, Mycobacterium bovis subsp bovis AF2122/97
ccggcguuguugaccagca

SEQ ID NO: 3125970 - RNA, 20 nt, Mycobacterium bovis subsp bovis AF2122/97
ccggcguuguugaccagcac

SEQ ID NO: 3125971 - RNA, 19 nt, Mycobacterium bovis subsp bovis AF2122/97
ccggcguuugggcaucauc

SEQ ID NO: 3125972 - RNA, 22 nt, Mycobacterium bovis subsp bovis AF2122/97
ccggcuaccgccuugucggcga

SEQ ID NO: 3125973 - RNA, 13 nt, Mycobacterium bovis subsp bovis AF2122/97
ccggcuaccgcgc

SEQ ID NO: 3125974 - RNA, 14 nt, Mycobacterium bovis subsp bovis AF2122/97
ccggcuaccgcgcu

SEQ ID NO: 3125975 - RNA, 16 nt, Mycobacterium bovis subsp bovis AF2122/97
ccggcuacgacggcgc

SEQ ID NO: 3125976 - RNA, 16 nt, Mycobacterium bovis subsp bovis AF2122/97
ccggcuacggcgacac

SEQ ID NO: 3125977 - RNA, 19 nt, Mycobacterium bovis subsp bovis AF2122/97
ccggcuaggagaucagcac

SEQ ID NO: 3125978 - RNA, 20 nt, Mycobacterium bovis subsp bovis AF2122/97
ccggcuagggcagcagcccg

SEQ ID NO: 3125979 - RNA, 23 nt, Mycobacterium bovis subsp bovis AF2122/97
ccggcuauaucccgccccgggcc

SEQ ID NO: 3125980 - RNA, 17 nt, Mycobacterium bovis subsp bovis AF2122/97
ccggcuauuagcggcuu

SEQ ID NO: 3125981 - RNA, 20 nt, Mycobacterium bovis subsp bovis AF2122/97
ccggcucaaggacgcaccgc

SEQ ID NO: 3125982 - RNA, 22 nt, Mycobacterium bovis subsp bovis AF2122/97
ccggcucaaggacgcaccgcca

SEQ ID NO: 3125983 - RNA, 17 nt, Mycobacterium bovis subsp bovis AF2122/97
ccggcucacagcacagc

SEQ ID NO: 3125984 - RNA, 20 nt, Mycobacterium bovis subsp bovis AF2122/97
ccggcucacagcacagcgca

SEQ ID NO: 3125985 - RNA, 22 nt, Mycobacterium bovis subsp bovis AF2122/97
ccggcucacagcacagcgcagc

SEQ ID NO: 3125986 - RNA, 16 nt, Mycobacterium bovis subsp bovis AF2122/97
ccggcucaccacgccg

SEQ ID NO: 3125987 - RNA, 17 nt, Mycobacterium bovis subsp bovis AF2122/97
ccggcuccacccuugcc

SEQ ID NO: 3125988 - RNA, 16 nt, Mycobacterium bovis subsp bovis AF2122/97
ccggcuccagcaccgu

SEQ ID NO: 3125989 - RNA, 20 nt, Mycobacterium bovis subsp bovis AF2122/97
ccggcuccagcaccgugacc

SEQ ID NO: 3125990 - RNA, 13 nt, Mycobacterium bovis subsp bovis AF2122/97
ccggcuccgccac

SEQ ID NO: 3125991 - RNA, 16 nt, Mycobacterium bovis subsp bovis AF2122/97
ccggcuccgccacugg

SEQ ID NO: 3125992 - RNA, 22 nt, Mycobacterium bovis subsp bovis AF2122/97
ccggcuccgccguugacgccgu

SEQ ID NO: 3125993 - RNA, 16 nt, Mycobacterium bovis subsp bovis AF2122/97
ccggcuccgccguugc

SEQ ID NO: 3125994 - RNA, 20 nt, Mycobacterium bovis subsp bovis AF2122/97
ccggcuccgccguugccgcc

SEQ ID NO: 3125995 - RNA, 17 nt, Mycobacterium bovis subsp bovis AF2122/97
ccggcuccggcggugcc

SEQ ID NO: 3125996 - RNA, 18 nt, Mycobacterium bovis subsp bovis AF2122/97
ccggcuccggcggugccg

SEQ ID NO: 3125997 - RNA, 20 nt, Mycobacterium bovis subsp bovis AF2122/97
ccggcuccggcggugccguc

SEQ ID NO: 3125998 - RNA, 21 nt, Mycobacterium bovis subsp bovis AF2122/97
ccggcuccggcggugccgucg

SEQ ID NO: 3125999 - RNA, 17 nt, Mycobacterium bovis subsp bovis AF2122/97
ccggcuccgguaggcga

SEQ ID NO: 3126000 - RNA, 16 nt, Mycobacterium bovis subsp bovis AF2122/97
ccggcuccuccccggc

SEQ ID NO: 3126001 - RNA, 19 nt, Mycobacterium bovis subsp bovis AF2122/97
ccggcuccuccccggcccg

SEQ ID NO: 3126002 - RNA, 23 nt, Mycobacterium bovis subsp bovis AF2122/97
ccggcucgacgcgucgccggccg

SEQ ID NO: 3126003 - RNA, 14 nt, Mycobacterium bovis subsp bovis AF2122/97
ccggcucgacugcc

SEQ ID NO: 3126004 - RNA, 16 nt, Mycobacterium bovis subsp bovis AF2122/97
ccggcucgacugccac

SEQ ID NO: 3126005 - RNA, 14 nt, Mycobacterium bovis subsp bovis AF2122/97
ccggcucgagcucg

SEQ ID NO: 3126006 - RNA, 22 nt, Mycobacterium bovis subsp bovis AF2122/97
ccggcucgagcucggcgaugcu

SEQ ID NO: 3126007 - RNA, 16 nt, Mycobacterium bovis subsp bovis AF2122/97
ccggcucgccgacccg

SEQ ID NO: 3126008 - RNA, 17 nt, Mycobacterium bovis subsp bovis AF2122/97
ccggcucgccgacccgc

SEQ ID NO: 3126009 - RNA, 22 nt, Mycobacterium bovis subsp bovis AF2122/97
ccggcucgccgacccgccgcgg

SEQ ID NO: 3126010 - RNA, 14 nt, Mycobacterium bovis subsp bovis AF2122/97
ccggcucgccggcg

SEQ ID NO: 3126011 - RNA, 19 nt, Mycobacterium bovis subsp bovis AF2122/97
ccggcucgccggcgaccgg

SEQ ID NO: 3126012 - RNA, 20 nt, Mycobacterium bovis subsp bovis AF2122/97
ccggcucgccggcgaccggg

SEQ ID NO: 3126013 - RNA, 15 nt, Mycobacterium bovis subsp bovis AF2122/97
ccggcucgccggcgc

SEQ ID NO: 3126014 - RNA, 18 nt, Mycobacterium bovis subsp bovis AF2122/97
ccggcucggaaaccgccc

SEQ ID NO: 3126015 - RNA, 21 nt, Mycobacterium bovis subsp bovis AF2122/97
ccggcucggaaaccgccccgu

SEQ ID NO: 3126016 - RNA, 14 nt, Mycobacterium bovis subsp bovis AF2122/97
ccggcucggccacc

SEQ ID NO: 3126017 - RNA, 12 nt, Mycobacterium bovis subsp bovis AF2122/97
ccggcucgggug

SEQ ID NO: 3126018 - RNA, 18 nt, Mycobacterium bovis subsp bovis AF2122/97
ccggcucggguggccagc

SEQ ID NO: 3126019 - RNA, 16 nt, Mycobacterium bovis subsp bovis AF2122/97
ccggcucggugcgcca

SEQ ID NO: 3126020 - RNA, 22 nt, Mycobacterium bovis subsp bovis AF2122/97
ccggcucggugcgccagaucac

SEQ ID NO: 3126021 - RNA, 13 nt, Mycobacterium bovis subsp bovis AF2122/97
ccggcucgucagg

SEQ ID NO: 3126022 - RNA, 12 nt, Mycobacterium bovis subsp bovis AF2122/97
ccggcucgucga

SEQ ID NO: 3126023 - RNA, 15 nt, Mycobacterium bovis subsp bovis AF2122/97
ccggcucgucgaucc

SEQ ID NO: 3126024 - RNA, 18 nt, Mycobacterium bovis subsp bovis AF2122/97
ccggcucgucgauccccg

SEQ ID NO: 3126025 - RNA, 22 nt, Mycobacterium bovis subsp bovis AF2122/97
ccggcucgucgauccccgcaau

SEQ ID NO: 3126026 - RNA, 23 nt, Mycobacterium bovis subsp bovis AF2122/97
ccggcucgucgaugucgacgucg

SEQ ID NO: 3126027 - RNA, 14 nt, Mycobacterium bovis subsp bovis AF2122/97
ccggcucgucgggc

SEQ ID NO: 3126028 - RNA, 16 nt, Mycobacterium bovis subsp bovis AF2122/97
ccggcucuccggugau

SEQ ID NO: 3126029 - RNA, 17 nt, Mycobacterium bovis subsp bovis AF2122/97
ccggcucucuucgcgcg

SEQ ID NO: 3126030 - RNA, 19 nt, Mycobacterium bovis subsp bovis AF2122/97
ccggcucucuucgcgcgcu

SEQ ID NO: 3126031 - RNA, 21 nt, Mycobacterium bovis subsp bovis AF2122/97
ccggcugaaacguccuugaac

SEQ ID NO: 3126032 - RNA, 13 nt, Mycobacterium bovis subsp bovis AF2122/97
ccggcugaccggg

SEQ ID NO: 3126033 - RNA, 15 nt, Mycobacterium bovis subsp bovis AF2122/97
ccggcugaccggggc

SEQ ID NO: 3126034 - RNA, 19 nt, Mycobacterium bovis subsp bovis AF2122/97
ccggcugaccggggcgccc

SEQ ID NO: 3126035 - RNA, 22 nt, Mycobacterium bovis subsp bovis AF2122/97
ccggcugaccggggcgcccggc

SEQ ID NO: 3126036 - RNA, 15 nt, Mycobacterium bovis subsp bovis AF2122/97
ccggcugacgaccaa

SEQ ID NO: 3126037 - RNA, 20 nt, Mycobacterium bovis subsp bovis AF2122/97
ccggcugacgaccaaccacc

SEQ ID NO: 3126038 - RNA, 19 nt, Mycobacterium bovis subsp bovis AF2122/97
ccggcugauucgagccaca

SEQ ID NO: 3126039 - RNA, 21 nt, Mycobacterium bovis subsp bovis AF2122/97
ccggcugcaaccagcggcaca

SEQ ID NO: 3126040 - RNA, 16 nt, Mycobacterium bovis subsp bovis AF2122/97
ccgggacuaccacccg

SEQ ID NO: 3126041 - RNA, 17 nt, Mycobacterium bovis subsp bovis AF2122/97
ccgggaggccaccgcga

SEQ ID NO: 3126042 - RNA, 11 nt, Mycobacterium bovis subsp bovis AF2122/97
ccgggagucgg

SEQ ID NO: 3126043 - RNA, 16 nt, Mycobacterium bovis subsp bovis AF2122/97
ccgggagugcgccggc

SEQ ID NO: 3126044 - RNA, 21 nt, Mycobacterium bovis subsp bovis AF2122/97
ccgggagugcgccggcuggcg

SEQ ID NO: 3126045 - RNA, 20 nt, Mycobacterium bovis subsp bovis AF2122/97
ccgggauaacccagcaccac

SEQ ID NO: 3126046 - RNA, 20 nt, Mycobacterium bovis subsp bovis AF2122/97
ccgggauaguuuucggccgc

SEQ ID NO: 3126047 - RNA, 21 nt, Mycobacterium bovis subsp bovis AF2122/97
ccgggauaguuuucggccgcc

SEQ ID NO: 3126048 - RNA, 16 nt, Mycobacterium bovis subsp bovis AF2122/97
ccgggaucccacggcg

SEQ ID NO: 3126049 - RNA, 17 nt, Mycobacterium bovis subsp bovis AF2122/97
ccgggaucccacggcgg

SEQ ID NO: 3126050 - RNA, 19 nt, Mycobacterium bovis subsp bovis AF2122/97
ccgggaucccacggcgggc

SEQ ID NO: 3126051 - RNA, 13 nt, Mycobacterium bovis subsp bovis AF2122/97
ccgggaucggcuc

SEQ ID NO: 3126052 - RNA, 18 nt, Mycobacterium bovis subsp bovis AF2122/97
ccgggaucggcuccgccg

SEQ ID NO: 3126053 - RNA, 22 nt, Mycobacterium bovis subsp bovis AF2122/97
ccgggaucggggcaccgugcgg

SEQ ID NO: 3126054 - RNA, 15 nt, Mycobacterium bovis subsp bovis AF2122/97
ccgggaucgucaggc

SEQ ID NO: 3126055 - RNA, 20 nt, Mycobacterium bovis subsp bovis AF2122/97
ccgggaucucgaaggccgcc

SEQ ID NO: 3126056 - RNA, 13 nt, Mycobacterium bovis subsp bovis AF2122/97
ccgggaucugcuc

SEQ ID NO: 3126057 - RNA, 20 nt, Mycobacterium bovis subsp bovis AF2122/97
ccgggaugaagcucgaccgc

SEQ ID NO: 3126058 - RNA, 15 nt, Mycobacterium bovis subsp bovis AF2122/97
ccgggaugccgccgc

SEQ ID NO: 3126059 - RNA, 16 nt, Mycobacterium bovis subsp bovis AF2122/97
ccgggaugccgccgcu

SEQ ID NO: 3126060 - RNA, 16 nt, Mycobacterium bovis subsp bovis AF2122/97
ccgggaugugcggcug

SEQ ID NO: 3126061 - RNA, 22 nt, Mycobacterium bovis subsp bovis AF2122/97
ccgggaugugcggcugcaccgg

SEQ ID NO: 3126062 - RNA, 16 nt, Mycobacterium bovis subsp bovis AF2122/97
ccgggcaaaucaagca

SEQ ID NO: 3126063 - RNA, 17 nt, Mycobacterium bovis subsp bovis AF2122/97
ccgggcaaaucaagcac

SEQ ID NO: 3126064 - RNA, 19 nt, Mycobacterium bovis subsp bovis AF2122/97
ccgggcaaaucaagcacag

SEQ ID NO: 3126065 - RNA, 20 nt, Mycobacterium bovis subsp bovis AF2122/97
ccgggcaaaucaagcacagc

SEQ ID NO: 3126066 - RNA, 13 nt, Mycobacterium bovis subsp bovis AF2122/97
ccgggcaaccagc

SEQ ID NO: 3126067 - RNA, 18 nt, Mycobacterium bovis subsp bovis AF2122/97
ccgggcaaccagcagcag

SEQ ID NO: 3126068 - RNA, 22 nt, Mycobacterium bovis subsp bovis AF2122/97
ccgggcaaccagcagcagguug

SEQ ID NO: 3126069 - RNA, 19 nt, Mycobacterium bovis subsp bovis AF2122/97
ccgggcaacgcgaaccggc

SEQ ID NO: 3126070 - RNA, 20 nt, Mycobacterium bovis subsp bovis AF2122/97
ccgggcaacgcgaaccggcc

SEQ ID NO: 3126071 - RNA, 22 nt, Mycobacterium bovis subsp bovis AF2122/97
ccgggcaacgcgaaccggccau

SEQ ID NO: 3126072 - RNA, 12 nt, Mycobacterium bovis subsp bovis AF2122/97
ccgggcaccacc

SEQ ID NO: 3126073 - RNA, 18 nt, Mycobacterium bovis subsp bovis AF2122/97
ccgggcaccaccacaccg

SEQ ID NO: 3126074 - RNA, 22 nt, Mycobacterium bovis subsp bovis AF2122/97
ccgggcacccuugccgauuccg

SEQ ID NO: 3126075 - RNA, 14 nt, Mycobacterium bovis subsp bovis AF2122/97
ccgggcaccggccg

SEQ ID NO: 3126076 - RNA, 16 nt, Mycobacterium bovis subsp bovis AF2122/97
ccgggcaccgucggaa

SEQ ID NO: 3126077 - RNA, 23 nt, Mycobacterium bovis subsp bovis AF2122/97
ccgggcacgaacaucagaucgcc

SEQ ID NO: 3126078 - RNA, 16 nt, Mycobacterium bovis subsp bovis AF2122/97
ccgggcacgcgaggcg

SEQ ID NO: 3126079 - RNA, 19 nt, Mycobacterium bovis subsp bovis AF2122/97
ccgggcagaugaugccguu

SEQ ID NO: 3126080 - RNA, 23 nt, Mycobacterium bovis subsp bovis AF2122/97
ccgggcagaugaugccguucgga

SEQ ID NO: 3126081 - RNA, 15 nt, Mycobacterium bovis subsp bovis AF2122/97
ccgggcagcaucaac

SEQ ID NO: 3126082 - RNA, 19 nt, Mycobacterium bovis subsp bovis AF2122/97
ccgggcagcaucaacaccg

SEQ ID NO: 3126083 - RNA, 20 nt, Mycobacterium bovis subsp bovis AF2122/97
ccgggcagcaucaacaccgg

SEQ ID NO: 3126084 - RNA, 15 nt, Mycobacterium bovis subsp bovis AF2122/97
ccgggcagccccucc

SEQ ID NO: 3126085 - RNA, 17 nt, Mycobacterium bovis subsp bovis AF2122/97
ccgggcagccccuccgc

SEQ ID NO: 3126086 - RNA, 19 nt, Mycobacterium bovis subsp bovis AF2122/97
ccgggcagccccuccgcgc

SEQ ID NO: 3126087 - RNA, 21 nt, Mycobacterium bovis subsp bovis AF2122/97
ccgggcagccccuccgcgccg

SEQ ID NO: 3126088 - RNA, 22 nt, Mycobacterium bovis subsp bovis AF2122/97
ccgggcagccccuccgcgccga

SEQ ID NO: 3126089 - RNA, 12 nt, Mycobacterium bovis subsp bovis AF2122/97
ccgggcagccgc

SEQ ID NO: 3126090 - RNA, 16 nt, Mycobacterium bovis subsp bovis AF2122/97
ccgggcagccgcacgg

SEQ ID NO: 3126091 - RNA, 17 nt, Mycobacterium bovis subsp bovis AF2122/97
ccgggcagccgcacggu

SEQ ID NO: 3126092 - RNA, 15 nt, Mycobacterium bovis subsp bovis AF2122/97
ccgggcagccgcgcc

SEQ ID NO: 3126093 - RNA, 17 nt, Mycobacterium bovis subsp bovis AF2122/97
ccgggcagccgcgccgc

SEQ ID NO: 3126094 - RNA, 16 nt, Mycobacterium bovis subsp bovis AF2122/97
ccgggcagccugcugc

SEQ ID NO: 3126095 - RNA, 14 nt, Mycobacterium bovis subsp bovis AF2122/97
ccgggcagcugggc

SEQ ID NO: 3126096 - RNA, 17 nt, Mycobacterium bovis subsp bovis AF2122/97
ccgggcaguccaggcac

SEQ ID NO: 3126097 - RNA, 19 nt, Mycobacterium bovis subsp bovis AF2122/97
ccgggcagugcgcggcguc

SEQ ID NO: 3126098 - RNA, 23 nt, Mycobacterium bovis subsp bovis AF2122/97
ccgggcaguuuguucgcgaagcu

SEQ ID NO: 3126099 - RNA, 24 nt, Mycobacterium bovis subsp bovis AF2122/97
ccgggcauccuucaccagcugcga

SEQ ID NO: 3126100 - RNA, 20 nt, Mycobacterium bovis subsp bovis AF2122/97
ccgggcaucggugccacggc

SEQ ID NO: 3126101 - RNA, 17 nt, Mycobacterium bovis subsp bovis AF2122/97
ccgggcaugaucacacu

SEQ ID NO: 3126102 - RNA, 20 nt, Mycobacterium bovis subsp bovis AF2122/97
ccgggcaugaucacacugcc

SEQ ID NO: 3126103 - RNA, 17 nt, Mycobacterium bovis subsp bovis AF2122/97
ccgggccacgucgagca

SEQ ID NO: 3126104 - RNA, 21 nt, Mycobacterium bovis subsp bovis AF2122/97
ccgggccacgucgagcacccg

SEQ ID NO: 3126105 - RNA, 22 nt, Mycobacterium bovis subsp bovis AF2122/97
ccgggccagaucgaagcgcagc

SEQ ID NO: 3126106 - RNA, 18 nt, Mycobacterium bovis subsp bovis AF2122/97
ccgggccaggccgaugcc

SEQ ID NO: 3126107 - RNA, 17 nt, Mycobacterium bovis subsp bovis AF2122/97
ccgggccaucgcauccc

SEQ ID NO: 3126108 - RNA, 21 nt, Mycobacterium bovis subsp bovis AF2122/97
ccgggccaucgcauccccagc

SEQ ID NO: 3126109 - RNA, 23 nt, Mycobacterium bovis subsp bovis AF2122/97
ccgggccauuaaaaagcccagcg

SEQ ID NO: 3126110 - RNA, 18 nt, Mycobacterium bovis subsp bovis AF2122/97
ccgggccccacaucgccc

SEQ ID NO: 3126111 - RNA, 14 nt, Mycobacterium bovis subsp bovis AF2122/97
ccgggccccggggu

SEQ ID NO: 3126112 - RNA, 21 nt, Mycobacterium bovis subsp bovis AF2122/97
ccgggccccggggugcccccg

SEQ ID NO: 3126113 - RNA, 20 nt, Mycobacterium bovis subsp bovis AF2122/97
ccgggccccuucgcagcaug

SEQ ID NO: 3126114 - RNA, 15 nt, Mycobacterium bovis subsp bovis AF2122/97
ccgggcccgacgacg

SEQ ID NO: 3126115 - RNA, 14 nt, Mycobacterium bovis subsp bovis AF2122/97
ccgggcccgacgcg

SEQ ID NO: 3126116 - RNA, 22 nt, Mycobacterium bovis subsp bovis AF2122/97
ccgggcccgacgcguggcaucc

SEQ ID NO: 3126117 - RNA, 12 nt, Mycobacterium bovis subsp bovis AF2122/97
ccgggcccgccg

SEQ ID NO: 3126118 - RNA, 14 nt, Mycobacterium bovis subsp bovis AF2122/97
ccgggcccgccggc

SEQ ID NO: 3126119 - RNA, 16 nt, Mycobacterium bovis subsp bovis AF2122/97
ccgggcccgccggccc

SEQ ID NO: 3126120 - RNA, 18 nt, Mycobacterium bovis subsp bovis AF2122/97
ccgggcccgccggccccg

SEQ ID NO: 3126121 - RNA, 14 nt, Mycobacterium bovis subsp bovis AF2122/97
ccgggcccgcggga

SEQ ID NO: 3126122 - RNA, 15 nt, Mycobacterium bovis subsp bovis AF2122/97
ccgggcccggcgaac

SEQ ID NO: 3126123 - RNA, 23 nt, Mycobacterium bovis subsp bovis AF2122/97
ccgggcccuccacugcgagcgcc

SEQ ID NO: 3126124 - RNA, 17 nt, Mycobacterium bovis subsp bovis AF2122/97
ccgggccgaagcgcgcg

SEQ ID NO: 3126125 - RNA, 21 nt, Mycobacterium bovis subsp bovis AF2122/97
ccgggccgagcgcaccacggc

SEQ ID NO: 3126126 - RNA, 17 nt, Mycobacterium bovis subsp bovis AF2122/97
ccgggcuuggccgcgcc

SEQ ID NO: 3126127 - RNA, 18 nt, Mycobacterium bovis subsp bovis AF2122/97
ccgggcuuggccgcgccg

SEQ ID NO: 3126128 - RNA, 23 nt, Mycobacterium bovis subsp bovis AF2122/97
ccgggcuuggccgcgccggucgu

SEQ ID NO: 3126129 - RNA, 21 nt, Mycobacterium bovis subsp bovis AF2122/97
ccgggcuuguagacgccaugc

SEQ ID NO: 3126130 - RNA, 17 nt, Mycobacterium bovis subsp bovis AF2122/97
ccggggaaagccgcagc

SEQ ID NO: 3126131 - RNA, 23 nt, Mycobacterium bovis subsp bovis AF2122/97
ccggggaaccuugaccgaccagc

SEQ ID NO: 3126132 - RNA, 16 nt, Mycobacterium bovis subsp bovis AF2122/97
ccggggaacgugaccc

SEQ ID NO: 3126133 - RNA, 20 nt, Mycobacterium bovis subsp bovis AF2122/97
ccggggacaacucgcguggc

SEQ ID NO: 3126134 - RNA, 20 nt, Mycobacterium bovis subsp bovis AF2122/97
ccggggacagcccggcagau

SEQ ID NO: 3126135 - RNA, 12 nt, Mycobacterium bovis subsp bovis AF2122/97
ccggggaccacg

SEQ ID NO: 3126136 - RNA, 17 nt, Mycobacterium bovis subsp bovis AF2122/97
ccggggaccucggcgau

SEQ ID NO: 3126137 - RNA, 18 nt, Mycobacterium bovis subsp bovis AF2122/97
ccggggacgccgcggcgc

SEQ ID NO: 3126138 - RNA, 14 nt, Mycobacterium bovis subsp bovis AF2122/97
ccggggacgcgccc

SEQ ID NO: 3126139 - RNA, 15 nt, Mycobacterium bovis subsp bovis AF2122/97
ccggggacgcgcccc

SEQ ID NO: 3126140 - RNA, 13 nt, Mycobacterium bovis subsp bovis AF2122/97
ccggggacggguc

SEQ ID NO: 3126141 - RNA, 15 nt, Mycobacterium bovis subsp bovis AF2122/97
ccggggacgggucgg

SEQ ID NO: 3126142 - RNA, 18 nt, Mycobacterium bovis subsp bovis AF2122/97
ccggggacgggucggcag

SEQ ID NO: 3126143 - RNA, 16 nt, Mycobacterium bovis subsp bovis AF2122/97
ccggggacgucgacuu

SEQ ID NO: 3126144 - RNA, 20 nt, Mycobacterium bovis subsp bovis AF2122/97
ccggggaguggaaacccgcc

SEQ ID NO: 3126145 - RNA, 19 nt, Mycobacterium bovis subsp bovis AF2122/97
ccggggauaccggucagca

SEQ ID NO: 3126146 - RNA, 12 nt, Mycobacterium bovis subsp bovis AF2122/97
ccggggaucggg

SEQ ID NO: 3126147 - RNA, 14 nt, Mycobacterium bovis subsp bovis AF2122/97
ccggggcagauggu

SEQ ID NO: 3126148 - RNA, 15 nt, Mycobacterium bovis subsp bovis AF2122/97
ccggggccacccgca

SEQ ID NO: 3126149 - RNA, 15 nt, Mycobacterium bovis subsp bovis AF2122/97
ccggggccccaugcc

SEQ ID NO: 3126150 - RNA, 16 nt, Mycobacterium bovis subsp bovis AF2122/97
ccggggccccaugccg

SEQ ID NO: 3126151 - RNA, 19 nt, Mycobacterium bovis subsp bovis AF2122/97
ccggggccccaugccgacc

SEQ ID NO: 3126152 - RNA, 21 nt, Mycobacterium bovis subsp bovis AF2122/97
ccggggccccaugccgaccgg

SEQ ID NO: 3126153 - RNA, 13 nt, Mycobacterium bovis subsp bovis AF2122/97
ccggggcccggac

SEQ ID NO: 3126154 - RNA, 12 nt, Mycobacterium bovis subsp bovis AF2122/97
ccggggccgcaa

SEQ ID NO: 3126155 - RNA, 17 nt, Mycobacterium bovis subsp bovis AF2122/97
ccggggccgccgaugcc

SEQ ID NO: 3126156 - RNA, 17 nt, Mycobacterium bovis subsp bovis AF2122/97
ccggggccgcggcccac

SEQ ID NO: 3126157 - RNA, 23 nt, Mycobacterium bovis subsp bovis AF2122/97
ccggggccuucggcccggugguc

SEQ ID NO: 3126158 - RNA, 20 nt, Mycobacterium bovis subsp bovis AF2122/97
ccggggcgaugucggcuggu

SEQ ID NO: 3126159 - RNA, 15 nt, Mycobacterium bovis subsp bovis AF2122/97
ccggggcgcccggcc

SEQ ID NO: 3126160 - RNA, 21 nt, Mycobacterium bovis subsp bovis AF2122/97
ccggggcgcccggccaggucg

SEQ ID NO: 3126161 - RNA, 15 nt, Mycobacterium bovis subsp bovis AF2122/97
ccggggcgcucgcgc

SEQ ID NO: 3126162 - RNA, 17 nt, Mycobacterium bovis subsp bovis AF2122/97
ccggggcgcucgcgcgc

SEQ ID NO: 3126163 - RNA, 18 nt, Mycobacterium bovis subsp bovis AF2122/97
ccggggcgcucgcgcgcu

SEQ ID NO: 3126164 - RNA, 23 nt, Mycobacterium bovis subsp bovis AF2122/97
ccggggcgcucgcgcgcugggcg

SEQ ID NO: 3126165 - RNA, 18 nt, Mycobacterium bovis subsp bovis AF2122/97
ccggggcgcucgugaugu

SEQ ID NO: 3126166 - RNA, 16 nt, Mycobacterium bovis subsp bovis AF2122/97
ccggggcggaaccugu

SEQ ID NO: 3126167 - RNA, 20 nt, Mycobacterium bovis subsp bovis AF2122/97
ccggggcggaaccugucaac

SEQ ID NO: 3126168 - RNA, 17 nt, Mycobacterium bovis subsp bovis AF2122/97
ccggggcggugggcgcu

SEQ ID NO: 3126169 - RNA, 22 nt, Mycobacterium bovis subsp bovis AF2122/97
ccggggcucaagucucccggcc

SEQ ID NO: 3126170 - RNA, 15 nt, Mycobacterium bovis subsp bovis AF2122/97
ccggggcugccgccg

SEQ ID NO: 3126171 - RNA, 20 nt, Mycobacterium bovis subsp bovis AF2122/97
ccggggcugccgccguugcc

SEQ ID NO: 3126172 - RNA, 22 nt, Mycobacterium bovis subsp bovis AF2122/97
ccgggggaagcgccaaacccgg

SEQ ID NO: 3126173 - RNA, 16 nt, Mycobacterium bovis subsp bovis AF2122/97
ccggggggcugcugcu

SEQ ID NO: 3126174 - RNA, 23 nt, Mycobacterium bovis subsp bovis AF2122/97
ccggggguguuggaagucccgcc

SEQ ID NO: 3126175 - RNA, 17 nt, Mycobacterium bovis subsp bovis AF2122/97
ccgggguagacgccccg

SEQ ID NO: 3126176 - RNA, 18 nt, Mycobacterium bovis subsp bovis AF2122/97
ccgggguauucccgcaga

SEQ ID NO: 3126177 - RNA, 20 nt, Mycobacterium bovis subsp bovis AF2122/97
ccggggucaccuuggccggg

SEQ ID NO: 3126178 - RNA, 18 nt, Mycobacterium bovis subsp bovis AF2122/97
ccgggguccaucggggcc

SEQ ID NO: 3126179 - RNA, 21 nt, Mycobacterium bovis subsp bovis AF2122/97
ccgggguccaucggggccguc

SEQ ID NO: 3126180 - RNA, 23 nt, Mycobacterium bovis subsp bovis AF2122/97
ccgggguccaucggggccgucgg

SEQ ID NO: 3126181 - RNA, 14 nt, Mycobacterium bovis subsp bovis AF2122/97
ccggggucgaacgc

SEQ ID NO: 3126182 - RNA, 15 nt, Mycobacterium bovis subsp bovis AF2122/97
ccggggucgaacgcg

SEQ ID NO: 3126183 - RNA, 15 nt, Mycobacterium bovis subsp bovis AF2122/97
ccggggucggcccgc

SEQ ID NO: 3126184 - RNA, 17 nt, Mycobacterium bovis subsp bovis AF2122/97
ccggggugacaucgcga

SEQ ID NO: 3126185 - RNA, 14 nt, Mycobacterium bovis subsp bovis AF2122/97
ccggggugcccccg

SEQ ID NO: 3126186 - RNA, 19 nt, Mycobacterium bovis subsp bovis AF2122/97
ccggggugcccccggugcc

SEQ ID NO: 3126187 - RNA, 22 nt, Mycobacterium bovis subsp bovis AF2122/97
ccggggugcccccggugccgcc

SEQ ID NO: 3126188 - RNA, 14 nt, Mycobacterium bovis subsp bovis AF2122/97
ccgggguggacggc

SEQ ID NO: 3126189 - RNA, 15 nt, Mycobacterium bovis subsp bovis AF2122/97
ccgggguggcgcgcc

SEQ ID NO: 3126190 - RNA, 16 nt, Mycobacterium bovis subsp bovis AF2122/97
ccgggguggcgcgcca

SEQ ID NO: 3126191 - RNA, 15 nt, Mycobacterium bovis subsp bovis AF2122/97
ccggggugugcgggc

SEQ ID NO: 3126192 - RNA, 13 nt, Mycobacterium bovis subsp bovis AF2122/97
ccgggguucaccg

SEQ ID NO: 3126193 - RNA, 17 nt, Mycobacterium bovis subsp bovis AF2122/97
ccgggguucaccgucga

SEQ ID NO: 3126194 - RNA, 22 nt, Mycobacterium bovis subsp bovis AF2122/97
ccggguaaagcgaugggaacgg

SEQ ID NO: 3126195 - RNA, 15 nt, Mycobacterium bovis subsp bovis AF2122/97
ccggguacgccgggc

SEQ ID NO: 3126196 - RNA, 14 nt, Mycobacterium bovis subsp bovis AF2122/97
ccggguacggcgua

SEQ ID NO: 3126197 - RNA, 17 nt, Mycobacterium bovis subsp bovis AF2122/97
ccggguagacaccgcga

SEQ ID NO: 3126198 - RNA, 18 nt, Mycobacterium bovis subsp bovis AF2122/97
ccggguagccggcgugca

SEQ ID NO: 3126199 - RNA, 16 nt, Mycobacterium bovis subsp bovis AF2122/97
ccggguagcggauagc

SEQ ID NO: 3126200 - RNA, 19 nt, Mycobacterium bovis subsp bovis AF2122/97
ccggguagcggcgccgccc

SEQ ID NO: 3126201 - RNA, 20 nt, Mycobacterium bovis subsp bovis AF2122/97
ccggguagcggcgccgcccu

SEQ ID NO: 3126202 - RNA, 19 nt, Mycobacterium bovis subsp bovis AF2122/97
ccggguagcucccugggcg

SEQ ID NO: 3126203 - RNA, 14 nt, Mycobacterium bovis subsp bovis AF2122/97
ccggguauggcggc

SEQ ID NO: 3126204 - RNA, 20 nt, Mycobacterium bovis subsp bovis AF2122/97
ccggguauggcggcgacggc

SEQ ID NO: 3126205 - RNA, 17 nt, Mycobacterium bovis subsp bovis AF2122/97
ccgggucaacgccauca

SEQ ID NO: 3126206 - RNA, 20 nt, Mycobacterium bovis subsp bovis AF2122/97
ccgggucaccgauucggcca

SEQ ID NO: 3126207 - RNA, 17 nt, Mycobacterium bovis subsp bovis AF2122/97
ccgggucacgugggcca

SEQ ID NO: 3126208 - RNA, 16 nt, Mycobacterium bovis subsp bovis AF2122/97
ccgggucagcccagcc

SEQ ID NO: 3126209 - RNA, 18 nt, Mycobacterium bovis subsp bovis AF2122/97
ccgggucagcccggcgcg

SEQ ID NO: 3126210 - RNA, 15 nt, Mycobacterium bovis subsp bovis AF2122/97
ccgggucagcgaccu

SEQ ID NO: 3126211 - RNA, 18 nt, Mycobacterium bovis subsp bovis AF2122/97
ccgggucauccgugucga

SEQ ID NO: 3126212 - RNA, 23 nt, Mycobacterium bovis subsp bovis AF2122/97
ccgguagcacagcagcaacgcgg

SEQ ID NO: 3126213 - RNA, 16 nt, Mycobacterium bovis subsp bovis AF2122/97
ccgguagccaggcgcg

SEQ ID NO: 3126214 - RNA, 15 nt, Mycobacterium bovis subsp bovis AF2122/97
ccgguagcgcgggug

SEQ ID NO: 3126215 - RNA, 15 nt, Mycobacterium bovis subsp bovis AF2122/97
ccgguagcguucggc

SEQ ID NO: 3126216 - RNA, 18 nt, Mycobacterium bovis subsp bovis AF2122/97
ccgguagcguucggcgag

SEQ ID NO: 3126217 - RNA, 15 nt, Mycobacterium bovis subsp bovis AF2122/97
ccgguagcugucgcc

SEQ ID NO: 3126218 - RNA, 17 nt, Mycobacterium bovis subsp bovis AF2122/97
ccgguagcugugguggu

SEQ ID NO: 3126219 - RNA, 15 nt, Mycobacterium bovis subsp bovis AF2122/97
ccgguaggcgagaca

SEQ ID NO: 3126220 - RNA, 16 nt, Mycobacterium bovis subsp bovis AF2122/97
ccgguaggcggccagc

SEQ ID NO: 3126221 - RNA, 18 nt, Mycobacterium bovis subsp bovis AF2122/97
ccgguaggcggccagcgc

SEQ ID NO: 3126222 - RNA, 21 nt, Mycobacterium bovis subsp bovis AF2122/97
ccgguaggcggccagcgcgcg

SEQ ID NO: 3126223 - RNA, 16 nt, Mycobacterium bovis subsp bovis AF2122/97
ccgguaguacuagcac

SEQ ID NO: 3126224 - RNA, 13 nt, Mycobacterium bovis subsp bovis AF2122/97
ccgguaguagcug

SEQ ID NO: 3126225 - RNA, 17 nt, Mycobacterium bovis subsp bovis AF2122/97
ccgguaguagcugacca

SEQ ID NO: 3126226 - RNA, 14 nt, Mycobacterium bovis subsp bovis AF2122/97
ccgguaucgccgcu

SEQ ID NO: 3126227 - RNA, 20 nt, Mycobacterium bovis subsp bovis AF2122/97
ccgguaucgccgcuacgccg

SEQ ID NO: 3126228 - RNA, 16 nt, Mycobacterium bovis subsp bovis AF2122/97
ccgguaucgucccggc

SEQ ID NO: 3126229 - RNA, 12 nt, Mycobacterium bovis subsp bovis AF2122/97
ccgguaugcgcg

SEQ ID NO: 3126230 - RNA, 16 nt, Mycobacterium bovis subsp bovis AF2122/97
ccgguauuaccgccgu

SEQ ID NO: 3126231 - RNA, 20 nt, Mycobacterium bovis subsp bovis AF2122/97
ccgguauuaccgccguggcc

SEQ ID NO: 3126232 - RNA, 21 nt, Mycobacterium bovis subsp bovis AF2122/97
ccgguauucccgcuuggcgug

SEQ ID NO: 3126233 - RNA, 16 nt, Mycobacterium bovis subsp bovis AF2122/97
ccggucaaacgcgcgc

SEQ ID NO: 3126234 - RNA, 20 nt, Mycobacterium bovis subsp bovis AF2122/97
ccggucaaacgcgcgcgcca

SEQ ID NO: 3126235 - RNA, 22 nt, Mycobacterium bovis subsp bovis AF2122/97
ccggucaaacugccaucggaca

SEQ ID NO: 3126236 - RNA, 13 nt, Mycobacterium bovis subsp bovis AF2122/97
ccggucaccgcgc

SEQ ID NO: 3126237 - RNA, 18 nt, Mycobacterium bovis subsp bovis AF2122/97
ccggucaccucgccggcg

SEQ ID NO: 3126238 - RNA, 19 nt, Mycobacterium bovis subsp bovis AF2122/97
ccggucaccucgccggcgg

SEQ ID NO: 3126239 - RNA, 21 nt, Mycobacterium bovis subsp bovis AF2122/97
ccggucagcaauacggcggcg

SEQ ID NO: 3126240 - RNA, 22 nt, Mycobacterium bovis subsp bovis AF2122/97
ccggucagcaauacggcggcgc

SEQ ID NO: 3126241 - RNA, 17 nt, Mycobacterium bovis subsp bovis AF2122/97
ccggucagcgacgcacg

SEQ ID NO: 3126242 - RNA, 19 nt, Mycobacterium bovis subsp bovis AF2122/97
ccggucagcgacgcacgca

SEQ ID NO: 3126243 - RNA, 14 nt, Mycobacterium bovis subsp bovis AF2122/97
ccggucagcgcggc

SEQ ID NO: 3126244 - RNA, 17 nt, Mycobacterium bovis subsp bovis AF2122/97
ccggucagcgcggcgca

SEQ ID NO: 3126245 - RNA, 14 nt, Mycobacterium bovis subsp bovis AF2122/97
ccggucaggacggc

SEQ ID NO: 3126246 - RNA, 17 nt, Mycobacterium bovis subsp bovis AF2122/97
ccggucaggacggcacc

SEQ ID NO: 3126247 - RNA, 21 nt, Mycobacterium bovis subsp bovis AF2122/97
ccggucaggcaguccaccgcg

SEQ ID NO: 3126248 - RNA, 16 nt, Mycobacterium bovis subsp bovis AF2122/97
ccggucaggccgccgc

SEQ ID NO: 3126249 - RNA, 19 nt, Mycobacterium bovis subsp bovis AF2122/97
ccggucaggccgccgcggc

SEQ ID NO: 3126250 - RNA, 19 nt, Mycobacterium bovis subsp bovis AF2122/97
ccggucagguacaucccgg

SEQ ID NO: 3126251 - RNA, 21 nt, Mycobacterium bovis subsp bovis AF2122/97
ccggucagguacaucccggug

SEQ ID NO: 3126252 - RNA, 21 nt, Mycobacterium bovis subsp bovis AF2122/97
ccggucauaccaagcgcggug

SEQ ID NO: 3126253 - RNA, 22 nt, Mycobacterium bovis subsp bovis AF2122/97
ccggucauccgggcgaccacca

SEQ ID NO: 3126254 - RNA, 13 nt, Mycobacterium bovis subsp bovis AF2122/97
ccgguccagaccc

SEQ ID NO: 3126255 - RNA, 23 nt, Mycobacterium bovis subsp bovis AF2122/97
ccgguccagacccagcucgucga

SEQ ID NO: 3126256 - RNA, 18 nt, Mycobacterium bovis subsp bovis AF2122/97
ccgguccagcagcucggc

SEQ ID NO: 3126257 - RNA, 19 nt, Mycobacterium bovis subsp bovis AF2122/97
ccgguccagcagcucggcc

SEQ ID NO: 3126258 - RNA, 16 nt, Mycobacterium bovis subsp bovis AF2122/97
ccgguccagcccagcg

SEQ ID NO: 3126259 - RNA, 18 nt, Mycobacterium bovis subsp bovis AF2122/97
ccgguccagcccagcgcg

SEQ ID NO: 3126260 - RNA, 13 nt, Mycobacterium bovis subsp bovis AF2122/97
ccgguccagccgg

SEQ ID NO: 3126261 - RNA, 17 nt, Mycobacterium bovis subsp bovis AF2122/97
ccgguccagcggccgcc

SEQ ID NO: 3126262 - RNA, 18 nt, Mycobacterium bovis subsp bovis AF2122/97
ccgguccagcggccgccg

SEQ ID NO: 3126263 - RNA, 19 nt, Mycobacterium bovis subsp bovis AF2122/97
ccgguccagcggccgccgc

SEQ ID NO: 3126264 - RNA, 22 nt, Mycobacterium bovis subsp bovis AF2122/97
ccgguccagcggccgccgcggc

SEQ ID NO: 3126265 - RNA, 20 nt, Mycobacterium bovis subsp bovis AF2122/97
ccgguccccccguugccgcc

SEQ ID NO: 3126266 - RNA, 15 nt, Mycobacterium bovis subsp bovis AF2122/97
ccggucccccgccca

SEQ ID NO: 3126267 - RNA, 15 nt, Mycobacterium bovis subsp bovis AF2122/97
ccggucccgccgacc

SEQ ID NO: 3126268 - RNA, 17 nt, Mycobacterium bovis subsp bovis AF2122/97
ccggucccgccgugccg

SEQ ID NO: 3126269 - RNA, 18 nt, Mycobacterium bovis subsp bovis AF2122/97
ccggucccgccgugccgc

SEQ ID NO: 3126270 - RNA, 20 nt, Mycobacterium bovis subsp bovis AF2122/97
ccggucccgcgugccacucg

SEQ ID NO: 3126271 - RNA, 16 nt, Mycobacterium bovis subsp bovis AF2122/97
ccggucccggacgugc

SEQ ID NO: 3126272 - RNA, 19 nt, Mycobacterium bovis subsp bovis AF2122/97
ccggucccggacgugccgg

SEQ ID NO: 3126273 - RNA, 20 nt, Mycobacterium bovis subsp bovis AF2122/97
ccggucccuuuguggggccg

SEQ ID NO: 3126274 - RNA, 16 nt, Mycobacterium bovis subsp bovis AF2122/97
ccgguccgccagcgcg

SEQ ID NO: 3126275 - RNA, 15 nt, Mycobacterium bovis subsp bovis AF2122/97
ccgguccgccgcaga

SEQ ID NO: 3126276 - RNA, 11 nt, Mycobacterium bovis subsp bovis AF2122/97
ccgguccggcg

SEQ ID NO: 3126277 - RNA, 14 nt, Mycobacterium bovis subsp bovis AF2122/97
ccgguccggcgucg

SEQ ID NO: 3126278 - RNA, 13 nt, Mycobacterium bovis subsp bovis AF2122/97
ccgguccgucacc

SEQ ID NO: 3126279 - RNA, 19 nt, Mycobacterium bovis subsp bovis AF2122/97
ccgguccgucaccaccgcc

SEQ ID NO: 3126280 - RNA, 21 nt, Mycobacterium bovis subsp bovis AF2122/97
ccgguccgucaccaccgccgc

SEQ ID NO: 3126281 - RNA, 17 nt, Mycobacterium bovis subsp bovis AF2122/97
ccgguccucgucggcga

SEQ ID NO: 3126282 - RNA, 16 nt, Mycobacterium bovis subsp bovis AF2122/97
ccgguccugcucgcac

SEQ ID NO: 3126283 - RNA, 20 nt, Mycobacterium bovis subsp bovis AF2122/97
ccgguccugggauccggcgg

SEQ ID NO: 3126284 - RNA, 22 nt, Mycobacterium bovis subsp bovis AF2122/97
ccgguccugggauccggcggca

SEQ ID NO: 3126285 - RNA, 23 nt, Mycobacterium bovis subsp bovis AF2122/97
ccggucgacagcgaaggcgccga

SEQ ID NO: 3126286 - RNA, 15 nt, Mycobacterium bovis subsp bovis AF2122/97
ccggucgacccacuc

SEQ ID NO: 3126287 - RNA, 18 nt, Mycobacterium bovis subsp bovis AF2122/97
ccggucgacccacucauc

SEQ ID NO: 3126288 - RNA, 19 nt, Mycobacterium bovis subsp bovis AF2122/97
ccggucgacgggucggcgc

SEQ ID NO: 3126289 - RNA, 21 nt, Mycobacterium bovis subsp bovis AF2122/97
ccggucgacgggucggcgccg

SEQ ID NO: 3126290 - RNA, 16 nt, Mycobacterium bovis subsp bovis AF2122/97
ccggucgacuccagca

SEQ ID NO: 3126291 - RNA, 22 nt, Mycobacterium bovis subsp bovis AF2122/97
ccggucgacuccagcaccagca

SEQ ID NO: 3126292 - RNA, 20 nt, Mycobacterium bovis subsp bovis AF2122/97
ccggucgagccagcggagca

SEQ ID NO: 3126293 - RNA, 19 nt, Mycobacterium bovis subsp bovis AF2122/97
ccggucgaggucggcgauc

SEQ ID NO: 3126294 - RNA, 14 nt, Mycobacterium bovis subsp bovis AF2122/97
ccggucgaggugac

SEQ ID NO: 3126295 - RNA, 17 nt, Mycobacterium bovis subsp bovis AF2122/97
ccggucgaugaccucca

SEQ ID NO: 3126296 - RNA, 19 nt, Mycobacterium bovis subsp bovis AF2122/97
ccggucgaugaccucguca

SEQ ID NO: 3126297 - RNA, 11 nt, Mycobacterium bovis subsp bovis AF2122/97
ccggucgaugu

SEQ ID NO: 3126298 - RNA, 17 nt, Mycobacterium bovis subsp bovis AF2122/97
ccggugauggccgacca

SEQ ID NO: 3126299 - RNA, 18 nt, Mycobacterium bovis subsp bovis AF2122/97
ccggugauggccgaccag

SEQ ID NO: 3126300 - RNA, 19 nt, Mycobacterium bovis subsp bovis AF2122/97
ccggugauggccgaccagc

SEQ ID NO: 3126301 - RNA, 20 nt, Mycobacterium bovis subsp bovis AF2122/97
ccggugauggccgaccagcc

SEQ ID NO: 3126302 - RNA, 21 nt, Mycobacterium bovis subsp bovis AF2122/97
ccggugauggccgaccagccg

SEQ ID NO: 3126303 - RNA, 16 nt, Mycobacterium bovis subsp bovis AF2122/97
ccggugauggugacca

SEQ ID NO: 3126304 - RNA, 19 nt, Mycobacterium bovis subsp bovis AF2122/97
ccggugauggugaccagca

SEQ ID NO: 3126305 - RNA, 23 nt, Mycobacterium bovis subsp bovis AF2122/97
ccggugauggugaccagcaggcc

SEQ ID NO: 3126306 - RNA, 18 nt, Mycobacterium bovis subsp bovis AF2122/97
ccggugauggugccaucc

SEQ ID NO: 3126307 - RNA, 19 nt, Mycobacterium bovis subsp bovis AF2122/97
ccggugauggugugcagca

SEQ ID NO: 3126308 - RNA, 23 nt, Mycobacterium bovis subsp bovis AF2122/97
ccggugauguagagcucaccguc

SEQ ID NO: 3126309 - RNA, 20 nt, Mycobacterium bovis subsp bovis AF2122/97
ccggugauguccgcacaacg

SEQ ID NO: 3126310 - RNA, 23 nt, Mycobacterium bovis subsp bovis AF2122/97
ccggugcaaccccaaguccagca

SEQ ID NO: 3126311 - RNA, 17 nt, Mycobacterium bovis subsp bovis AF2122/97
ccggugccacccuugcc

SEQ ID NO: 3126312 - RNA, 19 nt, Mycobacterium bovis subsp bovis AF2122/97
ccggugccaccggcuggug

SEQ ID NO: 3126313 - RNA, 20 nt, Mycobacterium bovis subsp bovis AF2122/97
ccggugccacugccguugcc

SEQ ID NO: 3126314 - RNA, 16 nt, Mycobacterium bovis subsp bovis AF2122/97
ccggugcccaccaccg

SEQ ID NO: 3126315 - RNA, 22 nt, Mycobacterium bovis subsp bovis AF2122/97
ccggugcccaccaccgacagca

SEQ ID NO: 3126316 - RNA, 20 nt, Mycobacterium bovis subsp bovis AF2122/97
ccggugcccgcaccacaccg

SEQ ID NO: 3126317 - RNA, 14 nt, Mycobacterium bovis subsp bovis AF2122/97
ccggugccgaccgg

SEQ ID NO: 3126318 - RNA, 13 nt, Mycobacterium bovis subsp bovis AF2122/97
ccggugccgacgg

SEQ ID NO: 3126319 - RNA, 14 nt, Mycobacterium bovis subsp bovis AF2122/97
ccggugccgacggc

SEQ ID NO: 3126320 - RNA, 18 nt, Mycobacterium bovis subsp bovis AF2122/97
ccggugccgacggcgccg

SEQ ID NO: 3126321 - RNA, 13 nt, Mycobacterium bovis subsp bovis AF2122/97
ccggugccgccau

SEQ ID NO: 3126322 - RNA, 21 nt, Mycobacterium bovis subsp bovis AF2122/97
ccggugccgccaucgccgccg

SEQ ID NO: 3126323 - RNA, 17 nt, Mycobacterium bovis subsp bovis AF2122/97
ccggugccgccauugac

SEQ ID NO: 3126324 - RNA, 19 nt, Mycobacterium bovis subsp bovis AF2122/97
ccggugccgccauugacgc

SEQ ID NO: 3126325 - RNA, 14 nt, Mycobacterium bovis subsp bovis AF2122/97
ccggugccgcccga

SEQ ID NO: 3126326 - RNA, 17 nt, Mycobacterium bovis subsp bovis AF2122/97
ccggugccgcccgagcc

SEQ ID NO: 3126327 - RNA, 15 nt, Mycobacterium bovis subsp bovis AF2122/97
ccggugccgcccgcg

SEQ ID NO: 3126328 - RNA, 16 nt, Mycobacterium bovis subsp bovis AF2122/97
ccggugccgcccgcgc

SEQ ID NO: 3126329 - RNA, 21 nt, Mycobacterium bovis subsp bovis AF2122/97
ccggugccgcccgcgccgccg

SEQ ID NO: 3126330 - RNA, 22 nt, Mycobacterium bovis subsp bovis AF2122/97
ccggugccgcccgcgccgccgc

SEQ ID NO: 3126331 - RNA, 20 nt, Mycobacterium bovis subsp bovis AF2122/97
ccggugccgcccgcgccucc

SEQ ID NO: 3126332 - RNA, 13 nt, Mycobacterium bovis subsp bovis AF2122/97
ccggugccgccga

SEQ ID NO: 3126333 - RNA, 13 nt, Mycobacterium bovis subsp bovis AF2122/97
ccggugccgccgc

SEQ ID NO: 3126334 - RNA, 15 nt, Mycobacterium bovis subsp bovis AF2122/97
ccggugccgccgccu

SEQ ID NO: 3126335 - RNA, 14 nt, Mycobacterium bovis subsp bovis AF2122/97
ccggugccgccgcg

SEQ ID NO: 3126336 - RNA, 16 nt, Mycobacterium bovis subsp bovis AF2122/97
ccggugccgccgcggc

SEQ ID NO: 3126337 - RNA, 23 nt, Mycobacterium bovis subsp bovis AF2122/97
ccggugccgccgcggccaccacc

SEQ ID NO: 3126338 - RNA, 14 nt, Mycobacterium bovis subsp bovis AF2122/97
ccggugccgccggu

SEQ ID NO: 3126339 - RNA, 16 nt, Mycobacterium bovis subsp bovis AF2122/97
ccggugccgccggugc

SEQ ID NO: 3126340 - RNA, 20 nt, Mycobacterium bovis subsp bovis AF2122/97
ccggugccgccggugccgcc

SEQ ID NO: 3126341 - RNA, 21 nt, Mycobacterium bovis subsp bovis AF2122/97
ccggugccgccggugccgcca

SEQ ID NO: 3126342 - RNA, 16 nt, Mycobacterium bovis subsp bovis AF2122/97
ccggugccgccgucgc

SEQ ID NO: 3126343 - RNA, 20 nt, Mycobacterium bovis subsp bovis AF2122/97
ccggugccgccgucgccgcc

SEQ ID NO: 3126344 - RNA, 20 nt, Mycobacterium bovis subsp bovis AF2122/97
ccggugccgccguugccauu

SEQ ID NO: 3126345 - RNA, 23 nt, Mycobacterium bovis subsp bovis AF2122/97
ccggugccgccguugccauugcc

SEQ ID NO: 3126346 - RNA, 12 nt, Mycobacterium bovis subsp bovis AF2122/97
ccggugccgccu

SEQ ID NO: 3126347 - RNA, 13 nt, Mycobacterium bovis subsp bovis AF2122/97
ccggugccgcggu

SEQ ID NO: 3126348 - RNA, 12 nt, Mycobacterium bovis subsp bovis AF2122/97
ccggugccggcc

SEQ ID NO: 3126349 - RNA, 14 nt, Mycobacterium bovis subsp bovis AF2122/97
ccggugccggcgac

SEQ ID NO: 3126350 - RNA, 17 nt, Mycobacterium bovis subsp bovis AF2122/97
ccggugccggcgacgcu

SEQ ID NO: 3126351 - RNA, 14 nt, Mycobacterium bovis subsp bovis AF2122/97
ccggugccggcgca

SEQ ID NO: 3126352 - RNA, 15 nt, Mycobacterium bovis subsp bovis AF2122/97
ccggugccggcguug

SEQ ID NO: 3126353 - RNA, 21 nt, Mycobacterium bovis subsp bovis AF2122/97
ccggugccggcguugccgccg

SEQ ID NO: 3126354 - RNA, 20 nt, Mycobacterium bovis subsp bovis AF2122/97
ccggugccgggaugccgccg

SEQ ID NO: 3126355 - RNA, 22 nt, Mycobacterium bovis subsp bovis AF2122/97
ccggugccgggaugccgccgcu

SEQ ID NO: 3126356 - RNA, 16 nt, Mycobacterium bovis subsp bovis AF2122/97
ccggugccgggcacca

SEQ ID NO: 3126357 - RNA, 21 nt, Mycobacterium bovis subsp bovis AF2122/97
ccggugccggucgagugccuc

SEQ ID NO: 3126358 - RNA, 13 nt, Mycobacterium bovis subsp bovis AF2122/97
ccggugccguugg

SEQ ID NO: 3126359 - RNA, 21 nt, Mycobacterium bovis subsp bovis AF2122/97
ccggugccguuggagccgcca

SEQ ID NO: 3126360 - RNA, 20 nt, Mycobacterium bovis subsp bovis AF2122/97
ccggugcgaauggugcaacg

SEQ ID NO: 3126361 - RNA, 22 nt, Mycobacterium bovis subsp bovis AF2122/97
ccggugcgaauggugcaacgcg

SEQ ID NO: 3126362 - RNA, 18 nt, Mycobacterium bovis subsp bovis AF2122/97
ccggugcgaccaacacgg

SEQ ID NO: 3126363 - RNA, 19 nt, Mycobacterium bovis subsp bovis AF2122/97
ccggugcgaucccacccuc

SEQ ID NO: 3126364 - RNA, 23 nt, Mycobacterium bovis subsp bovis AF2122/97
ccggugcgaucccacccucgggu

SEQ ID NO: 3126365 - RNA, 12 nt, Mycobacterium bovis subsp bovis AF2122/97
ccggugcgcacc

SEQ ID NO: 3126366 - RNA, 16 nt, Mycobacterium bovis subsp bovis AF2122/97
ccggugcgcaccagca

SEQ ID NO: 3126367 - RNA, 12 nt, Mycobacterium bovis subsp bovis AF2122/97
ccggugcgcagc

SEQ ID NO: 3126368 - RNA, 20 nt, Mycobacterium bovis subsp bovis AF2122/97
ccggugcgcagguacgccuc

SEQ ID NO: 3126369 - RNA, 13 nt, Mycobacterium bovis subsp bovis AF2122/97
ccggugcgcaucc

SEQ ID NO: 3126370 - RNA, 15 nt, Mycobacterium bovis subsp bovis AF2122/97
ccggugcgccgaucc

SEQ ID NO: 3126371 - RNA, 20 nt, Mycobacterium bovis subsp bovis AF2122/97
ccggugcgccgaucccgccc

SEQ ID NO: 3126372 - RNA, 14 nt, Mycobacterium bovis subsp bovis AF2122/97
ccggugcgcgcggu

SEQ ID NO: 3126373 - RNA, 16 nt, Mycobacterium bovis subsp bovis AF2122/97
ccggugcggacuucga

SEQ ID NO: 3126374 - RNA, 22 nt, Mycobacterium bovis subsp bovis AF2122/97
ccggugcggccaaugacgucgg

SEQ ID NO: 3126375 - RNA, 15 nt, Mycobacterium bovis subsp bovis AF2122/97
ccggugcggcgggcu

SEQ ID NO: 3126376 - RNA, 20 nt, Mycobacterium bovis subsp bovis AF2122/97
ccggugcggcgggcucgcuu

SEQ ID NO: 3126377 - RNA, 12 nt, Mycobacterium bovis subsp bovis AF2122/97
ccggugcggugc

SEQ ID NO: 3126378 - RNA, 20 nt, Mycobacterium bovis subsp bovis AF2122/97
ccggugcgguuucaccgacg

SEQ ID NO: 3126379 - RNA, 23 nt, Mycobacterium bovis subsp bovis AF2122/97
ccggugcgguuucaccgacgacg

SEQ ID NO: 3126380 - RNA, 18 nt, Mycobacterium bovis subsp bovis AF2122/97
ccggugcgucacagccgg

SEQ ID NO: 3126381 - RNA, 17 nt, Mycobacterium bovis subsp bovis AF2122/97
ccggugcucgucgagca

SEQ ID NO: 3126382 - RNA, 18 nt, Mycobacterium bovis subsp bovis AF2122/97
ccggugcucgucgagcau

SEQ ID NO: 3126383 - RNA, 22 nt, Mycobacterium bovis subsp bovis AF2122/97
ccggugcucgucgagcaugcga

SEQ ID NO: 3126384 - RNA, 13 nt, Mycobacterium bovis subsp bovis AF2122/97
ccgguucaccaug

SEQ ID NO: 3126385 - RNA, 13 nt, Mycobacterium bovis subsp bovis AF2122/97
ccgguucagcgcu

SEQ ID NO: 3126386 - RNA, 14 nt, Mycobacterium bovis subsp bovis AF2122/97
ccgguucagcgcug

SEQ ID NO: 3126387 - RNA, 23 nt, Mycobacterium bovis subsp bovis AF2122/97
ccgguucagcgcuggcaggccgg

SEQ ID NO: 3126388 - RNA, 18 nt, Mycobacterium bovis subsp bovis AF2122/97
ccgguucagggguggcgc

SEQ ID NO: 3126389 - RNA, 21 nt, Mycobacterium bovis subsp bovis AF2122/97
ccgguucccgggcagccgcac

SEQ ID NO: 3126390 - RNA, 22 nt, Mycobacterium bovis subsp bovis AF2122/97
ccgguucccuuguucccgaaac

SEQ ID NO: 3126391 - RNA, 16 nt, Mycobacterium bovis subsp bovis AF2122/97
ccgguuccgccggccc

SEQ ID NO: 3126392 - RNA, 20 nt, Mycobacterium bovis subsp bovis AF2122/97
ccgguuccgccggccccacc

SEQ ID NO: 3126393 - RNA, 22 nt, Mycobacterium bovis subsp bovis AF2122/97
ccgguucgauggcaucggccau

SEQ ID NO: 3126394 - RNA, 15 nt, Mycobacterium bovis subsp bovis AF2122/97
ccgguucgcccagca

SEQ ID NO: 3126395 - RNA, 22 nt, Mycobacterium bovis subsp bovis AF2122/97
ccgguucggcgaucuccggcgg

SEQ ID NO: 3126396 - RNA, 20 nt, Mycobacterium bovis subsp bovis AF2122/97
ccgguucugcgcccacccgc

SEQ ID NO: 3126397 - RNA, 18 nt, Mycobacterium bovis subsp bovis AF2122/97
ccgguugacacccgggcc

SEQ ID NO: 3126398 - RNA, 15 nt, Mycobacterium bovis subsp bovis AF2122/97
ccgguugacgccggu

SEQ ID NO: 3126399 - RNA, 17 nt, Mycobacterium bovis subsp bovis AF2122/97
ccgguugacgggcucgg

SEQ ID NO: 3126400 - RNA, 22 nt, Mycobacterium bovis subsp bovis AF2122/97
ccgguugacgggcucggcaggc

SEQ ID NO: 3126401 - RNA, 23 nt, Mycobacterium bovis subsp bovis AF2122/97
ccgguugacucgcuccgaccggu

SEQ ID NO: 3126402 - RNA, 18 nt, Mycobacterium bovis subsp bovis AF2122/97
ccgguugccaccugugcg

SEQ ID NO: 3126403 - RNA, 20 nt, Mycobacterium bovis subsp bovis AF2122/97
ccgguugcggcugcguuggc

SEQ ID NO: 3126404 - RNA, 20 nt, Mycobacterium bovis subsp bovis AF2122/97
ccgguugcggucaucggcgc

SEQ ID NO: 3126405 - RNA, 19 nt, Mycobacterium bovis subsp bovis AF2122/97
ccgguuggcgauccgcggc

SEQ ID NO: 3126406 - RNA, 18 nt, Mycobacterium bovis subsp bovis AF2122/97
ccgguuggcgcgggcgag

SEQ ID NO: 3126407 - RNA, 16 nt, Mycobacterium bovis subsp bovis AF2122/97
ccgguugggguggcgg

SEQ ID NO: 3126408 - RNA, 17 nt, Mycobacterium bovis subsp bovis AF2122/97
ccgguugucgcagcgca

SEQ ID NO: 3126409 - RNA, 17 nt, Mycobacterium bovis subsp bovis AF2122/97
ccgguugugcgcgcgcc

SEQ ID NO: 3126410 - RNA, 18 nt, Mycobacterium bovis subsp bovis AF2122/97
ccgguugugcgcgcgccc

SEQ ID NO: 3126411 - RNA, 15 nt, Mycobacterium bovis subsp bovis AF2122/97
ccgguuucuucggcc

SEQ ID NO: 3126412 - RNA, 18 nt, Mycobacterium bovis subsp bovis AF2122/97
ccgguuugacguccaggg

SEQ ID NO: 3126413 - RNA, 19 nt, Mycobacterium bovis subsp bovis AF2122/97
ccgguuugcacgcaccaca

SEQ ID NO: 3126414 - RNA, 16 nt, Mycobacterium bovis subsp bovis AF2122/97
ccguaacagccggccg

SEQ ID NO: 3126415 - RNA, 20 nt, Mycobacterium bovis subsp bovis AF2122/97
ccguaacagccggccggauc

SEQ ID NO: 3126416 - RNA, 19 nt, Mycobacterium bovis subsp bovis AF2122/97
ccguaacgccaagcucggc

SEQ ID NO: 3126417 - RNA, 20 nt, Mycobacterium bovis subsp bovis AF2122/97
ccguaacgcggaucgggcac

SEQ ID NO: 3126418 - RNA, 15 nt, Mycobacterium bovis subsp bovis AF2122/97
ccguaagcaccagcc

SEQ ID NO: 3126419 - RNA, 16 nt, Mycobacterium bovis subsp bovis AF2122/97
ccguaagcaccagcca

SEQ ID NO: 3126420 - RNA, 22 nt, Mycobacterium bovis subsp bovis AF2122/97
ccguaagcggauguccccgacg

SEQ ID NO: 3126421 - RNA, 15 nt, Mycobacterium bovis subsp bovis AF2122/97
ccguacagcccggcc

SEQ ID NO: 3126422 - RNA, 13 nt, Mycobacterium bovis subsp bovis AF2122/97
ccguacagcggcg

SEQ ID NO: 3126423 - RNA, 18 nt, Mycobacterium bovis subsp bovis AF2122/97
ccguacaguccacgcgua

SEQ ID NO: 3126424 - RNA, 14 nt, Mycobacterium bovis subsp bovis AF2122/97
ccguacccacgacg

SEQ ID NO: 3126425 - RNA, 12 nt, Mycobacterium bovis subsp bovis AF2122/97
ccguaccgguga

SEQ ID NO: 3126426 - RNA, 13 nt, Mycobacterium bovis subsp bovis AF2122/97
ccguacgccggcg

SEQ ID NO: 3126427 - RNA, 19 nt, Mycobacterium bovis subsp bovis AF2122/97
ccguagaagcgcuccagcu

SEQ ID NO: 3126428 - RNA, 13 nt, Mycobacterium bovis subsp bovis AF2122/97
ccguagacccaca

SEQ ID NO: 3126429 - RNA, 22 nt, Mycobacterium bovis subsp bovis AF2122/97
ccguagacccacagucgccggc

SEQ ID NO: 3126430 - RNA, 14 nt, Mycobacterium bovis subsp bovis AF2122/97
ccguagacgccgag

SEQ ID NO: 3126431 - RNA, 16 nt, Mycobacterium bovis subsp bovis AF2122/97
ccguagacgccgagca

SEQ ID NO: 3126432 - RNA, 17 nt, Mycobacterium bovis subsp bovis AF2122/97
ccguagagcuggugcgg

SEQ ID NO: 3126433 - RNA, 16 nt, Mycobacterium bovis subsp bovis AF2122/97
ccguagaugguggugg

SEQ ID NO: 3126434 - RNA, 23 nt, Mycobacterium bovis subsp bovis AF2122/97
ccguagauggugguggcccggcu

SEQ ID NO: 3126435 - RNA, 14 nt, Mycobacterium bovis subsp bovis AF2122/97
ccguagcacaccgg

SEQ ID NO: 3126436 - RNA, 16 nt, Mycobacterium bovis subsp bovis AF2122/97
ccguagcaucgggcga

SEQ ID NO: 3126437 - RNA, 14 nt, Mycobacterium bovis subsp bovis AF2122/97
ccguagccagcagg

SEQ ID NO: 3126438 - RNA, 14 nt, Mycobacterium bovis subsp bovis AF2122/97
ccguagcccacgac

SEQ ID NO: 3126439 - RNA, 15 nt, Mycobacterium bovis subsp bovis AF2122/97
ccguagcccacgacg

SEQ ID NO: 3126440 - RNA, 18 nt, Mycobacterium bovis subsp bovis AF2122/97
ccguagccggccggccca

SEQ ID NO: 3126441 - RNA, 18 nt, Mycobacterium bovis subsp bovis AF2122/97
ccguagccggcggugggg

SEQ ID NO: 3126442 - RNA, 17 nt, Mycobacterium bovis subsp bovis AF2122/97
ccguagcgcagcgccuc

SEQ ID NO: 3126443 - RNA, 16 nt, Mycobacterium bovis subsp bovis AF2122/97
ccguagcgcccacucc

SEQ ID NO: 3126444 - RNA, 17 nt, Mycobacterium bovis subsp bovis AF2122/97
ccguagcguccgcgccc

SEQ ID NO: 3126445 - RNA, 15 nt, Mycobacterium bovis subsp bovis AF2122/97
ccguagcugcgcagc

SEQ ID NO: 3126446 - RNA, 16 nt, Mycobacterium bovis subsp bovis AF2122/97
ccguagcugcgcagcg

SEQ ID NO: 3126447 - RNA, 18 nt, Mycobacterium bovis subsp bovis AF2122/97
ccguagcugcgcagcgca

SEQ ID NO: 3126448 - RNA, 14 nt, Mycobacterium bovis subsp bovis AF2122/97
ccguaggaacccga

SEQ ID NO: 3126449 - RNA, 13 nt, Mycobacterium bovis subsp bovis AF2122/97
ccguaggccacag

SEQ ID NO: 3126450 - RNA, 14 nt, Mycobacterium bovis subsp bovis AF2122/97
ccguaggccacagc

SEQ ID NO: 3126451 - RNA, 14 nt, Mycobacterium bovis subsp bovis AF2122/97
ccguaggcgccgaa

SEQ ID NO: 3126452 - RNA, 19 nt, Mycobacterium bovis subsp bovis AF2122/97
ccguaggcggcgacccgcc

SEQ ID NO: 3126453 - RNA, 16 nt, Mycobacterium bovis subsp bovis AF2122/97
ccguaggguggccgac

SEQ ID NO: 3126454 - RNA, 17 nt, Mycobacterium bovis subsp bovis AF2122/97
ccguaggguggccgacg

SEQ ID NO: 3126455 - RNA, 18 nt, Mycobacterium bovis subsp bovis AF2122/97
ccguaggugcacaacccg

SEQ ID NO: 3126456 - RNA, 21 nt, Mycobacterium bovis subsp bovis AF2122/97
ccguaguaaggagccgggccg

SEQ ID NO: 3126457 - RNA, 16 nt, Mycobacterium bovis subsp bovis AF2122/97
ccguaguaccaaagcg

SEQ ID NO: 3126458 - RNA, 14 nt, Mycobacterium bovis subsp bovis AF2122/97
ccguaguaguggcc

SEQ ID NO: 3126459 - RNA, 22 nt, Mycobacterium bovis subsp bovis AF2122/97
ccguagugaacggcucgggcag

SEQ ID NO: 3126460 - RNA, 19 nt, Mycobacterium bovis subsp bovis AF2122/97
ccguagugcacgucggcgg

SEQ ID NO: 3126461 - RNA, 15 nt, Mycobacterium bovis subsp bovis AF2122/97
ccguaguggccggcu

SEQ ID NO: 3126462 - RNA, 14 nt, Mycobacterium bovis subsp bovis AF2122/97
ccguagugucggcg

SEQ ID NO: 3126463 - RNA, 19 nt, Mycobacterium bovis subsp bovis AF2122/97
ccguaguugguccagguga

SEQ ID NO: 3126464 - RNA, 21 nt, Mycobacterium bovis subsp bovis AF2122/97
ccguauagccgacgccggugc

SEQ ID NO: 3126465 - RNA, 14 nt, Mycobacterium bovis subsp bovis AF2122/97
ccguauagcgugac

SEQ ID NO: 3126466 - RNA, 23 nt, Mycobacterium bovis subsp bovis AF2122/97
ccguauagcgugaccgugccguc

SEQ ID NO: 3126467 - RNA, 22 nt, Mycobacterium bovis subsp bovis AF2122/97
ccguauaggcccgggcggccag

SEQ ID NO: 3126468 - RNA, 13 nt, Mycobacterium bovis subsp bovis AF2122/97
ccguauccaggcg

SEQ ID NO: 3126469 - RNA, 14 nt, Mycobacterium bovis subsp bovis AF2122/97
ccguauccaggcgu

SEQ ID NO: 3126470 - RNA, 16 nt, Mycobacterium bovis subsp bovis AF2122/97
ccguaucggggcacca

SEQ ID NO: 3126471 - RNA, 19 nt, Mycobacterium bovis subsp bovis AF2122/97
ccguccggcuuggcggcga

SEQ ID NO: 3126472 - RNA, 20 nt, Mycobacterium bovis subsp bovis AF2122/97
ccguccgggcggccucccgg

SEQ ID NO: 3126473 - RNA, 22 nt, Mycobacterium bovis subsp bovis AF2122/97
ccguccgggcggccucccgggc

SEQ ID NO: 3126474 - RNA, 13 nt, Mycobacterium bovis subsp bovis AF2122/97
ccguccggggccg

SEQ ID NO: 3126475 - RNA, 14 nt, Mycobacterium bovis subsp bovis AF2122/97
ccguccggggccgc

SEQ ID NO: 3126476 - RNA, 14 nt, Mycobacterium bovis subsp bovis AF2122/97
ccguccgggucacc

SEQ ID NO: 3126477 - RNA, 15 nt, Mycobacterium bovis subsp bovis AF2122/97
ccguccgggucacca

SEQ ID NO: 3126478 - RNA, 18 nt, Mycobacterium bovis subsp bovis AF2122/97
ccguccgguggaccgccg

SEQ ID NO: 3126479 - RNA, 19 nt, Mycobacterium bovis subsp bovis AF2122/97
ccguccgguggaccgccga

SEQ ID NO: 3126480 - RNA, 19 nt, Mycobacterium bovis subsp bovis AF2122/97
ccguccucgcuauugggug

SEQ ID NO: 3126481 - RNA, 13 nt, Mycobacterium bovis subsp bovis AF2122/97
ccguccucgguca

SEQ ID NO: 3126482 - RNA, 16 nt, Mycobacterium bovis subsp bovis AF2122/97
ccguccucggucagcu

SEQ ID NO: 3126483 - RNA, 23 nt, Mycobacterium bovis subsp bovis AF2122/97
ccguccugacuuuugucacugcg

SEQ ID NO: 3126484 - RNA, 17 nt, Mycobacterium bovis subsp bovis AF2122/97
ccgucgaaauacccggu

SEQ ID NO: 3126485 - RNA, 15 nt, Mycobacterium bovis subsp bovis AF2122/97
ccgucgaacgcgcgc

SEQ ID NO: 3126486 - RNA, 18 nt, Mycobacterium bovis subsp bovis AF2122/97
ccgucgaacgcgcgcgug

SEQ ID NO: 3126487 - RNA, 21 nt, Mycobacterium bovis subsp bovis AF2122/97
ccgucgaagaugaccugaucg

SEQ ID NO: 3126488 - RNA, 22 nt, Mycobacterium bovis subsp bovis AF2122/97
ccgucgaagaugaccugaucga

SEQ ID NO: 3126489 - RNA, 19 nt, Mycobacterium bovis subsp bovis AF2122/97
ccgucgacaacaaacccgg

SEQ ID NO: 3126490 - RNA, 20 nt, Mycobacterium bovis subsp bovis AF2122/97
ccgucgacaacaaacccggc

SEQ ID NO: 3126491 - RNA, 21 nt, Mycobacterium bovis subsp bovis AF2122/97
ccgucgacaacaaacccggcc

SEQ ID NO: 3126492 - RNA, 20 nt, Mycobacterium bovis subsp bovis AF2122/97
ccgucgacaccgcggacccg

SEQ ID NO: 3126493 - RNA, 22 nt, Mycobacterium bovis subsp bovis AF2122/97
ccgucgacagucaacagggcca

SEQ ID NO: 3126494 - RNA, 23 nt, Mycobacterium bovis subsp bovis AF2122/97
ccgucgacagucaacagggccag

SEQ ID NO: 3126495 - RNA, 12 nt, Mycobacterium bovis subsp bovis AF2122/97
ccgucgaccggc

SEQ ID NO: 3126496 - RNA, 12 nt, Mycobacterium bovis subsp bovis AF2122/97
ccgucgacgcgg

SEQ ID NO: 3126497 - RNA, 14 nt, Mycobacterium bovis subsp bovis AF2122/97
ccgucgacgcggcc

SEQ ID NO: 3126498 - RNA, 14 nt, Mycobacterium bovis subsp bovis AF2122/97
ccgucgacgcgguc

SEQ ID NO: 3126499 - RNA, 17 nt, Mycobacterium bovis subsp bovis AF2122/97
ccgucgacgucgauggu

SEQ ID NO: 3126500 - RNA, 21 nt, Mycobacterium bovis subsp bovis AF2122/97
ccgucgagcaacgugacccgg

SEQ ID NO: 3126501 - RNA, 23 nt, Mycobacterium bovis subsp bovis AF2122/97
ccgucgagcaacgugacccggau

SEQ ID NO: 3126502 - RNA, 14 nt, Mycobacterium bovis subsp bovis AF2122/97
ccgucgagcacggu

SEQ ID NO: 3126503 - RNA, 19 nt, Mycobacterium bovis subsp bovis AF2122/97
ccgucgagcacggugagcc

SEQ ID NO: 3126504 - RNA, 18 nt, Mycobacterium bovis subsp bovis AF2122/97
ccgucgagccggacaggc

SEQ ID NO: 3126505 - RNA, 13 nt, Mycobacterium bovis subsp bovis AF2122/97
ccgucgagcgucu

SEQ ID NO: 3126506 - RNA, 22 nt, Mycobacterium bovis subsp bovis AF2122/97
ccgucgaguccaggccggcagc

SEQ ID NO: 3126507 - RNA, 16 nt, Mycobacterium bovis subsp bovis AF2122/97
ccgucgagucgccgag

SEQ ID NO: 3126508 - RNA, 17 nt, Mycobacterium bovis subsp bovis AF2122/97
ccgucgaguuccggccg

SEQ ID NO: 3126509 - RNA, 16 nt, Mycobacterium bovis subsp bovis AF2122/97
ccgucgaucaagugcg

SEQ ID NO: 3126510 - RNA, 15 nt, Mycobacterium bovis subsp bovis AF2122/97
ccgucgaucagcggc

SEQ ID NO: 3126511 - RNA, 19 nt, Mycobacterium bovis subsp bovis AF2122/97
ccgucgauccgucggcgga

SEQ ID NO: 3126512 - RNA, 17 nt, Mycobacterium bovis subsp bovis AF2122/97
ccgucgaugaccagcac

SEQ ID NO: 3126513 - RNA, 17 nt, Mycobacterium bovis subsp bovis AF2122/97
ccgucgauggaccgcac

SEQ ID NO: 3126514 - RNA, 18 nt, Mycobacterium bovis subsp bovis AF2122/97
ccgucgauggucagcaga

SEQ ID NO: 3126515 - RNA, 18 nt, Mycobacterium bovis subsp bovis AF2122/97
ccgucgauguugcccagc

SEQ ID NO: 3126516 - RNA, 22 nt, Mycobacterium bovis subsp bovis AF2122/97
ccgucgauuucgacgaccaccu

SEQ ID NO: 3126517 - RNA, 13 nt, Mycobacterium bovis subsp bovis AF2122/97
ccgucgcaccaga

SEQ ID NO: 3126518 - RNA, 12 nt, Mycobacterium bovis subsp bovis AF2122/97
ccgucgcagcca

SEQ ID NO: 3126519 - RNA, 14 nt, Mycobacterium bovis subsp bovis AF2122/97
ccgucgcagccagc

SEQ ID NO: 3126520 - RNA, 17 nt, Mycobacterium bovis subsp bovis AF2122/97
ccgucgccaaucugcgc

SEQ ID NO: 3126521 - RNA, 14 nt, Mycobacterium bovis subsp bovis AF2122/97
ccgucgccaccggu

SEQ ID NO: 3126522 - RNA, 22 nt, Mycobacterium bovis subsp bovis AF2122/97
ccgucgccacgcccagcgcccg

SEQ ID NO: 3126523 - RNA, 12 nt, Mycobacterium bovis subsp bovis AF2122/97
ccgucgcccggg

SEQ ID NO: 3126524 - RNA, 22 nt, Mycobacterium bovis subsp bovis AF2122/97
ccgucgcccuuagggucgccgc

SEQ ID NO: 3126525 - RNA, 18 nt, Mycobacterium bovis subsp bovis AF2122/97
ccgucgccgaacagugcg

SEQ ID NO: 3126526 - RNA, 21 nt, Mycobacterium bovis subsp bovis AF2122/97
ccgucgccgaucagcugcgca

SEQ ID NO: 3126527 - RNA, 12 nt, Mycobacterium bovis subsp bovis AF2122/97
ccgucgccgccc

SEQ ID NO: 3126528 - RNA, 14 nt, Mycobacterium bovis subsp bovis AF2122/97
ccgucgccgcccgu

SEQ ID NO: 3126529 - RNA, 18 nt, Mycobacterium bovis subsp bovis AF2122/97
ccgucgccgcccgugccg

SEQ ID NO: 3126530 - RNA, 19 nt, Mycobacterium bovis subsp bovis AF2122/97
ccgucgccgcccgugccgc

SEQ ID NO: 3126531 - RNA, 18 nt, Mycobacterium bovis subsp bovis AF2122/97
ccgucgccgcccuggccg

SEQ ID NO: 3126532 - RNA, 14 nt, Mycobacterium bovis subsp bovis AF2122/97
ccgucgccgccgcu

SEQ ID NO: 3126533 - RNA, 23 nt, Mycobacterium bovis subsp bovis AF2122/97
ccgucgccgccggcgccgccggu

SEQ ID NO: 3126534 - RNA, 21 nt, Mycobacterium bovis subsp bovis AF2122/97
ccgucgccgccggcuccggcg

SEQ ID NO: 3126535 - RNA, 22 nt, Mycobacterium bovis subsp bovis AF2122/97
ccgucgccgccgucaccgcccu

SEQ ID NO: 3126536 - RNA, 18 nt, Mycobacterium bovis subsp bovis AF2122/97
ccgucgccgccguugccg

SEQ ID NO: 3126537 - RNA, 24 nt, Mycobacterium bovis subsp bovis AF2122/97
ccgucgccggucaggccgccgcgg

SEQ ID NO: 3126538 - RNA, 20 nt, Mycobacterium bovis subsp bovis AF2122/97
ccgucgccggugacgacguc

SEQ ID NO: 3126539 - RNA, 16 nt, Mycobacterium bovis subsp bovis AF2122/97
ccgucgccggugccgg

SEQ ID NO: 3126540 - RNA, 21 nt, Mycobacterium bovis subsp bovis AF2122/97
ccgucgccuccagcagguccg

SEQ ID NO: 3126541 - RNA, 14 nt, Mycobacterium bovis subsp bovis AF2122/97
ccgucgccugccga

SEQ ID NO: 3126542 - RNA, 16 nt, Mycobacterium bovis subsp bovis AF2122/97
ccgucgccugccgacg

SEQ ID NO: 3126543 - RNA, 15 nt, Mycobacterium bovis subsp bovis AF2122/97
ccgucgcgacgucgg

SEQ ID NO: 3126544 - RNA, 17 nt, Mycobacterium bovis subsp bovis AF2122/97
ccgucgcgacgucggcc

SEQ ID NO: 3126545 - RNA, 19 nt, Mycobacterium bovis subsp bovis AF2122/97
ccgucgcgacgucggccgu

SEQ ID NO: 3126546 - RNA, 23 nt, Mycobacterium bovis subsp bovis AF2122/97
ccgucgcgccucaucggcuuuga

SEQ ID NO: 3126547 - RNA, 19 nt, Mycobacterium bovis subsp bovis AF2122/97
ccgucgcgcugccggccgc

SEQ ID NO: 3126548 - RNA, 19 nt, Mycobacterium bovis subsp bovis AF2122/97
ccgucgcggccggcggccg

SEQ ID NO: 3126549 - RNA, 15 nt, Mycobacterium bovis subsp bovis AF2122/97
ccgucgcggcggcac

SEQ ID NO: 3126550 - RNA, 14 nt, Mycobacterium bovis subsp bovis AF2122/97
ccgucgcggucaac

SEQ ID NO: 3126551 - RNA, 14 nt, Mycobacterium bovis subsp bovis AF2122/97
ccgucgcgucgacc

SEQ ID NO: 3126552 - RNA, 17 nt, Mycobacterium bovis subsp bovis AF2122/97
ccgucgcgucgaccgga

SEQ ID NO: 3126553 - RNA, 20 nt, Mycobacterium bovis subsp bovis AF2122/97
ccgucgcgucgaccggacaa

SEQ ID NO: 3126554 - RNA, 18 nt, Mycobacterium bovis subsp bovis AF2122/97
ccgucgcuacccgccacg

SEQ ID NO: 3126555 - RNA, 14 nt, Mycobacterium bovis subsp bovis AF2122/97
ccgucgcuagggug

SEQ ID NO: 3126556 - RNA, 18 nt, Mycobacterium bovis subsp bovis AF2122/97
ccgucgcuagggugagcc

SEQ ID NO: 3126557 - RNA, 14 nt, Mycobacterium bovis subsp bovis AF2122/97
ccgucgucggucuc

SEQ ID NO: 3126558 - RNA, 15 nt, Mycobacterium bovis subsp bovis AF2122/97
ccgucgucguacggc

SEQ ID NO: 3126559 - RNA, 16 nt, Mycobacterium bovis subsp bovis AF2122/97
ccgucgucgucgacac

SEQ ID NO: 3126560 - RNA, 23 nt, Mycobacterium bovis subsp bovis AF2122/97
ccgucgucgucgcuguaggcgau

SEQ ID NO: 3126561 - RNA, 16 nt, Mycobacterium bovis subsp bovis AF2122/97
ccgucgucgugcacga

SEQ ID NO: 3126562 - RNA, 21 nt, Mycobacterium bovis subsp bovis AF2122/97
ccgucgucgugcacgacgaca

SEQ ID NO: 3126563 - RNA, 22 nt, Mycobacterium bovis subsp bovis AF2122/97
ccgucgucguuucgccagccgg

SEQ ID NO: 3126564 - RNA, 16 nt, Mycobacterium bovis subsp bovis AF2122/97
ccgucgugaccgaccg

SEQ ID NO: 3126565 - RNA, 19 nt, Mycobacterium bovis subsp bovis AF2122/97
ccgucgugaucggcgaacc

SEQ ID NO: 3126566 - RNA, 16 nt, Mycobacterium bovis subsp bovis AF2122/97
ccgucgugcgugcggc

SEQ ID NO: 3126567 - RNA, 18 nt, Mycobacterium bovis subsp bovis AF2122/97
ccgucgugcgugcggcga

SEQ ID NO: 3126568 - RNA, 18 nt, Mycobacterium bovis subsp bovis AF2122/97
ccgucguggcgguggccg

SEQ ID NO: 3126569 - RNA, 24 nt, Mycobacterium bovis subsp bovis AF2122/97
ccgucguggcgguggccgucgggu

SEQ ID NO: 3126570 - RNA, 19 nt, Mycobacterium bovis subsp bovis AF2122/97
ccgucgugugguucacucu

SEQ ID NO: 3126571 - RNA, 19 nt, Mycobacterium bovis subsp bovis AF2122/97
ccgucguuaagacggcgac

SEQ ID NO: 3126572 - RNA, 23 nt, Mycobacterium bovis subsp bovis AF2122/97
ccgucguuaagacggcgacgaca

SEQ ID NO: 3126573 - RNA, 20 nt, Mycobacterium bovis subsp bovis AF2122/97
ccgucguugcccgacccgcc

SEQ ID NO: 3126574 - RNA, 19 nt, Mycobacterium bovis subsp bovis AF2122/97
ccgucuccggcgccaccgc

SEQ ID NO: 3126575 - RNA, 12 nt, Mycobacterium bovis subsp bovis AF2122/97
ccgucucgacac

SEQ ID NO: 3126576 - RNA, 14 nt, Mycobacterium bovis subsp bovis AF2122/97
ccgucucgaucgcg

SEQ ID NO: 3126577 - RNA, 19 nt, Mycobacterium bovis subsp bovis AF2122/97
ccgucucgcaccgcguuga

SEQ ID NO: 3126578 - RNA, 13 nt, Mycobacterium bovis subsp bovis AF2122/97
ccgucucgccccc

SEQ ID NO: 3126579 - RNA, 13 nt, Mycobacterium bovis subsp bovis AF2122/97
ccgucucgccgcg

SEQ ID NO: 3126580 - RNA, 14 nt, Mycobacterium bovis subsp bovis AF2122/97
ccgucucgccgcgc

SEQ ID NO: 3126581 - RNA, 14 nt, Mycobacterium bovis subsp bovis AF2122/97
ccgucucgccgugg

SEQ ID NO: 3126582 - RNA, 13 nt, Mycobacterium bovis subsp bovis AF2122/97
ccgucucggcgac

SEQ ID NO: 3126583 - RNA, 15 nt, Mycobacterium bovis subsp bovis AF2122/97
ccgucucggcgaccg

SEQ ID NO: 3126584 - RNA, 20 nt, Mycobacterium bovis subsp bovis AF2122/97
ccgucucggcgaccgacgcc

SEQ ID NO: 3126585 - RNA, 12 nt, Mycobacterium bovis subsp bovis AF2122/97
ccgucucugcca

SEQ ID NO: 3126586 - RNA, 14 nt, Mycobacterium bovis subsp bovis AF2122/97
ccgucucugccacg

SEQ ID NO: 3126587 - RNA, 14 nt, Mycobacterium bovis subsp bovis AF2122/97
ccgucugacagcau

SEQ ID NO: 3126588 - RNA, 23 nt, Mycobacterium bovis subsp bovis AF2122/97
ccgucugacagcauccuucgcgu

SEQ ID NO: 3126589 - RNA, 22 nt, Mycobacterium bovis subsp bovis AF2122/97
ccgucugacccaccgccccggc

SEQ ID NO: 3126590 - RNA, 12 nt, Mycobacterium bovis subsp bovis AF2122/97
ccgucugaucac

SEQ ID NO: 3126591 - RNA, 15 nt, Mycobacterium bovis subsp bovis AF2122/97
ccgucugcgacccgg

SEQ ID NO: 3126592 - RNA, 18 nt, Mycobacterium bovis subsp bovis AF2122/97
ccgucugcgacccgggcc

SEQ ID NO: 3126593 - RNA, 22 nt, Mycobacterium bovis subsp bovis AF2122/97
ccgucugcgacccgggccgcgg

SEQ ID NO: 3126594 - RNA, 23 nt, Mycobacterium bovis subsp bovis AF2122/97
ccgucugcgacccgggccgcggc

SEQ ID NO: 3126595 - RNA, 21 nt, Mycobacterium bovis subsp bovis AF2122/97
ccgucugcggaccggcgcgcu

SEQ ID NO: 3126596 - RNA, 11 nt, Mycobacterium bovis subsp bovis AF2122/97
ccgucugcggu

SEQ ID NO: 3126597 - RNA, 15 nt, Mycobacterium bovis subsp bovis AF2122/97
ccgucuggccguugc

SEQ ID NO: 3126598 - RNA, 16 nt, Mycobacterium bovis subsp bovis AF2122/97
ccgucuuaucggcguc

SEQ ID NO: 3126599 - RNA, 15 nt, Mycobacterium bovis subsp bovis AF2122/97
ccgucuuccagccag

SEQ ID NO: 3126600 - RNA, 14 nt, Mycobacterium bovis subsp bovis AF2122/97
ccgucuuggcccgg

SEQ ID NO: 3126601 - RNA, 16 nt, Mycobacterium bovis subsp bovis AF2122/97
ccgucuuggcccgguc

SEQ ID NO: 3126602 - RNA, 20 nt, Mycobacterium bovis subsp bovis AF2122/97
ccgucuuggcccgguccgcc

SEQ ID NO: 3126603 - RNA, 23 nt, Mycobacterium bovis subsp bovis AF2122/97
ccgucuuuggugccgagcagcuu

SEQ ID NO: 3126604 - RNA, 21 nt, Mycobacterium bovis subsp bovis AF2122/97
ccgucuuugucacgcaccgcg

SEQ ID NO: 3126605 - RNA, 22 nt, Mycobacterium bovis subsp bovis AF2122/97
ccgucuuugucacgcaccgcgg

SEQ ID NO: 3126606 - RNA, 15 nt, Mycobacterium bovis subsp bovis AF2122/97
ccgugaaccgcccgc

SEQ ID NO: 3126607 - RNA, 17 nt, Mycobacterium bovis subsp bovis AF2122/97
ccgugaagcccuggcca

SEQ ID NO: 3126608 - RNA, 16 nt, Mycobacterium bovis subsp bovis AF2122/97
ccgugaaucgagcacc

SEQ ID NO: 3126609 - RNA, 18 nt, Mycobacterium bovis subsp bovis AF2122/97
ccgugaaucgagcaccgc

SEQ ID NO: 3126610 - RNA, 22 nt, Mycobacterium bovis subsp bovis AF2122/97
ccgugaauggcagcacgaccug

SEQ ID NO: 3126611 - RNA, 23 nt, Mycobacterium bovis subsp bovis AF2122/97
ccgugacaccggggacgucgacu

SEQ ID NO: 3126612 - RNA, 21 nt, Mycobacterium bovis subsp bovis AF2122/97
ccgugacagcggcauugccag

SEQ ID NO: 3126613 - RNA, 20 nt, Mycobacterium bovis subsp bovis AF2122/97
ccgugacccauucucggccg

SEQ ID NO: 3126614 - RNA, 22 nt, Mycobacterium bovis subsp bovis AF2122/97
ccgugacccauucucggccggc

SEQ ID NO: 3126615 - RNA, 14 nt, Mycobacterium bovis subsp bovis AF2122/97
ccgugaccgccgcg

SEQ ID NO: 3126616 - RNA, 17 nt, Mycobacterium bovis subsp bovis AF2122/97
ccgugaccgccgcgccg

SEQ ID NO: 3126617 - RNA, 19 nt, Mycobacterium bovis subsp bovis AF2122/97
ccgugaccgccgcgccggc

SEQ ID NO: 3126618 - RNA, 16 nt, Mycobacterium bovis subsp bovis AF2122/97
ccgugacguagggcag

SEQ ID NO: 3126619 - RNA, 20 nt, Mycobacterium bovis subsp bovis AF2122/97
ccgugacguagggcagcgcc

SEQ ID NO: 3126620 - RNA, 22 nt, Mycobacterium bovis subsp bovis AF2122/97
ccgugacguagggcagcgccag

SEQ ID NO: 3126621 - RNA, 18 nt, Mycobacterium bovis subsp bovis AF2122/97
ccgugacguaucgccgcg

SEQ ID NO: 3126622 - RNA, 14 nt, Mycobacterium bovis subsp bovis AF2122/97
ccgugagcaccagc

SEQ ID NO: 3126623 - RNA, 17 nt, Mycobacterium bovis subsp bovis AF2122/97
ccgugagccggaccggc

SEQ ID NO: 3126624 - RNA, 18 nt, Mycobacterium bovis subsp bovis AF2122/97
ccgugaguucacguucgg

SEQ ID NO: 3126625 - RNA, 20 nt, Mycobacterium bovis subsp bovis AF2122/97
ccgugaguucacguucggcg

SEQ ID NO: 3126626 - RNA, 21 nt, Mycobacterium bovis subsp bovis AF2122/97
ccgugaucagcucgcgcacgu

SEQ ID NO: 3126627 - RNA, 19 nt, Mycobacterium bovis subsp bovis AF2122/97
ccgugaucgaggcggcggu

SEQ ID NO: 3126628 - RNA, 14 nt, Mycobacterium bovis subsp bovis AF2122/97
ccgugaucggcgcc

SEQ ID NO: 3126629 - RNA, 19 nt, Mycobacterium bovis subsp bovis AF2122/97
ccgugaugucccgcaaaau

SEQ ID NO: 3126630 - RNA, 12 nt, Mycobacterium bovis subsp bovis AF2122/97
ccgugcaccagc

SEQ ID NO: 3126631 - RNA, 16 nt, Mycobacterium bovis subsp bovis AF2122/97
ccgugcaccagcgacc

SEQ ID NO: 3126632 - RNA, 19 nt, Mycobacterium bovis subsp bovis AF2122/97
ccgugcaccagcucacccg

SEQ ID NO: 3126633 - RNA, 16 nt, Mycobacterium bovis subsp bovis AF2122/97
ccgugcacgaucgcgg

SEQ ID NO: 3126634 - RNA, 16 nt, Mycobacterium bovis subsp bovis AF2122/97
ccgugcacgucagcgg

SEQ ID NO: 3126635 - RNA, 20 nt, Mycobacterium bovis subsp bovis AF2122/97
ccgugcagcucggucagcgu

SEQ ID NO: 3126636 - RNA, 20 nt, Mycobacterium bovis subsp bovis AF2122/97
ccgugcagggcauugcggcc

SEQ ID NO: 3126637 - RNA, 23 nt, Mycobacterium bovis subsp bovis AF2122/97
ccgugcagggcauugcggcccgc

SEQ ID NO: 3126638 - RNA, 14 nt, Mycobacterium bovis subsp bovis AF2122/97
ccgugccagcaggg

SEQ ID NO: 3126639 - RNA, 11 nt, Mycobacterium bovis subsp bovis AF2122/97
ccgugccagcu

SEQ ID NO: 3126640 - RNA, 16 nt, Mycobacterium bovis subsp bovis AF2122/97
ccgugccagcugccga

SEQ ID NO: 3126641 - RNA, 14 nt, Mycobacterium bovis subsp bovis AF2122/97
ccgugcccaggcca

SEQ ID NO: 3126642 - RNA, 19 nt, Mycobacterium bovis subsp bovis AF2122/97
ccgugcccaggccaccggc

SEQ ID NO: 3126643 - RNA, 20 nt, Mycobacterium bovis subsp bovis AF2122/97
ccgugucgcagaucaggacg

SEQ ID NO: 3126644 - RNA, 14 nt, Mycobacterium bovis subsp bovis AF2122/97
ccgugucgccggcg

SEQ ID NO: 3126645 - RNA, 17 nt, Mycobacterium bovis subsp bovis AF2122/97
ccgugucgccggcgaag

SEQ ID NO: 3126646 - RNA, 14 nt, Mycobacterium bovis subsp bovis AF2122/97
ccgugugcacgcga

SEQ ID NO: 3126647 - RNA, 19 nt, Mycobacterium bovis subsp bovis AF2122/97
ccguguggccguuggccgg

SEQ ID NO: 3126648 - RNA, 17 nt, Mycobacterium bovis subsp bovis AF2122/97
ccgugugggccccgccg

SEQ ID NO: 3126649 - RNA, 15 nt, Mycobacterium bovis subsp bovis AF2122/97
ccgugugugcgaucc

SEQ ID NO: 3126650 - RNA, 16 nt, Mycobacterium bovis subsp bovis AF2122/97
ccgugugugcgaucca

SEQ ID NO: 3126651 - RNA, 19 nt, Mycobacterium bovis subsp bovis AF2122/97
ccguguugagggugcccga

SEQ ID NO: 3126652 - RNA, 13 nt, Mycobacterium bovis subsp bovis AF2122/97
ccguguuucgaac

SEQ ID NO: 3126653 - RNA, 20 nt, Mycobacterium bovis subsp bovis AF2122/97
ccguuaauucgaaacccggc

SEQ ID NO: 3126654 - RNA, 17 nt, Mycobacterium bovis subsp bovis AF2122/97
ccguuaccgacgccggu

SEQ ID NO: 3126655 - RNA, 12 nt, Mycobacterium bovis subsp bovis AF2122/97
ccguuaccgccg

SEQ ID NO: 3126656 - RNA, 18 nt, Mycobacterium bovis subsp bovis AF2122/97
ccguuaccgccgcugccg

SEQ ID NO: 3126657 - RNA, 14 nt, Mycobacterium bovis subsp bovis AF2122/97
ccguuaccgccggc

SEQ ID NO: 3126658 - RNA, 13 nt, Mycobacterium bovis subsp bovis AF2122/97
ccguuaccgccgu

SEQ ID NO: 3126659 - RNA, 16 nt, Mycobacterium bovis subsp bovis AF2122/97
ccguuaccgccgucgc

SEQ ID NO: 3126660 - RNA, 21 nt, Mycobacterium bovis subsp bovis AF2122/97
ccguuaccgccguuaccgacg

SEQ ID NO: 3126661 - RNA, 13 nt, Mycobacterium bovis subsp bovis AF2122/97
ccguuagccaggu

SEQ ID NO: 3126662 - RNA, 21 nt, Mycobacterium bovis subsp bovis AF2122/97
ccguuagcuuagcugccgucg

SEQ ID NO: 3126663 - RNA, 21 nt, Mycobacterium bovis subsp bovis AF2122/97
ccguucaacaugaguggcaau

SEQ ID NO: 3126664 - RNA, 22 nt, Mycobacterium bovis subsp bovis AF2122/97
ccguucaacguggaaaccgcuc

SEQ ID NO: 3126665 - RNA, 13 nt, Mycobacterium bovis subsp bovis AF2122/97
ccguucacccagc

SEQ ID NO: 3126666 - RNA, 14 nt, Mycobacterium bovis subsp bovis AF2122/97
ccguucacgcucgu

SEQ ID NO: 3126667 - RNA, 17 nt, Mycobacterium bovis subsp bovis AF2122/97
ccguucaugcggcggcg

SEQ ID NO: 3126668 - RNA, 16 nt, Mycobacterium bovis subsp bovis AF2122/97
ccguucccaccaccac

SEQ ID NO: 3126669 - RNA, 20 nt, Mycobacterium bovis subsp bovis AF2122/97
ccguucccacccacgccgac

SEQ ID NO: 3126670 - RNA, 21 nt, Mycobacterium bovis subsp bovis AF2122/97
ccguucccacccacgccgacu

SEQ ID NO: 3126671 - RNA, 15 nt, Mycobacterium bovis subsp bovis AF2122/97
ccguuccggcugcuu

SEQ ID NO: 3126672 - RNA, 16 nt, Mycobacterium bovis subsp bovis AF2122/97
ccguucgcccgcccgu

SEQ ID NO: 3126673 - RNA, 13 nt, Mycobacterium bovis subsp bovis AF2122/97
ccguucgccgucg

SEQ ID NO: 3126674 - RNA, 19 nt, Mycobacterium bovis subsp bovis AF2122/97
ccguucgccuggucaccga

SEQ ID NO: 3126675 - RNA, 13 nt, Mycobacterium bovis subsp bovis AF2122/97
ccguucgcgucgc

SEQ ID NO: 3126676 - RNA, 17 nt, Mycobacterium bovis subsp bovis AF2122/97
ccguucgcucagggugu

SEQ ID NO: 3126677 - RNA, 14 nt, Mycobacterium bovis subsp bovis AF2122/97
ccguucgcuccccc

SEQ ID NO: 3126678 - RNA, 15 nt, Mycobacterium bovis subsp bovis AF2122/97
ccguucgcucccccg

SEQ ID NO: 3126679 - RNA, 16 nt, Mycobacterium bovis subsp bovis AF2122/97
ccguucgcucccccgc

SEQ ID NO: 3126680 - RNA, 20 nt, Mycobacterium bovis subsp bovis AF2122/97
ccguucgcucccccgcuacg

SEQ ID NO: 3126681 - RNA, 12 nt, Mycobacterium bovis subsp bovis AF2122/97
ccguucggcgcc

SEQ ID NO: 3126682 - RNA, 17 nt, Mycobacterium bovis subsp bovis AF2122/97
ccguucggcgcccgcuc

SEQ ID NO: 3126683 - RNA, 18 nt, Mycobacterium bovis subsp bovis AF2122/97
ccguucggcgcccgcucg

SEQ ID NO: 3126684 - RNA, 14 nt, Mycobacterium bovis subsp bovis AF2122/97
ccguucggcugccg

SEQ ID NO: 3126685 - RNA, 17 nt, Mycobacterium bovis subsp bovis AF2122/97
ccguucgggccguccuc

SEQ ID NO: 3126686 - RNA, 20 nt, Mycobacterium bovis subsp bovis AF2122/97
ccguucggggccccgcggcg

SEQ ID NO: 3126687 - RNA, 21 nt, Mycobacterium bovis subsp bovis AF2122/97
ccguucggggccccgcggcgc

SEQ ID NO: 3126688 - RNA, 14 nt, Mycobacterium bovis subsp bovis AF2122/97
ccguucggggcgcg

SEQ ID NO: 3126689 - RNA, 16 nt, Mycobacterium bovis subsp bovis AF2122/97
ccguucugcccaggca

SEQ ID NO: 3126690 - RNA, 16 nt, Mycobacterium bovis subsp bovis AF2122/97
ccguucuggaaccccg

SEQ ID NO: 3126691 - RNA, 15 nt, Mycobacterium bovis subsp bovis AF2122/97
ccguucugucccggc

SEQ ID NO: 3126692 - RNA, 20 nt, Mycobacterium bovis subsp bovis AF2122/97
ccguucugucccggcgcgcc

SEQ ID NO: 3126693 - RNA, 21 nt, Mycobacterium bovis subsp bovis AF2122/97
ccguucugucccggcgcgcca

SEQ ID NO: 3126694 - RNA, 20 nt, Mycobacterium bovis subsp bovis AF2122/97
ccguucuucgcgauguccuc

SEQ ID NO: 3126695 - RNA, 16 nt, Mycobacterium bovis subsp bovis AF2122/97
ccguugaacggcacca

SEQ ID NO: 3126696 - RNA, 21 nt, Mycobacterium bovis subsp bovis AF2122/97
ccguugaacggcaccagcggg

SEQ ID NO: 3126697 - RNA, 21 nt, Mycobacterium bovis subsp bovis AF2122/97
ccguugaagacggccaccggg

SEQ ID NO: 3126698 - RNA, 13 nt, Mycobacterium bovis subsp bovis AF2122/97
ccguugaagccca

SEQ ID NO: 3126699 - RNA, 18 nt, Mycobacterium bovis subsp bovis AF2122/97
ccguugaagcccaacagc

SEQ ID NO: 3126700 - RNA, 19 nt, Mycobacterium bovis subsp bovis AF2122/97
ccguugaccucuucgggca

SEQ ID NO: 3126701 - RNA, 20 nt, Mycobacterium bovis subsp bovis AF2122/97
ccguugacgccguugccacc

SEQ ID NO: 3126702 - RNA, 14 nt, Mycobacterium bovis subsp bovis AF2122/97
ccguugagcagcac

SEQ ID NO: 3126703 - RNA, 18 nt, Mycobacterium bovis subsp bovis AF2122/97
ccguugagcauaugacgu

SEQ ID NO: 3126704 - RNA, 22 nt, Mycobacterium bovis subsp bovis AF2122/97
ccguugaggaacuccgcgaucc

SEQ ID NO: 3126705 - RNA, 19 nt, Mycobacterium bovis subsp bovis AF2122/97
ccguugaucaagaaggcca

SEQ ID NO: 3126706 - RNA, 16 nt, Mycobacterium bovis subsp bovis AF2122/97
ccguugaugccgccgg

SEQ ID NO: 3126707 - RNA, 17 nt, Mycobacterium bovis subsp bovis AF2122/97
ccguugaugccgccgga

SEQ ID NO: 3126708 - RNA, 18 nt, Mycobacterium bovis subsp bovis AF2122/97
ccguugaugucggcaggu

SEQ ID NO: 3126709 - RNA, 18 nt, Mycobacterium bovis subsp bovis AF2122/97
ccguugauucggccgccg

SEQ ID NO: 3126710 - RNA, 21 nt, Mycobacterium bovis subsp bovis AF2122/97
ccguugauucggccgccgacg

SEQ ID NO: 3126711 - RNA, 20 nt, Mycobacterium bovis subsp bovis AF2122/97
ccguugccaccggugccggc

SEQ ID NO: 3126712 - RNA, 21 nt, Mycobacterium bovis subsp bovis AF2122/97
ccguugccaccggugccggcg

SEQ ID NO: 3126713 - RNA, 21 nt, Mycobacterium bovis subsp bovis AF2122/97
ccguugccauugccucccgcg

SEQ ID NO: 3126714 - RNA, 16 nt, Mycobacterium bovis subsp bovis AF2122/97
ccguugcccaacccgg

SEQ ID NO: 3126715 - RNA, 19 nt, Mycobacterium bovis subsp bovis AF2122/97
ccguugcccccauugccgc

SEQ ID NO: 3126716 - RNA, 21 nt, Mycobacterium bovis subsp bovis AF2122/97
ccguugcccccauugccgccg

SEQ ID NO: 3126717 - RNA, 19 nt, Mycobacterium bovis subsp bovis AF2122/97
ccguugcccgacucggccg

SEQ ID NO: 3126718 - RNA, 20 nt, Mycobacterium bovis subsp bovis AF2122/97
ccguugcccgacucggccgu

SEQ ID NO: 3126719 - RNA, 19 nt, Mycobacterium bovis subsp bovis AF2122/97
ccguugccgaaccacgcgc

SEQ ID NO: 3126720 - RNA, 14 nt, Mycobacterium bovis subsp bovis AF2122/97
ccguugccgaucaa

SEQ ID NO: 3126721 - RNA, 18 nt, Mycobacterium bovis subsp bovis AF2122/97
ccguugccgaucagcccg

SEQ ID NO: 3126722 - RNA, 20 nt, Mycobacterium bovis subsp bovis AF2122/97
ccguugccgauggugauggg

SEQ ID NO: 3126723 - RNA, 23 nt, Mycobacterium bovis subsp bovis AF2122/97
ccguugccgauggugauggggga

SEQ ID NO: 3126724 - RNA, 14 nt, Mycobacterium bovis subsp bovis AF2122/97
ccguugccgccacg

SEQ ID NO: 3126725 - RNA, 17 nt, Mycobacterium bovis subsp bovis AF2122/97
ccguugccgccauuggc

SEQ ID NO: 3126726 - RNA, 16 nt, Mycobacterium bovis subsp bovis AF2122/97
ccguugccgcccacua

SEQ ID NO: 3126727 - RNA, 12 nt, Mycobacterium bovis subsp bovis AF2122/97
ccguugccgccg

SEQ ID NO: 3126728 - RNA, 15 nt, Mycobacterium bovis subsp bovis AF2122/97
ccguugccgccgaag

SEQ ID NO: 3126729 - RNA, 15 nt, Mycobacterium bovis subsp bovis AF2122/97
ccguugccgccgacg

SEQ ID NO: 3126730 - RNA, 13 nt, Mycobacterium bovis subsp bovis AF2122/97
ccuauccgggccc

SEQ ID NO: 3126731 - RNA, 16 nt, Mycobacterium bovis subsp bovis AF2122/97
ccuaucgacaacaugc

SEQ ID NO: 3126732 - RNA, 17 nt, Mycobacterium bovis subsp bovis AF2122/97
ccuaucugccgguaccg

SEQ ID NO: 3126733 - RNA, 16 nt, Mycobacterium bovis subsp bovis AF2122/97
ccuaugauucagccgg

SEQ ID NO: 3126734 - RNA, 17 nt, Mycobacterium bovis subsp bovis AF2122/97
ccuaugauucagccggc

SEQ ID NO: 3126735 - RNA, 18 nt, Mycobacterium bovis subsp bovis AF2122/97
ccuaugauucagccggcu

SEQ ID NO: 3126736 - RNA, 16 nt, Mycobacterium bovis subsp bovis AF2122/97
ccuaugggaccggcaa

SEQ ID NO: 3126737 - RNA, 17 nt, Mycobacterium bovis subsp bovis AF2122/97
ccuauggucaaccgcgc

SEQ ID NO: 3126738 - RNA, 16 nt, Mycobacterium bovis subsp bovis AF2122/97
ccuauugaacccgugu

SEQ ID NO: 3126739 - RNA, 11 nt, Mycobacterium bovis subsp bovis AF2122/97
ccucaaagccu

SEQ ID NO: 3126740 - RNA, 13 nt, Mycobacterium bovis subsp bovis AF2122/97
ccucaacaccagg

SEQ ID NO: 3126741 - RNA, 15 nt, Mycobacterium bovis subsp bovis AF2122/97
ccucaacaccaggcc

SEQ ID NO: 3126742 - RNA, 16 nt, Mycobacterium bovis subsp bovis AF2122/97
ccucaacaccaggccg

SEQ ID NO: 3126743 - RNA, 17 nt, Mycobacterium bovis subsp bovis AF2122/97
ccucaacgaucgcgccg

SEQ ID NO: 3126744 - RNA, 15 nt, Mycobacterium bovis subsp bovis AF2122/97
ccucaacgucccagc

SEQ ID NO: 3126745 - RNA, 20 nt, Mycobacterium bovis subsp bovis AF2122/97
ccucaaguugguucaccgcg

SEQ ID NO: 3126746 - RNA, 21 nt, Mycobacterium bovis subsp bovis AF2122/97
ccucaaguugguucaccgcga

SEQ ID NO: 3126747 - RNA, 17 nt, Mycobacterium bovis subsp bovis AF2122/97
ccucaaugaccaccggg

SEQ ID NO: 3126748 - RNA, 17 nt, Mycobacterium bovis subsp bovis AF2122/97
ccucaauuggcucggcg

SEQ ID NO: 3126749 - RNA, 18 nt, Mycobacterium bovis subsp bovis AF2122/97
ccucaauuggcucggcgu

SEQ ID NO: 3126750 - RNA, 17 nt, Mycobacterium bovis subsp bovis AF2122/97
ccucacaugcccggacg

SEQ ID NO: 3126751 - RNA, 14 nt, Mycobacterium bovis subsp bovis AF2122/97
ccucaccaggucuu

SEQ ID NO: 3126752 - RNA, 22 nt, Mycobacterium bovis subsp bovis AF2122/97
ccucaccaggucuucgaccacg

SEQ ID NO: 3126753 - RNA, 17 nt, Mycobacterium bovis subsp bovis AF2122/97
ccucacccacccgcggu

SEQ ID NO: 3126754 - RNA, 13 nt, Mycobacterium bovis subsp bovis AF2122/97
ccucacccagcug

SEQ ID NO: 3126755 - RNA, 18 nt, Mycobacterium bovis subsp bovis AF2122/97
ccucaccgaacggcaggg

SEQ ID NO: 3126756 - RNA, 19 nt, Mycobacterium bovis subsp bovis AF2122/97
ccucaccgacgucgccaag

SEQ ID NO: 3126757 - RNA, 19 nt, Mycobacterium bovis subsp bovis AF2122/97
ccucaccgaucucgaccag

SEQ ID NO: 3126758 - RNA, 17 nt, Mycobacterium bovis subsp bovis AF2122/97
ccucaccgccgcuaccg

SEQ ID NO: 3126759 - RNA, 18 nt, Mycobacterium bovis subsp bovis AF2122/97
ccucaccgccgcuaccgc

SEQ ID NO: 3126760 - RNA, 20 nt, Mycobacterium bovis subsp bovis AF2122/97
ccucaccgccugugccgccg

SEQ ID NO: 3126761 - RNA, 21 nt, Mycobacterium bovis subsp bovis AF2122/97
ccucaccgccugugccgccgg

SEQ ID NO: 3126762 - RNA, 22 nt, Mycobacterium bovis subsp bovis AF2122/97
ccucaccggguuggaagccgca

SEQ ID NO: 3126763 - RNA, 14 nt, Mycobacterium bovis subsp bovis AF2122/97
ccucacgggcgccg

SEQ ID NO: 3126764 - RNA, 15 nt, Mycobacterium bovis subsp bovis AF2122/97
ccucacugcggcgcc

SEQ ID NO: 3126765 - RNA, 18 nt, Mycobacterium bovis subsp bovis AF2122/97
ccucagacagcugcacac

SEQ ID NO: 3126766 - RNA, 15 nt, Mycobacterium bovis subsp bovis AF2122/97
ccucagccggugcgc

SEQ ID NO: 3126767 - RNA, 13 nt, Mycobacterium bovis subsp bovis AF2122/97
ccucagccgugcc

SEQ ID NO: 3126768 - RNA, 17 nt, Mycobacterium bovis subsp bovis AF2122/97
ccucagcgaugcucacu

SEQ ID NO: 3126769 - RNA, 21 nt, Mycobacterium bovis subsp bovis AF2122/97
ccucagcuagcgcgggcucac

SEQ ID NO: 3126770 - RNA, 11 nt, Mycobacterium bovis subsp bovis AF2122/97
ccucagcugcu

SEQ ID NO: 3126771 - RNA, 22 nt, Mycobacterium bovis subsp bovis AF2122/97
ccucagcugcucgucuuggcgg

SEQ ID NO: 3126772 - RNA, 22 nt, Mycobacterium bovis subsp bovis AF2122/97
ccucaguacagcgcguuggcga

SEQ ID NO: 3126773 - RNA, 13 nt, Mycobacterium bovis subsp bovis AF2122/97
ccucagugcgcac

SEQ ID NO: 3126774 - RNA, 14 nt, Mycobacterium bovis subsp bovis AF2122/97
ccucagugcgcacg

SEQ ID NO: 3126775 - RNA, 23 nt, Mycobacterium bovis subsp bovis AF2122/97
ccucauccaccgauggcgcgcuc

SEQ ID NO: 3126776 - RNA, 14 nt, Mycobacterium bovis subsp bovis AF2122/97
ccucaucgagcgcg

SEQ ID NO: 3126777 - RNA, 15 nt, Mycobacterium bovis subsp bovis AF2122/97
ccucaucgagcgcgc

SEQ ID NO: 3126778 - RNA, 19 nt, Mycobacterium bovis subsp bovis AF2122/97
ccucaucgagcgcgcgacg

SEQ ID NO: 3126779 - RNA, 20 nt, Mycobacterium bovis subsp bovis AF2122/97
ccucaucgcagacggcugcc

SEQ ID NO: 3126780 - RNA, 13 nt, Mycobacterium bovis subsp bovis AF2122/97
ccucaucgccauc

SEQ ID NO: 3126781 - RNA, 16 nt, Mycobacterium bovis subsp bovis AF2122/97
ccucaucgcggucgcc

SEQ ID NO: 3126782 - RNA, 21 nt, Mycobacterium bovis subsp bovis AF2122/97
ccucaucgcggucgccaccgu

SEQ ID NO: 3126783 - RNA, 15 nt, Mycobacterium bovis subsp bovis AF2122/97
ccucaucggacagcg

SEQ ID NO: 3126784 - RNA, 17 nt, Mycobacterium bovis subsp bovis AF2122/97
ccucaucggacagcgcc

SEQ ID NO: 3126785 - RNA, 13 nt, Mycobacterium bovis subsp bovis AF2122/97
ccucaucgugggg

SEQ ID NO: 3126786 - RNA, 21 nt, Mycobacterium bovis subsp bovis AF2122/97
ccucaucguuccacgagucgu

SEQ ID NO: 3126787 - RNA, 21 nt, Mycobacterium bovis subsp bovis AF2122/97
ccucaugcacgccguagcauc

SEQ ID NO: 3126788 - RNA, 19 nt, Mycobacterium bovis subsp bovis AF2122/97
ccucaugcuaggccaccgg

SEQ ID NO: 3126789 - RNA, 15 nt, Mycobacterium bovis subsp bovis AF2122/97
ccuccaagcccgccg

SEQ ID NO: 3126790 - RNA, 20 nt, Mycobacterium bovis subsp bovis AF2122/97
ccuccaagcccgccggaccc

SEQ ID NO: 3126791 - RNA, 22 nt, Mycobacterium bovis subsp bovis AF2122/97
ccuccaauugcgaaccggccgu

SEQ ID NO: 3126792 - RNA, 16 nt, Mycobacterium bovis subsp bovis AF2122/97
ccuccacagcggccau

SEQ ID NO: 3126793 - RNA, 20 nt, Mycobacterium bovis subsp bovis AF2122/97
ccuccaccaacucgacgugc

SEQ ID NO: 3126794 - RNA, 19 nt, Mycobacterium bovis subsp bovis AF2122/97
ccuccaccagugccccgcc

SEQ ID NO: 3126795 - RNA, 18 nt, Mycobacterium bovis subsp bovis AF2122/97
ccuccacccgccacgguu

SEQ ID NO: 3126796 - RNA, 16 nt, Mycobacterium bovis subsp bovis AF2122/97
ccuccaccgccgcgcg

SEQ ID NO: 3126797 - RNA, 15 nt, Mycobacterium bovis subsp bovis AF2122/97
ccuccacgcccuggc

SEQ ID NO: 3126798 - RNA, 22 nt, Mycobacterium bovis subsp bovis AF2122/97
ccuccacgcuggcgcccccgac

SEQ ID NO: 3126799 - RNA, 16 nt, Mycobacterium bovis subsp bovis AF2122/97
ccuccacggcgggaac

SEQ ID NO: 3126800 - RNA, 23 nt, Mycobacterium bovis subsp bovis AF2122/97
ccuccacugcgagcgccggcuuc

SEQ ID NO: 3126801 - RNA, 19 nt, Mycobacterium bovis subsp bovis AF2122/97
ccuccacuuuuccgccggc

SEQ ID NO: 3126802 - RNA, 21 nt, Mycobacterium bovis subsp bovis AF2122/97
ccuccagaaccgaagccucgg

SEQ ID NO: 3126803 - RNA, 14 nt, Mycobacterium bovis subsp bovis AF2122/97
ccuccagagacagc

SEQ ID NO: 3126804 - RNA, 20 nt, Mycobacterium bovis subsp bovis AF2122/97
ccuccagauaccaccgccgc

SEQ ID NO: 3126805 - RNA, 24 nt, Mycobacterium bovis subsp bovis AF2122/97
ccuccagauaccaccgccgcugcc

SEQ ID NO: 3126806 - RNA, 20 nt, Mycobacterium bovis subsp bovis AF2122/97
ccuccagcaccacggcgcgc

SEQ ID NO: 3126807 - RNA, 17 nt, Mycobacterium bovis subsp bovis AF2122/97
ccuccagcacccggucg

SEQ ID NO: 3126808 - RNA, 19 nt, Mycobacterium bovis subsp bovis AF2122/97
ccuccagcagcgacgguca

SEQ ID NO: 3126809 - RNA, 22 nt, Mycobacterium bovis subsp bovis AF2122/97
ccuccagcagguccgcggccgc

SEQ ID NO: 3126810 - RNA, 19 nt, Mycobacterium bovis subsp bovis AF2122/97
ccuccagcaggucgccugc

SEQ ID NO: 3126811 - RNA, 15 nt, Mycobacterium bovis subsp bovis AF2122/97
ccuccagccggcgaa

SEQ ID NO: 3126812 - RNA, 17 nt, Mycobacterium bovis subsp bovis AF2122/97
ccuccagugcggccuug

SEQ ID NO: 3126813 - RNA, 21 nt, Mycobacterium bovis subsp bovis AF2122/97
ccuccagugcggccuuggcga

SEQ ID NO: 3126814 - RNA, 17 nt, Mycobacterium bovis subsp bovis AF2122/97
ccuccauaucgcagcgu

SEQ ID NO: 3126815 - RNA, 15 nt, Mycobacterium bovis subsp bovis AF2122/97
ccucccacagguaga

SEQ ID NO: 3126816 - RNA, 17 nt, Mycobacterium bovis subsp bovis AF2122/97
ccucgaccagagccgcg

SEQ ID NO: 3126817 - RNA, 16 nt, Mycobacterium bovis subsp bovis AF2122/97
ccucgaccgccagccg

SEQ ID NO: 3126818 - RNA, 17 nt, Mycobacterium bovis subsp bovis AF2122/97
ccucgaccgccagccgc

SEQ ID NO: 3126819 - RNA, 21 nt, Mycobacterium bovis subsp bovis AF2122/97
ccucgaccggucggugauggu

SEQ ID NO: 3126820 - RNA, 23 nt, Mycobacterium bovis subsp bovis AF2122/97
ccucgaccuggaugggcucgacg

SEQ ID NO: 3126821 - RNA, 22 nt, Mycobacterium bovis subsp bovis AF2122/97
ccucgaccuggauugccaccag

SEQ ID NO: 3126822 - RNA, 12 nt, Mycobacterium bovis subsp bovis AF2122/97
ccucgacgagca

SEQ ID NO: 3126823 - RNA, 22 nt, Mycobacterium bovis subsp bovis AF2122/97
ccucgacgagucggcgggcgac

SEQ ID NO: 3126824 - RNA, 16 nt, Mycobacterium bovis subsp bovis AF2122/97
ccucgacgaucagcac

SEQ ID NO: 3126825 - RNA, 18 nt, Mycobacterium bovis subsp bovis AF2122/97
ccucgacgcacacccggu

SEQ ID NO: 3126826 - RNA, 14 nt, Mycobacterium bovis subsp bovis AF2122/97
ccucgacgccccag

SEQ ID NO: 3126827 - RNA, 14 nt, Mycobacterium bovis subsp bovis AF2122/97
ccucgacgccgcgc

SEQ ID NO: 3126828 - RNA, 16 nt, Mycobacterium bovis subsp bovis AF2122/97
ccucgacgccgcgcag

SEQ ID NO: 3126829 - RNA, 17 nt, Mycobacterium bovis subsp bovis AF2122/97
ccucgacgcggcaggcc

SEQ ID NO: 3126830 - RNA, 20 nt, Mycobacterium bovis subsp bovis AF2122/97
ccucgacgcggcaggccggu

SEQ ID NO: 3126831 - RNA, 20 nt, Mycobacterium bovis subsp bovis AF2122/97
ccucgacggcgucgacugcg

SEQ ID NO: 3126832 - RNA, 19 nt, Mycobacterium bovis subsp bovis AF2122/97
ccucgacggugacgaccac

SEQ ID NO: 3126833 - RNA, 18 nt, Mycobacterium bovis subsp bovis AF2122/97
ccucgacguccaucccgg

SEQ ID NO: 3126834 - RNA, 19 nt, Mycobacterium bovis subsp bovis AF2122/97
ccucgacguccaucccggc

SEQ ID NO: 3126835 - RNA, 22 nt, Mycobacterium bovis subsp bovis AF2122/97
ccucgacguccaucccggcgcc

SEQ ID NO: 3126836 - RNA, 15 nt, Mycobacterium bovis subsp bovis AF2122/97
ccucgacgucggcga

SEQ ID NO: 3126837 - RNA, 16 nt, Mycobacterium bovis subsp bovis AF2122/97
ccucgacuucggcggg

SEQ ID NO: 3126838 - RNA, 17 nt, Mycobacterium bovis subsp bovis AF2122/97
ccucgacuucggcggga

SEQ ID NO: 3126839 - RNA, 15 nt, Mycobacterium bovis subsp bovis AF2122/97
ccucgagacggucga

SEQ ID NO: 3126840 - RNA, 15 nt, Mycobacterium bovis subsp bovis AF2122/97
ccucgagcagugccg

SEQ ID NO: 3126841 - RNA, 18 nt, Mycobacterium bovis subsp bovis AF2122/97
ccucgagcgcggcgaucg

SEQ ID NO: 3126842 - RNA, 14 nt, Mycobacterium bovis subsp bovis AF2122/97
ccucgagcggcaga

SEQ ID NO: 3126843 - RNA, 18 nt, Mycobacterium bovis subsp bovis AF2122/97
ccucgagcugcuggcgcg

SEQ ID NO: 3126844 - RNA, 20 nt, Mycobacterium bovis subsp bovis AF2122/97
ccucgagcugcuggcgcgcc

SEQ ID NO: 3126845 - RNA, 13 nt, Mycobacterium bovis subsp bovis AF2122/97
ccucgagcuugcc

SEQ ID NO: 3126846 - RNA, 17 nt, Mycobacterium bovis subsp bovis AF2122/97
ccucgagcuugccgucg

SEQ ID NO: 3126847 - RNA, 19 nt, Mycobacterium bovis subsp bovis AF2122/97
ccucgagguauucgcgcag

SEQ ID NO: 3126848 - RNA, 21 nt, Mycobacterium bovis subsp bovis AF2122/97
ccucgagguauucgcgcagca

SEQ ID NO: 3126849 - RNA, 20 nt, Mycobacterium bovis subsp bovis AF2122/97
ccucgagguccucgucggcg

SEQ ID NO: 3126850 - RNA, 18 nt, Mycobacterium bovis subsp bovis AF2122/97
ccucgaguacccaaccgg

SEQ ID NO: 3126851 - RNA, 14 nt, Mycobacterium bovis subsp bovis AF2122/97
ccucgagugccgcc

SEQ ID NO: 3126852 - RNA, 15 nt, Mycobacterium bovis subsp bovis AF2122/97
ccucgagugccgccg

SEQ ID NO: 3126853 - RNA, 22 nt, Mycobacterium bovis subsp bovis AF2122/97
ccucgaguucgggcugcggcag

SEQ ID NO: 3126854 - RNA, 22 nt, Mycobacterium bovis subsp bovis AF2122/97
ccucgauaaccgcaguucuuga

SEQ ID NO: 3126855 - RNA, 17 nt, Mycobacterium bovis subsp bovis AF2122/97
ccucgaucacggcggcc

SEQ ID NO: 3126856 - RNA, 21 nt, Mycobacterium bovis subsp bovis AF2122/97
ccucgaucagacgcucgaccu

SEQ ID NO: 3126857 - RNA, 13 nt, Mycobacterium bovis subsp bovis AF2122/97
ccucgaucgacuc

SEQ ID NO: 3126858 - RNA, 20 nt, Mycobacterium bovis subsp bovis AF2122/97
ccucgaucgacucgaaccgu

SEQ ID NO: 3126859 - RNA, 14 nt, Mycobacterium bovis subsp bovis AF2122/97
ccucgaucgcgcag

SEQ ID NO: 3126860 - RNA, 16 nt, Mycobacterium bovis subsp bovis AF2122/97
ccucgaugacaucggu

SEQ ID NO: 3126861 - RNA, 20 nt, Mycobacterium bovis subsp bovis AF2122/97
ccucgaugacaucggucagc

SEQ ID NO: 3126862 - RNA, 20 nt, Mycobacterium bovis subsp bovis AF2122/97
ccucgaugaugcgcucggcc

SEQ ID NO: 3126863 - RNA, 17 nt, Mycobacterium bovis subsp bovis AF2122/97
ccucgaugccgcccgug

SEQ ID NO: 3126864 - RNA, 23 nt, Mycobacterium bovis subsp bovis AF2122/97
ccucgaugcggguggcgccggug

SEQ ID NO: 3126865 - RNA, 16 nt, Mycobacterium bovis subsp bovis AF2122/97
ccucgauggcguccau

SEQ ID NO: 3126866 - RNA, 16 nt, Mycobacterium bovis subsp bovis AF2122/97
ccucgauggucucccg

SEQ ID NO: 3126867 - RNA, 18 nt, Mycobacterium bovis subsp bovis AF2122/97
ccucgauggucucccggc

SEQ ID NO: 3126868 - RNA, 18 nt, Mycobacterium bovis subsp bovis AF2122/97
ccucgaugucgcggucgc

SEQ ID NO: 3126869 - RNA, 22 nt, Mycobacterium bovis subsp bovis AF2122/97
ccucgauucccggcgcgguggc

SEQ ID NO: 3126870 - RNA, 12 nt, Mycobacterium bovis subsp bovis AF2122/97
ccucgcaaccgg

SEQ ID NO: 3126871 - RNA, 17 nt, Mycobacterium bovis subsp bovis AF2122/97
ccucgcacaauggcggc

SEQ ID NO: 3126872 - RNA, 13 nt, Mycobacterium bovis subsp bovis AF2122/97
ccucgcacgacac

SEQ ID NO: 3126873 - RNA, 15 nt, Mycobacterium bovis subsp bovis AF2122/97
ccucgcaggugguga

SEQ ID NO: 3126874 - RNA, 19 nt, Mycobacterium bovis subsp bovis AF2122/97
ccucgcagguggugacacg

SEQ ID NO: 3126875 - RNA, 20 nt, Mycobacterium bovis subsp bovis AF2122/97
ccucgccaucgaccuugagc

SEQ ID NO: 3126876 - RNA, 13 nt, Mycobacterium bovis subsp bovis AF2122/97
ccucgcccagcaa

SEQ ID NO: 3126877 - RNA, 21 nt, Mycobacterium bovis subsp bovis AF2122/97
ccucgcccagcaaggcccgaa

SEQ ID NO: 3126878 - RNA, 16 nt, Mycobacterium bovis subsp bovis AF2122/97
ccucgccccaccggcc

SEQ ID NO: 3126879 - RNA, 21 nt, Mycobacterium bovis subsp bovis AF2122/97
ccucgcccucccgggcccgcu

SEQ ID NO: 3126880 - RNA, 15 nt, Mycobacterium bovis subsp bovis AF2122/97
ccucgcccugcagac

SEQ ID NO: 3126881 - RNA, 19 nt, Mycobacterium bovis subsp bovis AF2122/97
ccucgcccugcagacgggu

SEQ ID NO: 3126882 - RNA, 16 nt, Mycobacterium bovis subsp bovis AF2122/97
ccucgcccuggccgcu

SEQ ID NO: 3126883 - RNA, 14 nt, Mycobacterium bovis subsp bovis AF2122/97
ccucgccgcacgcc

SEQ ID NO: 3126884 - RNA, 15 nt, Mycobacterium bovis subsp bovis AF2122/97
ccucgccgcacgccg

SEQ ID NO: 3126885 - RNA, 12 nt, Mycobacterium bovis subsp bovis AF2122/97
ccucgccgcgcg

SEQ ID NO: 3126886 - RNA, 14 nt, Mycobacterium bovis subsp bovis AF2122/97
ccucgccgcggcgg

SEQ ID NO: 3126887 - RNA, 18 nt, Mycobacterium bovis subsp bovis AF2122/97
ccucgccggacgggugca

SEQ ID NO: 3126888 - RNA, 13 nt, Mycobacterium bovis subsp bovis AF2122/97
ccucgccggccac

SEQ ID NO: 3126889 - RNA, 16 nt, Mycobacterium bovis subsp bovis AF2122/97
ccucgccggccaccag

SEQ ID NO: 3126890 - RNA, 20 nt, Mycobacterium bovis subsp bovis AF2122/97
ccucgccggccacccgcgcg

SEQ ID NO: 3126891 - RNA, 12 nt, Mycobacterium bovis subsp bovis AF2122/97
ccucgccggccg

SEQ ID NO: 3126892 - RNA, 14 nt, Mycobacterium bovis subsp bovis AF2122/97
ccucgccggcgcgc

SEQ ID NO: 3126893 - RNA, 14 nt, Mycobacterium bovis subsp bovis AF2122/97
ccucgccggcggga

SEQ ID NO: 3126894 - RNA, 18 nt, Mycobacterium bovis subsp bovis AF2122/97
ccucgccggucagcgugc

SEQ ID NO: 3126895 - RNA, 15 nt, Mycobacterium bovis subsp bovis AF2122/97
ccucgccugcacgcc

SEQ ID NO: 3126896 - RNA, 19 nt, Mycobacterium bovis subsp bovis AF2122/97
ccucgccugcacgcccggc

SEQ ID NO: 3126897 - RNA, 14 nt, Mycobacterium bovis subsp bovis AF2122/97
ccucgcgcucgccg

SEQ ID NO: 3126898 - RNA, 18 nt, Mycobacterium bovis subsp bovis AF2122/97
ccucgcggaugagcucgg

SEQ ID NO: 3126899 - RNA, 23 nt, Mycobacterium bovis subsp bovis AF2122/97
ccucgcggaugagcucggccauc

SEQ ID NO: 3126900 - RNA, 19 nt, Mycobacterium bovis subsp bovis AF2122/97
ccucgcgggcuuaugcacg

SEQ ID NO: 3126901 - RNA, 16 nt, Mycobacterium bovis subsp bovis AF2122/97
ccucgcggugcgccac

SEQ ID NO: 3126902 - RNA, 20 nt, Mycobacterium bovis subsp bovis AF2122/97
ccucgcguagggccagcgcc

SEQ ID NO: 3126903 - RNA, 21 nt, Mycobacterium bovis subsp bovis AF2122/97
ccucgucggccgacaccgcca

SEQ ID NO: 3126904 - RNA, 20 nt, Mycobacterium bovis subsp bovis AF2122/97
ccucgucggcgacggccagc

SEQ ID NO: 3126905 - RNA, 21 nt, Mycobacterium bovis subsp bovis AF2122/97
ccucgucggcgacggccagcg

SEQ ID NO: 3126906 - RNA, 13 nt, Mycobacterium bovis subsp bovis AF2122/97
ccucgucggcguc

SEQ ID NO: 3126907 - RNA, 17 nt, Mycobacterium bovis subsp bovis AF2122/97
ccucgucggcgucgagc

SEQ ID NO: 3126908 - RNA, 22 nt, Mycobacterium bovis subsp bovis AF2122/97
ccucgucggcgucgagcucguc

SEQ ID NO: 3126909 - RNA, 23 nt, Mycobacterium bovis subsp bovis AF2122/97
ccucgucggugugccagugcugc

SEQ ID NO: 3126910 - RNA, 21 nt, Mycobacterium bovis subsp bovis AF2122/97
ccucgucgucgaaguuggcga

SEQ ID NO: 3126911 - RNA, 17 nt, Mycobacterium bovis subsp bovis AF2122/97
ccucgucgugcaccucg

SEQ ID NO: 3126912 - RNA, 16 nt, Mycobacterium bovis subsp bovis AF2122/97
ccucgucuucgucggu

SEQ ID NO: 3126913 - RNA, 14 nt, Mycobacterium bovis subsp bovis AF2122/97
ccucgugcagcacu

SEQ ID NO: 3126914 - RNA, 14 nt, Mycobacterium bovis subsp bovis AF2122/97
ccucgugcucggcc

SEQ ID NO: 3126915 - RNA, 17 nt, Mycobacterium bovis subsp bovis AF2122/97
ccucguuaucgaccgcc

SEQ ID NO: 3126916 - RNA, 18 nt, Mycobacterium bovis subsp bovis AF2122/97
ccucguuaucgaccgccg

SEQ ID NO: 3126917 - RNA, 19 nt, Mycobacterium bovis subsp bovis AF2122/97
ccucguuaucgaccgccgc

SEQ ID NO: 3126918 - RNA, 23 nt, Mycobacterium bovis subsp bovis AF2122/97
ccucguugaccgggucgccgaug

SEQ ID NO: 3126919 - RNA, 14 nt, Mycobacterium bovis subsp bovis AF2122/97
ccucguuguagccg

SEQ ID NO: 3126920 - RNA, 21 nt, Mycobacterium bovis subsp bovis AF2122/97
ccucuaaaccaagaaucaccg

SEQ ID NO: 3126921 - RNA, 16 nt, Mycobacterium bovis subsp bovis AF2122/97
ccucuagcgccucgcc

SEQ ID NO: 3126922 - RNA, 22 nt, Mycobacterium bovis subsp bovis AF2122/97
ccucuaugcgggcagcgaucuu

SEQ ID NO: 3126923 - RNA, 16 nt, Mycobacterium bovis subsp bovis AF2122/97
ccucuccguccucguc

SEQ ID NO: 3126924 - RNA, 12 nt, Mycobacterium bovis subsp bovis AF2122/97
ccucucugcgcc

SEQ ID NO: 3126925 - RNA, 14 nt, Mycobacterium bovis subsp bovis AF2122/97
ccucucugcgccag

SEQ ID NO: 3126926 - RNA, 15 nt, Mycobacterium bovis subsp bovis AF2122/97
ccucucugcgccagg

SEQ ID NO: 3126927 - RNA, 19 nt, Mycobacterium bovis subsp bovis AF2122/97
ccucucugucgcguugugg

SEQ ID NO: 3126928 - RNA, 16 nt, Mycobacterium bovis subsp bovis AF2122/97
ccucugcacggccguc

SEQ ID NO: 3126929 - RNA, 17 nt, Mycobacterium bovis subsp bovis AF2122/97
ccucugcgaucaguucg

SEQ ID NO: 3126930 - RNA, 12 nt, Mycobacterium bovis subsp bovis AF2122/97
ccucugcucagc

SEQ ID NO: 3126931 - RNA, 13 nt, Mycobacterium bovis subsp bovis AF2122/97
ccucugcucagcc

SEQ ID NO: 3126932 - RNA, 21 nt, Mycobacterium bovis subsp bovis AF2122/97
ccucugcugagcugcucgccg

SEQ ID NO: 3126933 - RNA, 13 nt, Mycobacterium bovis subsp bovis AF2122/97
ccucuuccuggcg

SEQ ID NO: 3126934 - RNA, 18 nt, Mycobacterium bovis subsp bovis AF2122/97
ccucuucgaucuguuccu

SEQ ID NO: 3126935 - RNA, 22 nt, Mycobacterium bovis subsp bovis AF2122/97
ccucuucgggguagaccuucuc

SEQ ID NO: 3126936 - RNA, 18 nt, Mycobacterium bovis subsp bovis AF2122/97
ccucuucgggugcagcca

SEQ ID NO: 3126937 - RNA, 14 nt, Mycobacterium bovis subsp bovis AF2122/97
ccugaaaacaccgc

SEQ ID NO: 3126938 - RNA, 23 nt, Mycobacterium bovis subsp bovis AF2122/97
ccugaaacgauugcugcggcuuu

SEQ ID NO: 3126939 - RNA, 19 nt, Mycobacterium bovis subsp bovis AF2122/97
ccugaaagcuaccgaucgc

SEQ ID NO: 3126940 - RNA, 17 nt, Mycobacterium bovis subsp bovis AF2122/97
ccugaagccagcgcagc

SEQ ID NO: 3126941 - RNA, 14 nt, Mycobacterium bovis subsp bovis AF2122/97
ccugaagccgcgcu

SEQ ID NO: 3126942 - RNA, 15 nt, Mycobacterium bovis subsp bovis AF2122/97
ccugaagccgcgcug

SEQ ID NO: 3126943 - RNA, 14 nt, Mycobacterium bovis subsp bovis AF2122/97
ccugaaggccagcc

SEQ ID NO: 3126944 - RNA, 18 nt, Mycobacterium bovis subsp bovis AF2122/97
ccugaaggccagccaacg

SEQ ID NO: 3126945 - RNA, 20 nt, Mycobacterium bovis subsp bovis AF2122/97
ccugaagggccgccucgcgg

SEQ ID NO: 3126946 - RNA, 19 nt, Mycobacterium bovis subsp bovis AF2122/97
ccugaaucgguucggccag

SEQ ID NO: 3126947 - RNA, 22 nt, Mycobacterium bovis subsp bovis AF2122/97
ccugaaucuuguuguucgccac

SEQ ID NO: 3126948 - RNA, 12 nt, Mycobacterium bovis subsp bovis AF2122/97
ccugacacccau

SEQ ID NO: 3126949 - RNA, 21 nt, Mycobacterium bovis subsp bovis AF2122/97
ccugacacccaucgaccgccc

SEQ ID NO: 3126950 - RNA, 18 nt, Mycobacterium bovis subsp bovis AF2122/97
ccugacacgcccgcgagc

SEQ ID NO: 3126951 - RNA, 13 nt, Mycobacterium bovis subsp bovis AF2122/97
ccugacagcgagc

SEQ ID NO: 3126952 - RNA, 16 nt, Mycobacterium bovis subsp bovis AF2122/97
ccugacccggagccgc

SEQ ID NO: 3126953 - RNA, 12 nt, Mycobacterium bovis subsp bovis AF2122/97
ccugaccggcuc

SEQ ID NO: 3126954 - RNA, 21 nt, Mycobacterium bovis subsp bovis AF2122/97
ccugaccgguggccaucgcgc

SEQ ID NO: 3126955 - RNA, 22 nt, Mycobacterium bovis subsp bovis AF2122/97
ccugaccgguggccaucgcgcg

SEQ ID NO: 3126956 - RNA, 20 nt, Mycobacterium bovis subsp bovis AF2122/97
ccugaccucauguccgccgu

SEQ ID NO: 3126957 - RNA, 19 nt, Mycobacterium bovis subsp bovis AF2122/97
ccugacgaaggucuccggc

SEQ ID NO: 3126958 - RNA, 22 nt, Mycobacterium bovis subsp bovis AF2122/97
ccugacgccauucaucggcauc

SEQ ID NO: 3126959 - RNA, 17 nt, Mycobacterium bovis subsp bovis AF2122/97
ccugacgcgucagcggc

SEQ ID NO: 3126960 - RNA, 22 nt, Mycobacterium bovis subsp bovis AF2122/97
ccugacgcgucagcggcgagca

SEQ ID NO: 3126961 - RNA, 15 nt, Mycobacterium bovis subsp bovis AF2122/97
ccugacgcucggucg

SEQ ID NO: 3126962 - RNA, 16 nt, Mycobacterium bovis subsp bovis AF2122/97
ccugacgcucggucgc

SEQ ID NO: 3126963 - RNA, 19 nt, Mycobacterium bovis subsp bovis AF2122/97
ccugacgcucggucgccac

SEQ ID NO: 3126964 - RNA, 23 nt, Mycobacterium bovis subsp bovis AF2122/97
ccugacgcucggucgccaccgcc

SEQ ID NO: 3126965 - RNA, 21 nt, Mycobacterium bovis subsp bovis AF2122/97
ccugacggaaguacuccaugg

SEQ ID NO: 3126966 - RNA, 15 nt, Mycobacterium bovis subsp bovis AF2122/97
ccugacucaucaccg

SEQ ID NO: 3126967 - RNA, 20 nt, Mycobacterium bovis subsp bovis AF2122/97
ccugagaacacguucggcgu

SEQ ID NO: 3126968 - RNA, 17 nt, Mycobacterium bovis subsp bovis AF2122/97
ccugagcaccaagaccg

SEQ ID NO: 3126969 - RNA, 18 nt, Mycobacterium bovis subsp bovis AF2122/97
ccugagcacguucaccgc

SEQ ID NO: 3126970 - RNA, 20 nt, Mycobacterium bovis subsp bovis AF2122/97
ccugagcacguucaccgcgc

SEQ ID NO: 3126971 - RNA, 11 nt, Mycobacterium bovis subsp bovis AF2122/97
ccugagcagau

SEQ ID NO: 3126972 - RNA, 19 nt, Mycobacterium bovis subsp bovis AF2122/97
ccugagcaucuccucgccu

SEQ ID NO: 3126973 - RNA, 19 nt, Mycobacterium bovis subsp bovis AF2122/97
ccugagccaccaacaccgc

SEQ ID NO: 3126974 - RNA, 13 nt, Mycobacterium bovis subsp bovis AF2122/97
ccugagcgccgcg

SEQ ID NO: 3126975 - RNA, 22 nt, Mycobacterium bovis subsp bovis AF2122/97
ccugagcgcgcgcggugcggcc

SEQ ID NO: 3126976 - RNA, 13 nt, Mycobacterium bovis subsp bovis AF2122/97
ccugagcucccgc

SEQ ID NO: 3126977 - RNA, 17 nt, Mycobacterium bovis subsp bovis AF2122/97
ccugagcugccgagcgg

SEQ ID NO: 3126978 - RNA, 15 nt, Mycobacterium bovis subsp bovis AF2122/97
ccugaggcaccucgg

SEQ ID NO: 3126979 - RNA, 15 nt, Mycobacterium bovis subsp bovis AF2122/97
ccugagucggcauug

SEQ ID NO: 3126980 - RNA, 16 nt, Mycobacterium bovis subsp bovis AF2122/97
ccugaguuccggucga

SEQ ID NO: 3126981 - RNA, 16 nt, Mycobacterium bovis subsp bovis AF2122/97
ccugaguugcggugug

SEQ ID NO: 3126982 - RNA, 17 nt, Mycobacterium bovis subsp bovis AF2122/97
ccugauaaagcccggcg

SEQ ID NO: 3126983 - RNA, 16 nt, Mycobacterium bovis subsp bovis AF2122/97
ccugaucgagcgccag

SEQ ID NO: 3126984 - RNA, 14 nt, Mycobacterium bovis subsp bovis AF2122/97
ccugaucggucaac

SEQ ID NO: 3126985 - RNA, 19 nt, Mycobacterium bovis subsp bovis AF2122/97
ccugaugaucguccagccc

SEQ ID NO: 3126986 - RNA, 16 nt, Mycobacterium bovis subsp bovis AF2122/97
ccugaugcggccggcg

SEQ ID NO: 3126987 - RNA, 18 nt, Mycobacterium bovis subsp bovis AF2122/97
ccugaugcggccggcgcc

SEQ ID NO: 3126988 - RNA, 19 nt, Mycobacterium bovis subsp bovis AF2122/97
ccugauggcgcugcaccgu

SEQ ID NO: 3126989 - RNA, 21 nt, Mycobacterium bovis subsp bovis AF2122/97
ccugcgccuuggucgccggcg

SEQ ID NO: 3126990 - RNA, 22 nt, Mycobacterium bovis subsp bovis AF2122/97
ccugcgccuuggucgccggcgu

SEQ ID NO: 3126991 - RNA, 16 nt, Mycobacterium bovis subsp bovis AF2122/97
ccugcgcgaccgacca

SEQ ID NO: 3126992 - RNA, 22 nt, Mycobacterium bovis subsp bovis AF2122/97
ccugcgcgaccgaccagccgug

SEQ ID NO: 3126993 - RNA, 12 nt, Mycobacterium bovis subsp bovis AF2122/97
ccugcgcgaggu

SEQ ID NO: 3126994 - RNA, 17 nt, Mycobacterium bovis subsp bovis AF2122/97
ccugcgcgagugccagu

SEQ ID NO: 3126995 - RNA, 21 nt, Mycobacterium bovis subsp bovis AF2122/97
ccugcgcgagugccaguccga

SEQ ID NO: 3126996 - RNA, 13 nt, Mycobacterium bovis subsp bovis AF2122/97
ccugcgcggcgau

SEQ ID NO: 3126997 - RNA, 17 nt, Mycobacterium bovis subsp bovis AF2122/97
ccugcgcggcgaucgcu

SEQ ID NO: 3126998 - RNA, 18 nt, Mycobacterium bovis subsp bovis AF2122/97
ccugcgcggcgaucgcuc

SEQ ID NO: 3126999 - RNA, 23 nt, Mycobacterium bovis subsp bovis AF2122/97
ccugcgcggcgugcgcggugaug

SEQ ID NO: 3127000 - RNA, 22 nt, Mycobacterium bovis subsp bovis AF2122/97
ccugcggauagugguugcggcc

SEQ ID NO: 3127001 - RNA, 13 nt, Mycobacterium bovis subsp bovis AF2122/97
ccugcggaucgga

SEQ ID NO: 3127002 - RNA, 19 nt, Mycobacterium bovis subsp bovis AF2122/97
ccugcggcaacggcucguc

SEQ ID NO: 3127003 - RNA, 19 nt, Mycobacterium bovis subsp bovis AF2122/97
ccugcggcagcggaccgcu

SEQ ID NO: 3127004 - RNA, 19 nt, Mycobacterium bovis subsp bovis AF2122/97
ccugcggcaggugcgguca

SEQ ID NO: 3127005 - RNA, 12 nt, Mycobacterium bovis subsp bovis AF2122/97
ccugcggccacg

SEQ ID NO: 3127006 - RNA, 17 nt, Mycobacterium bovis subsp bovis AF2122/97
ccugcggccacgguggc

SEQ ID NO: 3127007 - RNA, 23 nt, Mycobacterium bovis subsp bovis AF2122/97
ccugcggcugcuuggucgcccag

SEQ ID NO: 3127008 - RNA, 19 nt, Mycobacterium bovis subsp bovis AF2122/97
ccugcgggaaguugcccag

SEQ ID NO: 3127009 - RNA, 13 nt, Mycobacterium bovis subsp bovis AF2122/97
ccugcguccgacg

SEQ ID NO: 3127010 - RNA, 21 nt, Mycobacterium bovis subsp bovis AF2122/97
ccugcguccgacgccugggca

SEQ ID NO: 3127011 - RNA, 13 nt, Mycobacterium bovis subsp bovis AF2122/97
ccugcgucggccc

SEQ ID NO: 3127012 - RNA, 17 nt, Mycobacterium bovis subsp bovis AF2122/97
ccugcuaaccacggugu

SEQ ID NO: 3127013 - RNA, 19 nt, Mycobacterium bovis subsp bovis AF2122/97
ccugcuagcagcagcccga

SEQ ID NO: 3127014 - RNA, 15 nt, Mycobacterium bovis subsp bovis AF2122/97
ccugcucaaccagca

SEQ ID NO: 3127015 - RNA, 23 nt, Mycobacterium bovis subsp bovis AF2122/97
ccugcucagcuaaaaaccgcugc

SEQ ID NO: 3127016 - RNA, 13 nt, Mycobacterium bovis subsp bovis AF2122/97
ccugcucauccac

SEQ ID NO: 3127017 - RNA, 16 nt, Mycobacterium bovis subsp bovis AF2122/97
ccugcucauccaccuc

SEQ ID NO: 3127018 - RNA, 23 nt, Mycobacterium bovis subsp bovis AF2122/97
ccugcucauccaccucgauggcg

SEQ ID NO: 3127019 - RNA, 16 nt, Mycobacterium bovis subsp bovis AF2122/97
ccugcuccaccgucga

SEQ ID NO: 3127020 - RNA, 19 nt, Mycobacterium bovis subsp bovis AF2122/97
ccugcuccaccgucgaacc

SEQ ID NO: 3127021 - RNA, 17 nt, Mycobacterium bovis subsp bovis AF2122/97
ccugcuccgcugucacc

SEQ ID NO: 3127022 - RNA, 16 nt, Mycobacterium bovis subsp bovis AF2122/97
ccugcuccucggccag

SEQ ID NO: 3127023 - RNA, 19 nt, Mycobacterium bovis subsp bovis AF2122/97
ccugcucgaccaugccguc

SEQ ID NO: 3127024 - RNA, 15 nt, Mycobacterium bovis subsp bovis AF2122/97
ccugcucgauacggc

SEQ ID NO: 3127025 - RNA, 14 nt, Mycobacterium bovis subsp bovis AF2122/97
ccugcucgcacagc

SEQ ID NO: 3127026 - RNA, 20 nt, Mycobacterium bovis subsp bovis AF2122/97
ccugcucgcacagcaccacg

SEQ ID NO: 3127027 - RNA, 16 nt, Mycobacterium bovis subsp bovis AF2122/97
ccugcucgcagcgggc

SEQ ID NO: 3127028 - RNA, 13 nt, Mycobacterium bovis subsp bovis AF2122/97
ccugcucgccguc

SEQ ID NO: 3127029 - RNA, 15 nt, Mycobacterium bovis subsp bovis AF2122/97
ccugcucggcgaccg

SEQ ID NO: 3127030 - RNA, 22 nt, Mycobacterium bovis subsp bovis AF2122/97
ccugcucggcgaguucggcagc

SEQ ID NO: 3127031 - RNA, 17 nt, Mycobacterium bovis subsp bovis AF2122/97
ccugcucggcgcgccgg

SEQ ID NO: 3127032 - RNA, 20 nt, Mycobacterium bovis subsp bovis AF2122/97
ccugcucgggggccgaccag

SEQ ID NO: 3127033 - RNA, 15 nt, Mycobacterium bovis subsp bovis AF2122/97
ccugcucgucgagcc

SEQ ID NO: 3127034 - RNA, 14 nt, Mycobacterium bovis subsp bovis AF2122/97
ccugcucgucggcc

SEQ ID NO: 3127035 - RNA, 16 nt, Mycobacterium bovis subsp bovis AF2122/97
ccugcucgucggccac

SEQ ID NO: 3127036 - RNA, 13 nt, Mycobacterium bovis subsp bovis AF2122/97
ccugcucgucggu

SEQ ID NO: 3127037 - RNA, 16 nt, Mycobacterium bovis subsp bovis AF2122/97
ccugcucgucggucac

SEQ ID NO: 3127038 - RNA, 19 nt, Mycobacterium bovis subsp bovis AF2122/97
ccugcugcaaccgacuucg

SEQ ID NO: 3127039 - RNA, 23 nt, Mycobacterium bovis subsp bovis AF2122/97
ccugcugcaaccgacuucgaugg

SEQ ID NO: 3127040 - RNA, 20 nt, Mycobacterium bovis subsp bovis AF2122/97
ccugcugcagggccuggcca

SEQ ID NO: 3127041 - RNA, 14 nt, Mycobacterium bovis subsp bovis AF2122/97
ccugcugcugcagc

SEQ ID NO: 3127042 - RNA, 14 nt, Mycobacterium bovis subsp bovis AF2122/97
ccugcuggcccugc

SEQ ID NO: 3127043 - RNA, 15 nt, Mycobacterium bovis subsp bovis AF2122/97
ccugcuggccgcggc

SEQ ID NO: 3127044 - RNA, 14 nt, Mycobacterium bovis subsp bovis AF2122/97
ccugcugggaggga

SEQ ID NO: 3127045 - RNA, 16 nt, Mycobacterium bovis subsp bovis AF2122/97
ccugcuggucaccauc

SEQ ID NO: 3127046 - RNA, 17 nt, Mycobacterium bovis subsp bovis AF2122/97
ccugcuggucggugaug

SEQ ID NO: 3127047 - RNA, 18 nt, Mycobacterium bovis subsp bovis AF2122/97
ccugcugugggauucggg

SEQ ID NO: 3127048 - RNA, 13 nt, Mycobacterium bovis subsp bovis AF2122/97
ccugcuuggccac

SEQ ID NO: 3127049 - RNA, 20 nt, Mycobacterium bovis subsp bovis AF2122/97
ccugcuuguagcgcaucgcc

SEQ ID NO: 3127050 - RNA, 22 nt, Mycobacterium bovis subsp bovis AF2122/97
ccugcuuguagcgcaucgccaa

SEQ ID NO: 3127051 - RNA, 20 nt, Mycobacterium bovis subsp bovis AF2122/97
ccuggaaaggacggccggcc

SEQ ID NO: 3127052 - RNA, 21 nt, Mycobacterium bovis subsp bovis AF2122/97
ccuggaaagggccgccgcugg

SEQ ID NO: 3127053 - RNA, 20 nt, Mycobacterium bovis subsp bovis AF2122/97
ccuggaaauuucaguucggc

SEQ ID NO: 3127054 - RNA, 19 nt, Mycobacterium bovis subsp bovis AF2122/97
ccuggaaccaaaccugggc

SEQ ID NO: 3127055 - RNA, 19 nt, Mycobacterium bovis subsp bovis AF2122/97
ccuggaacugcaugguggc

SEQ ID NO: 3127056 - RNA, 15 nt, Mycobacterium bovis subsp bovis AF2122/97
ccuggaagacggugc

SEQ ID NO: 3127057 - RNA, 17 nt, Mycobacterium bovis subsp bovis AF2122/97
ccuggaagacggugcgg

SEQ ID NO: 3127058 - RNA, 19 nt, Mycobacterium bovis subsp bovis AF2122/97
ccuggaagacggugcgggc

SEQ ID NO: 3127059 - RNA, 14 nt, Mycobacterium bovis subsp bovis AF2122/97
ccuggaaggaggcc

SEQ ID NO: 3127060 - RNA, 20 nt, Mycobacterium bovis subsp bovis AF2122/97
ccuggaaugccgccacaaag

SEQ ID NO: 3127061 - RNA, 18 nt, Mycobacterium bovis subsp bovis AF2122/97
ccuggacaaccucgucga

SEQ ID NO: 3127062 - RNA, 17 nt, Mycobacterium bovis subsp bovis AF2122/97
ccuggacauaccggccc

SEQ ID NO: 3127063 - RNA, 14 nt, Mycobacterium bovis subsp bovis AF2122/97
ccuggaccagcggg

SEQ ID NO: 3127064 - RNA, 21 nt, Mycobacterium bovis subsp bovis AF2122/97
ccuggacgcgcauuucaccgg

SEQ ID NO: 3127065 - RNA, 16 nt, Mycobacterium bovis subsp bovis AF2122/97
ccuggacugcagcgcc

SEQ ID NO: 3127066 - RNA, 20 nt, Mycobacterium bovis subsp bovis AF2122/97
ccuggagcagccacgauccu

SEQ ID NO: 3127067 - RNA, 11 nt, Mycobacterium bovis subsp bovis AF2122/97
ccuggagccgu

SEQ ID NO: 3127068 - RNA, 15 nt, Mycobacterium bovis subsp bovis AF2122/97
ccuggagccgugcgg

SEQ ID NO: 3127069 - RNA, 19 nt, Mycobacterium bovis subsp bovis AF2122/97
ccuggagccgugcggucgc

SEQ ID NO: 3127070 - RNA, 20 nt, Mycobacterium bovis subsp bovis AF2122/97
ccuggauaugcuccggccgc

SEQ ID NO: 3127071 - RNA, 20 nt, Mycobacterium bovis subsp bovis AF2122/97
ccuggaucacacccacgucg

SEQ ID NO: 3127072 - RNA, 14 nt, Mycobacterium bovis subsp bovis AF2122/97
ccuggaucagccag

SEQ ID NO: 3127073 - RNA, 15 nt, Mycobacterium bovis subsp bovis AF2122/97
ccuggaucagccagu

SEQ ID NO: 3127074 - RNA, 19 nt, Mycobacterium bovis subsp bovis AF2122/97
ccuggaucagccaguugau

SEQ ID NO: 3127075 - RNA, 15 nt, Mycobacterium bovis subsp bovis AF2122/97
ccuggcaacgacacg

SEQ ID NO: 3127076 - RNA, 18 nt, Mycobacterium bovis subsp bovis AF2122/97
ccugguggcagacauggc

SEQ ID NO: 3127077 - RNA, 12 nt, Mycobacterium bovis subsp bovis AF2122/97
ccugguggcggg

SEQ ID NO: 3127078 - RNA, 13 nt, Mycobacterium bovis subsp bovis AF2122/97
ccugguggcggga

SEQ ID NO: 3127079 - RNA, 18 nt, Mycobacterium bovis subsp bovis AF2122/97
ccugguggucagucacca

SEQ ID NO: 3127080 - RNA, 17 nt, Mycobacterium bovis subsp bovis AF2122/97
ccugguguccgagcggc

SEQ ID NO: 3127081 - RNA, 14 nt, Mycobacterium bovis subsp bovis AF2122/97
ccuggugucgaucg

SEQ ID NO: 3127082 - RNA, 13 nt, Mycobacterium bovis subsp bovis AF2122/97
ccuggugugcggg

SEQ ID NO: 3127083 - RNA, 21 nt, Mycobacterium bovis subsp bovis AF2122/97
ccugguguucgggcagcuggc

SEQ ID NO: 3127084 - RNA, 23 nt, Mycobacterium bovis subsp bovis AF2122/97
ccuguacaaccugaugcucuggg

SEQ ID NO: 3127085 - RNA, 20 nt, Mycobacterium bovis subsp bovis AF2122/97
ccuguaguucgaugacugaa

SEQ ID NO: 3127086 - RNA, 15 nt, Mycobacterium bovis subsp bovis AF2122/97
ccugucaacgccgcg

SEQ ID NO: 3127087 - RNA, 21 nt, Mycobacterium bovis subsp bovis AF2122/97
ccugucauguccugggccgcc

SEQ ID NO: 3127088 - RNA, 22 nt, Mycobacterium bovis subsp bovis AF2122/97
ccugucauguccugggccgccg

SEQ ID NO: 3127089 - RNA, 17 nt, Mycobacterium bovis subsp bovis AF2122/97
ccugucccgcacccggc

SEQ ID NO: 3127090 - RNA, 13 nt, Mycobacterium bovis subsp bovis AF2122/97
ccugucccgccgg

SEQ ID NO: 3127091 - RNA, 17 nt, Mycobacterium bovis subsp bovis AF2122/97
ccugucccgccggcccc

SEQ ID NO: 3127092 - RNA, 13 nt, Mycobacterium bovis subsp bovis AF2122/97
ccuguccgauaac

SEQ ID NO: 3127093 - RNA, 23 nt, Mycobacterium bovis subsp bovis AF2122/97
ccuguccggcauaccgaacagca

SEQ ID NO: 3127094 - RNA, 18 nt, Mycobacterium bovis subsp bovis AF2122/97
ccuguccggcgccgaggu

SEQ ID NO: 3127095 - RNA, 23 nt, Mycobacterium bovis subsp bovis AF2122/97
ccuguccggugauccaacuggcc

SEQ ID NO: 3127096 - RNA, 21 nt, Mycobacterium bovis subsp bovis AF2122/97
ccuguccuuggcgaacgccac

SEQ ID NO: 3127097 - RNA, 21 nt, Mycobacterium bovis subsp bovis AF2122/97
ccugucgaagauccagcgcac

SEQ ID NO: 3127098 - RNA, 12 nt, Mycobacterium bovis subsp bovis AF2122/97
ccugucgcacca

SEQ ID NO: 3127099 - RNA, 13 nt, Mycobacterium bovis subsp bovis AF2122/97
ccugucgcaccag

SEQ ID NO: 3127100 - RNA, 21 nt, Mycobacterium bovis subsp bovis AF2122/97
ccugucgcaccagauagaucg

SEQ ID NO: 3127101 - RNA, 20 nt, Mycobacterium bovis subsp bovis AF2122/97
ccugugccagcagcagcgcc

SEQ ID NO: 3127102 - RNA, 17 nt, Mycobacterium bovis subsp bovis AF2122/97
ccugugccgccggcgcc

SEQ ID NO: 3127103 - RNA, 14 nt, Mycobacterium bovis subsp bovis AF2122/97
ccugugcgcgguga

SEQ ID NO: 3127104 - RNA, 17 nt, Mycobacterium bovis subsp bovis AF2122/97
ccugugcggagccgcca

SEQ ID NO: 3127105 - RNA, 15 nt, Mycobacterium bovis subsp bovis AF2122/97
ccugugcugccaacg

SEQ ID NO: 3127106 - RNA, 24 nt, Mycobacterium bovis subsp bovis AF2122/97
ccugugucgccgucgcggcacgcc

SEQ ID NO: 3127107 - RNA, 16 nt, Mycobacterium bovis subsp bovis AF2122/97
ccuguucacccacucc

SEQ ID NO: 3127108 - RNA, 19 nt, Mycobacterium bovis subsp bovis AF2122/97
ccuguucgagaucgccgag

SEQ ID NO: 3127109 - RNA, 14 nt, Mycobacterium bovis subsp bovis AF2122/97
ccuguucgccgucg

SEQ ID NO: 3127110 - RNA, 16 nt, Mycobacterium bovis subsp bovis AF2122/97
ccuguucgccgucgcu

SEQ ID NO: 3127111 - RNA, 19 nt, Mycobacterium bovis subsp bovis AF2122/97
ccuguucggcccgaggugc

SEQ ID NO: 3127112 - RNA, 16 nt, Mycobacterium bovis subsp bovis AF2122/97
ccuguugaacggccgc

SEQ ID NO: 3127113 - RNA, 23 nt, Mycobacterium bovis subsp bovis AF2122/97
ccuguugacccaucaugguccgg

SEQ ID NO: 3127114 - RNA, 21 nt, Mycobacterium bovis subsp bovis AF2122/97
ccuguuggcaugccgcccgcu

SEQ ID NO: 3127115 - RNA, 23 nt, Mycobacterium bovis subsp bovis AF2122/97
ccuguuuaccuuccucgcccuug

SEQ ID NO: 3127116 - RNA, 20 nt, Mycobacterium bovis subsp bovis AF2122/97
ccuguuugacugcgaccggu

SEQ ID NO: 3127117 - RNA, 21 nt, Mycobacterium bovis subsp bovis AF2122/97
ccuguuugagcgcacucaccu

SEQ ID NO: 3127118 - RNA, 16 nt, Mycobacterium bovis subsp bovis AF2122/97
ccuguuugcccaacag

SEQ ID NO: 3127119 - RNA, 14 nt, Mycobacterium bovis subsp bovis AF2122/97
ccuuaagccggcgc

SEQ ID NO: 3127120 - RNA, 21 nt, Mycobacterium bovis subsp bovis AF2122/97
ccuuagggucgccgcauugca

SEQ ID NO: 3127121 - RNA, 23 nt, Mycobacterium bovis subsp bovis AF2122/97
ccuuaucgcucucggucaguucc

SEQ ID NO: 3127122 - RNA, 14 nt, Mycobacterium bovis subsp bovis AF2122/97
ccuucaaagcggcc

SEQ ID NO: 3127123 - RNA, 21 nt, Mycobacterium bovis subsp bovis AF2122/97
ccuucaaagcggccucgaccu

SEQ ID NO: 3127124 - RNA, 19 nt, Mycobacterium bovis subsp bovis AF2122/97
ccuucacgcuggccuccag

SEQ ID NO: 3127125 - RNA, 15 nt, Mycobacterium bovis subsp bovis AF2122/97
ccuucagccagucca

SEQ ID NO: 3127126 - RNA, 23 nt, Mycobacterium bovis subsp bovis AF2122/97
ccuucagggcgucgaacucaucu

SEQ ID NO: 3127127 - RNA, 15 nt, Mycobacterium bovis subsp bovis AF2122/97
ccuucaucaacgaca

SEQ ID NO: 3127128 - RNA, 21 nt, Mycobacterium bovis subsp bovis AF2122/97
ccuucaucaacgacaccagau

SEQ ID NO: 3127129 - RNA, 14 nt, Mycobacterium bovis subsp bovis AF2122/97
ccuuccgccgccgc

SEQ ID NO: 3127130 - RNA, 20 nt, Mycobacterium bovis subsp bovis AF2122/97
ccuuccguuggcggcucgcg

SEQ ID NO: 3127131 - RNA, 22 nt, Mycobacterium bovis subsp bovis AF2122/97
ccuucgaaugccgugccgaagu

SEQ ID NO: 3127132 - RNA, 17 nt, Mycobacterium bovis subsp bovis AF2122/97
ccuucgacaaguccgcg

SEQ ID NO: 3127133 - RNA, 19 nt, Mycobacterium bovis subsp bovis AF2122/97
ccuucgaguuuggugucga

SEQ ID NO: 3127134 - RNA, 22 nt, Mycobacterium bovis subsp bovis AF2122/97
ccuucgaugaaauccuccuccg

SEQ ID NO: 3127135 - RNA, 20 nt, Mycobacterium bovis subsp bovis AF2122/97
ccuucgcagcauguggccgc

SEQ ID NO: 3127136 - RNA, 23 nt, Mycobacterium bovis subsp bovis AF2122/97
ccuucgcagcauguggccgccgu

SEQ ID NO: 3127137 - RNA, 14 nt, Mycobacterium bovis subsp bovis AF2122/97
ccuucgcggugugc

SEQ ID NO: 3127138 - RNA, 22 nt, Mycobacterium bovis subsp bovis AF2122/97
ccuucgcggugugcggcagccc

SEQ ID NO: 3127139 - RNA, 21 nt, Mycobacterium bovis subsp bovis AF2122/97
ccuucgcuauggcggcuucga

SEQ ID NO: 3127140 - RNA, 13 nt, Mycobacterium bovis subsp bovis AF2122/97
ccuucggcgagcg

SEQ ID NO: 3127141 - RNA, 21 nt, Mycobacterium bovis subsp bovis AF2122/97
ccuucgguaggcaggccggcu

SEQ ID NO: 3127142 - RNA, 16 nt, Mycobacterium bovis subsp bovis AF2122/97
ccuucggugucgccga

SEQ ID NO: 3127143 - RNA, 20 nt, Mycobacterium bovis subsp bovis AF2122/97
ccuucguaaccacgacgacg

SEQ ID NO: 3127144 - RNA, 15 nt, Mycobacterium bovis subsp bovis AF2122/97
ccuucguagaaggac

SEQ ID NO: 3127145 - RNA, 23 nt, Mycobacterium bovis subsp bovis AF2122/97
ccuucguagcggccgcaggcgaa

SEQ ID NO: 3127146 - RNA, 16 nt, Mycobacterium bovis subsp bovis AF2122/97
ccuucgucgcggccgc

SEQ ID NO: 3127147 - RNA, 13 nt, Mycobacterium bovis subsp bovis AF2122/97
ccuucuccaucgu

SEQ ID NO: 3127148 - RNA, 14 nt, Mycobacterium bovis subsp bovis AF2122/97
ccuucuccaucguc

SEQ ID NO: 3127149 - RNA, 19 nt, Mycobacterium bovis subsp bovis AF2122/97
ccuucuccccgaucagcac

SEQ ID NO: 3127150 - RNA, 13 nt, Mycobacterium bovis subsp bovis AF2122/97
ccuucucccgcac

SEQ ID NO: 3127151 - RNA, 21 nt, Mycobacterium bovis subsp bovis AF2122/97
ccuucucccgcacggccgggu

SEQ ID NO: 3127152 - RNA, 15 nt, Mycobacterium bovis subsp bovis AF2122/97
ccuucucgccgccgc

SEQ ID NO: 3127153 - RNA, 14 nt, Mycobacterium bovis subsp bovis AF2122/97
ccuucucgccgugu

SEQ ID NO: 3127154 - RNA, 19 nt, Mycobacterium bovis subsp bovis AF2122/97
ccuucucguaacgcggcac

SEQ ID NO: 3127155 - RNA, 16 nt, Mycobacterium bovis subsp bovis AF2122/97
ccuucucgucggccag

SEQ ID NO: 3127156 - RNA, 21 nt, Mycobacterium bovis subsp bovis AF2122/97
ccuucucgucggccagugcgc

SEQ ID NO: 3127157 - RNA, 14 nt, Mycobacterium bovis subsp bovis AF2122/97
ccuucugguucggg

SEQ ID NO: 3127158 - RNA, 13 nt, Mycobacterium bovis subsp bovis AF2122/97
ccuucuucucggc

SEQ ID NO: 3127159 - RNA, 22 nt, Mycobacterium bovis subsp bovis AF2122/97
ccuucuuggcaggugccuucuu

SEQ ID NO: 3127160 - RNA, 11 nt, Mycobacterium bovis subsp bovis AF2122/97
ccuucuuggcg

SEQ ID NO: 3127161 - RNA, 20 nt, Mycobacterium bovis subsp bovis AF2122/97
ccuugacagcuuucuuggcg

SEQ ID NO: 3127162 - RNA, 12 nt, Mycobacterium bovis subsp bovis AF2122/97
ccuugugacccc

SEQ ID NO: 3127163 - RNA, 14 nt, Mycobacterium bovis subsp bovis AF2122/97
ccuugugaccccgg

SEQ ID NO: 3127164 - RNA, 12 nt, Mycobacterium bovis subsp bovis AF2122/97
ccuugugcagau

SEQ ID NO: 3127165 - RNA, 19 nt, Mycobacterium bovis subsp bovis AF2122/97
ccuuguggcacacccgcac

SEQ ID NO: 3127166 - RNA, 20 nt, Mycobacterium bovis subsp bovis AF2122/97
ccuuguggucugccagcacc

SEQ ID NO: 3127167 - RNA, 15 nt, Mycobacterium bovis subsp bovis AF2122/97
ccuuguucccgaaac

SEQ ID NO: 3127168 - RNA, 18 nt, Mycobacterium bovis subsp bovis AF2122/97
ccuuguucccgaaacccg

SEQ ID NO: 3127169 - RNA, 17 nt, Mycobacterium bovis subsp bovis AF2122/97
ccuuguugaacguucug

SEQ ID NO: 3127170 - RNA, 17 nt, Mycobacterium bovis subsp bovis AF2122/97
ccuuguugaccaccacc

SEQ ID NO: 3127171 - RNA, 14 nt, Mycobacterium bovis subsp bovis AF2122/97
ccuuguugccgccg

SEQ ID NO: 3127172 - RNA, 18 nt, Mycobacterium bovis subsp bovis AF2122/97
ccuuguuggccugcaacg

SEQ ID NO: 3127173 - RNA, 20 nt, Mycobacterium bovis subsp bovis AF2122/97
ccuuguuggcgcccgggccc

SEQ ID NO: 3127174 - RNA, 16 nt, Mycobacterium bovis subsp bovis AF2122/97
ccuuuccggccgccug

SEQ ID NO: 3127175 - RNA, 19 nt, Mycobacterium bovis subsp bovis AF2122/97
ccuuucgugcaccgcgacc

SEQ ID NO: 3127176 - RNA, 20 nt, Mycobacterium bovis subsp bovis AF2122/97
ccuuugagcgcggccaccag

SEQ ID NO: 3127177 - RNA, 14 nt, Mycobacterium bovis subsp bovis AF2122/97
ccuuugauucuaac

SEQ ID NO: 3127178 - RNA, 19 nt, Mycobacterium bovis subsp bovis AF2122/97
ccuuugccaccucggcgcg

SEQ ID NO: 3127179 - RNA, 15 nt, Mycobacterium bovis subsp bovis AF2122/97
ccuuugcccgccgcg

SEQ ID NO: 3127180 - RNA, 20 nt, Mycobacterium bovis subsp bovis AF2122/97
ccuuugccgccgaacgccuc

SEQ ID NO: 3127181 - RNA, 16 nt, Mycobacterium bovis subsp bovis AF2122/97
ccuuuggccgcgaccg

SEQ ID NO: 3127182 - RNA, 20 nt, Mycobacterium bovis subsp bovis AF2122/97
ccuuuggcucccuuuuccaa

SEQ ID NO: 3127183 - RNA, 18 nt, Mycobacterium bovis subsp bovis AF2122/97
ccuuuguggggccgggcu

SEQ ID NO: 3127184 - RNA, 18 nt, Mycobacterium bovis subsp bovis AF2122/97
ccuuuugccgcagcaucc

SEQ ID NO: 3127185 - RNA, 13 nt, Mycobacterium bovis subsp bovis AF2122/97
ccuuuuucggcga

SEQ ID NO: 3127186 - RNA, 16 nt, Mycobacterium bovis subsp bovis AF2122/97
cgaaaaacaccagcga

SEQ ID NO: 3127187 - RNA, 23 nt, Mycobacterium bovis subsp bovis AF2122/97
cgaaaaacgaccccucacccagc

SEQ ID NO: 3127188 - RNA, 21 nt, Mycobacterium bovis subsp bovis AF2122/97
cgaaaaccucggacugcagcg

SEQ ID NO: 3127189 - RNA, 22 nt, Mycobacterium bovis subsp bovis AF2122/97
cgaaaacgacaucaccaccgca

SEQ ID NO: 3127190 - RNA, 22 nt, Mycobacterium bovis subsp bovis AF2122/97
cgaaaagccgugcaccagcgac

SEQ ID NO: 3127191 - RNA, 18 nt, Mycobacterium bovis subsp bovis AF2122/97
cgaaaagccguucgcguc

SEQ ID NO: 3127192 - RNA, 22 nt, Mycobacterium bovis subsp bovis AF2122/97
cgaaacaccgucuggccguugc

SEQ ID NO: 3127193 - RNA, 13 nt, Mycobacterium bovis subsp bovis AF2122/97
cgaaacagcaccc

SEQ ID NO: 3127194 - RNA, 17 nt, Mycobacterium bovis subsp bovis AF2122/97
cgaaacagcacccagac

SEQ ID NO: 3127195 - RNA, 19 nt, Mycobacterium bovis subsp bovis AF2122/97
cgaaacagcuugcugcgca

SEQ ID NO: 3127196 - RNA, 22 nt, Mycobacterium bovis subsp bovis AF2122/97
cgaaacaucucggcgcagccgg

SEQ ID NO: 3127197 - RNA, 14 nt, Mycobacterium bovis subsp bovis AF2122/97
cgaaacaugcgcca

SEQ ID NO: 3127198 - RNA, 23 nt, Mycobacterium bovis subsp bovis AF2122/97
cgaaaccacuuccggcguggccc

SEQ ID NO: 3127199 - RNA, 12 nt, Mycobacterium bovis subsp bovis AF2122/97
cgaaacccauga

SEQ ID NO: 3127200 - RNA, 14 nt, Mycobacterium bovis subsp bovis AF2122/97
cgaaacccaugacc

SEQ ID NO: 3127201 - RNA, 14 nt, Mycobacterium bovis subsp bovis AF2122/97
cgaaaccgcagcgc

SEQ ID NO: 3127202 - RNA, 12 nt, Mycobacterium bovis subsp bovis AF2122/97
cgaaaccgccgu

SEQ ID NO: 3127203 - RNA, 15 nt, Mycobacterium bovis subsp bovis AF2122/97
cgaaaccggaccuga

SEQ ID NO: 3127204 - RNA, 17 nt, Mycobacterium bovis subsp bovis AF2122/97
cgaaaccggucagcaca

SEQ ID NO: 3127205 - RNA, 13 nt, Mycobacterium bovis subsp bovis AF2122/97
cgaaacgauggcc

SEQ ID NO: 3127206 - RNA, 14 nt, Mycobacterium bovis subsp bovis AF2122/97
cgaaacgcccgggc

SEQ ID NO: 3127207 - RNA, 13 nt, Mycobacterium bovis subsp bovis AF2122/97
cgaaacgccgggu

SEQ ID NO: 3127208 - RNA, 19 nt, Mycobacterium bovis subsp bovis AF2122/97
cgaaacgcuuacccagccc

SEQ ID NO: 3127209 - RNA, 19 nt, Mycobacterium bovis subsp bovis AF2122/97
cgaaacggggcgacguccg

SEQ ID NO: 3127210 - RNA, 17 nt, Mycobacterium bovis subsp bovis AF2122/97
cgaaacgguacgccgcc

SEQ ID NO: 3127211 - RNA, 18 nt, Mycobacterium bovis subsp bovis AF2122/97
cgaaacgguacgccgccg

SEQ ID NO: 3127212 - RNA, 19 nt, Mycobacterium bovis subsp bovis AF2122/97
cgaaacgguacgccgccgc

SEQ ID NO: 3127213 - RNA, 14 nt, Mycobacterium bovis subsp bovis AF2122/97
cgaaacucaccagc

SEQ ID NO: 3127214 - RNA, 15 nt, Mycobacterium bovis subsp bovis AF2122/97
cgaaacucaccagca

SEQ ID NO: 3127215 - RNA, 18 nt, Mycobacterium bovis subsp bovis AF2122/97
cgaaacucaccagcaccc

SEQ ID NO: 3127216 - RNA, 22 nt, Mycobacterium bovis subsp bovis AF2122/97
cgaaacucaccagcaccccgag

SEQ ID NO: 3127217 - RNA, 20 nt, Mycobacterium bovis subsp bovis AF2122/97
cgaaacuucgcccgggccgc

SEQ ID NO: 3127218 - RNA, 17 nt, Mycobacterium bovis subsp bovis AF2122/97
cgaaagagaaggcggcg

SEQ ID NO: 3127219 - RNA, 20 nt, Mycobacterium bovis subsp bovis AF2122/97
cgaaagccaacucgaccgac

SEQ ID NO: 3127220 - RNA, 14 nt, Mycobacterium bovis subsp bovis AF2122/97
cgaaagccaggcgg

SEQ ID NO: 3127221 - RNA, 20 nt, Mycobacterium bovis subsp bovis AF2122/97
cgaaagccaggcggcaagga

SEQ ID NO: 3127222 - RNA, 15 nt, Mycobacterium bovis subsp bovis AF2122/97
cgaaagccgcggccg

SEQ ID NO: 3127223 - RNA, 20 nt, Mycobacterium bovis subsp bovis AF2122/97
cgaaagccuugccgucgagc

SEQ ID NO: 3127224 - RNA, 21 nt, Mycobacterium bovis subsp bovis AF2122/97
cgaaagcgccgaaacagcacc

SEQ ID NO: 3127225 - RNA, 17 nt, Mycobacterium bovis subsp bovis AF2122/97
cgaaagcgucgaucacc

SEQ ID NO: 3127226 - RNA, 18 nt, Mycobacterium bovis subsp bovis AF2122/97
cgaaagugguggcaacgg

SEQ ID NO: 3127227 - RNA, 21 nt, Mycobacterium bovis subsp bovis AF2122/97
cgaaauacccagcgcagcagc

SEQ ID NO: 3127228 - RNA, 24 nt, Mycobacterium bovis subsp bovis AF2122/97
cgaaaucagcccgcgcagcggucc

SEQ ID NO: 3127229 - RNA, 19 nt, Mycobacterium bovis subsp bovis AF2122/97
cgaaaucaguugcgcucca

SEQ ID NO: 3127230 - RNA, 15 nt, Mycobacterium bovis subsp bovis AF2122/97
cgaaaucccccgaca

SEQ ID NO: 3127231 - RNA, 22 nt, Mycobacterium bovis subsp bovis AF2122/97
cgaaauccccugcgcugcagcu

SEQ ID NO: 3127232 - RNA, 17 nt, Mycobacterium bovis subsp bovis AF2122/97
cgaaauccgccgggcgc

SEQ ID NO: 3127233 - RNA, 16 nt, Mycobacterium bovis subsp bovis AF2122/97
cgaaauccugguggca

SEQ ID NO: 3127234 - RNA, 14 nt, Mycobacterium bovis subsp bovis AF2122/97
cgaaaucgcacagc

SEQ ID NO: 3127235 - RNA, 16 nt, Mycobacterium bovis subsp bovis AF2122/97
cgaaaucgcacagcgc

SEQ ID NO: 3127236 - RNA, 18 nt, Mycobacterium bovis subsp bovis AF2122/97
cgaaaucgcacagcgcag

SEQ ID NO: 3127237 - RNA, 15 nt, Mycobacterium bovis subsp bovis AF2122/97
cgaaaucggccagcu

SEQ ID NO: 3127238 - RNA, 24 nt, Mycobacterium bovis subsp bovis AF2122/97
cgaaaucggcggcguccagcagcg

SEQ ID NO: 3127239 - RNA, 19 nt, Mycobacterium bovis subsp bovis AF2122/97
cgaaaucucaucgauuggc

SEQ ID NO: 3127240 - RNA, 22 nt, Mycobacterium bovis subsp bovis AF2122/97
cgaaaucucaucgauuggcucg

SEQ ID NO: 3127241 - RNA, 19 nt, Mycobacterium bovis subsp bovis AF2122/97
cgaaaugccgggcccgacg

SEQ ID NO: 3127242 - RNA, 20 nt, Mycobacterium bovis subsp bovis AF2122/97
cgaaaugccgggcccgacgu

SEQ ID NO: 3127243 - RNA, 17 nt, Mycobacterium bovis subsp bovis AF2122/97
cgaaaugccugcgcgau

SEQ ID NO: 3127244 - RNA, 21 nt, Mycobacterium bovis subsp bovis AF2122/97
cgaaauguuggccguaccggu

SEQ ID NO: 3127245 - RNA, 19 nt, Mycobacterium bovis subsp bovis AF2122/97
cgaacaacgcgacgaagca

SEQ ID NO: 3127246 - RNA, 13 nt, Mycobacterium bovis subsp bovis AF2122/97
cgaacaagaaaag

SEQ ID NO: 3127247 - RNA, 18 nt, Mycobacterium bovis subsp bovis AF2122/97
cgaacaaguggccagcgc

SEQ ID NO: 3127248 - RNA, 19 nt, Mycobacterium bovis subsp bovis AF2122/97
cgaaccgccgccgccgcgu

SEQ ID NO: 3127249 - RNA, 13 nt, Mycobacterium bovis subsp bovis AF2122/97
cgaaccgccggca

SEQ ID NO: 3127250 - RNA, 17 nt, Mycobacterium bovis subsp bovis AF2122/97
cgaaccgccggcaccgc

SEQ ID NO: 3127251 - RNA, 20 nt, Mycobacterium bovis subsp bovis AF2122/97
cgaaccgcguuaugccaggc

SEQ ID NO: 3127252 - RNA, 22 nt, Mycobacterium bovis subsp bovis AF2122/97
cgaaccgcguuaugccaggcgc

SEQ ID NO: 3127253 - RNA, 12 nt, Mycobacterium bovis subsp bovis AF2122/97
cgaaccgcucca

SEQ ID NO: 3127254 - RNA, 13 nt, Mycobacterium bovis subsp bovis AF2122/97
cgaaccgcuccac

SEQ ID NO: 3127255 - RNA, 18 nt, Mycobacterium bovis subsp bovis AF2122/97
cgaaccgcuccgagcacc

SEQ ID NO: 3127256 - RNA, 15 nt, Mycobacterium bovis subsp bovis AF2122/97
cgaaccggcaccagc

SEQ ID NO: 3127257 - RNA, 16 nt, Mycobacterium bovis subsp bovis AF2122/97
cgaaccggcaccagcg

SEQ ID NO: 3127258 - RNA, 19 nt, Mycobacterium bovis subsp bovis AF2122/97
cgaaccggcaccagcggca

SEQ ID NO: 3127259 - RNA, 18 nt, Mycobacterium bovis subsp bovis AF2122/97
cgaaccggccgucgacgc

SEQ ID NO: 3127260 - RNA, 18 nt, Mycobacterium bovis subsp bovis AF2122/97
cgaaccgguguagcagcg

SEQ ID NO: 3127261 - RNA, 20 nt, Mycobacterium bovis subsp bovis AF2122/97
cgaaccgguguagcagcgcc

SEQ ID NO: 3127262 - RNA, 21 nt, Mycobacterium bovis subsp bovis AF2122/97
cgaaccgguguagcagcgcca

SEQ ID NO: 3127263 - RNA, 19 nt, Mycobacterium bovis subsp bovis AF2122/97
cgaaccgucagcgcgccgu

SEQ ID NO: 3127264 - RNA, 23 nt, Mycobacterium bovis subsp bovis AF2122/97
cgaaccguuugguggcaccgguu

SEQ ID NO: 3127265 - RNA, 16 nt, Mycobacterium bovis subsp bovis AF2122/97
cgaaccugcggcagcg

SEQ ID NO: 3127266 - RNA, 18 nt, Mycobacterium bovis subsp bovis AF2122/97
cgaaccugcggcagcgga

SEQ ID NO: 3127267 - RNA, 20 nt, Mycobacterium bovis subsp bovis AF2122/97
cgaaccugcucggcgcgccg

SEQ ID NO: 3127268 - RNA, 22 nt, Mycobacterium bovis subsp bovis AF2122/97
cgaaccugucgaucacggccgu

SEQ ID NO: 3127269 - RNA, 16 nt, Mycobacterium bovis subsp bovis AF2122/97
cgaacgaagucgacga

SEQ ID NO: 3127270 - RNA, 14 nt, Mycobacterium bovis subsp bovis AF2122/97
cgaacgacagcaga

SEQ ID NO: 3127271 - RNA, 18 nt, Mycobacterium bovis subsp bovis AF2122/97
cgaacgacgcuuucccga

SEQ ID NO: 3127272 - RNA, 21 nt, Mycobacterium bovis subsp bovis AF2122/97
cgaacgacgcuuucccgauga

SEQ ID NO: 3127273 - RNA, 16 nt, Mycobacterium bovis subsp bovis AF2122/97
cgaacgacggguccgg

SEQ ID NO: 3127274 - RNA, 18 nt, Mycobacterium bovis subsp bovis AF2122/97
cgaacgacggguccgggc

SEQ ID NO: 3127275 - RNA, 20 nt, Mycobacterium bovis subsp bovis AF2122/97
cgaacgaggcgcccagcgac

SEQ ID NO: 3127276 - RNA, 16 nt, Mycobacterium bovis subsp bovis AF2122/97
cgaacgaucccgccga

SEQ ID NO: 3127277 - RNA, 18 nt, Mycobacterium bovis subsp bovis AF2122/97
cgaacgcaacagccgaac

SEQ ID NO: 3127278 - RNA, 19 nt, Mycobacterium bovis subsp bovis AF2122/97
cgaacgcaugcucgaucgc

SEQ ID NO: 3127279 - RNA, 23 nt, Mycobacterium bovis subsp bovis AF2122/97
cgaacgcaugcucgaucgcguuc

SEQ ID NO: 3127280 - RNA, 12 nt, Mycobacterium bovis subsp bovis AF2122/97
cgaacgccacca

SEQ ID NO: 3127281 - RNA, 21 nt, Mycobacterium bovis subsp bovis AF2122/97
cgaacgccacggcaucggcca

SEQ ID NO: 3127282 - RNA, 15 nt, Mycobacterium bovis subsp bovis AF2122/97
cgaacgccagcagcu

SEQ ID NO: 3127283 - RNA, 17 nt, Mycobacterium bovis subsp bovis AF2122/97
cgaacgcccugacggug

SEQ ID NO: 3127284 - RNA, 14 nt, Mycobacterium bovis subsp bovis AF2122/97
cgaacgccgcccgc

SEQ ID NO: 3127285 - RNA, 18 nt, Mycobacterium bovis subsp bovis AF2122/97
cgaacgccgucgacgcgg

SEQ ID NO: 3127286 - RNA, 17 nt, Mycobacterium bovis subsp bovis AF2122/97
cgaacgccucaccgacg

SEQ ID NO: 3127287 - RNA, 16 nt, Mycobacterium bovis subsp bovis AF2122/97
cgaacgccucgccggc

SEQ ID NO: 3127288 - RNA, 20 nt, Mycobacterium bovis subsp bovis AF2122/97
cgaacgccucgccggccacc

SEQ ID NO: 3127289 - RNA, 23 nt, Mycobacterium bovis subsp bovis AF2122/97
cgaacgccucgccggccaccagc

SEQ ID NO: 3127290 - RNA, 19 nt, Mycobacterium bovis subsp bovis AF2122/97
cgaacgccucugcgaucag

SEQ ID NO: 3127291 - RNA, 15 nt, Mycobacterium bovis subsp bovis AF2122/97
cgaacgccugcucgu

SEQ ID NO: 3127292 - RNA, 17 nt, Mycobacterium bovis subsp bovis AF2122/97
cgaacgccugcucgucg

SEQ ID NO: 3127293 - RNA, 23 nt, Mycobacterium bovis subsp bovis AF2122/97
cgaacgccugcucgucggccacc

SEQ ID NO: 3127294 - RNA, 16 nt, Mycobacterium bovis subsp bovis AF2122/97
cgaacgccugcuggua

SEQ ID NO: 3127295 - RNA, 13 nt, Mycobacterium bovis subsp bovis AF2122/97
cgaacgcgaucga

SEQ ID NO: 3127296 - RNA, 13 nt, Mycobacterium bovis subsp bovis AF2122/97
cgaacgcgccggu

SEQ ID NO: 3127297 - RNA, 15 nt, Mycobacterium bovis subsp bovis AF2122/97
cgaacgcggccaccg

SEQ ID NO: 3127298 - RNA, 12 nt, Mycobacterium bovis subsp bovis AF2122/97
cgaacgcggcgu

SEQ ID NO: 3127299 - RNA, 20 nt, Mycobacterium bovis subsp bovis AF2122/97
cgaacgcggcgucgauaacc

SEQ ID NO: 3127300 - RNA, 16 nt, Mycobacterium bovis subsp bovis AF2122/97
cgaacgcguccagcgc

SEQ ID NO: 3127301 - RNA, 17 nt, Mycobacterium bovis subsp bovis AF2122/97
cgaacgcguccagcgcg

SEQ ID NO: 3127302 - RNA, 19 nt, Mycobacterium bovis subsp bovis AF2122/97
cgaacgcguccagcgcggc

SEQ ID NO: 3127303 - RNA, 23 nt, Mycobacterium bovis subsp bovis AF2122/97
cgaacgcguccagcgcggccuug

SEQ ID NO: 3127304 - RNA, 15 nt, Mycobacterium bovis subsp bovis AF2122/97
cgaacgcuccaggcc

SEQ ID NO: 3127305 - RNA, 22 nt, Mycobacterium bovis subsp bovis AF2122/97
cgaacgcugaggaagcggcggc

SEQ ID NO: 3127306 - RNA, 14 nt, Mycobacterium bovis subsp bovis AF2122/97
cgaacgcuggcggc

SEQ ID NO: 3127307 - RNA, 18 nt, Mycobacterium bovis subsp bovis AF2122/97
cgaacggauaccugggac

SEQ ID NO: 3127308 - RNA, 17 nt, Mycobacterium bovis subsp bovis AF2122/97
cgaacggaucucggugg

SEQ ID NO: 3127309 - RNA, 20 nt, Mycobacterium bovis subsp bovis AF2122/97
cgaacggcaccagaucuucg

SEQ ID NO: 3127310 - RNA, 16 nt, Mycobacterium bovis subsp bovis AF2122/97
cgaacggccaggacaa

SEQ ID NO: 3127311 - RNA, 18 nt, Mycobacterium bovis subsp bovis AF2122/97
cgaacggcgaggugccca

SEQ ID NO: 3127312 - RNA, 22 nt, Mycobacterium bovis subsp bovis AF2122/97
cgaacggcuuggcgucggccgg

SEQ ID NO: 3127313 - RNA, 20 nt, Mycobacterium bovis subsp bovis AF2122/97
cgaacggguagucgggcaag

SEQ ID NO: 3127314 - RNA, 15 nt, Mycobacterium bovis subsp bovis AF2122/97
cgaacgggucggcga

SEQ ID NO: 3127315 - RNA, 19 nt, Mycobacterium bovis subsp bovis AF2122/97
cgaacgggucggcgaccac

SEQ ID NO: 3127316 - RNA, 17 nt, Mycobacterium bovis subsp bovis AF2122/97
cgaacgguagcacgguc

SEQ ID NO: 3127317 - RNA, 18 nt, Mycobacterium bovis subsp bovis AF2122/97
cgaacgguagcacggucu

SEQ ID NO: 3127318 - RNA, 18 nt, Mycobacterium bovis subsp bovis AF2122/97
cgaacgucaaccgggcgg

SEQ ID NO: 3127319 - RNA, 23 nt, Mycobacterium bovis subsp bovis AF2122/97
cgaacgucaaccgggcggcguuu

SEQ ID NO: 3127320 - RNA, 12 nt, Mycobacterium bovis subsp bovis AF2122/97
cgaacgucacca

SEQ ID NO: 3127321 - RNA, 18 nt, Mycobacterium bovis subsp bovis AF2122/97
cgaacgucagugccccgc

SEQ ID NO: 3127322 - RNA, 21 nt, Mycobacterium bovis subsp bovis AF2122/97
cgaacgucagugccccgcagc

SEQ ID NO: 3127323 - RNA, 18 nt, Mycobacterium bovis subsp bovis AF2122/97
cgaacgucgcggccagca

SEQ ID NO: 3127324 - RNA, 19 nt, Mycobacterium bovis subsp bovis AF2122/97
cgaacgucgcggccagcag

SEQ ID NO: 3127325 - RNA, 19 nt, Mycobacterium bovis subsp bovis AF2122/97
cgaacgugcaaccacggcg

SEQ ID NO: 3127326 - RNA, 19 nt, Mycobacterium bovis subsp bovis AF2122/97
cgaacgugcaaccauggcg

SEQ ID NO: 3127327 - RNA, 23 nt, Mycobacterium bovis subsp bovis AF2122/97
cgaacuaucguugugcggacauc

SEQ ID NO: 3127328 - RNA, 13 nt, Mycobacterium bovis subsp bovis AF2122/97
cgaacucaccgcc

SEQ ID NO: 3127329 - RNA, 17 nt, Mycobacterium bovis subsp bovis AF2122/97
cgaacucaccgccauga

SEQ ID NO: 3127330 - RNA, 15 nt, Mycobacterium bovis subsp bovis AF2122/97
cgaacucacgcagga

SEQ ID NO: 3127331 - RNA, 20 nt, Mycobacterium bovis subsp bovis AF2122/97
cgaacucaucgugguaacca

SEQ ID NO: 3127332 - RNA, 20 nt, Mycobacterium bovis subsp bovis AF2122/97
cgaacucaucuuugacaccg

SEQ ID NO: 3127333 - RNA, 18 nt, Mycobacterium bovis subsp bovis AF2122/97
cgaacuccagcagcccgg

SEQ ID NO: 3127334 - RNA, 14 nt, Mycobacterium bovis subsp bovis AF2122/97
cgaagccgggugcu

SEQ ID NO: 3127335 - RNA, 16 nt, Mycobacterium bovis subsp bovis AF2122/97
cgaagccggugccggc

SEQ ID NO: 3127336 - RNA, 17 nt, Mycobacterium bovis subsp bovis AF2122/97
cgaagccggugccggcg

SEQ ID NO: 3127337 - RNA, 22 nt, Mycobacterium bovis subsp bovis AF2122/97
cgaagccucggcaugcagcccc

SEQ ID NO: 3127338 - RNA, 19 nt, Mycobacterium bovis subsp bovis AF2122/97
cgaagcgauccggcugcgg

SEQ ID NO: 3127339 - RNA, 18 nt, Mycobacterium bovis subsp bovis AF2122/97
cgaagcgaucgccggccg

SEQ ID NO: 3127340 - RNA, 12 nt, Mycobacterium bovis subsp bovis AF2122/97
cgaagcgaugcc

SEQ ID NO: 3127341 - RNA, 15 nt, Mycobacterium bovis subsp bovis AF2122/97
cgaagcgcagcaccu

SEQ ID NO: 3127342 - RNA, 20 nt, Mycobacterium bovis subsp bovis AF2122/97
cgaagcgcucggcagccggc

SEQ ID NO: 3127343 - RNA, 15 nt, Mycobacterium bovis subsp bovis AF2122/97
cgaagcggccaccgc

SEQ ID NO: 3127344 - RNA, 16 nt, Mycobacterium bovis subsp bovis AF2122/97
cgaagcggccaccgcc

SEQ ID NO: 3127345 - RNA, 17 nt, Mycobacterium bovis subsp bovis AF2122/97
cgaagcggccaccgccg

SEQ ID NO: 3127346 - RNA, 20 nt, Mycobacterium bovis subsp bovis AF2122/97
cgaagcggccaccgccgccg

SEQ ID NO: 3127347 - RNA, 20 nt, Mycobacterium bovis subsp bovis AF2122/97
cgaagcggcugcugcgcggu

SEQ ID NO: 3127348 - RNA, 18 nt, Mycobacterium bovis subsp bovis AF2122/97
cgaagcgggacugcagcg

SEQ ID NO: 3127349 - RNA, 21 nt, Mycobacterium bovis subsp bovis AF2122/97
cgaagcgggcccgcaggucgg

SEQ ID NO: 3127350 - RNA, 15 nt, Mycobacterium bovis subsp bovis AF2122/97
cgaagcgggcgugcu

SEQ ID NO: 3127351 - RNA, 17 nt, Mycobacterium bovis subsp bovis AF2122/97
cgaagcggugacccacu

SEQ ID NO: 3127352 - RNA, 14 nt, Mycobacterium bovis subsp bovis AF2122/97
cgaagcgugcgccg

SEQ ID NO: 3127353 - RNA, 16 nt, Mycobacterium bovis subsp bovis AF2122/97
cgaagcgugcgccgac

SEQ ID NO: 3127354 - RNA, 17 nt, Mycobacterium bovis subsp bovis AF2122/97
cgaagcgugcgccgacu

SEQ ID NO: 3127355 - RNA, 18 nt, Mycobacterium bovis subsp bovis AF2122/97
cgaagcguucccgguccu

SEQ ID NO: 3127356 - RNA, 19 nt, Mycobacterium bovis subsp bovis AF2122/97
cgaagcucaucaccggcgc

SEQ ID NO: 3127357 - RNA, 18 nt, Mycobacterium bovis subsp bovis AF2122/97
cgaagcucaucgccgcua

SEQ ID NO: 3127358 - RNA, 13 nt, Mycobacterium bovis subsp bovis AF2122/97
cgaagcucgcgcu

SEQ ID NO: 3127359 - RNA, 15 nt, Mycobacterium bovis subsp bovis AF2122/97
cgaagcugaccagac

SEQ ID NO: 3127360 - RNA, 20 nt, Mycobacterium bovis subsp bovis AF2122/97
cgaagcugcgggucagcgcc

SEQ ID NO: 3127361 - RNA, 15 nt, Mycobacterium bovis subsp bovis AF2122/97
cgaagcugcgggucu

SEQ ID NO: 3127362 - RNA, 20 nt, Mycobacterium bovis subsp bovis AF2122/97
cgaagcugcugcugcuugac

SEQ ID NO: 3127363 - RNA, 21 nt, Mycobacterium bovis subsp bovis AF2122/97
cgaagcugugcccggcgcccg

SEQ ID NO: 3127364 - RNA, 22 nt, Mycobacterium bovis subsp bovis AF2122/97
cgaagcuugacguugccgggcu

SEQ ID NO: 3127365 - RNA, 23 nt, Mycobacterium bovis subsp bovis AF2122/97
cgaaggaaaaugauagcggcgca

SEQ ID NO: 3127366 - RNA, 17 nt, Mycobacterium bovis subsp bovis AF2122/97
cgaaggaugcugucaga

SEQ ID NO: 3127367 - RNA, 12 nt, Mycobacterium bovis subsp bovis AF2122/97
cgaaggccaccc

SEQ ID NO: 3127368 - RNA, 13 nt, Mycobacterium bovis subsp bovis AF2122/97
cgaaggccgccaa

SEQ ID NO: 3127369 - RNA, 14 nt, Mycobacterium bovis subsp bovis AF2122/97
cgaaggccgccaac

SEQ ID NO: 3127370 - RNA, 22 nt, Mycobacterium bovis subsp bovis AF2122/97
cgaaggccgccacaaacccgau

SEQ ID NO: 3127371 - RNA, 14 nt, Mycobacterium bovis subsp bovis AF2122/97
cgaaggccgcgcgc

SEQ ID NO: 3127372 - RNA, 21 nt, Mycobacterium bovis subsp bovis AF2122/97
cgaaggcgacaucaccaccga

SEQ ID NO: 3127373 - RNA, 20 nt, Mycobacterium bovis subsp bovis AF2122/97
cgaaggcggcuccaccgggc

SEQ ID NO: 3127374 - RNA, 20 nt, Mycobacterium bovis subsp bovis AF2122/97
cgaaggcguucgccggggcg

SEQ ID NO: 3127375 - RNA, 16 nt, Mycobacterium bovis subsp bovis AF2122/97
cgaaggcuugucggua

SEQ ID NO: 3127376 - RNA, 16 nt, Mycobacterium bovis subsp bovis AF2122/97
cgaaggggugcccggc

SEQ ID NO: 3127377 - RNA, 17 nt, Mycobacterium bovis subsp bovis AF2122/97
cgaaggggugcccggcg

SEQ ID NO: 3127378 - RNA, 20 nt, Mycobacterium bovis subsp bovis AF2122/97
cgaaggggugcccggcggcc

SEQ ID NO: 3127379 - RNA, 21 nt, Mycobacterium bovis subsp bovis AF2122/97
cgaaggggugcccggcggcca

SEQ ID NO: 3127380 - RNA, 18 nt, Mycobacterium bovis subsp bovis AF2122/97
cgaaggucagcaccgcuu

SEQ ID NO: 3127381 - RNA, 21 nt, Mycobacterium bovis subsp bovis AF2122/97
cgaaggucaucaugucgaggu

SEQ ID NO: 3127382 - RNA, 22 nt, Mycobacterium bovis subsp bovis AF2122/97
cgaaggucgguaccccagcgcu

SEQ ID NO: 3127383 - RNA, 20 nt, Mycobacterium bovis subsp bovis AF2122/97
cgaaggucuccggcaagccg

SEQ ID NO: 3127384 - RNA, 22 nt, Mycobacterium bovis subsp bovis AF2122/97
cgaaggucucgaaagccgcggc

SEQ ID NO: 3127385 - RNA, 19 nt, Mycobacterium bovis subsp bovis AF2122/97
cgaaggugaacgacauggg

SEQ ID NO: 3127386 - RNA, 22 nt, Mycobacterium bovis subsp bovis AF2122/97
cgaaggugaacgacaugggcag

SEQ ID NO: 3127387 - RNA, 20 nt, Mycobacterium bovis subsp bovis AF2122/97
cgaaggugaaucgacugauc

SEQ ID NO: 3127388 - RNA, 18 nt, Mycobacterium bovis subsp bovis AF2122/97
cgaaggugacaaaucggc

SEQ ID NO: 3127389 - RNA, 20 nt, Mycobacterium bovis subsp bovis AF2122/97
cgaaggugaccaggcggacg

SEQ ID NO: 3127390 - RNA, 20 nt, Mycobacterium bovis subsp bovis AF2122/97
cgaaggugaugaacaccggc

SEQ ID NO: 3127391 - RNA, 21 nt, Mycobacterium bovis subsp bovis AF2122/97
cgaaggugaugaacaccggcg

SEQ ID NO: 3127392 - RNA, 22 nt, Mycobacterium bovis subsp bovis AF2122/97
cgaaggugaugaacaccggcgc

SEQ ID NO: 3127393 - RNA, 23 nt, Mycobacterium bovis subsp bovis AF2122/97
cgaaggugaugaacaccggcgcc

SEQ ID NO: 3127394 - RNA, 23 nt, Mycobacterium bovis subsp bovis AF2122/97
cgaagguggcgaaaucgucgaac

SEQ ID NO: 3127395 - RNA, 15 nt, Mycobacterium bovis subsp bovis AF2122/97
cgaaguacuggccgc

SEQ ID NO: 3127396 - RNA, 15 nt, Mycobacterium bovis subsp bovis AF2122/97
cgaaguagccgaccg

SEQ ID NO: 3127397 - RNA, 15 nt, Mycobacterium bovis subsp bovis AF2122/97
cgaagucacgcaccc

SEQ ID NO: 3127398 - RNA, 17 nt, Mycobacterium bovis subsp bovis AF2122/97
cgaaguccaccacgacg

SEQ ID NO: 3127399 - RNA, 22 nt, Mycobacterium bovis subsp bovis AF2122/97
cgaaguccaccacgacgucggu

SEQ ID NO: 3127400 - RNA, 13 nt, Mycobacterium bovis subsp bovis AF2122/97
cgaaguccacgca

SEQ ID NO: 3127401 - RNA, 20 nt, Mycobacterium bovis subsp bovis AF2122/97
cgaaguccacgcaccacgag

SEQ ID NO: 3127402 - RNA, 15 nt, Mycobacterium bovis subsp bovis AF2122/97
cgaaguccuggcaga

SEQ ID NO: 3127403 - RNA, 12 nt, Mycobacterium bovis subsp bovis AF2122/97
cgaagucgacga

SEQ ID NO: 3127404 - RNA, 14 nt, Mycobacterium bovis subsp bovis AF2122/97
cgaagucgacgaac

SEQ ID NO: 3127405 - RNA, 18 nt, Mycobacterium bovis subsp bovis AF2122/97
cgaagucgagugccgcgu

SEQ ID NO: 3127406 - RNA, 22 nt, Mycobacterium bovis subsp bovis AF2122/97
cgaagucguacugguagcacuc

SEQ ID NO: 3127407 - RNA, 21 nt, Mycobacterium bovis subsp bovis AF2122/97
cgaagucuugaccgcaccggc

SEQ ID NO: 3127408 - RNA, 22 nt, Mycobacterium bovis subsp bovis AF2122/97
cgaagucuugaccgcaccggcc

SEQ ID NO: 3127409 - RNA, 14 nt, Mycobacterium bovis subsp bovis AF2122/97
cgaagugacccgaa

SEQ ID NO: 3127410 - RNA, 15 nt, Mycobacterium bovis subsp bovis AF2122/97
cgaagugacccgaac

SEQ ID NO: 3127411 - RNA, 16 nt, Mycobacterium bovis subsp bovis AF2122/97
cgaagugcaggugcgg

SEQ ID NO: 3127412 - RNA, 18 nt, Mycobacterium bovis subsp bovis AF2122/97
cgaagugcaggugcgggc

SEQ ID NO: 3127413 - RNA, 21 nt, Mycobacterium bovis subsp bovis AF2122/97
cgaagugcaggugcgggccgg

SEQ ID NO: 3127414 - RNA, 19 nt, Mycobacterium bovis subsp bovis AF2122/97
cgaagugccuuccucggca

SEQ ID NO: 3127415 - RNA, 20 nt, Mycobacterium bovis subsp bovis AF2122/97
cgaagugccuuccucggcaa

SEQ ID NO: 3127416 - RNA, 21 nt, Mycobacterium bovis subsp bovis AF2122/97
cgaagugccuuccucggcaag

SEQ ID NO: 3127417 - RNA, 16 nt, Mycobacterium bovis subsp bovis AF2122/97
cgaaguggugaccgac

SEQ ID NO: 3127418 - RNA, 20 nt, Mycobacterium bovis subsp bovis AF2122/97
cgaaguggugaccgacgcgg

SEQ ID NO: 3127419 - RNA, 16 nt, Mycobacterium bovis subsp bovis AF2122/97
cgaagugucgcugcaa

SEQ ID NO: 3127420 - RNA, 13 nt, Mycobacterium bovis subsp bovis AF2122/97
cgacaacacgccg

SEQ ID NO: 3127421 - RNA, 16 nt, Mycobacterium bovis subsp bovis AF2122/97
cgacaacacgccgucg

SEQ ID NO: 3127422 - RNA, 17 nt, Mycobacterium bovis subsp bovis AF2122/97
cgacaacacgccgucga

SEQ ID NO: 3127423 - RNA, 14 nt, Mycobacterium bovis subsp bovis AF2122/97
cgacaacagcacgu

SEQ ID NO: 3127424 - RNA, 16 nt, Mycobacterium bovis subsp bovis AF2122/97
cgacaacaugcccguc

SEQ ID NO: 3127425 - RNA, 18 nt, Mycobacterium bovis subsp bovis AF2122/97
cgacaacccggccgggcc

SEQ ID NO: 3127426 - RNA, 21 nt, Mycobacterium bovis subsp bovis AF2122/97
cgacaacccggcgucgacgau

SEQ ID NO: 3127427 - RNA, 20 nt, Mycobacterium bovis subsp bovis AF2122/97
cgacaaccgagcugacgccg

SEQ ID NO: 3127428 - RNA, 18 nt, Mycobacterium bovis subsp bovis AF2122/97
cgacaacgacgucgccga

SEQ ID NO: 3127429 - RNA, 19 nt, Mycobacterium bovis subsp bovis AF2122/97
cgacaacgacgucgccgac

SEQ ID NO: 3127430 - RNA, 22 nt, Mycobacterium bovis subsp bovis AF2122/97
cgacaacgacgucgccgacccg

SEQ ID NO: 3127431 - RNA, 17 nt, Mycobacterium bovis subsp bovis AF2122/97
cgacaacgaucgcgcga

SEQ ID NO: 3127432 - RNA, 13 nt, Mycobacterium bovis subsp bovis AF2122/97
cgacaacgauguc

SEQ ID NO: 3127433 - RNA, 23 nt, Mycobacterium bovis subsp bovis AF2122/97
cgacaacgccuuguuggcgcccg

SEQ ID NO: 3127434 - RNA, 14 nt, Mycobacterium bovis subsp bovis AF2122/97
cgacaacgcggcac

SEQ ID NO: 3127435 - RNA, 15 nt, Mycobacterium bovis subsp bovis AF2122/97
cgacaacgcggcacc

SEQ ID NO: 3127436 - RNA, 14 nt, Mycobacterium bovis subsp bovis AF2122/97
cgacaacgcugggc

SEQ ID NO: 3127437 - RNA, 16 nt, Mycobacterium bovis subsp bovis AF2122/97
cgacaacgcugggcgg

SEQ ID NO: 3127438 - RNA, 16 nt, Mycobacterium bovis subsp bovis AF2122/97
cgacaacggcggcaug

SEQ ID NO: 3127439 - RNA, 18 nt, Mycobacterium bovis subsp bovis AF2122/97
cgacaagaccggcgggca

SEQ ID NO: 3127440 - RNA, 19 nt, Mycobacterium bovis subsp bovis AF2122/97
cgacaaggcgauugucggg

SEQ ID NO: 3127441 - RNA, 17 nt, Mycobacterium bovis subsp bovis AF2122/97
cgacaaguccgcgaugg

SEQ ID NO: 3127442 - RNA, 18 nt, Mycobacterium bovis subsp bovis AF2122/97
cgacaaguccgcgauggc

SEQ ID NO: 3127443 - RNA, 19 nt, Mycobacterium bovis subsp bovis AF2122/97
cgacaaguccgcgauggcc

SEQ ID NO: 3127444 - RNA, 22 nt, Mycobacterium bovis subsp bovis AF2122/97
cgacaagugcacgaaguccugg

SEQ ID NO: 3127445 - RNA, 13 nt, Mycobacterium bovis subsp bovis AF2122/97
cgacaagugcccg

SEQ ID NO: 3127446 - RNA, 15 nt, Mycobacterium bovis subsp bovis AF2122/97
cgacaaucaccaacg

SEQ ID NO: 3127447 - RNA, 14 nt, Mycobacterium bovis subsp bovis AF2122/97
cgacaaucgcacgc

SEQ ID NO: 3127448 - RNA, 17 nt, Mycobacterium bovis subsp bovis AF2122/97
cgacaaucgcacgcugc

SEQ ID NO: 3127449 - RNA, 16 nt, Mycobacterium bovis subsp bovis AF2122/97
cgacaauggcgccagc

SEQ ID NO: 3127450 - RNA, 21 nt, Mycobacterium bovis subsp bovis AF2122/97
cgacaauggcgccagccgacc

SEQ ID NO: 3127451 - RNA, 17 nt, Mycobacterium bovis subsp bovis AF2122/97
cgacacaccccagcaac

SEQ ID NO: 3127452 - RNA, 13 nt, Mycobacterium bovis subsp bovis AF2122/97
cgacacacgccgc

SEQ ID NO: 3127453 - RNA, 14 nt, Mycobacterium bovis subsp bovis AF2122/97
cgacacacgccgcc

SEQ ID NO: 3127454 - RNA, 16 nt, Mycobacterium bovis subsp bovis AF2122/97
cgacacacgccgccgg

SEQ ID NO: 3127455 - RNA, 19 nt, Mycobacterium bovis subsp bovis AF2122/97
cgacacacgccgccggugu

SEQ ID NO: 3127456 - RNA, 14 nt, Mycobacterium bovis subsp bovis AF2122/97
cgacacagcggcgg

SEQ ID NO: 3127457 - RNA, 11 nt, Mycobacterium bovis subsp bovis AF2122/97
cgacaccacca

SEQ ID NO: 3127458 - RNA, 13 nt, Mycobacterium bovis subsp bovis AF2122/97
cgacaccaccagg

SEQ ID NO: 3127459 - RNA, 17 nt, Mycobacterium bovis subsp bovis AF2122/97
cgacaccaccauucccg

SEQ ID NO: 3127460 - RNA, 14 nt, Mycobacterium bovis subsp bovis AF2122/97
cgacaccaccggcg

SEQ ID NO: 3127461 - RNA, 15 nt, Mycobacterium bovis subsp bovis AF2122/97
cgacaccaccggcgc

SEQ ID NO: 3127462 - RNA, 16 nt, Mycobacterium bovis subsp bovis AF2122/97
cgacaccaccggcgcc

SEQ ID NO: 3127463 - RNA, 17 nt, Mycobacterium bovis subsp bovis AF2122/97
cgacaccaccggcgccg

SEQ ID NO: 3127464 - RNA, 20 nt, Mycobacterium bovis subsp bovis AF2122/97
cgacaccaccggcgccgccg

SEQ ID NO: 3127465 - RNA, 17 nt, Mycobacterium bovis subsp bovis AF2122/97
cgacaccacggaccagc

SEQ ID NO: 3127466 - RNA, 18 nt, Mycobacterium bovis subsp bovis AF2122/97
cgacaccauaggccgacg

SEQ ID NO: 3127467 - RNA, 18 nt, Mycobacterium bovis subsp bovis AF2122/97
cgacacccagccgcagcc

SEQ ID NO: 3127468 - RNA, 17 nt, Mycobacterium bovis subsp bovis AF2122/97
cgacacccauccucgcg

SEQ ID NO: 3127469 - RNA, 22 nt, Mycobacterium bovis subsp bovis AF2122/97
cgacaccccgaugccgugccgg

SEQ ID NO: 3127470 - RNA, 17 nt, Mycobacterium bovis subsp bovis AF2122/97
cgacacccgcauggcag

SEQ ID NO: 3127471 - RNA, 22 nt, Mycobacterium bovis subsp bovis AF2122/97
cgacacccgcauggcagcggcg

SEQ ID NO: 3127472 - RNA, 14 nt, Mycobacterium bovis subsp bovis AF2122/97
cgacacccgcucgg

SEQ ID NO: 3127473 - RNA, 19 nt, Mycobacterium bovis subsp bovis AF2122/97
cgacacccgcucggccguc

SEQ ID NO: 3127474 - RNA, 14 nt, Mycobacterium bovis subsp bovis AF2122/97
cgacacccugggug

SEQ ID NO: 3127475 - RNA, 19 nt, Mycobacterium bovis subsp bovis AF2122/97
cgacacccugggugccggc

SEQ ID NO: 3127476 - RNA, 22 nt, Mycobacterium bovis subsp bovis AF2122/97
cgacacccugggugccggcagc

SEQ ID NO: 3127477 - RNA, 18 nt, Mycobacterium bovis subsp bovis AF2122/97
cgacaccgacgcggucgg

SEQ ID NO: 3127478 - RNA, 23 nt, Mycobacterium bovis subsp bovis AF2122/97
cgacaccgacgcggucggcggcc

SEQ ID NO: 3127479 - RNA, 15 nt, Mycobacterium bovis subsp bovis AF2122/97
cgacaccgacucgca

SEQ ID NO: 3127480 - RNA, 18 nt, Mycobacterium bovis subsp bovis AF2122/97
cgacaccgagccacgacc

SEQ ID NO: 3127481 - RNA, 18 nt, Mycobacterium bovis subsp bovis AF2122/97
cgacaccgcagcgggcgg

SEQ ID NO: 3127482 - RNA, 15 nt, Mycobacterium bovis subsp bovis AF2122/97
cgacaccgcaggugc

SEQ ID NO: 3127483 - RNA, 20 nt, Mycobacterium bovis subsp bovis AF2122/97
cgacaccgcaggugccgugg

SEQ ID NO: 3127484 - RNA, 16 nt, Mycobacterium bovis subsp bovis AF2122/97
cgacaccgccaccacg

SEQ ID NO: 3127485 - RNA, 22 nt, Mycobacterium bovis subsp bovis AF2122/97
cgacaccgccccgccgcgacgg

SEQ ID NO: 3127486 - RNA, 12 nt, Mycobacterium bovis subsp bovis AF2122/97
cgacaccgcccg

SEQ ID NO: 3127487 - RNA, 13 nt, Mycobacterium bovis subsp bovis AF2122/97
cgacaccgcccga

SEQ ID NO: 3127488 - RNA, 16 nt, Mycobacterium bovis subsp bovis AF2122/97
cgacaccgcccgaccc

SEQ ID NO: 3127489 - RNA, 18 nt, Mycobacterium bovis subsp bovis AF2122/97
cgacaccgcggacccgca

SEQ ID NO: 3127490 - RNA, 23 nt, Mycobacterium bovis subsp bovis AF2122/97
cgacaccgcggacccgcagcugc

SEQ ID NO: 3127491 - RNA, 20 nt, Mycobacterium bovis subsp bovis AF2122/97
cgacaccgcggugccccgga

SEQ ID NO: 3127492 - RNA, 17 nt, Mycobacterium bovis subsp bovis AF2122/97
cgacaccggccgcgacg

SEQ ID NO: 3127493 - RNA, 12 nt, Mycobacterium bovis subsp bovis AF2122/97
cgacaccggcgc

SEQ ID NO: 3127494 - RNA, 17 nt, Mycobacterium bovis subsp bovis AF2122/97
cgacaccggcgcccuca

SEQ ID NO: 3127495 - RNA, 23 nt, Mycobacterium bovis subsp bovis AF2122/97
cgacaccguaggcgaucucacgc

SEQ ID NO: 3127496 - RNA, 18 nt, Mycobacterium bovis subsp bovis AF2122/97
cgacaccguccagcagcu

SEQ ID NO: 3127497 - RNA, 21 nt, Mycobacterium bovis subsp bovis AF2122/97
cgacaccgugaccgccgcgcc

SEQ ID NO: 3127498 - RNA, 23 nt, Mycobacterium bovis subsp bovis AF2122/97
cgacaccgugaccgccgcgccgg

SEQ ID NO: 3127499 - RNA, 15 nt, Mycobacterium bovis subsp bovis AF2122/97
cgacaccguguugcu

SEQ ID NO: 3127500 - RNA, 16 nt, Mycobacterium bovis subsp bovis AF2122/97
cgacaccguguugcug

SEQ ID NO: 3127501 - RNA, 17 nt, Mycobacterium bovis subsp bovis AF2122/97
cgacaccguguugcugu

SEQ ID NO: 3127502 - RNA, 18 nt, Mycobacterium bovis subsp bovis AF2122/97
cgacaccuccgucagcgc

SEQ ID NO: 3127503 - RNA, 19 nt, Mycobacterium bovis subsp bovis AF2122/97
cgacaccuccgucagcgcc

SEQ ID NO: 3127504 - RNA, 20 nt, Mycobacterium bovis subsp bovis AF2122/97
cgacaccucgaaggcacugc

SEQ ID NO: 3127505 - RNA, 17 nt, Mycobacterium bovis subsp bovis AF2122/97
cgacaccuguucaccaa

SEQ ID NO: 3127506 - RNA, 20 nt, Mycobacterium bovis subsp bovis AF2122/97
cgacacgaaggucgcggucg

SEQ ID NO: 3127507 - RNA, 18 nt, Mycobacterium bovis subsp bovis AF2122/97
cgacaucaccaccgcacg

SEQ ID NO: 3127508 - RNA, 15 nt, Mycobacterium bovis subsp bovis AF2122/97
cgacaucauggugaa

SEQ ID NO: 3127509 - RNA, 20 nt, Mycobacterium bovis subsp bovis AF2122/97
cgacaucauggugaaggcaa

SEQ ID NO: 3127510 - RNA, 13 nt, Mycobacterium bovis subsp bovis AF2122/97
cgacaucgacaag

SEQ ID NO: 3127511 - RNA, 13 nt, Mycobacterium bovis subsp bovis AF2122/97
cgacaucgagauc

SEQ ID NO: 3127512 - RNA, 15 nt, Mycobacterium bovis subsp bovis AF2122/97
cgacaucgagaucgc

SEQ ID NO: 3127513 - RNA, 12 nt, Mycobacterium bovis subsp bovis AF2122/97
cgacaucgccau

SEQ ID NO: 3127514 - RNA, 15 nt, Mycobacterium bovis subsp bovis AF2122/97
cgacaucgcugcgac

SEQ ID NO: 3127515 - RNA, 14 nt, Mycobacterium bovis subsp bovis AF2122/97
cgacaucggcccga

SEQ ID NO: 3127516 - RNA, 19 nt, Mycobacterium bovis subsp bovis AF2122/97
cgacaucggcccgaucacc

SEQ ID NO: 3127517 - RNA, 21 nt, Mycobacterium bovis subsp bovis AF2122/97
cgacaucggcccgaucaccau

SEQ ID NO: 3127518 - RNA, 22 nt, Mycobacterium bovis subsp bovis AF2122/97
cgacaucgguggcggccuccga

SEQ ID NO: 3127519 - RNA, 17 nt, Mycobacterium bovis subsp bovis AF2122/97
cgacaucgucgcgacga

SEQ ID NO: 3127520 - RNA, 19 nt, Mycobacterium bovis subsp bovis AF2122/97
cgacaucgucgcgacgacg

SEQ ID NO: 3127521 - RNA, 16 nt, Mycobacterium bovis subsp bovis AF2122/97
cgacaucguuggccgg

SEQ ID NO: 3127522 - RNA, 22 nt, Mycobacterium bovis subsp bovis AF2122/97
cgacaucguuggccgggcacgc

SEQ ID NO: 3127523 - RNA, 20 nt, Mycobacterium bovis subsp bovis AF2122/97
cgacaucucggucagaugcg

SEQ ID NO: 3127524 - RNA, 21 nt, Mycobacterium bovis subsp bovis AF2122/97
cgacaucugcccagcgguugc

SEQ ID NO: 3127525 - RNA, 14 nt, Mycobacterium bovis subsp bovis AF2122/97
cgacaugaaccggu

SEQ ID NO: 3127526 - RNA, 15 nt, Mycobacterium bovis subsp bovis AF2122/97
cgacaugacgcggcc

SEQ ID NO: 3127527 - RNA, 16 nt, Mycobacterium bovis subsp bovis AF2122/97
cgacaugacgcggcca

SEQ ID NO: 3127528 - RNA, 19 nt, Mycobacterium bovis subsp bovis AF2122/97
cgacaugagcgccacgccg

SEQ ID NO: 3127529 - RNA, 22 nt, Mycobacterium bovis subsp bovis AF2122/97
cgacaugaggcugccgaaguug

SEQ ID NO: 3127530 - RNA, 17 nt, Mycobacterium bovis subsp bovis AF2122/97
cgacaugggcaggccgc

SEQ ID NO: 3127531 - RNA, 18 nt, Mycobacterium bovis subsp bovis AF2122/97
cgacaugggucggcuguc

SEQ ID NO: 3127532 - RNA, 18 nt, Mycobacterium bovis subsp bovis AF2122/97
cgacaugguccgaccagc

SEQ ID NO: 3127533 - RNA, 19 nt, Mycobacterium bovis subsp bovis AF2122/97
cgacaugguccgaccagcg

SEQ ID NO: 3127534 - RNA, 20 nt, Mycobacterium bovis subsp bovis AF2122/97
cgacaugguccgaccagcgg

SEQ ID NO: 3127535 - RNA, 15 nt, Mycobacterium bovis subsp bovis AF2122/97
cgacauugccacggc

SEQ ID NO: 3127536 - RNA, 21 nt, Mycobacterium bovis subsp bovis AF2122/97
cgacauuggccgucaucgccg

SEQ ID NO: 3127537 - RNA, 19 nt, Mycobacterium bovis subsp bovis AF2122/97
cgaccaaaccgacgcgggc

SEQ ID NO: 3127538 - RNA, 23 nt, Mycobacterium bovis subsp bovis AF2122/97
cgaccaaaccgacgcgggccgcg

SEQ ID NO: 3127539 - RNA, 13 nt, Mycobacterium bovis subsp bovis AF2122/97
cgaccaacacggu

SEQ ID NO: 3127540 - RNA, 14 nt, Mycobacterium bovis subsp bovis AF2122/97
cgaccaacacgucg

SEQ ID NO: 3127541 - RNA, 15 nt, Mycobacterium bovis subsp bovis AF2122/97
cgaccaacacgucga

SEQ ID NO: 3127542 - RNA, 15 nt, Mycobacterium bovis subsp bovis AF2122/97
cgaccaacgcggugu

SEQ ID NO: 3127543 - RNA, 18 nt, Mycobacterium bovis subsp bovis AF2122/97
cgaccaagagguucuccg

SEQ ID NO: 3127544 - RNA, 14 nt, Mycobacterium bovis subsp bovis AF2122/97
cgaccaaggccgac

SEQ ID NO: 3127545 - RNA, 20 nt, Mycobacterium bovis subsp bovis AF2122/97
cgaccaagguguccagcacc

SEQ ID NO: 3127546 - RNA, 23 nt, Mycobacterium bovis subsp bovis AF2122/97
cgaccaagguguccagcaccugc

SEQ ID NO: 3127547 - RNA, 18 nt, Mycobacterium bovis subsp bovis AF2122/97
cgaccaagucaugcccac

SEQ ID NO: 3127548 - RNA, 24 nt, Mycobacterium bovis subsp bovis AF2122/97
cgaccaagucaugcccacgcugcc

SEQ ID NO: 3127549 - RNA, 15 nt, Mycobacterium bovis subsp bovis AF2122/97
cgaccaauagcacgg

SEQ ID NO: 3127550 - RNA, 15 nt, Mycobacterium bovis subsp bovis AF2122/97
cgaccaaugcagugc

SEQ ID NO: 3127551 - RNA, 20 nt, Mycobacterium bovis subsp bovis AF2122/97
cgaccaaugcagugcgaucg

SEQ ID NO: 3127552 - RNA, 23 nt, Mycobacterium bovis subsp bovis AF2122/97
cgaccaauucgaccgcgcggauc

SEQ ID NO: 3127553 - RNA, 18 nt, Mycobacterium bovis subsp bovis AF2122/97
cgaccaauucgcaaucgg

SEQ ID NO: 3127554 - RNA, 15 nt, Mycobacterium bovis subsp bovis AF2122/97
cgaccaauuggucga

SEQ ID NO: 3127555 - RNA, 20 nt, Mycobacterium bovis subsp bovis AF2122/97
cgaccacaucaugccagccg

SEQ ID NO: 3127556 - RNA, 22 nt, Mycobacterium bovis subsp bovis AF2122/97
cgaccacaucaugccagccguc

SEQ ID NO: 3127557 - RNA, 12 nt, Mycobacterium bovis subsp bovis AF2122/97
cgaccaccacca

SEQ ID NO: 3127558 - RNA, 15 nt, Mycobacterium bovis subsp bovis AF2122/97
cgaccaccaccaacg

SEQ ID NO: 3127559 - RNA, 12 nt, Mycobacterium bovis subsp bovis AF2122/97
cgaccaccaccc

SEQ ID NO: 3127560 - RNA, 16 nt, Mycobacterium bovis subsp bovis AF2122/97
cgaccaccaccgccgc

SEQ ID NO: 3127561 - RNA, 19 nt, Mycobacterium bovis subsp bovis AF2122/97
cgaccaccaccgccgccga

SEQ ID NO: 3127562 - RNA, 21 nt, Mycobacterium bovis subsp bovis AF2122/97
cgaccaccaccgccgccgaag

SEQ ID NO: 3127563 - RNA, 18 nt, Mycobacterium bovis subsp bovis AF2122/97
cgaccaccagagcgucga

SEQ ID NO: 3127564 - RNA, 13 nt, Mycobacterium bovis subsp bovis AF2122/97
cgaccaccagcgc

SEQ ID NO: 3127565 - RNA, 18 nt, Mycobacterium bovis subsp bovis AF2122/97
cgaccaccagcgccgacc

SEQ ID NO: 3127566 - RNA, 16 nt, Mycobacterium bovis subsp bovis AF2122/97
cgaccacccgcagggc

SEQ ID NO: 3127567 - RNA, 21 nt, Mycobacterium bovis subsp bovis AF2122/97
cgaccacccgcagggcaucgg

SEQ ID NO: 3127568 - RNA, 13 nt, Mycobacterium bovis subsp bovis AF2122/97
cgaccacccggau

SEQ ID NO: 3127569 - RNA, 13 nt, Mycobacterium bovis subsp bovis AF2122/97
cgaccaccgccga

SEQ ID NO: 3127570 - RNA, 15 nt, Mycobacterium bovis subsp bovis AF2122/97
cgaccaccgccgagc

SEQ ID NO: 3127571 - RNA, 13 nt, Mycobacterium bovis subsp bovis AF2122/97
cgaccaccgccgg

SEQ ID NO: 3127572 - RNA, 16 nt, Mycobacterium bovis subsp bovis AF2122/97
cgaccaccgccggccc

SEQ ID NO: 3127573 - RNA, 15 nt, Mycobacterium bovis subsp bovis AF2122/97
cgaccaccgccgggc

SEQ ID NO: 3127574 - RNA, 22 nt, Mycobacterium bovis subsp bovis AF2122/97
cgaccaccgcggcugcuccguc

SEQ ID NO: 3127575 - RNA, 12 nt, Mycobacterium bovis subsp bovis AF2122/97
cgaccaccgcgu

SEQ ID NO: 3127576 - RNA, 16 nt, Mycobacterium bovis subsp bovis AF2122/97
cgaccaccggaucgcc

SEQ ID NO: 3127577 - RNA, 22 nt, Mycobacterium bovis subsp bovis AF2122/97
cgaccaccggguagccggcgug

SEQ ID NO: 3127578 - RNA, 14 nt, Mycobacterium bovis subsp bovis AF2122/97
cgaccaccgucacg

SEQ ID NO: 3127579 - RNA, 19 nt, Mycobacterium bovis subsp bovis AF2122/97
cgaccaccucagcugcgga

SEQ ID NO: 3127580 - RNA, 20 nt, Mycobacterium bovis subsp bovis AF2122/97
cgaccaccucagcugcggac

SEQ ID NO: 3127581 - RNA, 22 nt, Mycobacterium bovis subsp bovis AF2122/97
cgaccaccugcugcacggucau

SEQ ID NO: 3127582 - RNA, 18 nt, Mycobacterium bovis subsp bovis AF2122/97
cgaccaccuucugacgcg

SEQ ID NO: 3127583 - RNA, 19 nt, Mycobacterium bovis subsp bovis AF2122/97
cgaccaccuucugacgcgg

SEQ ID NO: 3127584 - RNA, 23 nt, Mycobacterium bovis subsp bovis AF2122/97
cgaccaccuucugacgcggccgg

SEQ ID NO: 3127585 - RNA, 14 nt, Mycobacterium bovis subsp bovis AF2122/97
cgaccacgacguuc

SEQ ID NO: 3127586 - RNA, 14 nt, Mycobacterium bovis subsp bovis AF2122/97
cgaccacgaugauc

SEQ ID NO: 3127587 - RNA, 14 nt, Mycobacterium bovis subsp bovis AF2122/97
cgaccacgcaccgc

SEQ ID NO: 3127588 - RNA, 15 nt, Mycobacterium bovis subsp bovis AF2122/97
cgaccacgcaccgcc

SEQ ID NO: 3127589 - RNA, 18 nt, Mycobacterium bovis subsp bovis AF2122/97
cgaccacgcaccgccccg

SEQ ID NO: 3127590 - RNA, 20 nt, Mycobacterium bovis subsp bovis AF2122/97
cgaccacgcaccgccccgcc

SEQ ID NO: 3127591 - RNA, 13 nt, Mycobacterium bovis subsp bovis AF2122/97
cgaccacgccgcc

SEQ ID NO: 3127592 - RNA, 18 nt, Mycobacterium bovis subsp bovis AF2122/97
cgaccacgccgccggcgc

SEQ ID NO: 3127593 - RNA, 22 nt, Mycobacterium bovis subsp bovis AF2122/97
cgaccacugcccgggguccauc

SEQ ID NO: 3127594 - RNA, 15 nt, Mycobacterium bovis subsp bovis AF2122/97
cgaccccggcugcgc

SEQ ID NO: 3127595 - RNA, 17 nt, Mycobacterium bovis subsp bovis AF2122/97
cgaccccggcugcgcuu

SEQ ID NO: 3127596 - RNA, 21 nt, Mycobacterium bovis subsp bovis AF2122/97
cgaccccggugagcucuucgg

SEQ ID NO: 3127597 - RNA, 20 nt, Mycobacterium bovis subsp bovis AF2122/97
cgacccgaacugggcgaucg

SEQ ID NO: 3127598 - RNA, 13 nt, Mycobacterium bovis subsp bovis AF2122/97
cgacccgacgcug

SEQ ID NO: 3127599 - RNA, 17 nt, Mycobacterium bovis subsp bovis AF2122/97
cgacccgacgcuggucg

SEQ ID NO: 3127600 - RNA, 16 nt, Mycobacterium bovis subsp bovis AF2122/97
cgacccgacguagccg

SEQ ID NO: 3127601 - RNA, 13 nt, Mycobacterium bovis subsp bovis AF2122/97
cgacccgaucacc

SEQ ID NO: 3127602 - RNA, 14 nt, Mycobacterium bovis subsp bovis AF2122/97
cgacccgcaacccg

SEQ ID NO: 3127603 - RNA, 18 nt, Mycobacterium bovis subsp bovis AF2122/97
cgacccgcagaccgccac

SEQ ID NO: 3127604 - RNA, 20 nt, Mycobacterium bovis subsp bovis AF2122/97
cgacccgcagaccgccaccg

SEQ ID NO: 3127605 - RNA, 12 nt, Mycobacterium bovis subsp bovis AF2122/97
cgacccgcccau

SEQ ID NO: 3127606 - RNA, 16 nt, Mycobacterium bovis subsp bovis AF2122/97
cgacccgccgacgccg

SEQ ID NO: 3127607 - RNA, 18 nt, Mycobacterium bovis subsp bovis AF2122/97
cgacccgccgacgccgcc

SEQ ID NO: 3127608 - RNA, 20 nt, Mycobacterium bovis subsp bovis AF2122/97
cgacccgccgacgccgccgg

SEQ ID NO: 3127609 - RNA, 13 nt, Mycobacterium bovis subsp bovis AF2122/97
cgacccgccgcgc

SEQ ID NO: 3127610 - RNA, 20 nt, Mycobacterium bovis subsp bovis AF2122/97
cgacccgccgcgcccggcgc

SEQ ID NO: 3127611 - RNA, 21 nt, Mycobacterium bovis subsp bovis AF2122/97
cgacccgccgcgcccggcgca

SEQ ID NO: 3127612 - RNA, 22 nt, Mycobacterium bovis subsp bovis AF2122/97
cgacccgccgcgcccggcgcaa

SEQ ID NO: 3127613 - RNA, 22 nt, Mycobacterium bovis subsp bovis AF2122/97
cgacccgccgcggacaccagga

SEQ ID NO: 3127614 - RNA, 18 nt, Mycobacterium bovis subsp bovis AF2122/97
cgacccgcgcgccggcga

SEQ ID NO: 3127615 - RNA, 21 nt, Mycobacterium bovis subsp bovis AF2122/97
cgacccgcgcgccggcgaccc

SEQ ID NO: 3127616 - RNA, 13 nt, Mycobacterium bovis subsp bovis AF2122/97
cgacccgcggcgg

SEQ ID NO: 3127617 - RNA, 17 nt, Mycobacterium bovis subsp bovis AF2122/97
cgacccgcugccaccca

SEQ ID NO: 3127618 - RNA, 18 nt, Mycobacterium bovis subsp bovis AF2122/97
cgacccggaccugggcga

SEQ ID NO: 3127619 - RNA, 14 nt, Mycobacterium bovis subsp bovis AF2122/97
cgacccggccagcg

SEQ ID NO: 3127620 - RNA, 15 nt, Mycobacterium bovis subsp bovis AF2122/97
cgacccggccagcgg

SEQ ID NO: 3127621 - RNA, 14 nt, Mycobacterium bovis subsp bovis AF2122/97
cgacccggcccagc

SEQ ID NO: 3127622 - RNA, 17 nt, Mycobacterium bovis subsp bovis AF2122/97
cgacccggcccagcgcc

SEQ ID NO: 3127623 - RNA, 14 nt, Mycobacterium bovis subsp bovis AF2122/97
cgacccggccgaug

SEQ ID NO: 3127624 - RNA, 16 nt, Mycobacterium bovis subsp bovis AF2122/97
cgacccggccgcugac

SEQ ID NO: 3127625 - RNA, 16 nt, Mycobacterium bovis subsp bovis AF2122/97
cgacccgggaaggaac

SEQ ID NO: 3127626 - RNA, 17 nt, Mycobacterium bovis subsp bovis AF2122/97
cgacccgggaaggaacc

SEQ ID NO: 3127627 - RNA, 22 nt, Mycobacterium bovis subsp bovis AF2122/97
cgacccgggaaggaaccgggca

SEQ ID NO: 3127628 - RNA, 13 nt, Mycobacterium bovis subsp bovis AF2122/97
cgacccgggccgg

SEQ ID NO: 3127629 - RNA, 15 nt, Mycobacterium bovis subsp bovis AF2122/97
cgacccgggccgguc

SEQ ID NO: 3127630 - RNA, 16 nt, Mycobacterium bovis subsp bovis AF2122/97
cgacccgggcguccca

SEQ ID NO: 3127631 - RNA, 18 nt, Mycobacterium bovis subsp bovis AF2122/97
cgacccgggcgucccaau

SEQ ID NO: 3127632 - RNA, 18 nt, Mycobacterium bovis subsp bovis AF2122/97
cgacccgggggcgcccgg

SEQ ID NO: 3127633 - RNA, 19 nt, Mycobacterium bovis subsp bovis AF2122/97
cgacccggguagacaccgc

SEQ ID NO: 3127634 - RNA, 14 nt, Mycobacterium bovis subsp bovis AF2122/97
cgacccgggucggc

SEQ ID NO: 3127635 - RNA, 20 nt, Mycobacterium bovis subsp bovis AF2122/97
cgacccgggucggcacgacc

SEQ ID NO: 3127636 - RNA, 21 nt, Mycobacterium bovis subsp bovis AF2122/97
cgacccgggucggcacgaccc

SEQ ID NO: 3127637 - RNA, 21 nt, Mycobacterium bovis subsp bovis AF2122/97
cgacccgguccacgccaggag

SEQ ID NO: 3127638 - RNA, 12 nt, Mycobacterium bovis subsp bovis AF2122/97
cgacccggucga

SEQ ID NO: 3127639 - RNA, 14 nt, Mycobacterium bovis subsp bovis AF2122/97
cgacccggucgacg

SEQ ID NO: 3127640 - RNA, 15 nt, Mycobacterium bovis subsp bovis AF2122/97
cgacccggucgacgg

SEQ ID NO: 3127641 - RNA, 17 nt, Mycobacterium bovis subsp bovis AF2122/97
cgacccggucgacgggu

SEQ ID NO: 3127642 - RNA, 19 nt, Mycobacterium bovis subsp bovis AF2122/97
cgacccggucgacgggucg

SEQ ID NO: 3127643 - RNA, 18 nt, Mycobacterium bovis subsp bovis AF2122/97
cgacccgguuguguuggg

SEQ ID NO: 3127644 - RNA, 18 nt, Mycobacterium bovis subsp bovis AF2122/97
cgacccguaccagcccgu

SEQ ID NO: 3127645 - RNA, 19 nt, Mycobacterium bovis subsp bovis AF2122/97
cgacccgucgaacgcgcgc

SEQ ID NO: 3127646 - RNA, 20 nt, Mycobacterium bovis subsp bovis AF2122/97
cgacccuagauaugcacccg

SEQ ID NO: 3127647 - RNA, 13 nt, Mycobacterium bovis subsp bovis AF2122/97
cgacccuccagca

SEQ ID NO: 3127648 - RNA, 15 nt, Mycobacterium bovis subsp bovis AF2122/97
cgacccuccagcacg

SEQ ID NO: 3127649 - RNA, 14 nt, Mycobacterium bovis subsp bovis AF2122/97
cgacccugcccagc

SEQ ID NO: 3127650 - RNA, 21 nt, Mycobacterium bovis subsp bovis AF2122/97
cgaccgaaaauucaggcgccg

SEQ ID NO: 3127651 - RNA, 21 nt, Mycobacterium bovis subsp bovis AF2122/97
cgaccgaaacggggcgacguc

SEQ ID NO: 3127652 - RNA, 23 nt, Mycobacterium bovis subsp bovis AF2122/97
cgaccgaaacggggcgacguccg

SEQ ID NO: 3127653 - RNA, 16 nt, Mycobacterium bovis subsp bovis AF2122/97
cgaccgaaagccgcac

SEQ ID NO: 3127654 - RNA, 15 nt, Mycobacterium bovis subsp bovis AF2122/97
cgaccgaaccgucag

SEQ ID NO: 3127655 - RNA, 15 nt, Mycobacterium bovis subsp bovis AF2122/97
cgaccgacaccacca

SEQ ID NO: 3127656 - RNA, 13 nt, Mycobacterium bovis subsp bovis AF2122/97
cgaccgaccgcac

SEQ ID NO: 3127657 - RNA, 20 nt, Mycobacterium bovis subsp bovis AF2122/97
cgaccgaccuggucggugac

SEQ ID NO: 3127658 - RNA, 15 nt, Mycobacterium bovis subsp bovis AF2122/97
cgaccgacgggucgu

SEQ ID NO: 3127659 - RNA, 14 nt, Mycobacterium bovis subsp bovis AF2122/97
cgaccgagacggcg

SEQ ID NO: 3127660 - RNA, 18 nt, Mycobacterium bovis subsp bovis AF2122/97
cgaccgagacggcgucgg

SEQ ID NO: 3127661 - RNA, 19 nt, Mycobacterium bovis subsp bovis AF2122/97
cgaccgagacggcgucggg

SEQ ID NO: 3127662 - RNA, 16 nt, Mycobacterium bovis subsp bovis AF2122/97
cgaccgaggcacgucg

SEQ ID NO: 3127663 - RNA, 20 nt, Mycobacterium bovis subsp bovis AF2122/97
cgaccgauaacacccgggcc

SEQ ID NO: 3127664 - RNA, 17 nt, Mycobacterium bovis subsp bovis AF2122/97
cgaccgauacaccgacg

SEQ ID NO: 3127665 - RNA, 15 nt, Mycobacterium bovis subsp bovis AF2122/97
cgaccgaucggcgcg

SEQ ID NO: 3127666 - RNA, 20 nt, Mycobacterium bovis subsp bovis AF2122/97
cgaccgaugaucucacccag

SEQ ID NO: 3127667 - RNA, 22 nt, Mycobacterium bovis subsp bovis AF2122/97
cgaccgaugaucucacccagcu

SEQ ID NO: 3127668 - RNA, 22 nt, Mycobacterium bovis subsp bovis AF2122/97
cgaccgauggcucaccagcucc

SEQ ID NO: 3127669 - RNA, 15 nt, Mycobacterium bovis subsp bovis AF2122/97
cgaccgcaccgugcc

SEQ ID NO: 3127670 - RNA, 17 nt, Mycobacterium bovis subsp bovis AF2122/97
cgaccgcaccgugccga

SEQ ID NO: 3127671 - RNA, 14 nt, Mycobacterium bovis subsp bovis AF2122/97
cgaccgcacgacca

SEQ ID NO: 3127672 - RNA, 21 nt, Mycobacterium bovis subsp bovis AF2122/97
cgaccgcagcuggggcggaua

SEQ ID NO: 3127673 - RNA, 16 nt, Mycobacterium bovis subsp bovis AF2122/97
cgaccgcaugaucgca

SEQ ID NO: 3127674 - RNA, 22 nt, Mycobacterium bovis subsp bovis AF2122/97
cgaccgcaugaucgcaccgagg

SEQ ID NO: 3127675 - RNA, 23 nt, Mycobacterium bovis subsp bovis AF2122/97
cgaccgcauugagcuggcgcccg

SEQ ID NO: 3127676 - RNA, 14 nt, Mycobacterium bovis subsp bovis AF2122/97
cgaccgccaccgcc

SEQ ID NO: 3127677 - RNA, 15 nt, Mycobacterium bovis subsp bovis AF2122/97
cgaccgccaccgcca

SEQ ID NO: 3127678 - RNA, 23 nt, Mycobacterium bovis subsp bovis AF2122/97
cgaccgccaccgccagcgucgac

SEQ ID NO: 3127679 - RNA, 14 nt, Mycobacterium bovis subsp bovis AF2122/97
cgaccgccagccgc

SEQ ID NO: 3127680 - RNA, 20 nt, Mycobacterium bovis subsp bovis AF2122/97
cgaccgccagccgcgagccg

SEQ ID NO: 3127681 - RNA, 23 nt, Mycobacterium bovis subsp bovis AF2122/97
cgaccgucaugaagccguugccg

SEQ ID NO: 3127682 - RNA, 16 nt, Mycobacterium bovis subsp bovis AF2122/97
cgaccgucccagcgcc

SEQ ID NO: 3127683 - RNA, 12 nt, Mycobacterium bovis subsp bovis AF2122/97
cgaccguccggg

SEQ ID NO: 3127684 - RNA, 17 nt, Mycobacterium bovis subsp bovis AF2122/97
cgaccguccgggucacc

SEQ ID NO: 3127685 - RNA, 18 nt, Mycobacterium bovis subsp bovis AF2122/97
cgaccguccgggucacca

SEQ ID NO: 3127686 - RNA, 21 nt, Mycobacterium bovis subsp bovis AF2122/97
cgaccguccgggucaccagcg

SEQ ID NO: 3127687 - RNA, 12 nt, Mycobacterium bovis subsp bovis AF2122/97
cgaccgucgcgc

SEQ ID NO: 3127688 - RNA, 15 nt, Mycobacterium bovis subsp bovis AF2122/97
cgaccgucgcgcugc

SEQ ID NO: 3127689 - RNA, 16 nt, Mycobacterium bovis subsp bovis AF2122/97
cgaccgucgcgcugcc

SEQ ID NO: 3127690 - RNA, 17 nt, Mycobacterium bovis subsp bovis AF2122/97
cgaccgucgcgcugccg

SEQ ID NO: 3127691 - RNA, 19 nt, Mycobacterium bovis subsp bovis AF2122/97
cgaccgucgcgcugccggc

SEQ ID NO: 3127692 - RNA, 21 nt, Mycobacterium bovis subsp bovis AF2122/97
cgaccgucgcgcugccggccg

SEQ ID NO: 3127693 - RNA, 22 nt, Mycobacterium bovis subsp bovis AF2122/97
cgaccgucgcgcugccggccgc

SEQ ID NO: 3127694 - RNA, 19 nt, Mycobacterium bovis subsp bovis AF2122/97
cgaccgucggcuccagguc

SEQ ID NO: 3127695 - RNA, 16 nt, Mycobacterium bovis subsp bovis AF2122/97
cgaccgucgucaccgc

SEQ ID NO: 3127696 - RNA, 17 nt, Mycobacterium bovis subsp bovis AF2122/97
cgaccgucgucaccgcg

SEQ ID NO: 3127697 - RNA, 20 nt, Mycobacterium bovis subsp bovis AF2122/97
cgaccgucgucaccgcgacg

SEQ ID NO: 3127698 - RNA, 19 nt, Mycobacterium bovis subsp bovis AF2122/97
cgaccgucgucgugcaggc

SEQ ID NO: 3127699 - RNA, 14 nt, Mycobacterium bovis subsp bovis AF2122/97
cgaccgucucggug

SEQ ID NO: 3127700 - RNA, 15 nt, Mycobacterium bovis subsp bovis AF2122/97
cgaccgugcugggcg

SEQ ID NO: 3127701 - RNA, 21 nt, Mycobacterium bovis subsp bovis AF2122/97
cgaccgugcugggcgccgcgc

SEQ ID NO: 3127702 - RNA, 13 nt, Mycobacterium bovis subsp bovis AF2122/97
cgaccguggcggc

SEQ ID NO: 3127703 - RNA, 16 nt, Mycobacterium bovis subsp bovis AF2122/97
cgaccguggcggccuc

SEQ ID NO: 3127704 - RNA, 20 nt, Mycobacterium bovis subsp bovis AF2122/97
cgaccguggcugcgcucgcc

SEQ ID NO: 3127705 - RNA, 16 nt, Mycobacterium bovis subsp bovis AF2122/97
cgaccgugguggucgg

SEQ ID NO: 3127706 - RNA, 21 nt, Mycobacterium bovis subsp bovis AF2122/97
cgaccgugguggucgggcgca

SEQ ID NO: 3127707 - RNA, 13 nt, Mycobacterium bovis subsp bovis AF2122/97
cgaccgugucacc

SEQ ID NO: 3127708 - RNA, 19 nt, Mycobacterium bovis subsp bovis AF2122/97
cgaccgugucaccgccggg

SEQ ID NO: 3127709 - RNA, 20 nt, Mycobacterium bovis subsp bovis AF2122/97
cgaccuagucaccuugaccg

SEQ ID NO: 3127710 - RNA, 17 nt, Mycobacterium bovis subsp bovis AF2122/97
cgaccucacccacccgc

SEQ ID NO: 3127711 - RNA, 19 nt, Mycobacterium bovis subsp bovis AF2122/97
cgaccucacccacccgcgg

SEQ ID NO: 3127712 - RNA, 16 nt, Mycobacterium bovis subsp bovis AF2122/97
cgaccucacgaaucgc

SEQ ID NO: 3127713 - RNA, 22 nt, Mycobacterium bovis subsp bovis AF2122/97
cgaccucacggcauccgcucaa

SEQ ID NO: 3127714 - RNA, 22 nt, Mycobacterium bovis subsp bovis AF2122/97
cgaccucaucggcaccgucucg

SEQ ID NO: 3127715 - RNA, 15 nt, Mycobacterium bovis subsp bovis AF2122/97
cgaccuccaccaaug

SEQ ID NO: 3127716 - RNA, 18 nt, Mycobacterium bovis subsp bovis AF2122/97
cgaccuccaccaaugcuc

SEQ ID NO: 3127717 - RNA, 17 nt, Mycobacterium bovis subsp bovis AF2122/97
cgaccuccacgcgccac

SEQ ID NO: 3127718 - RNA, 19 nt, Mycobacterium bovis subsp bovis AF2122/97
cgaccuccggaaucgcccg

SEQ ID NO: 3127719 - RNA, 21 nt, Mycobacterium bovis subsp bovis AF2122/97
cgaccuccggaaucgcccggg

SEQ ID NO: 3127720 - RNA, 14 nt, Mycobacterium bovis subsp bovis AF2122/97
cgaccuccucgacc

SEQ ID NO: 3127721 - RNA, 16 nt, Mycobacterium bovis subsp bovis AF2122/97
cgaccuccucgaccag

SEQ ID NO: 3127722 - RNA, 21 nt, Mycobacterium bovis subsp bovis AF2122/97
cgaccuccucgaugaccggcg

SEQ ID NO: 3127723 - RNA, 14 nt, Mycobacterium bovis subsp bovis AF2122/97
cgaccucgccgcgg

SEQ ID NO: 3127724 - RNA, 15 nt, Mycobacterium bovis subsp bovis AF2122/97
cgaccucgccgcggc

SEQ ID NO: 3127725 - RNA, 15 nt, Mycobacterium bovis subsp bovis AF2122/97
cgaccucggcaacga

SEQ ID NO: 3127726 - RNA, 20 nt, Mycobacterium bovis subsp bovis AF2122/97
cgaccucggcaacgacugca

SEQ ID NO: 3127727 - RNA, 21 nt, Mycobacterium bovis subsp bovis AF2122/97
cgaccucgggaucggcggggu

SEQ ID NO: 3127728 - RNA, 16 nt, Mycobacterium bovis subsp bovis AF2122/97
cgaccucgucggccga

SEQ ID NO: 3127729 - RNA, 18 nt, Mycobacterium bovis subsp bovis AF2122/97
cgaccucgucggccgaca

SEQ ID NO: 3127730 - RNA, 20 nt, Mycobacterium bovis subsp bovis AF2122/97
cgaccucgucggccgacacc

SEQ ID NO: 3127731 - RNA, 24 nt, Mycobacterium bovis subsp bovis AF2122/97
cgaccucguucgucaccacgaucg

SEQ ID NO: 3127732 - RNA, 19 nt, Mycobacterium bovis subsp bovis AF2122/97
cgaccucugcacggccguc

SEQ ID NO: 3127733 - RNA, 20 nt, Mycobacterium bovis subsp bovis AF2122/97
cgaccucugcacggccguca

SEQ ID NO: 3127734 - RNA, 23 nt, Mycobacterium bovis subsp bovis AF2122/97
cgaccugaggcaccucggccuug

SEQ ID NO: 3127735 - RNA, 18 nt, Mycobacterium bovis subsp bovis AF2122/97
cgaccugagucggcauug

SEQ ID NO: 3127736 - RNA, 19 nt, Mycobacterium bovis subsp bovis AF2122/97
cgaccugccggaccgcgga

SEQ ID NO: 3127737 - RNA, 20 nt, Mycobacterium bovis subsp bovis AF2122/97
cgaccugccggaccgcggau

SEQ ID NO: 3127738 - RNA, 20 nt, Mycobacterium bovis subsp bovis AF2122/97
cgaccugcgcgacggcgcug

SEQ ID NO: 3127739 - RNA, 16 nt, Mycobacterium bovis subsp bovis AF2122/97
cgaccugcucauccac

SEQ ID NO: 3127740 - RNA, 20 nt, Mycobacterium bovis subsp bovis AF2122/97
cgaccugcucauccaccucg

SEQ ID NO: 3127741 - RNA, 15 nt, Mycobacterium bovis subsp bovis AF2122/97
cgaccugcucgauac

SEQ ID NO: 3127742 - RNA, 21 nt, Mycobacterium bovis subsp bovis AF2122/97
cgaccugcucgauacggcccu

SEQ ID NO: 3127743 - RNA, 13 nt, Mycobacterium bovis subsp bovis AF2122/97
cgaccugcucgcu

SEQ ID NO: 3127744 - RNA, 15 nt, Mycobacterium bovis subsp bovis AF2122/97
cgaccuggacaaccu

SEQ ID NO: 3127745 - RNA, 19 nt, Mycobacterium bovis subsp bovis AF2122/97
cgaccuggacgcggccaau

SEQ ID NO: 3127746 - RNA, 22 nt, Mycobacterium bovis subsp bovis AF2122/97
cgaccuggccacggggcugccg

SEQ ID NO: 3127747 - RNA, 20 nt, Mycobacterium bovis subsp bovis AF2122/97
cgaccugggacaguucgcgc

SEQ ID NO: 3127748 - RNA, 18 nt, Mycobacterium bovis subsp bovis AF2122/97
cgaccuggucgcuggugc

SEQ ID NO: 3127749 - RNA, 15 nt, Mycobacterium bovis subsp bovis AF2122/97
cgaccuguaugccgc

SEQ ID NO: 3127750 - RNA, 16 nt, Mycobacterium bovis subsp bovis AF2122/97
cgaccuguaugccgcg

SEQ ID NO: 3127751 - RNA, 12 nt, Mycobacterium bovis subsp bovis AF2122/97
cgaccuguccac

SEQ ID NO: 3127752 - RNA, 15 nt, Mycobacterium bovis subsp bovis AF2122/97
cgaccuguccaccca

SEQ ID NO: 3127753 - RNA, 14 nt, Mycobacterium bovis subsp bovis AF2122/97
cgaccuucaccgcg

SEQ ID NO: 3127754 - RNA, 15 nt, Mycobacterium bovis subsp bovis AF2122/97
cgaccuucggcccgc

SEQ ID NO: 3127755 - RNA, 16 nt, Mycobacterium bovis subsp bovis AF2122/97
cgaccuucucgaugcu

SEQ ID NO: 3127756 - RNA, 12 nt, Mycobacterium bovis subsp bovis AF2122/97
cgaccuugaccc

SEQ ID NO: 3127757 - RNA, 21 nt, Mycobacterium bovis subsp bovis AF2122/97
cgaccuugauuccugcccaac

SEQ ID NO: 3127758 - RNA, 16 nt, Mycobacterium bovis subsp bovis AF2122/97
cgaccuugcaccggcc

SEQ ID NO: 3127759 - RNA, 13 nt, Mycobacterium bovis subsp bovis AF2122/97
cgaccuugcccgc

SEQ ID NO: 3127760 - RNA, 18 nt, Mycobacterium bovis subsp bovis AF2122/97
cgaccuugguguggggcg

SEQ ID NO: 3127761 - RNA, 16 nt, Mycobacterium bovis subsp bovis AF2122/97
cgacgaaaggcgcguu

SEQ ID NO: 3127762 - RNA, 23 nt, Mycobacterium bovis subsp bovis AF2122/97
cgacgaaaggcucaaucgaugag

SEQ ID NO: 3127763 - RNA, 14 nt, Mycobacterium bovis subsp bovis AF2122/97
cgacgaacaccagc

SEQ ID NO: 3127764 - RNA, 15 nt, Mycobacterium bovis subsp bovis AF2122/97
cgacgaacaccagcg

SEQ ID NO: 3127765 - RNA, 18 nt, Mycobacterium bovis subsp bovis AF2122/97
cgacgaacaccagcgcgc

SEQ ID NO: 3127766 - RNA, 18 nt, Mycobacterium bovis subsp bovis AF2122/97
cgacgaacaccccgggcg

SEQ ID NO: 3127767 - RNA, 20 nt, Mycobacterium bovis subsp bovis AF2122/97
cgacgaguuccucguggguc

SEQ ID NO: 3127768 - RNA, 15 nt, Mycobacterium bovis subsp bovis AF2122/97
cgacgauaucgggag

SEQ ID NO: 3127769 - RNA, 22 nt, Mycobacterium bovis subsp bovis AF2122/97
cgacgaucaacggaacaucguc

SEQ ID NO: 3127770 - RNA, 23 nt, Mycobacterium bovis subsp bovis AF2122/97
cgacgaucaacggaacaucguca

SEQ ID NO: 3127771 - RNA, 15 nt, Mycobacterium bovis subsp bovis AF2122/97
cgacgaucagcacgu

SEQ ID NO: 3127772 - RNA, 20 nt, Mycobacterium bovis subsp bovis AF2122/97
cgacgaucagcacgucgcgg

SEQ ID NO: 3127773 - RNA, 15 nt, Mycobacterium bovis subsp bovis AF2122/97
cgacgaucagcgagu

SEQ ID NO: 3127774 - RNA, 23 nt, Mycobacterium bovis subsp bovis AF2122/97
cgacgaucauauggccgccgaac

SEQ ID NO: 3127775 - RNA, 16 nt, Mycobacterium bovis subsp bovis AF2122/97
cgacgauccacggcga

SEQ ID NO: 3127776 - RNA, 14 nt, Mycobacterium bovis subsp bovis AF2122/97
cgacgauccgcacg

SEQ ID NO: 3127777 - RNA, 16 nt, Mycobacterium bovis subsp bovis AF2122/97
cgacgaucgacgccgc

SEQ ID NO: 3127778 - RNA, 18 nt, Mycobacterium bovis subsp bovis AF2122/97
cgacgaucgacgccgcca

SEQ ID NO: 3127779 - RNA, 20 nt, Mycobacterium bovis subsp bovis AF2122/97
cgacgaucgacgccgccacc

SEQ ID NO: 3127780 - RNA, 21 nt, Mycobacterium bovis subsp bovis AF2122/97
cgacgaucgucuugucgccga

SEQ ID NO: 3127781 - RNA, 17 nt, Mycobacterium bovis subsp bovis AF2122/97
cgacgaucucgccgcca

SEQ ID NO: 3127782 - RNA, 18 nt, Mycobacterium bovis subsp bovis AF2122/97
cgacgaucucgccgccag

SEQ ID NO: 3127783 - RNA, 19 nt, Mycobacterium bovis subsp bovis AF2122/97
cgacgaucucgccgccagc

SEQ ID NO: 3127784 - RNA, 20 nt, Mycobacterium bovis subsp bovis AF2122/97
cgacgaucucgccgccagcg

SEQ ID NO: 3127785 - RNA, 15 nt, Mycobacterium bovis subsp bovis AF2122/97
cgacgaucucgccgg

SEQ ID NO: 3127786 - RNA, 23 nt, Mycobacterium bovis subsp bovis AF2122/97
cgacgaucucgccggcgaagacc

SEQ ID NO: 3127787 - RNA, 18 nt, Mycobacterium bovis subsp bovis AF2122/97
cgacgaucucggcggccg

SEQ ID NO: 3127788 - RNA, 12 nt, Mycobacterium bovis subsp bovis AF2122/97
cgacgaucucuc

SEQ ID NO: 3127789 - RNA, 14 nt, Mycobacterium bovis subsp bovis AF2122/97
cgacgaugacgcgc

SEQ ID NO: 3127790 - RNA, 16 nt, Mycobacterium bovis subsp bovis AF2122/97
cgacgaugacgcgcga

SEQ ID NO: 3127791 - RNA, 14 nt, Mycobacterium bovis subsp bovis AF2122/97
cgacgaugaugccg

SEQ ID NO: 3127792 - RNA, 18 nt, Mycobacterium bovis subsp bovis AF2122/97
cgacgaugaugccgucgu

SEQ ID NO: 3127793 - RNA, 19 nt, Mycobacterium bovis subsp bovis AF2122/97
cgacgaugcaggugacaug

SEQ ID NO: 3127794 - RNA, 19 nt, Mycobacterium bovis subsp bovis AF2122/97
cgacgaugccgggucgcgg

SEQ ID NO: 3127795 - RNA, 19 nt, Mycobacterium bovis subsp bovis AF2122/97
cgacgaugccucggcggcc

SEQ ID NO: 3127796 - RNA, 20 nt, Mycobacterium bovis subsp bovis AF2122/97
cgacgaugccucggcggccu

SEQ ID NO: 3127797 - RNA, 14 nt, Mycobacterium bovis subsp bovis AF2122/97
cgacgaugcgcacu

SEQ ID NO: 3127798 - RNA, 14 nt, Mycobacterium bovis subsp bovis AF2122/97
cgacgaugcgggcg

SEQ ID NO: 3127799 - RNA, 22 nt, Mycobacterium bovis subsp bovis AF2122/97
cgacgaugucgaagaucgagcc

SEQ ID NO: 3127800 - RNA, 14 nt, Mycobacterium bovis subsp bovis AF2122/97
cgacgaugugcacg

SEQ ID NO: 3127801 - RNA, 16 nt, Mycobacterium bovis subsp bovis AF2122/97
cgacgauuaccagcgg

SEQ ID NO: 3127802 - RNA, 20 nt, Mycobacterium bovis subsp bovis AF2122/97
cgacgauuaccagcggcacc

SEQ ID NO: 3127803 - RNA, 21 nt, Mycobacterium bovis subsp bovis AF2122/97
cgacgauuaccagcggcaccg

SEQ ID NO: 3127804 - RNA, 15 nt, Mycobacterium bovis subsp bovis AF2122/97
cgacgcaaagcagcg

SEQ ID NO: 3127805 - RNA, 12 nt, Mycobacterium bovis subsp bovis AF2122/97
cgacgcacaccc

SEQ ID NO: 3127806 - RNA, 16 nt, Mycobacterium bovis subsp bovis AF2122/97
cgacgcacaggcgacg

SEQ ID NO: 3127807 - RNA, 21 nt, Mycobacterium bovis subsp bovis AF2122/97
cgacgcacaggcgacggcccu

SEQ ID NO: 3127808 - RNA, 19 nt, Mycobacterium bovis subsp bovis AF2122/97
cgacgcaccaacgcgauca

SEQ ID NO: 3127809 - RNA, 18 nt, Mycobacterium bovis subsp bovis AF2122/97
cgacgcaccucgguggcu

SEQ ID NO: 3127810 - RNA, 21 nt, Mycobacterium bovis subsp bovis AF2122/97
cgacgcacugccccgcaucgc

SEQ ID NO: 3127811 - RNA, 18 nt, Mycobacterium bovis subsp bovis AF2122/97
cgacgcagaacggcguug

SEQ ID NO: 3127812 - RNA, 18 nt, Mycobacterium bovis subsp bovis AF2122/97
cgacgcagaccguccagc

SEQ ID NO: 3127813 - RNA, 19 nt, Mycobacterium bovis subsp bovis AF2122/97
cgacgcagaccguccagca

SEQ ID NO: 3127814 - RNA, 23 nt, Mycobacterium bovis subsp bovis AF2122/97
cgacgcagaccguccagcaacag

SEQ ID NO: 3127815 - RNA, 18 nt, Mycobacterium bovis subsp bovis AF2122/97
cgacgcagcuugcccgac

SEQ ID NO: 3127816 - RNA, 19 nt, Mycobacterium bovis subsp bovis AF2122/97
cgacgcagcuugcccgacg

SEQ ID NO: 3127817 - RNA, 22 nt, Mycobacterium bovis subsp bovis AF2122/97
cgacgcagcuugcccgacggcg

SEQ ID NO: 3127818 - RNA, 18 nt, Mycobacterium bovis subsp bovis AF2122/97
cgacgcaggugaacgccg

SEQ ID NO: 3127819 - RNA, 20 nt, Mycobacterium bovis subsp bovis AF2122/97
cgacgcaggugaacgccggu

SEQ ID NO: 3127820 - RNA, 15 nt, Mycobacterium bovis subsp bovis AF2122/97
cgacgcagugcccga

SEQ ID NO: 3127821 - RNA, 20 nt, Mycobacterium bovis subsp bovis AF2122/97
cgacgcauaaccggcgcgcc

SEQ ID NO: 3127822 - RNA, 19 nt, Mycobacterium bovis subsp bovis AF2122/97
cgacgcaugggucauggcg

SEQ ID NO: 3127823 - RNA, 13 nt, Mycobacterium bovis subsp bovis AF2122/97
cgacgccaacgcc

SEQ ID NO: 3127824 - RNA, 17 nt, Mycobacterium bovis subsp bovis AF2122/97
cgacgccaacgccagcg

SEQ ID NO: 3127825 - RNA, 16 nt, Mycobacterium bovis subsp bovis AF2122/97
cgacgccaaugccgcg

SEQ ID NO: 3127826 - RNA, 21 nt, Mycobacterium bovis subsp bovis AF2122/97
cgacgccaaugccgcggaggc

SEQ ID NO: 3127827 - RNA, 12 nt, Mycobacterium bovis subsp bovis AF2122/97
cgacgccaccgc

SEQ ID NO: 3127828 - RNA, 17 nt, Mycobacterium bovis subsp bovis AF2122/97
cgacgccaccgccacca

SEQ ID NO: 3127829 - RNA, 15 nt, Mycobacterium bovis subsp bovis AF2122/97
cgacgccagcugccc

SEQ ID NO: 3127830 - RNA, 19 nt, Mycobacterium bovis subsp bovis AF2122/97
cgacgccagcugcccgacg

SEQ ID NO: 3127831 - RNA, 22 nt, Mycobacterium bovis subsp bovis AF2122/97
cgacgccagcugcccgacguug

SEQ ID NO: 3127832 - RNA, 19 nt, Mycobacterium bovis subsp bovis AF2122/97
cgacgccaguguugcgcug

SEQ ID NO: 3127833 - RNA, 16 nt, Mycobacterium bovis subsp bovis AF2122/97
cgacgccaugagcgcg

SEQ ID NO: 3127834 - RNA, 20 nt, Mycobacterium bovis subsp bovis AF2122/97
cgacgccaugagcgcgccca

SEQ ID NO: 3127835 - RNA, 21 nt, Mycobacterium bovis subsp bovis AF2122/97
cgacgccaugagcgcgcccaa

SEQ ID NO: 3127836 - RNA, 22 nt, Mycobacterium bovis subsp bovis AF2122/97
cgacgccaugagcgcgcccaac

SEQ ID NO: 3127837 - RNA, 15 nt, Mycobacterium bovis subsp bovis AF2122/97
cgacgccauggucag

SEQ ID NO: 3127838 - RNA, 16 nt, Mycobacterium bovis subsp bovis AF2122/97
cgacgccaugucgaug

SEQ ID NO: 3127839 - RNA, 18 nt, Mycobacterium bovis subsp bovis AF2122/97
cgacgccaugucgauguc

SEQ ID NO: 3127840 - RNA, 23 nt, Mycobacterium bovis subsp bovis AF2122/97
cgacgccaugucgauguccacgc

SEQ ID NO: 3127841 - RNA, 13 nt, Mycobacterium bovis subsp bovis AF2122/97
cgacgcccauggc

SEQ ID NO: 3127842 - RNA, 18 nt, Mycobacterium bovis subsp bovis AF2122/97
cgacgcccauggcgucga

SEQ ID NO: 3127843 - RNA, 20 nt, Mycobacterium bovis subsp bovis AF2122/97
cgacgcccauggcgucgaac

SEQ ID NO: 3127844 - RNA, 16 nt, Mycobacterium bovis subsp bovis AF2122/97
cgacgccccgaucggc

SEQ ID NO: 3127845 - RNA, 13 nt, Mycobacterium bovis subsp bovis AF2122/97
cgacgcccgccuu

SEQ ID NO: 3127846 - RNA, 14 nt, Mycobacterium bovis subsp bovis AF2122/97
cgacgcccucacaa

SEQ ID NO: 3127847 - RNA, 21 nt, Mycobacterium bovis subsp bovis AF2122/97
cgacgcccucacaacgauugc

SEQ ID NO: 3127848 - RNA, 16 nt, Mycobacterium bovis subsp bovis AF2122/97
cgacgccgaaaaugcc

SEQ ID NO: 3127849 - RNA, 21 nt, Mycobacterium bovis subsp bovis AF2122/97
cgacgccgaaaaugccgccca

SEQ ID NO: 3127850 - RNA, 15 nt, Mycobacterium bovis subsp bovis AF2122/97
cgacgccgaccaccc

SEQ ID NO: 3127851 - RNA, 17 nt, Mycobacterium bovis subsp bovis AF2122/97
cgacgccgaccacccgg

SEQ ID NO: 3127852 - RNA, 14 nt, Mycobacterium bovis subsp bovis AF2122/97
cgacgccgacgaug

SEQ ID NO: 3127853 - RNA, 19 nt, Mycobacterium bovis subsp bovis AF2122/97
cgacggaguucgacgucgg

SEQ ID NO: 3127854 - RNA, 13 nt, Mycobacterium bovis subsp bovis AF2122/97
cgacggcaacagc

SEQ ID NO: 3127855 - RNA, 20 nt, Mycobacterium bovis subsp bovis AF2122/97
cgacggcaagcacgguggcc

SEQ ID NO: 3127856 - RNA, 21 nt, Mycobacterium bovis subsp bovis AF2122/97
cgacggcaagcacgguggccg

SEQ ID NO: 3127857 - RNA, 13 nt, Mycobacterium bovis subsp bovis AF2122/97
cgacggcaagcca

SEQ ID NO: 3127858 - RNA, 18 nt, Mycobacterium bovis subsp bovis AF2122/97
cgacggcaaugcggggca

SEQ ID NO: 3127859 - RNA, 19 nt, Mycobacterium bovis subsp bovis AF2122/97
cgacggcaaugcggggcaa

SEQ ID NO: 3127860 - RNA, 22 nt, Mycobacterium bovis subsp bovis AF2122/97
cgacggcaggcucgggcaaggc

SEQ ID NO: 3127861 - RNA, 16 nt, Mycobacterium bovis subsp bovis AF2122/97
cgacggcagugcugca

SEQ ID NO: 3127862 - RNA, 20 nt, Mycobacterium bovis subsp bovis AF2122/97
cgacggcaucaacgcgggcg

SEQ ID NO: 3127863 - RNA, 20 nt, Mycobacterium bovis subsp bovis AF2122/97
cgacggcauguaccgaccgc

SEQ ID NO: 3127864 - RNA, 19 nt, Mycobacterium bovis subsp bovis AF2122/97
cgacggcauuucagcgcgc

SEQ ID NO: 3127865 - RNA, 20 nt, Mycobacterium bovis subsp bovis AF2122/97
cgacggcauuucagcgcgcc

SEQ ID NO: 3127866 - RNA, 21 nt, Mycobacterium bovis subsp bovis AF2122/97
cgacggcauuucagcgcgccg

SEQ ID NO: 3127867 - RNA, 21 nt, Mycobacterium bovis subsp bovis AF2122/97
cgacggccaccccgucggggu

SEQ ID NO: 3127868 - RNA, 20 nt, Mycobacterium bovis subsp bovis AF2122/97
cgacggccacgguggagcgc

SEQ ID NO: 3127869 - RNA, 16 nt, Mycobacterium bovis subsp bovis AF2122/97
cgacggccagcaagac

SEQ ID NO: 3127870 - RNA, 21 nt, Mycobacterium bovis subsp bovis AF2122/97
cgacggccagcaagacgauga

SEQ ID NO: 3127871 - RNA, 12 nt, Mycobacterium bovis subsp bovis AF2122/97
cgacggccagcc

SEQ ID NO: 3127872 - RNA, 13 nt, Mycobacterium bovis subsp bovis AF2122/97
cgacggccagccc

SEQ ID NO: 3127873 - RNA, 13 nt, Mycobacterium bovis subsp bovis AF2122/97
cgacggccagcgc

SEQ ID NO: 3127874 - RNA, 14 nt, Mycobacterium bovis subsp bovis AF2122/97
cgacggccagcgcg

SEQ ID NO: 3127875 - RNA, 14 nt, Mycobacterium bovis subsp bovis AF2122/97
cgacggcccgccgu

SEQ ID NO: 3127876 - RNA, 18 nt, Mycobacterium bovis subsp bovis AF2122/97
cgacggcccgccguccgg

SEQ ID NO: 3127877 - RNA, 20 nt, Mycobacterium bovis subsp bovis AF2122/97
cgacggcccgccguccggcg

SEQ ID NO: 3127878 - RNA, 17 nt, Mycobacterium bovis subsp bovis AF2122/97
cgacggcccggugagcu

SEQ ID NO: 3127879 - RNA, 19 nt, Mycobacterium bovis subsp bovis AF2122/97
cgacggcccucgagcagcg

SEQ ID NO: 3127880 - RNA, 16 nt, Mycobacterium bovis subsp bovis AF2122/97
cgacggccgccagcag

SEQ ID NO: 3127881 - RNA, 20 nt, Mycobacterium bovis subsp bovis AF2122/97
cgacggccgccagcagcuuc

SEQ ID NO: 3127882 - RNA, 14 nt, Mycobacterium bovis subsp bovis AF2122/97
cgacggccgcggcg

SEQ ID NO: 3127883 - RNA, 15 nt, Mycobacterium bovis subsp bovis AF2122/97
cgacggccgcggcgu

SEQ ID NO: 3127884 - RNA, 17 nt, Mycobacterium bovis subsp bovis AF2122/97
cgacggccgcggcgucg

SEQ ID NO: 3127885 - RNA, 12 nt, Mycobacterium bovis subsp bovis AF2122/97
cgacggcgacca

SEQ ID NO: 3127886 - RNA, 17 nt, Mycobacterium bovis subsp bovis AF2122/97
cgacggcgaccaccgcg

SEQ ID NO: 3127887 - RNA, 15 nt, Mycobacterium bovis subsp bovis AF2122/97
cgacggcgacggcgc

SEQ ID NO: 3127888 - RNA, 18 nt, Mycobacterium bovis subsp bovis AF2122/97
cgacggcgauggcgcgca

SEQ ID NO: 3127889 - RNA, 13 nt, Mycobacterium bovis subsp bovis AF2122/97
cgacggcgcaugc

SEQ ID NO: 3127890 - RNA, 18 nt, Mycobacterium bovis subsp bovis AF2122/97
cgacggcgccauuggcgu

SEQ ID NO: 3127891 - RNA, 14 nt, Mycobacterium bovis subsp bovis AF2122/97
cgacggcgcccagc

SEQ ID NO: 3127892 - RNA, 16 nt, Mycobacterium bovis subsp bovis AF2122/97
cgacggcgcccagcgc

SEQ ID NO: 3127893 - RNA, 13 nt, Mycobacterium bovis subsp bovis AF2122/97
cgacggcgcccau

SEQ ID NO: 3127894 - RNA, 14 nt, Mycobacterium bovis subsp bovis AF2122/97
cgacggcgccgaac

SEQ ID NO: 3127895 - RNA, 16 nt, Mycobacterium bovis subsp bovis AF2122/97
cgacggcgccgaaccc

SEQ ID NO: 3127896 - RNA, 14 nt, Mycobacterium bovis subsp bovis AF2122/97
cgacggcgccgccc

SEQ ID NO: 3127897 - RNA, 14 nt, Mycobacterium bovis subsp bovis AF2122/97
cgacggcgccggca

SEQ ID NO: 3127898 - RNA, 21 nt, Mycobacterium bovis subsp bovis AF2122/97
cgacggcgccgucguugugcc

SEQ ID NO: 3127899 - RNA, 17 nt, Mycobacterium bovis subsp bovis AF2122/97
cgacggcgcggugcgcu

SEQ ID NO: 3127900 - RNA, 19 nt, Mycobacterium bovis subsp bovis AF2122/97
cgacggcgcggugcgcuca

SEQ ID NO: 3127901 - RNA, 18 nt, Mycobacterium bovis subsp bovis AF2122/97
cgacggcgcucggcgagc

SEQ ID NO: 3127902 - RNA, 15 nt, Mycobacterium bovis subsp bovis AF2122/97
cgacggcggcacggg

SEQ ID NO: 3127903 - RNA, 21 nt, Mycobacterium bovis subsp bovis AF2122/97
cgacggcggcacgggcggcca

SEQ ID NO: 3127904 - RNA, 22 nt, Mycobacterium bovis subsp bovis AF2122/97
cgacggcggccaaggucgaccc

SEQ ID NO: 3127905 - RNA, 12 nt, Mycobacterium bovis subsp bovis AF2122/97
cgacggcggccg

SEQ ID NO: 3127906 - RNA, 12 nt, Mycobacterium bovis subsp bovis AF2122/97
cgacggcggccu

SEQ ID NO: 3127907 - RNA, 15 nt, Mycobacterium bovis subsp bovis AF2122/97
cgacggcggccuucg

SEQ ID NO: 3127908 - RNA, 23 nt, Mycobacterium bovis subsp bovis AF2122/97
cgacggcggccuucggccggcgu

SEQ ID NO: 3127909 - RNA, 15 nt, Mycobacterium bovis subsp bovis AF2122/97
cgacggcggcgucga

SEQ ID NO: 3127910 - RNA, 19 nt, Mycobacterium bovis subsp bovis AF2122/97
cgacggcggcgucgaugag

SEQ ID NO: 3127911 - RNA, 14 nt, Mycobacterium bovis subsp bovis AF2122/97
cgacggcgucaccc

SEQ ID NO: 3127912 - RNA, 17 nt, Mycobacterium bovis subsp bovis AF2122/97
cgacggcgucgacugcg

SEQ ID NO: 3127913 - RNA, 23 nt, Mycobacterium bovis subsp bovis AF2122/97
cgacggcgucgacugcgugccgc

SEQ ID NO: 3127914 - RNA, 14 nt, Mycobacterium bovis subsp bovis AF2122/97
cgacggcgucuucg

SEQ ID NO: 3127915 - RNA, 15 nt, Mycobacterium bovis subsp bovis AF2122/97
cgacggcuccuccgg

SEQ ID NO: 3127916 - RNA, 21 nt, Mycobacterium bovis subsp bovis AF2122/97
cgacggcuccuccgguaucgg

SEQ ID NO: 3127917 - RNA, 12 nt, Mycobacterium bovis subsp bovis AF2122/97
cgacggcugacc

SEQ ID NO: 3127918 - RNA, 16 nt, Mycobacterium bovis subsp bovis AF2122/97
cgacgggaaagccacc

SEQ ID NO: 3127919 - RNA, 16 nt, Mycobacterium bovis subsp bovis AF2122/97
cgacgggaaccagcgg

SEQ ID NO: 3127920 - RNA, 17 nt, Mycobacterium bovis subsp bovis AF2122/97
cgacgggaaccagcggu

SEQ ID NO: 3127921 - RNA, 21 nt, Mycobacterium bovis subsp bovis AF2122/97
cgacgggaaccagcggucggc

SEQ ID NO: 3127922 - RNA, 23 nt, Mycobacterium bovis subsp bovis AF2122/97
cgacgggaaccucgaccgucacc

SEQ ID NO: 3127923 - RNA, 17 nt, Mycobacterium bovis subsp bovis AF2122/97
cgacgggacaacccgua

SEQ ID NO: 3127924 - RNA, 18 nt, Mycobacterium bovis subsp bovis AF2122/97
cgacgggagcgacgucgg

SEQ ID NO: 3127925 - RNA, 21 nt, Mycobacterium bovis subsp bovis AF2122/97
cgacgggcacccgagccgcac

SEQ ID NO: 3127926 - RNA, 14 nt, Mycobacterium bovis subsp bovis AF2122/97
cgacgggcacgcgg

SEQ ID NO: 3127927 - RNA, 17 nt, Mycobacterium bovis subsp bovis AF2122/97
cgacgggcacgcggcga

SEQ ID NO: 3127928 - RNA, 15 nt, Mycobacterium bovis subsp bovis AF2122/97
cgacgggccgucgcc

SEQ ID NO: 3127929 - RNA, 21 nt, Mycobacterium bovis subsp bovis AF2122/97
cgacgggcgaaauuccgggcc

SEQ ID NO: 3127930 - RNA, 20 nt, Mycobacterium bovis subsp bovis AF2122/97
cgacggggaacguccgcgcc

SEQ ID NO: 3127931 - RNA, 19 nt, Mycobacterium bovis subsp bovis AF2122/97
cgacggggcaaaggagccg

SEQ ID NO: 3127932 - RNA, 15 nt, Mycobacterium bovis subsp bovis AF2122/97
cgacggggcggucgg

SEQ ID NO: 3127933 - RNA, 16 nt, Mycobacterium bovis subsp bovis AF2122/97
cgacggggcggucggc

SEQ ID NO: 3127934 - RNA, 18 nt, Mycobacterium bovis subsp bovis AF2122/97
cgacggggcggucggccg

SEQ ID NO: 3127935 - RNA, 20 nt, Mycobacterium bovis subsp bovis AF2122/97
cgacggggcggucggccggc

SEQ ID NO: 3127936 - RNA, 22 nt, Mycobacterium bovis subsp bovis AF2122/97
cgacggggcggucggccggcuc

SEQ ID NO: 3127937 - RNA, 16 nt, Mycobacterium bovis subsp bovis AF2122/97
cgacgggggucgggcg

SEQ ID NO: 3127938 - RNA, 15 nt, Mycobacterium bovis subsp bovis AF2122/97
cgacggguccgggcc

SEQ ID NO: 3127939 - RNA, 14 nt, Mycobacterium bovis subsp bovis AF2122/97
cgacgggucggcgc

SEQ ID NO: 3127940 - RNA, 12 nt, Mycobacterium bovis subsp bovis AF2122/97
aaaccgcaccgu

SEQ ID NO: 3127941 - RNA, 17 nt, Mycobacterium bovis subsp bovis AF2122/97
aaaccgcagucgcggca

SEQ ID NO: 3127942 - RNA, 22 nt, Mycobacterium bovis subsp bovis AF2122/97
aaaccggcggcgacggcggcac

SEQ ID NO: 3127943 - RNA, 21 nt, Mycobacterium bovis subsp bovis AF2122/97
aaaccggugguagcgacgaug

SEQ ID NO: 3127944 - RNA, 22 nt, Mycobacterium bovis subsp bovis AF2122/97
aaaccggugguagcgacgaugu

SEQ ID NO: 3127945 - RNA, 16 nt, Mycobacterium bovis subsp bovis AF2122/97
aaaccguggccgcgau

SEQ ID NO: 3127946 - RNA, 20 nt, Mycobacterium bovis subsp bovis AF2122/97
aaaccucgccccaccggccg

SEQ ID NO: 3127947 - RNA, 23 nt, Mycobacterium bovis subsp bovis AF2122/97
aaaccucuucgggugcagccaga

SEQ ID NO: 3127948 - RNA, 22 nt, Mycobacterium bovis subsp bovis AF2122/97
aaaccugcaugcccagaaaacc

SEQ ID NO: 3127949 - RNA, 22 nt, Mycobacterium bovis subsp bovis AF2122/97
aaaccuggcuaucgcagaacgg

SEQ ID NO: 3127950 - RNA, 11 nt, Mycobacterium bovis subsp bovis AF2122/97
aaaccugggau

SEQ ID NO: 3127951 - RNA, 17 nt, Mycobacterium bovis subsp bovis AF2122/97
aaaccuucaacaacgau

SEQ ID NO: 3127952 - RNA, 23 nt, Mycobacterium bovis subsp bovis AF2122/97
aaacgagccggugcgcgcggucg

SEQ ID NO: 3127953 - RNA, 22 nt, Mycobacterium bovis subsp bovis AF2122/97
aaacgauccgauaaauggccga

SEQ ID NO: 3127954 - RNA, 17 nt, Mycobacterium bovis subsp bovis AF2122/97
aaacgauugcugcggcu

SEQ ID NO: 3127955 - RNA, 22 nt, Mycobacterium bovis subsp bovis AF2122/97
aaacgcgaugguggccgccacc

SEQ ID NO: 3127956 - RNA, 22 nt, Mycobacterium bovis subsp bovis AF2122/97
aaacgcugcgcccggaccacug

SEQ ID NO: 3127957 - RNA, 14 nt, Mycobacterium bovis subsp bovis AF2122/97
aaacgggccggugc

SEQ ID NO: 3127958 - RNA, 22 nt, Mycobacterium bovis subsp bovis AF2122/97
aaacgggguggcacgcaugagg

SEQ ID NO: 3127959 - RNA, 13 nt, Mycobacterium bovis subsp bovis AF2122/97
aaacgucggucgg

SEQ ID NO: 3127960 - RNA, 13 nt, Mycobacterium bovis subsp bovis AF2122/97
aaacuaccgaaca

SEQ ID NO: 3127961 - RNA, 14 nt, Mycobacterium bovis subsp bovis AF2122/97
aaacuauugcaccg

SEQ ID NO: 3127962 - RNA, 22 nt, Mycobacterium bovis subsp bovis AF2122/97
aaacucacccgagccaucaccg

SEQ ID NO: 3127963 - RNA, 16 nt, Mycobacterium bovis subsp bovis AF2122/97
aaacuccgugccgagc

SEQ ID NO: 3127964 - RNA, 17 nt, Mycobacterium bovis subsp bovis AF2122/97
aaacugccgcggcaccg

SEQ ID NO: 3127965 - RNA, 13 nt, Mycobacterium bovis subsp bovis AF2122/97
aaacugggcaccg

SEQ ID NO: 3127966 - RNA, 21 nt, Mycobacterium bovis subsp bovis AF2122/97
aaacuggggguuguucaacuc

SEQ ID NO: 3127967 - RNA, 15 nt, Mycobacterium bovis subsp bovis AF2122/97
aaagacagcgcggga

SEQ ID NO: 3127968 - RNA, 19 nt, Mycobacterium bovis subsp bovis AF2122/97
aaagaccgccgcugggucc

SEQ ID NO: 3127969 - RNA, 12 nt, Mycobacterium bovis subsp bovis AF2122/97
aaagacucgacc

SEQ ID NO: 3127970 - RNA, 17 nt, Mycobacterium bovis subsp bovis AF2122/97
aaagaucagcauggucc

SEQ ID NO: 3127971 - RNA, 22 nt, Mycobacterium bovis subsp bovis AF2122/97
aaagaucagcaugguccacagc

SEQ ID NO: 3127972 - RNA, 15 nt, Mycobacterium bovis subsp bovis AF2122/97
aaagccaacucgacc

SEQ ID NO: 3127973 - RNA, 22 nt, Mycobacterium bovis subsp bovis AF2122/97
aaagccaccagaauccugcuuu

SEQ ID NO: 3127974 - RNA, 19 nt, Mycobacterium bovis subsp bovis AF2122/97
aaagccagcgcagccaggc

SEQ ID NO: 3127975 - RNA, 14 nt, Mycobacterium bovis subsp bovis AF2122/97
aaagcccggcggca

SEQ ID NO: 3127976 - RNA, 14 nt, Mycobacterium bovis subsp bovis AF2122/97
aaagcgccagcagc

SEQ ID NO: 3127977 - RNA, 20 nt, Mycobacterium bovis subsp bovis AF2122/97
aaagcgccgaaacagcaccc

SEQ ID NO: 3127978 - RNA, 24 nt, Mycobacterium bovis subsp bovis AF2122/97
aaagcgguuauguauccgcgccgc

SEQ ID NO: 3127979 - RNA, 21 nt, Mycobacterium bovis subsp bovis AF2122/97
aaagcguaaggccggagucga

SEQ ID NO: 3127980 - RNA, 13 nt, Mycobacterium bovis subsp bovis AF2122/97
aaagcucucggca

SEQ ID NO: 3127981 - RNA, 19 nt, Mycobacterium bovis subsp bovis AF2122/97
aaagcugcucgucggcgcc

SEQ ID NO: 3127982 - RNA, 14 nt, Mycobacterium bovis subsp bovis AF2122/97
aaagcugucgaccg

SEQ ID NO: 3127983 - RNA, 19 nt, Mycobacterium bovis subsp bovis AF2122/97
aaagcuugggcgaucguca

SEQ ID NO: 3127984 - RNA, 14 nt, Mycobacterium bovis subsp bovis AF2122/97
aaaggaagaccucg

SEQ ID NO: 3127985 - RNA, 17 nt, Mycobacterium bovis subsp bovis AF2122/97
aaaggacggccggccgc

SEQ ID NO: 3127986 - RNA, 18 nt, Mycobacterium bovis subsp bovis AF2122/97
aaaggcuuccgcgugcga

SEQ ID NO: 3127987 - RNA, 16 nt, Mycobacterium bovis subsp bovis AF2122/97
aaagggccgccgcugg

SEQ ID NO: 3127988 - RNA, 14 nt, Mycobacterium bovis subsp bovis AF2122/97
aaaggucggccugc

SEQ ID NO: 3127989 - RNA, 19 nt, Mycobacterium bovis subsp bovis AF2122/97
aaagugguugucgcgguca

SEQ ID NO: 3127990 - RNA, 20 nt, Mycobacterium bovis subsp bovis AF2122/97
aaauaccuuuggcucccuuu

SEQ ID NO: 3127991 - RNA, 12 nt, Mycobacterium bovis subsp bovis AF2122/97
aaauaggacugc

SEQ ID NO: 3127992 - RNA, 15 nt, Mycobacterium bovis subsp bovis AF2122/97
aaauaggacugcgcc

SEQ ID NO: 3127993 - RNA, 22 nt, Mycobacterium bovis subsp bovis AF2122/97
aaauauuggcccgucacgcccg

SEQ ID NO: 3127994 - RNA, 12 nt, Mycobacterium bovis subsp bovis AF2122/97
aaaucaagcaca

SEQ ID NO: 3127995 - RNA, 13 nt, Mycobacterium bovis subsp bovis AF2122/97
aaaucaagcacag

SEQ ID NO: 3127996 - RNA, 15 nt, Mycobacterium bovis subsp bovis AF2122/97
aaaucaagcacagcc

SEQ ID NO: 3127997 - RNA, 21 nt, Mycobacterium bovis subsp bovis AF2122/97
aaaucaagcacagcccggcga

SEQ ID NO: 3127998 - RNA, 20 nt, Mycobacterium bovis subsp bovis AF2122/97
aaaucaagcacagcccggcu

SEQ ID NO: 3127999 - RNA, 14 nt, Mycobacterium bovis subsp bovis AF2122/97
aaaucacaauucca

SEQ ID NO: 3128000 - RNA, 21 nt, Mycobacterium bovis subsp bovis AF2122/97
aaaucaccucaccagucaggu

SEQ ID NO: 3128001 - RNA, 12 nt, Mycobacterium bovis subsp bovis AF2122/97
aaaucagaugcg

SEQ ID NO: 3128002 - RNA, 14 nt, Mycobacterium bovis subsp bovis AF2122/97
aaaucagccaggcg

SEQ ID NO: 3128003 - RNA, 23 nt, Mycobacterium bovis subsp bovis AF2122/97
aaauccaaaccuuugauucuaac

SEQ ID NO: 3128004 - RNA, 13 nt, Mycobacterium bovis subsp bovis AF2122/97
aaauccagcagcc

SEQ ID NO: 3128005 - RNA, 19 nt, Mycobacterium bovis subsp bovis AF2122/97
aaauccagcagccaggagc

SEQ ID NO: 3128006 - RNA, 20 nt, Mycobacterium bovis subsp bovis AF2122/97
aaauccccucgcaaccggcg

SEQ ID NO: 3128007 - RNA, 22 nt, Mycobacterium bovis subsp bovis AF2122/97
aaauccgacguggaacugcagc

SEQ ID NO: 3128008 - RNA, 14 nt, Mycobacterium bovis subsp bovis AF2122/97
aaauccuucggcgu

SEQ ID NO: 3128009 - RNA, 21 nt, Mycobacterium bovis subsp bovis AF2122/97
aaaucgaucguguacugcucc

SEQ ID NO: 3128010 - RNA, 17 nt, Mycobacterium bovis subsp bovis AF2122/97
aaaucgaugaccgucgc

SEQ ID NO: 3128011 - RNA, 14 nt, Mycobacterium bovis subsp bovis AF2122/97
aaaucgcacagcgc

SEQ ID NO: 3128012 - RNA, 22 nt, Mycobacterium bovis subsp bovis AF2122/97
aaaucgggaucugcgccgcgcg

SEQ ID NO: 3128013 - RNA, 20 nt, Mycobacterium bovis subsp bovis AF2122/97
aaaugccgagaagugggcgg

SEQ ID NO: 3128014 - RNA, 17 nt, Mycobacterium bovis subsp bovis AF2122/97
aaaugccugcgcgaugc

SEQ ID NO: 3128015 - RNA, 22 nt, Mycobacterium bovis subsp bovis AF2122/97
aaaugcgggcuuugccaacaaa

SEQ ID NO: 3128016 - RNA, 17 nt, Mycobacterium bovis subsp bovis AF2122/97
aaaugcuucgaccgccg

SEQ ID NO: 3128017 - RNA, 22 nt, Mycobacterium bovis subsp bovis AF2122/97
aaaugcuucgccaacugcggca

SEQ ID NO: 3128018 - RNA, 24 nt, Mycobacterium bovis subsp bovis AF2122/97
aaauguaccugguugcugacgacu

SEQ ID NO: 3128019 - RNA, 13 nt, Mycobacterium bovis subsp bovis AF2122/97
aaauucgcggcgg

SEQ ID NO: 3128020 - RNA, 23 nt, Mycobacterium bovis subsp bovis AF2122/97
aacaaacccaacaccagcagcac

SEQ ID NO: 3128021 - RNA, 15 nt, Mycobacterium bovis subsp bovis AF2122/97
aacaacagccgcagc

SEQ ID NO: 3128022 - RNA, 14 nt, Mycobacterium bovis subsp bovis AF2122/97
aacaacaucacugc

SEQ ID NO: 3128023 - RNA, 16 nt, Mycobacterium bovis subsp bovis AF2122/97
aacaacaucacugccu

SEQ ID NO: 3128024 - RNA, 22 nt, Mycobacterium bovis subsp bovis AF2122/97
aacaaccccgaggcaacaagca

SEQ ID NO: 3128025 - RNA, 16 nt, Mycobacterium bovis subsp bovis AF2122/97
aacaacgccgcgacgu

SEQ ID NO: 3128026 - RNA, 17 nt, Mycobacterium bovis subsp bovis AF2122/97
aacaugauccgccggca

SEQ ID NO: 3128027 - RNA, 17 nt, Mycobacterium bovis subsp bovis AF2122/97
aacaugcucacgaucac

SEQ ID NO: 3128028 - RNA, 21 nt, Mycobacterium bovis subsp bovis AF2122/97
aacaugcuggagaaaccacug

SEQ ID NO: 3128029 - RNA, 15 nt, Mycobacterium bovis subsp bovis AF2122/97
aacauggccagcauc

SEQ ID NO: 3128030 - RNA, 16 nt, Mycobacterium bovis subsp bovis AF2122/97
aacauuuucgcccgcu

SEQ ID NO: 3128031 - RNA, 23 nt, Mycobacterium bovis subsp bovis AF2122/97
aacauuuucgcccgcuccgggac

SEQ ID NO: 3128032 - RNA, 20 nt, Mycobacterium bovis subsp bovis AF2122/97
aaccaaccucggaucgccag

SEQ ID NO: 3128033 - RNA, 18 nt, Mycobacterium bovis subsp bovis AF2122/97
aaccaagaaucaccggca

SEQ ID NO: 3128034 - RNA, 19 nt, Mycobacterium bovis subsp bovis AF2122/97
aaccaagaaucaccggcaa

SEQ ID NO: 3128035 - RNA, 20 nt, Mycobacterium bovis subsp bovis AF2122/97
aaccacccaccggccaccag

SEQ ID NO: 3128036 - RNA, 15 nt, Mycobacterium bovis subsp bovis AF2122/97
aaccacgagcaucaa

SEQ ID NO: 3128037 - RNA, 15 nt, Mycobacterium bovis subsp bovis AF2122/97
aaccacgcgcccgca

SEQ ID NO: 3128038 - RNA, 17 nt, Mycobacterium bovis subsp bovis AF2122/97
aaccacggucagcacgc

SEQ ID NO: 3128039 - RNA, 19 nt, Mycobacterium bovis subsp bovis AF2122/97
aaccacuggauggcucgcc

SEQ ID NO: 3128040 - RNA, 15 nt, Mycobacterium bovis subsp bovis AF2122/97
aaccacuguuucuga

SEQ ID NO: 3128041 - RNA, 15 nt, Mycobacterium bovis subsp bovis AF2122/97
aaccacuuccggcgu

SEQ ID NO: 3128042 - RNA, 18 nt, Mycobacterium bovis subsp bovis AF2122/97
aaccagaggucacgcagc

SEQ ID NO: 3128043 - RNA, 17 nt, Mycobacterium bovis subsp bovis AF2122/97
aaccagaguucggccag

SEQ ID NO: 3128044 - RNA, 11 nt, Mycobacterium bovis subsp bovis AF2122/97
aaccagcagca

SEQ ID NO: 3128045 - RNA, 23 nt, Mycobacterium bovis subsp bovis AF2122/97
aaccagcauggcuuuugcgccga

SEQ ID NO: 3128046 - RNA, 21 nt, Mycobacterium bovis subsp bovis AF2122/97
aaccagccaccaccaggucgg

SEQ ID NO: 3128047 - RNA, 22 nt, Mycobacterium bovis subsp bovis AF2122/97
aaccagcgaaaugcccaucacc

SEQ ID NO: 3128048 - RNA, 20 nt, Mycobacterium bovis subsp bovis AF2122/97
aaccagcgagcccagcugcg

SEQ ID NO: 3128049 - RNA, 12 nt, Mycobacterium bovis subsp bovis AF2122/97
aaccagcgccac

SEQ ID NO: 3128050 - RNA, 19 nt, Mycobacterium bovis subsp bovis AF2122/97
aaccagcgcgucucguuga

SEQ ID NO: 3128051 - RNA, 22 nt, Mycobacterium bovis subsp bovis AF2122/97
aaccagcggucggcgaccacca

SEQ ID NO: 3128052 - RNA, 20 nt, Mycobacterium bovis subsp bovis AF2122/97
aaccagcguaucggccggca

SEQ ID NO: 3128053 - RNA, 23 nt, Mycobacterium bovis subsp bovis AF2122/97
aaccagcguaucggccggcagau

SEQ ID NO: 3128054 - RNA, 20 nt, Mycobacterium bovis subsp bovis AF2122/97
aaccaggaugguugcgacgg

SEQ ID NO: 3128055 - RNA, 18 nt, Mycobacterium bovis subsp bovis AF2122/97
aaccaggcgagccgccac

SEQ ID NO: 3128056 - RNA, 17 nt, Mycobacterium bovis subsp bovis AF2122/97
aaccaggcggccgcguc

SEQ ID NO: 3128057 - RNA, 22 nt, Mycobacterium bovis subsp bovis AF2122/97
aaccaggcuaauagcucgccgg

SEQ ID NO: 3128058 - RNA, 23 nt, Mycobacterium bovis subsp bovis AF2122/97
aaccagugaccguauuucgucca

SEQ ID NO: 3128059 - RNA, 18 nt, Mycobacterium bovis subsp bovis AF2122/97
aaccaugaccaccaaggu

SEQ ID NO: 3128060 - RNA, 18 nt, Mycobacterium bovis subsp bovis AF2122/97
aaccauguuaacgcgcgu

SEQ ID NO: 3128061 - RNA, 17 nt, Mycobacterium bovis subsp bovis AF2122/97
aacccagaucggcgacg

SEQ ID NO: 3128062 - RNA, 15 nt, Mycobacterium bovis subsp bovis AF2122/97
aacccagcaccacaa

SEQ ID NO: 3128063 - RNA, 23 nt, Mycobacterium bovis subsp bovis AF2122/97
aacccagcaccacaacgucggca

SEQ ID NO: 3128064 - RNA, 12 nt, Mycobacterium bovis subsp bovis AF2122/97
aacccagcacug

SEQ ID NO: 3128065 - RNA, 23 nt, Mycobacterium bovis subsp bovis AF2122/97
aacccaggucuuucgaauccccg

SEQ ID NO: 3128066 - RNA, 14 nt, Mycobacterium bovis subsp bovis AF2122/97
aacccagucccaac

SEQ ID NO: 3128067 - RNA, 18 nt, Mycobacterium bovis subsp bovis AF2122/97
aaccccaaguccagcagc

SEQ ID NO: 3128068 - RNA, 22 nt, Mycobacterium bovis subsp bovis AF2122/97
aaccccacacccgggacgaacc

SEQ ID NO: 3128069 - RNA, 22 nt, Mycobacterium bovis subsp bovis AF2122/97
aaccccacgcagaaguugaugg

SEQ ID NO: 3128070 - RNA, 17 nt, Mycobacterium bovis subsp bovis AF2122/97
aaccccaggcgcugccg

SEQ ID NO: 3128071 - RNA, 18 nt, Mycobacterium bovis subsp bovis AF2122/97
aaccccaucagaaugccu

SEQ ID NO: 3128072 - RNA, 15 nt, Mycobacterium bovis subsp bovis AF2122/97
aacccccgccgcgca

SEQ ID NO: 3128073 - RNA, 13 nt, Mycobacterium bovis subsp bovis AF2122/97
aacccccggggcg

SEQ ID NO: 3128074 - RNA, 19 nt, Mycobacterium bovis subsp bovis AF2122/97
aaccccgaagaccuggccu

SEQ ID NO: 3128075 - RNA, 21 nt, Mycobacterium bovis subsp bovis AF2122/97
aaccccggccaccagcaugcc

SEQ ID NO: 3128076 - RNA, 22 nt, Mycobacterium bovis subsp bovis AF2122/97
aaccccggccaccagcaugccu

SEQ ID NO: 3128077 - RNA, 15 nt, Mycobacterium bovis subsp bovis AF2122/97
aaccccggucggggu

SEQ ID NO: 3128078 - RNA, 23 nt, Mycobacterium bovis subsp bovis AF2122/97
aaccccguccucgaucgcgcaga

SEQ ID NO: 3128079 - RNA, 20 nt, Mycobacterium bovis subsp bovis AF2122/97
aacccgaaucccacagcagg

SEQ ID NO: 3128080 - RNA, 18 nt, Mycobacterium bovis subsp bovis AF2122/97
aacccgagcuugggccgg

SEQ ID NO: 3128081 - RNA, 18 nt, Mycobacterium bovis subsp bovis AF2122/97
aacccgaguucgggccgg

SEQ ID NO: 3128082 - RNA, 18 nt, Mycobacterium bovis subsp bovis AF2122/97
aacccgaucucugcggcg

SEQ ID NO: 3128083 - RNA, 19 nt, Mycobacterium bovis subsp bovis AF2122/97
aacccgauguggcgcuguu

SEQ ID NO: 3128084 - RNA, 21 nt, Mycobacterium bovis subsp bovis AF2122/97
aacccgauguggcgcuguugu

SEQ ID NO: 3128085 - RNA, 21 nt, Mycobacterium bovis subsp bovis AF2122/97
aacccgauuuauccggaucgg

SEQ ID NO: 3128086 - RNA, 19 nt, Mycobacterium bovis subsp bovis AF2122/97
aacccgcaccccggccgcg

SEQ ID NO: 3128087 - RNA, 23 nt, Mycobacterium bovis subsp bovis AF2122/97
aacccgcaccccggccgcgcgca

SEQ ID NO: 3128088 - RNA, 17 nt, Mycobacterium bovis subsp bovis AF2122/97
aacccgcaccggaucgg

SEQ ID NO: 3128089 - RNA, 20 nt, Mycobacterium bovis subsp bovis AF2122/97
aacccgccacguacuccacc

SEQ ID NO: 3128090 - RNA, 22 nt, Mycobacterium bovis subsp bovis AF2122/97
aacccgccguugccaccggugc

SEQ ID NO: 3128091 - RNA, 12 nt, Mycobacterium bovis subsp bovis AF2122/97
aacccgcgccgg

SEQ ID NO: 3128092 - RNA, 16 nt, Mycobacterium bovis subsp bovis AF2122/97
aacccgcgccggccgc

SEQ ID NO: 3128093 - RNA, 17 nt, Mycobacterium bovis subsp bovis AF2122/97
aacccgcucggcggucg

SEQ ID NO: 3128094 - RNA, 19 nt, Mycobacterium bovis subsp bovis AF2122/97
aacccggaaccagccgcgg

SEQ ID NO: 3128095 - RNA, 21 nt, Mycobacterium bovis subsp bovis AF2122/97
aacccggaaucgucgcggccg

SEQ ID NO: 3128096 - RNA, 22 nt, Mycobacterium bovis subsp bovis AF2122/97
aacccggaaucgucgcggccgu

SEQ ID NO: 3128097 - RNA, 18 nt, Mycobacterium bovis subsp bovis AF2122/97
aacccggauacaacacag

SEQ ID NO: 3128098 - RNA, 14 nt, Mycobacterium bovis subsp bovis AF2122/97
aacccggccgccga

SEQ ID NO: 3128099 - RNA, 12 nt, Mycobacterium bovis subsp bovis AF2122/97
aacccggcggca

SEQ ID NO: 3128100 - RNA, 16 nt, Mycobacterium bovis subsp bovis AF2122/97
aacccggcgucgacga

SEQ ID NO: 3128101 - RNA, 14 nt, Mycobacterium bovis subsp bovis AF2122/97
aacccgggccgcca

SEQ ID NO: 3128102 - RNA, 22 nt, Mycobacterium bovis subsp bovis AF2122/97
aacccgguauucaucaggccgg

SEQ ID NO: 3128103 - RNA, 19 nt, Mycobacterium bovis subsp bovis AF2122/97
aacccggugaccagcaacc

SEQ ID NO: 3128104 - RNA, 19 nt, Mycobacterium bovis subsp bovis AF2122/97
aacccggugucgugggcac

SEQ ID NO: 3128105 - RNA, 21 nt, Mycobacterium bovis subsp bovis AF2122/97
aacccguauugccaaagcccg

SEQ ID NO: 3128106 - RNA, 19 nt, Mycobacterium bovis subsp bovis AF2122/97
aacccguuuugggugaucg

SEQ ID NO: 3128107 - RNA, 13 nt, Mycobacterium bovis subsp bovis AF2122/97
aacccuagggcgg

SEQ ID NO: 3128108 - RNA, 23 nt, Mycobacterium bovis subsp bovis AF2122/97
aacccuagggcggugccgccgga

SEQ ID NO: 3128109 - RNA, 21 nt, Mycobacterium bovis subsp bovis AF2122/97
aacccuccggacccacccgca

SEQ ID NO: 3128110 - RNA, 15 nt, Mycobacterium bovis subsp bovis AF2122/97
aacccucgccacgca

SEQ ID NO: 3128111 - RNA, 13 nt, Mycobacterium bovis subsp bovis AF2122/97
aacccucgccggu

SEQ ID NO: 3128112 - RNA, 18 nt, Mycobacterium bovis subsp bovis AF2122/97
aaccuuguucagcaacaa

SEQ ID NO: 3128113 - RNA, 19 nt, Mycobacterium bovis subsp bovis AF2122/97
aaccuuugcguugcugagc

SEQ ID NO: 3128114 - RNA, 17 nt, Mycobacterium bovis subsp bovis AF2122/97
aacgaaccgcucagcgc

SEQ ID NO: 3128115 - RNA, 21 nt, Mycobacterium bovis subsp bovis AF2122/97
aacgaaugucaccccgcccag

SEQ ID NO: 3128116 - RNA, 17 nt, Mycobacterium bovis subsp bovis AF2122/97
aacgacaacacccacgu

SEQ ID NO: 3128117 - RNA, 13 nt, Mycobacterium bovis subsp bovis AF2122/97
aacgacaccagau

SEQ ID NO: 3128118 - RNA, 16 nt, Mycobacterium bovis subsp bovis AF2122/97
aacgacacgccgcucc

SEQ ID NO: 3128119 - RNA, 21 nt, Mycobacterium bovis subsp bovis AF2122/97
aacgacaucaccaccgcacgg

SEQ ID NO: 3128120 - RNA, 19 nt, Mycobacterium bovis subsp bovis AF2122/97
aacgacccgccgccccaca

SEQ ID NO: 3128121 - RNA, 19 nt, Mycobacterium bovis subsp bovis AF2122/97
aacgaccuccacgcccugg

SEQ ID NO: 3128122 - RNA, 18 nt, Mycobacterium bovis subsp bovis AF2122/97
aacgacgcuuucccgaug

SEQ ID NO: 3128123 - RNA, 21 nt, Mycobacterium bovis subsp bovis AF2122/97
aacgacggccgucgccccaaa

SEQ ID NO: 3128124 - RNA, 24 nt, Mycobacterium bovis subsp bovis AF2122/97
aacgacgggaaccagcggucggcg

SEQ ID NO: 3128125 - RNA, 19 nt, Mycobacterium bovis subsp bovis AF2122/97
aacgacgucgccgacccgg

SEQ ID NO: 3128126 - RNA, 15 nt, Mycobacterium bovis subsp bovis AF2122/97
aacgacuccuggcga

SEQ ID NO: 3128127 - RNA, 22 nt, Mycobacterium bovis subsp bovis AF2122/97
aacgacugaucaagugccagcg

SEQ ID NO: 3128128 - RNA, 21 nt, Mycobacterium bovis subsp bovis AF2122/97
aacgacuggguggugcucacc

SEQ ID NO: 3128129 - RNA, 20 nt, Mycobacterium bovis subsp bovis AF2122/97
aacgacuguggcgccgccgg

SEQ ID NO: 3128130 - RNA, 23 nt, Mycobacterium bovis subsp bovis AF2122/97
aacgagauucggagucaccagca

SEQ ID NO: 3128131 - RNA, 15 nt, Mycobacterium bovis subsp bovis AF2122/97
aacgagauucgucca

SEQ ID NO: 3128132 - RNA, 19 nt, Mycobacterium bovis subsp bovis AF2122/97
aacgagcaggauaaacccg

SEQ ID NO: 3128133 - RNA, 22 nt, Mycobacterium bovis subsp bovis AF2122/97
aacgaggcgcccagcgacaaca

SEQ ID NO: 3128134 - RNA, 17 nt, Mycobacterium bovis subsp bovis AF2122/97
aacgaguagccggucgg

SEQ ID NO: 3128135 - RNA, 16 nt, Mycobacterium bovis subsp bovis AF2122/97
aacgaguaggcggcuc

SEQ ID NO: 3128136 - RNA, 18 nt, Mycobacterium bovis subsp bovis AF2122/97
aacgagucagugccaucu

SEQ ID NO: 3128137 - RNA, 21 nt, Mycobacterium bovis subsp bovis AF2122/97
aacgauagaacguagcgccca

SEQ ID NO: 3128138 - RNA, 15 nt, Mycobacterium bovis subsp bovis AF2122/97
aacgaucagucgucu

SEQ ID NO: 3128139 - RNA, 18 nt, Mycobacterium bovis subsp bovis AF2122/97
aacgaucagucgucuuga

SEQ ID NO: 3128140 - RNA, 22 nt, Mycobacterium bovis subsp bovis AF2122/97
aacgaucgacaccagggcgugc

SEQ ID NO: 3128141 - RNA, 14 nt, Mycobacterium bovis subsp bovis AF2122/97
aacgaucgcgccgu

SEQ ID NO: 3128142 - RNA, 17 nt, Mycobacterium bovis subsp bovis AF2122/97
aacgaucgcgcgagcga

SEQ ID NO: 3128143 - RNA, 16 nt, Mycobacterium bovis subsp bovis AF2122/97
aacgaugccgccggcg

SEQ ID NO: 3128144 - RNA, 21 nt, Mycobacterium bovis subsp bovis AF2122/97
aacgaugccggcaagccugcg

SEQ ID NO: 3128145 - RNA, 17 nt, Mycobacterium bovis subsp bovis AF2122/97
aacgauggcgaugaggu

SEQ ID NO: 3128146 - RNA, 22 nt, Mycobacterium bovis subsp bovis AF2122/97
aacgauggggcaagcccaaaaa

SEQ ID NO: 3128147 - RNA, 23 nt, Mycobacterium bovis subsp bovis AF2122/97
aacgauggggcaagcccaaaaag

SEQ ID NO: 3128148 - RNA, 21 nt, Mycobacterium bovis subsp bovis AF2122/97
aacgaugguggcgaucaucgg

SEQ ID NO: 3128149 - RNA, 14 nt, Mycobacterium bovis subsp bovis AF2122/97
aacgauguccgcgc

SEQ ID NO: 3128150 - RNA, 16 nt, Mycobacterium bovis subsp bovis AF2122/97
aacgauguccgcgcga

SEQ ID NO: 3128151 - RNA, 22 nt, Mycobacterium bovis subsp bovis AF2122/97
aacgauugaacucuggugacgg

SEQ ID NO: 3128152 - RNA, 13 nt, Mycobacterium bovis subsp bovis AF2122/97
aacgcagccagcg

SEQ ID NO: 3128153 - RNA, 14 nt, Mycobacterium bovis subsp bovis AF2122/97
aacgcagccagcgc

SEQ ID NO: 3128154 - RNA, 18 nt, Mycobacterium bovis subsp bovis AF2122/97
aacgcaggcagugagggu

SEQ ID NO: 3128155 - RNA, 18 nt, Mycobacterium bovis subsp bovis AF2122/97
aacgcauacagcgcccgg

SEQ ID NO: 3128156 - RNA, 16 nt, Mycobacterium bovis subsp bovis AF2122/97
aacgccagucgagcac

SEQ ID NO: 3128157 - RNA, 14 nt, Mycobacterium bovis subsp bovis AF2122/97
aacgccaugccggg

SEQ ID NO: 3128158 - RNA, 19 nt, Mycobacterium bovis subsp bovis AF2122/97
aacgcccaacgucgccagg

SEQ ID NO: 3128159 - RNA, 13 nt, Mycobacterium bovis subsp bovis AF2122/97
aacgcccgcuuca

SEQ ID NO: 3128160 - RNA, 11 nt, Mycobacterium bovis subsp bovis AF2122/97
aacgcccggcu

SEQ ID NO: 3128161 - RNA, 16 nt, Mycobacterium bovis subsp bovis AF2122/97
aacgcccgggcggcgu

SEQ ID NO: 3128162 - RNA, 18 nt, Mycobacterium bovis subsp bovis AF2122/97
aacgcccguguugaagaa

SEQ ID NO: 3128163 - RNA, 17 nt, Mycobacterium bovis subsp bovis AF2122/97
aacgcccugacgguggu

SEQ ID NO: 3128164 - RNA, 15 nt, Mycobacterium bovis subsp bovis AF2122/97
aacgccgagcgccag

SEQ ID NO: 3128165 - RNA, 17 nt, Mycobacterium bovis subsp bovis AF2122/97
aacgccgagcgccaguu

SEQ ID NO: 3128166 - RNA, 20 nt, Mycobacterium bovis subsp bovis AF2122/97
aacgccgcaauggaccgaac

SEQ ID NO: 3128167 - RNA, 13 nt, Mycobacterium bovis subsp bovis AF2122/97
aacgccgccagcg

SEQ ID NO: 3128168 - RNA, 14 nt, Mycobacterium bovis subsp bovis AF2122/97
aacgccgccagcgc

SEQ ID NO: 3128169 - RNA, 17 nt, Mycobacterium bovis subsp bovis AF2122/97
aacgccgccagcgcggu

SEQ ID NO: 3128170 - RNA, 22 nt, Mycobacterium bovis subsp bovis AF2122/97
aacgccgccagcgcggugucgg

SEQ ID NO: 3128171 - RNA, 13 nt, Mycobacterium bovis subsp bovis AF2122/97
aacgccgcccgcc

SEQ ID NO: 3128172 - RNA, 17 nt, Mycobacterium bovis subsp bovis AF2122/97
aacgccgcccgcugggc

SEQ ID NO: 3128173 - RNA, 16 nt, Mycobacterium bovis subsp bovis AF2122/97
aacgccgcgacgugga

SEQ ID NO: 3128174 - RNA, 13 nt, Mycobacterium bovis subsp bovis AF2122/97
aacgccgcgccgu

SEQ ID NO: 3128175 - RNA, 13 nt, Mycobacterium bovis subsp bovis AF2122/97
aacgccgcgguca

SEQ ID NO: 3128176 - RNA, 20 nt, Mycobacterium bovis subsp bovis AF2122/97
aacgccggauuauucgcggu

SEQ ID NO: 3128177 - RNA, 12 nt, Mycobacterium bovis subsp bovis AF2122/97
aacgccggcacc

SEQ ID NO: 3128178 - RNA, 15 nt, Mycobacterium bovis subsp bovis AF2122/97
aacgccggcaccgac

SEQ ID NO: 3128179 - RNA, 20 nt, Mycobacterium bovis subsp bovis AF2122/97
aacgccggcgacggcgucac

SEQ ID NO: 3128180 - RNA, 16 nt, Mycobacterium bovis subsp bovis AF2122/97
aacgccggguucgccg

SEQ ID NO: 3128181 - RNA, 15 nt, Mycobacterium bovis subsp bovis AF2122/97
aacgccgucacggca

SEQ ID NO: 3128182 - RNA, 15 nt, Mycobacterium bovis subsp bovis AF2122/97
aacgccgucgccugc

SEQ ID NO: 3128183 - RNA, 15 nt, Mycobacterium bovis subsp bovis AF2122/97
aacgccgugccguac

SEQ ID NO: 3128184 - RNA, 17 nt, Mycobacterium bovis subsp bovis AF2122/97
aacgccucaggggcgcc

SEQ ID NO: 3128185 - RNA, 19 nt, Mycobacterium bovis subsp bovis AF2122/97
aacgccucgccggccacca

SEQ ID NO: 3128186 - RNA, 22 nt, Mycobacterium bovis subsp bovis AF2122/97
aacgccugaaacgauugcugcg

SEQ ID NO: 3128187 - RNA, 23 nt, Mycobacterium bovis subsp bovis AF2122/97
aacgccugaaacgauugcugcgg

SEQ ID NO: 3128188 - RNA, 22 nt, Mycobacterium bovis subsp bovis AF2122/97
aacgccuuguuggcgcccgggc

SEQ ID NO: 3128189 - RNA, 17 nt, Mycobacterium bovis subsp bovis AF2122/97
aacgcgaacccgcgagg

SEQ ID NO: 3128190 - RNA, 17 nt, Mycobacterium bovis subsp bovis AF2122/97
aacgcgagcgcuaucac

SEQ ID NO: 3128191 - RNA, 21 nt, Mycobacterium bovis subsp bovis AF2122/97
aacgcgcgcagccgggcaccg

SEQ ID NO: 3128192 - RNA, 22 nt, Mycobacterium bovis subsp bovis AF2122/97
aacgcgcgcguggucgccccga

SEQ ID NO: 3128193 - RNA, 16 nt, Mycobacterium bovis subsp bovis AF2122/97
aacgcgcuuggugugg

SEQ ID NO: 3128194 - RNA, 18 nt, Mycobacterium bovis subsp bovis AF2122/97
aacgcggacaccgcggcg

SEQ ID NO: 3128195 - RNA, 19 nt, Mycobacterium bovis subsp bovis AF2122/97
aacgcggacaccgcggcga

SEQ ID NO: 3128196 - RNA, 12 nt, Mycobacterium bovis subsp bovis AF2122/97
aacgcggcacca

SEQ ID NO: 3128197 - RNA, 15 nt, Mycobacterium bovis subsp bovis AF2122/97
aacgcggcaccacgu

SEQ ID NO: 3128198 - RNA, 19 nt, Mycobacterium bovis subsp bovis AF2122/97
aacuccgcguugggcaccu

SEQ ID NO: 3128199 - RNA, 13 nt, Mycobacterium bovis subsp bovis AF2122/97
aacuccucgaccg

SEQ ID NO: 3128200 - RNA, 20 nt, Mycobacterium bovis subsp bovis AF2122/97
aacucgaggucgagcgccgc

SEQ ID NO: 3128201 - RNA, 15 nt, Mycobacterium bovis subsp bovis AF2122/97
aacucgccccgcgug

SEQ ID NO: 3128202 - RNA, 17 nt, Mycobacterium bovis subsp bovis AF2122/97
aacucgcgaagcaucgc

SEQ ID NO: 3128203 - RNA, 13 nt, Mycobacterium bovis subsp bovis AF2122/97
aacucggcauuca

SEQ ID NO: 3128204 - RNA, 19 nt, Mycobacterium bovis subsp bovis AF2122/97
aacucggcgaccugccgga

SEQ ID NO: 3128205 - RNA, 15 nt, Mycobacterium bovis subsp bovis AF2122/97
aacucggcgucgugg

SEQ ID NO: 3128206 - RNA, 16 nt, Mycobacterium bovis subsp bovis AF2122/97
aacucggcgucguggu

SEQ ID NO: 3128207 - RNA, 12 nt, Mycobacterium bovis subsp bovis AF2122/97
aacucgggcagc

SEQ ID NO: 3128208 - RNA, 14 nt, Mycobacterium bovis subsp bovis AF2122/97
aacucgggggcugc

SEQ ID NO: 3128209 - RNA, 22 nt, Mycobacterium bovis subsp bovis AF2122/97
aacucggugccugucagaagga

SEQ ID NO: 3128210 - RNA, 15 nt, Mycobacterium bovis subsp bovis AF2122/97
aacucgucgauucgg

SEQ ID NO: 3128211 - RNA, 19 nt, Mycobacterium bovis subsp bovis AF2122/97
aacucuacgguggugcggu

SEQ ID NO: 3128212 - RNA, 15 nt, Mycobacterium bovis subsp bovis AF2122/97
aacucuucagcaagc

SEQ ID NO: 3128213 - RNA, 23 nt, Mycobacterium bovis subsp bovis AF2122/97
aacugaauggcaccgaggccaag

SEQ ID NO: 3128214 - RNA, 12 nt, Mycobacterium bovis subsp bovis AF2122/97
aacugagggcgg

SEQ ID NO: 3128215 - RNA, 19 nt, Mycobacterium bovis subsp bovis AF2122/97
aacugaucgaccgccuccu

SEQ ID NO: 3128216 - RNA, 21 nt, Mycobacterium bovis subsp bovis AF2122/97
aacugaugaaccacggcaggc

SEQ ID NO: 3128217 - RNA, 22 nt, Mycobacterium bovis subsp bovis AF2122/97
aacugcagcggcuugcccaggc

SEQ ID NO: 3128218 - RNA, 13 nt, Mycobacterium bovis subsp bovis AF2122/97
aacugccgcggca

SEQ ID NO: 3128219 - RNA, 19 nt, Mycobacterium bovis subsp bovis AF2122/97
aacugccggacuaccgccg

SEQ ID NO: 3128220 - RNA, 22 nt, Mycobacterium bovis subsp bovis AF2122/97
aacugccggacuaccgccggcg

SEQ ID NO: 3128221 - RNA, 19 nt, Mycobacterium bovis subsp bovis AF2122/97
aacugcgaucggccgccga

SEQ ID NO: 3128222 - RNA, 21 nt, Mycobacterium bovis subsp bovis AF2122/97
aacugcgaucggccgccgaau

SEQ ID NO: 3128223 - RNA, 20 nt, Mycobacterium bovis subsp bovis AF2122/97
aacugcgccguucgcucccc

SEQ ID NO: 3128224 - RNA, 21 nt, Mycobacterium bovis subsp bovis AF2122/97
aacugcgccguucgcuccccc

SEQ ID NO: 3128225 - RNA, 18 nt, Mycobacterium bovis subsp bovis AF2122/97
aacugcucgauccgcaac

SEQ ID NO: 3128226 - RNA, 23 nt, Mycobacterium bovis subsp bovis AF2122/97
aacugcugaugaaacgccgucgc

SEQ ID NO: 3128227 - RNA, 18 nt, Mycobacterium bovis subsp bovis AF2122/97
aacugcuugcgcaucgcc

SEQ ID NO: 3128228 - RNA, 22 nt, Mycobacterium bovis subsp bovis AF2122/97
aacugcuugcgcaucgccgaca

SEQ ID NO: 3128229 - RNA, 17 nt, Mycobacterium bovis subsp bovis AF2122/97
aacuggaccacagccgc

SEQ ID NO: 3128230 - RNA, 19 nt, Mycobacterium bovis subsp bovis AF2122/97
aacuggacggggaagcccg

SEQ ID NO: 3128231 - RNA, 19 nt, Mycobacterium bovis subsp bovis AF2122/97
aacuggacuggggcgccac

SEQ ID NO: 3128232 - RNA, 18 nt, Mycobacterium bovis subsp bovis AF2122/97
aacuggcggugcagugcc

SEQ ID NO: 3128233 - RNA, 20 nt, Mycobacterium bovis subsp bovis AF2122/97
aacugggcaccggcggucug

SEQ ID NO: 3128234 - RNA, 15 nt, Mycobacterium bovis subsp bovis AF2122/97
aacugggggccggca

SEQ ID NO: 3128235 - RNA, 16 nt, Mycobacterium bovis subsp bovis AF2122/97
aacugggggccggcac

SEQ ID NO: 3128236 - RNA, 21 nt, Mycobacterium bovis subsp bovis AF2122/97
aacugggggccggcacugccg

SEQ ID NO: 3128237 - RNA, 18 nt, Mycobacterium bovis subsp bovis AF2122/97
aacuguggaaggugauca

SEQ ID NO: 3128238 - RNA, 14 nt, Mycobacterium bovis subsp bovis AF2122/97
aacuucaacuggau

SEQ ID NO: 3128239 - RNA, 16 nt, Mycobacterium bovis subsp bovis AF2122/97
aacuucgacaacgcau

SEQ ID NO: 3128240 - RNA, 14 nt, Mycobacterium bovis subsp bovis AF2122/97
aacuugaucaccgc

SEQ ID NO: 3128241 - RNA, 18 nt, Mycobacterium bovis subsp bovis AF2122/97
aacuugccgcauaucacc

SEQ ID NO: 3128242 - RNA, 13 nt, Mycobacterium bovis subsp bovis AF2122/97
aacuugccggugc

SEQ ID NO: 3128243 - RNA, 15 nt, Mycobacterium bovis subsp bovis AF2122/97
aacuugcugacgaau

SEQ ID NO: 3128244 - RNA, 12 nt, Mycobacterium bovis subsp bovis AF2122/97
aacuuggcggcc

SEQ ID NO: 3128245 - RNA, 12 nt, Mycobacterium bovis subsp bovis AF2122/97
aagaaacaccac

SEQ ID NO: 3128246 - RNA, 18 nt, Mycobacterium bovis subsp bovis AF2122/97
aagaaacagguaagcagc

SEQ ID NO: 3128247 - RNA, 23 nt, Mycobacterium bovis subsp bovis AF2122/97
aagaaagacgcuguccaggucug

SEQ ID NO: 3128248 - RNA, 16 nt, Mycobacterium bovis subsp bovis AF2122/97
aagaaccugagcacca

SEQ ID NO: 3128249 - RNA, 20 nt, Mycobacterium bovis subsp bovis AF2122/97
aagaacucaaagacccgacg

SEQ ID NO: 3128250 - RNA, 22 nt, Mycobacterium bovis subsp bovis AF2122/97
aagaacucggcgucgugguggc

SEQ ID NO: 3128251 - RNA, 22 nt, Mycobacterium bovis subsp bovis AF2122/97
aagaagcccgacuggucacugc

SEQ ID NO: 3128252 - RNA, 16 nt, Mycobacterium bovis subsp bovis AF2122/97
aagaagccgguguuga

SEQ ID NO: 3128253 - RNA, 12 nt, Mycobacterium bovis subsp bovis AF2122/97
aagaaggccagc

SEQ ID NO: 3128254 - RNA, 14 nt, Mycobacterium bovis subsp bovis AF2122/97
aagaaucagcagca

SEQ ID NO: 3128255 - RNA, 15 nt, Mycobacterium bovis subsp bovis AF2122/97
aagaaucagcagcag

SEQ ID NO: 3128256 - RNA, 17 nt, Mycobacterium bovis subsp bovis AF2122/97
aagacagccugcgccac

SEQ ID NO: 3128257 - RNA, 13 nt, Mycobacterium bovis subsp bovis AF2122/97
aagacaguggcgc

SEQ ID NO: 3128258 - RNA, 18 nt, Mycobacterium bovis subsp bovis AF2122/97
aagaccaccgcccacagc

SEQ ID NO: 3128259 - RNA, 23 nt, Mycobacterium bovis subsp bovis AF2122/97
aagaccaccgcccacagcaacga

SEQ ID NO: 3128260 - RNA, 22 nt, Mycobacterium bovis subsp bovis AF2122/97
aagaccagcggcggcggcggca

SEQ ID NO: 3128261 - RNA, 18 nt, Mycobacterium bovis subsp bovis AF2122/97
aagaccggaucgccuugg

SEQ ID NO: 3128262 - RNA, 16 nt, Mycobacterium bovis subsp bovis AF2122/97
aagacgaauaacgccg

SEQ ID NO: 3128263 - RNA, 16 nt, Mycobacterium bovis subsp bovis AF2122/97
aagacgccgauccggu

SEQ ID NO: 3128264 - RNA, 23 nt, Mycobacterium bovis subsp bovis AF2122/97
aagacgccgauccgguggcuggc

SEQ ID NO: 3128265 - RNA, 17 nt, Mycobacterium bovis subsp bovis AF2122/97
aagacgccgucggcgcc

SEQ ID NO: 3128266 - RNA, 14 nt, Mycobacterium bovis subsp bovis AF2122/97
aagacgcgggucuu

SEQ ID NO: 3128267 - RNA, 13 nt, Mycobacterium bovis subsp bovis AF2122/97
aagacggccaccg

SEQ ID NO: 3128268 - RNA, 14 nt, Mycobacterium bovis subsp bovis AF2122/97
aagacggccaccgg

SEQ ID NO: 3128269 - RNA, 20 nt, Mycobacterium bovis subsp bovis AF2122/97
aagacggugcgggcuaggcg

SEQ ID NO: 3128270 - RNA, 12 nt, Mycobacterium bovis subsp bovis AF2122/97
aagacgucgagg

SEQ ID NO: 3128271 - RNA, 14 nt, Mycobacterium bovis subsp bovis AF2122/97
aagacgucggacgg

SEQ ID NO: 3128272 - RNA, 15 nt, Mycobacterium bovis subsp bovis AF2122/97
aagacgucggacggc

SEQ ID NO: 3128273 - RNA, 13 nt, Mycobacterium bovis subsp bovis AF2122/97
aagacgucggcgu

SEQ ID NO: 3128274 - RNA, 20 nt, Mycobacterium bovis subsp bovis AF2122/97
aagacgugguagaggaacag

SEQ ID NO: 3128275 - RNA, 11 nt, Mycobacterium bovis subsp bovis AF2122/97
aagagaagucu

SEQ ID NO: 3128276 - RNA, 16 nt, Mycobacterium bovis subsp bovis AF2122/97
aagagccgcagccacg

SEQ ID NO: 3128277 - RNA, 17 nt, Mycobacterium bovis subsp bovis AF2122/97
aagagcggagccggcgc

SEQ ID NO: 3128278 - RNA, 14 nt, Mycobacterium bovis subsp bovis AF2122/97
aagaggagaacgag

SEQ ID NO: 3128279 - RNA, 16 nt, Mycobacterium bovis subsp bovis AF2122/97
aagaggcgcaccuccu

SEQ ID NO: 3128280 - RNA, 16 nt, Mycobacterium bovis subsp bovis AF2122/97
aagagguggggcagga

SEQ ID NO: 3128281 - RNA, 18 nt, Mycobacterium bovis subsp bovis AF2122/97
aagagguuggcggccucg

SEQ ID NO: 3128282 - RNA, 20 nt, Mycobacterium bovis subsp bovis AF2122/97
aagagucgugccgccgcaug

SEQ ID NO: 3128283 - RNA, 17 nt, Mycobacterium bovis subsp bovis AF2122/97
aagaguucgcgcgccgc

SEQ ID NO: 3128284 - RNA, 15 nt, Mycobacterium bovis subsp bovis AF2122/97
aagauaacggcgacc

SEQ ID NO: 3128285 - RNA, 15 nt, Mycobacterium bovis subsp bovis AF2122/97
aagcgacgagcagca

SEQ ID NO: 3128286 - RNA, 17 nt, Mycobacterium bovis subsp bovis AF2122/97
aagcgacgagcagcaau

SEQ ID NO: 3128287 - RNA, 22 nt, Mycobacterium bovis subsp bovis AF2122/97
aagcgacgagcagcaauccaag

SEQ ID NO: 3128288 - RNA, 12 nt, Mycobacterium bovis subsp bovis AF2122/97
aagcgagcagcu

SEQ ID NO: 3128289 - RNA, 15 nt, Mycobacterium bovis subsp bovis AF2122/97
aagcgaggaucucgg

SEQ ID NO: 3128290 - RNA, 18 nt, Mycobacterium bovis subsp bovis AF2122/97
aagcgaugagggugcucg

SEQ ID NO: 3128291 - RNA, 16 nt, Mycobacterium bovis subsp bovis AF2122/97
aagcgaugccgugcug

SEQ ID NO: 3128292 - RNA, 22 nt, Mycobacterium bovis subsp bovis AF2122/97
aagcgcacaaacgacucgcggu

SEQ ID NO: 3128293 - RNA, 16 nt, Mycobacterium bovis subsp bovis AF2122/97
aagcgcaucgagcacc

SEQ ID NO: 3128294 - RNA, 21 nt, Mycobacterium bovis subsp bovis AF2122/97
aagcgccgaaacagcacccag

SEQ ID NO: 3128295 - RNA, 14 nt, Mycobacterium bovis subsp bovis AF2122/97
aagcgcgguggucg

SEQ ID NO: 3128296 - RNA, 19 nt, Mycobacterium bovis subsp bovis AF2122/97
aagcgcgguuucggcgaug

SEQ ID NO: 3128297 - RNA, 21 nt, Mycobacterium bovis subsp bovis AF2122/97
aagcgcucaaugaucgcggcg

SEQ ID NO: 3128298 - RNA, 20 nt, Mycobacterium bovis subsp bovis AF2122/97
aagcgcuuuagcgguguggg

SEQ ID NO: 3128299 - RNA, 18 nt, Mycobacterium bovis subsp bovis AF2122/97
aagcggaucuggccuugg

SEQ ID NO: 3128300 - RNA, 21 nt, Mycobacterium bovis subsp bovis AF2122/97
aagcggccaccgccgccgcca

SEQ ID NO: 3128301 - RNA, 23 nt, Mycobacterium bovis subsp bovis AF2122/97
aagcggccgguggaaaccgggcg

SEQ ID NO: 3128302 - RNA, 18 nt, Mycobacterium bovis subsp bovis AF2122/97
aagcggcugcugcgcggu

SEQ ID NO: 3128303 - RNA, 20 nt, Mycobacterium bovis subsp bovis AF2122/97
aagcgggacugcagcgcggu

SEQ ID NO: 3128304 - RNA, 16 nt, Mycobacterium bovis subsp bovis AF2122/97
aagcgggcgucgcggu

SEQ ID NO: 3128305 - RNA, 22 nt, Mycobacterium bovis subsp bovis AF2122/97
aagcgggcgugcucggaggcga

SEQ ID NO: 3128306 - RNA, 15 nt, Mycobacterium bovis subsp bovis AF2122/97
aagcgguuguccggu

SEQ ID NO: 3128307 - RNA, 15 nt, Mycobacterium bovis subsp bovis AF2122/97
aagcguccgcugcag

SEQ ID NO: 3128308 - RNA, 23 nt, Mycobacterium bovis subsp bovis AF2122/97
aagcgucguugcucggucucguc

SEQ ID NO: 3128309 - RNA, 19 nt, Mycobacterium bovis subsp bovis AF2122/97
aagcgugacccgccggcga

SEQ ID NO: 3128310 - RNA, 15 nt, Mycobacterium bovis subsp bovis AF2122/97
aagcgugcugccgcc

SEQ ID NO: 3128311 - RNA, 16 nt, Mycobacterium bovis subsp bovis AF2122/97
aagcuaccgaucgcca

SEQ ID NO: 3128312 - RNA, 21 nt, Mycobacterium bovis subsp bovis AF2122/97
aagcuaccgaucgccaaggcg

SEQ ID NO: 3128313 - RNA, 17 nt, Mycobacterium bovis subsp bovis AF2122/97
aagcucacacuggcuuu

SEQ ID NO: 3128314 - RNA, 13 nt, Mycobacterium bovis subsp bovis AF2122/97
aagcucagcuucu

SEQ ID NO: 3128315 - RNA, 19 nt, Mycobacterium bovis subsp bovis AF2122/97
aagcuccaguagucggccg

SEQ ID NO: 3128316 - RNA, 21 nt, Mycobacterium bovis subsp bovis AF2122/97
aagcucgacaacugcccgaug

SEQ ID NO: 3128317 - RNA, 20 nt, Mycobacterium bovis subsp bovis AF2122/97
aagcucgaccgcccggcuag

SEQ ID NO: 3128318 - RNA, 12 nt, Mycobacterium bovis subsp bovis AF2122/97
aagcucgccgga

SEQ ID NO: 3128319 - RNA, 19 nt, Mycobacterium bovis subsp bovis AF2122/97
aagcucucggcacccggca

SEQ ID NO: 3128320 - RNA, 14 nt, Mycobacterium bovis subsp bovis AF2122/97
aagcugaccgccag

SEQ ID NO: 3128321 - RNA, 17 nt, Mycobacterium bovis subsp bovis AF2122/97
aagcugagucgugacaa

SEQ ID NO: 3128322 - RNA, 22 nt, Mycobacterium bovis subsp bovis AF2122/97
aagcugagucgugacaaccauc

SEQ ID NO: 3128323 - RNA, 19 nt, Mycobacterium bovis subsp bovis AF2122/97
aagcugggcguaaaccgug

SEQ ID NO: 3128324 - RNA, 15 nt, Mycobacterium bovis subsp bovis AF2122/97
aagcugugcccggcg

SEQ ID NO: 3128325 - RNA, 17 nt, Mycobacterium bovis subsp bovis AF2122/97
aagcuucggccuucuug

SEQ ID NO: 3128326 - RNA, 19 nt, Mycobacterium bovis subsp bovis AF2122/97
aagcuucgggaaccagaug

SEQ ID NO: 3128327 - RNA, 13 nt, Mycobacterium bovis subsp bovis AF2122/97
aaggaaaagccug

SEQ ID NO: 3128328 - RNA, 18 nt, Mycobacterium bovis subsp bovis AF2122/97
aaggaaccgggcaaauca

SEQ ID NO: 3128329 - RNA, 20 nt, Mycobacterium bovis subsp bovis AF2122/97
aaggaaccgggcaaaucaag

SEQ ID NO: 3128330 - RNA, 16 nt, Mycobacterium bovis subsp bovis AF2122/97
aaggaccgcgcccaga

SEQ ID NO: 3128331 - RNA, 19 nt, Mycobacterium bovis subsp bovis AF2122/97
aaggaccgcucgucgccgg

SEQ ID NO: 3128332 - RNA, 13 nt, Mycobacterium bovis subsp bovis AF2122/97
aaggaccugugcg

SEQ ID NO: 3128333 - RNA, 15 nt, Mycobacterium bovis subsp bovis AF2122/97
aaggaccugugcggc

SEQ ID NO: 3128334 - RNA, 13 nt, Mycobacterium bovis subsp bovis AF2122/97
aaggacgacaccg

SEQ ID NO: 3128335 - RNA, 17 nt, Mycobacterium bovis subsp bovis AF2122/97
aaggacggcagccacca

SEQ ID NO: 3128336 - RNA, 21 nt, Mycobacterium bovis subsp bovis AF2122/97
aaggacguggcgcuggaccgg

SEQ ID NO: 3128337 - RNA, 19 nt, Mycobacterium bovis subsp bovis AF2122/97
aaggacguuucagccgggu

SEQ ID NO: 3128338 - RNA, 14 nt, Mycobacterium bovis subsp bovis AF2122/97
aaggcaaacaccag

SEQ ID NO: 3128339 - RNA, 16 nt, Mycobacterium bovis subsp bovis AF2122/97
aaggcaaacaccagcc

SEQ ID NO: 3128340 - RNA, 18 nt, Mycobacterium bovis subsp bovis AF2122/97
aaggcauugcccacaaag

SEQ ID NO: 3128341 - RNA, 22 nt, Mycobacterium bovis subsp bovis AF2122/97
aaggccagcgaaucgcugguga

SEQ ID NO: 3128342 - RNA, 14 nt, Mycobacterium bovis subsp bovis AF2122/97
aaggccgagcgcga

SEQ ID NO: 3128343 - RNA, 16 nt, Mycobacterium bovis subsp bovis AF2122/97
aaggccgcaauacccg

SEQ ID NO: 3128344 - RNA, 12 nt, Mycobacterium bovis subsp bovis AF2122/97
aaggccgccaac

SEQ ID NO: 3128345 - RNA, 15 nt, Mycobacterium bovis subsp bovis AF2122/97
aaggccgccaaccgu

SEQ ID NO: 3128346 - RNA, 19 nt, Mycobacterium bovis subsp bovis AF2122/97
aaggccgccgccgucggcg

SEQ ID NO: 3128347 - RNA, 15 nt, Mycobacterium bovis subsp bovis AF2122/97
aaggccgguagcgcg

SEQ ID NO: 3128348 - RNA, 23 nt, Mycobacterium bovis subsp bovis AF2122/97
aaggccuucagcggucgcagcuc

SEQ ID NO: 3128349 - RNA, 18 nt, Mycobacterium bovis subsp bovis AF2122/97
aaggcgacaucaccaccg

SEQ ID NO: 3128350 - RNA, 21 nt, Mycobacterium bovis subsp bovis AF2122/97
aaggcgacgccgaaaaugccg

SEQ ID NO: 3128351 - RNA, 13 nt, Mycobacterium bovis subsp bovis AF2122/97
aaggcgacucggu

SEQ ID NO: 3128352 - RNA, 22 nt, Mycobacterium bovis subsp bovis AF2122/97
aaggcgccgauaccggcggcga

SEQ ID NO: 3128353 - RNA, 14 nt, Mycobacterium bovis subsp bovis AF2122/97
aaggcgcgcugggc

SEQ ID NO: 3128354 - RNA, 21 nt, Mycobacterium bovis subsp bovis AF2122/97
aaggcgcugccuucuaccgaa

SEQ ID NO: 3128355 - RNA, 23 nt, Mycobacterium bovis subsp bovis AF2122/97
aaggcgugacgcuaacgucgauc

SEQ ID NO: 3128356 - RNA, 14 nt, Mycobacterium bovis subsp bovis AF2122/97
aaggcguucgccgg

SEQ ID NO: 3128357 - RNA, 18 nt, Mycobacterium bovis subsp bovis AF2122/97
aaggcguugguagccagg

SEQ ID NO: 3128358 - RNA, 14 nt, Mycobacterium bovis subsp bovis AF2122/97
aaggcucaccaggc

SEQ ID NO: 3128359 - RNA, 22 nt, Mycobacterium bovis subsp bovis AF2122/97
aaggcucagcagcgccgcgcgg

SEQ ID NO: 3128360 - RNA, 21 nt, Mycobacterium bovis subsp bovis AF2122/97
aagggauccgaagagccagca

SEQ ID NO: 3128361 - RNA, 12 nt, Mycobacterium bovis subsp bovis AF2122/97
aagggauccgga

SEQ ID NO: 3128362 - RNA, 24 nt, Mycobacterium bovis subsp bovis AF2122/97
aagggcaaccgccccuucccagua

SEQ ID NO: 3128363 - RNA, 14 nt, Mycobacterium bovis subsp bovis AF2122/97
aagggccggauggg

SEQ ID NO: 3128364 - RNA, 22 nt, Mycobacterium bovis subsp bovis AF2122/97
aagggcuggucuacccgcggcg

SEQ ID NO: 3128365 - RNA, 18 nt, Mycobacterium bovis subsp bovis AF2122/97
aagggcuugucgccggca

SEQ ID NO: 3128366 - RNA, 12 nt, Mycobacterium bovis subsp bovis AF2122/97
aagguccgugcc

SEQ ID NO: 3128367 - RNA, 22 nt, Mycobacterium bovis subsp bovis AF2122/97
aagguccgugccgaugccggcg

SEQ ID NO: 3128368 - RNA, 22 nt, Mycobacterium bovis subsp bovis AF2122/97
aaggucgacaugggucggcugu

SEQ ID NO: 3128369 - RNA, 14 nt, Mycobacterium bovis subsp bovis AF2122/97
aaggucggccaggc

SEQ ID NO: 3128370 - RNA, 19 nt, Mycobacterium bovis subsp bovis AF2122/97
aaggucuucaggccgcgca

SEQ ID NO: 3128371 - RNA, 12 nt, Mycobacterium bovis subsp bovis AF2122/97
aauccagcgccg

SEQ ID NO: 3128372 - RNA, 16 nt, Mycobacterium bovis subsp bovis AF2122/97
aauccaggccaccccg

SEQ ID NO: 3128373 - RNA, 13 nt, Mycobacterium bovis subsp bovis AF2122/97
aauccccgcggcg

SEQ ID NO: 3128374 - RNA, 20 nt, Mycobacterium bovis subsp bovis AF2122/97
aaucccgcucccccgccaac

SEQ ID NO: 3128375 - RNA, 14 nt, Mycobacterium bovis subsp bovis AF2122/97
aaucccucggccgc

SEQ ID NO: 3128376 - RNA, 17 nt, Mycobacterium bovis subsp bovis AF2122/97
aauccgaacucgcgggc

SEQ ID NO: 3128377 - RNA, 16 nt, Mycobacterium bovis subsp bovis AF2122/97
aauccgacguggaacu

SEQ ID NO: 3128378 - RNA, 18 nt, Mycobacterium bovis subsp bovis AF2122/97
aauccgaucaccucggcg

SEQ ID NO: 3128379 - RNA, 14 nt, Mycobacterium bovis subsp bovis AF2122/97
aauccgcccaccgg

SEQ ID NO: 3128380 - RNA, 16 nt, Mycobacterium bovis subsp bovis AF2122/97
aauccgcccuaaugaa

SEQ ID NO: 3128381 - RNA, 22 nt, Mycobacterium bovis subsp bovis AF2122/97
aauccgcccuugccgccuuggc

SEQ ID NO: 3128382 - RNA, 15 nt, Mycobacterium bovis subsp bovis AF2122/97
aauccggcugcggua

SEQ ID NO: 3128383 - RNA, 14 nt, Mycobacterium bovis subsp bovis AF2122/97
aauccggucagcgc

SEQ ID NO: 3128384 - RNA, 14 nt, Mycobacterium bovis subsp bovis AF2122/97
aauccggugaugac

SEQ ID NO: 3128385 - RNA, 17 nt, Mycobacterium bovis subsp bovis AF2122/97
aauccgguguugagauc

SEQ ID NO: 3128386 - RNA, 14 nt, Mycobacterium bovis subsp bovis AF2122/97
aauccuccuccgca

SEQ ID NO: 3128387 - RNA, 18 nt, Mycobacterium bovis subsp bovis AF2122/97
aauccugccgcacgggcc

SEQ ID NO: 3128388 - RNA, 16 nt, Mycobacterium bovis subsp bovis AF2122/97
aauccugcgcugcacc

SEQ ID NO: 3128389 - RNA, 17 nt, Mycobacterium bovis subsp bovis AF2122/97
aauccugcgcugcacca

SEQ ID NO: 3128390 - RNA, 12 nt, Mycobacterium bovis subsp bovis AF2122/97
aaucgaccgccg

SEQ ID NO: 3128391 - RNA, 23 nt, Mycobacterium bovis subsp bovis AF2122/97
aaucgacugaucgccacccgguc

SEQ ID NO: 3128392 - RNA, 13 nt, Mycobacterium bovis subsp bovis AF2122/97
aaucgagcaccgc

SEQ ID NO: 3128393 - RNA, 16 nt, Mycobacterium bovis subsp bovis AF2122/97
aaucgagcgcggcaac

SEQ ID NO: 3128394 - RNA, 21 nt, Mycobacterium bovis subsp bovis AF2122/97
aaucgaucgaauuaaagccac

SEQ ID NO: 3128395 - RNA, 21 nt, Mycobacterium bovis subsp bovis AF2122/97
aaucgauuccgggugcgaucg

SEQ ID NO: 3128396 - RNA, 21 nt, Mycobacterium bovis subsp bovis AF2122/97
aaucgcacagcgcgaucaacg

SEQ ID NO: 3128397 - RNA, 17 nt, Mycobacterium bovis subsp bovis AF2122/97
aaucgcaucuagguuca

SEQ ID NO: 3128398 - RNA, 15 nt, Mycobacterium bovis subsp bovis AF2122/97
aaucgcccagugugc

SEQ ID NO: 3128399 - RNA, 14 nt, Mycobacterium bovis subsp bovis AF2122/97
aaucgcccucgucg

SEQ ID NO: 3128400 - RNA, 15 nt, Mycobacterium bovis subsp bovis AF2122/97
aaucgccugcgacag

SEQ ID NO: 3128401 - RNA, 23 nt, Mycobacterium bovis subsp bovis AF2122/97
aaucgcgaacgaagucgacgaac

SEQ ID NO: 3128402 - RNA, 21 nt, Mycobacterium bovis subsp bovis AF2122/97
aaucgcgagcuuggccggcag

SEQ ID NO: 3128403 - RNA, 19 nt, Mycobacterium bovis subsp bovis AF2122/97
aaucgcgcuucaggcauca

SEQ ID NO: 3128404 - RNA, 16 nt, Mycobacterium bovis subsp bovis AF2122/97
aaucgcggagccagga

SEQ ID NO: 3128405 - RNA, 18 nt, Mycobacterium bovis subsp bovis AF2122/97
aaucgcggagccaggacg

SEQ ID NO: 3128406 - RNA, 13 nt, Mycobacterium bovis subsp bovis AF2122/97
aaucgcgucgagc

SEQ ID NO: 3128407 - RNA, 20 nt, Mycobacterium bovis subsp bovis AF2122/97
aaucgcgucgagcgccggcc

SEQ ID NO: 3128408 - RNA, 22 nt, Mycobacterium bovis subsp bovis AF2122/97
aaucgcgucgagcgccggccgc

SEQ ID NO: 3128409 - RNA, 14 nt, Mycobacterium bovis subsp bovis AF2122/97
aaucgcugaccgcg

SEQ ID NO: 3128410 - RNA, 20 nt, Mycobacterium bovis subsp bovis AF2122/97
aaucgcugaccgcguagacc

SEQ ID NO: 3128411 - RNA, 16 nt, Mycobacterium bovis subsp bovis AF2122/97
aaucggaccgaccggc

SEQ ID NO: 3128412 - RNA, 16 nt, Mycobacterium bovis subsp bovis AF2122/97
aaucggcaagacgcgg

SEQ ID NO: 3128413 - RNA, 23 nt, Mycobacterium bovis subsp bovis AF2122/97
aaucggcccgugccacagcucgc

SEQ ID NO: 3128414 - RNA, 17 nt, Mycobacterium bovis subsp bovis AF2122/97
aaucggccugccggcag

SEQ ID NO: 3128415 - RNA, 17 nt, Mycobacterium bovis subsp bovis AF2122/97
aaucggcggcacccggg

SEQ ID NO: 3128416 - RNA, 11 nt, Mycobacterium bovis subsp bovis AF2122/97
aaucggcggcg

SEQ ID NO: 3128417 - RNA, 19 nt, Mycobacterium bovis subsp bovis AF2122/97
aaucggcggcguccagcag

SEQ ID NO: 3128418 - RNA, 16 nt, Mycobacterium bovis subsp bovis AF2122/97
aaucgggauagcccag

SEQ ID NO: 3128419 - RNA, 22 nt, Mycobacterium bovis subsp bovis AF2122/97
aaucgguggucgauggacaaca

SEQ ID NO: 3128420 - RNA, 14 nt, Mycobacterium bovis subsp bovis AF2122/97
aaucgucagcgccg

SEQ ID NO: 3128421 - RNA, 13 nt, Mycobacterium bovis subsp bovis AF2122/97
aaucgucgcggcc

SEQ ID NO: 3128422 - RNA, 14 nt, Mycobacterium bovis subsp bovis AF2122/97
aaucguguaccucc

SEQ ID NO: 3128423 - RNA, 22 nt, Mycobacterium bovis subsp bovis AF2122/97
aaucgugucgccucgaugccaa

SEQ ID NO: 3128424 - RNA, 22 nt, Mycobacterium bovis subsp bovis AF2122/97
aaucguuccgcagucugacgaa

SEQ ID NO: 3128425 - RNA, 16 nt, Mycobacterium bovis subsp bovis AF2122/97
aaucguuggccaugcc

SEQ ID NO: 3128426 - RNA, 13 nt, Mycobacterium bovis subsp bovis AF2122/97
aaucucgccgggc

SEQ ID NO: 3128427 - RNA, 15 nt, Mycobacterium bovis subsp bovis AF2122/97
aaucucgccgggcug

SEQ ID NO: 3128428 - RNA, 19 nt, Mycobacterium bovis subsp bovis AF2122/97
aaucugcuagcuuggcggc

SEQ ID NO: 3128429 - RNA, 20 nt, Mycobacterium bovis subsp bovis AF2122/97
aaucuucucgagccgccgga

SEQ ID NO: 3128430 - RNA, 13 nt, Mycobacterium bovis subsp bovis AF2122/97
aaugaaccgcacc

SEQ ID NO: 3128431 - RNA, 15 nt, Mycobacterium bovis subsp bovis AF2122/97
aaugaaggcaccgaa

SEQ ID NO: 3128432 - RNA, 17 nt, Mycobacterium bovis subsp bovis AF2122/97
aaugacgauccagccca

SEQ ID NO: 3128433 - RNA, 22 nt, Mycobacterium bovis subsp bovis AF2122/97
aaugacgucggaccagcugccg

SEQ ID NO: 3128434 - RNA, 16 nt, Mycobacterium bovis subsp bovis AF2122/97
aaugacucggccgcac

SEQ ID NO: 3128435 - RNA, 16 nt, Mycobacterium bovis subsp bovis AF2122/97
aaugacuuggccagca

SEQ ID NO: 3128436 - RNA, 17 nt, Mycobacterium bovis subsp bovis AF2122/97
aaugauucggcacgccg

SEQ ID NO: 3128437 - RNA, 19 nt, Mycobacterium bovis subsp bovis AF2122/97
aaugcacaccgggcaccag

SEQ ID NO: 3128438 - RNA, 14 nt, Mycobacterium bovis subsp bovis AF2122/97
aaugcaucgcggcg

SEQ ID NO: 3128439 - RNA, 14 nt, Mycobacterium bovis subsp bovis AF2122/97
aaugccagcggcac

SEQ ID NO: 3128440 - RNA, 19 nt, Mycobacterium bovis subsp bovis AF2122/97
aaugcccuuggccagcagg

SEQ ID NO: 3128441 - RNA, 15 nt, Mycobacterium bovis subsp bovis AF2122/97
aaugccgacgccaac

SEQ ID NO: 3128442 - RNA, 12 nt, Mycobacterium bovis subsp bovis AF2122/97
aaugccgccgac

SEQ ID NO: 3128443 - RNA, 21 nt, Mycobacterium bovis subsp bovis AF2122/97
aaugccggugccgggcaccac

SEQ ID NO: 3128444 - RNA, 19 nt, Mycobacterium bovis subsp bovis AF2122/97
aaugcgaugcggucgucac

SEQ ID NO: 3128445 - RNA, 22 nt, Mycobacterium bovis subsp bovis AF2122/97
aaugcgcugucgcccucgaucg

SEQ ID NO: 3128446 - RNA, 22 nt, Mycobacterium bovis subsp bovis AF2122/97
aaugcgggucugcggucaucgc

SEQ ID NO: 3128447 - RNA, 15 nt, Mycobacterium bovis subsp bovis AF2122/97
aaugcggucaacgac

SEQ ID NO: 3128448 - RNA, 16 nt, Mycobacterium bovis subsp bovis AF2122/97
aaugcgguccucgauc

SEQ ID NO: 3128449 - RNA, 22 nt, Mycobacterium bovis subsp bovis AF2122/97
aaugcguugacgucgagcagcg

SEQ ID NO: 3128450 - RNA, 21 nt, Mycobacterium bovis subsp bovis AF2122/97
aaugcugacggugcaggacca

SEQ ID NO: 3128451 - RNA, 12 nt, Mycobacterium bovis subsp bovis AF2122/97
aaugcugcaggu

SEQ ID NO: 3128452 - RNA, 12 nt, Mycobacterium bovis subsp bovis AF2122/97
aaugcugcugca

SEQ ID NO: 3128453 - RNA, 14 nt, Mycobacterium bovis subsp bovis AF2122/97
aaugcuggcggcgc

SEQ ID NO: 3128454 - RNA, 13 nt, Mycobacterium bovis subsp bovis AF2122/97
aaugcuucgaccg

SEQ ID NO: 3128455 - RNA, 15 nt, Mycobacterium bovis subsp bovis AF2122/97
aauggacaccaaccc

SEQ ID NO: 3128456 - RNA, 14 nt, Mycobacterium bovis subsp bovis AF2122/97
aauggaccagcgcc

SEQ ID NO: 3128457 - RNA, 15 nt, Mycobacterium bovis subsp bovis AF2122/97
aauggacugaacacc

SEQ ID NO: 3128458 - RNA, 15 nt, Mycobacterium bovis subsp bovis AF2122/97
acaacaucacugccu

SEQ ID NO: 3128459 - RNA, 12 nt, Mycobacterium bovis subsp bovis AF2122/97
acaacaucgcca

SEQ ID NO: 3128460 - RNA, 12 nt, Mycobacterium bovis subsp bovis AF2122/97
acaacaucgccg

SEQ ID NO: 3128461 - RNA, 10 nt, Mycobacterium bovis subsp bovis AF2122/97
acaacaugcu

SEQ ID NO: 3128462 - RNA, 14 nt, Mycobacterium bovis subsp bovis AF2122/97
acaaccacccaccc

SEQ ID NO: 3128463 - RNA, 20 nt, Mycobacterium bovis subsp bovis AF2122/97
acaaccacggcagauugacg

SEQ ID NO: 3128464 - RNA, 17 nt, Mycobacterium bovis subsp bovis AF2122/97
acaacccggcgucgacg

SEQ ID NO: 3128465 - RNA, 23 nt, Mycobacterium bovis subsp bovis AF2122/97
acaacccggcgucgacgauuccc

SEQ ID NO: 3128466 - RNA, 23 nt, Mycobacterium bovis subsp bovis AF2122/97
acaacccguaggguggccgacga

SEQ ID NO: 3128467 - RNA, 19 nt, Mycobacterium bovis subsp bovis AF2122/97
acaacccgucgagccgugc

SEQ ID NO: 3128468 - RNA, 19 nt, Mycobacterium bovis subsp bovis AF2122/97
acaacccuguuguugucgg

SEQ ID NO: 3128469 - RNA, 20 nt, Mycobacterium bovis subsp bovis AF2122/97
acaaccgugagcaccagcag

SEQ ID NO: 3128470 - RNA, 15 nt, Mycobacterium bovis subsp bovis AF2122/97
acaacgaaaccgacc

SEQ ID NO: 3128471 - RNA, 14 nt, Mycobacterium bovis subsp bovis AF2122/97
acaacgacaacacc

SEQ ID NO: 3128472 - RNA, 13 nt, Mycobacterium bovis subsp bovis AF2122/97
acaacgacacgcc

SEQ ID NO: 3128473 - RNA, 17 nt, Mycobacterium bovis subsp bovis AF2122/97
acaacgacacgccgcau

SEQ ID NO: 3128474 - RNA, 17 nt, Mycobacterium bovis subsp bovis AF2122/97
acaacgacgucgccgac

SEQ ID NO: 3128475 - RNA, 22 nt, Mycobacterium bovis subsp bovis AF2122/97
acaacgauugcgaagggcaccg

SEQ ID NO: 3128476 - RNA, 15 nt, Mycobacterium bovis subsp bovis AF2122/97
acaacgccaggaacc

SEQ ID NO: 3128477 - RNA, 22 nt, Mycobacterium bovis subsp bovis AF2122/97
acaacgccauacacaacgccau

SEQ ID NO: 3128478 - RNA, 13 nt, Mycobacterium bovis subsp bovis AF2122/97
acaacgcccacca

SEQ ID NO: 3128479 - RNA, 14 nt, Mycobacterium bovis subsp bovis AF2122/97
acaacgcccaccac

SEQ ID NO: 3128480 - RNA, 12 nt, Mycobacterium bovis subsp bovis AF2122/97
acaacgccgcga

SEQ ID NO: 3128481 - RNA, 17 nt, Mycobacterium bovis subsp bovis AF2122/97
acaacgcgacgccgcuc

SEQ ID NO: 3128482 - RNA, 18 nt, Mycobacterium bovis subsp bovis AF2122/97
acaacgcgugaccagggc

SEQ ID NO: 3128483 - RNA, 19 nt, Mycobacterium bovis subsp bovis AF2122/97
acaacgcgugaccagggcc

SEQ ID NO: 3128484 - RNA, 21 nt, Mycobacterium bovis subsp bovis AF2122/97
acaacgcugggcggcuaccca

SEQ ID NO: 3128485 - RNA, 17 nt, Mycobacterium bovis subsp bovis AF2122/97
acaacgcuucggcgugc

SEQ ID NO: 3128486 - RNA, 12 nt, Mycobacterium bovis subsp bovis AF2122/97
acaacggcggca

SEQ ID NO: 3128487 - RNA, 13 nt, Mycobacterium bovis subsp bovis AF2122/97
acaacggcggcgc

SEQ ID NO: 3128488 - RNA, 19 nt, Mycobacterium bovis subsp bovis AF2122/97
acaacgucgccgcggcggc

SEQ ID NO: 3128489 - RNA, 23 nt, Mycobacterium bovis subsp bovis AF2122/97
acaacuaucgucgugucgccgcc

SEQ ID NO: 3128490 - RNA, 12 nt, Mycobacterium bovis subsp bovis AF2122/97
acaacuccagca

SEQ ID NO: 3128491 - RNA, 19 nt, Mycobacterium bovis subsp bovis AF2122/97
acaacucgcguggcaccga

SEQ ID NO: 3128492 - RNA, 14 nt, Mycobacterium bovis subsp bovis AF2122/97
acaacugcccgaug

SEQ ID NO: 3128493 - RNA, 15 nt, Mycobacterium bovis subsp bovis AF2122/97
acaacugccgagcag

SEQ ID NO: 3128494 - RNA, 17 nt, Mycobacterium bovis subsp bovis AF2122/97
acaacugcgccggugcc

SEQ ID NO: 3128495 - RNA, 20 nt, Mycobacterium bovis subsp bovis AF2122/97
acaacugcgccggugccggc

SEQ ID NO: 3128496 - RNA, 12 nt, Mycobacterium bovis subsp bovis AF2122/97
acaagcacagcg

SEQ ID NO: 3128497 - RNA, 21 nt, Mycobacterium bovis subsp bovis AF2122/97
acaagcacauuauucuucgcg

SEQ ID NO: 3128498 - RNA, 12 nt, Mycobacterium bovis subsp bovis AF2122/97
acaagcccagcc

SEQ ID NO: 3128499 - RNA, 21 nt, Mycobacterium bovis subsp bovis AF2122/97
acaagccgagcccgucgauca

SEQ ID NO: 3128500 - RNA, 23 nt, Mycobacterium bovis subsp bovis AF2122/97
acaagccgcugauguacccggcg

SEQ ID NO: 3128501 - RNA, 23 nt, Mycobacterium bovis subsp bovis AF2122/97
acaagccgugcagcucggucagc

SEQ ID NO: 3128502 - RNA, 17 nt, Mycobacterium bovis subsp bovis AF2122/97
acaagcgauggcaccac

SEQ ID NO: 3128503 - RNA, 24 nt, Mycobacterium bovis subsp bovis AF2122/97
acaagcggcccgcuguggucuuca

SEQ ID NO: 3128504 - RNA, 23 nt, Mycobacterium bovis subsp bovis AF2122/97
acaagcuccucgcgagucggcgg

SEQ ID NO: 3128505 - RNA, 12 nt, Mycobacterium bovis subsp bovis AF2122/97
acaagcugacac

SEQ ID NO: 3128506 - RNA, 22 nt, Mycobacterium bovis subsp bovis AF2122/97
acaaggccgccgccgucggcga

SEQ ID NO: 3128507 - RNA, 13 nt, Mycobacterium bovis subsp bovis AF2122/97
acaaguccgcgau

SEQ ID NO: 3128508 - RNA, 18 nt, Mycobacterium bovis subsp bovis AF2122/97
acaagucgacacgccgaa

SEQ ID NO: 3128509 - RNA, 18 nt, Mycobacterium bovis subsp bovis AF2122/97
acaaucacauagccgguc

SEQ ID NO: 3128510 - RNA, 20 nt, Mycobacterium bovis subsp bovis AF2122/97
acaauccgguguugagaucg

SEQ ID NO: 3128511 - RNA, 16 nt, Mycobacterium bovis subsp bovis AF2122/97
acaaucgcacgcugcu

SEQ ID NO: 3128512 - RNA, 14 nt, Mycobacterium bovis subsp bovis AF2122/97
acaaucucggcguu

SEQ ID NO: 3128513 - RNA, 14 nt, Mycobacterium bovis subsp bovis AF2122/97
acaaugccagcugu

SEQ ID NO: 3128514 - RNA, 19 nt, Mycobacterium bovis subsp bovis AF2122/97
acaauggcggcgccgucga

SEQ ID NO: 3128515 - RNA, 18 nt, Mycobacterium bovis subsp bovis AF2122/97
acaauuccacaaauccaa

SEQ ID NO: 3128516 - RNA, 19 nt, Mycobacterium bovis subsp bovis AF2122/97
acaauuccacaaauccaaa

SEQ ID NO: 3128517 - RNA, 12 nt, Mycobacterium bovis subsp bovis AF2122/97
acacaaccgacg

SEQ ID NO: 3128518 - RNA, 23 nt, Mycobacterium bovis subsp bovis AF2122/97
acacaacgacgaauaaguacucu

SEQ ID NO: 3128519 - RNA, 19 nt, Mycobacterium bovis subsp bovis AF2122/97
acacaacgggugucggcgu

SEQ ID NO: 3128520 - RNA, 12 nt, Mycobacterium bovis subsp bovis AF2122/97
acacacccaccg

SEQ ID NO: 3128521 - RNA, 21 nt, Mycobacterium bovis subsp bovis AF2122/97
acacagaucuugugccaggcg

SEQ ID NO: 3128522 - RNA, 15 nt, Mycobacterium bovis subsp bovis AF2122/97
acacagccgcgcugc

SEQ ID NO: 3128523 - RNA, 23 nt, Mycobacterium bovis subsp bovis AF2122/97
acacagcguccgucgucggcguc

SEQ ID NO: 3128524 - RNA, 23 nt, Mycobacterium bovis subsp bovis AF2122/97
acacaggaagcguugucgcccac

SEQ ID NO: 3128525 - RNA, 13 nt, Mycobacterium bovis subsp bovis AF2122/97
acacaggacuugu

SEQ ID NO: 3128526 - RNA, 21 nt, Mycobacterium bovis subsp bovis AF2122/97
acacaggcguccaucgccacc

SEQ ID NO: 3128527 - RNA, 22 nt, Mycobacterium bovis subsp bovis AF2122/97
acacaggcguccaucgccaccg

SEQ ID NO: 3128528 - RNA, 16 nt, Mycobacterium bovis subsp bovis AF2122/97
acacagucggugcagc

SEQ ID NO: 3128529 - RNA, 17 nt, Mycobacterium bovis subsp bovis AF2122/97
acacaucgucacugcca

SEQ ID NO: 3128530 - RNA, 14 nt, Mycobacterium bovis subsp bovis AF2122/97
acacaugccgcagg

SEQ ID NO: 3128531 - RNA, 14 nt, Mycobacterium bovis subsp bovis AF2122/97
acacauugccggcc

SEQ ID NO: 3128532 - RNA, 11 nt, Mycobacterium bovis subsp bovis AF2122/97
acaccaacacc

SEQ ID NO: 3128533 - RNA, 17 nt, Mycobacterium bovis subsp bovis AF2122/97
acaccaacaccgcggcg

SEQ ID NO: 3128534 - RNA, 13 nt, Mycobacterium bovis subsp bovis AF2122/97
acaccaacaccgg

SEQ ID NO: 3128535 - RNA, 13 nt, Mycobacterium bovis subsp bovis AF2122/97
acaccaacccacc

SEQ ID NO: 3128536 - RNA, 18 nt, Mycobacterium bovis subsp bovis AF2122/97
acaccaacgacagcgacg

SEQ ID NO: 3128537 - RNA, 13 nt, Mycobacterium bovis subsp bovis AF2122/97
acaccaccauucc

SEQ ID NO: 3128538 - RNA, 18 nt, Mycobacterium bovis subsp bovis AF2122/97
acaccacgauggcggcca

SEQ ID NO: 3128539 - RNA, 19 nt, Mycobacterium bovis subsp bovis AF2122/97
acaccacggaccagcgccg

SEQ ID NO: 3128540 - RNA, 19 nt, Mycobacterium bovis subsp bovis AF2122/97
acaccacgguuggccacca

SEQ ID NO: 3128541 - RNA, 14 nt, Mycobacterium bovis subsp bovis AF2122/97
acaccagaugcacc

SEQ ID NO: 3128542 - RNA, 14 nt, Mycobacterium bovis subsp bovis AF2122/97
acaccagauggcuc

SEQ ID NO: 3128543 - RNA, 12 nt, Mycobacterium bovis subsp bovis AF2122/97
acaccagcagca

SEQ ID NO: 3128544 - RNA, 20 nt, Mycobacterium bovis subsp bovis AF2122/97
acaccagcagcacuccggcg

SEQ ID NO: 3128545 - RNA, 21 nt, Mycobacterium bovis subsp bovis AF2122/97
acaccgucacgccaccgcaac

SEQ ID NO: 3128546 - RNA, 23 nt, Mycobacterium bovis subsp bovis AF2122/97
acaccgucagcgucugagcgccg

SEQ ID NO: 3128547 - RNA, 16 nt, Mycobacterium bovis subsp bovis AF2122/97
acaccgucaugccguu

SEQ ID NO: 3128548 - RNA, 19 nt, Mycobacterium bovis subsp bovis AF2122/97
acaccguccagcagcucgg

SEQ ID NO: 3128549 - RNA, 22 nt, Mycobacterium bovis subsp bovis AF2122/97
acaccgucgcgcucgcaccacc

SEQ ID NO: 3128550 - RNA, 14 nt, Mycobacterium bovis subsp bovis AF2122/97
acaccgucggcagc

SEQ ID NO: 3128551 - RNA, 19 nt, Mycobacterium bovis subsp bovis AF2122/97
acaccgucggcagcagcgg

SEQ ID NO: 3128552 - RNA, 20 nt, Mycobacterium bovis subsp bovis AF2122/97
acaccgugaccgccgcgccg

SEQ ID NO: 3128553 - RNA, 19 nt, Mycobacterium bovis subsp bovis AF2122/97
acaccgugcaccagcucac

SEQ ID NO: 3128554 - RNA, 18 nt, Mycobacterium bovis subsp bovis AF2122/97
acaccguggaucggcagc

SEQ ID NO: 3128555 - RNA, 15 nt, Mycobacterium bovis subsp bovis AF2122/97
acaccgugucgccgg

SEQ ID NO: 3128556 - RNA, 16 nt, Mycobacterium bovis subsp bovis AF2122/97
acaccgugucgccggc

SEQ ID NO: 3128557 - RNA, 16 nt, Mycobacterium bovis subsp bovis AF2122/97
acaccucaaacgccug

SEQ ID NO: 3128558 - RNA, 17 nt, Mycobacterium bovis subsp bovis AF2122/97
acaccucauacgccaau

SEQ ID NO: 3128559 - RNA, 14 nt, Mycobacterium bovis subsp bovis AF2122/97
acaccuccucgagc

SEQ ID NO: 3128560 - RNA, 13 nt, Mycobacterium bovis subsp bovis AF2122/97
acaccucgggguu

SEQ ID NO: 3128561 - RNA, 18 nt, Mycobacterium bovis subsp bovis AF2122/97
acaccucgggguuacguu

SEQ ID NO: 3128562 - RNA, 19 nt, Mycobacterium bovis subsp bovis AF2122/97
acaccugcgcggcgugcgc

SEQ ID NO: 3128563 - RNA, 22 nt, Mycobacterium bovis subsp bovis AF2122/97
acaccugcgcggcgugcgcggu

SEQ ID NO: 3128564 - RNA, 12 nt, Mycobacterium bovis subsp bovis AF2122/97
acaccugcggcu

SEQ ID NO: 3128565 - RNA, 14 nt, Mycobacterium bovis subsp bovis AF2122/97
acaccugcggcugc

SEQ ID NO: 3128566 - RNA, 15 nt, Mycobacterium bovis subsp bovis AF2122/97
acaccuucgacguug

SEQ ID NO: 3128567 - RNA, 21 nt, Mycobacterium bovis subsp bovis AF2122/97
acaccuuggccgccggccgcg

SEQ ID NO: 3128568 - RNA, 23 nt, Mycobacterium bovis subsp bovis AF2122/97
acaccuuggccgccggccgcgca

SEQ ID NO: 3128569 - RNA, 18 nt, Mycobacterium bovis subsp bovis AF2122/97
acaccuuggcggucggca

SEQ ID NO: 3128570 - RNA, 17 nt, Mycobacterium bovis subsp bovis AF2122/97
acaccuuguggacccgc

SEQ ID NO: 3128571 - RNA, 18 nt, Mycobacterium bovis subsp bovis AF2122/97
acaccuuguggacccgcc

SEQ ID NO: 3128572 - RNA, 14 nt, Mycobacterium bovis subsp bovis AF2122/97
acaccuuucuccac

SEQ ID NO: 3128573 - RNA, 14 nt, Mycobacterium bovis subsp bovis AF2122/97
acacgaauccggcc

SEQ ID NO: 3128574 - RNA, 13 nt, Mycobacterium bovis subsp bovis AF2122/97
acacgaccucuug

SEQ ID NO: 3128575 - RNA, 18 nt, Mycobacterium bovis subsp bovis AF2122/97
acacgacgaauguccgca

SEQ ID NO: 3128576 - RNA, 19 nt, Mycobacterium bovis subsp bovis AF2122/97
acacgacugucccgcgcaa

SEQ ID NO: 3128577 - RNA, 17 nt, Mycobacterium bovis subsp bovis AF2122/97
acacgaucuugcggaag

SEQ ID NO: 3128578 - RNA, 14 nt, Mycobacterium bovis subsp bovis AF2122/97
acacgaugcccggc

SEQ ID NO: 3128579 - RNA, 15 nt, Mycobacterium bovis subsp bovis AF2122/97
acacgaugcccggca

SEQ ID NO: 3128580 - RNA, 17 nt, Mycobacterium bovis subsp bovis AF2122/97
acacgaugcgcggugcg

SEQ ID NO: 3128581 - RNA, 17 nt, Mycobacterium bovis subsp bovis AF2122/97
acacgccagccgugccg

SEQ ID NO: 3128582 - RNA, 13 nt, Mycobacterium bovis subsp bovis AF2122/97
acacgccagguga

SEQ ID NO: 3128583 - RNA, 14 nt, Mycobacterium bovis subsp bovis AF2122/97
acacgccgaugccg

SEQ ID NO: 3128584 - RNA, 13 nt, Mycobacterium bovis subsp bovis AF2122/97
acacgccgccggu

SEQ ID NO: 3128585 - RNA, 21 nt, Mycobacterium bovis subsp bovis AF2122/97
acacgccggcccggugaugaa

SEQ ID NO: 3128586 - RNA, 16 nt, Mycobacterium bovis subsp bovis AF2122/97
acacgccguuggggcc

SEQ ID NO: 3128587 - RNA, 12 nt, Mycobacterium bovis subsp bovis AF2122/97
acacgcgguccc

SEQ ID NO: 3128588 - RNA, 13 nt, Mycobacterium bovis subsp bovis AF2122/97
acacgcgugcacc

SEQ ID NO: 3128589 - RNA, 12 nt, Mycobacterium bovis subsp bovis AF2122/97
acacggcagcug

SEQ ID NO: 3128590 - RNA, 13 nt, Mycobacterium bovis subsp bovis AF2122/97
acacggccuugcc

SEQ ID NO: 3128591 - RNA, 13 nt, Mycobacterium bovis subsp bovis AF2122/97
acacggcgcugcc

SEQ ID NO: 3128592 - RNA, 20 nt, Mycobacterium bovis subsp bovis AF2122/97
acacggcgcugcccacgccg

SEQ ID NO: 3128593 - RNA, 18 nt, Mycobacterium bovis subsp bovis AF2122/97
acacggcucgccggcucg

SEQ ID NO: 3128594 - RNA, 21 nt, Mycobacterium bovis subsp bovis AF2122/97
acacgguacugugggcgaucg

SEQ ID NO: 3128595 - RNA, 17 nt, Mycobacterium bovis subsp bovis AF2122/97
acacggucaccggcacg

SEQ ID NO: 3128596 - RNA, 14 nt, Mycobacterium bovis subsp bovis AF2122/97
acacgguccgccac

SEQ ID NO: 3128597 - RNA, 15 nt, Mycobacterium bovis subsp bovis AF2122/97
acacggucgucgcga

SEQ ID NO: 3128598 - RNA, 17 nt, Mycobacterium bovis subsp bovis AF2122/97
acacggucgucgcgagc

SEQ ID NO: 3128599 - RNA, 17 nt, Mycobacterium bovis subsp bovis AF2122/97
acacggugcugccguug

SEQ ID NO: 3128600 - RNA, 20 nt, Mycobacterium bovis subsp bovis AF2122/97
acacgguguauugggguggc

SEQ ID NO: 3128601 - RNA, 14 nt, Mycobacterium bovis subsp bovis AF2122/97
acacguaccgacag

SEQ ID NO: 3128602 - RNA, 15 nt, Mycobacterium bovis subsp bovis AF2122/97
acacguccaguggca

SEQ ID NO: 3128603 - RNA, 21 nt, Mycobacterium bovis subsp bovis AF2122/97
acacguccaguggcagccagc

SEQ ID NO: 3128604 - RNA, 16 nt, Mycobacterium bovis subsp bovis AF2122/97
acacguccgcgcaccg

SEQ ID NO: 3128605 - RNA, 21 nt, Mycobacterium bovis subsp bovis AF2122/97
acacguccggcgaugaccaga

SEQ ID NO: 3128606 - RNA, 15 nt, Mycobacterium bovis subsp bovis AF2122/97
acacgucgacaccga

SEQ ID NO: 3128607 - RNA, 23 nt, Mycobacterium bovis subsp bovis AF2122/97
acacgucgcggguaaccggcucc

SEQ ID NO: 3128608 - RNA, 12 nt, Mycobacterium bovis subsp bovis AF2122/97
acacgucggcca

SEQ ID NO: 3128609 - RNA, 23 nt, Mycobacterium bovis subsp bovis AF2122/97
acacgucuaucuggucgggucgc

SEQ ID NO: 3128610 - RNA, 20 nt, Mycobacterium bovis subsp bovis AF2122/97
acacgugauagcuugcgucg

SEQ ID NO: 3128611 - RNA, 14 nt, Mycobacterium bovis subsp bovis AF2122/97
acacguucggcguc

SEQ ID NO: 3128612 - RNA, 15 nt, Mycobacterium bovis subsp bovis AF2122/97
acacguugacgaugu

SEQ ID NO: 3128613 - RNA, 16 nt, Mycobacterium bovis subsp bovis AF2122/97
acacguugacucgucg

SEQ ID NO: 3128614 - RNA, 21 nt, Mycobacterium bovis subsp bovis AF2122/97
acacguuggcggaugcccgca

SEQ ID NO: 3128615 - RNA, 19 nt, Mycobacterium bovis subsp bovis AF2122/97
acacguuucacguggucgg

SEQ ID NO: 3128616 - RNA, 20 nt, Mycobacterium bovis subsp bovis AF2122/97
acacuaaccgaauuguugua

SEQ ID NO: 3128617 - RNA, 18 nt, Mycobacterium bovis subsp bovis AF2122/97
acacuccugagaugcggc

SEQ ID NO: 3128618 - RNA, 19 nt, Mycobacterium bovis subsp bovis AF2122/97
acacuccugagaugcggcc

SEQ ID NO: 3128619 - RNA, 22 nt, Mycobacterium bovis subsp bovis AF2122/97
acacucgaagucgcccaguccc

SEQ ID NO: 3128620 - RNA, 12 nt, Mycobacterium bovis subsp bovis AF2122/97
acacucgcagca

SEQ ID NO: 3128621 - RNA, 12 nt, Mycobacterium bovis subsp bovis AF2122/97
acacucggccgg

SEQ ID NO: 3128622 - RNA, 19 nt, Mycobacterium bovis subsp bovis AF2122/97
acacugaguucggugcugu

SEQ ID NO: 3128623 - RNA, 21 nt, Mycobacterium bovis subsp bovis AF2122/97
acacugccggacagccacgca

SEQ ID NO: 3128624 - RNA, 23 nt, Mycobacterium bovis subsp bovis AF2122/97
acacugcgaaggaccagagcucg

SEQ ID NO: 3128625 - RNA, 14 nt, Mycobacterium bovis subsp bovis AF2122/97
acacugcugcggca

SEQ ID NO: 3128626 - RNA, 13 nt, Mycobacterium bovis subsp bovis AF2122/97
acacuggccgucg

SEQ ID NO: 3128627 - RNA, 19 nt, Mycobacterium bovis subsp bovis AF2122/97
acacuggccgucggcguga

SEQ ID NO: 3128628 - RNA, 22 nt, Mycobacterium bovis subsp bovis AF2122/97
acacuggggauaaacugccgcg

SEQ ID NO: 3128629 - RNA, 18 nt, Mycobacterium bovis subsp bovis AF2122/97
acacugguggugcccgga

SEQ ID NO: 3128630 - RNA, 21 nt, Mycobacterium bovis subsp bovis AF2122/97
acacuguuacuccgacggccc

SEQ ID NO: 3128631 - RNA, 16 nt, Mycobacterium bovis subsp bovis AF2122/97
acacuguucccacagg

SEQ ID NO: 3128632 - RNA, 16 nt, Mycobacterium bovis subsp bovis AF2122/97
acagcuggcggcagcg

SEQ ID NO: 3128633 - RNA, 16 nt, Mycobacterium bovis subsp bovis AF2122/97
acagcugggucggagu

SEQ ID NO: 3128634 - RNA, 18 nt, Mycobacterium bovis subsp bovis AF2122/97
acagcuucgcgcagccgg

SEQ ID NO: 3128635 - RNA, 19 nt, Mycobacterium bovis subsp bovis AF2122/97
acagcuucgcgcagccggu

SEQ ID NO: 3128636 - RNA, 23 nt, Mycobacterium bovis subsp bovis AF2122/97
acagcuugcccgagcccagccgg

SEQ ID NO: 3128637 - RNA, 20 nt, Mycobacterium bovis subsp bovis AF2122/97
acagcuugcgcagccgcagc

SEQ ID NO: 3128638 - RNA, 18 nt, Mycobacterium bovis subsp bovis AF2122/97
acagcuugcugcgcacca

SEQ ID NO: 3128639 - RNA, 23 nt, Mycobacterium bovis subsp bovis AF2122/97
acagcuuggacgugguguaucga

SEQ ID NO: 3128640 - RNA, 17 nt, Mycobacterium bovis subsp bovis AF2122/97
acagcuuggagaucgcc

SEQ ID NO: 3128641 - RNA, 22 nt, Mycobacterium bovis subsp bovis AF2122/97
acagcuuggagaucgccgccgg

SEQ ID NO: 3128642 - RNA, 14 nt, Mycobacterium bovis subsp bovis AF2122/97
acaggaagcgaccg

SEQ ID NO: 3128643 - RNA, 20 nt, Mycobacterium bovis subsp bovis AF2122/97
acaggaagcguugucgccca

SEQ ID NO: 3128644 - RNA, 19 nt, Mycobacterium bovis subsp bovis AF2122/97
acaggacaauggacaccaa

SEQ ID NO: 3128645 - RNA, 14 nt, Mycobacterium bovis subsp bovis AF2122/97
acaggccccacacc

SEQ ID NO: 3128646 - RNA, 19 nt, Mycobacterium bovis subsp bovis AF2122/97
acaggcccgccagcagggc

SEQ ID NO: 3128647 - RNA, 22 nt, Mycobacterium bovis subsp bovis AF2122/97
acaggcccugguagugaacgga

SEQ ID NO: 3128648 - RNA, 23 nt, Mycobacterium bovis subsp bovis AF2122/97
acaggccgaagcucacacuggcu

SEQ ID NO: 3128649 - RNA, 13 nt, Mycobacterium bovis subsp bovis AF2122/97
acaggccggccgc

SEQ ID NO: 3128650 - RNA, 19 nt, Mycobacterium bovis subsp bovis AF2122/97
acaggccguggcggacggc

SEQ ID NO: 3128651 - RNA, 18 nt, Mycobacterium bovis subsp bovis AF2122/97
acaggccuaggucgacgc

SEQ ID NO: 3128652 - RNA, 19 nt, Mycobacterium bovis subsp bovis AF2122/97
acaggccuaggucgacgcc

SEQ ID NO: 3128653 - RNA, 15 nt, Mycobacterium bovis subsp bovis AF2122/97
acaggcgacacauug

SEQ ID NO: 3128654 - RNA, 14 nt, Mycobacterium bovis subsp bovis AF2122/97
acaggcgaccgggg

SEQ ID NO: 3128655 - RNA, 16 nt, Mycobacterium bovis subsp bovis AF2122/97
acaggcgcccacaaau

SEQ ID NO: 3128656 - RNA, 14 nt, Mycobacterium bovis subsp bovis AF2122/97
acaggcggcgcugc

SEQ ID NO: 3128657 - RNA, 15 nt, Mycobacterium bovis subsp bovis AF2122/97
acaggcguccaucgc

SEQ ID NO: 3128658 - RNA, 13 nt, Mycobacterium bovis subsp bovis AF2122/97
acaggcugcugcg

SEQ ID NO: 3128659 - RNA, 20 nt, Mycobacterium bovis subsp bovis AF2122/97
acaggcuggcgauggccguc

SEQ ID NO: 3128660 - RNA, 15 nt, Mycobacterium bovis subsp bovis AF2122/97
acaggcuugacugca

SEQ ID NO: 3128661 - RNA, 19 nt, Mycobacterium bovis subsp bovis AF2122/97
acaggcuugacugcacacc

SEQ ID NO: 3128662 - RNA, 13 nt, Mycobacterium bovis subsp bovis AF2122/97
acaggcuuggcau

SEQ ID NO: 3128663 - RNA, 16 nt, Mycobacterium bovis subsp bovis AF2122/97
acagggaggucgccgc

SEQ ID NO: 3128664 - RNA, 15 nt, Mycobacterium bovis subsp bovis AF2122/97
acagggccagaucgc

SEQ ID NO: 3128665 - RNA, 17 nt, Mycobacterium bovis subsp bovis AF2122/97
acagggccagaucgccg

SEQ ID NO: 3128666 - RNA, 22 nt, Mycobacterium bovis subsp bovis AF2122/97
acagggugggggcaucaggguc

SEQ ID NO: 3128667 - RNA, 16 nt, Mycobacterium bovis subsp bovis AF2122/97
acagggugugcgaaca

SEQ ID NO: 3128668 - RNA, 13 nt, Mycobacterium bovis subsp bovis AF2122/97
acagguagucgcc

SEQ ID NO: 3128669 - RNA, 14 nt, Mycobacterium bovis subsp bovis AF2122/97
acagguagucgccg

SEQ ID NO: 3128670 - RNA, 16 nt, Mycobacterium bovis subsp bovis AF2122/97
acaggucagcgcugcc

SEQ ID NO: 3128671 - RNA, 13 nt, Mycobacterium bovis subsp bovis AF2122/97
acagguccggguu

SEQ ID NO: 3128672 - RNA, 14 nt, Mycobacterium bovis subsp bovis AF2122/97
acagguccugcgcc

SEQ ID NO: 3128673 - RNA, 23 nt, Mycobacterium bovis subsp bovis AF2122/97
acagguccugcgccgcacgccga

SEQ ID NO: 3128674 - RNA, 19 nt, Mycobacterium bovis subsp bovis AF2122/97
acaggucgcccaacaccgc

SEQ ID NO: 3128675 - RNA, 14 nt, Mycobacterium bovis subsp bovis AF2122/97
acaggucgccgggg

SEQ ID NO: 3128676 - RNA, 21 nt, Mycobacterium bovis subsp bovis AF2122/97
acaggugccagaccagggcag

SEQ ID NO: 3128677 - RNA, 21 nt, Mycobacterium bovis subsp bovis AF2122/97
acagguguuggacgccuugca

SEQ ID NO: 3128678 - RNA, 18 nt, Mycobacterium bovis subsp bovis AF2122/97
acagguuugcgccgcgca

SEQ ID NO: 3128679 - RNA, 14 nt, Mycobacterium bovis subsp bovis AF2122/97
acaguaggccuccg

SEQ ID NO: 3128680 - RNA, 22 nt, Mycobacterium bovis subsp bovis AF2122/97
acaguaucgccggaguuccgcc

SEQ ID NO: 3128681 - RNA, 15 nt, Mycobacterium bovis subsp bovis AF2122/97
acaguccgcgccggc

SEQ ID NO: 3128682 - RNA, 20 nt, Mycobacterium bovis subsp bovis AF2122/97
acagucgagugaagccgaca

SEQ ID NO: 3128683 - RNA, 14 nt, Mycobacterium bovis subsp bovis AF2122/97
acagucgcgcgcuc

SEQ ID NO: 3128684 - RNA, 15 nt, Mycobacterium bovis subsp bovis AF2122/97
acagucggugcagcg

SEQ ID NO: 3128685 - RNA, 20 nt, Mycobacterium bovis subsp bovis AF2122/97
acagugaaauccgagccgcg

SEQ ID NO: 3128686 - RNA, 20 nt, Mycobacterium bovis subsp bovis AF2122/97
acagugaccugggcgcccca

SEQ ID NO: 3128687 - RNA, 17 nt, Mycobacterium bovis subsp bovis AF2122/97
acagugacgccacgacc

SEQ ID NO: 3128688 - RNA, 21 nt, Mycobacterium bovis subsp bovis AF2122/97
acagugcgcggaucaacaggc

SEQ ID NO: 3128689 - RNA, 22 nt, Mycobacterium bovis subsp bovis AF2122/97
acaguggcucgcggaugcucgu

SEQ ID NO: 3128690 - RNA, 19 nt, Mycobacterium bovis subsp bovis AF2122/97
acagugucucacaaacugg

SEQ ID NO: 3128691 - RNA, 16 nt, Mycobacterium bovis subsp bovis AF2122/97
acaguuaucagccgcg

SEQ ID NO: 3128692 - RNA, 14 nt, Mycobacterium bovis subsp bovis AF2122/97
acaguucugccuua

SEQ ID NO: 3128693 - RNA, 13 nt, Mycobacterium bovis subsp bovis AF2122/97
acaguugcccgac

SEQ ID NO: 3128694 - RNA, 21 nt, Mycobacterium bovis subsp bovis AF2122/97
acauaagcgaggaucucggcg

SEQ ID NO: 3128695 - RNA, 21 nt, Mycobacterium bovis subsp bovis AF2122/97
acauaccggcgcauaccggcg

SEQ ID NO: 3128696 - RNA, 17 nt, Mycobacterium bovis subsp bovis AF2122/97
acauagaccucgccggu

SEQ ID NO: 3128697 - RNA, 12 nt, Mycobacterium bovis subsp bovis AF2122/97
acauagccgguc

SEQ ID NO: 3128698 - RNA, 20 nt, Mycobacterium bovis subsp bovis AF2122/97
acauagcgauucgcgcugcu

SEQ ID NO: 3128699 - RNA, 14 nt, Mycobacterium bovis subsp bovis AF2122/97
acauaggccaccuc

SEQ ID NO: 3128700 - RNA, 14 nt, Mycobacterium bovis subsp bovis AF2122/97
acaucaccaaaaac

SEQ ID NO: 3128701 - RNA, 18 nt, Mycobacterium bovis subsp bovis AF2122/97
acaucaccaccgccgggg

SEQ ID NO: 3128702 - RNA, 12 nt, Mycobacterium bovis subsp bovis AF2122/97
acaucaccgacc

SEQ ID NO: 3128703 - RNA, 14 nt, Mycobacterium bovis subsp bovis AF2122/97
acaucacucgcgcc

SEQ ID NO: 3128704 - RNA, 15 nt, Mycobacterium bovis subsp bovis AF2122/97
acaucagcaggacca

SEQ ID NO: 3128705 - RNA, 13 nt, Mycobacterium bovis subsp bovis AF2122/97
acauccacaccgc

SEQ ID NO: 3128706 - RNA, 16 nt, Mycobacterium bovis subsp bovis AF2122/97
acauccacaccgcggc

SEQ ID NO: 3128707 - RNA, 23 nt, Mycobacterium bovis subsp bovis AF2122/97
acauccagggccgagcagcuccu

SEQ ID NO: 3128708 - RNA, 15 nt, Mycobacterium bovis subsp bovis AF2122/97
acauccaucgccagu

SEQ ID NO: 3128709 - RNA, 16 nt, Mycobacterium bovis subsp bovis AF2122/97
acauccaucuccaugu

SEQ ID NO: 3128710 - RNA, 20 nt, Mycobacterium bovis subsp bovis AF2122/97
acaucccggaccgaugguug

SEQ ID NO: 3128711 - RNA, 17 nt, Mycobacterium bovis subsp bovis AF2122/97
acauccgacagcagccg

SEQ ID NO: 3128712 - RNA, 12 nt, Mycobacterium bovis subsp bovis AF2122/97
acauccgcggca

SEQ ID NO: 3128713 - RNA, 17 nt, Mycobacterium bovis subsp bovis AF2122/97
acauccgggccgagcgc

SEQ ID NO: 3128714 - RNA, 20 nt, Mycobacterium bovis subsp bovis AF2122/97
acauccgggccgagcgcacc

SEQ ID NO: 3128715 - RNA, 16 nt, Mycobacterium bovis subsp bovis AF2122/97
acauccugcagcucgg

SEQ ID NO: 3128716 - RNA, 20 nt, Mycobacterium bovis subsp bovis AF2122/97
acauccuugacgcggccaca

SEQ ID NO: 3128717 - RNA, 15 nt, Mycobacterium bovis subsp bovis AF2122/97
acaucgagaucgccg

SEQ ID NO: 3128718 - RNA, 23 nt, Mycobacterium bovis subsp bovis AF2122/97
acaucgagccaacgcgcagagcg

SEQ ID NO: 3128719 - RNA, 15 nt, Mycobacterium bovis subsp bovis AF2122/97
accaagcgugccugc

SEQ ID NO: 3128720 - RNA, 14 nt, Mycobacterium bovis subsp bovis AF2122/97
accaagcucggcca

SEQ ID NO: 3128721 - RNA, 19 nt, Mycobacterium bovis subsp bovis AF2122/97
accaagcucggccagcacg

SEQ ID NO: 3128722 - RNA, 21 nt, Mycobacterium bovis subsp bovis AF2122/97
accaagcucggccagcacgcc

SEQ ID NO: 3128723 - RNA, 16 nt, Mycobacterium bovis subsp bovis AF2122/97
accaaggacgaacgcg

SEQ ID NO: 3128724 - RNA, 16 nt, Mycobacterium bovis subsp bovis AF2122/97
accaaggccgagcgcg

SEQ ID NO: 3128725 - RNA, 20 nt, Mycobacterium bovis subsp bovis AF2122/97
accaagguacuugcgcaacc

SEQ ID NO: 3128726 - RNA, 12 nt, Mycobacterium bovis subsp bovis AF2122/97
accaaggucggc

SEQ ID NO: 3128727 - RNA, 14 nt, Mycobacterium bovis subsp bovis AF2122/97
accaaggucggcga

SEQ ID NO: 3128728 - RNA, 19 nt, Mycobacterium bovis subsp bovis AF2122/97
accaaggucuucaggccgc

SEQ ID NO: 3128729 - RNA, 19 nt, Mycobacterium bovis subsp bovis AF2122/97
accaagguguggccuugcg

SEQ ID NO: 3128730 - RNA, 23 nt, Mycobacterium bovis subsp bovis AF2122/97
accaagguuggucggugcugacc

SEQ ID NO: 3128731 - RNA, 16 nt, Mycobacterium bovis subsp bovis AF2122/97
accaaguagucggguu

SEQ ID NO: 3128732 - RNA, 23 nt, Mycobacterium bovis subsp bovis AF2122/97
accaaguccaacgacuguggcgc

SEQ ID NO: 3128733 - RNA, 18 nt, Mycobacterium bovis subsp bovis AF2122/97
accaauaccgcacccgcu

SEQ ID NO: 3128734 - RNA, 14 nt, Mycobacterium bovis subsp bovis AF2122/97
accaauccaggcca

SEQ ID NO: 3128735 - RNA, 15 nt, Mycobacterium bovis subsp bovis AF2122/97
accaauccaggccac

SEQ ID NO: 3128736 - RNA, 16 nt, Mycobacterium bovis subsp bovis AF2122/97
accaaugaccgccagc

SEQ ID NO: 3128737 - RNA, 18 nt, Mycobacterium bovis subsp bovis AF2122/97
accaaugaccgccagcag

SEQ ID NO: 3128738 - RNA, 15 nt, Mycobacterium bovis subsp bovis AF2122/97
accaaugcagugcga

SEQ ID NO: 3128739 - RNA, 23 nt, Mycobacterium bovis subsp bovis AF2122/97
accaaugcuccugguggcagaaa

SEQ ID NO: 3128740 - RNA, 19 nt, Mycobacterium bovis subsp bovis AF2122/97
accaauucccgcgcggcgu

SEQ ID NO: 3128741 - RNA, 21 nt, Mycobacterium bovis subsp bovis AF2122/97
accacaaccgugagcaccagc

SEQ ID NO: 3128742 - RNA, 23 nt, Mycobacterium bovis subsp bovis AF2122/97
accacaaccgugagcaccagcag

SEQ ID NO: 3128743 - RNA, 15 nt, Mycobacterium bovis subsp bovis AF2122/97
accacaauccacgca

SEQ ID NO: 3128744 - RNA, 21 nt, Mycobacterium bovis subsp bovis AF2122/97
accacaauccacgcacucguc

SEQ ID NO: 3128745 - RNA, 19 nt, Mycobacterium bovis subsp bovis AF2122/97
accacaccaaggccgagcg

SEQ ID NO: 3128746 - RNA, 15 nt, Mycobacterium bovis subsp bovis AF2122/97
accacaccggagccg

SEQ ID NO: 3128747 - RNA, 14 nt, Mycobacterium bovis subsp bovis AF2122/97
accacaccggcagc

SEQ ID NO: 3128748 - RNA, 18 nt, Mycobacterium bovis subsp bovis AF2122/97
accacagacugcgcggca

SEQ ID NO: 3128749 - RNA, 15 nt, Mycobacterium bovis subsp bovis AF2122/97
accacagugaaaucc

SEQ ID NO: 3128750 - RNA, 22 nt, Mycobacterium bovis subsp bovis AF2122/97
accacagugaaauccgagccgc

SEQ ID NO: 3128751 - RNA, 22 nt, Mycobacterium bovis subsp bovis AF2122/97
accacagugccaauuccagccc

SEQ ID NO: 3128752 - RNA, 17 nt, Mycobacterium bovis subsp bovis AF2122/97
accacaucaugccagcc

SEQ ID NO: 3128753 - RNA, 15 nt, Mycobacterium bovis subsp bovis AF2122/97
accacaucggugcca

SEQ ID NO: 3128754 - RNA, 16 nt, Mycobacterium bovis subsp bovis AF2122/97
accacaugcgagucgc

SEQ ID NO: 3128755 - RNA, 21 nt, Mycobacterium bovis subsp bovis AF2122/97
accacauuggcgaucagcagc

SEQ ID NO: 3128756 - RNA, 22 nt, Mycobacterium bovis subsp bovis AF2122/97
accacauuggugauggccgacg

SEQ ID NO: 3128757 - RNA, 13 nt, Mycobacterium bovis subsp bovis AF2122/97
accaccaccgccg

SEQ ID NO: 3128758 - RNA, 14 nt, Mycobacterium bovis subsp bovis AF2122/97
accaccaccgccgg

SEQ ID NO: 3128759 - RNA, 17 nt, Mycobacterium bovis subsp bovis AF2122/97
accaccaccgccggugc

SEQ ID NO: 3128760 - RNA, 22 nt, Mycobacterium bovis subsp bovis AF2122/97
accaccaccgccggugccgcca

SEQ ID NO: 3128761 - RNA, 11 nt, Mycobacterium bovis subsp bovis AF2122/97
accaccacgau

SEQ ID NO: 3128762 - RNA, 11 nt, Mycobacterium bovis subsp bovis AF2122/97
accaccacggc

SEQ ID NO: 3128763 - RNA, 15 nt, Mycobacterium bovis subsp bovis AF2122/97
accaccacggccaga

SEQ ID NO: 3128764 - RNA, 22 nt, Mycobacterium bovis subsp bovis AF2122/97
accaccacguggcccuccucgg

SEQ ID NO: 3128765 - RNA, 19 nt, Mycobacterium bovis subsp bovis AF2122/97
accaccacuaggucgccgg

SEQ ID NO: 3128766 - RNA, 20 nt, Mycobacterium bovis subsp bovis AF2122/97
accaccacuaggucgccggc

SEQ ID NO: 3128767 - RNA, 16 nt, Mycobacterium bovis subsp bovis AF2122/97
accaccacuucggcgc

SEQ ID NO: 3128768 - RNA, 18 nt, Mycobacterium bovis subsp bovis AF2122/97
accaccacuucggcgccg

SEQ ID NO: 3128769 - RNA, 12 nt, Mycobacterium bovis subsp bovis AF2122/97
accaccagcacg

SEQ ID NO: 3128770 - RNA, 20 nt, Mycobacterium bovis subsp bovis AF2122/97
accaccagcgugcugccgga

SEQ ID NO: 3128771 - RNA, 20 nt, Mycobacterium bovis subsp bovis AF2122/97
accaccagggcaacggccgc

SEQ ID NO: 3128772 - RNA, 21 nt, Mycobacterium bovis subsp bovis AF2122/97
accaccaguaccaccggcacc

SEQ ID NO: 3128773 - RNA, 23 nt, Mycobacterium bovis subsp bovis AF2122/97
accaccauucccggacccaccaa

SEQ ID NO: 3128774 - RNA, 13 nt, Mycobacterium bovis subsp bovis AF2122/97
accacccaacagc

SEQ ID NO: 3128775 - RNA, 14 nt, Mycobacterium bovis subsp bovis AF2122/97
accacccaacagcc

SEQ ID NO: 3128776 - RNA, 21 nt, Mycobacterium bovis subsp bovis AF2122/97
accacccaacagcccaccggu

SEQ ID NO: 3128777 - RNA, 16 nt, Mycobacterium bovis subsp bovis AF2122/97
accacccacccgcacc

SEQ ID NO: 3128778 - RNA, 17 nt, Mycobacterium bovis subsp bovis AF2122/97
accacccaccggccacc

SEQ ID NO: 3128779 - RNA, 19 nt, Mycobacterium bovis subsp bovis AF2122/97
accacccaccggccaccag

SEQ ID NO: 3128780 - RNA, 14 nt, Mycobacterium bovis subsp bovis AF2122/97
accacccagauugc

SEQ ID NO: 3128781 - RNA, 14 nt, Mycobacterium bovis subsp bovis AF2122/97
accacccaggccau

SEQ ID NO: 3128782 - RNA, 13 nt, Mycobacterium bovis subsp bovis AF2122/97
accaccccagggc

SEQ ID NO: 3128783 - RNA, 13 nt, Mycobacterium bovis subsp bovis AF2122/97
accacccccaccg

SEQ ID NO: 3128784 - RNA, 13 nt, Mycobacterium bovis subsp bovis AF2122/97
accaccccgaggc

SEQ ID NO: 3128785 - RNA, 15 nt, Mycobacterium bovis subsp bovis AF2122/97
accaccccggccaac

SEQ ID NO: 3128786 - RNA, 20 nt, Mycobacterium bovis subsp bovis AF2122/97
accaccccguagcggucucc

SEQ ID NO: 3128787 - RNA, 15 nt, Mycobacterium bovis subsp bovis AF2122/97
accacccgaccgcca

SEQ ID NO: 3128788 - RNA, 15 nt, Mycobacterium bovis subsp bovis AF2122/97
accacccgcaccuca

SEQ ID NO: 3128789 - RNA, 22 nt, Mycobacterium bovis subsp bovis AF2122/97
accacccgcacuccaagucaca

SEQ ID NO: 3128790 - RNA, 20 nt, Mycobacterium bovis subsp bovis AF2122/97
accacccggcgcgaauuccu

SEQ ID NO: 3128791 - RNA, 19 nt, Mycobacterium bovis subsp bovis AF2122/97
accacccgguccugcucgc

SEQ ID NO: 3128792 - RNA, 21 nt, Mycobacterium bovis subsp bovis AF2122/97
accaccgaaauacccagcgca

SEQ ID NO: 3128793 - RNA, 22 nt, Mycobacterium bovis subsp bovis AF2122/97
accaccgaaauacccagcgcag

SEQ ID NO: 3128794 - RNA, 15 nt, Mycobacterium bovis subsp bovis AF2122/97
accaccgacagcacc

SEQ ID NO: 3128795 - RNA, 13 nt, Mycobacterium bovis subsp bovis AF2122/97
accaccgaccucg

SEQ ID NO: 3128796 - RNA, 16 nt, Mycobacterium bovis subsp bovis AF2122/97
accaccgcaccugcga

SEQ ID NO: 3128797 - RNA, 17 nt, Mycobacterium bovis subsp bovis AF2122/97
accaccgccgacaggcc

SEQ ID NO: 3128798 - RNA, 14 nt, Mycobacterium bovis subsp bovis AF2122/97
accaccgccgccgg

SEQ ID NO: 3128799 - RNA, 15 nt, Mycobacterium bovis subsp bovis AF2122/97
accaccgccgccggc

SEQ ID NO: 3128800 - RNA, 22 nt, Mycobacterium bovis subsp bovis AF2122/97
accaccgccgccggcaccgccg

SEQ ID NO: 3128801 - RNA, 13 nt, Mycobacterium bovis subsp bovis AF2122/97
accaccgccggcc

SEQ ID NO: 3128802 - RNA, 12 nt, Mycobacterium bovis subsp bovis AF2122/97
accaccgccggu

SEQ ID NO: 3128803 - RNA, 14 nt, Mycobacterium bovis subsp bovis AF2122/97
accaccgccggugc

SEQ ID NO: 3128804 - RNA, 17 nt, Mycobacterium bovis subsp bovis AF2122/97
accaccgccuggaucag

SEQ ID NO: 3128805 - RNA, 15 nt, Mycobacterium bovis subsp bovis AF2122/97
accaccgcggcggcg

SEQ ID NO: 3128806 - RNA, 22 nt, Mycobacterium bovis subsp bovis AF2122/97
accacggucagcacgcugacca

SEQ ID NO: 3128807 - RNA, 19 nt, Mycobacterium bovis subsp bovis AF2122/97
accacgguggucccccgca

SEQ ID NO: 3128808 - RNA, 18 nt, Mycobacterium bovis subsp bovis AF2122/97
accacggugugcuaccaa

SEQ ID NO: 3128809 - RNA, 19 nt, Mycobacterium bovis subsp bovis AF2122/97
accacgguuggccaccagc

SEQ ID NO: 3128810 - RNA, 16 nt, Mycobacterium bovis subsp bovis AF2122/97
accacgucgaccgaac

SEQ ID NO: 3128811 - RNA, 22 nt, Mycobacterium bovis subsp bovis AF2122/97
accacgucgacgaugucgaaga

SEQ ID NO: 3128812 - RNA, 18 nt, Mycobacterium bovis subsp bovis AF2122/97
accacgucgagguccacc

SEQ ID NO: 3128813 - RNA, 19 nt, Mycobacterium bovis subsp bovis AF2122/97
accacgucgagguccacca

SEQ ID NO: 3128814 - RNA, 13 nt, Mycobacterium bovis subsp bovis AF2122/97
accacgucggcga

SEQ ID NO: 3128815 - RNA, 16 nt, Mycobacterium bovis subsp bovis AF2122/97
accacgugaucgacga

SEQ ID NO: 3128816 - RNA, 17 nt, Mycobacterium bovis subsp bovis AF2122/97
accacgugaucgacgac

SEQ ID NO: 3128817 - RNA, 14 nt, Mycobacterium bovis subsp bovis AF2122/97
accacgugcgccac

SEQ ID NO: 3128818 - RNA, 13 nt, Mycobacterium bovis subsp bovis AF2122/97
accacguggcccu

SEQ ID NO: 3128819 - RNA, 18 nt, Mycobacterium bovis subsp bovis AF2122/97
accacguugugcagcgcg

SEQ ID NO: 3128820 - RNA, 22 nt, Mycobacterium bovis subsp bovis AF2122/97
accacucgcggauccgggcgug

SEQ ID NO: 3128821 - RNA, 22 nt, Mycobacterium bovis subsp bovis AF2122/97
accacugaucggcauuccuuga

SEQ ID NO: 3128822 - RNA, 21 nt, Mycobacterium bovis subsp bovis AF2122/97
accacugcaugaacugcucgc

SEQ ID NO: 3128823 - RNA, 15 nt, Mycobacterium bovis subsp bovis AF2122/97
accacugcgcccgcc

SEQ ID NO: 3128824 - RNA, 15 nt, Mycobacterium bovis subsp bovis AF2122/97
accacuggacccgcc

SEQ ID NO: 3128825 - RNA, 16 nt, Mycobacterium bovis subsp bovis AF2122/97
accacuggauggcucg

SEQ ID NO: 3128826 - RNA, 14 nt, Mycobacterium bovis subsp bovis AF2122/97
accacuguuacggc

SEQ ID NO: 3128827 - RNA, 16 nt, Mycobacterium bovis subsp bovis AF2122/97
accacuguuggugccg

SEQ ID NO: 3128828 - RNA, 22 nt, Mycobacterium bovis subsp bovis AF2122/97
accacuguuggugccgccacca

SEQ ID NO: 3128829 - RNA, 19 nt, Mycobacterium bovis subsp bovis AF2122/97
accacuucccgcuugagca

SEQ ID NO: 3128830 - RNA, 20 nt, Mycobacterium bovis subsp bovis AF2122/97
accacuuccggcguggcccc

SEQ ID NO: 3128831 - RNA, 22 nt, Mycobacterium bovis subsp bovis AF2122/97
accacuucgcuuucccgucggc

SEQ ID NO: 3128832 - RNA, 17 nt, Mycobacterium bovis subsp bovis AF2122/97
accacuugcagcacaac

SEQ ID NO: 3128833 - RNA, 18 nt, Mycobacterium bovis subsp bovis AF2122/97
accacuugcagcacaacg

SEQ ID NO: 3128834 - RNA, 17 nt, Mycobacterium bovis subsp bovis AF2122/97
accacuuggguggcgcc

SEQ ID NO: 3128835 - RNA, 17 nt, Mycobacterium bovis subsp bovis AF2122/97
accagaaacaccgacga

SEQ ID NO: 3128836 - RNA, 18 nt, Mycobacterium bovis subsp bovis AF2122/97
accagaaacaccgacgac

SEQ ID NO: 3128837 - RNA, 20 nt, Mycobacterium bovis subsp bovis AF2122/97
accagaaacaccgacgacgg

SEQ ID NO: 3128838 - RNA, 14 nt, Mycobacterium bovis subsp bovis AF2122/97
accagaaccagcga

SEQ ID NO: 3128839 - RNA, 16 nt, Mycobacterium bovis subsp bovis AF2122/97
accagaaccagcgacc

SEQ ID NO: 3128840 - RNA, 22 nt, Mycobacterium bovis subsp bovis AF2122/97
accagacccacgauggcaaacg

SEQ ID NO: 3128841 - RNA, 17 nt, Mycobacterium bovis subsp bovis AF2122/97
accagacugcagugccg

SEQ ID NO: 3128842 - RNA, 20 nt, Mycobacterium bovis subsp bovis AF2122/97
accagagcgucgaacacguc

SEQ ID NO: 3128843 - RNA, 20 nt, Mycobacterium bovis subsp bovis AF2122/97
accagaggcgugucgacucc

SEQ ID NO: 3128844 - RNA, 17 nt, Mycobacterium bovis subsp bovis AF2122/97
accagaggucacgcagc

SEQ ID NO: 3128845 - RNA, 14 nt, Mycobacterium bovis subsp bovis AF2122/97
accagaguucggcc

SEQ ID NO: 3128846 - RNA, 22 nt, Mycobacterium bovis subsp bovis AF2122/97
accagauagaucgugaucgacc

SEQ ID NO: 3128847 - RNA, 18 nt, Mycobacterium bovis subsp bovis AF2122/97
accagaucuucgagcgca

SEQ ID NO: 3128848 - RNA, 12 nt, Mycobacterium bovis subsp bovis AF2122/97
accagcaacagc

SEQ ID NO: 3128849 - RNA, 21 nt, Mycobacterium bovis subsp bovis AF2122/97
accagcaacagcccgaggcca

SEQ ID NO: 3128850 - RNA, 17 nt, Mycobacterium bovis subsp bovis AF2122/97
accagcaaccaccccag

SEQ ID NO: 3128851 - RNA, 22 nt, Mycobacterium bovis subsp bovis AF2122/97
accagcaaccaccccagggcaa

SEQ ID NO: 3128852 - RNA, 13 nt, Mycobacterium bovis subsp bovis AF2122/97
accagcaaugccg

SEQ ID NO: 3128853 - RNA, 14 nt, Mycobacterium bovis subsp bovis AF2122/97
accagcacacccgu

SEQ ID NO: 3128854 - RNA, 17 nt, Mycobacterium bovis subsp bovis AF2122/97
accagcacaccgcccgc

SEQ ID NO: 3128855 - RNA, 19 nt, Mycobacterium bovis subsp bovis AF2122/97
accagcacaccgcccgcac

SEQ ID NO: 3128856 - RNA, 12 nt, Mycobacterium bovis subsp bovis AF2122/97
accagcaccccg

SEQ ID NO: 3128857 - RNA, 13 nt, Mycobacterium bovis subsp bovis AF2122/97
accagcacccgcu

SEQ ID NO: 3128858 - RNA, 14 nt, Mycobacterium bovis subsp bovis AF2122/97
accagcaccgccgc

SEQ ID NO: 3128859 - RNA, 18 nt, Mycobacterium bovis subsp bovis AF2122/97
accagcaccgccgcgccg

SEQ ID NO: 3128860 - RNA, 19 nt, Mycobacterium bovis subsp bovis AF2122/97
accagcaccgccgcugcca

SEQ ID NO: 3128861 - RNA, 20 nt, Mycobacterium bovis subsp bovis AF2122/97
accagcaccgccgcugccau

SEQ ID NO: 3128862 - RNA, 14 nt, Mycobacterium bovis subsp bovis AF2122/97
accagcacgacugc

SEQ ID NO: 3128863 - RNA, 18 nt, Mycobacterium bovis subsp bovis AF2122/97
accagcacggcaaccagc

SEQ ID NO: 3128864 - RNA, 19 nt, Mycobacterium bovis subsp bovis AF2122/97
accagcagaccaagcccua

SEQ ID NO: 3128865 - RNA, 23 nt, Mycobacterium bovis subsp bovis AF2122/97
accagcagacgccguagccggcc

SEQ ID NO: 3128866 - RNA, 16 nt, Mycobacterium bovis subsp bovis AF2122/97
accagcagauccaggc

SEQ ID NO: 3128867 - RNA, 16 nt, Mycobacterium bovis subsp bovis AF2122/97
accagcagcaccaacu

SEQ ID NO: 3128868 - RNA, 12 nt, Mycobacterium bovis subsp bovis AF2122/97
accagcagcacu

SEQ ID NO: 3128869 - RNA, 17 nt, Mycobacterium bovis subsp bovis AF2122/97
accagcagcacuccggc

SEQ ID NO: 3128870 - RNA, 15 nt, Mycobacterium bovis subsp bovis AF2122/97
accagcagccagccc

SEQ ID NO: 3128871 - RNA, 21 nt, Mycobacterium bovis subsp bovis AF2122/97
accagcaggcccuggccaccc

SEQ ID NO: 3128872 - RNA, 16 nt, Mycobacterium bovis subsp bovis AF2122/97
accagcaggccgggcg

SEQ ID NO: 3128873 - RNA, 20 nt, Mycobacterium bovis subsp bovis AF2122/97
accagcauucucgccgacgg

SEQ ID NO: 3128874 - RNA, 18 nt, Mycobacterium bovis subsp bovis AF2122/97
accagccaaaacgagcag

SEQ ID NO: 3128875 - RNA, 14 nt, Mycobacterium bovis subsp bovis AF2122/97
accagccaccacca

SEQ ID NO: 3128876 - RNA, 18 nt, Mycobacterium bovis subsp bovis AF2122/97
accagccaccaccagguc

SEQ ID NO: 3128877 - RNA, 15 nt, Mycobacterium bovis subsp bovis AF2122/97
accagccagcgagga

SEQ ID NO: 3128878 - RNA, 18 nt, Mycobacterium bovis subsp bovis AF2122/97
accagccaggugauuacc

SEQ ID NO: 3128879 - RNA, 19 nt, Mycobacterium bovis subsp bovis AF2122/97
accagcccaccggcgccgc

SEQ ID NO: 3128880 - RNA, 22 nt, Mycobacterium bovis subsp bovis AF2122/97
accagcccgaugaucccgccac

SEQ ID NO: 3128881 - RNA, 16 nt, Mycobacterium bovis subsp bovis AF2122/97
accagcccggccgccg

SEQ ID NO: 3128882 - RNA, 18 nt, Mycobacterium bovis subsp bovis AF2122/97
accagcccggccgccgag

SEQ ID NO: 3128883 - RNA, 15 nt, Mycobacterium bovis subsp bovis AF2122/97
accagccgaucauca

SEQ ID NO: 3128884 - RNA, 16 nt, Mycobacterium bovis subsp bovis AF2122/97
accagccgggcaaggc

SEQ ID NO: 3128885 - RNA, 23 nt, Mycobacterium bovis subsp bovis AF2122/97
accagccggucuuggacagcagc

SEQ ID NO: 3128886 - RNA, 13 nt, Mycobacterium bovis subsp bovis AF2122/97
accagccggugag

SEQ ID NO: 3128887 - RNA, 14 nt, Mycobacterium bovis subsp bovis AF2122/97
accagccggugagc

SEQ ID NO: 3128888 - RNA, 22 nt, Mycobacterium bovis subsp bovis AF2122/97
accagccggugagcgagcgcgc

SEQ ID NO: 3128889 - RNA, 24 nt, Mycobacterium bovis subsp bovis AF2122/97
accagccggugagcgagcgcgcgu

SEQ ID NO: 3128890 - RNA, 23 nt, Mycobacterium bovis subsp bovis AF2122/97
accagccgguuggcugccggcaa

SEQ ID NO: 3128891 - RNA, 21 nt, Mycobacterium bovis subsp bovis AF2122/97
accagccgucguccgcugacc

SEQ ID NO: 3128892 - RNA, 13 nt, Mycobacterium bovis subsp bovis AF2122/97
accaggggcgcgu

SEQ ID NO: 3128893 - RNA, 20 nt, Mycobacterium bovis subsp bovis AF2122/97
accaggggucgcugugcagc

SEQ ID NO: 3128894 - RNA, 23 nt, Mycobacterium bovis subsp bovis AF2122/97
accagggugacggaguuggcccg

SEQ ID NO: 3128895 - RNA, 18 nt, Mycobacterium bovis subsp bovis AF2122/97
accagggugccggcggug

SEQ ID NO: 3128896 - RNA, 13 nt, Mycobacterium bovis subsp bovis AF2122/97
accaggguggcau

SEQ ID NO: 3128897 - RNA, 16 nt, Mycobacterium bovis subsp bovis AF2122/97
accaggguggcaucga

SEQ ID NO: 3128898 - RNA, 18 nt, Mycobacterium bovis subsp bovis AF2122/97
accaggguguauggccac

SEQ ID NO: 3128899 - RNA, 20 nt, Mycobacterium bovis subsp bovis AF2122/97
accaggguuggcaccgucag

SEQ ID NO: 3128900 - RNA, 18 nt, Mycobacterium bovis subsp bovis AF2122/97
accagguaaucaccuggc

SEQ ID NO: 3128901 - RNA, 16 nt, Mycobacterium bovis subsp bovis AF2122/97
accagguaaugguggc

SEQ ID NO: 3128902 - RNA, 17 nt, Mycobacterium bovis subsp bovis AF2122/97
accagguacgcgaucag

SEQ ID NO: 3128903 - RNA, 20 nt, Mycobacterium bovis subsp bovis AF2122/97
accagguacgcgaucagcgc

SEQ ID NO: 3128904 - RNA, 15 nt, Mycobacterium bovis subsp bovis AF2122/97
accagguacgggagc

SEQ ID NO: 3128905 - RNA, 22 nt, Mycobacterium bovis subsp bovis AF2122/97
accagguacgggagcccgagcu

SEQ ID NO: 3128906 - RNA, 15 nt, Mycobacterium bovis subsp bovis AF2122/97
accagguccaccccg

SEQ ID NO: 3128907 - RNA, 18 nt, Mycobacterium bovis subsp bovis AF2122/97
accaggucgauaagggcu

SEQ ID NO: 3128908 - RNA, 17 nt, Mycobacterium bovis subsp bovis AF2122/97
accaggucgccagcucg

SEQ ID NO: 3128909 - RNA, 15 nt, Mycobacterium bovis subsp bovis AF2122/97
accaggucggucagg

SEQ ID NO: 3128910 - RNA, 17 nt, Mycobacterium bovis subsp bovis AF2122/97
accaggucggucagguc

SEQ ID NO: 3128911 - RNA, 21 nt, Mycobacterium bovis subsp bovis AF2122/97
accaggucggugugcaucgcc

SEQ ID NO: 3128912 - RNA, 19 nt, Mycobacterium bovis subsp bovis AF2122/97
accaggucgugcccgggac

SEQ ID NO: 3128913 - RNA, 18 nt, Mycobacterium bovis subsp bovis AF2122/97
accaggugcccgccccga

SEQ ID NO: 3128914 - RNA, 20 nt, Mycobacterium bovis subsp bovis AF2122/97
accaggugccgugaucgcug

SEQ ID NO: 3128915 - RNA, 16 nt, Mycobacterium bovis subsp bovis AF2122/97
accagguggccaggcc

SEQ ID NO: 3128916 - RNA, 16 nt, Mycobacterium bovis subsp bovis AF2122/97
accagguugguuucga

SEQ ID NO: 3128917 - RNA, 15 nt, Mycobacterium bovis subsp bovis AF2122/97
accaguaaugcccau

SEQ ID NO: 3128918 - RNA, 18 nt, Mycobacterium bovis subsp bovis AF2122/97
accaguaccaccggcacc

SEQ ID NO: 3128919 - RNA, 19 nt, Mycobacterium bovis subsp bovis AF2122/97
accaguaccgucaucgcgg

SEQ ID NO: 3128920 - RNA, 13 nt, Mycobacterium bovis subsp bovis AF2122/97
accagucgaagaa

SEQ ID NO: 3128921 - RNA, 16 nt, Mycobacterium bovis subsp bovis AF2122/97
accagugaucagcgca

SEQ ID NO: 3128922 - RNA, 11 nt, Mycobacterium bovis subsp bovis AF2122/97
accagugcccc

SEQ ID NO: 3128923 - RNA, 20 nt, Mycobacterium bovis subsp bovis AF2122/97
accagugccccgccgagcgg

SEQ ID NO: 3128924 - RNA, 15 nt, Mycobacterium bovis subsp bovis AF2122/97
accagugcgguggca

SEQ ID NO: 3128925 - RNA, 13 nt, Mycobacterium bovis subsp bovis AF2122/97
accaguggcgccc

SEQ ID NO: 3128926 - RNA, 24 nt, Mycobacterium bovis subsp bovis AF2122/97
accagugguuuugggcgauuuugc

SEQ ID NO: 3128927 - RNA, 20 nt, Mycobacterium bovis subsp bovis AF2122/97
accaguguggcgaugaccac

SEQ ID NO: 3128928 - RNA, 21 nt, Mycobacterium bovis subsp bovis AF2122/97
accaguguggcgaugaccacg

SEQ ID NO: 3128929 - RNA, 18 nt, Mycobacterium bovis subsp bovis AF2122/97
accauacccgcgcgcacc

SEQ ID NO: 3128930 - RNA, 17 nt, Mycobacterium bovis subsp bovis AF2122/97
accauacucaccgacgc

SEQ ID NO: 3128931 - RNA, 16 nt, Mycobacterium bovis subsp bovis AF2122/97
accaucacacccauca

SEQ ID NO: 3128932 - RNA, 23 nt, Mycobacterium bovis subsp bovis AF2122/97
accaucaccgccuuugccgccgg

SEQ ID NO: 3128933 - RNA, 14 nt, Mycobacterium bovis subsp bovis AF2122/97
accaucaccgcgcc

SEQ ID NO: 3128934 - RNA, 22 nt, Mycobacterium bovis subsp bovis AF2122/97
accaucaccgcgccagccucca

SEQ ID NO: 3128935 - RNA, 23 nt, Mycobacterium bovis subsp bovis AF2122/97
accaucaccgcgccagccuccac

SEQ ID NO: 3128936 - RNA, 14 nt, Mycobacterium bovis subsp bovis AF2122/97
accaucaccggugc

SEQ ID NO: 3128937 - RNA, 20 nt, Mycobacterium bovis subsp bovis AF2122/97
accaucacgguggccgcacg

SEQ ID NO: 3128938 - RNA, 22 nt, Mycobacterium bovis subsp bovis AF2122/97
accaucaucaccucucgcuugc

SEQ ID NO: 3128939 - RNA, 13 nt, Mycobacterium bovis subsp bovis AF2122/97
accaucaucucgg

SEQ ID NO: 3128940 - RNA, 17 nt, Mycobacterium bovis subsp bovis AF2122/97
accauccagcccauccc

SEQ ID NO: 3128941 - RNA, 19 nt, Mycobacterium bovis subsp bovis AF2122/97
accaucgacccgaucacgc

SEQ ID NO: 3128942 - RNA, 17 nt, Mycobacterium bovis subsp bovis AF2122/97
accaucgaggcgaucac

SEQ ID NO: 3128943 - RNA, 20 nt, Mycobacterium bovis subsp bovis AF2122/97
accaucgaggcgaucaccgc

SEQ ID NO: 3128944 - RNA, 21 nt, Mycobacterium bovis subsp bovis AF2122/97
accaucgaggcgaucaccgcg

SEQ ID NO: 3128945 - RNA, 23 nt, Mycobacterium bovis subsp bovis AF2122/97
accaucgaggcgaucaccgcgcc

SEQ ID NO: 3128946 - RNA, 14 nt, Mycobacterium bovis subsp bovis AF2122/97
accaucgccagccg

SEQ ID NO: 3128947 - RNA, 18 nt, Mycobacterium bovis subsp bovis AF2122/97
accaucgccagccggcga

SEQ ID NO: 3128948 - RNA, 14 nt, Mycobacterium bovis subsp bovis AF2122/97
accaucgccgccgc

SEQ ID NO: 3128949 - RNA, 14 nt, Mycobacterium bovis subsp bovis AF2122/97
accaucgccgccgu

SEQ ID NO: 3128950 - RNA, 21 nt, Mycobacterium bovis subsp bovis AF2122/97
accaucgccgccguugccgcc

SEQ ID NO: 3128951 - RNA, 18 nt, Mycobacterium bovis subsp bovis AF2122/97
accaucgcgacggcaagc

SEQ ID NO: 3128952 - RNA, 20 nt, Mycobacterium bovis subsp bovis AF2122/97
accaucgcuugcgcacggau

SEQ ID NO: 3128953 - RNA, 18 nt, Mycobacterium bovis subsp bovis AF2122/97
accaucgguggccaucgc

SEQ ID NO: 3128954 - RNA, 17 nt, Mycobacterium bovis subsp bovis AF2122/97
accaucguugccggugc

SEQ ID NO: 3128955 - RNA, 19 nt, Mycobacterium bovis subsp bovis AF2122/97
accaucguugccggugccg

SEQ ID NO: 3128956 - RNA, 23 nt, Mycobacterium bovis subsp bovis AF2122/97
accaucguugccggugccgccgc

SEQ ID NO: 3128957 - RNA, 16 nt, Mycobacterium bovis subsp bovis AF2122/97
accaucucaccgggcc

SEQ ID NO: 3128958 - RNA, 21 nt, Mycobacterium bovis subsp bovis AF2122/97
accaucuccggugugaucggc

SEQ ID NO: 3128959 - RNA, 20 nt, Mycobacterium bovis subsp bovis AF2122/97
accaucuguuccgugccagc

SEQ ID NO: 3128960 - RNA, 17 nt, Mycobacterium bovis subsp bovis AF2122/97
accaucuucacgaagug

SEQ ID NO: 3128961 - RNA, 16 nt, Mycobacterium bovis subsp bovis AF2122/97
accaugaccaccaagg

SEQ ID NO: 3128962 - RNA, 21 nt, Mycobacterium bovis subsp bovis AF2122/97
accaugaucacaccgagcgca

SEQ ID NO: 3128963 - RNA, 17 nt, Mycobacterium bovis subsp bovis AF2122/97
accaugauugccaggac

SEQ ID NO: 3128964 - RNA, 16 nt, Mycobacterium bovis subsp bovis AF2122/97
accaugccgaucggcc

SEQ ID NO: 3128965 - RNA, 13 nt, Mycobacterium bovis subsp bovis AF2122/97
accaugccgucgu

SEQ ID NO: 3128966 - RNA, 18 nt, Mycobacterium bovis subsp bovis AF2122/97
accaugccgucgucggcg

SEQ ID NO: 3128967 - RNA, 19 nt, Mycobacterium bovis subsp bovis AF2122/97
accaugcgguuagcagccg

SEQ ID NO: 3128968 - RNA, 16 nt, Mycobacterium bovis subsp bovis AF2122/97
accauggcgccgcgcc

SEQ ID NO: 3128969 - RNA, 23 nt, Mycobacterium bovis subsp bovis AF2122/97
accauggcggcuccgcccggcgu

SEQ ID NO: 3128970 - RNA, 17 nt, Mycobacterium bovis subsp bovis AF2122/97
accaugguugaugacgg

SEQ ID NO: 3128971 - RNA, 22 nt, Mycobacterium bovis subsp bovis AF2122/97
accauguauuucucccagccca

SEQ ID NO: 3128972 - RNA, 18 nt, Mycobacterium bovis subsp bovis AF2122/97
accaugucggccacccgg

SEQ ID NO: 3128973 - RNA, 12 nt, Mycobacterium bovis subsp bovis AF2122/97
accauucggcga

SEQ ID NO: 3128974 - RNA, 23 nt, Mycobacterium bovis subsp bovis AF2122/97
acccaaaaugccuuggcagccca

SEQ ID NO: 3128975 - RNA, 11 nt, Mycobacterium bovis subsp bovis AF2122/97
acccaacacca

SEQ ID NO: 3128976 - RNA, 16 nt, Mycobacterium bovis subsp bovis AF2122/97
acccaacaccagcagc

SEQ ID NO: 3128977 - RNA, 16 nt, Mycobacterium bovis subsp bovis AF2122/97
acccaacccggcggca

SEQ ID NO: 3128978 - RNA, 16 nt, Mycobacterium bovis subsp bovis AF2122/97
acccaggcacaacauc

SEQ ID NO: 3128979 - RNA, 19 nt, Mycobacterium bovis subsp bovis AF2122/97
acccaggcacaacaucgcc

SEQ ID NO: 3128980 - RNA, 17 nt, Mycobacterium bovis subsp bovis AF2122/97
acccaggccgucgcgcc

SEQ ID NO: 3128981 - RNA, 18 nt, Mycobacterium bovis subsp bovis AF2122/97
acccagggccuucccgau

SEQ ID NO: 3128982 - RNA, 20 nt, Mycobacterium bovis subsp bovis AF2122/97
acccagggcguuggcggcuu

SEQ ID NO: 3128983 - RNA, 16 nt, Mycobacterium bovis subsp bovis AF2122/97
acccaggugucgcugc

SEQ ID NO: 3128984 - RNA, 12 nt, Mycobacterium bovis subsp bovis AF2122/97
acccaguccggu

SEQ ID NO: 3128985 - RNA, 16 nt, Mycobacterium bovis subsp bovis AF2122/97
acccagucggcgccgc

SEQ ID NO: 3128986 - RNA, 17 nt, Mycobacterium bovis subsp bovis AF2122/97
acccagugucagcaaga

SEQ ID NO: 3128987 - RNA, 22 nt, Mycobacterium bovis subsp bovis AF2122/97
acccauaucgauaaccgcgacc

SEQ ID NO: 3128988 - RNA, 13 nt, Mycobacterium bovis subsp bovis AF2122/97
acccaucaacauc

SEQ ID NO: 3128989 - RNA, 16 nt, Mycobacterium bovis subsp bovis AF2122/97
acccaucaacaucggc

SEQ ID NO: 3128990 - RNA, 18 nt, Mycobacterium bovis subsp bovis AF2122/97
acccaucaacgccggcga

SEQ ID NO: 3128991 - RNA, 14 nt, Mycobacterium bovis subsp bovis AF2122/97
acccaucaccagcg

SEQ ID NO: 3128992 - RNA, 14 nt, Mycobacterium bovis subsp bovis AF2122/97
acccaucaccgcca

SEQ ID NO: 3128993 - RNA, 22 nt, Mycobacterium bovis subsp bovis AF2122/97
acccaucaccgccagccccgcg

SEQ ID NO: 3128994 - RNA, 18 nt, Mycobacterium bovis subsp bovis AF2122/97
acccaucaucgccaccac

SEQ ID NO: 3128995 - RNA, 20 nt, Mycobacterium bovis subsp bovis AF2122/97
acccauccggcucgguggcg

SEQ ID NO: 3128996 - RNA, 21 nt, Mycobacterium bovis subsp bovis AF2122/97
acccauccucgcggugcgcca

SEQ ID NO: 3128997 - RNA, 15 nt, Mycobacterium bovis subsp bovis AF2122/97
acccaucgaccgccc

SEQ ID NO: 3128998 - RNA, 19 nt, Mycobacterium bovis subsp bovis AF2122/97
acccaucgaccgcccgcca

SEQ ID NO: 3128999 - RNA, 20 nt, Mycobacterium bovis subsp bovis AF2122/97
acccaucgaccgcccgccag

SEQ ID NO: 3129000 - RNA, 21 nt, Mycobacterium bovis subsp bovis AF2122/97
acccaucgaccgcccgccagc

SEQ ID NO: 3129001 - RNA, 15 nt, Mycobacterium bovis subsp bovis AF2122/97
acccaucgccacacc

SEQ ID NO: 3129002 - RNA, 16 nt, Mycobacterium bovis subsp bovis AF2122/97
acccaucgccacaccc

SEQ ID NO: 3129003 - RNA, 20 nt, Mycobacterium bovis subsp bovis AF2122/97
acccaucgucgagccgccag

SEQ ID NO: 3129004 - RNA, 16 nt, Mycobacterium bovis subsp bovis AF2122/97
acccaucucgaaggug

SEQ ID NO: 3129005 - RNA, 16 nt, Mycobacterium bovis subsp bovis AF2122/97
acccaugaugugcagc

SEQ ID NO: 3129006 - RNA, 13 nt, Mycobacterium bovis subsp bovis AF2122/97
acccaugcaugcg

SEQ ID NO: 3129007 - RNA, 15 nt, Mycobacterium bovis subsp bovis AF2122/97
acccaugcaugcguu

SEQ ID NO: 3129008 - RNA, 21 nt, Mycobacterium bovis subsp bovis AF2122/97
acccauggccucccacucacc

SEQ ID NO: 3129009 - RNA, 19 nt, Mycobacterium bovis subsp bovis AF2122/97
acccauucucggccggcgg

SEQ ID NO: 3129010 - RNA, 16 nt, Mycobacterium bovis subsp bovis AF2122/97
acccauuucgucagcg

SEQ ID NO: 3129011 - RNA, 17 nt, Mycobacterium bovis subsp bovis AF2122/97
accccaacagggcggca

SEQ ID NO: 3129012 - RNA, 17 nt, Mycobacterium bovis subsp bovis AF2122/97
accccaaguccagcagc

SEQ ID NO: 3129013 - RNA, 16 nt, Mycobacterium bovis subsp bovis AF2122/97
accccaaucgaccgcc

SEQ ID NO: 3129014 - RNA, 21 nt, Mycobacterium bovis subsp bovis AF2122/97
accccaaucgaccgcccgcca

SEQ ID NO: 3129015 - RNA, 16 nt, Mycobacterium bovis subsp bovis AF2122/97
accccacacagucggu

SEQ ID NO: 3129016 - RNA, 20 nt, Mycobacterium bovis subsp bovis AF2122/97
accccacacccgggacgaac

SEQ ID NO: 3129017 - RNA, 14 nt, Mycobacterium bovis subsp bovis AF2122/97
accccacggccagu

SEQ ID NO: 3129018 - RNA, 20 nt, Mycobacterium bovis subsp bovis AF2122/97
accccacuggcacacgguca

SEQ ID NO: 3129019 - RNA, 15 nt, Mycobacterium bovis subsp bovis AF2122/97
accccagccggcagc

SEQ ID NO: 3129020 - RNA, 13 nt, Mycobacterium bovis subsp bovis AF2122/97
accccagcgccac

SEQ ID NO: 3129021 - RNA, 14 nt, Mycobacterium bovis subsp bovis AF2122/97
accccagcggccac

SEQ ID NO: 3129022 - RNA, 15 nt, Mycobacterium bovis subsp bovis AF2122/97
accccagcggccacc

SEQ ID NO: 3129023 - RNA, 20 nt, Mycobacterium bovis subsp bovis AF2122/97
accccagcggccaccgaggc

SEQ ID NO: 3129024 - RNA, 19 nt, Mycobacterium bovis subsp bovis AF2122/97
accccagucggccaagcug

SEQ ID NO: 3129025 - RNA, 22 nt, Mycobacterium bovis subsp bovis AF2122/97
accccauaaucacaucgcccgg

SEQ ID NO: 3129026 - RNA, 15 nt, Mycobacterium bovis subsp bovis AF2122/97
accccauggccaccg

SEQ ID NO: 3129027 - RNA, 16 nt, Mycobacterium bovis subsp bovis AF2122/97
accccauggccaccga

SEQ ID NO: 3129028 - RNA, 13 nt, Mycobacterium bovis subsp bovis AF2122/97
accccauggccag

SEQ ID NO: 3129029 - RNA, 16 nt, Mycobacterium bovis subsp bovis AF2122/97
accccauggccagcgc

SEQ ID NO: 3129030 - RNA, 16 nt, Mycobacterium bovis subsp bovis AF2122/97
acccccaaccgccggc

SEQ ID NO: 3129031 - RNA, 23 nt, Mycobacterium bovis subsp bovis AF2122/97
acccccaacugcgaaacgccacc

SEQ ID NO: 3129032 - RNA, 17 nt, Mycobacterium bovis subsp bovis AF2122/97
acccccagcaaaggggu

SEQ ID NO: 3129033 - RNA, 15 nt, Mycobacterium bovis subsp bovis AF2122/97
acccccagcacccgg

SEQ ID NO: 3129034 - RNA, 13 nt, Mycobacterium bovis subsp bovis AF2122/97
acccccagcgccc

SEQ ID NO: 3129035 - RNA, 21 nt, Mycobacterium bovis subsp bovis AF2122/97
acccccaggcgcucagcgcgg

SEQ ID NO: 3129036 - RNA, 16 nt, Mycobacterium bovis subsp bovis AF2122/97
accccccagcgacggc

SEQ ID NO: 3129037 - RNA, 13 nt, Mycobacterium bovis subsp bovis AF2122/97
accccccagcgcc

SEQ ID NO: 3129038 - RNA, 20 nt, Mycobacterium bovis subsp bovis AF2122/97
acccccccccccacccacca

SEQ ID NO: 3129039 - RNA, 16 nt, Mycobacterium bovis subsp bovis AF2122/97
accccccgggcccgcc

SEQ ID NO: 3129040 - RNA, 17 nt, Mycobacterium bovis subsp bovis AF2122/97
acccccgauagcgaccg

SEQ ID NO: 3129041 - RNA, 18 nt, Mycobacterium bovis subsp bovis AF2122/97
acccccgauagcgaccgc

SEQ ID NO: 3129042 - RNA, 22 nt, Mycobacterium bovis subsp bovis AF2122/97
acccccgucgaucagcggcagc

SEQ ID NO: 3129043 - RNA, 17 nt, Mycobacterium bovis subsp bovis AF2122/97
acccccgucgccaccga

SEQ ID NO: 3129044 - RNA, 21 nt, Mycobacterium bovis subsp bovis AF2122/97
acccccgucgccaccgauggc

SEQ ID NO: 3129045 - RNA, 13 nt, Mycobacterium bovis subsp bovis AF2122/97
acccccugacggc

SEQ ID NO: 3129046 - RNA, 15 nt, Mycobacterium bovis subsp bovis AF2122/97
acccccugccacagc

SEQ ID NO: 3129047 - RNA, 14 nt, Mycobacterium bovis subsp bovis AF2122/97
acccccuucacccu

SEQ ID NO: 3129048 - RNA, 15 nt, Mycobacterium bovis subsp bovis AF2122/97
accccgaacauccgc

SEQ ID NO: 3129049 - RNA, 19 nt, Mycobacterium bovis subsp bovis AF2122/97
accccgaacauccgccgcc

SEQ ID NO: 3129050 - RNA, 21 nt, Mycobacterium bovis subsp bovis AF2122/97
accccgaacauugcgcccagc

SEQ ID NO: 3129051 - RNA, 24 nt, Mycobacterium bovis subsp bovis AF2122/97
accccgaagaugccugcuagcagc

SEQ ID NO: 3129052 - RNA, 23 nt, Mycobacterium bovis subsp bovis AF2122/97
accccgaauagucggcaucgcga

SEQ ID NO: 3129053 - RNA, 14 nt, Mycobacterium bovis subsp bovis AF2122/97
accccgaccaccag

SEQ ID NO: 3129054 - RNA, 17 nt, Mycobacterium bovis subsp bovis AF2122/97
accccgaccucccggca

SEQ ID NO: 3129055 - RNA, 15 nt, Mycobacterium bovis subsp bovis AF2122/97
accccgacgaugcgc

SEQ ID NO: 3129056 - RNA, 15 nt, Mycobacterium bovis subsp bovis AF2122/97
accccgagccgcagc

SEQ ID NO: 3129057 - RNA, 23 nt, Mycobacterium bovis subsp bovis AF2122/97
accccgagccgcagcucgccgag

SEQ ID NO: 3129058 - RNA, 12 nt, Mycobacterium bovis subsp bovis AF2122/97
accccgagccgu

SEQ ID NO: 3129059 - RNA, 16 nt, Mycobacterium bovis subsp bovis AF2122/97
accccgagccuugagc

SEQ ID NO: 3129060 - RNA, 14 nt, Mycobacterium bovis subsp bovis AF2122/97
accccgagcggagc

SEQ ID NO: 3129061 - RNA, 19 nt, Mycobacterium bovis subsp bovis AF2122/97
accccgagcggagccgccg

SEQ ID NO: 3129062 - RNA, 19 nt, Mycobacterium bovis subsp bovis AF2122/97
accccgagcucaccaaggu

SEQ ID NO: 3129063 - RNA, 12 nt, Mycobacterium bovis subsp bovis AF2122/97
accccgagcugc

SEQ ID NO: 3129064 - RNA, 13 nt, Mycobacterium bovis subsp bovis AF2122/97
accccgaggccga

SEQ ID NO: 3129065 - RNA, 15 nt, Mycobacterium bovis subsp bovis AF2122/97
acccgagccggcacg

SEQ ID NO: 3129066 - RNA, 18 nt, Mycobacterium bovis subsp bovis AF2122/97
acccgagccggcacgcgc

SEQ ID NO: 3129067 - RNA, 13 nt, Mycobacterium bovis subsp bovis AF2122/97
acccgagcgaugc

SEQ ID NO: 3129068 - RNA, 21 nt, Mycobacterium bovis subsp bovis AF2122/97
acccgagcgcucgaucacggc

SEQ ID NO: 3129069 - RNA, 21 nt, Mycobacterium bovis subsp bovis AF2122/97
acccgagcuugggccggugca

SEQ ID NO: 3129070 - RNA, 23 nt, Mycobacterium bovis subsp bovis AF2122/97
acccgagggccugacgcgucagc

SEQ ID NO: 3129071 - RNA, 21 nt, Mycobacterium bovis subsp bovis AF2122/97
acccgaguuauagaagccgac

SEQ ID NO: 3129072 - RNA, 23 nt, Mycobacterium bovis subsp bovis AF2122/97
acccgaguuauagaagccgacgu

SEQ ID NO: 3129073 - RNA, 21 nt, Mycobacterium bovis subsp bovis AF2122/97
acccgauaacaaggccgccgc

SEQ ID NO: 3129074 - RNA, 16 nt, Mycobacterium bovis subsp bovis AF2122/97
acccgaucaaugcggu

SEQ ID NO: 3129075 - RNA, 24 nt, Mycobacterium bovis subsp bovis AF2122/97
acccgaucaccuucggccgaccgg

SEQ ID NO: 3129076 - RNA, 15 nt, Mycobacterium bovis subsp bovis AF2122/97
acccgaucagguacg

SEQ ID NO: 3129077 - RNA, 19 nt, Mycobacterium bovis subsp bovis AF2122/97
acccgaucagguacgccag

SEQ ID NO: 3129078 - RNA, 15 nt, Mycobacterium bovis subsp bovis AF2122/97
acccgaucgcgccag

SEQ ID NO: 3129079 - RNA, 15 nt, Mycobacterium bovis subsp bovis AF2122/97
acccgaucgucgagc

SEQ ID NO: 3129080 - RNA, 17 nt, Mycobacterium bovis subsp bovis AF2122/97
acccgaucucugcggcg

SEQ ID NO: 3129081 - RNA, 17 nt, Mycobacterium bovis subsp bovis AF2122/97
acccgaugacccacugc

SEQ ID NO: 3129082 - RNA, 18 nt, Mycobacterium bovis subsp bovis AF2122/97
acccgaugcgucucgcgc

SEQ ID NO: 3129083 - RNA, 17 nt, Mycobacterium bovis subsp bovis AF2122/97
acccgauuggccaaccc

SEQ ID NO: 3129084 - RNA, 19 nt, Mycobacterium bovis subsp bovis AF2122/97
acccgcaacgacugaucaa

SEQ ID NO: 3129085 - RNA, 16 nt, Mycobacterium bovis subsp bovis AF2122/97
acccgcaacuacggcg

SEQ ID NO: 3129086 - RNA, 14 nt, Mycobacterium bovis subsp bovis AF2122/97
acccgcaaugaccg

SEQ ID NO: 3129087 - RNA, 17 nt, Mycobacterium bovis subsp bovis AF2122/97
acccgcaaugaccgcgg

SEQ ID NO: 3129088 - RNA, 13 nt, Mycobacterium bovis subsp bovis AF2122/97
acccgcaaugcgc

SEQ ID NO: 3129089 - RNA, 21 nt, Mycobacterium bovis subsp bovis AF2122/97
acccgcaaugcgcgcgauggc

SEQ ID NO: 3129090 - RNA, 21 nt, Mycobacterium bovis subsp bovis AF2122/97
acccgcaauuccggugaucgc

SEQ ID NO: 3129091 - RNA, 13 nt, Mycobacterium bovis subsp bovis AF2122/97
acccgcaccaccg

SEQ ID NO: 3129092 - RNA, 14 nt, Mycobacterium bovis subsp bovis AF2122/97
acccgcaccaccgg

SEQ ID NO: 3129093 - RNA, 12 nt, Mycobacterium bovis subsp bovis AF2122/97
acccgcaccccg

SEQ ID NO: 3129094 - RNA, 15 nt, Mycobacterium bovis subsp bovis AF2122/97
acccgcaccccggcc

SEQ ID NO: 3129095 - RNA, 13 nt, Mycobacterium bovis subsp bovis AF2122/97
acccgcaccgccg

SEQ ID NO: 3129096 - RNA, 21 nt, Mycobacterium bovis subsp bovis AF2122/97
acccgcaccgcgguacgccgg

SEQ ID NO: 3129097 - RNA, 20 nt, Mycobacterium bovis subsp bovis AF2122/97
acccgcaccggugacgcaca

SEQ ID NO: 3129098 - RNA, 14 nt, Mycobacterium bovis subsp bovis AF2122/97
acccgcacggccuc

SEQ ID NO: 3129099 - RNA, 17 nt, Mycobacterium bovis subsp bovis AF2122/97
acccgcacggccuccgg

SEQ ID NO: 3129100 - RNA, 17 nt, Mycobacterium bovis subsp bovis AF2122/97
acccgcacuccaaguca

SEQ ID NO: 3129101 - RNA, 22 nt, Mycobacterium bovis subsp bovis AF2122/97
acccgcacuccacgaucggccc

SEQ ID NO: 3129102 - RNA, 17 nt, Mycobacterium bovis subsp bovis AF2122/97
acccgcagaccgccacc

SEQ ID NO: 3129103 - RNA, 13 nt, Mycobacterium bovis subsp bovis AF2122/97
acccgcagaccgg

SEQ ID NO: 3129104 - RNA, 18 nt, Mycobacterium bovis subsp bovis AF2122/97
acccgcagccgcgagucc

SEQ ID NO: 3129105 - RNA, 14 nt, Mycobacterium bovis subsp bovis AF2122/97
acccgcagccgcgc

SEQ ID NO: 3129106 - RNA, 17 nt, Mycobacterium bovis subsp bovis AF2122/97
acccgcagcuguggccc

SEQ ID NO: 3129107 - RNA, 20 nt, Mycobacterium bovis subsp bovis AF2122/97
acccgcagcuguggcccacu

SEQ ID NO: 3129108 - RNA, 12 nt, Mycobacterium bovis subsp bovis AF2122/97
acccgcagggca

SEQ ID NO: 3129109 - RNA, 20 nt, Mycobacterium bovis subsp bovis AF2122/97
acccgcagguagucgucgac

SEQ ID NO: 3129110 - RNA, 21 nt, Mycobacterium bovis subsp bovis AF2122/97
acccgcaggucgaucugcgcc

SEQ ID NO: 3129111 - RNA, 13 nt, Mycobacterium bovis subsp bovis AF2122/97
acccgcaggucgc

SEQ ID NO: 3129112 - RNA, 16 nt, Mycobacterium bovis subsp bovis AF2122/97
acccgcaggucgcacc

SEQ ID NO: 3129113 - RNA, 14 nt, Mycobacterium bovis subsp bovis AF2122/97
acccgcagucgguc

SEQ ID NO: 3129114 - RNA, 15 nt, Mycobacterium bovis subsp bovis AF2122/97
acccgcaguggucgg

SEQ ID NO: 3129115 - RNA, 22 nt, Mycobacterium bovis subsp bovis AF2122/97
acccgcaucggaaucgcgagcu

SEQ ID NO: 3129116 - RNA, 15 nt, Mycobacterium bovis subsp bovis AF2122/97
acccgcaugacgccg

SEQ ID NO: 3129117 - RNA, 18 nt, Mycobacterium bovis subsp bovis AF2122/97
acccgcaugacgccggcg

SEQ ID NO: 3129118 - RNA, 14 nt, Mycobacterium bovis subsp bovis AF2122/97
acccgcauggacgc

SEQ ID NO: 3129119 - RNA, 17 nt, Mycobacterium bovis subsp bovis AF2122/97
acccgcauggacgcgau

SEQ ID NO: 3129120 - RNA, 17 nt, Mycobacterium bovis subsp bovis AF2122/97
acccgcauggcagcggc

SEQ ID NO: 3129121 - RNA, 18 nt, Mycobacterium bovis subsp bovis AF2122/97
acccgcauggcagcggcg

SEQ ID NO: 3129122 - RNA, 13 nt, Mycobacterium bovis subsp bovis AF2122/97
acccgccaccgcg

SEQ ID NO: 3129123 - RNA, 19 nt, Mycobacterium bovis subsp bovis AF2122/97
acccgccaccgcgacaccc

SEQ ID NO: 3129124 - RNA, 22 nt, Mycobacterium bovis subsp bovis AF2122/97
acccgccaccgcgacaccccgg

SEQ ID NO: 3129125 - RNA, 21 nt, Mycobacterium bovis subsp bovis AF2122/97
acccgccacgguucgggcagc

SEQ ID NO: 3129126 - RNA, 22 nt, Mycobacterium bovis subsp bovis AF2122/97
acccgccagaugaugccacccu

SEQ ID NO: 3129127 - RNA, 22 nt, Mycobacterium bovis subsp bovis AF2122/97
acccgccaggccgcgcgacaac

SEQ ID NO: 3129128 - RNA, 18 nt, Mycobacterium bovis subsp bovis AF2122/97
acccgccagggcggcauc

SEQ ID NO: 3129129 - RNA, 20 nt, Mycobacterium bovis subsp bovis AF2122/97
acccgcccaggcguccauca

SEQ ID NO: 3129130 - RNA, 22 nt, Mycobacterium bovis subsp bovis AF2122/97
acccgcccgagaguggacgugu

SEQ ID NO: 3129131 - RNA, 16 nt, Mycobacterium bovis subsp bovis AF2122/97
acccgcccuugccgcc

SEQ ID NO: 3129132 - RNA, 17 nt, Mycobacterium bovis subsp bovis AF2122/97
acccgcccuugccgccg

SEQ ID NO: 3129133 - RNA, 18 nt, Mycobacterium bovis subsp bovis AF2122/97
acccgccgacgccgccgg

SEQ ID NO: 3129134 - RNA, 16 nt, Mycobacterium bovis subsp bovis AF2122/97
acccgccgaugaugcg

SEQ ID NO: 3129135 - RNA, 17 nt, Mycobacterium bovis subsp bovis AF2122/97
acccgccgaugaugcgg

SEQ ID NO: 3129136 - RNA, 20 nt, Mycobacterium bovis subsp bovis AF2122/97
acccgccgaugaugcggcgc

SEQ ID NO: 3129137 - RNA, 17 nt, Mycobacterium bovis subsp bovis AF2122/97
acccgccgaugcugccg

SEQ ID NO: 3129138 - RNA, 13 nt, Mycobacterium bovis subsp bovis AF2122/97
acccgccgcccca

SEQ ID NO: 3129139 - RNA, 16 nt, Mycobacterium bovis subsp bovis AF2122/97
acccgccgccgcccgg

SEQ ID NO: 3129140 - RNA, 13 nt, Mycobacterium bovis subsp bovis AF2122/97
acccgccgcgaug

SEQ ID NO: 3129141 - RNA, 16 nt, Mycobacterium bovis subsp bovis AF2122/97
acccgccgcgcccggc

SEQ ID NO: 3129142 - RNA, 17 nt, Mycobacterium bovis subsp bovis AF2122/97
acccgccgcgcccggcg

SEQ ID NO: 3129143 - RNA, 16 nt, Mycobacterium bovis subsp bovis AF2122/97
acccgccgcggacacc

SEQ ID NO: 3129144 - RNA, 20 nt, Mycobacterium bovis subsp bovis AF2122/97
acccgccgcgguuaucgccg

SEQ ID NO: 3129145 - RNA, 23 nt, Mycobacterium bovis subsp bovis AF2122/97
acccgccggccgucggccggaug

SEQ ID NO: 3129146 - RNA, 21 nt, Mycobacterium bovis subsp bovis AF2122/97
acccgccggcgacugcagcga

SEQ ID NO: 3129147 - RNA, 17 nt, Mycobacterium bovis subsp bovis AF2122/97
acccgccggguccgccg

SEQ ID NO: 3129148 - RNA, 21 nt, Mycobacterium bovis subsp bovis AF2122/97
acccgccggguccgccgggcc

SEQ ID NO: 3129149 - RNA, 20 nt, Mycobacterium bovis subsp bovis AF2122/97
acccgccgugcccccggcuu

SEQ ID NO: 3129150 - RNA, 23 nt, Mycobacterium bovis subsp bovis AF2122/97
acccgccguugccaccggugccg

SEQ ID NO: 3129151 - RNA, 15 nt, Mycobacterium bovis subsp bovis AF2122/97
acccggcgucgacga

SEQ ID NO: 3129152 - RNA, 19 nt, Mycobacterium bovis subsp bovis AF2122/97
acccggcgugagcuccgca

SEQ ID NO: 3129153 - RNA, 16 nt, Mycobacterium bovis subsp bovis AF2122/97
acccggcuccagcacc

SEQ ID NO: 3129154 - RNA, 19 nt, Mycobacterium bovis subsp bovis AF2122/97
acccggcuguucucgccga

SEQ ID NO: 3129155 - RNA, 18 nt, Mycobacterium bovis subsp bovis AF2122/97
acccggcuucgccgcgcu

SEQ ID NO: 3129156 - RNA, 12 nt, Mycobacterium bovis subsp bovis AF2122/97
acccgggaagga

SEQ ID NO: 3129157 - RNA, 13 nt, Mycobacterium bovis subsp bovis AF2122/97
acccgggcagccu

SEQ ID NO: 3129158 - RNA, 19 nt, Mycobacterium bovis subsp bovis AF2122/97
acccgggcagccugcugca

SEQ ID NO: 3129159 - RNA, 13 nt, Mycobacterium bovis subsp bovis AF2122/97
acccgggccacgu

SEQ ID NO: 3129160 - RNA, 16 nt, Mycobacterium bovis subsp bovis AF2122/97
acccgggccacgucga

SEQ ID NO: 3129161 - RNA, 18 nt, Mycobacterium bovis subsp bovis AF2122/97
acccgggccacgucgagc

SEQ ID NO: 3129162 - RNA, 19 nt, Mycobacterium bovis subsp bovis AF2122/97
acccgggccacgucgagca

SEQ ID NO: 3129163 - RNA, 15 nt, Mycobacterium bovis subsp bovis AF2122/97
acccgggccgcggcg

SEQ ID NO: 3129164 - RNA, 16 nt, Mycobacterium bovis subsp bovis AF2122/97
acccgggccgcggcgg

SEQ ID NO: 3129165 - RNA, 17 nt, Mycobacterium bovis subsp bovis AF2122/97
acccgggccgcggcggc

SEQ ID NO: 3129166 - RNA, 16 nt, Mycobacterium bovis subsp bovis AF2122/97
acccgggccgggccga

SEQ ID NO: 3129167 - RNA, 21 nt, Mycobacterium bovis subsp bovis AF2122/97
acccgggccggucggugagcc

SEQ ID NO: 3129168 - RNA, 18 nt, Mycobacterium bovis subsp bovis AF2122/97
acccgggccucggcgccg

SEQ ID NO: 3129169 - RNA, 15 nt, Mycobacterium bovis subsp bovis AF2122/97
acccgggccugggac

SEQ ID NO: 3129170 - RNA, 17 nt, Mycobacterium bovis subsp bovis AF2122/97
acccgggcgaccuccgg

SEQ ID NO: 3129171 - RNA, 20 nt, Mycobacterium bovis subsp bovis AF2122/97
acccgggcgagcgcggccug

SEQ ID NO: 3129172 - RNA, 14 nt, Mycobacterium bovis subsp bovis AF2122/97
acccgggcguccca

SEQ ID NO: 3129173 - RNA, 16 nt, Mycobacterium bovis subsp bovis AF2122/97
acccgggcgugggugu

SEQ ID NO: 3129174 - RNA, 17 nt, Mycobacterium bovis subsp bovis AF2122/97
acccggggggccucguu

SEQ ID NO: 3129175 - RNA, 16 nt, Mycobacterium bovis subsp bovis AF2122/97
acccggggugcccggc

SEQ ID NO: 3129176 - RNA, 17 nt, Mycobacterium bovis subsp bovis AF2122/97
acccggggugcccggcc

SEQ ID NO: 3129177 - RNA, 18 nt, Mycobacterium bovis subsp bovis AF2122/97
acccggggugcccggccg

SEQ ID NO: 3129178 - RNA, 18 nt, Mycobacterium bovis subsp bovis AF2122/97
acccggguagacaccgcg

SEQ ID NO: 3129179 - RNA, 19 nt, Mycobacterium bovis subsp bovis AF2122/97
acccggguagacaccgcga

SEQ ID NO: 3129180 - RNA, 11 nt, Mycobacterium bovis subsp bovis AF2122/97
acccgggucgg

SEQ ID NO: 3129181 - RNA, 14 nt, Mycobacterium bovis subsp bovis AF2122/97
acccgggucggcac

SEQ ID NO: 3129182 - RNA, 15 nt, Mycobacterium bovis subsp bovis AF2122/97
acccgguaacgccau

SEQ ID NO: 3129183 - RNA, 19 nt, Mycobacterium bovis subsp bovis AF2122/97
acccgguaacgccaucguc

SEQ ID NO: 3129184 - RNA, 19 nt, Mycobacterium bovis subsp bovis AF2122/97
acccgguaccucaacacca

SEQ ID NO: 3129185 - RNA, 22 nt, Mycobacterium bovis subsp bovis AF2122/97
acccgguaccucaacaccaggc

SEQ ID NO: 3129186 - RNA, 16 nt, Mycobacterium bovis subsp bovis AF2122/97
acccgguaguccgcgc

SEQ ID NO: 3129187 - RNA, 16 nt, Mycobacterium bovis subsp bovis AF2122/97
acccgguaugcgcguc

SEQ ID NO: 3129188 - RNA, 20 nt, Mycobacterium bovis subsp bovis AF2122/97
acccgguaugcgcgucccca

SEQ ID NO: 3129189 - RNA, 18 nt, Mycobacterium bovis subsp bovis AF2122/97
acccggucaacgugaacu

SEQ ID NO: 3129190 - RNA, 15 nt, Mycobacterium bovis subsp bovis AF2122/97
acccgguccagccgg

SEQ ID NO: 3129191 - RNA, 16 nt, Mycobacterium bovis subsp bovis AF2122/97
acccgguccagccggu

SEQ ID NO: 3129192 - RNA, 18 nt, Mycobacterium bovis subsp bovis AF2122/97
acccgguccauucguccg

SEQ ID NO: 3129193 - RNA, 18 nt, Mycobacterium bovis subsp bovis AF2122/97
acccggucccccgaagug

SEQ ID NO: 3129194 - RNA, 15 nt, Mycobacterium bovis subsp bovis AF2122/97
acccgguccggcccg

SEQ ID NO: 3129195 - RNA, 20 nt, Mycobacterium bovis subsp bovis AF2122/97
acccgguccggcccggggac

SEQ ID NO: 3129196 - RNA, 22 nt, Mycobacterium bovis subsp bovis AF2122/97
acccgguccugcucgcacagca

SEQ ID NO: 3129197 - RNA, 16 nt, Mycobacterium bovis subsp bovis AF2122/97
acccggucgacggguc

SEQ ID NO: 3129198 - RNA, 23 nt, Mycobacterium bovis subsp bovis AF2122/97
acccggucgacgggucggcgccg

SEQ ID NO: 3129199 - RNA, 19 nt, Mycobacterium bovis subsp bovis AF2122/97
acccggucgauucggcuca

SEQ ID NO: 3129200 - RNA, 13 nt, Mycobacterium bovis subsp bovis AF2122/97
acccggucgccgg

SEQ ID NO: 3129201 - RNA, 18 nt, Mycobacterium bovis subsp bovis AF2122/97
acccggucggccauccac

SEQ ID NO: 3129202 - RNA, 23 nt, Mycobacterium bovis subsp bovis AF2122/97
acccggucggccauccaccgcag

SEQ ID NO: 3129203 - RNA, 15 nt, Mycobacterium bovis subsp bovis AF2122/97
acccggucggcggca

SEQ ID NO: 3129204 - RNA, 16 nt, Mycobacterium bovis subsp bovis AF2122/97
acccggucggcggcau

SEQ ID NO: 3129205 - RNA, 15 nt, Mycobacterium bovis subsp bovis AF2122/97
acccggugaccagca

SEQ ID NO: 3129206 - RNA, 20 nt, Mycobacterium bovis subsp bovis AF2122/97
acccggugacccgcugggcc

SEQ ID NO: 3129207 - RNA, 19 nt, Mycobacterium bovis subsp bovis AF2122/97
acccggugaugguggcggu

SEQ ID NO: 3129208 - RNA, 23 nt, Mycobacterium bovis subsp bovis AF2122/97
acccggugaugguggcgguuccg

SEQ ID NO: 3129209 - RNA, 20 nt, Mycobacterium bovis subsp bovis AF2122/97
acccggugauggugugcagc

SEQ ID NO: 3129210 - RNA, 23 nt, Mycobacterium bovis subsp bovis AF2122/97
acccggugauggugugcagcagc

SEQ ID NO: 3129211 - RNA, 15 nt, Mycobacterium bovis subsp bovis AF2122/97
acccggugccgcagc

SEQ ID NO: 3129212 - RNA, 16 nt, Mycobacterium bovis subsp bovis AF2122/97
acccggugccgcagca

SEQ ID NO: 3129213 - RNA, 19 nt, Mycobacterium bovis subsp bovis AF2122/97
acccgguggcguuugaugc

SEQ ID NO: 3129214 - RNA, 11 nt, Mycobacterium bovis subsp bovis AF2122/97
acccgguggcu

SEQ ID NO: 3129215 - RNA, 13 nt, Mycobacterium bovis subsp bovis AF2122/97
acccgguguugag

SEQ ID NO: 3129216 - RNA, 22 nt, Mycobacterium bovis subsp bovis AF2122/97
acccgguguugagcgaacccgc

SEQ ID NO: 3129217 - RNA, 23 nt, Mycobacterium bovis subsp bovis AF2122/97
acccgguguugagcgaacccgcg

SEQ ID NO: 3129218 - RNA, 17 nt, Mycobacterium bovis subsp bovis AF2122/97
acccgguuauggcaagc

SEQ ID NO: 3129219 - RNA, 14 nt, Mycobacterium bovis subsp bovis AF2122/97
acccgguugugcgc

SEQ ID NO: 3129220 - RNA, 22 nt, Mycobacterium bovis subsp bovis AF2122/97
acccguacccacgacgggccga

SEQ ID NO: 3129221 - RNA, 20 nt, Mycobacterium bovis subsp bovis AF2122/97
acccguagcuuggcgaucuc

SEQ ID NO: 3129222 - RNA, 22 nt, Mycobacterium bovis subsp bovis AF2122/97
acccguagguaguuguccagga

SEQ ID NO: 3129223 - RNA, 19 nt, Mycobacterium bovis subsp bovis AF2122/97
acccguauugccaaagccc

SEQ ID NO: 3129224 - RNA, 18 nt, Mycobacterium bovis subsp bovis AF2122/97
acccgucacaagcugaca

SEQ ID NO: 3129225 - RNA, 15 nt, Mycobacterium bovis subsp bovis AF2122/97
acccgucaugcccac

SEQ ID NO: 3129226 - RNA, 20 nt, Mycobacterium bovis subsp bovis AF2122/97
acccgucaugcccaccgccu

SEQ ID NO: 3129227 - RNA, 20 nt, Mycobacterium bovis subsp bovis AF2122/97
acccguccaacuacgccagc

SEQ ID NO: 3129228 - RNA, 23 nt, Mycobacterium bovis subsp bovis AF2122/97
acccgucccacgugugcggaagc

SEQ ID NO: 3129229 - RNA, 13 nt, Mycobacterium bovis subsp bovis AF2122/97
acccguccgccgc

SEQ ID NO: 3129230 - RNA, 14 nt, Mycobacterium bovis subsp bovis AF2122/97
acccgucgaacgcg

SEQ ID NO: 3129231 - RNA, 17 nt, Mycobacterium bovis subsp bovis AF2122/97
acccgucgagcagcaug

SEQ ID NO: 3129232 - RNA, 13 nt, Mycobacterium bovis subsp bovis AF2122/97
acccgucgagccg

SEQ ID NO: 3129233 - RNA, 13 nt, Mycobacterium bovis subsp bovis AF2122/97
acccgucggcccg

SEQ ID NO: 3129234 - RNA, 23 nt, Mycobacterium bovis subsp bovis AF2122/97
acccgucuuaucggcgucguaga

SEQ ID NO: 3129235 - RNA, 14 nt, Mycobacterium bovis subsp bovis AF2122/97
acccgugagcucgu

SEQ ID NO: 3129236 - RNA, 16 nt, Mycobacterium bovis subsp bovis AF2122/97
acccgugcacgaucgc

SEQ ID NO: 3129237 - RNA, 17 nt, Mycobacterium bovis subsp bovis AF2122/97
acccgugcacgaucgcg

SEQ ID NO: 3129238 - RNA, 19 nt, Mycobacterium bovis subsp bovis AF2122/97
accgacaccgugucgccgg

SEQ ID NO: 3129239 - RNA, 21 nt, Mycobacterium bovis subsp bovis AF2122/97
accgacaccgugucgccggcg

SEQ ID NO: 3129240 - RNA, 17 nt, Mycobacterium bovis subsp bovis AF2122/97
accgacaccguguugcu

SEQ ID NO: 3129241 - RNA, 23 nt, Mycobacterium bovis subsp bovis AF2122/97
accgacagccccaucaccaccgg

SEQ ID NO: 3129242 - RNA, 15 nt, Mycobacterium bovis subsp bovis AF2122/97
accgacaucgucauc

SEQ ID NO: 3129243 - RNA, 14 nt, Mycobacterium bovis subsp bovis AF2122/97
accgaccaccgcga

SEQ ID NO: 3129244 - RNA, 20 nt, Mycobacterium bovis subsp bovis AF2122/97
accgaccacgcgagggcauc

SEQ ID NO: 3129245 - RNA, 12 nt, Mycobacterium bovis subsp bovis AF2122/97
accgaccagccg

SEQ ID NO: 3129246 - RNA, 23 nt, Mycobacterium bovis subsp bovis AF2122/97
accgaccagggccgccgcugccg

SEQ ID NO: 3129247 - RNA, 15 nt, Mycobacterium bovis subsp bovis AF2122/97
accgacccggccgcu

SEQ ID NO: 3129248 - RNA, 15 nt, Mycobacterium bovis subsp bovis AF2122/97
accgaccgaaagccg

SEQ ID NO: 3129249 - RNA, 14 nt, Mycobacterium bovis subsp bovis AF2122/97
accgaccgcaugau

SEQ ID NO: 3129250 - RNA, 18 nt, Mycobacterium bovis subsp bovis AF2122/97
accgaccgcaugaucgca

SEQ ID NO: 3129251 - RNA, 20 nt, Mycobacterium bovis subsp bovis AF2122/97
accgaccgcaugaucgcacc

SEQ ID NO: 3129252 - RNA, 12 nt, Mycobacterium bovis subsp bovis AF2122/97
accgaccgcguu

SEQ ID NO: 3129253 - RNA, 22 nt, Mycobacterium bovis subsp bovis AF2122/97
accgaccgcguuguccgcggcc

SEQ ID NO: 3129254 - RNA, 15 nt, Mycobacterium bovis subsp bovis AF2122/97
accgaccggcucacg

SEQ ID NO: 3129255 - RNA, 14 nt, Mycobacterium bovis subsp bovis AF2122/97
accgaccgggucgc

SEQ ID NO: 3129256 - RNA, 20 nt, Mycobacterium bovis subsp bovis AF2122/97
accgaccgggucgcaaccgc

SEQ ID NO: 3129257 - RNA, 22 nt, Mycobacterium bovis subsp bovis AF2122/97
accgaccgggucgcaaccgccg

SEQ ID NO: 3129258 - RNA, 22 nt, Mycobacterium bovis subsp bovis AF2122/97
accgaccuacugcggucgccca

SEQ ID NO: 3129259 - RNA, 18 nt, Mycobacterium bovis subsp bovis AF2122/97
accgaccucggcgaccgc

SEQ ID NO: 3129260 - RNA, 15 nt, Mycobacterium bovis subsp bovis AF2122/97
accgacgacgcgcgc

SEQ ID NO: 3129261 - RNA, 12 nt, Mycobacterium bovis subsp bovis AF2122/97
accgacgacggc

SEQ ID NO: 3129262 - RNA, 18 nt, Mycobacterium bovis subsp bovis AF2122/97
accgacgacggcgacggc

SEQ ID NO: 3129263 - RNA, 15 nt, Mycobacterium bovis subsp bovis AF2122/97
accgacgccgccagg

SEQ ID NO: 3129264 - RNA, 12 nt, Mycobacterium bovis subsp bovis AF2122/97
accgacgccggu

SEQ ID NO: 3129265 - RNA, 16 nt, Mycobacterium bovis subsp bovis AF2122/97
accgacgccgguggca

SEQ ID NO: 3129266 - RNA, 22 nt, Mycobacterium bovis subsp bovis AF2122/97
accgacgcgcccgcgcgcuccg

SEQ ID NO: 3129267 - RNA, 17 nt, Mycobacterium bovis subsp bovis AF2122/97
accgacgcggucggcgg

SEQ ID NO: 3129268 - RNA, 20 nt, Mycobacterium bovis subsp bovis AF2122/97
accgacgcggucggcggccg

SEQ ID NO: 3129269 - RNA, 15 nt, Mycobacterium bovis subsp bovis AF2122/97
accgacgcguccggu

SEQ ID NO: 3129270 - RNA, 15 nt, Mycobacterium bovis subsp bovis AF2122/97
accgacgcugaaguu

SEQ ID NO: 3129271 - RNA, 20 nt, Mycobacterium bovis subsp bovis AF2122/97
accgacggaaugucagccgg

SEQ ID NO: 3129272 - RNA, 20 nt, Mycobacterium bovis subsp bovis AF2122/97
accgacggccagcaagacga

SEQ ID NO: 3129273 - RNA, 15 nt, Mycobacterium bovis subsp bovis AF2122/97
accgacggcgcaugc

SEQ ID NO: 3129274 - RNA, 15 nt, Mycobacterium bovis subsp bovis AF2122/97
accgacgucgccaag

SEQ ID NO: 3129275 - RNA, 20 nt, Mycobacterium bovis subsp bovis AF2122/97
accgacguggccagcccgcc

SEQ ID NO: 3129276 - RNA, 22 nt, Mycobacterium bovis subsp bovis AF2122/97
accgacugcugucaccgcaacc

SEQ ID NO: 3129277 - RNA, 16 nt, Mycobacterium bovis subsp bovis AF2122/97
accgagaaagugcagu

SEQ ID NO: 3129278 - RNA, 17 nt, Mycobacterium bovis subsp bovis AF2122/97
accgagaacaccacgca

SEQ ID NO: 3129279 - RNA, 16 nt, Mycobacterium bovis subsp bovis AF2122/97
accgagaagcccaccg

SEQ ID NO: 3129280 - RNA, 23 nt, Mycobacterium bovis subsp bovis AF2122/97
accgagaagcccaccgucugcug

SEQ ID NO: 3129281 - RNA, 13 nt, Mycobacterium bovis subsp bovis AF2122/97
accgagacggcgu

SEQ ID NO: 3129282 - RNA, 15 nt, Mycobacterium bovis subsp bovis AF2122/97
accgagacuugcugg

SEQ ID NO: 3129283 - RNA, 19 nt, Mycobacterium bovis subsp bovis AF2122/97
accgagaucaccgccacca

SEQ ID NO: 3129284 - RNA, 20 nt, Mycobacterium bovis subsp bovis AF2122/97
accgagaucaccgccaccac

SEQ ID NO: 3129285 - RNA, 13 nt, Mycobacterium bovis subsp bovis AF2122/97
accgagaugcgca

SEQ ID NO: 3129286 - RNA, 23 nt, Mycobacterium bovis subsp bovis AF2122/97
accgagcaaacacgccucgccga

SEQ ID NO: 3129287 - RNA, 21 nt, Mycobacterium bovis subsp bovis AF2122/97
accgagcacggguagcgucca

SEQ ID NO: 3129288 - RNA, 11 nt, Mycobacterium bovis subsp bovis AF2122/97
accgagcagca

SEQ ID NO: 3129289 - RNA, 18 nt, Mycobacterium bovis subsp bovis AF2122/97
accgagccacgacccagc

SEQ ID NO: 3129290 - RNA, 21 nt, Mycobacterium bovis subsp bovis AF2122/97
accgagccacgacccagcaug

SEQ ID NO: 3129291 - RNA, 16 nt, Mycobacterium bovis subsp bovis AF2122/97
accgagcccgaucgcg

SEQ ID NO: 3129292 - RNA, 19 nt, Mycobacterium bovis subsp bovis AF2122/97
accgagccgaccggcggca

SEQ ID NO: 3129293 - RNA, 15 nt, Mycobacterium bovis subsp bovis AF2122/97
accgagccgcgaugc

SEQ ID NO: 3129294 - RNA, 20 nt, Mycobacterium bovis subsp bovis AF2122/97
accgagcgcaaucgaccacg

SEQ ID NO: 3129295 - RNA, 17 nt, Mycobacterium bovis subsp bovis AF2122/97
accgagcggucgaucug

SEQ ID NO: 3129296 - RNA, 20 nt, Mycobacterium bovis subsp bovis AF2122/97
accgagcugauccggguggc

SEQ ID NO: 3129297 - RNA, 14 nt, Mycobacterium bovis subsp bovis AF2122/97
accgaggaccucgu

SEQ ID NO: 3129298 - RNA, 22 nt, Mycobacterium bovis subsp bovis AF2122/97
accgaggaugugguuggugcug

SEQ ID NO: 3129299 - RNA, 13 nt, Mycobacterium bovis subsp bovis AF2122/97
accgaggccgccg

SEQ ID NO: 3129300 - RNA, 14 nt, Mycobacterium bovis subsp bovis AF2122/97
accgaggccgccga

SEQ ID NO: 3129301 - RNA, 15 nt, Mycobacterium bovis subsp bovis AF2122/97
accgagggucgggca

SEQ ID NO: 3129302 - RNA, 17 nt, Mycobacterium bovis subsp bovis AF2122/97
accgaggucgagcgacc

SEQ ID NO: 3129303 - RNA, 20 nt, Mycobacterium bovis subsp bovis AF2122/97
accgaggucgagcgacccca

SEQ ID NO: 3129304 - RNA, 15 nt, Mycobacterium bovis subsp bovis AF2122/97
accgaggucgccaac

SEQ ID NO: 3129305 - RNA, 23 nt, Mycobacterium bovis subsp bovis AF2122/97
accgaggucggccagcagcagug

SEQ ID NO: 3129306 - RNA, 20 nt, Mycobacterium bovis subsp bovis AF2122/97
accgaggugccgcgcagcug

SEQ ID NO: 3129307 - RNA, 13 nt, Mycobacterium bovis subsp bovis AF2122/97
accgagucgacgg

SEQ ID NO: 3129308 - RNA, 22 nt, Mycobacterium bovis subsp bovis AF2122/97
accgagucgacggccagugcgc

SEQ ID NO: 3129309 - RNA, 13 nt, Mycobacterium bovis subsp bovis AF2122/97
accgauacccccg

SEQ ID NO: 3129310 - RNA, 17 nt, Mycobacterium bovis subsp bovis AF2122/97
accgauaccucgccauc

SEQ ID NO: 3129311 - RNA, 21 nt, Mycobacterium bovis subsp bovis AF2122/97
accgauagccugcggcggcgu

SEQ ID NO: 3129312 - RNA, 22 nt, Mycobacterium bovis subsp bovis AF2122/97
accgauaucgcugcggaaauga

SEQ ID NO: 3129313 - RNA, 13 nt, Mycobacterium bovis subsp bovis AF2122/97
accgaucaauccg

SEQ ID NO: 3129314 - RNA, 13 nt, Mycobacterium bovis subsp bovis AF2122/97
accgaucaccggu

SEQ ID NO: 3129315 - RNA, 15 nt, Mycobacterium bovis subsp bovis AF2122/97
accgauccaguucac

SEQ ID NO: 3129316 - RNA, 20 nt, Mycobacterium bovis subsp bovis AF2122/97
accgaucccgcggccgggcc

SEQ ID NO: 3129317 - RNA, 16 nt, Mycobacterium bovis subsp bovis AF2122/97
accgaucgacugcagc

SEQ ID NO: 3129318 - RNA, 13 nt, Mycobacterium bovis subsp bovis AF2122/97
accgaucgccaag

SEQ ID NO: 3129319 - RNA, 12 nt, Mycobacterium bovis subsp bovis AF2122/97
accgaucggcag

SEQ ID NO: 3129320 - RNA, 17 nt, Mycobacterium bovis subsp bovis AF2122/97
accgaucggucguccgg

SEQ ID NO: 3129321 - RNA, 15 nt, Mycobacterium bovis subsp bovis AF2122/97
accgaucuuggccac

SEQ ID NO: 3129322 - RNA, 17 nt, Mycobacterium bovis subsp bovis AF2122/97
accgaucuuggccaccg

SEQ ID NO: 3129323 - RNA, 18 nt, Mycobacterium bovis subsp bovis AF2122/97
accgaucuuggccaccgc

SEQ ID NO: 3129324 - RNA, 15 nt, Mycobacterium bovis subsp bovis AF2122/97
accgaugccacaucg

SEQ ID NO: 3129325 - RNA, 16 nt, Mycobacterium bovis subsp bovis AF2122/97
accgccagcgccaccg

SEQ ID NO: 3129326 - RNA, 17 nt, Mycobacterium bovis subsp bovis AF2122/97
accgccagcgccaccgu

SEQ ID NO: 3129327 - RNA, 14 nt, Mycobacterium bovis subsp bovis AF2122/97
accgccagcgccgc

SEQ ID NO: 3129328 - RNA, 14 nt, Mycobacterium bovis subsp bovis AF2122/97
accgccagcggccg

SEQ ID NO: 3129329 - RNA, 15 nt, Mycobacterium bovis subsp bovis AF2122/97
accgccagcggccgc

SEQ ID NO: 3129330 - RNA, 19 nt, Mycobacterium bovis subsp bovis AF2122/97
accgccagcggccgcucca

SEQ ID NO: 3129331 - RNA, 16 nt, Mycobacterium bovis subsp bovis AF2122/97
accgccagcguggaga

SEQ ID NO: 3129332 - RNA, 22 nt, Mycobacterium bovis subsp bovis AF2122/97
accgccagcugggcagccagau

SEQ ID NO: 3129333 - RNA, 19 nt, Mycobacterium bovis subsp bovis AF2122/97
accgccaguuccggugacg

SEQ ID NO: 3129334 - RNA, 20 nt, Mycobacterium bovis subsp bovis AF2122/97
accgccauccuucgggguga

SEQ ID NO: 3129335 - RNA, 21 nt, Mycobacterium bovis subsp bovis AF2122/97
accgccaucgucgaagaccuc

SEQ ID NO: 3129336 - RNA, 23 nt, Mycobacterium bovis subsp bovis AF2122/97
accgccaugagguaggucgccgc

SEQ ID NO: 3129337 - RNA, 14 nt, Mycobacterium bovis subsp bovis AF2122/97
accgcccagugcca

SEQ ID NO: 3129338 - RNA, 20 nt, Mycobacterium bovis subsp bovis AF2122/97
accgcccagugccagaaccc

SEQ ID NO: 3129339 - RNA, 17 nt, Mycobacterium bovis subsp bovis AF2122/97
accgcccaguugggccu

SEQ ID NO: 3129340 - RNA, 16 nt, Mycobacterium bovis subsp bovis AF2122/97
accgcccccagcgguu

SEQ ID NO: 3129341 - RNA, 15 nt, Mycobacterium bovis subsp bovis AF2122/97
accgccccgugggcc

SEQ ID NO: 3129342 - RNA, 18 nt, Mycobacterium bovis subsp bovis AF2122/97
accgcccgacccaucacc

SEQ ID NO: 3129343 - RNA, 18 nt, Mycobacterium bovis subsp bovis AF2122/97
accgcccgcaagucggac

SEQ ID NO: 3129344 - RNA, 13 nt, Mycobacterium bovis subsp bovis AF2122/97
accgcccgccgaa

SEQ ID NO: 3129345 - RNA, 13 nt, Mycobacterium bovis subsp bovis AF2122/97
accgcccggcccg

SEQ ID NO: 3129346 - RNA, 17 nt, Mycobacterium bovis subsp bovis AF2122/97
accgcccggcccggcuc

SEQ ID NO: 3129347 - RNA, 24 nt, Mycobacterium bovis subsp bovis AF2122/97
accgcccggcccggcucggugcgc

SEQ ID NO: 3129348 - RNA, 15 nt, Mycobacterium bovis subsp bovis AF2122/97
accgcccgugccguc

SEQ ID NO: 3129349 - RNA, 12 nt, Mycobacterium bovis subsp bovis AF2122/97
accgcccuugcc

SEQ ID NO: 3129350 - RNA, 18 nt, Mycobacterium bovis subsp bovis AF2122/97
accgcccuugccgccggc

SEQ ID NO: 3129351 - RNA, 16 nt, Mycobacterium bovis subsp bovis AF2122/97
accgccgacaggccgg

SEQ ID NO: 3129352 - RNA, 17 nt, Mycobacterium bovis subsp bovis AF2122/97
accgccgacaggccggc

SEQ ID NO: 3129353 - RNA, 18 nt, Mycobacterium bovis subsp bovis AF2122/97
accgccgaccggaccggg

SEQ ID NO: 3129354 - RNA, 19 nt, Mycobacterium bovis subsp bovis AF2122/97
accgccgaccggaccgggg

SEQ ID NO: 3129355 - RNA, 21 nt, Mycobacterium bovis subsp bovis AF2122/97
accgccgaccuagucaccuug

SEQ ID NO: 3129356 - RNA, 13 nt, Mycobacterium bovis subsp bovis AF2122/97
accgccgacgaac

SEQ ID NO: 3129357 - RNA, 23 nt, Mycobacterium bovis subsp bovis AF2122/97
accgccgacgccguugcccacgu

SEQ ID NO: 3129358 - RNA, 12 nt, Mycobacterium bovis subsp bovis AF2122/97
accgccgagcgg

SEQ ID NO: 3129359 - RNA, 19 nt, Mycobacterium bovis subsp bovis AF2122/97
accgccgaucggccacagu

SEQ ID NO: 3129360 - RNA, 21 nt, Mycobacterium bovis subsp bovis AF2122/97
accgccgcacgcuagccgaca

SEQ ID NO: 3129361 - RNA, 15 nt, Mycobacterium bovis subsp bovis AF2122/97
accgccgccaagcuc

SEQ ID NO: 3129362 - RNA, 19 nt, Mycobacterium bovis subsp bovis AF2122/97
accgccgccaccagggcgg

SEQ ID NO: 3129363 - RNA, 20 nt, Mycobacterium bovis subsp bovis AF2122/97
accgccgcccccgccggccg

SEQ ID NO: 3129364 - RNA, 21 nt, Mycobacterium bovis subsp bovis AF2122/97
accgccgcccccgccggccgc

SEQ ID NO: 3129365 - RNA, 19 nt, Mycobacterium bovis subsp bovis AF2122/97
accgccgccgaagcgaugc

SEQ ID NO: 3129366 - RNA, 13 nt, Mycobacterium bovis subsp bovis AF2122/97
accgccgccgcca

SEQ ID NO: 3129367 - RNA, 19 nt, Mycobacterium bovis subsp bovis AF2122/97
accgccgccgccaccggcg

SEQ ID NO: 3129368 - RNA, 20 nt, Mycobacterium bovis subsp bovis AF2122/97
accgccgccgccaccggcgc

SEQ ID NO: 3129369 - RNA, 22 nt, Mycobacterium bovis subsp bovis AF2122/97
accgccgccgccaccggcgccg

SEQ ID NO: 3129370 - RNA, 15 nt, Mycobacterium bovis subsp bovis AF2122/97
accgccgccgccgac

SEQ ID NO: 3129371 - RNA, 20 nt, Mycobacterium bovis subsp bovis AF2122/97
accgccgccgccgacgccgc

SEQ ID NO: 3129372 - RNA, 16 nt, Mycobacterium bovis subsp bovis AF2122/97
accgccgccggaucgc

SEQ ID NO: 3129373 - RNA, 14 nt, Mycobacterium bovis subsp bovis AF2122/97
accgccgccggcac

SEQ ID NO: 3129374 - RNA, 21 nt, Mycobacterium bovis subsp bovis AF2122/97
accgccgccggcaccgccggc

SEQ ID NO: 3129375 - RNA, 22 nt, Mycobacterium bovis subsp bovis AF2122/97
accgccgccggcaccgccggcg

SEQ ID NO: 3129376 - RNA, 23 nt, Mycobacterium bovis subsp bovis AF2122/97
accgccgccggcaccgccggcgc

SEQ ID NO: 3129377 - RNA, 14 nt, Mycobacterium bovis subsp bovis AF2122/97
accgccgccugccc

SEQ ID NO: 3129378 - RNA, 19 nt, Mycobacterium bovis subsp bovis AF2122/97
accgccgcgaccgccucgc

SEQ ID NO: 3129379 - RNA, 17 nt, Mycobacterium bovis subsp bovis AF2122/97
accgccgcgaccgcgag

SEQ ID NO: 3129380 - RNA, 19 nt, Mycobacterium bovis subsp bovis AF2122/97
accgccgcgaccgcgagca

SEQ ID NO: 3129381 - RNA, 13 nt, Mycobacterium bovis subsp bovis AF2122/97
accgccgcgccgg

SEQ ID NO: 3129382 - RNA, 16 nt, Mycobacterium bovis subsp bovis AF2122/97
accgccgcgccggcac

SEQ ID NO: 3129383 - RNA, 15 nt, Mycobacterium bovis subsp bovis AF2122/97
accgccgcgccggcg

SEQ ID NO: 3129384 - RNA, 12 nt, Mycobacterium bovis subsp bovis AF2122/97
accgccgcggcc

SEQ ID NO: 3129385 - RNA, 23 nt, Mycobacterium bovis subsp bovis AF2122/97
accgccgcggccgccguccccgc

SEQ ID NO: 3129386 - RNA, 13 nt, Mycobacterium bovis subsp bovis AF2122/97
accgccgcggucg

SEQ ID NO: 3129387 - RNA, 18 nt, Mycobacterium bovis subsp bovis AF2122/97
accgccgcuaccccagcc

SEQ ID NO: 3129388 - RNA, 17 nt, Mycobacterium bovis subsp bovis AF2122/97
accgccgcuaccgcccg

SEQ ID NO: 3129389 - RNA, 18 nt, Mycobacterium bovis subsp bovis AF2122/97
accgccgcuaccgcccgc

SEQ ID NO: 3129390 - RNA, 21 nt, Mycobacterium bovis subsp bovis AF2122/97
accgccgcuaccgcccgcgcc

SEQ ID NO: 3129391 - RNA, 19 nt, Mycobacterium bovis subsp bovis AF2122/97
accgccgcugccgccgagc

SEQ ID NO: 3129392 - RNA, 23 nt, Mycobacterium bovis subsp bovis AF2122/97
accgccgcugccgccgagcuggc

SEQ ID NO: 3129393 - RNA, 17 nt, Mycobacterium bovis subsp bovis AF2122/97
accgccgcugccgcgcg

SEQ ID NO: 3129394 - RNA, 17 nt, Mycobacterium bovis subsp bovis AF2122/97
accgccggaccgccgca

SEQ ID NO: 3129395 - RNA, 21 nt, Mycobacterium bovis subsp bovis AF2122/97
accgccggcaauaccgccagc

SEQ ID NO: 3129396 - RNA, 14 nt, Mycobacterium bovis subsp bovis AF2122/97
accgccggcaccgc

SEQ ID NO: 3129397 - RNA, 17 nt, Mycobacterium bovis subsp bovis AF2122/97
accgccggcaccgccag

SEQ ID NO: 3129398 - RNA, 18 nt, Mycobacterium bovis subsp bovis AF2122/97
accgccggcaccgccagu

SEQ ID NO: 3129399 - RNA, 18 nt, Mycobacterium bovis subsp bovis AF2122/97
accgccggcaccgccggc

SEQ ID NO: 3129400 - RNA, 20 nt, Mycobacterium bovis subsp bovis AF2122/97
accgccggcaccgccggcgc

SEQ ID NO: 3129401 - RNA, 19 nt, Mycobacterium bovis subsp bovis AF2122/97
accgccggcagcaucggca

SEQ ID NO: 3129402 - RNA, 12 nt, Mycobacterium bovis subsp bovis AF2122/97
accgccggcccc

SEQ ID NO: 3129403 - RNA, 21 nt, Mycobacterium bovis subsp bovis AF2122/97
accgccggccccaccggugcc

SEQ ID NO: 3129404 - RNA, 15 nt, Mycobacterium bovis subsp bovis AF2122/97
accgccggcgccacc

SEQ ID NO: 3129405 - RNA, 16 nt, Mycobacterium bovis subsp bovis AF2122/97
accgccggcgccaccg

SEQ ID NO: 3129406 - RNA, 17 nt, Mycobacterium bovis subsp bovis AF2122/97
accgccggcgccaccgu

SEQ ID NO: 3129407 - RNA, 23 nt, Mycobacterium bovis subsp bovis AF2122/97
accgccggcgccaccgucgccgu

SEQ ID NO: 3129408 - RNA, 13 nt, Mycobacterium bovis subsp bovis AF2122/97
accgccggcgccg

SEQ ID NO: 3129409 - RNA, 21 nt, Mycobacterium bovis subsp bovis AF2122/97
accgccggcgccggugccgcc

SEQ ID NO: 3129410 - RNA, 11 nt, Mycobacterium bovis subsp bovis AF2122/97
accgccggcgg

SEQ ID NO: 3129411 - RNA, 19 nt, Mycobacterium bovis subsp bovis AF2122/97
accgcgccaccuccgacgg

SEQ ID NO: 3129412 - RNA, 20 nt, Mycobacterium bovis subsp bovis AF2122/97
accgcgccagguacucggug

SEQ ID NO: 3129413 - RNA, 22 nt, Mycobacterium bovis subsp bovis AF2122/97
accgcgccauagcagagccggg

SEQ ID NO: 3129414 - RNA, 18 nt, Mycobacterium bovis subsp bovis AF2122/97
accgcgcccgccgauccu

SEQ ID NO: 3129415 - RNA, 21 nt, Mycobacterium bovis subsp bovis AF2122/97
accgcgcccgcgggcaguggc

SEQ ID NO: 3129416 - RNA, 16 nt, Mycobacterium bovis subsp bovis AF2122/97
accgcgcccuucagca

SEQ ID NO: 3129417 - RNA, 19 nt, Mycobacterium bovis subsp bovis AF2122/97
accgcgcccuucagcacgg

SEQ ID NO: 3129418 - RNA, 15 nt, Mycobacterium bovis subsp bovis AF2122/97
accgcgccgaacacg

SEQ ID NO: 3129419 - RNA, 17 nt, Mycobacterium bovis subsp bovis AF2122/97
accgcgccgaacacgca

SEQ ID NO: 3129420 - RNA, 17 nt, Mycobacterium bovis subsp bovis AF2122/97
accgcgccgaucaccac

SEQ ID NO: 3129421 - RNA, 19 nt, Mycobacterium bovis subsp bovis AF2122/97
accgcgccgaucaccaccg

SEQ ID NO: 3129422 - RNA, 12 nt, Mycobacterium bovis subsp bovis AF2122/97
accgcgccggcg

SEQ ID NO: 3129423 - RNA, 21 nt, Mycobacterium bovis subsp bovis AF2122/97
accgcgccggcggaagcggcg

SEQ ID NO: 3129424 - RNA, 15 nt, Mycobacterium bovis subsp bovis AF2122/97
accgcgccggcggca

SEQ ID NO: 3129425 - RNA, 14 nt, Mycobacterium bovis subsp bovis AF2122/97
accgcgcgcucgcc

SEQ ID NO: 3129426 - RNA, 12 nt, Mycobacterium bovis subsp bovis AF2122/97
accgcgcggcgc

SEQ ID NO: 3129427 - RNA, 17 nt, Mycobacterium bovis subsp bovis AF2122/97
accgcgcggcgcagcac

SEQ ID NO: 3129428 - RNA, 21 nt, Mycobacterium bovis subsp bovis AF2122/97
accgcgcguaauccgagcgcg

SEQ ID NO: 3129429 - RNA, 21 nt, Mycobacterium bovis subsp bovis AF2122/97
accgcgcguugaagucgccgg

SEQ ID NO: 3129430 - RNA, 21 nt, Mycobacterium bovis subsp bovis AF2122/97
accgcgcuggucagccgugcc

SEQ ID NO: 3129431 - RNA, 23 nt, Mycobacterium bovis subsp bovis AF2122/97
accgcgcugguugaacaugucca

SEQ ID NO: 3129432 - RNA, 22 nt, Mycobacterium bovis subsp bovis AF2122/97
accgcgcuguugccaucgacgc

SEQ ID NO: 3129433 - RNA, 13 nt, Mycobacterium bovis subsp bovis AF2122/97
accgcggacccgc

SEQ ID NO: 3129434 - RNA, 17 nt, Mycobacterium bovis subsp bovis AF2122/97
accgcggacccgcagcu

SEQ ID NO: 3129435 - RNA, 17 nt, Mycobacterium bovis subsp bovis AF2122/97
accgcggagauaccgga

SEQ ID NO: 3129436 - RNA, 22 nt, Mycobacterium bovis subsp bovis AF2122/97
accgcggagauaccggacccca

SEQ ID NO: 3129437 - RNA, 18 nt, Mycobacterium bovis subsp bovis AF2122/97
accgcggauaggccgcgc

SEQ ID NO: 3129438 - RNA, 17 nt, Mycobacterium bovis subsp bovis AF2122/97
accgcggaucgaccgcc

SEQ ID NO: 3129439 - RNA, 18 nt, Mycobacterium bovis subsp bovis AF2122/97
accgcggauuccagcgcg

SEQ ID NO: 3129440 - RNA, 16 nt, Mycobacterium bovis subsp bovis AF2122/97
accgcggccagcggga

SEQ ID NO: 3129441 - RNA, 17 nt, Mycobacterium bovis subsp bovis AF2122/97
accgcggccaugacacg

SEQ ID NO: 3129442 - RNA, 14 nt, Mycobacterium bovis subsp bovis AF2122/97
accgcggccccgcc

SEQ ID NO: 3129443 - RNA, 15 nt, Mycobacterium bovis subsp bovis AF2122/97
accgcggccccgccg

SEQ ID NO: 3129444 - RNA, 17 nt, Mycobacterium bovis subsp bovis AF2122/97
accgcggccccgccguu

SEQ ID NO: 3129445 - RNA, 20 nt, Mycobacterium bovis subsp bovis AF2122/97
accgcggccccgccguugcc

SEQ ID NO: 3129446 - RNA, 14 nt, Mycobacterium bovis subsp bovis AF2122/97
accgcggcccggac

SEQ ID NO: 3129447 - RNA, 18 nt, Mycobacterium bovis subsp bovis AF2122/97
accgcggcccggacgucg

SEQ ID NO: 3129448 - RNA, 21 nt, Mycobacterium bovis subsp bovis AF2122/97
accgcggcccggacgucggcg

SEQ ID NO: 3129449 - RNA, 15 nt, Mycobacterium bovis subsp bovis AF2122/97
accgcggccggccgu

SEQ ID NO: 3129450 - RNA, 12 nt, Mycobacterium bovis subsp bovis AF2122/97
accgcggccggg

SEQ ID NO: 3129451 - RNA, 14 nt, Mycobacterium bovis subsp bovis AF2122/97
accgcggccgggug

SEQ ID NO: 3129452 - RNA, 21 nt, Mycobacterium bovis subsp bovis AF2122/97
accgcggccggguggcccggc

SEQ ID NO: 3129453 - RNA, 21 nt, Mycobacterium bovis subsp bovis AF2122/97
accgcggccuuggcggccgcg

SEQ ID NO: 3129454 - RNA, 20 nt, Mycobacterium bovis subsp bovis AF2122/97
accgcggcgauuacggccag

SEQ ID NO: 3129455 - RNA, 22 nt, Mycobacterium bovis subsp bovis AF2122/97
accgcggcgcguccgggcucgc

SEQ ID NO: 3129456 - RNA, 12 nt, Mycobacterium bovis subsp bovis AF2122/97
accgcggcggcg

SEQ ID NO: 3129457 - RNA, 15 nt, Mycobacterium bovis subsp bovis AF2122/97
accgcggcggcggcc

SEQ ID NO: 3129458 - RNA, 22 nt, Mycobacterium bovis subsp bovis AF2122/97
accgcggcugcuccgucgccga

SEQ ID NO: 3129459 - RNA, 21 nt, Mycobacterium bovis subsp bovis AF2122/97
accgcggcugucacgccugcc

SEQ ID NO: 3129460 - RNA, 20 nt, Mycobacterium bovis subsp bovis AF2122/97
accgcgggaccuucgagccg

SEQ ID NO: 3129461 - RNA, 20 nt, Mycobacterium bovis subsp bovis AF2122/97
accgcgggaucgguggcggc

SEQ ID NO: 3129462 - RNA, 13 nt, Mycobacterium bovis subsp bovis AF2122/97
accgcgggccgcc

SEQ ID NO: 3129463 - RNA, 21 nt, Mycobacterium bovis subsp bovis AF2122/97
accgcgggcgccuuccaggcg

SEQ ID NO: 3129464 - RNA, 17 nt, Mycobacterium bovis subsp bovis AF2122/97
accgcgggcggcaucgc

SEQ ID NO: 3129465 - RNA, 21 nt, Mycobacterium bovis subsp bovis AF2122/97
accgcgggcggcaucgccgag

SEQ ID NO: 3129466 - RNA, 22 nt, Mycobacterium bovis subsp bovis AF2122/97
accgcggggaugguguggucga

SEQ ID NO: 3129467 - RNA, 22 nt, Mycobacterium bovis subsp bovis AF2122/97
accgcggggcagcgggccgccc

SEQ ID NO: 3129468 - RNA, 21 nt, Mycobacterium bovis subsp bovis AF2122/97
accgcgggucgugccagcagc

SEQ ID NO: 3129469 - RNA, 17 nt, Mycobacterium bovis subsp bovis AF2122/97
accgcgguacgccgguc

SEQ ID NO: 3129470 - RNA, 15 nt, Mycobacterium bovis subsp bovis AF2122/97
accgcggucaccgac

SEQ ID NO: 3129471 - RNA, 16 nt, Mycobacterium bovis subsp bovis AF2122/97
accgcggucagcucgg

SEQ ID NO: 3129472 - RNA, 16 nt, Mycobacterium bovis subsp bovis AF2122/97
accgcggucgcugcga

SEQ ID NO: 3129473 - RNA, 23 nt, Mycobacterium bovis subsp bovis AF2122/97
accgcggucuucuucaccgccuu

SEQ ID NO: 3129474 - RNA, 16 nt, Mycobacterium bovis subsp bovis AF2122/97
accgcggugacccgga

SEQ ID NO: 3129475 - RNA, 23 nt, Mycobacterium bovis subsp bovis AF2122/97
accgcggugacucggccuccgcc

SEQ ID NO: 3129476 - RNA, 12 nt, Mycobacterium bovis subsp bovis AF2122/97
accgcggugccc

SEQ ID NO: 3129477 - RNA, 20 nt, Mycobacterium bovis subsp bovis AF2122/97
accgcggugugcgugucacc

SEQ ID NO: 3129478 - RNA, 17 nt, Mycobacterium bovis subsp bovis AF2122/97
accgcguacaggccggc

SEQ ID NO: 3129479 - RNA, 18 nt, Mycobacterium bovis subsp bovis AF2122/97
accgcguacaggccggcc

SEQ ID NO: 3129480 - RNA, 23 nt, Mycobacterium bovis subsp bovis AF2122/97
accgcguagaccccaaucgaccg

SEQ ID NO: 3129481 - RNA, 17 nt, Mycobacterium bovis subsp bovis AF2122/97
accgcguagagcagcag

SEQ ID NO: 3129482 - RNA, 17 nt, Mycobacterium bovis subsp bovis AF2122/97
accgcgucaacgcuguu

SEQ ID NO: 3129483 - RNA, 23 nt, Mycobacterium bovis subsp bovis AF2122/97
accgcgucaccggaggccgccgc

SEQ ID NO: 3129484 - RNA, 17 nt, Mycobacterium bovis subsp bovis AF2122/97
accgcgucacuucccgg

SEQ ID NO: 3129485 - RNA, 15 nt, Mycobacterium bovis subsp bovis AF2122/97
accgcgucaucaccg

SEQ ID NO: 3129486 - RNA, 18 nt, Mycobacterium bovis subsp bovis AF2122/97
accgcgucaucaccggua

SEQ ID NO: 3129487 - RNA, 12 nt, Mycobacterium bovis subsp bovis AF2122/97
accgcgucgaag

SEQ ID NO: 3129488 - RNA, 14 nt, Mycobacterium bovis subsp bovis AF2122/97
accgcgucgaccgg

SEQ ID NO: 3129489 - RNA, 13 nt, Mycobacterium bovis subsp bovis AF2122/97
accgcgucggcgg

SEQ ID NO: 3129490 - RNA, 13 nt, Mycobacterium bovis subsp bovis AF2122/97
accgcgugcgccg

SEQ ID NO: 3129491 - RNA, 21 nt, Mycobacterium bovis subsp bovis AF2122/97
accgcguggucggcgaacgcg

SEQ ID NO: 3129492 - RNA, 18 nt, Mycobacterium bovis subsp bovis AF2122/97
accgcguuaugccaggcg

SEQ ID NO: 3129493 - RNA, 17 nt, Mycobacterium bovis subsp bovis AF2122/97
accgcguugaugaccag

SEQ ID NO: 3129494 - RNA, 16 nt, Mycobacterium bovis subsp bovis AF2122/97
accgcguugaugaccg

SEQ ID NO: 3129495 - RNA, 22 nt, Mycobacterium bovis subsp bovis AF2122/97
accgcguugaugaccgccgccg

SEQ ID NO: 3129496 - RNA, 17 nt, Mycobacterium bovis subsp bovis AF2122/97
accgcguuuugcaggcc

SEQ ID NO: 3129497 - RNA, 14 nt, Mycobacterium bovis subsp bovis AF2122/97
accggaucaucgcc

SEQ ID NO: 3129498 - RNA, 16 nt, Mycobacterium bovis subsp bovis AF2122/97
accggauccacggaga

SEQ ID NO: 3129499 - RNA, 23 nt, Mycobacterium bovis subsp bovis AF2122/97
accggaucgaccaauucgaccgc

SEQ ID NO: 3129500 - RNA, 12 nt, Mycobacterium bovis subsp bovis AF2122/97
accggaucgccg

SEQ ID NO: 3129501 - RNA, 16 nt, Mycobacterium bovis subsp bovis AF2122/97
accggaucgccgucgg

SEQ ID NO: 3129502 - RNA, 19 nt, Mycobacterium bovis subsp bovis AF2122/97
accggaucgucgaacagca

SEQ ID NO: 3129503 - RNA, 19 nt, Mycobacterium bovis subsp bovis AF2122/97
accggaugauguggugugc

SEQ ID NO: 3129504 - RNA, 16 nt, Mycobacterium bovis subsp bovis AF2122/97
accggcaacaucagca

SEQ ID NO: 3129505 - RNA, 14 nt, Mycobacterium bovis subsp bovis AF2122/97
accggcaacaucgg

SEQ ID NO: 3129506 - RNA, 14 nt, Mycobacterium bovis subsp bovis AF2122/97
accggcaaccgccg

SEQ ID NO: 3129507 - RNA, 18 nt, Mycobacterium bovis subsp bovis AF2122/97
accggcaagccacgccgg

SEQ ID NO: 3129508 - RNA, 18 nt, Mycobacterium bovis subsp bovis AF2122/97
accggcaauaccggcauc

SEQ ID NO: 3129509 - RNA, 15 nt, Mycobacterium bovis subsp bovis AF2122/97
accggcaccagcggc

SEQ ID NO: 3129510 - RNA, 18 nt, Mycobacterium bovis subsp bovis AF2122/97
accggcacccccgucgcc

SEQ ID NO: 3129511 - RNA, 16 nt, Mycobacterium bovis subsp bovis AF2122/97
accggcacccgcacgg

SEQ ID NO: 3129512 - RNA, 16 nt, Mycobacterium bovis subsp bovis AF2122/97
accggcacccgcggcg

SEQ ID NO: 3129513 - RNA, 19 nt, Mycobacterium bovis subsp bovis AF2122/97
accggcacccgcuggcggu

SEQ ID NO: 3129514 - RNA, 18 nt, Mycobacterium bovis subsp bovis AF2122/97
accggcaccgccugcgcc

SEQ ID NO: 3129515 - RNA, 23 nt, Mycobacterium bovis subsp bovis AF2122/97
accggcaccgccugcgccgcccg

SEQ ID NO: 3129516 - RNA, 16 nt, Mycobacterium bovis subsp bovis AF2122/97
accggcaccgcugccg

SEQ ID NO: 3129517 - RNA, 23 nt, Mycobacterium bovis subsp bovis AF2122/97
accggcaccgcugccgcugccga

SEQ ID NO: 3129518 - RNA, 15 nt, Mycobacterium bovis subsp bovis AF2122/97
accggcaccggccgu

SEQ ID NO: 3129519 - RNA, 19 nt, Mycobacterium bovis subsp bovis AF2122/97
accggcaccggccgugccg

SEQ ID NO: 3129520 - RNA, 16 nt, Mycobacterium bovis subsp bovis AF2122/97
accggcacgccggcgg

SEQ ID NO: 3129521 - RNA, 16 nt, Mycobacterium bovis subsp bovis AF2122/97
accggcacgucgcccc

SEQ ID NO: 3129522 - RNA, 21 nt, Mycobacterium bovis subsp bovis AF2122/97
accggcagcgaugcggugucg

SEQ ID NO: 3129523 - RNA, 14 nt, Mycobacterium bovis subsp bovis AF2122/97
accggcaggccggc

SEQ ID NO: 3129524 - RNA, 15 nt, Mycobacterium bovis subsp bovis AF2122/97
accggcaggccggcg

SEQ ID NO: 3129525 - RNA, 20 nt, Mycobacterium bovis subsp bovis AF2122/97
accggcauaacgaucccgug

SEQ ID NO: 3129526 - RNA, 19 nt, Mycobacterium bovis subsp bovis AF2122/97
accggcaucgaagugcggc

SEQ ID NO: 3129527 - RNA, 23 nt, Mycobacterium bovis subsp bovis AF2122/97
accggcaucgaagugcggcccgg

SEQ ID NO: 3129528 - RNA, 20 nt, Mycobacterium bovis subsp bovis AF2122/97
accggcaucgaucaacacca

SEQ ID NO: 3129529 - RNA, 19 nt, Mycobacterium bovis subsp bovis AF2122/97
accggcaucgcgaacucgg

SEQ ID NO: 3129530 - RNA, 22 nt, Mycobacterium bovis subsp bovis AF2122/97
accggcaucgcgaacucgggca

SEQ ID NO: 3129531 - RNA, 15 nt, Mycobacterium bovis subsp bovis AF2122/97
accggcaugccgcca

SEQ ID NO: 3129532 - RNA, 16 nt, Mycobacterium bovis subsp bovis AF2122/97
accggcaugccgccau

SEQ ID NO: 3129533 - RNA, 20 nt, Mycobacterium bovis subsp bovis AF2122/97
accggcaugccgccaugcgc

SEQ ID NO: 3129534 - RNA, 21 nt, Mycobacterium bovis subsp bovis AF2122/97
accggcaugccgccaugcgca

SEQ ID NO: 3129535 - RNA, 17 nt, Mycobacterium bovis subsp bovis AF2122/97
accggcaugcgugccgg

SEQ ID NO: 3129536 - RNA, 18 nt, Mycobacterium bovis subsp bovis AF2122/97
accggcaugcgugccggc

SEQ ID NO: 3129537 - RNA, 19 nt, Mycobacterium bovis subsp bovis AF2122/97
accggccaacagucgcagc

SEQ ID NO: 3129538 - RNA, 21 nt, Mycobacterium bovis subsp bovis AF2122/97
accggccaacagucgcagcac

SEQ ID NO: 3129539 - RNA, 17 nt, Mycobacterium bovis subsp bovis AF2122/97
accggccaacgccgccg

SEQ ID NO: 3129540 - RNA, 14 nt, Mycobacterium bovis subsp bovis AF2122/97
accggccaccagcc

SEQ ID NO: 3129541 - RNA, 16 nt, Mycobacterium bovis subsp bovis AF2122/97
accggccaccagcccg

SEQ ID NO: 3129542 - RNA, 17 nt, Mycobacterium bovis subsp bovis AF2122/97
accggccaccagcccga

SEQ ID NO: 3129543 - RNA, 17 nt, Mycobacterium bovis subsp bovis AF2122/97
accggccaccagggcca

SEQ ID NO: 3129544 - RNA, 18 nt, Mycobacterium bovis subsp bovis AF2122/97
accggccaccagggccac

SEQ ID NO: 3129545 - RNA, 21 nt, Mycobacterium bovis subsp bovis AF2122/97
accggccaccagggccaccgc

SEQ ID NO: 3129546 - RNA, 17 nt, Mycobacterium bovis subsp bovis AF2122/97
accggccagaugguggc

SEQ ID NO: 3129547 - RNA, 15 nt, Mycobacterium bovis subsp bovis AF2122/97
accggccagccgacg

SEQ ID NO: 3129548 - RNA, 17 nt, Mycobacterium bovis subsp bovis AF2122/97
accggccagccgacgcg

SEQ ID NO: 3129549 - RNA, 20 nt, Mycobacterium bovis subsp bovis AF2122/97
accggccagccgacgcggcg

SEQ ID NO: 3129550 - RNA, 17 nt, Mycobacterium bovis subsp bovis AF2122/97
accggccagccgcggcc

SEQ ID NO: 3129551 - RNA, 14 nt, Mycobacterium bovis subsp bovis AF2122/97
accggccagcggcc

SEQ ID NO: 3129552 - RNA, 18 nt, Mycobacterium bovis subsp bovis AF2122/97
accggccagcggcccguc

SEQ ID NO: 3129553 - RNA, 14 nt, Mycobacterium bovis subsp bovis AF2122/97
accggccaggccgg

SEQ ID NO: 3129554 - RNA, 19 nt, Mycobacterium bovis subsp bovis AF2122/97
accggccaggccggcggcg

SEQ ID NO: 3129555 - RNA, 15 nt, Mycobacterium bovis subsp bovis AF2122/97
accggcccaguggga

SEQ ID NO: 3129556 - RNA, 17 nt, Mycobacterium bovis subsp bovis AF2122/97
accggcccagugggacu

SEQ ID NO: 3129557 - RNA, 19 nt, Mycobacterium bovis subsp bovis AF2122/97
accggccccaccgacagcc

SEQ ID NO: 3129558 - RNA, 17 nt, Mycobacterium bovis subsp bovis AF2122/97
accggccccaccggcac

SEQ ID NO: 3129559 - RNA, 16 nt, Mycobacterium bovis subsp bovis AF2122/97
accggcccccggucga

SEQ ID NO: 3129560 - RNA, 15 nt, Mycobacterium bovis subsp bovis AF2122/97
accggcccgaugacc

SEQ ID NO: 3129561 - RNA, 15 nt, Mycobacterium bovis subsp bovis AF2122/97
accggcccgaugccg

SEQ ID NO: 3129562 - RNA, 18 nt, Mycobacterium bovis subsp bovis AF2122/97
accggcccgcagcagcau

SEQ ID NO: 3129563 - RNA, 18 nt, Mycobacterium bovis subsp bovis AF2122/97
accggcccgcauccgcac

SEQ ID NO: 3129564 - RNA, 21 nt, Mycobacterium bovis subsp bovis AF2122/97
accggcccgcauccgcaccga

SEQ ID NO: 3129565 - RNA, 18 nt, Mycobacterium bovis subsp bovis AF2122/97
accggccgccaucaucgc

SEQ ID NO: 3129566 - RNA, 13 nt, Mycobacterium bovis subsp bovis AF2122/97
accggccgccgac

SEQ ID NO: 3129567 - RNA, 20 nt, Mycobacterium bovis subsp bovis AF2122/97
accggccgcgacgacacgcc

SEQ ID NO: 3129568 - RNA, 14 nt, Mycobacterium bovis subsp bovis AF2122/97
accggccgcgcaga

SEQ ID NO: 3129569 - RNA, 17 nt, Mycobacterium bovis subsp bovis AF2122/97
accggccgcuauggccc

SEQ ID NO: 3129570 - RNA, 12 nt, Mycobacterium bovis subsp bovis AF2122/97
accggccggccg

SEQ ID NO: 3129571 - RNA, 17 nt, Mycobacterium bovis subsp bovis AF2122/97
accggccggccgcgggc

SEQ ID NO: 3129572 - RNA, 12 nt, Mycobacterium bovis subsp bovis AF2122/97
accggccggcgc

SEQ ID NO: 3129573 - RNA, 13 nt, Mycobacterium bovis subsp bovis AF2122/97
accggccgucccg

SEQ ID NO: 3129574 - RNA, 15 nt, Mycobacterium bovis subsp bovis AF2122/97
accggccgucgacgc

SEQ ID NO: 3129575 - RNA, 16 nt, Mycobacterium bovis subsp bovis AF2122/97
accggccgugccgccg

SEQ ID NO: 3129576 - RNA, 17 nt, Mycobacterium bovis subsp bovis AF2122/97
accggccgugccgccga

SEQ ID NO: 3129577 - RNA, 23 nt, Mycobacterium bovis subsp bovis AF2122/97
accggccuugcccucaacggcgg

SEQ ID NO: 3129578 - RNA, 21 nt, Mycobacterium bovis subsp bovis AF2122/97
accggccuuuccagcaccccg

SEQ ID NO: 3129579 - RNA, 22 nt, Mycobacterium bovis subsp bovis AF2122/97
accggccuuuccagcaccccga

SEQ ID NO: 3129580 - RNA, 21 nt, Mycobacterium bovis subsp bovis AF2122/97
accggcgaccggugccugcaa

SEQ ID NO: 3129581 - RNA, 13 nt, Mycobacterium bovis subsp bovis AF2122/97
accggcgacgccg

SEQ ID NO: 3129582 - RNA, 17 nt, Mycobacterium bovis subsp bovis AF2122/97
accggcgacgccggccu

SEQ ID NO: 3129583 - RNA, 15 nt, Mycobacterium bovis subsp bovis AF2122/97
accggcgagcccgca

SEQ ID NO: 3129584 - RNA, 14 nt, Mycobacterium bovis subsp bovis AF2122/97
accgggacaaucuc

SEQ ID NO: 3129585 - RNA, 21 nt, Mycobacterium bovis subsp bovis AF2122/97
accgggacaaucucggccgca

SEQ ID NO: 3129586 - RNA, 18 nt, Mycobacterium bovis subsp bovis AF2122/97
accgggacaccaaaagga

SEQ ID NO: 3129587 - RNA, 19 nt, Mycobacterium bovis subsp bovis AF2122/97
accgggacgauucucgagu

SEQ ID NO: 3129588 - RNA, 16 nt, Mycobacterium bovis subsp bovis AF2122/97
accgggaggccaccgc

SEQ ID NO: 3129589 - RNA, 16 nt, Mycobacterium bovis subsp bovis AF2122/97
accgggaucugggucu

SEQ ID NO: 3129590 - RNA, 18 nt, Mycobacterium bovis subsp bovis AF2122/97
accgggcaaaucaagcac

SEQ ID NO: 3129591 - RNA, 19 nt, Mycobacterium bovis subsp bovis AF2122/97
accgggcaacggcggggcc

SEQ ID NO: 3129592 - RNA, 12 nt, Mycobacterium bovis subsp bovis AF2122/97
accgggcacgga

SEQ ID NO: 3129593 - RNA, 17 nt, Mycobacterium bovis subsp bovis AF2122/97
accgggcccgacgacga

SEQ ID NO: 3129594 - RNA, 16 nt, Mycobacterium bovis subsp bovis AF2122/97
accgggcccgccggcc

SEQ ID NO: 3129595 - RNA, 17 nt, Mycobacterium bovis subsp bovis AF2122/97
accgggcccgccggccc

SEQ ID NO: 3129596 - RNA, 20 nt, Mycobacterium bovis subsp bovis AF2122/97
accgggcccggcgaacaggc

SEQ ID NO: 3129597 - RNA, 23 nt, Mycobacterium bovis subsp bovis AF2122/97
accgggccucaugcuaggccacc

SEQ ID NO: 3129598 - RNA, 18 nt, Mycobacterium bovis subsp bovis AF2122/97
accgggcgauucgcaauc

SEQ ID NO: 3129599 - RNA, 15 nt, Mycobacterium bovis subsp bovis AF2122/97
accgggcggacagga

SEQ ID NO: 3129600 - RNA, 17 nt, Mycobacterium bovis subsp bovis AF2122/97
accgggcggcggcgacu

SEQ ID NO: 3129601 - RNA, 15 nt, Mycobacterium bovis subsp bovis AF2122/97
accgggcgggcuggu

SEQ ID NO: 3129602 - RNA, 14 nt, Mycobacterium bovis subsp bovis AF2122/97
accgggcgugccau

SEQ ID NO: 3129603 - RNA, 17 nt, Mycobacterium bovis subsp bovis AF2122/97
accgggcguuucccugc

SEQ ID NO: 3129604 - RNA, 20 nt, Mycobacterium bovis subsp bovis AF2122/97
accgggcucagacuuucgcc

SEQ ID NO: 3129605 - RNA, 20 nt, Mycobacterium bovis subsp bovis AF2122/97
accgggcuccaauugcggcc

SEQ ID NO: 3129606 - RNA, 21 nt, Mycobacterium bovis subsp bovis AF2122/97
accgggcuccaauugcggccg

SEQ ID NO: 3129607 - RNA, 17 nt, Mycobacterium bovis subsp bovis AF2122/97
accgggcuggccagcgc

SEQ ID NO: 3129608 - RNA, 21 nt, Mycobacterium bovis subsp bovis AF2122/97
accgggcuggccagcgcgcuc

SEQ ID NO: 3129609 - RNA, 19 nt, Mycobacterium bovis subsp bovis AF2122/97
accggggaagaucucggcc

SEQ ID NO: 3129610 - RNA, 22 nt, Mycobacterium bovis subsp bovis AF2122/97
accggggacagcccggcagaug

SEQ ID NO: 3129611 - RNA, 17 nt, Mycobacterium bovis subsp bovis AF2122/97
accggggacgucgacuu

SEQ ID NO: 3129612 - RNA, 21 nt, Mycobacterium bovis subsp bovis AF2122/97
accggggacgucgacuucgcc

SEQ ID NO: 3129613 - RNA, 16 nt, Mycobacterium bovis subsp bovis AF2122/97
accggggaucggggca

SEQ ID NO: 3129614 - RNA, 13 nt, Mycobacterium bovis subsp bovis AF2122/97
accggggcggccg

SEQ ID NO: 3129615 - RNA, 20 nt, Mycobacterium bovis subsp bovis AF2122/97
accggguaaugcgacgccgg

SEQ ID NO: 3129616 - RNA, 16 nt, Mycobacterium bovis subsp bovis AF2122/97
accggguagcucccug

SEQ ID NO: 3129617 - RNA, 16 nt, Mycobacterium bovis subsp bovis AF2122/97
accgggucagcccagc

SEQ ID NO: 3129618 - RNA, 18 nt, Mycobacterium bovis subsp bovis AF2122/97
accggguccggugaaccc

SEQ ID NO: 3129619 - RNA, 21 nt, Mycobacterium bovis subsp bovis AF2122/97
accggguccggugaacccgau

SEQ ID NO: 3129620 - RNA, 15 nt, Mycobacterium bovis subsp bovis AF2122/97
accgggucgaucacc

SEQ ID NO: 3129621 - RNA, 18 nt, Mycobacterium bovis subsp bovis AF2122/97
accgggucgaucaccgac

SEQ ID NO: 3129622 - RNA, 21 nt, Mycobacterium bovis subsp bovis AF2122/97
accgggucgcaaccgccgcca

SEQ ID NO: 3129623 - RNA, 18 nt, Mycobacterium bovis subsp bovis AF2122/97
accgggucgggcaccgcg

SEQ ID NO: 3129624 - RNA, 12 nt, Mycobacterium bovis subsp bovis AF2122/97
accgggugcagg

SEQ ID NO: 3129625 - RNA, 15 nt, Mycobacterium bovis subsp bovis AF2122/97
accgggugugcgucg

SEQ ID NO: 3129626 - RNA, 22 nt, Mycobacterium bovis subsp bovis AF2122/97
accgggugugcgucgagguggc

SEQ ID NO: 3129627 - RNA, 22 nt, Mycobacterium bovis subsp bovis AF2122/97
accggguuuuccaucuucaucg

SEQ ID NO: 3129628 - RNA, 20 nt, Mycobacterium bovis subsp bovis AF2122/97
accgguaacgccaacaccgg

SEQ ID NO: 3129629 - RNA, 22 nt, Mycobacterium bovis subsp bovis AF2122/97
accgguaacgccaacaccggca

SEQ ID NO: 3129630 - RNA, 12 nt, Mycobacterium bovis subsp bovis AF2122/97
accgguacccgu

SEQ ID NO: 3129631 - RNA, 20 nt, Mycobacterium bovis subsp bovis AF2122/97
accgguaccgaucagcaggg

SEQ ID NO: 3129632 - RNA, 14 nt, Mycobacterium bovis subsp bovis AF2122/97
accgguaccgccac

SEQ ID NO: 3129633 - RNA, 14 nt, Mycobacterium bovis subsp bovis AF2122/97
accgguauguucgg

SEQ ID NO: 3129634 - RNA, 17 nt, Mycobacterium bovis subsp bovis AF2122/97
accggucaaacgcgcgc

SEQ ID NO: 3129635 - RNA, 14 nt, Mycobacterium bovis subsp bovis AF2122/97
accggucacccgug

SEQ ID NO: 3129636 - RNA, 13 nt, Mycobacterium bovis subsp bovis AF2122/97
accggucaccgcg

SEQ ID NO: 3129637 - RNA, 17 nt, Mycobacterium bovis subsp bovis AF2122/97
accggucaccgcgcagc

SEQ ID NO: 3129638 - RNA, 17 nt, Mycobacterium bovis subsp bovis AF2122/97
accggucacgucgauga

SEQ ID NO: 3129639 - RNA, 21 nt, Mycobacterium bovis subsp bovis AF2122/97
accggucccugcgccgucaac

SEQ ID NO: 3129640 - RNA, 19 nt, Mycobacterium bovis subsp bovis AF2122/97
accgguccgucaccaccgc

SEQ ID NO: 3129641 - RNA, 15 nt, Mycobacterium bovis subsp bovis AF2122/97
accggucgacagcga

SEQ ID NO: 3129642 - RNA, 13 nt, Mycobacterium bovis subsp bovis AF2122/97
accggucgaccca

SEQ ID NO: 3129643 - RNA, 15 nt, Mycobacterium bovis subsp bovis AF2122/97
accggucggcagcuu

SEQ ID NO: 3129644 - RNA, 23 nt, Mycobacterium bovis subsp bovis AF2122/97
accggucggcagcuucucgccga

SEQ ID NO: 3129645 - RNA, 22 nt, Mycobacterium bovis subsp bovis AF2122/97
accggucggccauugcccgggc

SEQ ID NO: 3129646 - RNA, 19 nt, Mycobacterium bovis subsp bovis AF2122/97
accggucgucugucucggu

SEQ ID NO: 3129647 - RNA, 19 nt, Mycobacterium bovis subsp bovis AF2122/97
accggugacgcacagcagc

SEQ ID NO: 3129648 - RNA, 16 nt, Mycobacterium bovis subsp bovis AF2122/97
accggugagcgcagcu

SEQ ID NO: 3129649 - RNA, 19 nt, Mycobacterium bovis subsp bovis AF2122/97
accggugaucguggguacc

SEQ ID NO: 3129650 - RNA, 17 nt, Mycobacterium bovis subsp bovis AF2122/97
accggugauggugacca

SEQ ID NO: 3129651 - RNA, 21 nt, Mycobacterium bovis subsp bovis AF2122/97
accggugauggugaccagcag

SEQ ID NO: 3129652 - RNA, 16 nt, Mycobacterium bovis subsp bovis AF2122/97
accggugccagcagug

SEQ ID NO: 3129653 - RNA, 15 nt, Mycobacterium bovis subsp bovis AF2122/97
accggugcccaccac

SEQ ID NO: 3129654 - RNA, 17 nt, Mycobacterium bovis subsp bovis AF2122/97
accggugcccaccaccg

SEQ ID NO: 3129655 - RNA, 19 nt, Mycobacterium bovis subsp bovis AF2122/97
accggugcccaccaccgac

SEQ ID NO: 3129656 - RNA, 14 nt, Mycobacterium bovis subsp bovis AF2122/97
accggugccgcccg

SEQ ID NO: 3129657 - RNA, 17 nt, Mycobacterium bovis subsp bovis AF2122/97
accggugccgcccgcgc

SEQ ID NO: 3129658 - RNA, 20 nt, Mycobacterium bovis subsp bovis AF2122/97
accggugccgcccgcgccgc

SEQ ID NO: 3129659 - RNA, 14 nt, Mycobacterium bovis subsp bovis AF2122/97
accggugccgccgu

SEQ ID NO: 3129660 - RNA, 12 nt, Mycobacterium bovis subsp bovis AF2122/97
accgguggcacc

SEQ ID NO: 3129661 - RNA, 17 nt, Mycobacterium bovis subsp bovis AF2122/97
accgguggcagccugcu

SEQ ID NO: 3129662 - RNA, 17 nt, Mycobacterium bovis subsp bovis AF2122/97
accgguggccaucgcgc

SEQ ID NO: 3129663 - RNA, 14 nt, Mycobacterium bovis subsp bovis AF2122/97
accgguggccgguc

SEQ ID NO: 3129664 - RNA, 15 nt, Mycobacterium bovis subsp bovis AF2122/97
accgguggccggucg

SEQ ID NO: 3129665 - RNA, 16 nt, Mycobacterium bovis subsp bovis AF2122/97
accgguggccggucgu

SEQ ID NO: 3129666 - RNA, 19 nt, Mycobacterium bovis subsp bovis AF2122/97
accgguggcgcccuugggc

SEQ ID NO: 3129667 - RNA, 17 nt, Mycobacterium bovis subsp bovis AF2122/97
accggugguagcgacga

SEQ ID NO: 3129668 - RNA, 15 nt, Mycobacterium bovis subsp bovis AF2122/97
accgguggugcggcc

SEQ ID NO: 3129669 - RNA, 14 nt, Mycobacterium bovis subsp bovis AF2122/97
accgguguagcagc

SEQ ID NO: 3129670 - RNA, 14 nt, Mycobacterium bovis subsp bovis AF2122/97
accggugucggcca

SEQ ID NO: 3129671 - RNA, 23 nt, Mycobacterium bovis subsp bovis AF2122/97
accgucuggaguucgucaccguu

SEQ ID NO: 3129672 - RNA, 23 nt, Mycobacterium bovis subsp bovis AF2122/97
accgucuggccguugcccgacuc

SEQ ID NO: 3129673 - RNA, 16 nt, Mycobacterium bovis subsp bovis AF2122/97
accgucuuuggugccg

SEQ ID NO: 3129674 - RNA, 15 nt, Mycobacterium bovis subsp bovis AF2122/97
accgugaaccgcccg

SEQ ID NO: 3129675 - RNA, 22 nt, Mycobacterium bovis subsp bovis AF2122/97
accgugaccgagaagcccaccg

SEQ ID NO: 3129676 - RNA, 12 nt, Mycobacterium bovis subsp bovis AF2122/97
accgugaccgcc

SEQ ID NO: 3129677 - RNA, 13 nt, Mycobacterium bovis subsp bovis AF2122/97
accgugaccgccg

SEQ ID NO: 3129678 - RNA, 14 nt, Mycobacterium bovis subsp bovis AF2122/97
accgugaccgccgc

SEQ ID NO: 3129679 - RNA, 22 nt, Mycobacterium bovis subsp bovis AF2122/97
accgugacguagggcagcgcca

SEQ ID NO: 3129680 - RNA, 17 nt, Mycobacterium bovis subsp bovis AF2122/97
accgugcaccagcucac

SEQ ID NO: 3129681 - RNA, 15 nt, Mycobacterium bovis subsp bovis AF2122/97
accgugcacgucagc

SEQ ID NO: 3129682 - RNA, 16 nt, Mycobacterium bovis subsp bovis AF2122/97
accgugcacgucagcg

SEQ ID NO: 3129683 - RNA, 16 nt, Mycobacterium bovis subsp bovis AF2122/97
accgugcccuggguga

SEQ ID NO: 3129684 - RNA, 18 nt, Mycobacterium bovis subsp bovis AF2122/97
accgugcccugggugaug

SEQ ID NO: 3129685 - RNA, 13 nt, Mycobacterium bovis subsp bovis AF2122/97
accgugccgcccg

SEQ ID NO: 3129686 - RNA, 14 nt, Mycobacterium bovis subsp bovis AF2122/97
accgugccgcccgg

SEQ ID NO: 3129687 - RNA, 17 nt, Mycobacterium bovis subsp bovis AF2122/97
accgugccgggcgacgg

SEQ ID NO: 3129688 - RNA, 12 nt, Mycobacterium bovis subsp bovis AF2122/97
accgugccgucg

SEQ ID NO: 3129689 - RNA, 15 nt, Mycobacterium bovis subsp bovis AF2122/97
accgugccgucggcg

SEQ ID NO: 3129690 - RNA, 16 nt, Mycobacterium bovis subsp bovis AF2122/97
accgugccgucggcgu

SEQ ID NO: 3129691 - RNA, 21 nt, Mycobacterium bovis subsp bovis AF2122/97
accgugcgccgaauggcggug

SEQ ID NO: 3129692 - RNA, 23 nt, Mycobacterium bovis subsp bovis AF2122/97
accgugcgguauuugaacgcccg

SEQ ID NO: 3129693 - RNA, 20 nt, Mycobacterium bovis subsp bovis AF2122/97
accgugcggucgugccccgc

SEQ ID NO: 3129694 - RNA, 17 nt, Mycobacterium bovis subsp bovis AF2122/97
accgugcuggcaccagc

SEQ ID NO: 3129695 - RNA, 14 nt, Mycobacterium bovis subsp bovis AF2122/97
accgugcugggcau

SEQ ID NO: 3129696 - RNA, 20 nt, Mycobacterium bovis subsp bovis AF2122/97
accgugcugggcaucaccga

SEQ ID NO: 3129697 - RNA, 17 nt, Mycobacterium bovis subsp bovis AF2122/97
accgugcugggcgccgc

SEQ ID NO: 3129698 - RNA, 19 nt, Mycobacterium bovis subsp bovis AF2122/97
accgugcugggcgccgcgc

SEQ ID NO: 3129699 - RNA, 20 nt, Mycobacterium bovis subsp bovis AF2122/97
accgugcugggcgccgcgcu

SEQ ID NO: 3129700 - RNA, 23 nt, Mycobacterium bovis subsp bovis AF2122/97
accgugcugggcgccgcgcucga

SEQ ID NO: 3129701 - RNA, 20 nt, Mycobacterium bovis subsp bovis AF2122/97
accguggauaacgacugaca

SEQ ID NO: 3129702 - RNA, 22 nt, Mycobacterium bovis subsp bovis AF2122/97
accguggauaacgacugacaac

SEQ ID NO: 3129703 - RNA, 18 nt, Mycobacterium bovis subsp bovis AF2122/97
accguggcagcugcucuc

SEQ ID NO: 3129704 - RNA, 18 nt, Mycobacterium bovis subsp bovis AF2122/97
accguggccgcgaucccg

SEQ ID NO: 3129705 - RNA, 21 nt, Mycobacterium bovis subsp bovis AF2122/97
accguggccgcgaucccggcc

SEQ ID NO: 3129706 - RNA, 13 nt, Mycobacterium bovis subsp bovis AF2122/97
accguggccucga

SEQ ID NO: 3129707 - RNA, 19 nt, Mycobacterium bovis subsp bovis AF2122/97
accguggccucgaagggcu

SEQ ID NO: 3129708 - RNA, 16 nt, Mycobacterium bovis subsp bovis AF2122/97
accguggcgcccgcgu

SEQ ID NO: 3129709 - RNA, 15 nt, Mycobacterium bovis subsp bovis AF2122/97
accguggcgccgguc

SEQ ID NO: 3129710 - RNA, 22 nt, Mycobacterium bovis subsp bovis AF2122/97
accguggcggaucgcgagcgcc

SEQ ID NO: 3129711 - RNA, 15 nt, Mycobacterium bovis subsp bovis AF2122/97
accguggcggccucc

SEQ ID NO: 3129712 - RNA, 17 nt, Mycobacterium bovis subsp bovis AF2122/97
accguggcggccuccuc

SEQ ID NO: 3129713 - RNA, 23 nt, Mycobacterium bovis subsp bovis AF2122/97
accguggcggggaaaccggccag

SEQ ID NO: 3129714 - RNA, 13 nt, Mycobacterium bovis subsp bovis AF2122/97
accguggcugcgc

SEQ ID NO: 3129715 - RNA, 15 nt, Mycobacterium bovis subsp bovis AF2122/97
accgugggccugccc

SEQ ID NO: 3129716 - RNA, 17 nt, Mycobacterium bovis subsp bovis AF2122/97
accgugggcgacggcgg

SEQ ID NO: 3129717 - RNA, 20 nt, Mycobacterium bovis subsp bovis AF2122/97
accgugggcgacggcggcgu

SEQ ID NO: 3129718 - RNA, 21 nt, Mycobacterium bovis subsp bovis AF2122/97
accgugggguaucgccagcca

SEQ ID NO: 3129719 - RNA, 11 nt, Mycobacterium bovis subsp bovis AF2122/97
accguggucgg

SEQ ID NO: 3129720 - RNA, 14 nt, Mycobacterium bovis subsp bovis AF2122/97
accgugguggacga

SEQ ID NO: 3129721 - RNA, 20 nt, Mycobacterium bovis subsp bovis AF2122/97
accgugguggacgaccgcgc

SEQ ID NO: 3129722 - RNA, 21 nt, Mycobacterium bovis subsp bovis AF2122/97
accgugguggacgaccgcgcg

SEQ ID NO: 3129723 - RNA, 11 nt, Mycobacterium bovis subsp bovis AF2122/97
accgugguggu

SEQ ID NO: 3129724 - RNA, 19 nt, Mycobacterium bovis subsp bovis AF2122/97
accgugguggucgggcgca

SEQ ID NO: 3129725 - RNA, 17 nt, Mycobacterium bovis subsp bovis AF2122/97
accgugguguacccgcc

SEQ ID NO: 3129726 - RNA, 23 nt, Mycobacterium bovis subsp bovis AF2122/97
accguguacugguacagcgcuuc

SEQ ID NO: 3129727 - RNA, 14 nt, Mycobacterium bovis subsp bovis AF2122/97
accgugucaccgcc

SEQ ID NO: 3129728 - RNA, 16 nt, Mycobacterium bovis subsp bovis AF2122/97
accgugucgccggcga

SEQ ID NO: 3129729 - RNA, 20 nt, Mycobacterium bovis subsp bovis AF2122/97
accgugugcacgcgauggcc

SEQ ID NO: 3129730 - RNA, 21 nt, Mycobacterium bovis subsp bovis AF2122/97
accguguggccguuggccgga

SEQ ID NO: 3129731 - RNA, 14 nt, Mycobacterium bovis subsp bovis AF2122/97
accguguugcugcc

SEQ ID NO: 3129732 - RNA, 14 nt, Mycobacterium bovis subsp bovis AF2122/97
accguucacccagc

SEQ ID NO: 3129733 - RNA, 19 nt, Mycobacterium bovis subsp bovis AF2122/97
accguucgaucagguucgu

SEQ ID NO: 3129734 - RNA, 18 nt, Mycobacterium bovis subsp bovis AF2122/97
accguucggcgacagcgc

SEQ ID NO: 3129735 - RNA, 15 nt, Mycobacterium bovis subsp bovis AF2122/97
accguugaccucuuc

SEQ ID NO: 3129736 - RNA, 20 nt, Mycobacterium bovis subsp bovis AF2122/97
accguugccgaaccacgcgc

SEQ ID NO: 3129737 - RNA, 21 nt, Mycobacterium bovis subsp bovis AF2122/97
accguugcgaagaagaaggcg

SEQ ID NO: 3129738 - RNA, 19 nt, Mycobacterium bovis subsp bovis AF2122/97
accguuggagucaggcggg

SEQ ID NO: 3129739 - RNA, 16 nt, Mycobacterium bovis subsp bovis AF2122/97
accguuucgaucucga

SEQ ID NO: 3129740 - RNA, 20 nt, Mycobacterium bovis subsp bovis AF2122/97
accguuucgaucucgagcag

SEQ ID NO: 3129741 - RNA, 16 nt, Mycobacterium bovis subsp bovis AF2122/97
accguuucgccggcgc

SEQ ID NO: 3129742 - RNA, 17 nt, Mycobacterium bovis subsp bovis AF2122/97
accguuugcgcaccggu

SEQ ID NO: 3129743 - RNA, 16 nt, Mycobacterium bovis subsp bovis AF2122/97
accguuugguccauca

SEQ ID NO: 3129744 - RNA, 19 nt, Mycobacterium bovis subsp bovis AF2122/97
accuaacccgcaccggauc

SEQ ID NO: 3129745 - RNA, 18 nt, Mycobacterium bovis subsp bovis AF2122/97
accuaccgagaucaccgc

SEQ ID NO: 3129746 - RNA, 21 nt, Mycobacterium bovis subsp bovis AF2122/97
accuaccgagaucaccgccac

SEQ ID NO: 3129747 - RNA, 14 nt, Mycobacterium bovis subsp bovis AF2122/97
accuagcaccgcgc

SEQ ID NO: 3129748 - RNA, 20 nt, Mycobacterium bovis subsp bovis AF2122/97
accuagcagggugccggcgc

SEQ ID NO: 3129749 - RNA, 22 nt, Mycobacterium bovis subsp bovis AF2122/97
accuagcagggugccggcgccg

SEQ ID NO: 3129750 - RNA, 11 nt, Mycobacterium bovis subsp bovis AF2122/97
accuagccgca

SEQ ID NO: 3129751 - RNA, 18 nt, Mycobacterium bovis subsp bovis AF2122/97
accuauccguucaauuuc

SEQ ID NO: 3129752 - RNA, 16 nt, Mycobacterium bovis subsp bovis AF2122/97
accuaucgcguuguga

SEQ ID NO: 3129753 - RNA, 19 nt, Mycobacterium bovis subsp bovis AF2122/97
accuauggucaaccgcgcc

SEQ ID NO: 3129754 - RNA, 16 nt, Mycobacterium bovis subsp bovis AF2122/97
accuauuggucgcucg

SEQ ID NO: 3129755 - RNA, 18 nt, Mycobacterium bovis subsp bovis AF2122/97
accucaacaccaggccgu

SEQ ID NO: 3129756 - RNA, 15 nt, Mycobacterium bovis subsp bovis AF2122/97
accucaccgaacggc

SEQ ID NO: 3129757 - RNA, 18 nt, Mycobacterium bovis subsp bovis AF2122/97
accucucugcgccaggcg

SEQ ID NO: 3129758 - RNA, 16 nt, Mycobacterium bovis subsp bovis AF2122/97
accucucugucgcguu

SEQ ID NO: 3129759 - RNA, 17 nt, Mycobacterium bovis subsp bovis AF2122/97
accucugcugagcugcu

SEQ ID NO: 3129760 - RNA, 13 nt, Mycobacterium bovis subsp bovis AF2122/97
accucuggcggcg

SEQ ID NO: 3129761 - RNA, 15 nt, Mycobacterium bovis subsp bovis AF2122/97
accucuucgggcagc

SEQ ID NO: 3129762 - RNA, 19 nt, Mycobacterium bovis subsp bovis AF2122/97
accucuucgggugcagcca

SEQ ID NO: 3129763 - RNA, 11 nt, Mycobacterium bovis subsp bovis AF2122/97
accucuugccc

SEQ ID NO: 3129764 - RNA, 22 nt, Mycobacterium bovis subsp bovis AF2122/97
accucuugcccuucuucgaccg

SEQ ID NO: 3129765 - RNA, 14 nt, Mycobacterium bovis subsp bovis AF2122/97
accugaaccggccg

SEQ ID NO: 3129766 - RNA, 15 nt, Mycobacterium bovis subsp bovis AF2122/97
accugaacggcaacg

SEQ ID NO: 3129767 - RNA, 17 nt, Mycobacterium bovis subsp bovis AF2122/97
accugacacgcccgcga

SEQ ID NO: 3129768 - RNA, 15 nt, Mycobacterium bovis subsp bovis AF2122/97
accugacgcucgguc

SEQ ID NO: 3129769 - RNA, 21 nt, Mycobacterium bovis subsp bovis AF2122/97
accugacgugcggcgcggcga

SEQ ID NO: 3129770 - RNA, 18 nt, Mycobacterium bovis subsp bovis AF2122/97
accugagcaccaagaccg

SEQ ID NO: 3129771 - RNA, 21 nt, Mycobacterium bovis subsp bovis AF2122/97
accugagcaucuccucgccug

SEQ ID NO: 3129772 - RNA, 20 nt, Mycobacterium bovis subsp bovis AF2122/97
accugagcgcgcgcggugcg

SEQ ID NO: 3129773 - RNA, 13 nt, Mycobacterium bovis subsp bovis AF2122/97
accugaggcaccu

SEQ ID NO: 3129774 - RNA, 15 nt, Mycobacterium bovis subsp bovis AF2122/97
accugaguccggcac

SEQ ID NO: 3129775 - RNA, 13 nt, Mycobacterium bovis subsp bovis AF2122/97
accugauccggcc

SEQ ID NO: 3129776 - RNA, 20 nt, Mycobacterium bovis subsp bovis AF2122/97
accugcaagacgccgauccg

SEQ ID NO: 3129777 - RNA, 22 nt, Mycobacterium bovis subsp bovis AF2122/97
accugcaagacgccgauccggu

SEQ ID NO: 3129778 - RNA, 15 nt, Mycobacterium bovis subsp bovis AF2122/97
accugcacccaggca

SEQ ID NO: 3129779 - RNA, 13 nt, Mycobacterium bovis subsp bovis AF2122/97
accugcaucacaa

SEQ ID NO: 3129780 - RNA, 14 nt, Mycobacterium bovis subsp bovis AF2122/97
accugcaugcccag

SEQ ID NO: 3129781 - RNA, 15 nt, Mycobacterium bovis subsp bovis AF2122/97
accugccaccagaca

SEQ ID NO: 3129782 - RNA, 14 nt, Mycobacterium bovis subsp bovis AF2122/97
accugcccgucccg

SEQ ID NO: 3129783 - RNA, 15 nt, Mycobacterium bovis subsp bovis AF2122/97
accugcccgucccgc

SEQ ID NO: 3129784 - RNA, 17 nt, Mycobacterium bovis subsp bovis AF2122/97
accugcccgucccgcuc

SEQ ID NO: 3129785 - RNA, 22 nt, Mycobacterium bovis subsp bovis AF2122/97
accugcccgucccgcucgagca

SEQ ID NO: 3129786 - RNA, 23 nt, Mycobacterium bovis subsp bovis AF2122/97
accugccgacucaucggccgcgg

SEQ ID NO: 3129787 - RNA, 17 nt, Mycobacterium bovis subsp bovis AF2122/97
accugccgaucgggcuc

SEQ ID NO: 3129788 - RNA, 17 nt, Mycobacterium bovis subsp bovis AF2122/97
accugccgggccacggc

SEQ ID NO: 3129789 - RNA, 19 nt, Mycobacterium bovis subsp bovis AF2122/97
accugcgcaaauugcaaca

SEQ ID NO: 3129790 - RNA, 20 nt, Mycobacterium bovis subsp bovis AF2122/97
accugcgccaccugaaagcu

SEQ ID NO: 3129791 - RNA, 15 nt, Mycobacterium bovis subsp bovis AF2122/97
accugcgcgacggcg

SEQ ID NO: 3129792 - RNA, 20 nt, Mycobacterium bovis subsp bovis AF2122/97
accugcggcagcggaccgcu

SEQ ID NO: 3129793 - RNA, 17 nt, Mycobacterium bovis subsp bovis AF2122/97
accugcgucaucgcggg

SEQ ID NO: 3129794 - RNA, 18 nt, Mycobacterium bovis subsp bovis AF2122/97
accugcgucaucgcgggu

SEQ ID NO: 3129795 - RNA, 18 nt, Mycobacterium bovis subsp bovis AF2122/97
accugcgucggcccgcgg

SEQ ID NO: 3129796 - RNA, 21 nt, Mycobacterium bovis subsp bovis AF2122/97
accugcugcaccgucagcccg

SEQ ID NO: 3129797 - RNA, 17 nt, Mycobacterium bovis subsp bovis AF2122/97
accugcuggaagccguc

SEQ ID NO: 3129798 - RNA, 19 nt, Mycobacterium bovis subsp bovis AF2122/97
accugcuggaagccgucuc

SEQ ID NO: 3129799 - RNA, 17 nt, Mycobacterium bovis subsp bovis AF2122/97
accugcuggaucucggu

SEQ ID NO: 3129800 - RNA, 13 nt, Mycobacterium bovis subsp bovis AF2122/97
accugcuggcgca

SEQ ID NO: 3129801 - RNA, 16 nt, Mycobacterium bovis subsp bovis AF2122/97
accuggacaaccucgu

SEQ ID NO: 3129802 - RNA, 13 nt, Mycobacterium bovis subsp bovis AF2122/97
accuggaccucgu

SEQ ID NO: 3129803 - RNA, 15 nt, Mycobacterium bovis subsp bovis AF2122/97
accuggacugcagcg

SEQ ID NO: 3129804 - RNA, 22 nt, Mycobacterium bovis subsp bovis AF2122/97
accuggagccgugcggucgcgc

SEQ ID NO: 3129805 - RNA, 22 nt, Mycobacterium bovis subsp bovis AF2122/97
accuggagcuaugucauagcgc

SEQ ID NO: 3129806 - RNA, 17 nt, Mycobacterium bovis subsp bovis AF2122/97
accuggaguccagcucg

SEQ ID NO: 3129807 - RNA, 15 nt, Mycobacterium bovis subsp bovis AF2122/97
accuggcccgccacg

SEQ ID NO: 3129808 - RNA, 23 nt, Mycobacterium bovis subsp bovis AF2122/97
accuggcccgccacgaugucguc

SEQ ID NO: 3129809 - RNA, 21 nt, Mycobacterium bovis subsp bovis AF2122/97
accuggccgcccgcugcggcg

SEQ ID NO: 3129810 - RNA, 19 nt, Mycobacterium bovis subsp bovis AF2122/97
accuggccugcggcaggug

SEQ ID NO: 3129811 - RNA, 13 nt, Mycobacterium bovis subsp bovis AF2122/97
accuggcgacgcg

SEQ ID NO: 3129812 - RNA, 21 nt, Mycobacterium bovis subsp bovis AF2122/97
accuggcgcagcaacucgacg

SEQ ID NO: 3129813 - RNA, 16 nt, Mycobacterium bovis subsp bovis AF2122/97
accuggcggugccggc

SEQ ID NO: 3129814 - RNA, 18 nt, Mycobacterium bovis subsp bovis AF2122/97
accuggcggugccggcgg

SEQ ID NO: 3129815 - RNA, 21 nt, Mycobacterium bovis subsp bovis AF2122/97
accugggacaguucgcgccgu

SEQ ID NO: 3129816 - RNA, 20 nt, Mycobacterium bovis subsp bovis AF2122/97
accugggcgacaguaggguc

SEQ ID NO: 3129817 - RNA, 19 nt, Mycobacterium bovis subsp bovis AF2122/97
accugggcgacuaccggcu

SEQ ID NO: 3129818 - RNA, 15 nt, Mycobacterium bovis subsp bovis AF2122/97
accugggcugccggc

SEQ ID NO: 3129819 - RNA, 17 nt, Mycobacterium bovis subsp bovis AF2122/97
accugggcugccggcca

SEQ ID NO: 3129820 - RNA, 20 nt, Mycobacterium bovis subsp bovis AF2122/97
accugggcugccggccagac

SEQ ID NO: 3129821 - RNA, 21 nt, Mycobacterium bovis subsp bovis AF2122/97
accuggggccaccagaaccac

SEQ ID NO: 3129822 - RNA, 21 nt, Mycobacterium bovis subsp bovis AF2122/97
accuggucgcguccacccacg

SEQ ID NO: 3129823 - RNA, 15 nt, Mycobacterium bovis subsp bovis AF2122/97
accuggucggccgca

SEQ ID NO: 3129824 - RNA, 16 nt, Mycobacterium bovis subsp bovis AF2122/97
accugguuccagaggc

SEQ ID NO: 3129825 - RNA, 19 nt, Mycobacterium bovis subsp bovis AF2122/97
accugguuccagaggcccg

SEQ ID NO: 3129826 - RNA, 21 nt, Mycobacterium bovis subsp bovis AF2122/97
accugguucgacucaugccga

SEQ ID NO: 3129827 - RNA, 21 nt, Mycobacterium bovis subsp bovis AF2122/97
accugguugcugacgacuggg

SEQ ID NO: 3129828 - RNA, 21 nt, Mycobacterium bovis subsp bovis AF2122/97
accuguaccgccacggcggcu

SEQ ID NO: 3129829 - RNA, 23 nt, Mycobacterium bovis subsp bovis AF2122/97
accuguaguucgaugacugaauc

SEQ ID NO: 3129830 - RNA, 20 nt, Mycobacterium bovis subsp bovis AF2122/97
accugucguccucgcuggau

SEQ ID NO: 3129831 - RNA, 12 nt, Mycobacterium bovis subsp bovis AF2122/97
accugugcggcc

SEQ ID NO: 3129832 - RNA, 17 nt, Mycobacterium bovis subsp bovis AF2122/97
accuguugcccuugcgc

SEQ ID NO: 3129833 - RNA, 16 nt, Mycobacterium bovis subsp bovis AF2122/97
accuguuuggggcugu

SEQ ID NO: 3129834 - RNA, 20 nt, Mycobacterium bovis subsp bovis AF2122/97
accuuagcgccguugccgcc

SEQ ID NO: 3129835 - RNA, 21 nt, Mycobacterium bovis subsp bovis AF2122/97
accuuagcgcuugccgcugag

SEQ ID NO: 3129836 - RNA, 22 nt, Mycobacterium bovis subsp bovis AF2122/97
accuucaccgcguguaccgcga

SEQ ID NO: 3129837 - RNA, 14 nt, Mycobacterium bovis subsp bovis AF2122/97
accuucaucaacga

SEQ ID NO: 3129838 - RNA, 19 nt, Mycobacterium bovis subsp bovis AF2122/97
accuuccucgaaaucgugu

SEQ ID NO: 3129839 - RNA, 15 nt, Mycobacterium bovis subsp bovis AF2122/97
accuuccucgcccuu

SEQ ID NO: 3129840 - RNA, 20 nt, Mycobacterium bovis subsp bovis AF2122/97
accuucgacaaguccgcgau

SEQ ID NO: 3129841 - RNA, 19 nt, Mycobacterium bovis subsp bovis AF2122/97
accuucggcccaugcagcg

SEQ ID NO: 3129842 - RNA, 12 nt, Mycobacterium bovis subsp bovis AF2122/97
accuucggccga

SEQ ID NO: 3129843 - RNA, 22 nt, Mycobacterium bovis subsp bovis AF2122/97
acgaccagguaaugguggcguc

SEQ ID NO: 3129844 - RNA, 14 nt, Mycobacterium bovis subsp bovis AF2122/97
acgacccagcaugg

SEQ ID NO: 3129845 - RNA, 15 nt, Mycobacterium bovis subsp bovis AF2122/97
acgacccccgaucag

SEQ ID NO: 3129846 - RNA, 14 nt, Mycobacterium bovis subsp bovis AF2122/97
acgacccgggaagg

SEQ ID NO: 3129847 - RNA, 18 nt, Mycobacterium bovis subsp bovis AF2122/97
acgacccgggaaggaacc

SEQ ID NO: 3129848 - RNA, 22 nt, Mycobacterium bovis subsp bovis AF2122/97
acgacccgggaaggaaccgggc

SEQ ID NO: 3129849 - RNA, 23 nt, Mycobacterium bovis subsp bovis AF2122/97
acgacccgggaaggaaccgggca

SEQ ID NO: 3129850 - RNA, 23 nt, Mycobacterium bovis subsp bovis AF2122/97
acgacccuggccuuugagcgcgg

SEQ ID NO: 3129851 - RNA, 13 nt, Mycobacterium bovis subsp bovis AF2122/97
acgaccgccgaua

SEQ ID NO: 3129852 - RNA, 17 nt, Mycobacterium bovis subsp bovis AF2122/97
acgaccgcgcaacaccu

SEQ ID NO: 3129853 - RNA, 15 nt, Mycobacterium bovis subsp bovis AF2122/97
acgaccggccaacgc

SEQ ID NO: 3129854 - RNA, 21 nt, Mycobacterium bovis subsp bovis AF2122/97
acgaccgucgcgcugccggcc

SEQ ID NO: 3129855 - RNA, 15 nt, Mycobacterium bovis subsp bovis AF2122/97
acgaccgucggcucc

SEQ ID NO: 3129856 - RNA, 17 nt, Mycobacterium bovis subsp bovis AF2122/97
acgaccgucucgguggu

SEQ ID NO: 3129857 - RNA, 21 nt, Mycobacterium bovis subsp bovis AF2122/97
acgaccgugcugggcgccgcg

SEQ ID NO: 3129858 - RNA, 13 nt, Mycobacterium bovis subsp bovis AF2122/97
acgaccguuugaa

SEQ ID NO: 3129859 - RNA, 14 nt, Mycobacterium bovis subsp bovis AF2122/97
acgaccuccacgcc

SEQ ID NO: 3129860 - RNA, 17 nt, Mycobacterium bovis subsp bovis AF2122/97
acgacgacaagugcccg

SEQ ID NO: 3129861 - RNA, 19 nt, Mycobacterium bovis subsp bovis AF2122/97
acgacgacccgacguagcc

SEQ ID NO: 3129862 - RNA, 12 nt, Mycobacterium bovis subsp bovis AF2122/97
acgacgacgaca

SEQ ID NO: 3129863 - RNA, 22 nt, Mycobacterium bovis subsp bovis AF2122/97
acgacgaucgcgucgggcucgg

SEQ ID NO: 3129864 - RNA, 17 nt, Mycobacterium bovis subsp bovis AF2122/97
acgacgaugaugccguc

SEQ ID NO: 3129865 - RNA, 15 nt, Mycobacterium bovis subsp bovis AF2122/97
acgacgcauccggau

SEQ ID NO: 3129866 - RNA, 13 nt, Mycobacterium bovis subsp bovis AF2122/97
acgacgccaccgc

SEQ ID NO: 3129867 - RNA, 21 nt, Mycobacterium bovis subsp bovis AF2122/97
acgacgccaugagcgcgccca

SEQ ID NO: 3129868 - RNA, 13 nt, Mycobacterium bovis subsp bovis AF2122/97
acgacgccggccu

SEQ ID NO: 3129869 - RNA, 15 nt, Mycobacterium bovis subsp bovis AF2122/97
acgacgcgacacgcc

SEQ ID NO: 3129870 - RNA, 21 nt, Mycobacterium bovis subsp bovis AF2122/97
acgacggccgacaacccggcc

SEQ ID NO: 3129871 - RNA, 23 nt, Mycobacterium bovis subsp bovis AF2122/97
acgacggccgacaacccggccgg

SEQ ID NO: 3129872 - RNA, 11 nt, Mycobacterium bovis subsp bovis AF2122/97
acgacggcgac

SEQ ID NO: 3129873 - RNA, 16 nt, Mycobacterium bovis subsp bovis AF2122/97
acgacgggaaccagcg

SEQ ID NO: 3129874 - RNA, 23 nt, Mycobacterium bovis subsp bovis AF2122/97
acgacgggccgaguucgucagcg

SEQ ID NO: 3129875 - RNA, 16 nt, Mycobacterium bovis subsp bovis AF2122/97
acgacggguccgggcc

SEQ ID NO: 3129876 - RNA, 18 nt, Mycobacterium bovis subsp bovis AF2122/97
acgacggguuggcgucgc

SEQ ID NO: 3129877 - RNA, 18 nt, Mycobacterium bovis subsp bovis AF2122/97
acgacgguccguucgcgc

SEQ ID NO: 3129878 - RNA, 22 nt, Mycobacterium bovis subsp bovis AF2122/97
acgacgguccguucgcgccguu

SEQ ID NO: 3129879 - RNA, 19 nt, Mycobacterium bovis subsp bovis AF2122/97
acgacgguuccgccaccgg

SEQ ID NO: 3129880 - RNA, 19 nt, Mycobacterium bovis subsp bovis AF2122/97
acgacguccucgacgauca

SEQ ID NO: 3129881 - RNA, 15 nt, Mycobacterium bovis subsp bovis AF2122/97
acgacgucgagcgcc

SEQ ID NO: 3129882 - RNA, 15 nt, Mycobacterium bovis subsp bovis AF2122/97
acgacgucgccgccg

SEQ ID NO: 3129883 - RNA, 14 nt, Mycobacterium bovis subsp bovis AF2122/97
acgacgucggccgc

SEQ ID NO: 3129884 - RNA, 24 nt, Mycobacterium bovis subsp bovis AF2122/97
acgacgucggccgcaucgcccaac

SEQ ID NO: 3129885 - RNA, 15 nt, Mycobacterium bovis subsp bovis AF2122/97
acgacgucgucgccg

SEQ ID NO: 3129886 - RNA, 18 nt, Mycobacterium bovis subsp bovis AF2122/97
acgacguugccucgcgac

SEQ ID NO: 3129887 - RNA, 16 nt, Mycobacterium bovis subsp bovis AF2122/97
acgacguugcgaggcc

SEQ ID NO: 3129888 - RNA, 13 nt, Mycobacterium bovis subsp bovis AF2122/97
acgacucccccgg

SEQ ID NO: 3129889 - RNA, 16 nt, Mycobacterium bovis subsp bovis AF2122/97
acgacucccccggcuc

SEQ ID NO: 3129890 - RNA, 15 nt, Mycobacterium bovis subsp bovis AF2122/97
acgacuccggcaagc

SEQ ID NO: 3129891 - RNA, 21 nt, Mycobacterium bovis subsp bovis AF2122/97
acgacuccggcaagcacaccg

SEQ ID NO: 3129892 - RNA, 21 nt, Mycobacterium bovis subsp bovis AF2122/97
acgacuccuauugcagcacaa

SEQ ID NO: 3129893 - RNA, 18 nt, Mycobacterium bovis subsp bovis AF2122/97
acgacucgcgguggccga

SEQ ID NO: 3129894 - RNA, 17 nt, Mycobacterium bovis subsp bovis AF2122/97
acgacuggacaggucgc

SEQ ID NO: 3129895 - RNA, 22 nt, Mycobacterium bovis subsp bovis AF2122/97
acgacuggacaggucgcccaac

SEQ ID NO: 3129896 - RNA, 13 nt, Mycobacterium bovis subsp bovis AF2122/97
acgacugggcgcc

SEQ ID NO: 3129897 - RNA, 16 nt, Mycobacterium bovis subsp bovis AF2122/97
acgacugugcgccgca

SEQ ID NO: 3129898 - RNA, 18 nt, Mycobacterium bovis subsp bovis AF2122/97
acgacugugcgccgcagc

SEQ ID NO: 3129899 - RNA, 15 nt, Mycobacterium bovis subsp bovis AF2122/97
acgacuguggcgccg

SEQ ID NO: 3129900 - RNA, 18 nt, Mycobacterium bovis subsp bovis AF2122/97
acgacuguggcgccgccg

SEQ ID NO: 3129901 - RNA, 15 nt, Mycobacterium bovis subsp bovis AF2122/97
acgagaagacaccgc

SEQ ID NO: 3129902 - RNA, 17 nt, Mycobacterium bovis subsp bovis AF2122/97
acgagaagacaccgcgc

SEQ ID NO: 3129903 - RNA, 18 nt, Mycobacterium bovis subsp bovis AF2122/97
acgagacgaaccgccgac

SEQ ID NO: 3129904 - RNA, 19 nt, Mycobacterium bovis subsp bovis AF2122/97
acgagacgcaaaaucgccc

SEQ ID NO: 3129905 - RNA, 16 nt, Mycobacterium bovis subsp bovis AF2122/97
acgagauugccgggcc

SEQ ID NO: 3129906 - RNA, 20 nt, Mycobacterium bovis subsp bovis AF2122/97
acgagauugccgggccgccg

SEQ ID NO: 3129907 - RNA, 23 nt, Mycobacterium bovis subsp bovis AF2122/97
acgagauugccgggccgccgagc

SEQ ID NO: 3129908 - RNA, 18 nt, Mycobacterium bovis subsp bovis AF2122/97
acgagcacacaacaccca

SEQ ID NO: 3129909 - RNA, 19 nt, Mycobacterium bovis subsp bovis AF2122/97
acgagcacaugcucgacgc

SEQ ID NO: 3129910 - RNA, 18 nt, Mycobacterium bovis subsp bovis AF2122/97
acgagcaccgcgccgcgc

SEQ ID NO: 3129911 - RNA, 14 nt, Mycobacterium bovis subsp bovis AF2122/97
acgagcagcaaucc

SEQ ID NO: 3129912 - RNA, 12 nt, Mycobacterium bovis subsp bovis AF2122/97
acgagccaacaa

SEQ ID NO: 3129913 - RNA, 15 nt, Mycobacterium bovis subsp bovis AF2122/97
acgagccaccaccgc

SEQ ID NO: 3129914 - RNA, 16 nt, Mycobacterium bovis subsp bovis AF2122/97
acgagccaccaccgcc

SEQ ID NO: 3129915 - RNA, 16 nt, Mycobacterium bovis subsp bovis AF2122/97
acgagccagaggugga

SEQ ID NO: 3129916 - RNA, 20 nt, Mycobacterium bovis subsp bovis AF2122/97
acgagccagagguggaucag

SEQ ID NO: 3129917 - RNA, 14 nt, Mycobacterium bovis subsp bovis AF2122/97
acgagcccacgcgc

SEQ ID NO: 3129918 - RNA, 23 nt, Mycobacterium bovis subsp bovis AF2122/97
acgagccgcaaaaucgaugacgg

SEQ ID NO: 3129919 - RNA, 13 nt, Mycobacterium bovis subsp bovis AF2122/97
acgagccgcgguc

SEQ ID NO: 3129920 - RNA, 17 nt, Mycobacterium bovis subsp bovis AF2122/97
acgagccgcggucggcg

SEQ ID NO: 3129921 - RNA, 14 nt, Mycobacterium bovis subsp bovis AF2122/97
acgagccgguggcg

SEQ ID NO: 3129922 - RNA, 22 nt, Mycobacterium bovis subsp bovis AF2122/97
acgagccguccaauuccgcaga

SEQ ID NO: 3129923 - RNA, 23 nt, Mycobacterium bovis subsp bovis AF2122/97
acgagcgaaggugaacgacaugg

SEQ ID NO: 3129924 - RNA, 12 nt, Mycobacterium bovis subsp bovis AF2122/97
acgagcgauacg

SEQ ID NO: 3129925 - RNA, 19 nt, Mycobacterium bovis subsp bovis AF2122/97
acgagcggguccgacgggc

SEQ ID NO: 3129926 - RNA, 18 nt, Mycobacterium bovis subsp bovis AF2122/97
acgagcgucagauccggc

SEQ ID NO: 3129927 - RNA, 19 nt, Mycobacterium bovis subsp bovis AF2122/97
acgagcucaccugcgggug

SEQ ID NO: 3129928 - RNA, 23 nt, Mycobacterium bovis subsp bovis AF2122/97
acgagcuguacuugggauugcgg

SEQ ID NO: 3129929 - RNA, 15 nt, Mycobacterium bovis subsp bovis AF2122/97
acgagcuuccacgcc

SEQ ID NO: 3129930 - RNA, 14 nt, Mycobacterium bovis subsp bovis AF2122/97
acgccaccgucgcu

SEQ ID NO: 3129931 - RNA, 20 nt, Mycobacterium bovis subsp bovis AF2122/97
acgccaccugacgugcggcg

SEQ ID NO: 3129932 - RNA, 14 nt, Mycobacterium bovis subsp bovis AF2122/97
acgccacgaccgcc

SEQ ID NO: 3129933 - RNA, 12 nt, Mycobacterium bovis subsp bovis AF2122/97
acgccacgacgu

SEQ ID NO: 3129934 - RNA, 21 nt, Mycobacterium bovis subsp bovis AF2122/97
acgccacgcgucuucggucgc

SEQ ID NO: 3129935 - RNA, 18 nt, Mycobacterium bovis subsp bovis AF2122/97
acgccacggcaucggcca

SEQ ID NO: 3129936 - RNA, 16 nt, Mycobacterium bovis subsp bovis AF2122/97
acgccacugccagccg

SEQ ID NO: 3129937 - RNA, 16 nt, Mycobacterium bovis subsp bovis AF2122/97
acgccagaacguggcc

SEQ ID NO: 3129938 - RNA, 15 nt, Mycobacterium bovis subsp bovis AF2122/97
acgccagcaaugccc

SEQ ID NO: 3129939 - RNA, 15 nt, Mycobacterium bovis subsp bovis AF2122/97
acgccagcaccagcg

SEQ ID NO: 3129940 - RNA, 14 nt, Mycobacterium bovis subsp bovis AF2122/97
acgccagccaggcg

SEQ ID NO: 3129941 - RNA, 16 nt, Mycobacterium bovis subsp bovis AF2122/97
acgccagccaggcgaa

SEQ ID NO: 3129942 - RNA, 23 nt, Mycobacterium bovis subsp bovis AF2122/97
acgccagccccauugccgucgcg

SEQ ID NO: 3129943 - RNA, 17 nt, Mycobacterium bovis subsp bovis AF2122/97
acgccagcccguccggc

SEQ ID NO: 3129944 - RNA, 20 nt, Mycobacterium bovis subsp bovis AF2122/97
acgccagcccguccggcccc

SEQ ID NO: 3129945 - RNA, 17 nt, Mycobacterium bovis subsp bovis AF2122/97
acgccagccuggccauc

SEQ ID NO: 3129946 - RNA, 17 nt, Mycobacterium bovis subsp bovis AF2122/97
acgccagcucgccggcc

SEQ ID NO: 3129947 - RNA, 18 nt, Mycobacterium bovis subsp bovis AF2122/97
acgccagcucgccggccg

SEQ ID NO: 3129948 - RNA, 12 nt, Mycobacterium bovis subsp bovis AF2122/97
acgccagcugcc

SEQ ID NO: 3129949 - RNA, 16 nt, Mycobacterium bovis subsp bovis AF2122/97
acgccagcugcccgac

SEQ ID NO: 3129950 - RNA, 21 nt, Mycobacterium bovis subsp bovis AF2122/97
acgccagcuuggcaaccuguu

SEQ ID NO: 3129951 - RNA, 19 nt, Mycobacterium bovis subsp bovis AF2122/97
acgccaggagcgugucggc

SEQ ID NO: 3129952 - RNA, 17 nt, Mycobacterium bovis subsp bovis AF2122/97
acgccaggggacccggg

SEQ ID NO: 3129953 - RNA, 20 nt, Mycobacterium bovis subsp bovis AF2122/97
acgccaggggacccggggcc

SEQ ID NO: 3129954 - RNA, 14 nt, Mycobacterium bovis subsp bovis AF2122/97
acgccaggugaugc

SEQ ID NO: 3129955 - RNA, 19 nt, Mycobacterium bovis subsp bovis AF2122/97
acgccaggugcagcaccag

SEQ ID NO: 3129956 - RNA, 17 nt, Mycobacterium bovis subsp bovis AF2122/97
acgccagucccggcgca

SEQ ID NO: 3129957 - RNA, 15 nt, Mycobacterium bovis subsp bovis AF2122/97
acgccagucgagcac

SEQ ID NO: 3129958 - RNA, 21 nt, Mycobacterium bovis subsp bovis AF2122/97
acgccagucgcaggaucggcg

SEQ ID NO: 3129959 - RNA, 15 nt, Mycobacterium bovis subsp bovis AF2122/97
acgccaguguugcgc

SEQ ID NO: 3129960 - RNA, 16 nt, Mycobacterium bovis subsp bovis AF2122/97
acgccaguguugcgcu

SEQ ID NO: 3129961 - RNA, 21 nt, Mycobacterium bovis subsp bovis AF2122/97
acgccaguguugcgcugcggc

SEQ ID NO: 3129962 - RNA, 22 nt, Mycobacterium bovis subsp bovis AF2122/97
acgccaguguugcgcugcggcc

SEQ ID NO: 3129963 - RNA, 18 nt, Mycobacterium bovis subsp bovis AF2122/97
acgccauccacgacaucg

SEQ ID NO: 3129964 - RNA, 19 nt, Mycobacterium bovis subsp bovis AF2122/97
acgccaugagcgcgcccaa

SEQ ID NO: 3129965 - RNA, 12 nt, Mycobacterium bovis subsp bovis AF2122/97
acgccaugcccg

SEQ ID NO: 3129966 - RNA, 14 nt, Mycobacterium bovis subsp bovis AF2122/97
acgccaugcccgca

SEQ ID NO: 3129967 - RNA, 15 nt, Mycobacterium bovis subsp bovis AF2122/97
acgccaugucgaugu

SEQ ID NO: 3129968 - RNA, 23 nt, Mycobacterium bovis subsp bovis AF2122/97
acgccauucaucggcaucgacug

SEQ ID NO: 3129969 - RNA, 23 nt, Mycobacterium bovis subsp bovis AF2122/97
acgccauuggccugucaggcggc

SEQ ID NO: 3129970 - RNA, 20 nt, Mycobacterium bovis subsp bovis AF2122/97
acgcccaacgucgccagguc

SEQ ID NO: 3129971 - RNA, 22 nt, Mycobacterium bovis subsp bovis AF2122/97
acgcccacaaugacucggccgc

SEQ ID NO: 3129972 - RNA, 14 nt, Mycobacterium bovis subsp bovis AF2122/97
acgcccacagcuga

SEQ ID NO: 3129973 - RNA, 16 nt, Mycobacterium bovis subsp bovis AF2122/97
acgcccacaugcucag

SEQ ID NO: 3129974 - RNA, 17 nt, Mycobacterium bovis subsp bovis AF2122/97
acgcccacaugcucagg

SEQ ID NO: 3129975 - RNA, 13 nt, Mycobacterium bovis subsp bovis AF2122/97
acgcccaccacgc

SEQ ID NO: 3129976 - RNA, 15 nt, Mycobacterium bovis subsp bovis AF2122/97
acgcccacuccagca

SEQ ID NO: 3129977 - RNA, 19 nt, Mycobacterium bovis subsp bovis AF2122/97
acgcccacuccagcagcuc

SEQ ID NO: 3129978 - RNA, 19 nt, Mycobacterium bovis subsp bovis AF2122/97
acgcccaggcgaccgcuga

SEQ ID NO: 3129979 - RNA, 21 nt, Mycobacterium bovis subsp bovis AF2122/97
acgcccaucucaugcaucugc

SEQ ID NO: 3129980 - RNA, 15 nt, Mycobacterium bovis subsp bovis AF2122/97
acgcccaugaccggc

SEQ ID NO: 3129981 - RNA, 18 nt, Mycobacterium bovis subsp bovis AF2122/97
acgcccaugaccggccgc

SEQ ID NO: 3129982 - RNA, 16 nt, Mycobacterium bovis subsp bovis AF2122/97
acgccccgaucggcca

SEQ ID NO: 3129983 - RNA, 17 nt, Mycobacterium bovis subsp bovis AF2122/97
acgccccgaucggccac

SEQ ID NO: 3129984 - RNA, 17 nt, Mycobacterium bovis subsp bovis AF2122/97
acgccccggcgcggcca

SEQ ID NO: 3129985 - RNA, 19 nt, Mycobacterium bovis subsp bovis AF2122/97
acgccccggcgcggccagc

SEQ ID NO: 3129986 - RNA, 19 nt, Mycobacterium bovis subsp bovis AF2122/97
acgccccuucccuaucacg

SEQ ID NO: 3129987 - RNA, 23 nt, Mycobacterium bovis subsp bovis AF2122/97
acgcccgacgaggaugucgauga

SEQ ID NO: 3129988 - RNA, 13 nt, Mycobacterium bovis subsp bovis AF2122/97
acgcccgagucgu

SEQ ID NO: 3129989 - RNA, 21 nt, Mycobacterium bovis subsp bovis AF2122/97
acgcccgauacgccaccggca

SEQ ID NO: 3129990 - RNA, 15 nt, Mycobacterium bovis subsp bovis AF2122/97
acgcccgcuccgcgg

SEQ ID NO: 3129991 - RNA, 16 nt, Mycobacterium bovis subsp bovis AF2122/97
acgcccgcuccgcggc

SEQ ID NO: 3129992 - RNA, 12 nt, Mycobacterium bovis subsp bovis AF2122/97
acgcccggcccc

SEQ ID NO: 3129993 - RNA, 14 nt, Mycobacterium bovis subsp bovis AF2122/97
acgcccggccccgc

SEQ ID NO: 3129994 - RNA, 17 nt, Mycobacterium bovis subsp bovis AF2122/97
acgcccggccccgcggc

SEQ ID NO: 3129995 - RNA, 16 nt, Mycobacterium bovis subsp bovis AF2122/97
acgcccgggcaccggc

SEQ ID NO: 3129996 - RNA, 19 nt, Mycobacterium bovis subsp bovis AF2122/97
acgcccgggcaccggccgg

SEQ ID NO: 3129997 - RNA, 13 nt, Mycobacterium bovis subsp bovis AF2122/97
acgcccuccuggc

SEQ ID NO: 3129998 - RNA, 18 nt, Mycobacterium bovis subsp bovis AF2122/97
acgcccucgacgccgcgc

SEQ ID NO: 3129999 - RNA, 11 nt, Mycobacterium bovis subsp bovis AF2122/97
acgcccucggg

SEQ ID NO: 3130000 - RNA, 22 nt, Mycobacterium bovis subsp bovis AF2122/97
acgcccucgguagcauccagcg

SEQ ID NO: 3130001 - RNA, 15 nt, Mycobacterium bovis subsp bovis AF2122/97
acgcccucgucgauc

SEQ ID NO: 3130002 - RNA, 17 nt, Mycobacterium bovis subsp bovis AF2122/97
acgcccucgucgaucgc

SEQ ID NO: 3130003 - RNA, 21 nt, Mycobacterium bovis subsp bovis AF2122/97
acgcccugaagggccgccucg

SEQ ID NO: 3130004 - RNA, 19 nt, Mycobacterium bovis subsp bovis AF2122/97
acgcccuggugucgaucgu

SEQ ID NO: 3130005 - RNA, 12 nt, Mycobacterium bovis subsp bovis AF2122/97
acgcccuguucu

SEQ ID NO: 3130006 - RNA, 15 nt, Mycobacterium bovis subsp bovis AF2122/97
acgcccuguucuccg

SEQ ID NO: 3130007 - RNA, 16 nt, Mycobacterium bovis subsp bovis AF2122/97
acgccgaaaaugccgc

SEQ ID NO: 3130008 - RNA, 20 nt, Mycobacterium bovis subsp bovis AF2122/97
acgccgaaaaugccgcccag

SEQ ID NO: 3130009 - RNA, 21 nt, Mycobacterium bovis subsp bovis AF2122/97
acgccgaaaaugccgcccagc

SEQ ID NO: 3130010 - RNA, 19 nt, Mycobacterium bovis subsp bovis AF2122/97
acgccgaacgcgagguucc

SEQ ID NO: 3130011 - RNA, 21 nt, Mycobacterium bovis subsp bovis AF2122/97
acgccgaacgugcaaccacgg

SEQ ID NO: 3130012 - RNA, 22 nt, Mycobacterium bovis subsp bovis AF2122/97
acgccgaauacggcugccucca

SEQ ID NO: 3130013 - RNA, 15 nt, Mycobacterium bovis subsp bovis AF2122/97
acgccgaccagcacc

SEQ ID NO: 3130014 - RNA, 16 nt, Mycobacterium bovis subsp bovis AF2122/97
acgccgaccagcaccc

SEQ ID NO: 3130015 - RNA, 19 nt, Mycobacterium bovis subsp bovis AF2122/97
acgccgaccaucucaccgg

SEQ ID NO: 3130016 - RNA, 17 nt, Mycobacterium bovis subsp bovis AF2122/97
acgccgaccgcgccgca

SEQ ID NO: 3130017 - RNA, 24 nt, Mycobacterium bovis subsp bovis AF2122/97
acgccguggagaucuccucgaguu

SEQ ID NO: 3130018 - RNA, 19 nt, Mycobacterium bovis subsp bovis AF2122/97
acgccguggugcgcauggc

SEQ ID NO: 3130019 - RNA, 23 nt, Mycobacterium bovis subsp bovis AF2122/97
acgccgugugcaucggcgaccgc

SEQ ID NO: 3130020 - RNA, 16 nt, Mycobacterium bovis subsp bovis AF2122/97
acgccucgacacccag

SEQ ID NO: 3130021 - RNA, 18 nt, Mycobacterium bovis subsp bovis AF2122/97
acgccucgacagcggcaa

SEQ ID NO: 3130022 - RNA, 16 nt, Mycobacterium bovis subsp bovis AF2122/97
acgccucgccggccac

SEQ ID NO: 3130023 - RNA, 20 nt, Mycobacterium bovis subsp bovis AF2122/97
acgccucgccggccaccagc

SEQ ID NO: 3130024 - RNA, 22 nt, Mycobacterium bovis subsp bovis AF2122/97
acgccugaaacgauugcugcgg

SEQ ID NO: 3130025 - RNA, 19 nt, Mycobacterium bovis subsp bovis AF2122/97
acgccugaacgacccgcug

SEQ ID NO: 3130026 - RNA, 15 nt, Mycobacterium bovis subsp bovis AF2122/97
acgccugagccacca

SEQ ID NO: 3130027 - RNA, 23 nt, Mycobacterium bovis subsp bovis AF2122/97
acgccugccgaaacgccgaccgc

SEQ ID NO: 3130028 - RNA, 18 nt, Mycobacterium bovis subsp bovis AF2122/97
acgccugcgaggaugcgc

SEQ ID NO: 3130029 - RNA, 22 nt, Mycobacterium bovis subsp bovis AF2122/97
acgccugcgggaaguugcccag

SEQ ID NO: 3130030 - RNA, 23 nt, Mycobacterium bovis subsp bovis AF2122/97
acgccuggcuacgcgcgcccgau

SEQ ID NO: 3130031 - RNA, 15 nt, Mycobacterium bovis subsp bovis AF2122/97
acgccugggcacggc

SEQ ID NO: 3130032 - RNA, 24 nt, Mycobacterium bovis subsp bovis AF2122/97
acgccuuccagcccgagcagaaac

SEQ ID NO: 3130033 - RNA, 17 nt, Mycobacterium bovis subsp bovis AF2122/97
acgccuugacugaacuc

SEQ ID NO: 3130034 - RNA, 18 nt, Mycobacterium bovis subsp bovis AF2122/97
acgccuugagccgaggcg

SEQ ID NO: 3130035 - RNA, 23 nt, Mycobacterium bovis subsp bovis AF2122/97
acgccuugcacaagcugaacuac

SEQ ID NO: 3130036 - RNA, 13 nt, Mycobacterium bovis subsp bovis AF2122/97
acgccuugucggc

SEQ ID NO: 3130037 - RNA, 17 nt, Mycobacterium bovis subsp bovis AF2122/97
acgccuuguuggcgccc

SEQ ID NO: 3130038 - RNA, 22 nt, Mycobacterium bovis subsp bovis AF2122/97
acgccuuguuggcgcccgggcc

SEQ ID NO: 3130039 - RNA, 14 nt, Mycobacterium bovis subsp bovis AF2122/97
acgcgaacccauac

SEQ ID NO: 3130040 - RNA, 14 nt, Mycobacterium bovis subsp bovis AF2122/97
acgcgaaccggcca

SEQ ID NO: 3130041 - RNA, 14 nt, Mycobacterium bovis subsp bovis AF2122/97
acgcgaacgcggcc

SEQ ID NO: 3130042 - RNA, 22 nt, Mycobacterium bovis subsp bovis AF2122/97
acgcgaauaccagaccggccga

SEQ ID NO: 3130043 - RNA, 14 nt, Mycobacterium bovis subsp bovis AF2122/97
acgcgaaugacgau

SEQ ID NO: 3130044 - RNA, 15 nt, Mycobacterium bovis subsp bovis AF2122/97
acgcgacacacgccg

SEQ ID NO: 3130045 - RNA, 16 nt, Mycobacterium bovis subsp bovis AF2122/97
acgcgacacacgccgc

SEQ ID NO: 3130046 - RNA, 13 nt, Mycobacterium bovis subsp bovis AF2122/97
acgcgacacgccg

SEQ ID NO: 3130047 - RNA, 19 nt, Mycobacterium bovis subsp bovis AF2122/97
acgcgacacgccgauucgc

SEQ ID NO: 3130048 - RNA, 17 nt, Mycobacterium bovis subsp bovis AF2122/97
acgcgacacgccggcgg

SEQ ID NO: 3130049 - RNA, 16 nt, Mycobacterium bovis subsp bovis AF2122/97
acgcgacagccaccuc

SEQ ID NO: 3130050 - RNA, 13 nt, Mycobacterium bovis subsp bovis AF2122/97
acgcgaccaccgc

SEQ ID NO: 3130051 - RNA, 20 nt, Mycobacterium bovis subsp bovis AF2122/97
acgcgaccaucucgacgucg

SEQ ID NO: 3130052 - RNA, 22 nt, Mycobacterium bovis subsp bovis AF2122/97
acgcgaccaucucgacgucggu

SEQ ID NO: 3130053 - RNA, 15 nt, Mycobacterium bovis subsp bovis AF2122/97
acgcgaccgcgaugg

SEQ ID NO: 3130054 - RNA, 11 nt, Mycobacterium bovis subsp bovis AF2122/97
acgcgacgccg

SEQ ID NO: 3130055 - RNA, 13 nt, Mycobacterium bovis subsp bovis AF2122/97
acgcgacgccguc

SEQ ID NO: 3130056 - RNA, 14 nt, Mycobacterium bovis subsp bovis AF2122/97
acgcgagcaacacc

SEQ ID NO: 3130057 - RNA, 15 nt, Mycobacterium bovis subsp bovis AF2122/97
acgcgagcaacacca

SEQ ID NO: 3130058 - RNA, 11 nt, Mycobacterium bovis subsp bovis AF2122/97
acgcgagcgcu

SEQ ID NO: 3130059 - RNA, 21 nt, Mycobacterium bovis subsp bovis AF2122/97
acgcgagcgcuaucaccgccu

SEQ ID NO: 3130060 - RNA, 22 nt, Mycobacterium bovis subsp bovis AF2122/97
acgcgaucagcgcgcacacggc

SEQ ID NO: 3130061 - RNA, 13 nt, Mycobacterium bovis subsp bovis AF2122/97
acgcgaucaggcg

SEQ ID NO: 3130062 - RNA, 14 nt, Mycobacterium bovis subsp bovis AF2122/97
acgcgaucggcguc

SEQ ID NO: 3130063 - RNA, 17 nt, Mycobacterium bovis subsp bovis AF2122/97
acgcgaugaccgcaccg

SEQ ID NO: 3130064 - RNA, 13 nt, Mycobacterium bovis subsp bovis AF2122/97
acgcgaugguggc

SEQ ID NO: 3130065 - RNA, 19 nt, Mycobacterium bovis subsp bovis AF2122/97
acgcgaugguggccgccac

SEQ ID NO: 3130066 - RNA, 20 nt, Mycobacterium bovis subsp bovis AF2122/97
acgcgaugguggccgccacc

SEQ ID NO: 3130067 - RNA, 20 nt, Mycobacterium bovis subsp bovis AF2122/97
acgcgcaacgccgccagccu

SEQ ID NO: 3130068 - RNA, 21 nt, Mycobacterium bovis subsp bovis AF2122/97
acgcgcaacgccgccagccug

SEQ ID NO: 3130069 - RNA, 20 nt, Mycobacterium bovis subsp bovis AF2122/97
acgcgcaacucgccacgguc

SEQ ID NO: 3130070 - RNA, 17 nt, Mycobacterium bovis subsp bovis AF2122/97
acgcgcaccuggcgcgc

SEQ ID NO: 3130071 - RNA, 15 nt, Mycobacterium bovis subsp bovis AF2122/97
acgcgcacucgacgc

SEQ ID NO: 3130072 - RNA, 17 nt, Mycobacterium bovis subsp bovis AF2122/97
acgcgcacucgacgcca

SEQ ID NO: 3130073 - RNA, 18 nt, Mycobacterium bovis subsp bovis AF2122/97
acgcgcagaaagucgcgc

SEQ ID NO: 3130074 - RNA, 18 nt, Mycobacterium bovis subsp bovis AF2122/97
acgcgcaguuuggcggcg

SEQ ID NO: 3130075 - RNA, 20 nt, Mycobacterium bovis subsp bovis AF2122/97
acgcgcaguuuggcggcgcg

SEQ ID NO: 3130076 - RNA, 15 nt, Mycobacterium bovis subsp bovis AF2122/97
acgcgcaucgcacgg

SEQ ID NO: 3130077 - RNA, 11 nt, Mycobacterium bovis subsp bovis AF2122/97
acgcgcaugcc

SEQ ID NO: 3130078 - RNA, 14 nt, Mycobacterium bovis subsp bovis AF2122/97
acgcgcaugccccg

SEQ ID NO: 3130079 - RNA, 20 nt, Mycobacterium bovis subsp bovis AF2122/97
acgcgcaugccccgaccgcg

SEQ ID NO: 3130080 - RNA, 21 nt, Mycobacterium bovis subsp bovis AF2122/97
acgcgcaugccccgaccgcgu

SEQ ID NO: 3130081 - RNA, 17 nt, Mycobacterium bovis subsp bovis AF2122/97
acgcgcauucgccgggc

SEQ ID NO: 3130082 - RNA, 14 nt, Mycobacterium bovis subsp bovis AF2122/97
acgcgcccgacgaa

SEQ ID NO: 3130083 - RNA, 14 nt, Mycobacterium bovis subsp bovis AF2122/97
acgcgcccgcacca

SEQ ID NO: 3130084 - RNA, 15 nt, Mycobacterium bovis subsp bovis AF2122/97
acgcgcccgcaccac

SEQ ID NO: 3130085 - RNA, 18 nt, Mycobacterium bovis subsp bovis AF2122/97
acgcgcccgcaccaccgg

SEQ ID NO: 3130086 - RNA, 22 nt, Mycobacterium bovis subsp bovis AF2122/97
acgcgcccgcaccaccggcccc

SEQ ID NO: 3130087 - RNA, 22 nt, Mycobacterium bovis subsp bovis AF2122/97
acgcgccguaacagccggccgg

SEQ ID NO: 3130088 - RNA, 22 nt, Mycobacterium bovis subsp bovis AF2122/97
acgcgccgucucgaagcucagc

SEQ ID NO: 3130089 - RNA, 18 nt, Mycobacterium bovis subsp bovis AF2122/97
acgcgcgagaacacccgu

SEQ ID NO: 3130090 - RNA, 17 nt, Mycobacterium bovis subsp bovis AF2122/97
acgcgcgcagccgggca

SEQ ID NO: 3130091 - RNA, 18 nt, Mycobacterium bovis subsp bovis AF2122/97
acgcgcgcagccgggcac

SEQ ID NO: 3130092 - RNA, 19 nt, Mycobacterium bovis subsp bovis AF2122/97
acgcgcgcaggccgccgcc

SEQ ID NO: 3130093 - RNA, 23 nt, Mycobacterium bovis subsp bovis AF2122/97
acgcgcgcguggucgccccgaug

SEQ ID NO: 3130094 - RNA, 12 nt, Mycobacterium bovis subsp bovis AF2122/97
acgcgcgcucgc

SEQ ID NO: 3130095 - RNA, 15 nt, Mycobacterium bovis subsp bovis AF2122/97
acgcgcgcucgcuca

SEQ ID NO: 3130096 - RNA, 17 nt, Mycobacterium bovis subsp bovis AF2122/97
acgcgcgcucgcucacc

SEQ ID NO: 3130097 - RNA, 20 nt, Mycobacterium bovis subsp bovis AF2122/97
acgcgcgcucgcucaccggc

SEQ ID NO: 3130098 - RNA, 20 nt, Mycobacterium bovis subsp bovis AF2122/97
acgcgcggaucggcggccgc

SEQ ID NO: 3130099 - RNA, 13 nt, Mycobacterium bovis subsp bovis AF2122/97
acgcgcggcggcg

SEQ ID NO: 3130100 - RNA, 13 nt, Mycobacterium bovis subsp bovis AF2122/97
acgcgcucaccga

SEQ ID NO: 3130101 - RNA, 16 nt, Mycobacterium bovis subsp bovis AF2122/97
acgcgcucgggcgaga

SEQ ID NO: 3130102 - RNA, 22 nt, Mycobacterium bovis subsp bovis AF2122/97
acgcgcuugaagguucgaucgc

SEQ ID NO: 3130103 - RNA, 18 nt, Mycobacterium bovis subsp bovis AF2122/97
acgcugauugcgaccgcg

SEQ ID NO: 3130104 - RNA, 12 nt, Mycobacterium bovis subsp bovis AF2122/97
acgcugcaggcg

SEQ ID NO: 3130105 - RNA, 15 nt, Mycobacterium bovis subsp bovis AF2122/97
acgcugcaggcggcc

SEQ ID NO: 3130106 - RNA, 19 nt, Mycobacterium bovis subsp bovis AF2122/97
acgcugcaggcggccgagc

SEQ ID NO: 3130107 - RNA, 23 nt, Mycobacterium bovis subsp bovis AF2122/97
acgcugcaggcggccgagcuggu

SEQ ID NO: 3130108 - RNA, 21 nt, Mycobacterium bovis subsp bovis AF2122/97
acgcugcccaaaagcgcggca

SEQ ID NO: 3130109 - RNA, 20 nt, Mycobacterium bovis subsp bovis AF2122/97
acgcugcccacgggccggcc

SEQ ID NO: 3130110 - RNA, 15 nt, Mycobacterium bovis subsp bovis AF2122/97
acgcugccgccaggc

SEQ ID NO: 3130111 - RNA, 17 nt, Mycobacterium bovis subsp bovis AF2122/97
acgcugcucgacgguca

SEQ ID NO: 3130112 - RNA, 19 nt, Mycobacterium bovis subsp bovis AF2122/97
acgcugcucgacggucagu

SEQ ID NO: 3130113 - RNA, 17 nt, Mycobacterium bovis subsp bovis AF2122/97
acgcugcucuggacggu

SEQ ID NO: 3130114 - RNA, 19 nt, Mycobacterium bovis subsp bovis AF2122/97
acgcugcucuggacgguca

SEQ ID NO: 3130115 - RNA, 17 nt, Mycobacterium bovis subsp bovis AF2122/97
acgcugcuggcaugcag

SEQ ID NO: 3130116 - RNA, 22 nt, Mycobacterium bovis subsp bovis AF2122/97
acgcuggaacuuggcgucgaca

SEQ ID NO: 3130117 - RNA, 21 nt, Mycobacterium bovis subsp bovis AF2122/97
acgcuggccacgauccgcggu

SEQ ID NO: 3130118 - RNA, 15 nt, Mycobacterium bovis subsp bovis AF2122/97
acgcuggccacucac

SEQ ID NO: 3130119 - RNA, 23 nt, Mycobacterium bovis subsp bovis AF2122/97
acgcuggcgcccccgacgacggc

SEQ ID NO: 3130120 - RNA, 13 nt, Mycobacterium bovis subsp bovis AF2122/97
acgcuggcgggca

SEQ ID NO: 3130121 - RNA, 20 nt, Mycobacterium bovis subsp bovis AF2122/97
acgcugggcggcuacccaug

SEQ ID NO: 3130122 - RNA, 15 nt, Mycobacterium bovis subsp bovis AF2122/97
acgcuggucggcggc

SEQ ID NO: 3130123 - RNA, 17 nt, Mycobacterium bovis subsp bovis AF2122/97
acgcuguaagcaugccg

SEQ ID NO: 3130124 - RNA, 19 nt, Mycobacterium bovis subsp bovis AF2122/97
acgcugucccagcccggcc

SEQ ID NO: 3130125 - RNA, 13 nt, Mycobacterium bovis subsp bovis AF2122/97
acgcugucccgcg

SEQ ID NO: 3130126 - RNA, 22 nt, Mycobacterium bovis subsp bovis AF2122/97
acgcugucccgcgggccagcac

SEQ ID NO: 3130127 - RNA, 19 nt, Mycobacterium bovis subsp bovis AF2122/97
acgcuguccgcgugaaucc

SEQ ID NO: 3130128 - RNA, 17 nt, Mycobacterium bovis subsp bovis AF2122/97
acgcuguggcucgacga

SEQ ID NO: 3130129 - RNA, 22 nt, Mycobacterium bovis subsp bovis AF2122/97
acgcuguggcucgacgaugcgg

SEQ ID NO: 3130130 - RNA, 23 nt, Mycobacterium bovis subsp bovis AF2122/97
acgcuguggcucgacgaugcggu

SEQ ID NO: 3130131 - RNA, 17 nt, Mycobacterium bovis subsp bovis AF2122/97
acgcuuaacagcggguc

SEQ ID NO: 3130132 - RNA, 18 nt, Mycobacterium bovis subsp bovis AF2122/97
acgcuucggcacgcuuga

SEQ ID NO: 3130133 - RNA, 21 nt, Mycobacterium bovis subsp bovis AF2122/97
acgcuucggcacgcuugaugu

SEQ ID NO: 3130134 - RNA, 13 nt, Mycobacterium bovis subsp bovis AF2122/97
acgcuucggcagc

SEQ ID NO: 3130135 - RNA, 22 nt, Mycobacterium bovis subsp bovis AF2122/97
acgcuucggcagcucccgccac

SEQ ID NO: 3130136 - RNA, 22 nt, Mycobacterium bovis subsp bovis AF2122/97
acgcuucuuccgcgcgccggcg

SEQ ID NO: 3130137 - RNA, 14 nt, Mycobacterium bovis subsp bovis AF2122/97
acgcuuucccgaug

SEQ ID NO: 3130138 - RNA, 12 nt, Mycobacterium bovis subsp bovis AF2122/97
acggaaccaccg

SEQ ID NO: 3130139 - RNA, 15 nt, Mycobacterium bovis subsp bovis AF2122/97
acggaaccgauaccu

SEQ ID NO: 3130140 - RNA, 14 nt, Mycobacterium bovis subsp bovis AF2122/97
acggaagaccgcgg

SEQ ID NO: 3130141 - RNA, 20 nt, Mycobacterium bovis subsp bovis AF2122/97
acggaaucgguuucgaccug

SEQ ID NO: 3130142 - RNA, 15 nt, Mycobacterium bovis subsp bovis AF2122/97
acggaauguagccga

SEQ ID NO: 3130143 - RNA, 20 nt, Mycobacterium bovis subsp bovis AF2122/97
acggaauguagccgacuucg

SEQ ID NO: 3130144 - RNA, 18 nt, Mycobacterium bovis subsp bovis AF2122/97
acggacaguuccccgggc

SEQ ID NO: 3130145 - RNA, 17 nt, Mycobacterium bovis subsp bovis AF2122/97
acggaccaucgccaggc

SEQ ID NO: 3130146 - RNA, 19 nt, Mycobacterium bovis subsp bovis AF2122/97
acggaccaucuccggugug

SEQ ID NO: 3130147 - RNA, 11 nt, Mycobacterium bovis subsp bovis AF2122/97
acggaccgcca

SEQ ID NO: 3130148 - RNA, 14 nt, Mycobacterium bovis subsp bovis AF2122/97
acggaccgucgccg

SEQ ID NO: 3130149 - RNA, 14 nt, Mycobacterium bovis subsp bovis AF2122/97
acggaccuccucgc

SEQ ID NO: 3130150 - RNA, 18 nt, Mycobacterium bovis subsp bovis AF2122/97
acggacucccucgaucac

SEQ ID NO: 3130151 - RNA, 19 nt, Mycobacterium bovis subsp bovis AF2122/97
acggacucccucgaucacg

SEQ ID NO: 3130152 - RNA, 18 nt, Mycobacterium bovis subsp bovis AF2122/97
acggacuccggccggccu

SEQ ID NO: 3130153 - RNA, 15 nt, Mycobacterium bovis subsp bovis AF2122/97
acggagaccggccgg

SEQ ID NO: 3130154 - RNA, 17 nt, Mycobacterium bovis subsp bovis AF2122/97
acggagaccggccgggu

SEQ ID NO: 3130155 - RNA, 15 nt, Mycobacterium bovis subsp bovis AF2122/97
acggagaccguggau

SEQ ID NO: 3130156 - RNA, 19 nt, Mycobacterium bovis subsp bovis AF2122/97
acggagcccaaaaccgcga

SEQ ID NO: 3130157 - RNA, 14 nt, Mycobacterium bovis subsp bovis AF2122/97
acggagcgagcuca

SEQ ID NO: 3130158 - RNA, 17 nt, Mycobacterium bovis subsp bovis AF2122/97
acggagcgagcucagcg

SEQ ID NO: 3130159 - RNA, 18 nt, Mycobacterium bovis subsp bovis AF2122/97
acggaggguugccgccga

SEQ ID NO: 3130160 - RNA, 17 nt, Mycobacterium bovis subsp bovis AF2122/97
acggaggugccggcgcc

SEQ ID NO: 3130161 - RNA, 18 nt, Mycobacterium bovis subsp bovis AF2122/97
acggaguuggcccgacgc

SEQ ID NO: 3130162 - RNA, 17 nt, Mycobacterium bovis subsp bovis AF2122/97
acggauaacccguggcg

SEQ ID NO: 3130163 - RNA, 19 nt, Mycobacterium bovis subsp bovis AF2122/97
acggauaauucaacagcac

SEQ ID NO: 3130164 - RNA, 17 nt, Mycobacterium bovis subsp bovis AF2122/97
acggauaucagcaacag

SEQ ID NO: 3130165 - RNA, 17 nt, Mycobacterium bovis subsp bovis AF2122/97
acggaucaggcccgggc

SEQ ID NO: 3130166 - RNA, 15 nt, Mycobacterium bovis subsp bovis AF2122/97
acggauccucgaaca

SEQ ID NO: 3130167 - RNA, 21 nt, Mycobacterium bovis subsp bovis AF2122/97
acggaucgcccugacacccau

SEQ ID NO: 3130168 - RNA, 12 nt, Mycobacterium bovis subsp bovis AF2122/97
acggaucgcggc

SEQ ID NO: 3130169 - RNA, 15 nt, Mycobacterium bovis subsp bovis AF2122/97
acggaucgcggcggc

SEQ ID NO: 3130170 - RNA, 17 nt, Mycobacterium bovis subsp bovis AF2122/97
acggaucgcggcggcgu

SEQ ID NO: 3130171 - RNA, 14 nt, Mycobacterium bovis subsp bovis AF2122/97
acggaugucgccca

SEQ ID NO: 3130172 - RNA, 20 nt, Mycobacterium bovis subsp bovis AF2122/97
acggauuacaugucacaccc

SEQ ID NO: 3130173 - RNA, 17 nt, Mycobacterium bovis subsp bovis AF2122/97
acggauucccgcccagc

SEQ ID NO: 3130174 - RNA, 17 nt, Mycobacterium bovis subsp bovis AF2122/97
acggauucgaaggcacc

SEQ ID NO: 3130175 - RNA, 18 nt, Mycobacterium bovis subsp bovis AF2122/97
acggauucgaaggcaccu

SEQ ID NO: 3130176 - RNA, 20 nt, Mycobacterium bovis subsp bovis AF2122/97
acggcaaaacacaccgaaca

SEQ ID NO: 3130177 - RNA, 13 nt, Mycobacterium bovis subsp bovis AF2122/97
acggcaaccagcg

SEQ ID NO: 3130178 - RNA, 21 nt, Mycobacterium bovis subsp bovis AF2122/97
acggcaagccaaccagcccgg

SEQ ID NO: 3130179 - RNA, 22 nt, Mycobacterium bovis subsp bovis AF2122/97
acggcaagccaaccagcccggc

SEQ ID NO: 3130180 - RNA, 19 nt, Mycobacterium bovis subsp bovis AF2122/97
acggcaagcuaccggcccg

SEQ ID NO: 3130181 - RNA, 21 nt, Mycobacterium bovis subsp bovis AF2122/97
acggcaagcuaccggcccgau

SEQ ID NO: 3130182 - RNA, 21 nt, Mycobacterium bovis subsp bovis AF2122/97
acggcaagggcauacagcaug

SEQ ID NO: 3130183 - RNA, 19 nt, Mycobacterium bovis subsp bovis AF2122/97
acggcaaggucgcggccag

SEQ ID NO: 3130184 - RNA, 17 nt, Mycobacterium bovis subsp bovis AF2122/97
acggcaauacccgccgc

SEQ ID NO: 3130185 - RNA, 15 nt, Mycobacterium bovis subsp bovis AF2122/97
acggcaaucaacgca

SEQ ID NO: 3130186 - RNA, 20 nt, Mycobacterium bovis subsp bovis AF2122/97
acggcaccaccaagcucggc

SEQ ID NO: 3130187 - RNA, 21 nt, Mycobacterium bovis subsp bovis AF2122/97
acggcaccaccaagcucggcc

SEQ ID NO: 3130188 - RNA, 23 nt, Mycobacterium bovis subsp bovis AF2122/97
acggcaccagaucuucgagcgca

SEQ ID NO: 3130189 - RNA, 13 nt, Mycobacterium bovis subsp bovis AF2122/97
acggcgaccgcca

SEQ ID NO: 3130190 - RNA, 15 nt, Mycobacterium bovis subsp bovis AF2122/97
acggcgaccgccauc

SEQ ID NO: 3130191 - RNA, 18 nt, Mycobacterium bovis subsp bovis AF2122/97
acggcgaccgccaucacg

SEQ ID NO: 3130192 - RNA, 12 nt, Mycobacterium bovis subsp bovis AF2122/97
acggcgacgaca

SEQ ID NO: 3130193 - RNA, 18 nt, Mycobacterium bovis subsp bovis AF2122/97
acggcgacgaucucggcg

SEQ ID NO: 3130194 - RNA, 14 nt, Mycobacterium bovis subsp bovis AF2122/97
acggcgacgauguc

SEQ ID NO: 3130195 - RNA, 16 nt, Mycobacterium bovis subsp bovis AF2122/97
acggcgacucgaggac

SEQ ID NO: 3130196 - RNA, 20 nt, Mycobacterium bovis subsp bovis AF2122/97
acggcgagaaaaugacccac

SEQ ID NO: 3130197 - RNA, 21 nt, Mycobacterium bovis subsp bovis AF2122/97
acggcgagaaaaugacccaca

SEQ ID NO: 3130198 - RNA, 22 nt, Mycobacterium bovis subsp bovis AF2122/97
acggcgagaaaaugacccacac

SEQ ID NO: 3130199 - RNA, 13 nt, Mycobacterium bovis subsp bovis AF2122/97
acggcgaggccga

SEQ ID NO: 3130200 - RNA, 14 nt, Mycobacterium bovis subsp bovis AF2122/97
acggcgaguaggcg

SEQ ID NO: 3130201 - RNA, 17 nt, Mycobacterium bovis subsp bovis AF2122/97
acggcgaguaggcgugg

SEQ ID NO: 3130202 - RNA, 12 nt, Mycobacterium bovis subsp bovis AF2122/97
acggcgaucacc

SEQ ID NO: 3130203 - RNA, 19 nt, Mycobacterium bovis subsp bovis AF2122/97
acggcgaucaccgagaugg

SEQ ID NO: 3130204 - RNA, 23 nt, Mycobacterium bovis subsp bovis AF2122/97
acggcgauccggucggccaggcc

SEQ ID NO: 3130205 - RNA, 24 nt, Mycobacterium bovis subsp bovis AF2122/97
acggcgauccggucggccaggccg

SEQ ID NO: 3130206 - RNA, 12 nt, Mycobacterium bovis subsp bovis AF2122/97
acggcgaugcgg

SEQ ID NO: 3130207 - RNA, 14 nt, Mycobacterium bovis subsp bovis AF2122/97
acggcgaugcgguc

SEQ ID NO: 3130208 - RNA, 16 nt, Mycobacterium bovis subsp bovis AF2122/97
acggcgauggcgcgca

SEQ ID NO: 3130209 - RNA, 22 nt, Mycobacterium bovis subsp bovis AF2122/97
acggcgcaguuggcaccagccg

SEQ ID NO: 3130210 - RNA, 21 nt, Mycobacterium bovis subsp bovis AF2122/97
acggcgcaugcguaugcccac

SEQ ID NO: 3130211 - RNA, 13 nt, Mycobacterium bovis subsp bovis AF2122/97
acggcgccaggca

SEQ ID NO: 3130212 - RNA, 21 nt, Mycobacterium bovis subsp bovis AF2122/97
acggcgccaggcaccacgacc

SEQ ID NO: 3130213 - RNA, 15 nt, Mycobacterium bovis subsp bovis AF2122/97
acggcgcccagcgcu

SEQ ID NO: 3130214 - RNA, 18 nt, Mycobacterium bovis subsp bovis AF2122/97
acggcgcccauagcaccu

SEQ ID NO: 3130215 - RNA, 12 nt, Mycobacterium bovis subsp bovis AF2122/97
acggcgccgaac

SEQ ID NO: 3130216 - RNA, 14 nt, Mycobacterium bovis subsp bovis AF2122/97
acggcgccgaaccc

SEQ ID NO: 3130217 - RNA, 16 nt, Mycobacterium bovis subsp bovis AF2122/97
acggcgccgaacccgg

SEQ ID NO: 3130218 - RNA, 23 nt, Mycobacterium bovis subsp bovis AF2122/97
acggcgccgaacccgguguugag

SEQ ID NO: 3130219 - RNA, 13 nt, Mycobacterium bovis subsp bovis AF2122/97
acggcgccgccac

SEQ ID NO: 3130220 - RNA, 14 nt, Mycobacterium bovis subsp bovis AF2122/97
acggcgccgccacg

SEQ ID NO: 3130221 - RNA, 13 nt, Mycobacterium bovis subsp bovis AF2122/97
acggcgccgccca

SEQ ID NO: 3130222 - RNA, 23 nt, Mycobacterium bovis subsp bovis AF2122/97
acggcgccgcccacggggcguga

SEQ ID NO: 3130223 - RNA, 21 nt, Mycobacterium bovis subsp bovis AF2122/97
acggcgccggcaucggucagc

SEQ ID NO: 3130224 - RNA, 23 nt, Mycobacterium bovis subsp bovis AF2122/97
acggcgccgucguugugccgguc

SEQ ID NO: 3130225 - RNA, 14 nt, Mycobacterium bovis subsp bovis AF2122/97
acggcgcgccgacc

SEQ ID NO: 3130226 - RNA, 16 nt, Mycobacterium bovis subsp bovis AF2122/97
acggcgcgcgcgccgg

SEQ ID NO: 3130227 - RNA, 18 nt, Mycobacterium bovis subsp bovis AF2122/97
acggcgcgcgcgccggcu

SEQ ID NO: 3130228 - RNA, 13 nt, Mycobacterium bovis subsp bovis AF2122/97
acggcgcggcgga

SEQ ID NO: 3130229 - RNA, 22 nt, Mycobacterium bovis subsp bovis AF2122/97
acggcgcggcggagugcauguc

SEQ ID NO: 3130230 - RNA, 18 nt, Mycobacterium bovis subsp bovis AF2122/97
acggcgcgggccaccacg

SEQ ID NO: 3130231 - RNA, 23 nt, Mycobacterium bovis subsp bovis AF2122/97
acggcgcgggccaccacgcgccg

SEQ ID NO: 3130232 - RNA, 16 nt, Mycobacterium bovis subsp bovis AF2122/97
acggcgcucggcgagc

SEQ ID NO: 3130233 - RNA, 19 nt, Mycobacterium bovis subsp bovis AF2122/97
acggcgcugcccacgccgg

SEQ ID NO: 3130234 - RNA, 17 nt, Mycobacterium bovis subsp bovis AF2122/97
acggcgcugccgggauc

SEQ ID NO: 3130235 - RNA, 16 nt, Mycobacterium bovis subsp bovis AF2122/97
acggcgcuguggcggg

SEQ ID NO: 3130236 - RNA, 23 nt, Mycobacterium bovis subsp bovis AF2122/97
acggcggaagaagugcacugcga

SEQ ID NO: 3130237 - RNA, 15 nt, Mycobacterium bovis subsp bovis AF2122/97
acggcggagucgcgc

SEQ ID NO: 3130238 - RNA, 17 nt, Mycobacterium bovis subsp bovis AF2122/97
acggcggauaaccggca

SEQ ID NO: 3130239 - RNA, 22 nt, Mycobacterium bovis subsp bovis AF2122/97
acggcggaucggcggccggcac

SEQ ID NO: 3130240 - RNA, 18 nt, Mycobacterium bovis subsp bovis AF2122/97
acggcggcaacggcggca

SEQ ID NO: 3130241 - RNA, 15 nt, Mycobacterium bovis subsp bovis AF2122/97
acggcggcacgggcg

SEQ ID NO: 3130242 - RNA, 19 nt, Mycobacterium bovis subsp bovis AF2122/97
acggcggcacgggcggcca

SEQ ID NO: 3130243 - RNA, 21 nt, Mycobacterium bovis subsp bovis AF2122/97
acggcggcacgggcggccaug

SEQ ID NO: 3130244 - RNA, 23 nt, Mycobacterium bovis subsp bovis AF2122/97
acggcggcacgggcggccauggc

SEQ ID NO: 3130245 - RNA, 15 nt, Mycobacterium bovis subsp bovis AF2122/97
acggcggcagcggcg

SEQ ID NO: 3130246 - RNA, 17 nt, Mycobacterium bovis subsp bovis AF2122/97
acggcggcaggccggcc

SEQ ID NO: 3130247 - RNA, 18 nt, Mycobacterium bovis subsp bovis AF2122/97
acggcggcaggccggcca

SEQ ID NO: 3130248 - RNA, 19 nt, Mycobacterium bovis subsp bovis AF2122/97
acggcggcaggccggccac

SEQ ID NO: 3130249 - RNA, 20 nt, Mycobacterium bovis subsp bovis AF2122/97
acggcggcagucgcgguacc

SEQ ID NO: 3130250 - RNA, 12 nt, Mycobacterium bovis subsp bovis AF2122/97
acggcggccacg

SEQ ID NO: 3130251 - RNA, 22 nt, Mycobacterium bovis subsp bovis AF2122/97
acggcggcccacgcgcacucga

SEQ ID NO: 3130252 - RNA, 17 nt, Mycobacterium bovis subsp bovis AF2122/97
acggcggccccggcauu

SEQ ID NO: 3130253 - RNA, 13 nt, Mycobacterium bovis subsp bovis AF2122/97
acggcggccgcca

SEQ ID NO: 3130254 - RNA, 17 nt, Mycobacterium bovis subsp bovis AF2122/97
acggcggccgcgauggc

SEQ ID NO: 3130255 - RNA, 18 nt, Mycobacterium bovis subsp bovis AF2122/97
acggcggccuucggccgg

SEQ ID NO: 3130256 - RNA, 14 nt, Mycobacterium bovis subsp bovis AF2122/97
acggcggcgacggc

SEQ ID NO: 3130257 - RNA, 15 nt, Mycobacterium bovis subsp bovis AF2122/97
acggcggcgccgccc

SEQ ID NO: 3130258 - RNA, 16 nt, Mycobacterium bovis subsp bovis AF2122/97
acggcggcgccgccca

SEQ ID NO: 3130259 - RNA, 18 nt, Mycobacterium bovis subsp bovis AF2122/97
acggcggcgccgcccaac

SEQ ID NO: 3130260 - RNA, 16 nt, Mycobacterium bovis subsp bovis AF2122/97
acggcggcgucgauga

SEQ ID NO: 3130261 - RNA, 13 nt, Mycobacterium bovis subsp bovis AF2122/97
acggcggcgucgc

SEQ ID NO: 3130262 - RNA, 16 nt, Mycobacterium bovis subsp bovis AF2122/97
acggcggcgucgcggu

SEQ ID NO: 3130263 - RNA, 23 nt, Mycobacterium bovis subsp bovis AF2122/97
acggcggcgugggagguggcgcg

SEQ ID NO: 3130264 - RNA, 15 nt, Mycobacterium bovis subsp bovis AF2122/97
acggcggcugucggc

SEQ ID NO: 3130265 - RNA, 18 nt, Mycobacterium bovis subsp bovis AF2122/97
acggcggcugucggccgg

SEQ ID NO: 3130266 - RNA, 18 nt, Mycobacterium bovis subsp bovis AF2122/97
acggcgggaugcagcugc

SEQ ID NO: 3130267 - RNA, 21 nt, Mycobacterium bovis subsp bovis AF2122/97
acggcgggaugcagcugcccg

SEQ ID NO: 3130268 - RNA, 18 nt, Mycobacterium bovis subsp bovis AF2122/97
acggcgggccgcgcggcg

SEQ ID NO: 3130269 - RNA, 21 nt, Mycobacterium bovis subsp bovis AF2122/97
acggcgggccgcgcggcgaca

SEQ ID NO: 3130270 - RNA, 22 nt, Mycobacterium bovis subsp bovis AF2122/97
acggcgggccgcgcggcgacag

SEQ ID NO: 3130271 - RNA, 16 nt, Mycobacterium bovis subsp bovis AF2122/97
acggcgggcggccgcu

SEQ ID NO: 3130272 - RNA, 20 nt, Mycobacterium bovis subsp bovis AF2122/97
acggcggggccggcggcucg

SEQ ID NO: 3130273 - RNA, 14 nt, Mycobacterium bovis subsp bovis AF2122/97
acggcggggcggcg

SEQ ID NO: 3130274 - RNA, 18 nt, Mycobacterium bovis subsp bovis AF2122/97
acggcggguuuucucgcc

SEQ ID NO: 3130275 - RNA, 15 nt, Mycobacterium bovis subsp bovis AF2122/97
acggcgguaagggcg

SEQ ID NO: 3130276 - RNA, 20 nt, Mycobacterium bovis subsp bovis AF2122/97
acgggccggccgagcgcacu

SEQ ID NO: 3130277 - RNA, 21 nt, Mycobacterium bovis subsp bovis AF2122/97
acgggccuucagcucaccacc

SEQ ID NO: 3130278 - RNA, 20 nt, Mycobacterium bovis subsp bovis AF2122/97
acgggcgccggaacgagcgg

SEQ ID NO: 3130279 - RNA, 19 nt, Mycobacterium bovis subsp bovis AF2122/97
acgggcgcguccucgccgc

SEQ ID NO: 3130280 - RNA, 18 nt, Mycobacterium bovis subsp bovis AF2122/97
acgggcggggacggcggc

SEQ ID NO: 3130281 - RNA, 19 nt, Mycobacterium bovis subsp bovis AF2122/97
acgggcggggacggcggca

SEQ ID NO: 3130282 - RNA, 14 nt, Mycobacterium bovis subsp bovis AF2122/97
acgggcgugcugcc

SEQ ID NO: 3130283 - RNA, 19 nt, Mycobacterium bovis subsp bovis AF2122/97
acgggcuaccggcagcugc

SEQ ID NO: 3130284 - RNA, 20 nt, Mycobacterium bovis subsp bovis AF2122/97
acgggcucgcugcaccagcu

SEQ ID NO: 3130285 - RNA, 21 nt, Mycobacterium bovis subsp bovis AF2122/97
acgggcucgcugcaccagcug

SEQ ID NO: 3130286 - RNA, 12 nt, Mycobacterium bovis subsp bovis AF2122/97
acgggcucggca

SEQ ID NO: 3130287 - RNA, 17 nt, Mycobacterium bovis subsp bovis AF2122/97
acgggcucggcaggccc

SEQ ID NO: 3130288 - RNA, 18 nt, Mycobacterium bovis subsp bovis AF2122/97
acgggcucggcaggcccg

SEQ ID NO: 3130289 - RNA, 21 nt, Mycobacterium bovis subsp bovis AF2122/97
acgggcugacgaucuccaccc

SEQ ID NO: 3130290 - RNA, 17 nt, Mycobacterium bovis subsp bovis AF2122/97
acgggcuuccgacauga

SEQ ID NO: 3130291 - RNA, 20 nt, Mycobacterium bovis subsp bovis AF2122/97
acggggaacguccgcgccga

SEQ ID NO: 3130292 - RNA, 23 nt, Mycobacterium bovis subsp bovis AF2122/97
acggggaggucaaaaucagggug

SEQ ID NO: 3130293 - RNA, 17 nt, Mycobacterium bovis subsp bovis AF2122/97
acggggauggagccggu

SEQ ID NO: 3130294 - RNA, 14 nt, Mycobacterium bovis subsp bovis AF2122/97
acggggccgucucg

SEQ ID NO: 3130295 - RNA, 12 nt, Mycobacterium bovis subsp bovis AF2122/97
acggggcgacgu

SEQ ID NO: 3130296 - RNA, 15 nt, Mycobacterium bovis subsp bovis AF2122/97
acggggcggucggcc

SEQ ID NO: 3130297 - RNA, 19 nt, Mycobacterium bovis subsp bovis AF2122/97
acggggcggucggccggcu

SEQ ID NO: 3130298 - RNA, 17 nt, Mycobacterium bovis subsp bovis AF2122/97
acggggcugaccgccac

SEQ ID NO: 3130299 - RNA, 22 nt, Mycobacterium bovis subsp bovis AF2122/97
acggggcugaccgccaccccgc

SEQ ID NO: 3130300 - RNA, 17 nt, Mycobacterium bovis subsp bovis AF2122/97
acgggggcuguccaccg

SEQ ID NO: 3130301 - RNA, 21 nt, Mycobacterium bovis subsp bovis AF2122/97
acgggggucgggcgugucggg

SEQ ID NO: 3130302 - RNA, 22 nt, Mycobacterium bovis subsp bovis AF2122/97
acggggucaaucccacgcccgg

SEQ ID NO: 3130303 - RNA, 13 nt, Mycobacterium bovis subsp bovis AF2122/97
acggggucgccgg

SEQ ID NO: 3130304 - RNA, 18 nt, Mycobacterium bovis subsp bovis AF2122/97
acgggguugaccgccacc

SEQ ID NO: 3130305 - RNA, 23 nt, Mycobacterium bovis subsp bovis AF2122/97
acggguaauucuugacgccgaug

SEQ ID NO: 3130306 - RNA, 14 nt, Mycobacterium bovis subsp bovis AF2122/97
acggguacacccgc

SEQ ID NO: 3130307 - RNA, 22 nt, Mycobacterium bovis subsp bovis AF2122/97
acggguagacccacaucagguc

SEQ ID NO: 3130308 - RNA, 15 nt, Mycobacterium bovis subsp bovis AF2122/97
acggguccgggccaa

SEQ ID NO: 3130309 - RNA, 12 nt, Mycobacterium bovis subsp bovis AF2122/97
acgggucgaugu

SEQ ID NO: 3130310 - RNA, 16 nt, Mycobacterium bovis subsp bovis AF2122/97
acgggucgccgccauc

SEQ ID NO: 3130311 - RNA, 12 nt, Mycobacterium bovis subsp bovis AF2122/97
acgggucgccgg

SEQ ID NO: 3130312 - RNA, 21 nt, Mycobacterium bovis subsp bovis AF2122/97
acgggucgccggacugcggcc

SEQ ID NO: 3130313 - RNA, 12 nt, Mycobacterium bovis subsp bovis AF2122/97
acgggucgcggu

SEQ ID NO: 3130314 - RNA, 15 nt, Mycobacterium bovis subsp bovis AF2122/97
acgggucggcgccga

SEQ ID NO: 3130315 - RNA, 23 nt, Mycobacterium bovis subsp bovis AF2122/97
acgggucgggcaaccugccgggc

SEQ ID NO: 3130316 - RNA, 17 nt, Mycobacterium bovis subsp bovis AF2122/97
acgggucguaggacacc

SEQ ID NO: 3130317 - RNA, 19 nt, Mycobacterium bovis subsp bovis AF2122/97
acgggucuggccaacgccg

SEQ ID NO: 3130318 - RNA, 21 nt, Mycobacterium bovis subsp bovis AF2122/97
acgggugaaggaugcggcccc

SEQ ID NO: 3130319 - RNA, 22 nt, Mycobacterium bovis subsp bovis AF2122/97
acgggugugccuacuugcucga

SEQ ID NO: 3130320 - RNA, 13 nt, Mycobacterium bovis subsp bovis AF2122/97
acggguucacccu

SEQ ID NO: 3130321 - RNA, 16 nt, Mycobacterium bovis subsp bovis AF2122/97
acggguuggcgaucau

SEQ ID NO: 3130322 - RNA, 16 nt, Mycobacterium bovis subsp bovis AF2122/97
acgguacauccagaga

SEQ ID NO: 3130323 - RNA, 23 nt, Mycobacterium bovis subsp bovis AF2122/97
acgguacgccgccgcgacgcacu

SEQ ID NO: 3130324 - RNA, 23 nt, Mycobacterium bovis subsp bovis AF2122/97
acgguagacaagucggcgcuggc

SEQ ID NO: 3130325 - RNA, 15 nt, Mycobacterium bovis subsp bovis AF2122/97
acgguagccaagcga

SEQ ID NO: 3130326 - RNA, 23 nt, Mycobacterium bovis subsp bovis AF2122/97
acggucaaaugaauggugaccgg

SEQ ID NO: 3130327 - RNA, 12 nt, Mycobacterium bovis subsp bovis AF2122/97
acggucaacgac

SEQ ID NO: 3130328 - RNA, 15 nt, Mycobacterium bovis subsp bovis AF2122/97
acggucaagccggcg

SEQ ID NO: 3130329 - RNA, 16 nt, Mycobacterium bovis subsp bovis AF2122/97
acggucaagccggcgc

SEQ ID NO: 3130330 - RNA, 15 nt, Mycobacterium bovis subsp bovis AF2122/97
acggucaaucccggc

SEQ ID NO: 3130331 - RNA, 20 nt, Mycobacterium bovis subsp bovis AF2122/97
acggucaauugugcggcccc

SEQ ID NO: 3130332 - RNA, 18 nt, Mycobacterium bovis subsp bovis AF2122/97
acggucacacgccagccg

SEQ ID NO: 3130333 - RNA, 19 nt, Mycobacterium bovis subsp bovis AF2122/97
acggucaccggcgcaccgg

SEQ ID NO: 3130334 - RNA, 21 nt, Mycobacterium bovis subsp bovis AF2122/97
acggucagcacgcugaccaca

SEQ ID NO: 3130335 - RNA, 23 nt, Mycobacterium bovis subsp bovis AF2122/97
acggucagcacgcugaccacaac

SEQ ID NO: 3130336 - RNA, 19 nt, Mycobacterium bovis subsp bovis AF2122/97
acggucagcagacugccga

SEQ ID NO: 3130337 - RNA, 13 nt, Mycobacterium bovis subsp bovis AF2122/97
acggucagccagg

SEQ ID NO: 3130338 - RNA, 22 nt, Mycobacterium bovis subsp bovis AF2122/97
acggucagcucgcugacggcaa

SEQ ID NO: 3130339 - RNA, 17 nt, Mycobacterium bovis subsp bovis AF2122/97
acggucagguccugggu

SEQ ID NO: 3130340 - RNA, 22 nt, Mycobacterium bovis subsp bovis AF2122/97
acggucaucccuuucgcgccgc

SEQ ID NO: 3130341 - RNA, 16 nt, Mycobacterium bovis subsp bovis AF2122/97
acggucauccggccgu

SEQ ID NO: 3130342 - RNA, 17 nt, Mycobacterium bovis subsp bovis AF2122/97
acgguccacgacgucga

SEQ ID NO: 3130343 - RNA, 13 nt, Mycobacterium bovis subsp bovis AF2122/97
acgguccgccacg

SEQ ID NO: 3130344 - RNA, 15 nt, Mycobacterium bovis subsp bovis AF2122/97
acgguccgccacggc

SEQ ID NO: 3130345 - RNA, 17 nt, Mycobacterium bovis subsp bovis AF2122/97
acgguccgccacggcgg

SEQ ID NO: 3130346 - RNA, 19 nt, Mycobacterium bovis subsp bovis AF2122/97
acgguccgccacggcgggc

SEQ ID NO: 3130347 - RNA, 17 nt, Mycobacterium bovis subsp bovis AF2122/97
acgguccggcccaccag

SEQ ID NO: 3130348 - RNA, 22 nt, Mycobacterium bovis subsp bovis AF2122/97
acgguccggcccaccagcgcag

SEQ ID NO: 3130349 - RNA, 12 nt, Mycobacterium bovis subsp bovis AF2122/97
acgguccggcgu

SEQ ID NO: 3130350 - RNA, 17 nt, Mycobacterium bovis subsp bovis AF2122/97
acggucgcucggcauga

SEQ ID NO: 3130351 - RNA, 22 nt, Mycobacterium bovis subsp bovis AF2122/97
acggucggaucgauuccgccgc

SEQ ID NO: 3130352 - RNA, 14 nt, Mycobacterium bovis subsp bovis AF2122/97
acggucgucgauca

SEQ ID NO: 3130353 - RNA, 15 nt, Mycobacterium bovis subsp bovis AF2122/97
acggucgucgaucac

SEQ ID NO: 3130354 - RNA, 16 nt, Mycobacterium bovis subsp bovis AF2122/97
acggucgucgaucacg

SEQ ID NO: 3130355 - RNA, 13 nt, Mycobacterium bovis subsp bovis AF2122/97
acggucgucgcga

SEQ ID NO: 3130356 - RNA, 23 nt, Mycobacterium bovis subsp bovis AF2122/97
acggucuggcccgcgacaucggg

SEQ ID NO: 3130357 - RNA, 16 nt, Mycobacterium bovis subsp bovis AF2122/97
acggucugggucuugg

SEQ ID NO: 3130358 - RNA, 14 nt, Mycobacterium bovis subsp bovis AF2122/97
acggucuugauguu

SEQ ID NO: 3130359 - RNA, 13 nt, Mycobacterium bovis subsp bovis AF2122/97
acggugaaaccgg

SEQ ID NO: 3130360 - RNA, 16 nt, Mycobacterium bovis subsp bovis AF2122/97
acggugaaaccggccu

SEQ ID NO: 3130361 - RNA, 15 nt, Mycobacterium bovis subsp bovis AF2122/97
acggugaauucacga

SEQ ID NO: 3130362 - RNA, 11 nt, Mycobacterium bovis subsp bovis AF2122/97
acgucaccggg

SEQ ID NO: 3130363 - RNA, 18 nt, Mycobacterium bovis subsp bovis AF2122/97
acgucacgcgcggcggcg

SEQ ID NO: 3130364 - RNA, 16 nt, Mycobacterium bovis subsp bovis AF2122/97
acgucacgucgacggc

SEQ ID NO: 3130365 - RNA, 21 nt, Mycobacterium bovis subsp bovis AF2122/97
acgucacgucgacggcggccg

SEQ ID NO: 3130366 - RNA, 18 nt, Mycobacterium bovis subsp bovis AF2122/97
acgucacguggucggcca

SEQ ID NO: 3130367 - RNA, 20 nt, Mycobacterium bovis subsp bovis AF2122/97
acgucacguggucggccacc

SEQ ID NO: 3130368 - RNA, 15 nt, Mycobacterium bovis subsp bovis AF2122/97
acgucagcaccaucc

SEQ ID NO: 3130369 - RNA, 21 nt, Mycobacterium bovis subsp bovis AF2122/97
acgucaggcagcuccgccgcc

SEQ ID NO: 3130370 - RNA, 21 nt, Mycobacterium bovis subsp bovis AF2122/97
acgucauaucucgagcccucg

SEQ ID NO: 3130371 - RNA, 15 nt, Mycobacterium bovis subsp bovis AF2122/97
acgucaucgccgacc

SEQ ID NO: 3130372 - RNA, 20 nt, Mycobacterium bovis subsp bovis AF2122/97
acgucaucuggcgcugcugg

SEQ ID NO: 3130373 - RNA, 14 nt, Mycobacterium bovis subsp bovis AF2122/97
acguccaacagcgc

SEQ ID NO: 3130374 - RNA, 15 nt, Mycobacterium bovis subsp bovis AF2122/97
acguccaacucggcc

SEQ ID NO: 3130375 - RNA, 19 nt, Mycobacterium bovis subsp bovis AF2122/97
acguccagccguggcggcg

SEQ ID NO: 3130376 - RNA, 22 nt, Mycobacterium bovis subsp bovis AF2122/97
acguccagccguggcggcgggc

SEQ ID NO: 3130377 - RNA, 18 nt, Mycobacterium bovis subsp bovis AF2122/97
acguccaguggcagccag

SEQ ID NO: 3130378 - RNA, 19 nt, Mycobacterium bovis subsp bovis AF2122/97
acguccaguggcagccagc

SEQ ID NO: 3130379 - RNA, 19 nt, Mycobacterium bovis subsp bovis AF2122/97
acguccaucaccggcggcc

SEQ ID NO: 3130380 - RNA, 20 nt, Mycobacterium bovis subsp bovis AF2122/97
acguccaucaccggcggccc

SEQ ID NO: 3130381 - RNA, 15 nt, Mycobacterium bovis subsp bovis AF2122/97
acguccaucccggcg

SEQ ID NO: 3130382 - RNA, 17 nt, Mycobacterium bovis subsp bovis AF2122/97
acguccccuguugcaga

SEQ ID NO: 3130383 - RNA, 21 nt, Mycobacterium bovis subsp bovis AF2122/97
acgucccgguaauccacucca

SEQ ID NO: 3130384 - RNA, 17 nt, Mycobacterium bovis subsp bovis AF2122/97
acguccgcaaccucgcc

SEQ ID NO: 3130385 - RNA, 16 nt, Mycobacterium bovis subsp bovis AF2122/97
acguccgcggucgcag

SEQ ID NO: 3130386 - RNA, 21 nt, Mycobacterium bovis subsp bovis AF2122/97
acguccugcccgucgucggca

SEQ ID NO: 3130387 - RNA, 20 nt, Mycobacterium bovis subsp bovis AF2122/97
acgucgacaccgaggaccuc

SEQ ID NO: 3130388 - RNA, 16 nt, Mycobacterium bovis subsp bovis AF2122/97
acgucgacccccugcc

SEQ ID NO: 3130389 - RNA, 21 nt, Mycobacterium bovis subsp bovis AF2122/97
acgucgaccgugucaccgccg

SEQ ID NO: 3130390 - RNA, 22 nt, Mycobacterium bovis subsp bovis AF2122/97
acgucgaccgugucaccgccgg

SEQ ID NO: 3130391 - RNA, 17 nt, Mycobacterium bovis subsp bovis AF2122/97
acgucgaccucggcaac

SEQ ID NO: 3130392 - RNA, 18 nt, Mycobacterium bovis subsp bovis AF2122/97
acgucgacgccggccagc

SEQ ID NO: 3130393 - RNA, 15 nt, Mycobacterium bovis subsp bovis AF2122/97
acgucgacggcgaug

SEQ ID NO: 3130394 - RNA, 16 nt, Mycobacterium bovis subsp bovis AF2122/97
acgucgacggcgaugg

SEQ ID NO: 3130395 - RNA, 17 nt, Mycobacterium bovis subsp bovis AF2122/97
acgucgacggcgauggc

SEQ ID NO: 3130396 - RNA, 17 nt, Mycobacterium bovis subsp bovis AF2122/97
acgucgacggcggccgc

SEQ ID NO: 3130397 - RNA, 15 nt, Mycobacterium bovis subsp bovis AF2122/97
acgucgacuucgccc

SEQ ID NO: 3130398 - RNA, 16 nt, Mycobacterium bovis subsp bovis AF2122/97
acgucgacuucgcccg

SEQ ID NO: 3130399 - RNA, 14 nt, Mycobacterium bovis subsp bovis AF2122/97
acgucgagcagccg

SEQ ID NO: 3130400 - RNA, 16 nt, Mycobacterium bovis subsp bovis AF2122/97
acgucgagcagcgcca

SEQ ID NO: 3130401 - RNA, 14 nt, Mycobacterium bovis subsp bovis AF2122/97
acgucgagguugau

SEQ ID NO: 3130402 - RNA, 13 nt, Mycobacterium bovis subsp bovis AF2122/97
acgucgaucaaca

SEQ ID NO: 3130403 - RNA, 19 nt, Mycobacterium bovis subsp bovis AF2122/97
acgucgaucucggcgcagg

SEQ ID NO: 3130404 - RNA, 16 nt, Mycobacterium bovis subsp bovis AF2122/97
acgucgcauugugcaa

SEQ ID NO: 3130405 - RNA, 13 nt, Mycobacterium bovis subsp bovis AF2122/97
acgucgccagguc

SEQ ID NO: 3130406 - RNA, 14 nt, Mycobacterium bovis subsp bovis AF2122/97
acgucgccgcggcg

SEQ ID NO: 3130407 - RNA, 18 nt, Mycobacterium bovis subsp bovis AF2122/97
acgucgccggcuaccgcc

SEQ ID NO: 3130408 - RNA, 15 nt, Mycobacterium bovis subsp bovis AF2122/97
acgucgccucgagau

SEQ ID NO: 3130409 - RNA, 16 nt, Mycobacterium bovis subsp bovis AF2122/97
acgucgcgcaucgccu

SEQ ID NO: 3130410 - RNA, 21 nt, Mycobacterium bovis subsp bovis AF2122/97
acgucgcgccaggcgcgaucg

SEQ ID NO: 3130411 - RNA, 19 nt, Mycobacterium bovis subsp bovis AF2122/97
acgucgcggauugccgcgc

SEQ ID NO: 3130412 - RNA, 20 nt, Mycobacterium bovis subsp bovis AF2122/97
acgucgcggcguuguugcgg

SEQ ID NO: 3130413 - RNA, 22 nt, Mycobacterium bovis subsp bovis AF2122/97
acgucgcgguaggcgggagaga

SEQ ID NO: 3130414 - RNA, 24 nt, Mycobacterium bovis subsp bovis AF2122/97
acgucgcguucuccggcaccgguc

SEQ ID NO: 3130415 - RNA, 17 nt, Mycobacterium bovis subsp bovis AF2122/97
acgucgcuagaucccag

SEQ ID NO: 3130416 - RNA, 15 nt, Mycobacterium bovis subsp bovis AF2122/97
acgucgcuccgaugu

SEQ ID NO: 3130417 - RNA, 20 nt, Mycobacterium bovis subsp bovis AF2122/97
acgucgcuguaggccagccc

SEQ ID NO: 3130418 - RNA, 22 nt, Mycobacterium bovis subsp bovis AF2122/97
acgucggcccauaacagcuggc

SEQ ID NO: 3130419 - RNA, 14 nt, Mycobacterium bovis subsp bovis AF2122/97
acgucggcgaacgc

SEQ ID NO: 3130420 - RNA, 12 nt, Mycobacterium bovis subsp bovis AF2122/97
acgucggcgaau

SEQ ID NO: 3130421 - RNA, 14 nt, Mycobacterium bovis subsp bovis AF2122/97
acgucggcgaccag

SEQ ID NO: 3130422 - RNA, 22 nt, Mycobacterium bovis subsp bovis AF2122/97
acgucggcgcguccgcaggcga

SEQ ID NO: 3130423 - RNA, 12 nt, Mycobacterium bovis subsp bovis AF2122/97
acgucggcggcc

SEQ ID NO: 3130424 - RNA, 18 nt, Mycobacterium bovis subsp bovis AF2122/97
acgucggcguggucgcgc

SEQ ID NO: 3130425 - RNA, 18 nt, Mycobacterium bovis subsp bovis AF2122/97
acgucggcucgucgcucg

SEQ ID NO: 3130426 - RNA, 18 nt, Mycobacterium bovis subsp bovis AF2122/97
acgucgggaucgccaugu

SEQ ID NO: 3130427 - RNA, 18 nt, Mycobacterium bovis subsp bovis AF2122/97
acgucgggcauggcggcg

SEQ ID NO: 3130428 - RNA, 15 nt, Mycobacterium bovis subsp bovis AF2122/97
acgucgggcccgaug

SEQ ID NO: 3130429 - RNA, 20 nt, Mycobacterium bovis subsp bovis AF2122/97
acgucgggcccgaugucguc

SEQ ID NO: 3130430 - RNA, 21 nt, Mycobacterium bovis subsp bovis AF2122/97
acgucgguaaacguugggaaa

SEQ ID NO: 3130431 - RNA, 15 nt, Mycobacterium bovis subsp bovis AF2122/97
acgucgguccaccca

SEQ ID NO: 3130432 - RNA, 15 nt, Mycobacterium bovis subsp bovis AF2122/97
acgucggugaagucc

SEQ ID NO: 3130433 - RNA, 18 nt, Mycobacterium bovis subsp bovis AF2122/97
acgucggugaccucggcg

SEQ ID NO: 3130434 - RNA, 23 nt, Mycobacterium bovis subsp bovis AF2122/97
acgucggugugcgcgccaggcuc

SEQ ID NO: 3130435 - RNA, 16 nt, Mycobacterium bovis subsp bovis AF2122/97
acgucgugaccggcgg

SEQ ID NO: 3130436 - RNA, 18 nt, Mycobacterium bovis subsp bovis AF2122/97
acgucguggcgcucggcg

SEQ ID NO: 3130437 - RNA, 22 nt, Mycobacterium bovis subsp bovis AF2122/97
acgucguugggcaugucgccga

SEQ ID NO: 3130438 - RNA, 21 nt, Mycobacterium bovis subsp bovis AF2122/97
acgucucuggugcaggugagu

SEQ ID NO: 3130439 - RNA, 18 nt, Mycobacterium bovis subsp bovis AF2122/97
acgucugcagccucgaug

SEQ ID NO: 3130440 - RNA, 17 nt, Mycobacterium bovis subsp bovis AF2122/97
acgucugccacgucggc

SEQ ID NO: 3130441 - RNA, 15 nt, Mycobacterium bovis subsp bovis AF2122/97
acgucuggguugcgu

SEQ ID NO: 3130442 - RNA, 17 nt, Mycobacterium bovis subsp bovis AF2122/97
acgucuucacucacgac

SEQ ID NO: 3130443 - RNA, 18 nt, Mycobacterium bovis subsp bovis AF2122/97
acgucuucacucacgacg

SEQ ID NO: 3130444 - RNA, 23 nt, Mycobacterium bovis subsp bovis AF2122/97
acgucuucgggcucguccagcaa

SEQ ID NO: 3130445 - RNA, 19 nt, Mycobacterium bovis subsp bovis AF2122/97
acgucuuggaacacggccg

SEQ ID NO: 3130446 - RNA, 18 nt, Mycobacterium bovis subsp bovis AF2122/97
acgugaacugagggcgga

SEQ ID NO: 3130447 - RNA, 21 nt, Mycobacterium bovis subsp bovis AF2122/97
acgugaagccaagcgacucgc

SEQ ID NO: 3130448 - RNA, 17 nt, Mycobacterium bovis subsp bovis AF2122/97
acguugugccuuagcug

SEQ ID NO: 3130449 - RNA, 19 nt, Mycobacterium bovis subsp bovis AF2122/97
acuaaccuggcguagauca

SEQ ID NO: 3130450 - RNA, 16 nt, Mycobacterium bovis subsp bovis AF2122/97
acuaacggcagccacc

SEQ ID NO: 3130451 - RNA, 16 nt, Mycobacterium bovis subsp bovis AF2122/97
acuaagggcacuccac

SEQ ID NO: 3130452 - RNA, 13 nt, Mycobacterium bovis subsp bovis AF2122/97
acuaccacccgca

SEQ ID NO: 3130453 - RNA, 14 nt, Mycobacterium bovis subsp bovis AF2122/97
acuacccagccagc

SEQ ID NO: 3130454 - RNA, 14 nt, Mycobacterium bovis subsp bovis AF2122/97
acuaccgacgcacc

SEQ ID NO: 3130455 - RNA, 18 nt, Mycobacterium bovis subsp bovis AF2122/97
acuacgggucuggccaac

SEQ ID NO: 3130456 - RNA, 14 nt, Mycobacterium bovis subsp bovis AF2122/97
acuacggugcccug

SEQ ID NO: 3130457 - RNA, 23 nt, Mycobacterium bovis subsp bovis AF2122/97
acuacuaggccccuggccgccgc

SEQ ID NO: 3130458 - RNA, 16 nt, Mycobacterium bovis subsp bovis AF2122/97
acuacuccggucccgc

SEQ ID NO: 3130459 - RNA, 16 nt, Mycobacterium bovis subsp bovis AF2122/97
acuagcagcgggcugc

SEQ ID NO: 3130460 - RNA, 16 nt, Mycobacterium bovis subsp bovis AF2122/97
acuagccaguuacguu

SEQ ID NO: 3130461 - RNA, 13 nt, Mycobacterium bovis subsp bovis AF2122/97
acuagccgaucca

SEQ ID NO: 3130462 - RNA, 15 nt, Mycobacterium bovis subsp bovis AF2122/97
acuagccgauccagc

SEQ ID NO: 3130463 - RNA, 19 nt, Mycobacterium bovis subsp bovis AF2122/97
acuagccgauccagcaggc

SEQ ID NO: 3130464 - RNA, 22 nt, Mycobacterium bovis subsp bovis AF2122/97
acuagccgauccagcaggccgu

SEQ ID NO: 3130465 - RNA, 14 nt, Mycobacterium bovis subsp bovis AF2122/97
acuaggcccagcac

SEQ ID NO: 3130466 - RNA, 16 nt, Mycobacterium bovis subsp bovis AF2122/97
acuaggucgccggcca

SEQ ID NO: 3130467 - RNA, 16 nt, Mycobacterium bovis subsp bovis AF2122/97
acuagguucagcgacu

SEQ ID NO: 3130468 - RNA, 19 nt, Mycobacterium bovis subsp bovis AF2122/97
acuaucgcaccuccggcgu

SEQ ID NO: 3130469 - RNA, 23 nt, Mycobacterium bovis subsp bovis AF2122/97
acuaucgcaccuccggcguggcu

SEQ ID NO: 3130470 - RNA, 18 nt, Mycobacterium bovis subsp bovis AF2122/97
acuaucgucgugucgccg

SEQ ID NO: 3130471 - RNA, 15 nt, Mycobacterium bovis subsp bovis AF2122/97
acuaucguugugcgg

SEQ ID NO: 3130472 - RNA, 15 nt, Mycobacterium bovis subsp bovis AF2122/97
acucaacaccagcaa

SEQ ID NO: 3130473 - RNA, 15 nt, Mycobacterium bovis subsp bovis AF2122/97
acucaacccgccguc

SEQ ID NO: 3130474 - RNA, 20 nt, Mycobacterium bovis subsp bovis AF2122/97
acucaagauaacggcgaccg

SEQ ID NO: 3130475 - RNA, 23 nt, Mycobacterium bovis subsp bovis AF2122/97
acucacauuggccaggucggcca

SEQ ID NO: 3130476 - RNA, 16 nt, Mycobacterium bovis subsp bovis AF2122/97
acucaccagcaccccg

SEQ ID NO: 3130477 - RNA, 17 nt, Mycobacterium bovis subsp bovis AF2122/97
acucaccagcaccccga

SEQ ID NO: 3130478 - RNA, 22 nt, Mycobacterium bovis subsp bovis AF2122/97
acucacccgagccaucaccgca

SEQ ID NO: 3130479 - RNA, 18 nt, Mycobacterium bovis subsp bovis AF2122/97
acucacccgggcagccug

SEQ ID NO: 3130480 - RNA, 22 nt, Mycobacterium bovis subsp bovis AF2122/97
acucacccgggcagccugcugc

SEQ ID NO: 3130481 - RNA, 23 nt, Mycobacterium bovis subsp bovis AF2122/97
acucacccgggcagccugcugca

SEQ ID NO: 3130482 - RNA, 16 nt, Mycobacterium bovis subsp bovis AF2122/97
acucacgggugcuggc

SEQ ID NO: 3130483 - RNA, 14 nt, Mycobacterium bovis subsp bovis AF2122/97
acucacggugaucg

SEQ ID NO: 3130484 - RNA, 18 nt, Mycobacterium bovis subsp bovis AF2122/97
acucacuaccgaucacau

SEQ ID NO: 3130485 - RNA, 22 nt, Mycobacterium bovis subsp bovis AF2122/97
acucacucgguguuucgugcca

SEQ ID NO: 3130486 - RNA, 20 nt, Mycobacterium bovis subsp bovis AF2122/97
acucagcccgacaccgaucg

SEQ ID NO: 3130487 - RNA, 14 nt, Mycobacterium bovis subsp bovis AF2122/97
acucagcccggcac

SEQ ID NO: 3130488 - RNA, 21 nt, Mycobacterium bovis subsp bovis AF2122/97
acucaggaucccgguggcagc

SEQ ID NO: 3130489 - RNA, 19 nt, Mycobacterium bovis subsp bovis AF2122/97
acucaggccgguaccggga

SEQ ID NO: 3130490 - RNA, 15 nt, Mycobacterium bovis subsp bovis AF2122/97
acucagguccgcaac

SEQ ID NO: 3130491 - RNA, 17 nt, Mycobacterium bovis subsp bovis AF2122/97
acucaguguuccgccac

SEQ ID NO: 3130492 - RNA, 22 nt, Mycobacterium bovis subsp bovis AF2122/97
acucaguguuccgccacccgcc

SEQ ID NO: 3130493 - RNA, 21 nt, Mycobacterium bovis subsp bovis AF2122/97
acucaucgacguuccagcagu

SEQ ID NO: 3130494 - RNA, 19 nt, Mycobacterium bovis subsp bovis AF2122/97
acucaugcccgacgagucg

SEQ ID NO: 3130495 - RNA, 19 nt, Mycobacterium bovis subsp bovis AF2122/97
acucauuacgguagacguu

SEQ ID NO: 3130496 - RNA, 20 nt, Mycobacterium bovis subsp bovis AF2122/97
acucauuacgguagacguug

SEQ ID NO: 3130497 - RNA, 14 nt, Mycobacterium bovis subsp bovis AF2122/97
acuccaagaugccg

SEQ ID NO: 3130498 - RNA, 14 nt, Mycobacterium bovis subsp bovis AF2122/97
acuccaagucacag

SEQ ID NO: 3130499 - RNA, 16 nt, Mycobacterium bovis subsp bovis AF2122/97
acuccaccccacccag

SEQ ID NO: 3130500 - RNA, 13 nt, Mycobacterium bovis subsp bovis AF2122/97
acuccaccgcgcc

SEQ ID NO: 3130501 - RNA, 17 nt, Mycobacterium bovis subsp bovis AF2122/97
acuccaccgcuggcccg

SEQ ID NO: 3130502 - RNA, 22 nt, Mycobacterium bovis subsp bovis AF2122/97
acuccacgaucggcccagcccu

SEQ ID NO: 3130503 - RNA, 13 nt, Mycobacterium bovis subsp bovis AF2122/97
acuccagcaccag

SEQ ID NO: 3130504 - RNA, 15 nt, Mycobacterium bovis subsp bovis AF2122/97
acuccagcaccagca

SEQ ID NO: 3130505 - RNA, 16 nt, Mycobacterium bovis subsp bovis AF2122/97
acuccagcaccagcac

SEQ ID NO: 3130506 - RNA, 17 nt, Mycobacterium bovis subsp bovis AF2122/97
acuccagcaccagcacg

SEQ ID NO: 3130507 - RNA, 14 nt, Mycobacterium bovis subsp bovis AF2122/97
acuccagccgcaac

SEQ ID NO: 3130508 - RNA, 22 nt, Mycobacterium bovis subsp bovis AF2122/97
acuccagccgcaacaccccccg

SEQ ID NO: 3130509 - RNA, 12 nt, Mycobacterium bovis subsp bovis AF2122/97
acuccagcgaac

SEQ ID NO: 3130510 - RNA, 19 nt, Mycobacterium bovis subsp bovis AF2122/97
acuccagcgaaccgacccg

SEQ ID NO: 3130511 - RNA, 14 nt, Mycobacterium bovis subsp bovis AF2122/97
acuccagcggcggg

SEQ ID NO: 3130512 - RNA, 14 nt, Mycobacterium bovis subsp bovis AF2122/97
acuccagcuugccg

SEQ ID NO: 3130513 - RNA, 18 nt, Mycobacterium bovis subsp bovis AF2122/97
acuccagcuugccgaccu

SEQ ID NO: 3130514 - RNA, 16 nt, Mycobacterium bovis subsp bovis AF2122/97
acuccaucaccacacc

SEQ ID NO: 3130515 - RNA, 22 nt, Mycobacterium bovis subsp bovis AF2122/97
acuccaucaccacaccggcagc

SEQ ID NO: 3130516 - RNA, 21 nt, Mycobacterium bovis subsp bovis AF2122/97
acuccaugaaucgcgcuucag

SEQ ID NO: 3130517 - RNA, 22 nt, Mycobacterium bovis subsp bovis AF2122/97
acuccaugaaucgcgcuucagg

SEQ ID NO: 3130518 - RNA, 22 nt, Mycobacterium bovis subsp bovis AF2122/97
acuccaugagccguagugcaau

SEQ ID NO: 3130519 - RNA, 14 nt, Mycobacterium bovis subsp bovis AF2122/97
acuccccagcccca

SEQ ID NO: 3130520 - RNA, 16 nt, Mycobacterium bovis subsp bovis AF2122/97
acuccccagccccacc

SEQ ID NO: 3130521 - RNA, 15 nt, Mycobacterium bovis subsp bovis AF2122/97
acucccccacacacc

SEQ ID NO: 3130522 - RNA, 20 nt, Mycobacterium bovis subsp bovis AF2122/97
acucccccgaaccugcggca

SEQ ID NO: 3130523 - RNA, 15 nt, Mycobacterium bovis subsp bovis AF2122/97
acuccccgccgggca

SEQ ID NO: 3130524 - RNA, 14 nt, Mycobacterium bovis subsp bovis AF2122/97
acucccgcgaucgc

SEQ ID NO: 3130525 - RNA, 22 nt, Mycobacterium bovis subsp bovis AF2122/97
acucccgcgaucgcgacacggc

SEQ ID NO: 3130526 - RNA, 16 nt, Mycobacterium bovis subsp bovis AF2122/97
acucccgcgcgggcgg

SEQ ID NO: 3130527 - RNA, 22 nt, Mycobacterium bovis subsp bovis AF2122/97
acucccggauauugccaucccu

SEQ ID NO: 3130528 - RNA, 16 nt, Mycobacterium bovis subsp bovis AF2122/97
acucccggcucggcca

SEQ ID NO: 3130529 - RNA, 18 nt, Mycobacterium bovis subsp bovis AF2122/97
acucccggcucggccagc

SEQ ID NO: 3130530 - RNA, 20 nt, Mycobacterium bovis subsp bovis AF2122/97
acucccggcucggccagcca

SEQ ID NO: 3130531 - RNA, 15 nt, Mycobacterium bovis subsp bovis AF2122/97
acucccucgaucacg

SEQ ID NO: 3130532 - RNA, 21 nt, Mycobacterium bovis subsp bovis AF2122/97
acucccucgaucacggcggcc

SEQ ID NO: 3130533 - RNA, 18 nt, Mycobacterium bovis subsp bovis AF2122/97
acucccuggccgcuucga

SEQ ID NO: 3130534 - RNA, 14 nt, Mycobacterium bovis subsp bovis AF2122/97
acuccgacggcccg

SEQ ID NO: 3130535 - RNA, 15 nt, Mycobacterium bovis subsp bovis AF2122/97
acuccgaucgggccc

SEQ ID NO: 3130536 - RNA, 22 nt, Mycobacterium bovis subsp bovis AF2122/97
acuccgccaacaucuccgcguc

SEQ ID NO: 3130537 - RNA, 22 nt, Mycobacterium bovis subsp bovis AF2122/97
acuccgccaccaucgccucggc

SEQ ID NO: 3130538 - RNA, 20 nt, Mycobacterium bovis subsp bovis AF2122/97
acuccgccgauagcaccgga

SEQ ID NO: 3130539 - RNA, 15 nt, Mycobacterium bovis subsp bovis AF2122/97
acuccgcgagcccgg

SEQ ID NO: 3130540 - RNA, 17 nt, Mycobacterium bovis subsp bovis AF2122/97
acuccgcgagcccggcc

SEQ ID NO: 3130541 - RNA, 16 nt, Mycobacterium bovis subsp bovis AF2122/97
acuccgcgcgcugggc

SEQ ID NO: 3130542 - RNA, 17 nt, Mycobacterium bovis subsp bovis AF2122/97
acuccgcgcgcugggcc

SEQ ID NO: 3130543 - RNA, 15 nt, Mycobacterium bovis subsp bovis AF2122/97
acuccgcggaaccca

SEQ ID NO: 3130544 - RNA, 20 nt, Mycobacterium bovis subsp bovis AF2122/97
acuccgcggaacccagcacu

SEQ ID NO: 3130545 - RNA, 13 nt, Mycobacterium bovis subsp bovis AF2122/97
acuccgcggcgcg

SEQ ID NO: 3130546 - RNA, 18 nt, Mycobacterium bovis subsp bovis AF2122/97
acuccggcaagcacaccg

SEQ ID NO: 3130547 - RNA, 21 nt, Mycobacterium bovis subsp bovis AF2122/97
acuccggcaagcacaccgcca

SEQ ID NO: 3130548 - RNA, 22 nt, Mycobacterium bovis subsp bovis AF2122/97
acuccggcaagcacaccgccag

SEQ ID NO: 3130549 - RNA, 13 nt, Mycobacterium bovis subsp bovis AF2122/97
acuccggccgcac

SEQ ID NO: 3130550 - RNA, 13 nt, Mycobacterium bovis subsp bovis AF2122/97
acuccggcgacga

SEQ ID NO: 3130551 - RNA, 19 nt, Mycobacterium bovis subsp bovis AF2122/97
acuccggcgacgaucucgc

SEQ ID NO: 3130552 - RNA, 12 nt, Mycobacterium bovis subsp bovis AF2122/97
acuccggcggcu

SEQ ID NO: 3130553 - RNA, 21 nt, Mycobacterium bovis subsp bovis AF2122/97
acuccgggcucggcgucgccg

SEQ ID NO: 3130554 - RNA, 22 nt, Mycobacterium bovis subsp bovis AF2122/97
acuccgggcucggcgucgccgc

SEQ ID NO: 3130555 - RNA, 18 nt, Mycobacterium bovis subsp bovis AF2122/97
acuccggucaacacccgc

SEQ ID NO: 3130556 - RNA, 15 nt, Mycobacterium bovis subsp bovis AF2122/97
acuccggucagcgcg

SEQ ID NO: 3130557 - RNA, 18 nt, Mycobacterium bovis subsp bovis AF2122/97
acuccggucagcgcggcg

SEQ ID NO: 3130558 - RNA, 13 nt, Mycobacterium bovis subsp bovis AF2122/97
acuccggucccgc

SEQ ID NO: 3130559 - RNA, 13 nt, Mycobacterium bovis subsp bovis AF2122/97
acuccguccgccg

SEQ ID NO: 3130560 - RNA, 22 nt, Mycobacterium bovis subsp bovis AF2122/97
acuccgugcuuccauucgcggu

SEQ ID NO: 3130561 - RNA, 19 nt, Mycobacterium bovis subsp bovis AF2122/97
acuccguugccaccuuggu

SEQ ID NO: 3130562 - RNA, 20 nt, Mycobacterium bovis subsp bovis AF2122/97
acuccuagccaacgagcgcg

SEQ ID NO: 3130563 - RNA, 13 nt, Mycobacterium bovis subsp bovis AF2122/97
acuccucagccgc

SEQ ID NO: 3130564 - RNA, 15 nt, Mycobacterium bovis subsp bovis AF2122/97
acuccucagccgccu

SEQ ID NO: 3130565 - RNA, 16 nt, Mycobacterium bovis subsp bovis AF2122/97
acuccucucucuuggu

SEQ ID NO: 3130566 - RNA, 13 nt, Mycobacterium bovis subsp bovis AF2122/97
acuccugcacaca

SEQ ID NO: 3130567 - RNA, 13 nt, Mycobacterium bovis subsp bovis AF2122/97
acuccugcagccc

SEQ ID NO: 3130568 - RNA, 22 nt, Mycobacterium bovis subsp bovis AF2122/97
acuccugcagcccgggcagcac

SEQ ID NO: 3130569 - RNA, 16 nt, Mycobacterium bovis subsp bovis AF2122/97
acuccugcggcaccgc

SEQ ID NO: 3130570 - RNA, 17 nt, Mycobacterium bovis subsp bovis AF2122/97
acuccugcggcaccgcu

SEQ ID NO: 3130571 - RNA, 17 nt, Mycobacterium bovis subsp bovis AF2122/97
acucgaacaaccccggu

SEQ ID NO: 3130572 - RNA, 18 nt, Mycobacterium bovis subsp bovis AF2122/97
acucgaaccguuucggga

SEQ ID NO: 3130573 - RNA, 13 nt, Mycobacterium bovis subsp bovis AF2122/97
acucgaagcgggc

SEQ ID NO: 3130574 - RNA, 16 nt, Mycobacterium bovis subsp bovis AF2122/97
acucgaauccggccca

SEQ ID NO: 3130575 - RNA, 15 nt, Mycobacterium bovis subsp bovis AF2122/97
acucgaccaccgccg

SEQ ID NO: 3130576 - RNA, 15 nt, Mycobacterium bovis subsp bovis AF2122/97
acucgacccggccaa

SEQ ID NO: 3130577 - RNA, 13 nt, Mycobacterium bovis subsp bovis AF2122/97
acucgaccgcgac

SEQ ID NO: 3130578 - RNA, 14 nt, Mycobacterium bovis subsp bovis AF2122/97
acucgaccgcgacg

SEQ ID NO: 3130579 - RNA, 22 nt, Mycobacterium bovis subsp bovis AF2122/97
acucgacgucgucgucgacggc

SEQ ID NO: 3130580 - RNA, 18 nt, Mycobacterium bovis subsp bovis AF2122/97
acucgagagcgaucaacg

SEQ ID NO: 3130581 - RNA, 18 nt, Mycobacterium bovis subsp bovis AF2122/97
acucgagaguggccucgu

SEQ ID NO: 3130582 - RNA, 21 nt, Mycobacterium bovis subsp bovis AF2122/97
acucgagcgcucacauucaac

SEQ ID NO: 3130583 - RNA, 17 nt, Mycobacterium bovis subsp bovis AF2122/97
acucgaggucgagcgcc

SEQ ID NO: 3130584 - RNA, 23 nt, Mycobacterium bovis subsp bovis AF2122/97
acucgaggucgagcgccgcggac

SEQ ID NO: 3130585 - RNA, 19 nt, Mycobacterium bovis subsp bovis AF2122/97
acucgauauaacccggcuc

SEQ ID NO: 3130586 - RNA, 15 nt, Mycobacterium bovis subsp bovis AF2122/97
acucgaucaccggca

SEQ ID NO: 3130587 - RNA, 19 nt, Mycobacterium bovis subsp bovis AF2122/97
acucgcagcaacaccucgu

SEQ ID NO: 3130588 - RNA, 15 nt, Mycobacterium bovis subsp bovis AF2122/97
acucgccaccgcggc

SEQ ID NO: 3130589 - RNA, 17 nt, Mycobacterium bovis subsp bovis AF2122/97
acucgccacggucgccg

SEQ ID NO: 3130590 - RNA, 20 nt, Mycobacterium bovis subsp bovis AF2122/97
acucgccacucagcccgaca

SEQ ID NO: 3130591 - RNA, 15 nt, Mycobacterium bovis subsp bovis AF2122/97
acucgcccaagcgca

SEQ ID NO: 3130592 - RNA, 21 nt, Mycobacterium bovis subsp bovis AF2122/97
acucgcccaagcgcagccugg

SEQ ID NO: 3130593 - RNA, 15 nt, Mycobacterium bovis subsp bovis AF2122/97
acucgcccgcugccg

SEQ ID NO: 3130594 - RNA, 16 nt, Mycobacterium bovis subsp bovis AF2122/97
acucgccgaaaucggc

SEQ ID NO: 3130595 - RNA, 19 nt, Mycobacterium bovis subsp bovis AF2122/97
acucgccgaaucgcugacc

SEQ ID NO: 3130596 - RNA, 18 nt, Mycobacterium bovis subsp bovis AF2122/97
acucgccgacgucgacgc

SEQ ID NO: 3130597 - RNA, 23 nt, Mycobacterium bovis subsp bovis AF2122/97
acucgccgacgucgacgccggcc

SEQ ID NO: 3130598 - RNA, 13 nt, Mycobacterium bovis subsp bovis AF2122/97
acucgccgcuggc

SEQ ID NO: 3130599 - RNA, 22 nt, Mycobacterium bovis subsp bovis AF2122/97
acucgccgcuggcaaucccgcg

SEQ ID NO: 3130600 - RNA, 21 nt, Mycobacterium bovis subsp bovis AF2122/97
acucgccggcgaauccgcaca

SEQ ID NO: 3130601 - RNA, 19 nt, Mycobacterium bovis subsp bovis AF2122/97
acucgcgcacauaggcgau

SEQ ID NO: 3130602 - RNA, 12 nt, Mycobacterium bovis subsp bovis AF2122/97
acucgcgcagga

SEQ ID NO: 3130603 - RNA, 23 nt, Mycobacterium bovis subsp bovis AF2122/97
acucgcgcgucgucgcgcugaac

SEQ ID NO: 3130604 - RNA, 15 nt, Mycobacterium bovis subsp bovis AF2122/97
acucgcggauccggg

SEQ ID NO: 3130605 - RNA, 17 nt, Mycobacterium bovis subsp bovis AF2122/97
acucgcggauccgggcg

SEQ ID NO: 3130606 - RNA, 15 nt, Mycobacterium bovis subsp bovis AF2122/97
acucgcggccggcgu

SEQ ID NO: 3130607 - RNA, 22 nt, Mycobacterium bovis subsp bovis AF2122/97
acucgcggccggcgucggcguc

SEQ ID NO: 3130608 - RNA, 13 nt, Mycobacterium bovis subsp bovis AF2122/97
acucgcgguggcc

SEQ ID NO: 3130609 - RNA, 16 nt, Mycobacterium bovis subsp bovis AF2122/97
acucgcguggcaccga

SEQ ID NO: 3130610 - RNA, 12 nt, Mycobacterium bovis subsp bovis AF2122/97
acucgcucagga

SEQ ID NO: 3130611 - RNA, 17 nt, Mycobacterium bovis subsp bovis AF2122/97
acucggaauucggcguc

SEQ ID NO: 3130612 - RNA, 14 nt, Mycobacterium bovis subsp bovis AF2122/97
acucggacccaccc

SEQ ID NO: 3130613 - RNA, 15 nt, Mycobacterium bovis subsp bovis AF2122/97
acucggacgcgccgg

SEQ ID NO: 3130614 - RNA, 21 nt, Mycobacterium bovis subsp bovis AF2122/97
acucggauagccccguguugu

SEQ ID NO: 3130615 - RNA, 16 nt, Mycobacterium bovis subsp bovis AF2122/97
acucggcaccgcggcc

SEQ ID NO: 3130616 - RNA, 14 nt, Mycobacterium bovis subsp bovis AF2122/97
acucggcaccugga

SEQ ID NO: 3130617 - RNA, 22 nt, Mycobacterium bovis subsp bovis AF2122/97
acucggcauccaggcugucgcg

SEQ ID NO: 3130618 - RNA, 17 nt, Mycobacterium bovis subsp bovis AF2122/97
acucggcauucaccgcg

SEQ ID NO: 3130619 - RNA, 17 nt, Mycobacterium bovis subsp bovis AF2122/97
acucggccaacgacggc

SEQ ID NO: 3130620 - RNA, 19 nt, Mycobacterium bovis subsp bovis AF2122/97
acucggccaacgacggccg

SEQ ID NO: 3130621 - RNA, 22 nt, Mycobacterium bovis subsp bovis AF2122/97
acugcccugauugaagcccccc

SEQ ID NO: 3130622 - RNA, 17 nt, Mycobacterium bovis subsp bovis AF2122/97
acugccgagcacgacga

SEQ ID NO: 3130623 - RNA, 22 nt, Mycobacterium bovis subsp bovis AF2122/97
acugccgccgcuuucgccggcg

SEQ ID NO: 3130624 - RNA, 12 nt, Mycobacterium bovis subsp bovis AF2122/97
acugccgcggca

SEQ ID NO: 3130625 - RNA, 15 nt, Mycobacterium bovis subsp bovis AF2122/97
acugccgcggcaccg

SEQ ID NO: 3130626 - RNA, 16 nt, Mycobacterium bovis subsp bovis AF2122/97
acugccgcggcaccgc

SEQ ID NO: 3130627 - RNA, 17 nt, Mycobacterium bovis subsp bovis AF2122/97
acugccgcggcaccgcc

SEQ ID NO: 3130628 - RNA, 21 nt, Mycobacterium bovis subsp bovis AF2122/97
acugccgcggcaccgccccgc

SEQ ID NO: 3130629 - RNA, 22 nt, Mycobacterium bovis subsp bovis AF2122/97
acugccggacagccacgcacaa

SEQ ID NO: 3130630 - RNA, 13 nt, Mycobacterium bovis subsp bovis AF2122/97
acugccggcacgc

SEQ ID NO: 3130631 - RNA, 23 nt, Mycobacterium bovis subsp bovis AF2122/97
acugccggccaacuucugcacga

SEQ ID NO: 3130632 - RNA, 16 nt, Mycobacterium bovis subsp bovis AF2122/97
acugccguucggggcg

SEQ ID NO: 3130633 - RNA, 15 nt, Mycobacterium bovis subsp bovis AF2122/97
acugccguugccgcc

SEQ ID NO: 3130634 - RNA, 19 nt, Mycobacterium bovis subsp bovis AF2122/97
acugcgaacccugcgcacu

SEQ ID NO: 3130635 - RNA, 20 nt, Mycobacterium bovis subsp bovis AF2122/97
acugcgaacccugcgcacuc

SEQ ID NO: 3130636 - RNA, 21 nt, Mycobacterium bovis subsp bovis AF2122/97
acugcgaagaguccuuaaacg

SEQ ID NO: 3130637 - RNA, 24 nt, Mycobacterium bovis subsp bovis AF2122/97
acugcgaaggaccagagcucgaag

SEQ ID NO: 3130638 - RNA, 15 nt, Mycobacterium bovis subsp bovis AF2122/97
acugcgaaugcuggg

SEQ ID NO: 3130639 - RNA, 16 nt, Mycobacterium bovis subsp bovis AF2122/97
acugcgaaugcugggc

SEQ ID NO: 3130640 - RNA, 19 nt, Mycobacterium bovis subsp bovis AF2122/97
acugcgaaugcugggcccg

SEQ ID NO: 3130641 - RNA, 22 nt, Mycobacterium bovis subsp bovis AF2122/97
acugcgaccgguucggcguaca

SEQ ID NO: 3130642 - RNA, 19 nt, Mycobacterium bovis subsp bovis AF2122/97
acugcgaccgucccggccu

SEQ ID NO: 3130643 - RNA, 16 nt, Mycobacterium bovis subsp bovis AF2122/97
acugcgagcgccggcu

SEQ ID NO: 3130644 - RNA, 12 nt, Mycobacterium bovis subsp bovis AF2122/97
acugcgaucggc

SEQ ID NO: 3130645 - RNA, 17 nt, Mycobacterium bovis subsp bovis AF2122/97
acugcgcaccugggucg

SEQ ID NO: 3130646 - RNA, 13 nt, Mycobacterium bovis subsp bovis AF2122/97
acugcgccaccgg

SEQ ID NO: 3130647 - RNA, 16 nt, Mycobacterium bovis subsp bovis AF2122/97
acugcgccaccgguga

SEQ ID NO: 3130648 - RNA, 14 nt, Mycobacterium bovis subsp bovis AF2122/97
acugcgcccgccac

SEQ ID NO: 3130649 - RNA, 16 nt, Mycobacterium bovis subsp bovis AF2122/97
acugcgcccgccacgu

SEQ ID NO: 3130650 - RNA, 13 nt, Mycobacterium bovis subsp bovis AF2122/97
acugcgccgccgg

SEQ ID NO: 3130651 - RNA, 15 nt, Mycobacterium bovis subsp bovis AF2122/97
acugcgccgccggcg

SEQ ID NO: 3130652 - RNA, 17 nt, Mycobacterium bovis subsp bovis AF2122/97
acugcgccgccggcgcg

SEQ ID NO: 3130653 - RNA, 13 nt, Mycobacterium bovis subsp bovis AF2122/97
acugcgccggccg

SEQ ID NO: 3130654 - RNA, 20 nt, Mycobacterium bovis subsp bovis AF2122/97
acugcgccggugccggccau

SEQ ID NO: 3130655 - RNA, 13 nt, Mycobacterium bovis subsp bovis AF2122/97
acugcgccguucg

SEQ ID NO: 3130656 - RNA, 18 nt, Mycobacterium bovis subsp bovis AF2122/97
acugcgccguucgcuccc

SEQ ID NO: 3130657 - RNA, 22 nt, Mycobacterium bovis subsp bovis AF2122/97
acugcgccguucgcucccccgc

SEQ ID NO: 3130658 - RNA, 19 nt, Mycobacterium bovis subsp bovis AF2122/97
acugcgcgugcucgacgcg

SEQ ID NO: 3130659 - RNA, 17 nt, Mycobacterium bovis subsp bovis AF2122/97
acugcgcuacaucagaa

SEQ ID NO: 3130660 - RNA, 22 nt, Mycobacterium bovis subsp bovis AF2122/97
acugcggcagguucggcgacuc

SEQ ID NO: 3130661 - RNA, 18 nt, Mycobacterium bovis subsp bovis AF2122/97
acugcggcauggcaggcg

SEQ ID NO: 3130662 - RNA, 19 nt, Mycobacterium bovis subsp bovis AF2122/97
acugcggcccgacccggcc

SEQ ID NO: 3130663 - RNA, 13 nt, Mycobacterium bovis subsp bovis AF2122/97
acugcggucgccc

SEQ ID NO: 3130664 - RNA, 12 nt, Mycobacterium bovis subsp bovis AF2122/97
acugcggugcca

SEQ ID NO: 3130665 - RNA, 21 nt, Mycobacterium bovis subsp bovis AF2122/97
acugcgugccgcaccgccugc

SEQ ID NO: 3130666 - RNA, 21 nt, Mycobacterium bovis subsp bovis AF2122/97
acugcguuccaucgccgacgc

SEQ ID NO: 3130667 - RNA, 15 nt, Mycobacterium bovis subsp bovis AF2122/97
acugcguuggcgacc

SEQ ID NO: 3130668 - RNA, 20 nt, Mycobacterium bovis subsp bovis AF2122/97
acugcguuggcgaccaugca

SEQ ID NO: 3130669 - RNA, 13 nt, Mycobacterium bovis subsp bovis AF2122/97
acugcucgauccg

SEQ ID NO: 3130670 - RNA, 16 nt, Mycobacterium bovis subsp bovis AF2122/97
acugcucgauccgcaa

SEQ ID NO: 3130671 - RNA, 17 nt, Mycobacterium bovis subsp bovis AF2122/97
acugcucggauccggcc

SEQ ID NO: 3130672 - RNA, 20 nt, Mycobacterium bovis subsp bovis AF2122/97
acugcucggauccggccagg

SEQ ID NO: 3130673 - RNA, 18 nt, Mycobacterium bovis subsp bovis AF2122/97
acugcugaaucacaccau

SEQ ID NO: 3130674 - RNA, 21 nt, Mycobacterium bovis subsp bovis AF2122/97
acugcugcggcagcgcggcca

SEQ ID NO: 3130675 - RNA, 20 nt, Mycobacterium bovis subsp bovis AF2122/97
acugcugggcuucgagugcg

SEQ ID NO: 3130676 - RNA, 14 nt, Mycobacterium bovis subsp bovis AF2122/97
acugcuggucaggu

SEQ ID NO: 3130677 - RNA, 22 nt, Mycobacterium bovis subsp bovis AF2122/97
acugcuuccauaacgacucgcg

SEQ ID NO: 3130678 - RNA, 16 nt, Mycobacterium bovis subsp bovis AF2122/97
acugcuuccggaacaa

SEQ ID NO: 3130679 - RNA, 21 nt, Mycobacterium bovis subsp bovis AF2122/97
acugcuugcgcaucgccgaca

SEQ ID NO: 3130680 - RNA, 15 nt, Mycobacterium bovis subsp bovis AF2122/97
acuggaaggcgggca

SEQ ID NO: 3130681 - RNA, 15 nt, Mycobacterium bovis subsp bovis AF2122/97
acuggaauggcucac

SEQ ID NO: 3130682 - RNA, 18 nt, Mycobacterium bovis subsp bovis AF2122/97
acuggacaagcuccucgc

SEQ ID NO: 3130683 - RNA, 15 nt, Mycobacterium bovis subsp bovis AF2122/97
acuggaccggugcca

SEQ ID NO: 3130684 - RNA, 20 nt, Mycobacterium bovis subsp bovis AF2122/97
acuggacggggaagcccggc

SEQ ID NO: 3130685 - RNA, 11 nt, Mycobacterium bovis subsp bovis AF2122/97
acuggacucuu

SEQ ID NO: 3130686 - RNA, 22 nt, Mycobacterium bovis subsp bovis AF2122/97
acuggcacacggucaccggcac

SEQ ID NO: 3130687 - RNA, 14 nt, Mycobacterium bovis subsp bovis AF2122/97
acuggcaccgccag

SEQ ID NO: 3130688 - RNA, 16 nt, Mycobacterium bovis subsp bovis AF2122/97
acuggcaccgccagcc

SEQ ID NO: 3130689 - RNA, 15 nt, Mycobacterium bovis subsp bovis AF2122/97
acuggccccgccagc

SEQ ID NO: 3130690 - RNA, 21 nt, Mycobacterium bovis subsp bovis AF2122/97
acuggccccgguggugcugcc

SEQ ID NO: 3130691 - RNA, 21 nt, Mycobacterium bovis subsp bovis AF2122/97
acuggcccggacaugcgggca

SEQ ID NO: 3130692 - RNA, 14 nt, Mycobacterium bovis subsp bovis AF2122/97
acuggccgcccggc

SEQ ID NO: 3130693 - RNA, 21 nt, Mycobacterium bovis subsp bovis AF2122/97
acuggccgccgcgcaccgcgg

SEQ ID NO: 3130694 - RNA, 19 nt, Mycobacterium bovis subsp bovis AF2122/97
acuggccguuucggcgccg

SEQ ID NO: 3130695 - RNA, 16 nt, Mycobacterium bovis subsp bovis AF2122/97
acuggcgccggugccg

SEQ ID NO: 3130696 - RNA, 20 nt, Mycobacterium bovis subsp bovis AF2122/97
acuggcgccggugccgccgg

SEQ ID NO: 3130697 - RNA, 19 nt, Mycobacterium bovis subsp bovis AF2122/97
acuggcgguccgaugcgcg

SEQ ID NO: 3130698 - RNA, 21 nt, Mycobacterium bovis subsp bovis AF2122/97
acuggcgguguaacccggaac

SEQ ID NO: 3130699 - RNA, 18 nt, Mycobacterium bovis subsp bovis AF2122/97
acuggcguugccaccgga

SEQ ID NO: 3130700 - RNA, 15 nt, Mycobacterium bovis subsp bovis AF2122/97
acuggcugaucggcg

SEQ ID NO: 3130701 - RNA, 15 nt, Mycobacterium bovis subsp bovis AF2122/97
acugggcaaacccgg

SEQ ID NO: 3130702 - RNA, 16 nt, Mycobacterium bovis subsp bovis AF2122/97
acugggcaccggcggu

SEQ ID NO: 3130703 - RNA, 19 nt, Mycobacterium bovis subsp bovis AF2122/97
acugggccaaagcgcgggc

SEQ ID NO: 3130704 - RNA, 17 nt, Mycobacterium bovis subsp bovis AF2122/97
acugggccaggucggcg

SEQ ID NO: 3130705 - RNA, 17 nt, Mycobacterium bovis subsp bovis AF2122/97
acugggccucagacaac

SEQ ID NO: 3130706 - RNA, 12 nt, Mycobacterium bovis subsp bovis AF2122/97
acugggcggccu

SEQ ID NO: 3130707 - RNA, 24 nt, Mycobacterium bovis subsp bovis AF2122/97
acugggcggggcugggcgccaugc

SEQ ID NO: 3130708 - RNA, 18 nt, Mycobacterium bovis subsp bovis AF2122/97
acuuggcggccagccgcu

SEQ ID NO: 3130709 - RNA, 23 nt, Mycobacterium bovis subsp bovis AF2122/97
acuuggcggucgguuccggugua

SEQ ID NO: 3130710 - RNA, 18 nt, Mycobacterium bovis subsp bovis AF2122/97
acuuggcgucgacaucgg

SEQ ID NO: 3130711 - RNA, 18 nt, Mycobacterium bovis subsp bovis AF2122/97
acuuggggucguucgccg

SEQ ID NO: 3130712 - RNA, 17 nt, Mycobacterium bovis subsp bovis AF2122/97
acuuggugauccgagac

SEQ ID NO: 3130713 - RNA, 22 nt, Mycobacterium bovis subsp bovis AF2122/97
acuuggugauccgagaccaugc

SEQ ID NO: 3130714 - RNA, 19 nt, Mycobacterium bovis subsp bovis AF2122/97
acuugugccacuucuucac

SEQ ID NO: 3130715 - RNA, 18 nt, Mycobacterium bovis subsp bovis AF2122/97
acuuguugacgaacccac

SEQ ID NO: 3130716 - RNA, 19 nt, Mycobacterium bovis subsp bovis AF2122/97
acuuucgcccagucgccgc

SEQ ID NO: 3130717 - RNA, 16 nt, Mycobacterium bovis subsp bovis AF2122/97
acuuugagcagaaggc

SEQ ID NO: 3130718 - RNA, 15 nt, Mycobacterium bovis subsp bovis AF2122/97
acuuugggucggcga

SEQ ID NO: 3130719 - RNA, 19 nt, Mycobacterium bovis subsp bovis AF2122/97
acuuuucgagugugaacug

SEQ ID NO: 3130720 - RNA, 19 nt, Mycobacterium bovis subsp bovis AF2122/97
agaaaacggcggcgccggu

SEQ ID NO: 3130721 - RNA, 17 nt, Mycobacterium bovis subsp bovis AF2122/97
agaaacacgacagccag

SEQ ID NO: 3130722 - RNA, 17 nt, Mycobacterium bovis subsp bovis AF2122/97
agaaacccggcgaccac

SEQ ID NO: 3130723 - RNA, 15 nt, Mycobacterium bovis subsp bovis AF2122/97
agaaacgccgagcgc

SEQ ID NO: 3130724 - RNA, 16 nt, Mycobacterium bovis subsp bovis AF2122/97
agaaacgucugccacg

SEQ ID NO: 3130725 - RNA, 18 nt, Mycobacterium bovis subsp bovis AF2122/97
agaaagcccaggggagcu

SEQ ID NO: 3130726 - RNA, 15 nt, Mycobacterium bovis subsp bovis AF2122/97
agaaaucaaauccuu

SEQ ID NO: 3130727 - RNA, 14 nt, Mycobacterium bovis subsp bovis AF2122/97
agaacaacggcgcg

SEQ ID NO: 3130728 - RNA, 16 nt, Mycobacterium bovis subsp bovis AF2122/97
agaacaccggccaggc

SEQ ID NO: 3130729 - RNA, 14 nt, Mycobacterium bovis subsp bovis AF2122/97
agaacaucccccgg

SEQ ID NO: 3130730 - RNA, 13 nt, Mycobacterium bovis subsp bovis AF2122/97
agaaccacgacgu

SEQ ID NO: 3130731 - RNA, 15 nt, Mycobacterium bovis subsp bovis AF2122/97
agaacccacgcaugc

SEQ ID NO: 3130732 - RNA, 12 nt, Mycobacterium bovis subsp bovis AF2122/97
agaaccccgaag

SEQ ID NO: 3130733 - RNA, 15 nt, Mycobacterium bovis subsp bovis AF2122/97
agaacccuccgcacc

SEQ ID NO: 3130734 - RNA, 17 nt, Mycobacterium bovis subsp bovis AF2122/97
agaaccgacggccagca

SEQ ID NO: 3130735 - RNA, 15 nt, Mycobacterium bovis subsp bovis AF2122/97
agaaccggccgacga

SEQ ID NO: 3130736 - RNA, 18 nt, Mycobacterium bovis subsp bovis AF2122/97
agaaccggguaaugcgac

SEQ ID NO: 3130737 - RNA, 20 nt, Mycobacterium bovis subsp bovis AF2122/97
agaaccggguaaugcgacgc

SEQ ID NO: 3130738 - RNA, 23 nt, Mycobacterium bovis subsp bovis AF2122/97
agaaccggguaaugcgacgccgg

SEQ ID NO: 3130739 - RNA, 15 nt, Mycobacterium bovis subsp bovis AF2122/97
agaaccuggagccgu

SEQ ID NO: 3130740 - RNA, 20 nt, Mycobacterium bovis subsp bovis AF2122/97
agaaccuggagccgugcggu

SEQ ID NO: 3130741 - RNA, 15 nt, Mycobacterium bovis subsp bovis AF2122/97
agaacgacgccaccg

SEQ ID NO: 3130742 - RNA, 15 nt, Mycobacterium bovis subsp bovis AF2122/97
agaacgauguccgcg

SEQ ID NO: 3130743 - RNA, 18 nt, Mycobacterium bovis subsp bovis AF2122/97
agaacgauguccgcgcga

SEQ ID NO: 3130744 - RNA, 20 nt, Mycobacterium bovis subsp bovis AF2122/97
agaacgcggccucgucgagu

SEQ ID NO: 3130745 - RNA, 16 nt, Mycobacterium bovis subsp bovis AF2122/97
agaacgcgucguagcg

SEQ ID NO: 3130746 - RNA, 23 nt, Mycobacterium bovis subsp bovis AF2122/97
agaacggauaauucaacagcacc

SEQ ID NO: 3130747 - RNA, 15 nt, Mycobacterium bovis subsp bovis AF2122/97
agaacggaugccggu

SEQ ID NO: 3130748 - RNA, 19 nt, Mycobacterium bovis subsp bovis AF2122/97
agaacggaugccggucggc

SEQ ID NO: 3130749 - RNA, 21 nt, Mycobacterium bovis subsp bovis AF2122/97
agaacggaugccggucggcgu

SEQ ID NO: 3130750 - RNA, 14 nt, Mycobacterium bovis subsp bovis AF2122/97
agaacggcgaucac

SEQ ID NO: 3130751 - RNA, 19 nt, Mycobacterium bovis subsp bovis AF2122/97
agaacgucaaacccagcga

SEQ ID NO: 3130752 - RNA, 20 nt, Mycobacterium bovis subsp bovis AF2122/97
agaacgucgagacuucggug

SEQ ID NO: 3130753 - RNA, 18 nt, Mycobacterium bovis subsp bovis AF2122/97
agaacguggccguuaauu

SEQ ID NO: 3130754 - RNA, 22 nt, Mycobacterium bovis subsp bovis AF2122/97
agaacucggcgucgugguggcc

SEQ ID NO: 3130755 - RNA, 17 nt, Mycobacterium bovis subsp bovis AF2122/97
agaacucggugccccca

SEQ ID NO: 3130756 - RNA, 19 nt, Mycobacterium bovis subsp bovis AF2122/97
agaacucguugagcagcug

SEQ ID NO: 3130757 - RNA, 12 nt, Mycobacterium bovis subsp bovis AF2122/97
agaacuggcugc

SEQ ID NO: 3130758 - RNA, 16 nt, Mycobacterium bovis subsp bovis AF2122/97
agaacuggcugcuguu

SEQ ID NO: 3130759 - RNA, 23 nt, Mycobacterium bovis subsp bovis AF2122/97
agaacuuguuugucaccgcagcc

SEQ ID NO: 3130760 - RNA, 17 nt, Mycobacterium bovis subsp bovis AF2122/97
agaagaacucggugccc

SEQ ID NO: 3130761 - RNA, 15 nt, Mycobacterium bovis subsp bovis AF2122/97
agaagaagcccagga

SEQ ID NO: 3130762 - RNA, 17 nt, Mycobacterium bovis subsp bovis AF2122/97
agaagauggcaccgccc

SEQ ID NO: 3130763 - RNA, 22 nt, Mycobacterium bovis subsp bovis AF2122/97
agaagcccaggacggcuaccac

SEQ ID NO: 3130764 - RNA, 15 nt, Mycobacterium bovis subsp bovis AF2122/97
agaagcccccaaacc

SEQ ID NO: 3130765 - RNA, 14 nt, Mycobacterium bovis subsp bovis AF2122/97
agaagcccgaaguc

SEQ ID NO: 3130766 - RNA, 15 nt, Mycobacterium bovis subsp bovis AF2122/97
agaagccggccacua

SEQ ID NO: 3130767 - RNA, 15 nt, Mycobacterium bovis subsp bovis AF2122/97
agaaggaucagcgca

SEQ ID NO: 3130768 - RNA, 20 nt, Mycobacterium bovis subsp bovis AF2122/97
agaaggaucagcgcacuggc

SEQ ID NO: 3130769 - RNA, 14 nt, Mycobacterium bovis subsp bovis AF2122/97
agaaggccagcgaa

SEQ ID NO: 3130770 - RNA, 17 nt, Mycobacterium bovis subsp bovis AF2122/97
agaaggccagcgcgccc

SEQ ID NO: 3130771 - RNA, 13 nt, Mycobacterium bovis subsp bovis AF2122/97
agaaggccgcacc

SEQ ID NO: 3130772 - RNA, 15 nt, Mycobacterium bovis subsp bovis AF2122/97
agaaggcgcgggcga

SEQ ID NO: 3130773 - RNA, 21 nt, Mycobacterium bovis subsp bovis AF2122/97
agaaggugacgaucgacagcc

SEQ ID NO: 3130774 - RNA, 17 nt, Mycobacterium bovis subsp bovis AF2122/97
agaaguaggcggcgacg

SEQ ID NO: 3130775 - RNA, 23 nt, Mycobacterium bovis subsp bovis AF2122/97
agaagucaaggugucaacgcgcg

SEQ ID NO: 3130776 - RNA, 21 nt, Mycobacterium bovis subsp bovis AF2122/97
agaagucgaucgccgaggcag

SEQ ID NO: 3130777 - RNA, 17 nt, Mycobacterium bovis subsp bovis AF2122/97
agaagucgcagcgagga

SEQ ID NO: 3130778 - RNA, 19 nt, Mycobacterium bovis subsp bovis AF2122/97
agaaguuagccaccuugga

SEQ ID NO: 3130779 - RNA, 18 nt, Mycobacterium bovis subsp bovis AF2122/97
agaaguucuucgcgaaga

SEQ ID NO: 3130780 - RNA, 13 nt, Mycobacterium bovis subsp bovis AF2122/97
agaauaugccgau

SEQ ID NO: 3130781 - RNA, 14 nt, Mycobacterium bovis subsp bovis AF2122/97
agaaucagcagcag

SEQ ID NO: 3130782 - RNA, 16 nt, Mycobacterium bovis subsp bovis AF2122/97
agaauccggcaaccac

SEQ ID NO: 3130783 - RNA, 20 nt, Mycobacterium bovis subsp bovis AF2122/97
agaaucgcacgaaaucagcc

SEQ ID NO: 3130784 - RNA, 16 nt, Mycobacterium bovis subsp bovis AF2122/97
agaaucucgccgggcu

SEQ ID NO: 3130785 - RNA, 13 nt, Mycobacterium bovis subsp bovis AF2122/97
agaaucugccucu

SEQ ID NO: 3130786 - RNA, 22 nt, Mycobacterium bovis subsp bovis AF2122/97
agaauggccgccuugaggcccu

SEQ ID NO: 3130787 - RNA, 19 nt, Mycobacterium bovis subsp bovis AF2122/97
agaaugggauggcaccacc

SEQ ID NO: 3130788 - RNA, 11 nt, Mycobacterium bovis subsp bovis AF2122/97
agaauuggccc

SEQ ID NO: 3130789 - RNA, 18 nt, Mycobacterium bovis subsp bovis AF2122/97
agacaaaggugccgaccg

SEQ ID NO: 3130790 - RNA, 14 nt, Mycobacterium bovis subsp bovis AF2122/97
agacaacgccgucg

SEQ ID NO: 3130791 - RNA, 20 nt, Mycobacterium bovis subsp bovis AF2122/97
agacacagaaucgcccauuu

SEQ ID NO: 3130792 - RNA, 18 nt, Mycobacterium bovis subsp bovis AF2122/97
agacaccgcgaucaccac

SEQ ID NO: 3130793 - RNA, 21 nt, Mycobacterium bovis subsp bovis AF2122/97
agacaccgcgaucaccaccgg

SEQ ID NO: 3130794 - RNA, 23 nt, Mycobacterium bovis subsp bovis AF2122/97
agacaccggcgucgaaggugacc

SEQ ID NO: 3130795 - RNA, 17 nt, Mycobacterium bovis subsp bovis AF2122/97
agacgaugcuggcggcc

SEQ ID NO: 3130796 - RNA, 15 nt, Mycobacterium bovis subsp bovis AF2122/97
agacgauggccaggu

SEQ ID NO: 3130797 - RNA, 16 nt, Mycobacterium bovis subsp bovis AF2122/97
agacgauucggcggcc

SEQ ID NO: 3130798 - RNA, 20 nt, Mycobacterium bovis subsp bovis AF2122/97
agacgcaaaaagcuccaaau

SEQ ID NO: 3130799 - RNA, 20 nt, Mycobacterium bovis subsp bovis AF2122/97
agacgcaaaauccccucgca

SEQ ID NO: 3130800 - RNA, 20 nt, Mycobacterium bovis subsp bovis AF2122/97
agacgcaaaaucgcccaauu

SEQ ID NO: 3130801 - RNA, 19 nt, Mycobacterium bovis subsp bovis AF2122/97
agacgcaaaaucgcccgaa

SEQ ID NO: 3130802 - RNA, 15 nt, Mycobacterium bovis subsp bovis AF2122/97
agacgcacggccacc

SEQ ID NO: 3130803 - RNA, 20 nt, Mycobacterium bovis subsp bovis AF2122/97
agacgcacggccaccgcgca

SEQ ID NO: 3130804 - RNA, 22 nt, Mycobacterium bovis subsp bovis AF2122/97
agacgcacggccaccgcgcaac

SEQ ID NO: 3130805 - RNA, 17 nt, Mycobacterium bovis subsp bovis AF2122/97
agacgcagaagccccca

SEQ ID NO: 3130806 - RNA, 18 nt, Mycobacterium bovis subsp bovis AF2122/97
agacgcagaagcccccaa

SEQ ID NO: 3130807 - RNA, 19 nt, Mycobacterium bovis subsp bovis AF2122/97
agacgcagaaucgcaugau

SEQ ID NO: 3130808 - RNA, 20 nt, Mycobacterium bovis subsp bovis AF2122/97
agacgcagaaucgcccaauu

SEQ ID NO: 3130809 - RNA, 17 nt, Mycobacterium bovis subsp bovis AF2122/97
agacgcagagucgcacu

SEQ ID NO: 3130810 - RNA, 19 nt, Mycobacterium bovis subsp bovis AF2122/97
agacgcauaagcccccgca

SEQ ID NO: 3130811 - RNA, 18 nt, Mycobacterium bovis subsp bovis AF2122/97
agacgccacugccagccg

SEQ ID NO: 3130812 - RNA, 12 nt, Mycobacterium bovis subsp bovis AF2122/97
agacgccgccgc

SEQ ID NO: 3130813 - RNA, 22 nt, Mycobacterium bovis subsp bovis AF2122/97
agacgccgccgcugccgcccuu

SEQ ID NO: 3130814 - RNA, 16 nt, Mycobacterium bovis subsp bovis AF2122/97
agacgccgucggcgcc

SEQ ID NO: 3130815 - RNA, 22 nt, Mycobacterium bovis subsp bovis AF2122/97
agacgcgaaaucccccgacacg

SEQ ID NO: 3130816 - RNA, 23 nt, Mycobacterium bovis subsp bovis AF2122/97
agacgcggucgacgacgcccuca

SEQ ID NO: 3130817 - RNA, 13 nt, Mycobacterium bovis subsp bovis AF2122/97
agacgcucgaccu

SEQ ID NO: 3130818 - RNA, 16 nt, Mycobacterium bovis subsp bovis AF2122/97
agacgcucgaccugcc

SEQ ID NO: 3130819 - RNA, 17 nt, Mycobacterium bovis subsp bovis AF2122/97
agacgcucgaccugccu

SEQ ID NO: 3130820 - RNA, 18 nt, Mycobacterium bovis subsp bovis AF2122/97
agacgcucuugaauagga

SEQ ID NO: 3130821 - RNA, 15 nt, Mycobacterium bovis subsp bovis AF2122/97
agacgcugcccaaaa

SEQ ID NO: 3130822 - RNA, 14 nt, Mycobacterium bovis subsp bovis AF2122/97
agacgcugcgcgcc

SEQ ID NO: 3130823 - RNA, 18 nt, Mycobacterium bovis subsp bovis AF2122/97
agacgcuguccaggucug

SEQ ID NO: 3130824 - RNA, 18 nt, Mycobacterium bovis subsp bovis AF2122/97
agacggcacccccgacga

SEQ ID NO: 3130825 - RNA, 15 nt, Mycobacterium bovis subsp bovis AF2122/97
agacggcaggaauga

SEQ ID NO: 3130826 - RNA, 13 nt, Mycobacterium bovis subsp bovis AF2122/97
agacggccaccgg

SEQ ID NO: 3130827 - RNA, 14 nt, Mycobacterium bovis subsp bovis AF2122/97
agacggcgacgaug

SEQ ID NO: 3130828 - RNA, 13 nt, Mycobacterium bovis subsp bovis AF2122/97
agacggcggcauc

SEQ ID NO: 3130829 - RNA, 21 nt, Mycobacterium bovis subsp bovis AF2122/97
agacggcucagcgugcgcugg

SEQ ID NO: 3130830 - RNA, 20 nt, Mycobacterium bovis subsp bovis AF2122/97
agacggggcgagcaugccgu

SEQ ID NO: 3130831 - RNA, 19 nt, Mycobacterium bovis subsp bovis AF2122/97
agacggggugagccgaccc

SEQ ID NO: 3130832 - RNA, 22 nt, Mycobacterium bovis subsp bovis AF2122/97
agacggugcagcuccccgccgg

SEQ ID NO: 3130833 - RNA, 18 nt, Mycobacterium bovis subsp bovis AF2122/97
agacggugcgggcuaggc

SEQ ID NO: 3130834 - RNA, 14 nt, Mycobacterium bovis subsp bovis AF2122/97
agacgguuaccgcg

SEQ ID NO: 3130835 - RNA, 16 nt, Mycobacterium bovis subsp bovis AF2122/97
agacgguuaccgcgaa

SEQ ID NO: 3130836 - RNA, 15 nt, Mycobacterium bovis subsp bovis AF2122/97
agacguacugggcga

SEQ ID NO: 3130837 - RNA, 20 nt, Mycobacterium bovis subsp bovis AF2122/97
agacguauaucgguugcugc

SEQ ID NO: 3130838 - RNA, 14 nt, Mycobacterium bovis subsp bovis AF2122/97
agacguccgcgguc

SEQ ID NO: 3130839 - RNA, 15 nt, Mycobacterium bovis subsp bovis AF2122/97
agacguccgcggucg

SEQ ID NO: 3130840 - RNA, 19 nt, Mycobacterium bovis subsp bovis AF2122/97
agacguccgcggucgcagc

SEQ ID NO: 3130841 - RNA, 20 nt, Mycobacterium bovis subsp bovis AF2122/97
agacguccgcggucgcagca

SEQ ID NO: 3130842 - RNA, 21 nt, Mycobacterium bovis subsp bovis AF2122/97
agacgucgaccgugucaccgc

SEQ ID NO: 3130843 - RNA, 15 nt, Mycobacterium bovis subsp bovis AF2122/97
agacgugccaaugau

SEQ ID NO: 3130844 - RNA, 13 nt, Mycobacterium bovis subsp bovis AF2122/97
agacgugcgucag

SEQ ID NO: 3130845 - RNA, 21 nt, Mycobacterium bovis subsp bovis AF2122/97
agacgugggcgcuggugcgcc

SEQ ID NO: 3130846 - RNA, 17 nt, Mycobacterium bovis subsp bovis AF2122/97
agacgugguagccggcg

SEQ ID NO: 3130847 - RNA, 23 nt, Mycobacterium bovis subsp bovis AF2122/97
agacguuccaucacggaccaggc

SEQ ID NO: 3130848 - RNA, 19 nt, Mycobacterium bovis subsp bovis AF2122/97
agacguuggucaucaacgc

SEQ ID NO: 3130849 - RNA, 21 nt, Mycobacterium bovis subsp bovis AF2122/97
agacguuucccaggcccgaca

SEQ ID NO: 3130850 - RNA, 12 nt, Mycobacterium bovis subsp bovis AF2122/97
agacuccagcaa

SEQ ID NO: 3130851 - RNA, 19 nt, Mycobacterium bovis subsp bovis AF2122/97
agacuccagcaaggccagc

SEQ ID NO: 3130852 - RNA, 17 nt, Mycobacterium bovis subsp bovis AF2122/97
agacuccguugccaccu

SEQ ID NO: 3130853 - RNA, 14 nt, Mycobacterium bovis subsp bovis AF2122/97
agacucgcggucga

SEQ ID NO: 3130854 - RNA, 18 nt, Mycobacterium bovis subsp bovis AF2122/97
agacucgcggucgacagc

SEQ ID NO: 3130855 - RNA, 16 nt, Mycobacterium bovis subsp bovis AF2122/97
agacugcgccgccggc

SEQ ID NO: 3130856 - RNA, 13 nt, Mycobacterium bovis subsp bovis AF2122/97
agacugcgcggca

SEQ ID NO: 3130857 - RNA, 19 nt, Mycobacterium bovis subsp bovis AF2122/97
agacugggcgcuggaggcc

SEQ ID NO: 3130858 - RNA, 22 nt, Mycobacterium bovis subsp bovis AF2122/97
agacugggcgcuggaggccacc

SEQ ID NO: 3130859 - RNA, 21 nt, Mycobacterium bovis subsp bovis AF2122/97
agacuguugucccuauaccgc

SEQ ID NO: 3130860 - RNA, 16 nt, Mycobacterium bovis subsp bovis AF2122/97
agacuugcugcuccuu

SEQ ID NO: 3130861 - RNA, 15 nt, Mycobacterium bovis subsp bovis AF2122/97
agacuuucgcccagu

SEQ ID NO: 3130862 - RNA, 15 nt, Mycobacterium bovis subsp bovis AF2122/97
agagaacuccgccac

SEQ ID NO: 3130863 - RNA, 16 nt, Mycobacterium bovis subsp bovis AF2122/97
agagacaugccggcga

SEQ ID NO: 3130864 - RNA, 18 nt, Mycobacterium bovis subsp bovis AF2122/97
agagacguacugggcgau

SEQ ID NO: 3130865 - RNA, 19 nt, Mycobacterium bovis subsp bovis AF2122/97
agagaguuagugacguaga

SEQ ID NO: 3130866 - RNA, 20 nt, Mycobacterium bovis subsp bovis AF2122/97
agagaucagcacccaagaau

SEQ ID NO: 3130867 - RNA, 22 nt, Mycobacterium bovis subsp bovis AF2122/97
agagcacugggcuggccagcac

SEQ ID NO: 3130868 - RNA, 22 nt, Mycobacterium bovis subsp bovis AF2122/97
agagcagaucuuccgagcacuc

SEQ ID NO: 3130869 - RNA, 12 nt, Mycobacterium bovis subsp bovis AF2122/97
agagcagcagcg

SEQ ID NO: 3130870 - RNA, 13 nt, Mycobacterium bovis subsp bovis AF2122/97
agagcagccagcc

SEQ ID NO: 3130871 - RNA, 12 nt, Mycobacterium bovis subsp bovis AF2122/97
agagcaggccca

SEQ ID NO: 3130872 - RNA, 15 nt, Mycobacterium bovis subsp bovis AF2122/97
agagcaugccgcccg

SEQ ID NO: 3130873 - RNA, 17 nt, Mycobacterium bovis subsp bovis AF2122/97
agagcaugccgcccgcg

SEQ ID NO: 3130874 - RNA, 18 nt, Mycobacterium bovis subsp bovis AF2122/97
agagcaugccgcccgcgc

SEQ ID NO: 3130875 - RNA, 18 nt, Mycobacterium bovis subsp bovis AF2122/97
agagcaugguccagcaca

SEQ ID NO: 3130876 - RNA, 12 nt, Mycobacterium bovis subsp bovis AF2122/97
agagccagcaac

SEQ ID NO: 3130877 - RNA, 14 nt, Mycobacterium bovis subsp bovis AF2122/97
agagccccgaccag

SEQ ID NO: 3130878 - RNA, 19 nt, Mycobacterium bovis subsp bovis AF2122/97
agagccccgaccagcagac

SEQ ID NO: 3130879 - RNA, 13 nt, Mycobacterium bovis subsp bovis AF2122/97
agagccgaccggg

SEQ ID NO: 3130880 - RNA, 19 nt, Mycobacterium bovis subsp bovis AF2122/97
agagccgacgugcggcggc

SEQ ID NO: 3130881 - RNA, 11 nt, Mycobacterium bovis subsp bovis AF2122/97
agagccgccgu

SEQ ID NO: 3130882 - RNA, 19 nt, Mycobacterium bovis subsp bovis AF2122/97
agaucgcgugccacagcau

SEQ ID NO: 3130883 - RNA, 21 nt, Mycobacterium bovis subsp bovis AF2122/97
agaucgcguggaucgcgcuca

SEQ ID NO: 3130884 - RNA, 18 nt, Mycobacterium bovis subsp bovis AF2122/97
agaucgcuaggaccgcgg

SEQ ID NO: 3130885 - RNA, 12 nt, Mycobacterium bovis subsp bovis AF2122/97
agaucggaucga

SEQ ID NO: 3130886 - RNA, 21 nt, Mycobacterium bovis subsp bovis AF2122/97
agaucggccggauacgggcug

SEQ ID NO: 3130887 - RNA, 14 nt, Mycobacterium bovis subsp bovis AF2122/97
agaucggcgccccu

SEQ ID NO: 3130888 - RNA, 19 nt, Mycobacterium bovis subsp bovis AF2122/97
agaucggguggcgggucag

SEQ ID NO: 3130889 - RNA, 20 nt, Mycobacterium bovis subsp bovis AF2122/97
agaucggguggcgggucagc

SEQ ID NO: 3130890 - RNA, 14 nt, Mycobacterium bovis subsp bovis AF2122/97
agaucggugccagc

SEQ ID NO: 3130891 - RNA, 20 nt, Mycobacterium bovis subsp bovis AF2122/97
agaucguagggacgccgagc

SEQ ID NO: 3130892 - RNA, 21 nt, Mycobacterium bovis subsp bovis AF2122/97
agaucgucgacccaccaugug

SEQ ID NO: 3130893 - RNA, 22 nt, Mycobacterium bovis subsp bovis AF2122/97
agaucguugccucgucgccgcg

SEQ ID NO: 3130894 - RNA, 20 nt, Mycobacterium bovis subsp bovis AF2122/97
agaucucacgugcccgcgcg

SEQ ID NO: 3130895 - RNA, 19 nt, Mycobacterium bovis subsp bovis AF2122/97
agaucuccccgaccgcgcc

SEQ ID NO: 3130896 - RNA, 21 nt, Mycobacterium bovis subsp bovis AF2122/97
agaucucgauuaucgcgcgca

SEQ ID NO: 3130897 - RNA, 13 nt, Mycobacterium bovis subsp bovis AF2122/97
agaucucgcgggc

SEQ ID NO: 3130898 - RNA, 22 nt, Mycobacterium bovis subsp bovis AF2122/97
agaucucugagcgggcgggccu

SEQ ID NO: 3130899 - RNA, 16 nt, Mycobacterium bovis subsp bovis AF2122/97
agaucugggcuggcag

SEQ ID NO: 3130900 - RNA, 23 nt, Mycobacterium bovis subsp bovis AF2122/97
agaucuucaccggccggugccag

SEQ ID NO: 3130901 - RNA, 19 nt, Mycobacterium bovis subsp bovis AF2122/97
agaucuucgagcgcaucag

SEQ ID NO: 3130902 - RNA, 20 nt, Mycobacterium bovis subsp bovis AF2122/97
agaucuugcagugcgccagc

SEQ ID NO: 3130903 - RNA, 17 nt, Mycobacterium bovis subsp bovis AF2122/97
agaucuugugccaggcg

SEQ ID NO: 3130904 - RNA, 22 nt, Mycobacterium bovis subsp bovis AF2122/97
agaugaacuucccacccggccu

SEQ ID NO: 3130905 - RNA, 16 nt, Mycobacterium bovis subsp bovis AF2122/97
agaugaauugccgggc

SEQ ID NO: 3130906 - RNA, 17 nt, Mycobacterium bovis subsp bovis AF2122/97
agaugaauugccgggcg

SEQ ID NO: 3130907 - RNA, 23 nt, Mycobacterium bovis subsp bovis AF2122/97
agaugacgguggugacgucgagg

SEQ ID NO: 3130908 - RNA, 20 nt, Mycobacterium bovis subsp bovis AF2122/97
agaugaucgcgaacaucgcc

SEQ ID NO: 3130909 - RNA, 17 nt, Mycobacterium bovis subsp bovis AF2122/97
agaugauuucgccgagc

SEQ ID NO: 3130910 - RNA, 19 nt, Mycobacterium bovis subsp bovis AF2122/97
agaugcacgucgagcaggc

SEQ ID NO: 3130911 - RNA, 19 nt, Mycobacterium bovis subsp bovis AF2122/97
agaugccauuucgucgucg

SEQ ID NO: 3130912 - RNA, 21 nt, Mycobacterium bovis subsp bovis AF2122/97
agaugccgcgaucgugcaggu

SEQ ID NO: 3130913 - RNA, 15 nt, Mycobacterium bovis subsp bovis AF2122/97
agaugccggcgagca

SEQ ID NO: 3130914 - RNA, 23 nt, Mycobacterium bovis subsp bovis AF2122/97
agaugccguaguaaggagccggg

SEQ ID NO: 3130915 - RNA, 18 nt, Mycobacterium bovis subsp bovis AF2122/97
agaugccugcuagcagca

SEQ ID NO: 3130916 - RNA, 21 nt, Mycobacterium bovis subsp bovis AF2122/97
agaugcgcggggaucacaccc

SEQ ID NO: 3130917 - RNA, 16 nt, Mycobacterium bovis subsp bovis AF2122/97
agaugcggaacgccga

SEQ ID NO: 3130918 - RNA, 14 nt, Mycobacterium bovis subsp bovis AF2122/97
agaugcgugcggca

SEQ ID NO: 3130919 - RNA, 14 nt, Mycobacterium bovis subsp bovis AF2122/97
agaugcugcacccg

SEQ ID NO: 3130920 - RNA, 21 nt, Mycobacterium bovis subsp bovis AF2122/97
agauggcaccgcccccgucgg

SEQ ID NO: 3130921 - RNA, 23 nt, Mycobacterium bovis subsp bovis AF2122/97
agauggcaccgcccccgucggcc

SEQ ID NO: 3130922 - RNA, 19 nt, Mycobacterium bovis subsp bovis AF2122/97
agauggcauugcgcccacc

SEQ ID NO: 3130923 - RNA, 13 nt, Mycobacterium bovis subsp bovis AF2122/97
agauggcgaucau

SEQ ID NO: 3130924 - RNA, 18 nt, Mycobacterium bovis subsp bovis AF2122/97
agauggcgcgcugggcug

SEQ ID NO: 3130925 - RNA, 23 nt, Mycobacterium bovis subsp bovis AF2122/97
agaugggauaccccuccgaucac

SEQ ID NO: 3130926 - RNA, 14 nt, Mycobacterium bovis subsp bovis AF2122/97
agaugggccuccac

SEQ ID NO: 3130927 - RNA, 21 nt, Mycobacterium bovis subsp bovis AF2122/97
agaugggccuccaccgcgucc

SEQ ID NO: 3130928 - RNA, 18 nt, Mycobacterium bovis subsp bovis AF2122/97
agauggggugacgcaccc

SEQ ID NO: 3130929 - RNA, 14 nt, Mycobacterium bovis subsp bovis AF2122/97
agauggucaccgga

SEQ ID NO: 3130930 - RNA, 20 nt, Mycobacterium bovis subsp bovis AF2122/97
agauggucgggcggcgucga

SEQ ID NO: 3130931 - RNA, 23 nt, Mycobacterium bovis subsp bovis AF2122/97
agauggugaaguugccggucagg

SEQ ID NO: 3130932 - RNA, 18 nt, Mycobacterium bovis subsp bovis AF2122/97
agaugguggucaccacca

SEQ ID NO: 3130933 - RNA, 19 nt, Mycobacterium bovis subsp bovis AF2122/97
agauggugguggcccggcu

SEQ ID NO: 3130934 - RNA, 22 nt, Mycobacterium bovis subsp bovis AF2122/97
agauguccgguccgccagcgcg

SEQ ID NO: 3130935 - RNA, 15 nt, Mycobacterium bovis subsp bovis AF2122/97
agauguugccgccgg

SEQ ID NO: 3130936 - RNA, 19 nt, Mycobacterium bovis subsp bovis AF2122/97
agauguugcgacggccggc

SEQ ID NO: 3130937 - RNA, 14 nt, Mycobacterium bovis subsp bovis AF2122/97
agauucauuggccu

SEQ ID NO: 3130938 - RNA, 21 nt, Mycobacterium bovis subsp bovis AF2122/97
agauuccugguuccaagggaa

SEQ ID NO: 3130939 - RNA, 15 nt, Mycobacterium bovis subsp bovis AF2122/97
agauucggugccagc

SEQ ID NO: 3130940 - RNA, 19 nt, Mycobacterium bovis subsp bovis AF2122/97
agauucggugccagcaggc

SEQ ID NO: 3130941 - RNA, 13 nt, Mycobacterium bovis subsp bovis AF2122/97
agauugccgagcc

SEQ ID NO: 3130942 - RNA, 13 nt, Mycobacterium bovis subsp bovis AF2122/97
agauugccgggcc

SEQ ID NO: 3130943 - RNA, 12 nt, Mycobacterium bovis subsp bovis AF2122/97
agauugcugacg

SEQ ID NO: 3130944 - RNA, 13 nt, Mycobacterium bovis subsp bovis AF2122/97
agauugcugacga

SEQ ID NO: 3130945 - RNA, 16 nt, Mycobacterium bovis subsp bovis AF2122/97
agauuggguccagcga

SEQ ID NO: 3130946 - RNA, 19 nt, Mycobacterium bovis subsp bovis AF2122/97
agauuucugggccgcucca

SEQ ID NO: 3130947 - RNA, 14 nt, Mycobacterium bovis subsp bovis AF2122/97
agauuucuugaccg

SEQ ID NO: 3130948 - RNA, 15 nt, Mycobacterium bovis subsp bovis AF2122/97
agcaaaaacauugcu

SEQ ID NO: 3130949 - RNA, 18 nt, Mycobacterium bovis subsp bovis AF2122/97
agcaaaaaccagcgucca

SEQ ID NO: 3130950 - RNA, 16 nt, Mycobacterium bovis subsp bovis AF2122/97
agcaaaauggccaccg

SEQ ID NO: 3130951 - RNA, 16 nt, Mycobacterium bovis subsp bovis AF2122/97
agcaaaccagauugcc

SEQ ID NO: 3130952 - RNA, 23 nt, Mycobacterium bovis subsp bovis AF2122/97
agcaaaccgaccgugaucagcgc

SEQ ID NO: 3130953 - RNA, 12 nt, Mycobacterium bovis subsp bovis AF2122/97
agcaaaccgcgc

SEQ ID NO: 3130954 - RNA, 16 nt, Mycobacterium bovis subsp bovis AF2122/97
agcaaacgaggauuca

SEQ ID NO: 3130955 - RNA, 16 nt, Mycobacterium bovis subsp bovis AF2122/97
agcaaagccagcgcag

SEQ ID NO: 3130956 - RNA, 20 nt, Mycobacterium bovis subsp bovis AF2122/97
agcaaaggggugugugcugc

SEQ ID NO: 3130957 - RNA, 16 nt, Mycobacterium bovis subsp bovis AF2122/97
agcaacaacgucugca

SEQ ID NO: 3130958 - RNA, 20 nt, Mycobacterium bovis subsp bovis AF2122/97
agcaacaccgucggcagcag

SEQ ID NO: 3130959 - RNA, 18 nt, Mycobacterium bovis subsp bovis AF2122/97
agcaacaccucgucaccc

SEQ ID NO: 3130960 - RNA, 16 nt, Mycobacterium bovis subsp bovis AF2122/97
agcaacagcaggugcc

SEQ ID NO: 3130961 - RNA, 16 nt, Mycobacterium bovis subsp bovis AF2122/97
agcaacgaagccggcg

SEQ ID NO: 3130962 - RNA, 17 nt, Mycobacterium bovis subsp bovis AF2122/97
agcaacgaagccggcgc

SEQ ID NO: 3130963 - RNA, 20 nt, Mycobacterium bovis subsp bovis AF2122/97
agcaacgaagccggcgccgg

SEQ ID NO: 3130964 - RNA, 17 nt, Mycobacterium bovis subsp bovis AF2122/97
agcaacgccacccgaau

SEQ ID NO: 3130965 - RNA, 13 nt, Mycobacterium bovis subsp bovis AF2122/97
agcaacgcccaac

SEQ ID NO: 3130966 - RNA, 20 nt, Mycobacterium bovis subsp bovis AF2122/97
agcaacgcccaacgucgcca

SEQ ID NO: 3130967 - RNA, 15 nt, Mycobacterium bovis subsp bovis AF2122/97
agcaacgcggugccg

SEQ ID NO: 3130968 - RNA, 13 nt, Mycobacterium bovis subsp bovis AF2122/97
agcacccggucga

SEQ ID NO: 3130969 - RNA, 19 nt, Mycobacterium bovis subsp bovis AF2122/97
agcacccucaggcaaucgc

SEQ ID NO: 3130970 - RNA, 20 nt, Mycobacterium bovis subsp bovis AF2122/97
agcacccugaugugagucca

SEQ ID NO: 3130971 - RNA, 14 nt, Mycobacterium bovis subsp bovis AF2122/97
agcacccugcgggc

SEQ ID NO: 3130972 - RNA, 16 nt, Mycobacterium bovis subsp bovis AF2122/97
agcacccugcgggccg

SEQ ID NO: 3130973 - RNA, 18 nt, Mycobacterium bovis subsp bovis AF2122/97
agcaccgaauuacgcacc

SEQ ID NO: 3130974 - RNA, 15 nt, Mycobacterium bovis subsp bovis AF2122/97
agcaccgacaccggc

SEQ ID NO: 3130975 - RNA, 18 nt, Mycobacterium bovis subsp bovis AF2122/97
agcaccgacaccggccgc

SEQ ID NO: 3130976 - RNA, 19 nt, Mycobacterium bovis subsp bovis AF2122/97
agcaccgaccagggccgcc

SEQ ID NO: 3130977 - RNA, 14 nt, Mycobacterium bovis subsp bovis AF2122/97
agcaccgacgugau

SEQ ID NO: 3130978 - RNA, 19 nt, Mycobacterium bovis subsp bovis AF2122/97
agcaccgacgugaugguga

SEQ ID NO: 3130979 - RNA, 12 nt, Mycobacterium bovis subsp bovis AF2122/97
agcaccgaugcu

SEQ ID NO: 3130980 - RNA, 14 nt, Mycobacterium bovis subsp bovis AF2122/97
agcaccgaugcuga

SEQ ID NO: 3130981 - RNA, 18 nt, Mycobacterium bovis subsp bovis AF2122/97
agcaccgcaaccacgccc

SEQ ID NO: 3130982 - RNA, 18 nt, Mycobacterium bovis subsp bovis AF2122/97
agcaccgcagcgaccacc

SEQ ID NO: 3130983 - RNA, 19 nt, Mycobacterium bovis subsp bovis AF2122/97
agcaccgcagcgaccaccg

SEQ ID NO: 3130984 - RNA, 16 nt, Mycobacterium bovis subsp bovis AF2122/97
agcaccgccgcugcca

SEQ ID NO: 3130985 - RNA, 21 nt, Mycobacterium bovis subsp bovis AF2122/97
agcaccgcgaacauggugcgg

SEQ ID NO: 3130986 - RNA, 16 nt, Mycobacterium bovis subsp bovis AF2122/97
agcaccgcgacgacga

SEQ ID NO: 3130987 - RNA, 22 nt, Mycobacterium bovis subsp bovis AF2122/97
agcaccgcuacgaccaauagca

SEQ ID NO: 3130988 - RNA, 22 nt, Mycobacterium bovis subsp bovis AF2122/97
agcaccgcucgguccagccggu

SEQ ID NO: 3130989 - RNA, 15 nt, Mycobacterium bovis subsp bovis AF2122/97
agcaccgcuggcagc

SEQ ID NO: 3130990 - RNA, 19 nt, Mycobacterium bovis subsp bovis AF2122/97
agcaccggaucgaccaauu

SEQ ID NO: 3130991 - RNA, 16 nt, Mycobacterium bovis subsp bovis AF2122/97
agcaccggcacccgca

SEQ ID NO: 3130992 - RNA, 14 nt, Mycobacterium bovis subsp bovis AF2122/97
agcaccggcugcgg

SEQ ID NO: 3130993 - RNA, 15 nt, Mycobacterium bovis subsp bovis AF2122/97
agcaccgggaagucg

SEQ ID NO: 3130994 - RNA, 22 nt, Mycobacterium bovis subsp bovis AF2122/97
agcaccgggcucagacuuucgc

SEQ ID NO: 3130995 - RNA, 20 nt, Mycobacterium bovis subsp bovis AF2122/97
agcaccggggacagcccggc

SEQ ID NO: 3130996 - RNA, 14 nt, Mycobacterium bovis subsp bovis AF2122/97
agcaccgugacagc

SEQ ID NO: 3130997 - RNA, 16 nt, Mycobacterium bovis subsp bovis AF2122/97
agcaccgugacagcgg

SEQ ID NO: 3130998 - RNA, 14 nt, Mycobacterium bovis subsp bovis AF2122/97
agcaccgugcccug

SEQ ID NO: 3130999 - RNA, 20 nt, Mycobacterium bovis subsp bovis AF2122/97
agcaccucagaaaguccccg

SEQ ID NO: 3131000 - RNA, 22 nt, Mycobacterium bovis subsp bovis AF2122/97
agcaccucagaaaguccccgca

SEQ ID NO: 3131001 - RNA, 14 nt, Mycobacterium bovis subsp bovis AF2122/97
agcaccuccaccgc

SEQ ID NO: 3131002 - RNA, 17 nt, Mycobacterium bovis subsp bovis AF2122/97
agcaccuccaccgcgcc

SEQ ID NO: 3131003 - RNA, 18 nt, Mycobacterium bovis subsp bovis AF2122/97
agcaccuccaccgcgccg

SEQ ID NO: 3131004 - RNA, 13 nt, Mycobacterium bovis subsp bovis AF2122/97
agcaccugcaccg

SEQ ID NO: 3131005 - RNA, 16 nt, Mycobacterium bovis subsp bovis AF2122/97
agcaccugcaccgcau

SEQ ID NO: 3131006 - RNA, 14 nt, Mycobacterium bovis subsp bovis AF2122/97
agcaccugggcgcg

SEQ ID NO: 3131007 - RNA, 18 nt, Mycobacterium bovis subsp bovis AF2122/97
agcaccugggcgcgcugg

SEQ ID NO: 3131008 - RNA, 16 nt, Mycobacterium bovis subsp bovis AF2122/97
agcaccuugcgauugc

SEQ ID NO: 3131009 - RNA, 15 nt, Mycobacterium bovis subsp bovis AF2122/97
agcacgaaagucaau

SEQ ID NO: 3131010 - RNA, 21 nt, Mycobacterium bovis subsp bovis AF2122/97
agcacgaaagucaaucgcguc

SEQ ID NO: 3131011 - RNA, 15 nt, Mycobacterium bovis subsp bovis AF2122/97
agcacgaagcuggcg

SEQ ID NO: 3131012 - RNA, 15 nt, Mycobacterium bovis subsp bovis AF2122/97
agcacgacgacgucg

SEQ ID NO: 3131013 - RNA, 16 nt, Mycobacterium bovis subsp bovis AF2122/97
agcacgacgacgucgg

SEQ ID NO: 3131014 - RNA, 21 nt, Mycobacterium bovis subsp bovis AF2122/97
agcacgacgugcgucggcccg

SEQ ID NO: 3131015 - RNA, 14 nt, Mycobacterium bovis subsp bovis AF2122/97
agcacgaugucgau

SEQ ID NO: 3131016 - RNA, 18 nt, Mycobacterium bovis subsp bovis AF2122/97
agcacgaugucgaugccg

SEQ ID NO: 3131017 - RNA, 13 nt, Mycobacterium bovis subsp bovis AF2122/97
agcacgcccucga

SEQ ID NO: 3131018 - RNA, 18 nt, Mycobacterium bovis subsp bovis AF2122/97
agcacgcccucgacgcgc

SEQ ID NO: 3131019 - RNA, 19 nt, Mycobacterium bovis subsp bovis AF2122/97
agcacgccgagcccgccgg

SEQ ID NO: 3131020 - RNA, 17 nt, Mycobacterium bovis subsp bovis AF2122/97
agcacgccgccggccgc

SEQ ID NO: 3131021 - RNA, 20 nt, Mycobacterium bovis subsp bovis AF2122/97
agcacgccgccggccgccag

SEQ ID NO: 3131022 - RNA, 13 nt, Mycobacterium bovis subsp bovis AF2122/97
agcacgccgggug

SEQ ID NO: 3131023 - RNA, 15 nt, Mycobacterium bovis subsp bovis AF2122/97
agcacgccguccagg

SEQ ID NO: 3131024 - RNA, 16 nt, Mycobacterium bovis subsp bovis AF2122/97
agcacgcgugguucgg

SEQ ID NO: 3131025 - RNA, 13 nt, Mycobacterium bovis subsp bovis AF2122/97
agcacgcugacca

SEQ ID NO: 3131026 - RNA, 18 nt, Mycobacterium bovis subsp bovis AF2122/97
agcacgcugaccacaacc

SEQ ID NO: 3131027 - RNA, 14 nt, Mycobacterium bovis subsp bovis AF2122/97
agcacgcugcugcg

SEQ ID NO: 3131028 - RNA, 20 nt, Mycobacterium bovis subsp bovis AF2122/97
agcacgcuggcguuguugac

SEQ ID NO: 3131029 - RNA, 22 nt, Mycobacterium bovis subsp bovis AF2122/97
agcacggcgacgaucucggcgg

SEQ ID NO: 3131030 - RNA, 11 nt, Mycobacterium bovis subsp bovis AF2122/97
agcacggcgau

SEQ ID NO: 3131031 - RNA, 20 nt, Mycobacterium bovis subsp bovis AF2122/97
agcacggcgccgccacggau

SEQ ID NO: 3131032 - RNA, 14 nt, Mycobacterium bovis subsp bovis AF2122/97
agcacggcgcggcg

SEQ ID NO: 3131033 - RNA, 15 nt, Mycobacterium bovis subsp bovis AF2122/97
agcacggcgcggcgg

SEQ ID NO: 3131034 - RNA, 16 nt, Mycobacterium bovis subsp bovis AF2122/97
agcacggcggccacgu

SEQ ID NO: 3131035 - RNA, 14 nt, Mycobacterium bovis subsp bovis AF2122/97
agcacggcuucgac

SEQ ID NO: 3131036 - RNA, 13 nt, Mycobacterium bovis subsp bovis AF2122/97
agcacggcuucgc

SEQ ID NO: 3131037 - RNA, 22 nt, Mycobacterium bovis subsp bovis AF2122/97
agcacgggacuucgugccucgg

SEQ ID NO: 3131038 - RNA, 14 nt, Mycobacterium bovis subsp bovis AF2122/97
agcacgggcacgau

SEQ ID NO: 3131039 - RNA, 17 nt, Mycobacterium bovis subsp bovis AF2122/97
agcacgggcacgaucgu

SEQ ID NO: 3131040 - RNA, 17 nt, Mycobacterium bovis subsp bovis AF2122/97
agcacggggaccgggcu

SEQ ID NO: 3131041 - RNA, 17 nt, Mycobacterium bovis subsp bovis AF2122/97
agcacggguagcgucca

SEQ ID NO: 3131042 - RNA, 16 nt, Mycobacterium bovis subsp bovis AF2122/97
agcacggucugggucu

SEQ ID NO: 3131043 - RNA, 15 nt, Mycobacterium bovis subsp bovis AF2122/97
agcacggugagccgg

SEQ ID NO: 3131044 - RNA, 19 nt, Mycobacterium bovis subsp bovis AF2122/97
agcacggugagccgguggc

SEQ ID NO: 3131045 - RNA, 16 nt, Mycobacterium bovis subsp bovis AF2122/97
agcacggugaucagca

SEQ ID NO: 3131046 - RNA, 22 nt, Mycobacterium bovis subsp bovis AF2122/97
agcacgguggccgagccgcggu

SEQ ID NO: 3131047 - RNA, 19 nt, Mycobacterium bovis subsp bovis AF2122/97
agcacgguggcuucgacgg

SEQ ID NO: 3131048 - RNA, 12 nt, Mycobacterium bovis subsp bovis AF2122/97
agcacgucccgg

SEQ ID NO: 3131049 - RNA, 11 nt, Mycobacterium bovis subsp bovis AF2122/97
agcacguccgc

SEQ ID NO: 3131050 - RNA, 14 nt, Mycobacterium bovis subsp bovis AF2122/97
agcacguccgcgga

SEQ ID NO: 3131051 - RNA, 15 nt, Mycobacterium bovis subsp bovis AF2122/97
agcacgucgaacucg

SEQ ID NO: 3131052 - RNA, 16 nt, Mycobacterium bovis subsp bovis AF2122/97
agcacgucgcggccgu

SEQ ID NO: 3131053 - RNA, 22 nt, Mycobacterium bovis subsp bovis AF2122/97
agcacgucgcggccguggaugu

SEQ ID NO: 3131054 - RNA, 21 nt, Mycobacterium bovis subsp bovis AF2122/97
agcacgucggggugccggcug

SEQ ID NO: 3131055 - RNA, 23 nt, Mycobacterium bovis subsp bovis AF2122/97
agcagcccgggugaaacgauggc

SEQ ID NO: 3131056 - RNA, 12 nt, Mycobacterium bovis subsp bovis AF2122/97
agcagccgaacc

SEQ ID NO: 3131057 - RNA, 13 nt, Mycobacterium bovis subsp bovis AF2122/97
agcagccgaaccg

SEQ ID NO: 3131058 - RNA, 18 nt, Mycobacterium bovis subsp bovis AF2122/97
agcagccgaaccggcacc

SEQ ID NO: 3131059 - RNA, 19 nt, Mycobacterium bovis subsp bovis AF2122/97
agcagccgaaccggcacca

SEQ ID NO: 3131060 - RNA, 19 nt, Mycobacterium bovis subsp bovis AF2122/97
agcagccgaugcugcgggc

SEQ ID NO: 3131061 - RNA, 14 nt, Mycobacterium bovis subsp bovis AF2122/97
agcagccgcgacau

SEQ ID NO: 3131062 - RNA, 20 nt, Mycobacterium bovis subsp bovis AF2122/97
agcagcgaaaaccgucgcag

SEQ ID NO: 3131063 - RNA, 14 nt, Mycobacterium bovis subsp bovis AF2122/97
agcagcgaccagca

SEQ ID NO: 3131064 - RNA, 14 nt, Mycobacterium bovis subsp bovis AF2122/97
agcagcgccacccg

SEQ ID NO: 3131065 - RNA, 16 nt, Mycobacterium bovis subsp bovis AF2122/97
agcagcgccacccgcg

SEQ ID NO: 3131066 - RNA, 17 nt, Mycobacterium bovis subsp bovis AF2122/97
agcagcgccacccgcgu

SEQ ID NO: 3131067 - RNA, 16 nt, Mycobacterium bovis subsp bovis AF2122/97
agcagcgccagcagcu

SEQ ID NO: 3131068 - RNA, 20 nt, Mycobacterium bovis subsp bovis AF2122/97
agcagcgccgcguucagggc

SEQ ID NO: 3131069 - RNA, 18 nt, Mycobacterium bovis subsp bovis AF2122/97
agcagcgccggcaccgac

SEQ ID NO: 3131070 - RNA, 23 nt, Mycobacterium bovis subsp bovis AF2122/97
agcagcggcggaaggacggcagc

SEQ ID NO: 3131071 - RNA, 16 nt, Mycobacterium bovis subsp bovis AF2122/97
agcagcggcucggcgg

SEQ ID NO: 3131072 - RNA, 21 nt, Mycobacterium bovis subsp bovis AF2122/97
agcagcggcucggcggcgcgu

SEQ ID NO: 3131073 - RNA, 23 nt, Mycobacterium bovis subsp bovis AF2122/97
agcagcgggacauccagugcggu

SEQ ID NO: 3131074 - RNA, 15 nt, Mycobacterium bovis subsp bovis AF2122/97
agcagcggugcagcc

SEQ ID NO: 3131075 - RNA, 17 nt, Mycobacterium bovis subsp bovis AF2122/97
agcagcgguugaugcgg

SEQ ID NO: 3131076 - RNA, 19 nt, Mycobacterium bovis subsp bovis AF2122/97
agcagcgguugaugcggcc

SEQ ID NO: 3131077 - RNA, 20 nt, Mycobacterium bovis subsp bovis AF2122/97
agcagcgguugaugcggccg

SEQ ID NO: 3131078 - RNA, 14 nt, Mycobacterium bovis subsp bovis AF2122/97
agcagcgucaucag

SEQ ID NO: 3131079 - RNA, 17 nt, Mycobacterium bovis subsp bovis AF2122/97
agcagcgucaucagguc

SEQ ID NO: 3131080 - RNA, 18 nt, Mycobacterium bovis subsp bovis AF2122/97
agcagcgugaccaccgcc

SEQ ID NO: 3131081 - RNA, 21 nt, Mycobacterium bovis subsp bovis AF2122/97
agcagcguggcgaugggucug

SEQ ID NO: 3131082 - RNA, 15 nt, Mycobacterium bovis subsp bovis AF2122/97
agcagcgugggaaga

SEQ ID NO: 3131083 - RNA, 18 nt, Mycobacterium bovis subsp bovis AF2122/97
agcagcuagcccggcagc

SEQ ID NO: 3131084 - RNA, 23 nt, Mycobacterium bovis subsp bovis AF2122/97
agcagcuccuugaggucacccau

SEQ ID NO: 3131085 - RNA, 13 nt, Mycobacterium bovis subsp bovis AF2122/97
agcagcucgccgg

SEQ ID NO: 3131086 - RNA, 20 nt, Mycobacterium bovis subsp bovis AF2122/97
agcagcucgccggcacgcag

SEQ ID NO: 3131087 - RNA, 19 nt, Mycobacterium bovis subsp bovis AF2122/97
agcagcucggccgaggcgg

SEQ ID NO: 3131088 - RNA, 22 nt, Mycobacterium bovis subsp bovis AF2122/97
agcagcucggccgaggcggucu

SEQ ID NO: 3131089 - RNA, 23 nt, Mycobacterium bovis subsp bovis AF2122/97
agcagcugaaaauaggccgggca

SEQ ID NO: 3131090 - RNA, 21 nt, Mycobacterium bovis subsp bovis AF2122/97
agcagcugcgauauggucacc

SEQ ID NO: 3131091 - RNA, 22 nt, Mycobacterium bovis subsp bovis AF2122/97
agcagcugcgauauggucacca

SEQ ID NO: 3131092 - RNA, 20 nt, Mycobacterium bovis subsp bovis AF2122/97
agcagcugggcaucaccgcc

SEQ ID NO: 3131093 - RNA, 21 nt, Mycobacterium bovis subsp bovis AF2122/97
agcagcugggcaucaccgccg

SEQ ID NO: 3131094 - RNA, 21 nt, Mycobacterium bovis subsp bovis AF2122/97
agcagcuggucgugggccacc

SEQ ID NO: 3131095 - RNA, 15 nt, Mycobacterium bovis subsp bovis AF2122/97
agcagcuugacccac

SEQ ID NO: 3131096 - RNA, 12 nt, Mycobacterium bovis subsp bovis AF2122/97
agcaggacaccu

SEQ ID NO: 3131097 - RNA, 14 nt, Mycobacterium bovis subsp bovis AF2122/97
agcaggacaccuac

SEQ ID NO: 3131098 - RNA, 20 nt, Mycobacterium bovis subsp bovis AF2122/97
agcaggacgaugaugaucac

SEQ ID NO: 3131099 - RNA, 11 nt, Mycobacterium bovis subsp bovis AF2122/97
agcaggaugau

SEQ ID NO: 3131100 - RNA, 20 nt, Mycobacterium bovis subsp bovis AF2122/97
agcaggaugaugaccgccau

SEQ ID NO: 3131101 - RNA, 20 nt, Mycobacterium bovis subsp bovis AF2122/97
agcaggaugcgaucgucacg

SEQ ID NO: 3131102 - RNA, 23 nt, Mycobacterium bovis subsp bovis AF2122/97
agcaggccacugcguuccaucgc

SEQ ID NO: 3131103 - RNA, 13 nt, Mycobacterium bovis subsp bovis AF2122/97
agcaggcccagcg

SEQ ID NO: 3131104 - RNA, 17 nt, Mycobacterium bovis subsp bovis AF2122/97
agcaggcccauaccgau

SEQ ID NO: 3131105 - RNA, 19 nt, Mycobacterium bovis subsp bovis AF2122/97
agcaggcccuggccaccca

SEQ ID NO: 3131106 - RNA, 13 nt, Mycobacterium bovis subsp bovis AF2122/97
agcaggccgggcg

SEQ ID NO: 3131107 - RNA, 15 nt, Mycobacterium bovis subsp bovis AF2122/97
agcaggccgggcgca

SEQ ID NO: 3131108 - RNA, 22 nt, Mycobacterium bovis subsp bovis AF2122/97
agcaggccuccaagcccgccgg

SEQ ID NO: 3131109 - RNA, 15 nt, Mycobacterium bovis subsp bovis AF2122/97
agcaggcgagugaag

SEQ ID NO: 3131110 - RNA, 20 nt, Mycobacterium bovis subsp bovis AF2122/97
agcaggcgcaccaggcggcc

SEQ ID NO: 3131111 - RNA, 21 nt, Mycobacterium bovis subsp bovis AF2122/97
agcaggcggcugaacggcagc

SEQ ID NO: 3131112 - RNA, 13 nt, Mycobacterium bovis subsp bovis AF2122/97
agcaggcggggga

SEQ ID NO: 3131113 - RNA, 15 nt, Mycobacterium bovis subsp bovis AF2122/97
agcaggcuggcugcc

SEQ ID NO: 3131114 - RNA, 13 nt, Mycobacterium bovis subsp bovis AF2122/97
agcagggccacca

SEQ ID NO: 3131115 - RNA, 20 nt, Mycobacterium bovis subsp bovis AF2122/97
agcagggccaccaccacggc

SEQ ID NO: 3131116 - RNA, 17 nt, Mycobacterium bovis subsp bovis AF2122/97
agcagggccagaccgaa

SEQ ID NO: 3131117 - RNA, 14 nt, Mycobacterium bovis subsp bovis AF2122/97
agcagggccggcac

SEQ ID NO: 3131118 - RNA, 15 nt, Mycobacterium bovis subsp bovis AF2122/97
agcagggccggcacc

SEQ ID NO: 3131119 - RNA, 16 nt, Mycobacterium bovis subsp bovis AF2122/97
agcagggccggcaccg

SEQ ID NO: 3131120 - RNA, 18 nt, Mycobacterium bovis subsp bovis AF2122/97
agcagggccggcaccgca

SEQ ID NO: 3131121 - RNA, 22 nt, Mycobacterium bovis subsp bovis AF2122/97
agcagggccggcaccgcagcgg

SEQ ID NO: 3131122 - RNA, 15 nt, Mycobacterium bovis subsp bovis AF2122/97
agcagggcuucgugc

SEQ ID NO: 3131123 - RNA, 21 nt, Mycobacterium bovis subsp bovis AF2122/97
agcaggggacgaccaugccga

SEQ ID NO: 3131124 - RNA, 23 nt, Mycobacterium bovis subsp bovis AF2122/97
agcaggggacgaccaugccgauc

SEQ ID NO: 3131125 - RNA, 20 nt, Mycobacterium bovis subsp bovis AF2122/97
agcaggggacgggcggccag

SEQ ID NO: 3131126 - RNA, 16 nt, Mycobacterium bovis subsp bovis AF2122/97
agcagggugccggcgc

SEQ ID NO: 3131127 - RNA, 19 nt, Mycobacterium bovis subsp bovis AF2122/97
agcagguacaucaccacga

SEQ ID NO: 3131128 - RNA, 16 nt, Mycobacterium bovis subsp bovis AF2122/97
agcagguacucgcccc

SEQ ID NO: 3131129 - RNA, 17 nt, Mycobacterium bovis subsp bovis AF2122/97
agcagguccgcggccgc

SEQ ID NO: 3131130 - RNA, 15 nt, Mycobacterium bovis subsp bovis AF2122/97
agcaggucgccugcc

SEQ ID NO: 3131131 - RNA, 19 nt, Mycobacterium bovis subsp bovis AF2122/97
agcaggugcccgaggugcu

SEQ ID NO: 3131132 - RNA, 17 nt, Mycobacterium bovis subsp bovis AF2122/97
agcaguacaccgcccgg

SEQ ID NO: 3131133 - RNA, 17 nt, Mycobacterium bovis subsp bovis AF2122/97
agcaguacuaacaacac

SEQ ID NO: 3131134 - RNA, 20 nt, Mycobacterium bovis subsp bovis AF2122/97
agcaguacuaacaacaccac

SEQ ID NO: 3131135 - RNA, 23 nt, Mycobacterium bovis subsp bovis AF2122/97
agcaguagcugcucaucgcgccc

SEQ ID NO: 3131136 - RNA, 14 nt, Mycobacterium bovis subsp bovis AF2122/97
agcaguccacgagc

SEQ ID NO: 3131137 - RNA, 15 nt, Mycobacterium bovis subsp bovis AF2122/97
agcagugcagcaaca

SEQ ID NO: 3131138 - RNA, 16 nt, Mycobacterium bovis subsp bovis AF2122/97
agcagugccucggcga

SEQ ID NO: 3131139 - RNA, 12 nt, Mycobacterium bovis subsp bovis AF2122/97
agcagugcgggg

SEQ ID NO: 3131140 - RNA, 23 nt, Mycobacterium bovis subsp bovis AF2122/97
agcagugcgguaaagaucuuguc

SEQ ID NO: 3131141 - RNA, 14 nt, Mycobacterium bovis subsp bovis AF2122/97
agccacggcacugg

SEQ ID NO: 3131142 - RNA, 15 nt, Mycobacterium bovis subsp bovis AF2122/97
agccacggcugccca

SEQ ID NO: 3131143 - RNA, 20 nt, Mycobacterium bovis subsp bovis AF2122/97
agccacggguagcugccgcg

SEQ ID NO: 3131144 - RNA, 23 nt, Mycobacterium bovis subsp bovis AF2122/97
agccacggguagcugccgcggcc

SEQ ID NO: 3131145 - RNA, 19 nt, Mycobacterium bovis subsp bovis AF2122/97
agccacguagacaaggcca

SEQ ID NO: 3131146 - RNA, 23 nt, Mycobacterium bovis subsp bovis AF2122/97
agccacguucgcggccaacccau

SEQ ID NO: 3131147 - RNA, 13 nt, Mycobacterium bovis subsp bovis AF2122/97
agccacuccucgg

SEQ ID NO: 3131148 - RNA, 17 nt, Mycobacterium bovis subsp bovis AF2122/97
agccacucgaucaccgg

SEQ ID NO: 3131149 - RNA, 23 nt, Mycobacterium bovis subsp bovis AF2122/97
agccacucgccacucagcccgac

SEQ ID NO: 3131150 - RNA, 14 nt, Mycobacterium bovis subsp bovis AF2122/97
agccacucggcccg

SEQ ID NO: 3131151 - RNA, 21 nt, Mycobacterium bovis subsp bovis AF2122/97
agccacugcggcauggcaggc

SEQ ID NO: 3131152 - RNA, 18 nt, Mycobacterium bovis subsp bovis AF2122/97
agccagaccaacaugaac

SEQ ID NO: 3131153 - RNA, 16 nt, Mycobacterium bovis subsp bovis AF2122/97
agccagagguggauca

SEQ ID NO: 3131154 - RNA, 17 nt, Mycobacterium bovis subsp bovis AF2122/97
agccagaucagccgccg

SEQ ID NO: 3131155 - RNA, 14 nt, Mycobacterium bovis subsp bovis AF2122/97
agccagaugccggu

SEQ ID NO: 3131156 - RNA, 12 nt, Mycobacterium bovis subsp bovis AF2122/97
agccagcaacac

SEQ ID NO: 3131157 - RNA, 22 nt, Mycobacterium bovis subsp bovis AF2122/97
agccagcacccgcagccgcgag

SEQ ID NO: 3131158 - RNA, 13 nt, Mycobacterium bovis subsp bovis AF2122/97
agccagcagcaca

SEQ ID NO: 3131159 - RNA, 14 nt, Mycobacterium bovis subsp bovis AF2122/97
agccagcagcacau

SEQ ID NO: 3131160 - RNA, 17 nt, Mycobacterium bovis subsp bovis AF2122/97
agccagcagcggcgagc

SEQ ID NO: 3131161 - RNA, 20 nt, Mycobacterium bovis subsp bovis AF2122/97
agccagcagcggcgagccaa

SEQ ID NO: 3131162 - RNA, 16 nt, Mycobacterium bovis subsp bovis AF2122/97
agccagcaucggcagc

SEQ ID NO: 3131163 - RNA, 13 nt, Mycobacterium bovis subsp bovis AF2122/97
agccagccgcgaa

SEQ ID NO: 3131164 - RNA, 15 nt, Mycobacterium bovis subsp bovis AF2122/97
agccagccugcuggc

SEQ ID NO: 3131165 - RNA, 23 nt, Mycobacterium bovis subsp bovis AF2122/97
agccagccugcuggccgcggccu

SEQ ID NO: 3131166 - RNA, 16 nt, Mycobacterium bovis subsp bovis AF2122/97
agccagcgcagccagg

SEQ ID NO: 3131167 - RNA, 15 nt, Mycobacterium bovis subsp bovis AF2122/97
agccagcggagcagc

SEQ ID NO: 3131168 - RNA, 20 nt, Mycobacterium bovis subsp bovis AF2122/97
agccagcgguagcugcccag

SEQ ID NO: 3131169 - RNA, 22 nt, Mycobacterium bovis subsp bovis AF2122/97
agccagcugaacacgaauccgg

SEQ ID NO: 3131170 - RNA, 18 nt, Mycobacterium bovis subsp bovis AF2122/97
agccaggagccgaucacg

SEQ ID NO: 3131171 - RNA, 16 nt, Mycobacterium bovis subsp bovis AF2122/97
agccaggcacguccga

SEQ ID NO: 3131172 - RNA, 23 nt, Mycobacterium bovis subsp bovis AF2122/97
agccaggcacguccgaucggcgc

SEQ ID NO: 3131173 - RNA, 13 nt, Mycobacterium bovis subsp bovis AF2122/97
agccaggccgcaa

SEQ ID NO: 3131174 - RNA, 19 nt, Mycobacterium bovis subsp bovis AF2122/97
agccaggccuuggugcggc

SEQ ID NO: 3131175 - RNA, 20 nt, Mycobacterium bovis subsp bovis AF2122/97
agccaggccuuggugcggcc

SEQ ID NO: 3131176 - RNA, 21 nt, Mycobacterium bovis subsp bovis AF2122/97
agccaggccuuggugcggccg

SEQ ID NO: 3131177 - RNA, 22 nt, Mycobacterium bovis subsp bovis AF2122/97
agccaggcgcgcuaccagcuca

SEQ ID NO: 3131178 - RNA, 11 nt, Mycobacterium bovis subsp bovis AF2122/97
agccaggcggu

SEQ ID NO: 3131179 - RNA, 21 nt, Mycobacterium bovis subsp bovis AF2122/97
agccaggcgugcacaggucag

SEQ ID NO: 3131180 - RNA, 21 nt, Mycobacterium bovis subsp bovis AF2122/97
agccagggaucagccgugcgg

SEQ ID NO: 3131181 - RNA, 23 nt, Mycobacterium bovis subsp bovis AF2122/97
agccagggauuuccagcagugcg

SEQ ID NO: 3131182 - RNA, 15 nt, Mycobacterium bovis subsp bovis AF2122/97
agccagggccgcaua

SEQ ID NO: 3131183 - RNA, 23 nt, Mycobacterium bovis subsp bovis AF2122/97
agccagggccgcauacacgaggu

SEQ ID NO: 3131184 - RNA, 20 nt, Mycobacterium bovis subsp bovis AF2122/97
agccaggucgauaccggcgu

SEQ ID NO: 3131185 - RNA, 22 nt, Mycobacterium bovis subsp bovis AF2122/97
agccaguaaaaaggcaggacug

SEQ ID NO: 3131186 - RNA, 10 nt, Mycobacterium bovis subsp bovis AF2122/97
agccagucca

SEQ ID NO: 3131187 - RNA, 16 nt, Mycobacterium bovis subsp bovis AF2122/97
agccaguccagcgcgc

SEQ ID NO: 3131188 - RNA, 16 nt, Mycobacterium bovis subsp bovis AF2122/97
agccagucggccaccu

SEQ ID NO: 3131189 - RNA, 17 nt, Mycobacterium bovis subsp bovis AF2122/97
agccauagugcggcagc

SEQ ID NO: 3131190 - RNA, 17 nt, Mycobacterium bovis subsp bovis AF2122/97
agccaugccgcucggca

SEQ ID NO: 3131191 - RNA, 23 nt, Mycobacterium bovis subsp bovis AF2122/97
agccauggccgccaggugaauuc

SEQ ID NO: 3131192 - RNA, 18 nt, Mycobacterium bovis subsp bovis AF2122/97
agccaugggauucggcca

SEQ ID NO: 3131193 - RNA, 19 nt, Mycobacterium bovis subsp bovis AF2122/97
agccauucaaguucgccga

SEQ ID NO: 3131194 - RNA, 14 nt, Mycobacterium bovis subsp bovis AF2122/97
agccauucggugug

SEQ ID NO: 3131195 - RNA, 19 nt, Mycobacterium bovis subsp bovis AF2122/97
agccauuuccuuggcgcug

SEQ ID NO: 3131196 - RNA, 17 nt, Mycobacterium bovis subsp bovis AF2122/97
agcccaaaaacggcagc

SEQ ID NO: 3131197 - RNA, 18 nt, Mycobacterium bovis subsp bovis AF2122/97
agcccaaagcgccagcag

SEQ ID NO: 3131198 - RNA, 13 nt, Mycobacterium bovis subsp bovis AF2122/97
agcccaaauccca

SEQ ID NO: 3131199 - RNA, 16 nt, Mycobacterium bovis subsp bovis AF2122/97
agcccaaaucccagag

SEQ ID NO: 3131200 - RNA, 20 nt, Mycobacterium bovis subsp bovis AF2122/97
agcccaaaucccagagcauc

SEQ ID NO: 3131201 - RNA, 15 nt, Mycobacterium bovis subsp bovis AF2122/97
agcccaacagcaacc

SEQ ID NO: 3131202 - RNA, 17 nt, Mycobacterium bovis subsp bovis AF2122/97
agcccaacucggccagc

SEQ ID NO: 3131203 - RNA, 18 nt, Mycobacterium bovis subsp bovis AF2122/97
agcccaacucggccagcu

SEQ ID NO: 3131204 - RNA, 20 nt, Mycobacterium bovis subsp bovis AF2122/97
agcccaauccgcaacagcuc

SEQ ID NO: 3131205 - RNA, 12 nt, Mycobacterium bovis subsp bovis AF2122/97
agcccacccggg

SEQ ID NO: 3131206 - RNA, 13 nt, Mycobacterium bovis subsp bovis AF2122/97
agcccacccgggu

SEQ ID NO: 3131207 - RNA, 14 nt, Mycobacterium bovis subsp bovis AF2122/97
agcccacccgggug

SEQ ID NO: 3131208 - RNA, 15 nt, Mycobacterium bovis subsp bovis AF2122/97
agcccacccgggugg

SEQ ID NO: 3131209 - RNA, 17 nt, Mycobacterium bovis subsp bovis AF2122/97
agcccaccggcgccgcc

SEQ ID NO: 3131210 - RNA, 19 nt, Mycobacterium bovis subsp bovis AF2122/97
agcccaccggcgccgccgg

SEQ ID NO: 3131211 - RNA, 20 nt, Mycobacterium bovis subsp bovis AF2122/97
agcccaccggcgccgccggc

SEQ ID NO: 3131212 - RNA, 21 nt, Mycobacterium bovis subsp bovis AF2122/97
agcccaccggugccgcccgcg

SEQ ID NO: 3131213 - RNA, 12 nt, Mycobacterium bovis subsp bovis AF2122/97
agcccaccgucg

SEQ ID NO: 3131214 - RNA, 22 nt, Mycobacterium bovis subsp bovis AF2122/97
agcccaccgucugcuggccggg

SEQ ID NO: 3131215 - RNA, 17 nt, Mycobacterium bovis subsp bovis AF2122/97
agcccagauagagcugg

SEQ ID NO: 3131216 - RNA, 18 nt, Mycobacterium bovis subsp bovis AF2122/97
agcccagauccagcaacg

SEQ ID NO: 3131217 - RNA, 20 nt, Mycobacterium bovis subsp bovis AF2122/97
agcccagcagguuccacggc

SEQ ID NO: 3131218 - RNA, 14 nt, Mycobacterium bovis subsp bovis AF2122/97
agcccagccgggca

SEQ ID NO: 3131219 - RNA, 12 nt, Mycobacterium bovis subsp bovis AF2122/97
agcccagcgccu

SEQ ID NO: 3131220 - RNA, 14 nt, Mycobacterium bovis subsp bovis AF2122/97
agcccagcgccucc

SEQ ID NO: 3131221 - RNA, 13 nt, Mycobacterium bovis subsp bovis AF2122/97
agcccagcugcgc

SEQ ID NO: 3131222 - RNA, 15 nt, Mycobacterium bovis subsp bovis AF2122/97
agcccaggacggcua

SEQ ID NO: 3131223 - RNA, 21 nt, Mycobacterium bovis subsp bovis AF2122/97
agcccaggcgaucgcccggcc

SEQ ID NO: 3131224 - RNA, 17 nt, Mycobacterium bovis subsp bovis AF2122/97
agcccaguaagccacgg

SEQ ID NO: 3131225 - RNA, 14 nt, Mycobacterium bovis subsp bovis AF2122/97
agcccaucccgauc

SEQ ID NO: 3131226 - RNA, 17 nt, Mycobacterium bovis subsp bovis AF2122/97
agcccaucuaccagcuc

SEQ ID NO: 3131227 - RNA, 18 nt, Mycobacterium bovis subsp bovis AF2122/97
agcccaucuaccagcuca

SEQ ID NO: 3131228 - RNA, 16 nt, Mycobacterium bovis subsp bovis AF2122/97
agcccguucgugccgu

SEQ ID NO: 3131229 - RNA, 14 nt, Mycobacterium bovis subsp bovis AF2122/97
agcccguugcagga

SEQ ID NO: 3131230 - RNA, 15 nt, Mycobacterium bovis subsp bovis AF2122/97
agcccguugggcucu

SEQ ID NO: 3131231 - RNA, 18 nt, Mycobacterium bovis subsp bovis AF2122/97
agcccguugguagccggu

SEQ ID NO: 3131232 - RNA, 21 nt, Mycobacterium bovis subsp bovis AF2122/97
agcccguuguccagaacggcg

SEQ ID NO: 3131233 - RNA, 13 nt, Mycobacterium bovis subsp bovis AF2122/97
agcccuccagggc

SEQ ID NO: 3131234 - RNA, 14 nt, Mycobacterium bovis subsp bovis AF2122/97
agcccuccgagcac

SEQ ID NO: 3131235 - RNA, 15 nt, Mycobacterium bovis subsp bovis AF2122/97
agcccuccucgauga

SEQ ID NO: 3131236 - RNA, 18 nt, Mycobacterium bovis subsp bovis AF2122/97
agcccucgacguccaucc

SEQ ID NO: 3131237 - RNA, 13 nt, Mycobacterium bovis subsp bovis AF2122/97
agcccugcgcagc

SEQ ID NO: 3131238 - RNA, 13 nt, Mycobacterium bovis subsp bovis AF2122/97
agcccuggccagc

SEQ ID NO: 3131239 - RNA, 14 nt, Mycobacterium bovis subsp bovis AF2122/97
agcccuguuugacu

SEQ ID NO: 3131240 - RNA, 22 nt, Mycobacterium bovis subsp bovis AF2122/97
agcccuucagcgaagccggguc

SEQ ID NO: 3131241 - RNA, 16 nt, Mycobacterium bovis subsp bovis AF2122/97
agcccuucgcgggaga

SEQ ID NO: 3131242 - RNA, 13 nt, Mycobacterium bovis subsp bovis AF2122/97
agcccuuggcgcg

SEQ ID NO: 3131243 - RNA, 14 nt, Mycobacterium bovis subsp bovis AF2122/97
agcccuuggcgcgc

SEQ ID NO: 3131244 - RNA, 15 nt, Mycobacterium bovis subsp bovis AF2122/97
agcccuuggcgcgca

SEQ ID NO: 3131245 - RNA, 20 nt, Mycobacterium bovis subsp bovis AF2122/97
agcccuuguagcacaccgac

SEQ ID NO: 3131246 - RNA, 20 nt, Mycobacterium bovis subsp bovis AF2122/97
agccgaaaucacugaggcug

SEQ ID NO: 3131247 - RNA, 13 nt, Mycobacterium bovis subsp bovis AF2122/97
agccgaacaccgu

SEQ ID NO: 3131248 - RNA, 18 nt, Mycobacterium bovis subsp bovis AF2122/97
agccgaagaaccggucgc

SEQ ID NO: 3131249 - RNA, 20 nt, Mycobacterium bovis subsp bovis AF2122/97
agccgaagcgcccguuggcc

SEQ ID NO: 3131250 - RNA, 20 nt, Mycobacterium bovis subsp bovis AF2122/97
agccgaaguugaugucgcgu

SEQ ID NO: 3131251 - RNA, 13 nt, Mycobacterium bovis subsp bovis AF2122/97
agccgacaacgac

SEQ ID NO: 3131252 - RNA, 20 nt, Mycobacterium bovis subsp bovis AF2122/97
agccgacaacgacgucgccg

SEQ ID NO: 3131253 - RNA, 13 nt, Mycobacterium bovis subsp bovis AF2122/97
agccgaccaccgc

SEQ ID NO: 3131254 - RNA, 15 nt, Mycobacterium bovis subsp bovis AF2122/97
agccgaccaccgccg

SEQ ID NO: 3131255 - RNA, 22 nt, Mycobacterium bovis subsp bovis AF2122/97
agccgaccaccgccgggcugug

SEQ ID NO: 3131256 - RNA, 14 nt, Mycobacterium bovis subsp bovis AF2122/97
agccgaccagcgcu

SEQ ID NO: 3131257 - RNA, 19 nt, Mycobacterium bovis subsp bovis AF2122/97
agccgaccaggaccaccgc

SEQ ID NO: 3131258 - RNA, 20 nt, Mycobacterium bovis subsp bovis AF2122/97
agccgaccaggaccaccgca

SEQ ID NO: 3131259 - RNA, 21 nt, Mycobacterium bovis subsp bovis AF2122/97
agccgaccaugguagcgcccc

SEQ ID NO: 3131260 - RNA, 21 nt, Mycobacterium bovis subsp bovis AF2122/97
agccgacccgcccgaagaugc

SEQ ID NO: 3131261 - RNA, 12 nt, Mycobacterium bovis subsp bovis AF2122/97
agccgaccgaau

SEQ ID NO: 3131262 - RNA, 14 nt, Mycobacterium bovis subsp bovis AF2122/97
agccgaccgaccgc

SEQ ID NO: 3131263 - RNA, 14 nt, Mycobacterium bovis subsp bovis AF2122/97
agccgaccgauggc

SEQ ID NO: 3131264 - RNA, 15 nt, Mycobacterium bovis subsp bovis AF2122/97
agccgaccgauggcu

SEQ ID NO: 3131265 - RNA, 16 nt, Mycobacterium bovis subsp bovis AF2122/97
agccgaccgauggcuc

SEQ ID NO: 3131266 - RNA, 12 nt, Mycobacterium bovis subsp bovis AF2122/97
agccgaccgcgg

SEQ ID NO: 3131267 - RNA, 18 nt, Mycobacterium bovis subsp bovis AF2122/97
agccgaccgcgggucgug

SEQ ID NO: 3131268 - RNA, 12 nt, Mycobacterium bovis subsp bovis AF2122/97
agccgaccggca

SEQ ID NO: 3131269 - RNA, 22 nt, Mycobacterium bovis subsp bovis AF2122/97
agccgaccggcagcgaugcggu

SEQ ID NO: 3131270 - RNA, 14 nt, Mycobacterium bovis subsp bovis AF2122/97
agccgaccggguug

SEQ ID NO: 3131271 - RNA, 15 nt, Mycobacterium bovis subsp bovis AF2122/97
agccgaccguaccga

SEQ ID NO: 3131272 - RNA, 16 nt, Mycobacterium bovis subsp bovis AF2122/97
agccgacgaacgacgg

SEQ ID NO: 3131273 - RNA, 16 nt, Mycobacterium bovis subsp bovis AF2122/97
agccgacgaccagcag

SEQ ID NO: 3131274 - RNA, 22 nt, Mycobacterium bovis subsp bovis AF2122/97
agccgacgcacgugaugcccug

SEQ ID NO: 3131275 - RNA, 15 nt, Mycobacterium bovis subsp bovis AF2122/97
agccgacgccggugc

SEQ ID NO: 3131276 - RNA, 12 nt, Mycobacterium bovis subsp bovis AF2122/97
agccgacgucgc

SEQ ID NO: 3131277 - RNA, 14 nt, Mycobacterium bovis subsp bovis AF2122/97
agccgacgucgccg

SEQ ID NO: 3131278 - RNA, 18 nt, Mycobacterium bovis subsp bovis AF2122/97
agccgacgucgccggacg

SEQ ID NO: 3131279 - RNA, 19 nt, Mycobacterium bovis subsp bovis AF2122/97
agccgacgugcggcggccu

SEQ ID NO: 3131280 - RNA, 20 nt, Mycobacterium bovis subsp bovis AF2122/97
agccgacguugaagccgccg

SEQ ID NO: 3131281 - RNA, 21 nt, Mycobacterium bovis subsp bovis AF2122/97
agccgacguugaagccgccgg

SEQ ID NO: 3131282 - RNA, 16 nt, Mycobacterium bovis subsp bovis AF2122/97
agccgacuaucggccg

SEQ ID NO: 3131283 - RNA, 14 nt, Mycobacterium bovis subsp bovis AF2122/97
agccgagacaccac

SEQ ID NO: 3131284 - RNA, 15 nt, Mycobacterium bovis subsp bovis AF2122/97
agccgagaccacgcg

SEQ ID NO: 3131285 - RNA, 16 nt, Mycobacterium bovis subsp bovis AF2122/97
agccgagaccacgcgc

SEQ ID NO: 3131286 - RNA, 18 nt, Mycobacterium bovis subsp bovis AF2122/97
agccgagaccacgcgcgu

SEQ ID NO: 3131287 - RNA, 15 nt, Mycobacterium bovis subsp bovis AF2122/97
agccgagcacgggca

SEQ ID NO: 3131288 - RNA, 13 nt, Mycobacterium bovis subsp bovis AF2122/97
agccgagcaucag

SEQ ID NO: 3131289 - RNA, 18 nt, Mycobacterium bovis subsp bovis AF2122/97
agccgagccagcuccggc

SEQ ID NO: 3131290 - RNA, 15 nt, Mycobacterium bovis subsp bovis AF2122/97
agccgagccaguccu

SEQ ID NO: 3131291 - RNA, 17 nt, Mycobacterium bovis subsp bovis AF2122/97
agccgagcccgucgauc

SEQ ID NO: 3131292 - RNA, 14 nt, Mycobacterium bovis subsp bovis AF2122/97
agccgagccucgcu

SEQ ID NO: 3131293 - RNA, 15 nt, Mycobacterium bovis subsp bovis AF2122/97
agccgagcgcccgca

SEQ ID NO: 3131294 - RNA, 16 nt, Mycobacterium bovis subsp bovis AF2122/97
agccgagcgcccgcaa

SEQ ID NO: 3131295 - RNA, 22 nt, Mycobacterium bovis subsp bovis AF2122/97
agccgagcucacuucacgccgc

SEQ ID NO: 3131296 - RNA, 12 nt, Mycobacterium bovis subsp bovis AF2122/97
agccgagcucgu

SEQ ID NO: 3131297 - RNA, 14 nt, Mycobacterium bovis subsp bovis AF2122/97
agccgagcuugagc

SEQ ID NO: 3131298 - RNA, 23 nt, Mycobacterium bovis subsp bovis AF2122/97
agccgaggaaguccagcuggccg

SEQ ID NO: 3131299 - RNA, 22 nt, Mycobacterium bovis subsp bovis AF2122/97
agccgaggacuggaaagcagca

SEQ ID NO: 3131300 - RNA, 23 nt, Mycobacterium bovis subsp bovis AF2122/97
agccgaggacuggaaagcagcag

SEQ ID NO: 3131301 - RNA, 14 nt, Mycobacterium bovis subsp bovis AF2122/97
agccgaggucgccc

SEQ ID NO: 3131302 - RNA, 20 nt, Mycobacterium bovis subsp bovis AF2122/97
agccgagguucaaagcagcg

SEQ ID NO: 3131303 - RNA, 17 nt, Mycobacterium bovis subsp bovis AF2122/97
agccgauauaccagggc

SEQ ID NO: 3131304 - RNA, 16 nt, Mycobacterium bovis subsp bovis AF2122/97
agccgaucaccgccgg

SEQ ID NO: 3131305 - RNA, 22 nt, Mycobacterium bovis subsp bovis AF2122/97
agccgaucacgggcuaccggca

SEQ ID NO: 3131306 - RNA, 16 nt, Mycobacterium bovis subsp bovis AF2122/97
agccgaucaucaccgg

SEQ ID NO: 3131307 - RNA, 19 nt, Mycobacterium bovis subsp bovis AF2122/97
agccgaucaucaccggcau

SEQ ID NO: 3131308 - RNA, 15 nt, Mycobacterium bovis subsp bovis AF2122/97
agccgauccagcagg

SEQ ID NO: 3131309 - RNA, 18 nt, Mycobacterium bovis subsp bovis AF2122/97
agccgauccagcaggccg

SEQ ID NO: 3131310 - RNA, 18 nt, Mycobacterium bovis subsp bovis AF2122/97
agccgaucgcccgcugag

SEQ ID NO: 3131311 - RNA, 18 nt, Mycobacterium bovis subsp bovis AF2122/97
agccgaugaccugcccgu

SEQ ID NO: 3131312 - RNA, 22 nt, Mycobacterium bovis subsp bovis AF2122/97
agccgaugaucgaacacggcac

SEQ ID NO: 3131313 - RNA, 20 nt, Mycobacterium bovis subsp bovis AF2122/97
agccgaugcucgucccagaa

SEQ ID NO: 3131314 - RNA, 18 nt, Mycobacterium bovis subsp bovis AF2122/97
agccgauguccgacgcca

SEQ ID NO: 3131315 - RNA, 14 nt, Mycobacterium bovis subsp bovis AF2122/97
agccgcggccacgg

SEQ ID NO: 3131316 - RNA, 12 nt, Mycobacterium bovis subsp bovis AF2122/97
agccgcggcccg

SEQ ID NO: 3131317 - RNA, 15 nt, Mycobacterium bovis subsp bovis AF2122/97
agccgcggcccgcgu

SEQ ID NO: 3131318 - RNA, 22 nt, Mycobacterium bovis subsp bovis AF2122/97
agccgcggcccucgaugccgcg

SEQ ID NO: 3131319 - RNA, 21 nt, Mycobacterium bovis subsp bovis AF2122/97
agccgcggcgccauagccgcg

SEQ ID NO: 3131320 - RNA, 15 nt, Mycobacterium bovis subsp bovis AF2122/97
agccgcggcggcagc

SEQ ID NO: 3131321 - RNA, 20 nt, Mycobacterium bovis subsp bovis AF2122/97
agccgcggcggcagcaccca

SEQ ID NO: 3131322 - RNA, 15 nt, Mycobacterium bovis subsp bovis AF2122/97
agccgcggcuaggcc

SEQ ID NO: 3131323 - RNA, 22 nt, Mycobacterium bovis subsp bovis AF2122/97
agccgcggcuaggccagcacgg

SEQ ID NO: 3131324 - RNA, 24 nt, Mycobacterium bovis subsp bovis AF2122/97
agccgcggcuaggccagcacggcg

SEQ ID NO: 3131325 - RNA, 15 nt, Mycobacterium bovis subsp bovis AF2122/97
agccgcgggccgcgu

SEQ ID NO: 3131326 - RNA, 22 nt, Mycobacterium bovis subsp bovis AF2122/97
agccgcggggcgaaguggaucu

SEQ ID NO: 3131327 - RNA, 17 nt, Mycobacterium bovis subsp bovis AF2122/97
agccgcgguagacggca

SEQ ID NO: 3131328 - RNA, 19 nt, Mycobacterium bovis subsp bovis AF2122/97
agccgcgguagacggcacu

SEQ ID NO: 3131329 - RNA, 20 nt, Mycobacterium bovis subsp bovis AF2122/97
agccgcuacguuacgccgag

SEQ ID NO: 3131330 - RNA, 23 nt, Mycobacterium bovis subsp bovis AF2122/97
agccgcuacguuacgccgagaug

SEQ ID NO: 3131331 - RNA, 16 nt, Mycobacterium bovis subsp bovis AF2122/97
agccgcucacccgguc

SEQ ID NO: 3131332 - RNA, 18 nt, Mycobacterium bovis subsp bovis AF2122/97
agccgcucacccggucgc

SEQ ID NO: 3131333 - RNA, 17 nt, Mycobacterium bovis subsp bovis AF2122/97
agccgcuccacguacgc

SEQ ID NO: 3131334 - RNA, 23 nt, Mycobacterium bovis subsp bovis AF2122/97
agccgcuccacguacgcggcugc

SEQ ID NO: 3131335 - RNA, 16 nt, Mycobacterium bovis subsp bovis AF2122/97
agccgcuccgcccauu

SEQ ID NO: 3131336 - RNA, 17 nt, Mycobacterium bovis subsp bovis AF2122/97
agccgcucgacggcccg

SEQ ID NO: 3131337 - RNA, 19 nt, Mycobacterium bovis subsp bovis AF2122/97
agccgcucgacggcccgcc

SEQ ID NO: 3131338 - RNA, 22 nt, Mycobacterium bovis subsp bovis AF2122/97
agccgcucgggguggucggcuc

SEQ ID NO: 3131339 - RNA, 17 nt, Mycobacterium bovis subsp bovis AF2122/97
agccgcugaucugccgc

SEQ ID NO: 3131340 - RNA, 21 nt, Mycobacterium bovis subsp bovis AF2122/97
agccgcugauguacccggcga

SEQ ID NO: 3131341 - RNA, 21 nt, Mycobacterium bovis subsp bovis AF2122/97
agccgcugccacaggugaccu

SEQ ID NO: 3131342 - RNA, 15 nt, Mycobacterium bovis subsp bovis AF2122/97
agccgcugccuggcc

SEQ ID NO: 3131343 - RNA, 20 nt, Mycobacterium bovis subsp bovis AF2122/97
agccgcugccuggccgggac

SEQ ID NO: 3131344 - RNA, 18 nt, Mycobacterium bovis subsp bovis AF2122/97
agccgcugcgccagguca

SEQ ID NO: 3131345 - RNA, 15 nt, Mycobacterium bovis subsp bovis AF2122/97
agccgcugcggcacc

SEQ ID NO: 3131346 - RNA, 15 nt, Mycobacterium bovis subsp bovis AF2122/97
agccgcuggaagucg

SEQ ID NO: 3131347 - RNA, 18 nt, Mycobacterium bovis subsp bovis AF2122/97
agccgcuggaagucgguc

SEQ ID NO: 3131348 - RNA, 21 nt, Mycobacterium bovis subsp bovis AF2122/97
agccgcuggaagucggucugc

SEQ ID NO: 3131349 - RNA, 13 nt, Mycobacterium bovis subsp bovis AF2122/97
agccggaccgcga

SEQ ID NO: 3131350 - RNA, 22 nt, Mycobacterium bovis subsp bovis AF2122/97
agccggaccgcgacggcgccgg

SEQ ID NO: 3131351 - RNA, 17 nt, Mycobacterium bovis subsp bovis AF2122/97
agccggacguucuggau

SEQ ID NO: 3131352 - RNA, 22 nt, Mycobacterium bovis subsp bovis AF2122/97
agccggaguucuguaccggcug

SEQ ID NO: 3131353 - RNA, 22 nt, Mycobacterium bovis subsp bovis AF2122/97
agccggauaaucauccgagcgg

SEQ ID NO: 3131354 - RNA, 23 nt, Mycobacterium bovis subsp bovis AF2122/97
agccggauaaucauccgagcggu

SEQ ID NO: 3131355 - RNA, 13 nt, Mycobacterium bovis subsp bovis AF2122/97
agccggcagcagc

SEQ ID NO: 3131356 - RNA, 15 nt, Mycobacterium bovis subsp bovis AF2122/97
agccggcagcagcgg

SEQ ID NO: 3131357 - RNA, 22 nt, Mycobacterium bovis subsp bovis AF2122/97
agccggcagcagcgggcgcgcu

SEQ ID NO: 3131358 - RNA, 18 nt, Mycobacterium bovis subsp bovis AF2122/97
agccggcauagcggccca

SEQ ID NO: 3131359 - RNA, 22 nt, Mycobacterium bovis subsp bovis AF2122/97
agccggccaauggccugcagcg

SEQ ID NO: 3131360 - RNA, 12 nt, Mycobacterium bovis subsp bovis AF2122/97
agccggccaccu

SEQ ID NO: 3131361 - RNA, 19 nt, Mycobacterium bovis subsp bovis AF2122/97
agccggccaccucggugcg

SEQ ID NO: 3131362 - RNA, 20 nt, Mycobacterium bovis subsp bovis AF2122/97
agccggccaccucggugcgg

SEQ ID NO: 3131363 - RNA, 16 nt, Mycobacterium bovis subsp bovis AF2122/97
agccggccacgcauuc

SEQ ID NO: 3131364 - RNA, 22 nt, Mycobacterium bovis subsp bovis AF2122/97
agccggccacuacggccuggcc

SEQ ID NO: 3131365 - RNA, 19 nt, Mycobacterium bovis subsp bovis AF2122/97
agccggcccgucgcgucga

SEQ ID NO: 3131366 - RNA, 16 nt, Mycobacterium bovis subsp bovis AF2122/97
agccggcccugcucgc

SEQ ID NO: 3131367 - RNA, 18 nt, Mycobacterium bovis subsp bovis AF2122/97
agccggcccugcucgccg

SEQ ID NO: 3131368 - RNA, 12 nt, Mycobacterium bovis subsp bovis AF2122/97
agccggccgcga

SEQ ID NO: 3131369 - RNA, 14 nt, Mycobacterium bovis subsp bovis AF2122/97
agccggccgcgacc

SEQ ID NO: 3131370 - RNA, 17 nt, Mycobacterium bovis subsp bovis AF2122/97
agccggccgcgaccgcg

SEQ ID NO: 3131371 - RNA, 22 nt, Mycobacterium bovis subsp bovis AF2122/97
agccggccgcuuggccgcugcc

SEQ ID NO: 3131372 - RNA, 14 nt, Mycobacterium bovis subsp bovis AF2122/97
agccggccgugaug

SEQ ID NO: 3131373 - RNA, 17 nt, Mycobacterium bovis subsp bovis AF2122/97
agccggccugucccgca

SEQ ID NO: 3131374 - RNA, 20 nt, Mycobacterium bovis subsp bovis AF2122/97
agccggccugucccgcaccc

SEQ ID NO: 3131375 - RNA, 16 nt, Mycobacterium bovis subsp bovis AF2122/97
agccggcgacaccgca

SEQ ID NO: 3131376 - RNA, 17 nt, Mycobacterium bovis subsp bovis AF2122/97
agccggcgacaccgcag

SEQ ID NO: 3131377 - RNA, 15 nt, Mycobacterium bovis subsp bovis AF2122/97
agccggcgcagcugu

SEQ ID NO: 3131378 - RNA, 13 nt, Mycobacterium bovis subsp bovis AF2122/97
agccggcgcccgc

SEQ ID NO: 3131379 - RNA, 14 nt, Mycobacterium bovis subsp bovis AF2122/97
agccggcgcccgcc

SEQ ID NO: 3131380 - RNA, 18 nt, Mycobacterium bovis subsp bovis AF2122/97
agccggcgcccgccgcga

SEQ ID NO: 3131381 - RNA, 18 nt, Mycobacterium bovis subsp bovis AF2122/97
agccggcgccgccgugcg

SEQ ID NO: 3131382 - RNA, 19 nt, Mycobacterium bovis subsp bovis AF2122/97
agccggcgccgccgugcgg

SEQ ID NO: 3131383 - RNA, 13 nt, Mycobacterium bovis subsp bovis AF2122/97
agccggcgcgccc

SEQ ID NO: 3131384 - RNA, 19 nt, Mycobacterium bovis subsp bovis AF2122/97
agccggcgcgccccaccgc

SEQ ID NO: 3131385 - RNA, 22 nt, Mycobacterium bovis subsp bovis AF2122/97
agccggcgcgccccaccgcgcc

SEQ ID NO: 3131386 - RNA, 15 nt, Mycobacterium bovis subsp bovis AF2122/97
agccggcgcgccgga

SEQ ID NO: 3131387 - RNA, 19 nt, Mycobacterium bovis subsp bovis AF2122/97
agccggcgcgccggaugua

SEQ ID NO: 3131388 - RNA, 19 nt, Mycobacterium bovis subsp bovis AF2122/97
agccggcggagaaggcgac

SEQ ID NO: 3131389 - RNA, 14 nt, Mycobacterium bovis subsp bovis AF2122/97
agccggcgugcacu

SEQ ID NO: 3131390 - RNA, 15 nt, Mycobacterium bovis subsp bovis AF2122/97
agccggcgugcacuc

SEQ ID NO: 3131391 - RNA, 20 nt, Mycobacterium bovis subsp bovis AF2122/97
agccgggaccauagucgccg

SEQ ID NO: 3131392 - RNA, 18 nt, Mycobacterium bovis subsp bovis AF2122/97
agccgggagucgucggca

SEQ ID NO: 3131393 - RNA, 23 nt, Mycobacterium bovis subsp bovis AF2122/97
agccgggagucgucggcaugggc

SEQ ID NO: 3131394 - RNA, 14 nt, Mycobacterium bovis subsp bovis AF2122/97
agccgggauugccg

SEQ ID NO: 3131395 - RNA, 15 nt, Mycobacterium bovis subsp bovis AF2122/97
agccgggauugccgc

SEQ ID NO: 3131396 - RNA, 13 nt, Mycobacterium bovis subsp bovis AF2122/97
agccgggcaaggc

SEQ ID NO: 3131397 - RNA, 15 nt, Mycobacterium bovis subsp bovis AF2122/97
agccgggcaccaccc

SEQ ID NO: 3131398 - RNA, 13 nt, Mycobacterium bovis subsp bovis AF2122/97
agccgggcacccu

SEQ ID NO: 3131399 - RNA, 19 nt, Mycobacterium bovis subsp bovis AF2122/97
agccgggccccacaucgcc

SEQ ID NO: 3131400 - RNA, 21 nt, Mycobacterium bovis subsp bovis AF2122/97
agccgggccccacaucgcccc

SEQ ID NO: 3131401 - RNA, 22 nt, Mycobacterium bovis subsp bovis AF2122/97
agccguucucgcccacccgcug

SEQ ID NO: 3131402 - RNA, 16 nt, Mycobacterium bovis subsp bovis AF2122/97
agccguucugucccgg

SEQ ID NO: 3131403 - RNA, 20 nt, Mycobacterium bovis subsp bovis AF2122/97
agccguugccgccacgggcg

SEQ ID NO: 3131404 - RNA, 23 nt, Mycobacterium bovis subsp bovis AF2122/97
agccguugccgccacgggcggcc

SEQ ID NO: 3131405 - RNA, 15 nt, Mycobacterium bovis subsp bovis AF2122/97
agccguuugcgcugg

SEQ ID NO: 3131406 - RNA, 20 nt, Mycobacterium bovis subsp bovis AF2122/97
agccguuuuccugaucgcgc

SEQ ID NO: 3131407 - RNA, 21 nt, Mycobacterium bovis subsp bovis AF2122/97
agccuaccggcuacggcgaca

SEQ ID NO: 3131408 - RNA, 13 nt, Mycobacterium bovis subsp bovis AF2122/97
agccucagccgcu

SEQ ID NO: 3131409 - RNA, 16 nt, Mycobacterium bovis subsp bovis AF2122/97
agccucagugcgcacg

SEQ ID NO: 3131410 - RNA, 16 nt, Mycobacterium bovis subsp bovis AF2122/97
agccuccaccaggucg

SEQ ID NO: 3131411 - RNA, 14 nt, Mycobacterium bovis subsp bovis AF2122/97
agccucgaccgguc

SEQ ID NO: 3131412 - RNA, 15 nt, Mycobacterium bovis subsp bovis AF2122/97
agccucgcgggcagg

SEQ ID NO: 3131413 - RNA, 17 nt, Mycobacterium bovis subsp bovis AF2122/97
agccucggcaugcagcc

SEQ ID NO: 3131414 - RNA, 20 nt, Mycobacterium bovis subsp bovis AF2122/97
agccucggcaugcagcccca

SEQ ID NO: 3131415 - RNA, 21 nt, Mycobacterium bovis subsp bovis AF2122/97
agccucggcaugcagccccac

SEQ ID NO: 3131416 - RNA, 22 nt, Mycobacterium bovis subsp bovis AF2122/97
agccucguagaacgcuagcgcc

SEQ ID NO: 3131417 - RNA, 14 nt, Mycobacterium bovis subsp bovis AF2122/97
agccucucuuccca

SEQ ID NO: 3131418 - RNA, 23 nt, Mycobacterium bovis subsp bovis AF2122/97
agccucucuucccaaccgcccgu

SEQ ID NO: 3131419 - RNA, 13 nt, Mycobacterium bovis subsp bovis AF2122/97
agccucuugguca

SEQ ID NO: 3131420 - RNA, 17 nt, Mycobacterium bovis subsp bovis AF2122/97
agccucuuggucaacgg

SEQ ID NO: 3131421 - RNA, 23 nt, Mycobacterium bovis subsp bovis AF2122/97
agccugaccgaagucugcagacg

SEQ ID NO: 3131422 - RNA, 21 nt, Mycobacterium bovis subsp bovis AF2122/97
agccugagcacguucaccgcg

SEQ ID NO: 3131423 - RNA, 19 nt, Mycobacterium bovis subsp bovis AF2122/97
agccugauaaagcccggcg

SEQ ID NO: 3131424 - RNA, 20 nt, Mycobacterium bovis subsp bovis AF2122/97
agccugauaaagcccggcgg

SEQ ID NO: 3131425 - RNA, 17 nt, Mycobacterium bovis subsp bovis AF2122/97
agccugcagcgaaacac

SEQ ID NO: 3131426 - RNA, 16 nt, Mycobacterium bovis subsp bovis AF2122/97
agccugcggcggcguu

SEQ ID NO: 3131427 - RNA, 14 nt, Mycobacterium bovis subsp bovis AF2122/97
agccugcgggccgg

SEQ ID NO: 3131428 - RNA, 18 nt, Mycobacterium bovis subsp bovis AF2122/97
agccugcuggccgcggcc

SEQ ID NO: 3131429 - RNA, 16 nt, Mycobacterium bovis subsp bovis AF2122/97
agccuggaucacaccc

SEQ ID NO: 3131430 - RNA, 23 nt, Mycobacterium bovis subsp bovis AF2122/97
agccuggaucacacccacgucga

SEQ ID NO: 3131431 - RNA, 16 nt, Mycobacterium bovis subsp bovis AF2122/97
agccuggccucgccau

SEQ ID NO: 3131432 - RNA, 15 nt, Mycobacterium bovis subsp bovis AF2122/97
agccuggcuguccgc

SEQ ID NO: 3131433 - RNA, 21 nt, Mycobacterium bovis subsp bovis AF2122/97
agccuucggugucgccgaaca

SEQ ID NO: 3131434 - RNA, 14 nt, Mycobacterium bovis subsp bovis AF2122/97
agccuugaucucgu

SEQ ID NO: 3131435 - RNA, 16 nt, Mycobacterium bovis subsp bovis AF2122/97
agccuuguugccgccg

SEQ ID NO: 3131436 - RNA, 20 nt, Mycobacterium bovis subsp bovis AF2122/97
agccuuucgugcaccgcgac

SEQ ID NO: 3131437 - RNA, 21 nt, Mycobacterium bovis subsp bovis AF2122/97
agccuuucgugcaccgcgacc

SEQ ID NO: 3131438 - RNA, 18 nt, Mycobacterium bovis subsp bovis AF2122/97
agcgaaaacccggucggc

SEQ ID NO: 3131439 - RNA, 22 nt, Mycobacterium bovis subsp bovis AF2122/97
agcgaaaacccggucggcgaaa

SEQ ID NO: 3131440 - RNA, 14 nt, Mycobacterium bovis subsp bovis AF2122/97
agcgaaaugcccau

SEQ ID NO: 3131441 - RNA, 19 nt, Mycobacterium bovis subsp bovis AF2122/97
agcgaaaugcccaucacca

SEQ ID NO: 3131442 - RNA, 20 nt, Mycobacterium bovis subsp bovis AF2122/97
agcgaaaugcccaucaccag

SEQ ID NO: 3131443 - RNA, 18 nt, Mycobacterium bovis subsp bovis AF2122/97
agcgaaaugccggugccg

SEQ ID NO: 3131444 - RNA, 13 nt, Mycobacterium bovis subsp bovis AF2122/97
agcgaaccaccgg

SEQ ID NO: 3131445 - RNA, 17 nt, Mycobacterium bovis subsp bovis AF2122/97
agcgaaccaccggcgcc

SEQ ID NO: 3131446 - RNA, 19 nt, Mycobacterium bovis subsp bovis AF2122/97
agcgaacccgagccgccgu

SEQ ID NO: 3131447 - RNA, 23 nt, Mycobacterium bovis subsp bovis AF2122/97
agcgaacccgcguugaaggcgcc

SEQ ID NO: 3131448 - RNA, 18 nt, Mycobacterium bovis subsp bovis AF2122/97
agcgaaccgaagccgucg

SEQ ID NO: 3131449 - RNA, 17 nt, Mycobacterium bovis subsp bovis AF2122/97
agcgaaccggcugggcg

SEQ ID NO: 3131450 - RNA, 15 nt, Mycobacterium bovis subsp bovis AF2122/97
agcgaacggccagga

SEQ ID NO: 3131451 - RNA, 13 nt, Mycobacterium bovis subsp bovis AF2122/97
agcgaagccgggu

SEQ ID NO: 3131452 - RNA, 16 nt, Mycobacterium bovis subsp bovis AF2122/97
agcgaagccgggucug

SEQ ID NO: 3131453 - RNA, 17 nt, Mycobacterium bovis subsp bovis AF2122/97
agcgaaggcgccgaaca

SEQ ID NO: 3131454 - RNA, 15 nt, Mycobacterium bovis subsp bovis AF2122/97
agcgaaggugaacga

SEQ ID NO: 3131455 - RNA, 16 nt, Mycobacterium bovis subsp bovis AF2122/97
agcgaagugucgcugc

SEQ ID NO: 3131456 - RNA, 22 nt, Mycobacterium bovis subsp bovis AF2122/97
agcgaaugucugcgcagguggu

SEQ ID NO: 3131457 - RNA, 14 nt, Mycobacterium bovis subsp bovis AF2122/97
agcgacaacaccac

SEQ ID NO: 3131458 - RNA, 15 nt, Mycobacterium bovis subsp bovis AF2122/97
agcgacagcgugccg

SEQ ID NO: 3131459 - RNA, 16 nt, Mycobacterium bovis subsp bovis AF2122/97
agcgaccaccgucacg

SEQ ID NO: 3131460 - RNA, 22 nt, Mycobacterium bovis subsp bovis AF2122/97
agcgaccaccgucacgaucagg

SEQ ID NO: 3131461 - RNA, 17 nt, Mycobacterium bovis subsp bovis AF2122/97
agcgaccaggucgccag

SEQ ID NO: 3131462 - RNA, 21 nt, Mycobacterium bovis subsp bovis AF2122/97
agcgacccccagcgcccgccg

SEQ ID NO: 3131463 - RNA, 14 nt, Mycobacterium bovis subsp bovis AF2122/97
agcgaccgacgcca

SEQ ID NO: 3131464 - RNA, 17 nt, Mycobacterium bovis subsp bovis AF2122/97
agcgaccgcggccccgc

SEQ ID NO: 3131465 - RNA, 18 nt, Mycobacterium bovis subsp bovis AF2122/97
agcgaccgcggucgcugc

SEQ ID NO: 3131466 - RNA, 14 nt, Mycobacterium bovis subsp bovis AF2122/97
agcgaccgcugcag

SEQ ID NO: 3131467 - RNA, 22 nt, Mycobacterium bovis subsp bovis AF2122/97
agcgaccgucccagcgccgcag

SEQ ID NO: 3131468 - RNA, 18 nt, Mycobacterium bovis subsp bovis AF2122/97
agcgaccgucguccagac

SEQ ID NO: 3131469 - RNA, 16 nt, Mycobacterium bovis subsp bovis AF2122/97
agcgaccuagcagcgc

SEQ ID NO: 3131470 - RNA, 15 nt, Mycobacterium bovis subsp bovis AF2122/97
agcgaccucgccgcg

SEQ ID NO: 3131471 - RNA, 18 nt, Mycobacterium bovis subsp bovis AF2122/97
agcgaccucgccgcggcg

SEQ ID NO: 3131472 - RNA, 12 nt, Mycobacterium bovis subsp bovis AF2122/97
agcgaccugggu

SEQ ID NO: 3131473 - RNA, 15 nt, Mycobacterium bovis subsp bovis AF2122/97
agcgacgaccacacc

SEQ ID NO: 3131474 - RNA, 18 nt, Mycobacterium bovis subsp bovis AF2122/97
agcgacgcaaagcagcgc

SEQ ID NO: 3131475 - RNA, 23 nt, Mycobacterium bovis subsp bovis AF2122/97
agcgacgcauaaccggcgcgccc

SEQ ID NO: 3131476 - RNA, 13 nt, Mycobacterium bovis subsp bovis AF2122/97
agcgacgccggcc

SEQ ID NO: 3131477 - RNA, 14 nt, Mycobacterium bovis subsp bovis AF2122/97
agcgacgccggccc

SEQ ID NO: 3131478 - RNA, 22 nt, Mycobacterium bovis subsp bovis AF2122/97
agcgacgcuaggacggcugccg

SEQ ID NO: 3131479 - RNA, 16 nt, Mycobacterium bovis subsp bovis AF2122/97
agcgacgcugccgcca

SEQ ID NO: 3131480 - RNA, 16 nt, Mycobacterium bovis subsp bovis AF2122/97
agcgacggccgccagc

SEQ ID NO: 3131481 - RNA, 18 nt, Mycobacterium bovis subsp bovis AF2122/97
agcgacggccgccagcag

SEQ ID NO: 3131482 - RNA, 21 nt, Mycobacterium bovis subsp bovis AF2122/97
agcgacggccgccagcagcuu

SEQ ID NO: 3131483 - RNA, 14 nt, Mycobacterium bovis subsp bovis AF2122/97
agcgacggucccgg

SEQ ID NO: 3131484 - RNA, 16 nt, Mycobacterium bovis subsp bovis AF2122/97
agcgacuccagcgccc

SEQ ID NO: 3131485 - RNA, 17 nt, Mycobacterium bovis subsp bovis AF2122/97
agcgacuccagcgcccg

SEQ ID NO: 3131486 - RNA, 13 nt, Mycobacterium bovis subsp bovis AF2122/97
agcgacucgccgg

SEQ ID NO: 3131487 - RNA, 20 nt, Mycobacterium bovis subsp bovis AF2122/97
agcgccagccgcugccacag

SEQ ID NO: 3131488 - RNA, 21 nt, Mycobacterium bovis subsp bovis AF2122/97
agcgccagccgcugccacagg

SEQ ID NO: 3131489 - RNA, 14 nt, Mycobacterium bovis subsp bovis AF2122/97
agcgccagcgagca

SEQ ID NO: 3131490 - RNA, 11 nt, Mycobacterium bovis subsp bovis AF2122/97
agcgccaggcc

SEQ ID NO: 3131491 - RNA, 18 nt, Mycobacterium bovis subsp bovis AF2122/97
agcgccaggccgcacagc

SEQ ID NO: 3131492 - RNA, 13 nt, Mycobacterium bovis subsp bovis AF2122/97
agcgccaguagca

SEQ ID NO: 3131493 - RNA, 17 nt, Mycobacterium bovis subsp bovis AF2122/97
agcgccagugccucgcg

SEQ ID NO: 3131494 - RNA, 20 nt, Mycobacterium bovis subsp bovis AF2122/97
agcgcccaccguagacgaca

SEQ ID NO: 3131495 - RNA, 12 nt, Mycobacterium bovis subsp bovis AF2122/97
agcgcccacugg

SEQ ID NO: 3131496 - RNA, 17 nt, Mycobacterium bovis subsp bovis AF2122/97
agcgcccagaucgccga

SEQ ID NO: 3131497 - RNA, 19 nt, Mycobacterium bovis subsp bovis AF2122/97
agcgcccagaucgccgaga

SEQ ID NO: 3131498 - RNA, 14 nt, Mycobacterium bovis subsp bovis AF2122/97
agcgcccccagcag

SEQ ID NO: 3131499 - RNA, 16 nt, Mycobacterium bovis subsp bovis AF2122/97
agcgcccccagcagcu

SEQ ID NO: 3131500 - RNA, 13 nt, Mycobacterium bovis subsp bovis AF2122/97
agcgcccccgcug

SEQ ID NO: 3131501 - RNA, 17 nt, Mycobacterium bovis subsp bovis AF2122/97
agcgcccgcgagagagu

SEQ ID NO: 3131502 - RNA, 20 nt, Mycobacterium bovis subsp bovis AF2122/97
agcgcccggccacuccagua

SEQ ID NO: 3131503 - RNA, 18 nt, Mycobacterium bovis subsp bovis AF2122/97
agcgcccggcccgccacc

SEQ ID NO: 3131504 - RNA, 13 nt, Mycobacterium bovis subsp bovis AF2122/97
agcgcccggucac

SEQ ID NO: 3131505 - RNA, 15 nt, Mycobacterium bovis subsp bovis AF2122/97
agcgcccggucacgc

SEQ ID NO: 3131506 - RNA, 13 nt, Mycobacterium bovis subsp bovis AF2122/97
agcgcccgucgcu

SEQ ID NO: 3131507 - RNA, 22 nt, Mycobacterium bovis subsp bovis AF2122/97
agcgcccgucguagguggccgg

SEQ ID NO: 3131508 - RNA, 16 nt, Mycobacterium bovis subsp bovis AF2122/97
agcgcccguuggccaa

SEQ ID NO: 3131509 - RNA, 20 nt, Mycobacterium bovis subsp bovis AF2122/97
agcgcccguuggccaagaau

SEQ ID NO: 3131510 - RNA, 16 nt, Mycobacterium bovis subsp bovis AF2122/97
agcgccgaaacagcac

SEQ ID NO: 3131511 - RNA, 18 nt, Mycobacterium bovis subsp bovis AF2122/97
agcgccgaaacagcaccc

SEQ ID NO: 3131512 - RNA, 19 nt, Mycobacterium bovis subsp bovis AF2122/97
agcgccgaaacagcaccca

SEQ ID NO: 3131513 - RNA, 20 nt, Mycobacterium bovis subsp bovis AF2122/97
agcgccgaaacagcacccag

SEQ ID NO: 3131514 - RNA, 16 nt, Mycobacterium bovis subsp bovis AF2122/97
agcgccgagagcaccg

SEQ ID NO: 3131515 - RNA, 14 nt, Mycobacterium bovis subsp bovis AF2122/97
agcgccgagcucgg

SEQ ID NO: 3131516 - RNA, 15 nt, Mycobacterium bovis subsp bovis AF2122/97
agcgccgauggccgc

SEQ ID NO: 3131517 - RNA, 21 nt, Mycobacterium bovis subsp bovis AF2122/97
agcgccgauguggccggcgau

SEQ ID NO: 3131518 - RNA, 23 nt, Mycobacterium bovis subsp bovis AF2122/97
agcgccgauguggccggcgaugg

SEQ ID NO: 3131519 - RNA, 13 nt, Mycobacterium bovis subsp bovis AF2122/97
agcgccgcagggu

SEQ ID NO: 3131520 - RNA, 12 nt, Mycobacterium bovis subsp bovis AF2122/97
agcgccgccacc

SEQ ID NO: 3131521 - RNA, 14 nt, Mycobacterium bovis subsp bovis AF2122/97
agcgccgccacccc

SEQ ID NO: 3131522 - RNA, 13 nt, Mycobacterium bovis subsp bovis AF2122/97
agcgccgccaccg

SEQ ID NO: 3131523 - RNA, 22 nt, Mycobacterium bovis subsp bovis AF2122/97
agcgccgccaccgaagccgccg

SEQ ID NO: 3131524 - RNA, 11 nt, Mycobacterium bovis subsp bovis AF2122/97
agcgccgccga

SEQ ID NO: 3131525 - RNA, 17 nt, Mycobacterium bovis subsp bovis AF2122/97
agcgccgccgccgacga

SEQ ID NO: 3131526 - RNA, 15 nt, Mycobacterium bovis subsp bovis AF2122/97
agcgccgccgcgagc

SEQ ID NO: 3131527 - RNA, 17 nt, Mycobacterium bovis subsp bovis AF2122/97
agcgccgccgcgagcgc

SEQ ID NO: 3131528 - RNA, 21 nt, Mycobacterium bovis subsp bovis AF2122/97
agcgccgccgcgagcgccggc

SEQ ID NO: 3131529 - RNA, 11 nt, Mycobacterium bovis subsp bovis AF2122/97
agcgccgccgg

SEQ ID NO: 3131530 - RNA, 17 nt, Mycobacterium bovis subsp bovis AF2122/97
agcgccgccggaagcgc

SEQ ID NO: 3131531 - RNA, 13 nt, Mycobacterium bovis subsp bovis AF2122/97
agcgccgccggcg

SEQ ID NO: 3131532 - RNA, 14 nt, Mycobacterium bovis subsp bovis AF2122/97
agcgccgccggcgc

SEQ ID NO: 3131533 - RNA, 18 nt, Mycobacterium bovis subsp bovis AF2122/97
agcgccgccggcgccggc

SEQ ID NO: 3131534 - RNA, 13 nt, Mycobacterium bovis subsp bovis AF2122/97
agcgccgcgccca

SEQ ID NO: 3131535 - RNA, 16 nt, Mycobacterium bovis subsp bovis AF2122/97
agcgccgcgcuugcga

SEQ ID NO: 3131536 - RNA, 23 nt, Mycobacterium bovis subsp bovis AF2122/97
agcgccgcgcuugcgaucggcac

SEQ ID NO: 3131537 - RNA, 12 nt, Mycobacterium bovis subsp bovis AF2122/97
agcgccgcggcg

SEQ ID NO: 3131538 - RNA, 13 nt, Mycobacterium bovis subsp bovis AF2122/97
agcgccgcggcga

SEQ ID NO: 3131539 - RNA, 18 nt, Mycobacterium bovis subsp bovis AF2122/97
agcgccgcuuggcgaucc

SEQ ID NO: 3131540 - RNA, 22 nt, Mycobacterium bovis subsp bovis AF2122/97
agcgccggauggguggccagca

SEQ ID NO: 3131541 - RNA, 23 nt, Mycobacterium bovis subsp bovis AF2122/97
agcgccggauggguggccagcaa

SEQ ID NO: 3131542 - RNA, 16 nt, Mycobacterium bovis subsp bovis AF2122/97
agcgccggcaccgaca

SEQ ID NO: 3131543 - RNA, 14 nt, Mycobacterium bovis subsp bovis AF2122/97
agcgccggccaggc

SEQ ID NO: 3131544 - RNA, 17 nt, Mycobacterium bovis subsp bovis AF2122/97
agcgccggccaggcuau

SEQ ID NO: 3131545 - RNA, 18 nt, Mycobacterium bovis subsp bovis AF2122/97
agcgccggccgcggcggc

SEQ ID NO: 3131546 - RNA, 19 nt, Mycobacterium bovis subsp bovis AF2122/97
agcgccggccgcggcggcc

SEQ ID NO: 3131547 - RNA, 20 nt, Mycobacterium bovis subsp bovis AF2122/97
agcgccggccgcggcggccc

SEQ ID NO: 3131548 - RNA, 21 nt, Mycobacterium bovis subsp bovis AF2122/97
agcgccggccgcggcggcccc

SEQ ID NO: 3131549 - RNA, 16 nt, Mycobacterium bovis subsp bovis AF2122/97
agcgccguacagcggc

SEQ ID NO: 3131550 - RNA, 15 nt, Mycobacterium bovis subsp bovis AF2122/97
agcgccgucagcaug

SEQ ID NO: 3131551 - RNA, 18 nt, Mycobacterium bovis subsp bovis AF2122/97
agcgccgucaucgcagca

SEQ ID NO: 3131552 - RNA, 16 nt, Mycobacterium bovis subsp bovis AF2122/97
agcgccguggcgcggu

SEQ ID NO: 3131553 - RNA, 19 nt, Mycobacterium bovis subsp bovis AF2122/97
agcgccguugccgccacgc

SEQ ID NO: 3131554 - RNA, 22 nt, Mycobacterium bovis subsp bovis AF2122/97
agcgccuccacucuucgggcgg

SEQ ID NO: 3131555 - RNA, 18 nt, Mycobacterium bovis subsp bovis AF2122/97
agcgccucgccggccacc

SEQ ID NO: 3131556 - RNA, 19 nt, Mycobacterium bovis subsp bovis AF2122/97
agcgccucgccggccaccc

SEQ ID NO: 3131557 - RNA, 18 nt, Mycobacterium bovis subsp bovis AF2122/97
agcgccugagcggccucg

SEQ ID NO: 3131558 - RNA, 13 nt, Mycobacterium bovis subsp bovis AF2122/97
agcgccugguccu

SEQ ID NO: 3131559 - RNA, 17 nt, Mycobacterium bovis subsp bovis AF2122/97
agcgccuugaccagcag

SEQ ID NO: 3131560 - RNA, 18 nt, Mycobacterium bovis subsp bovis AF2122/97
agcgccuugaccagcagc

SEQ ID NO: 3131561 - RNA, 17 nt, Mycobacterium bovis subsp bovis AF2122/97
agcgccuugacgccagu

SEQ ID NO: 3131562 - RNA, 22 nt, Mycobacterium bovis subsp bovis AF2122/97
agcgccuugcgggccuggugga

SEQ ID NO: 3131563 - RNA, 16 nt, Mycobacterium bovis subsp bovis AF2122/97
agcgccuugucgaucu

SEQ ID NO: 3131564 - RNA, 21 nt, Mycobacterium bovis subsp bovis AF2122/97
agcgccuuguuggcgaagucg

SEQ ID NO: 3131565 - RNA, 20 nt, Mycobacterium bovis subsp bovis AF2122/97
agcgccuuucggucacgcgu

SEQ ID NO: 3131566 - RNA, 13 nt, Mycobacterium bovis subsp bovis AF2122/97
agcgcgaaagcgc

SEQ ID NO: 3131567 - RNA, 18 nt, Mycobacterium bovis subsp bovis AF2122/97
agcgcgaaagcgccgaaa

SEQ ID NO: 3131568 - RNA, 19 nt, Mycobacterium bovis subsp bovis AF2122/97
agcgcgaaagcgccgaaac

SEQ ID NO: 3131569 - RNA, 21 nt, Mycobacterium bovis subsp bovis AF2122/97
agcgcgaaccugcucggcgcg

SEQ ID NO: 3131570 - RNA, 22 nt, Mycobacterium bovis subsp bovis AF2122/97
agcgcgaaccugcucggcgcgc

SEQ ID NO: 3131571 - RNA, 19 nt, Mycobacterium bovis subsp bovis AF2122/97
agcgcgaaguacgacgacc

SEQ ID NO: 3131572 - RNA, 13 nt, Mycobacterium bovis subsp bovis AF2122/97
agcgcgacaaagu

SEQ ID NO: 3131573 - RNA, 20 nt, Mycobacterium bovis subsp bovis AF2122/97
agcgcgacccguagcuuggc

SEQ ID NO: 3131574 - RNA, 21 nt, Mycobacterium bovis subsp bovis AF2122/97
agcgcggguggcucggguggu

SEQ ID NO: 3131575 - RNA, 22 nt, Mycobacterium bovis subsp bovis AF2122/97
agcgcgguggucgcgaccgacc

SEQ ID NO: 3131576 - RNA, 21 nt, Mycobacterium bovis subsp bovis AF2122/97
agcgcggugucggggcccccg

SEQ ID NO: 3131577 - RNA, 16 nt, Mycobacterium bovis subsp bovis AF2122/97
agcgcgguuucggcga

SEQ ID NO: 3131578 - RNA, 20 nt, Mycobacterium bovis subsp bovis AF2122/97
agcgcguacuuggugguggu

SEQ ID NO: 3131579 - RNA, 20 nt, Mycobacterium bovis subsp bovis AF2122/97
agcgcguagcgggcgcccuu

SEQ ID NO: 3131580 - RNA, 14 nt, Mycobacterium bovis subsp bovis AF2122/97
agcgcguaguccgc

SEQ ID NO: 3131581 - RNA, 19 nt, Mycobacterium bovis subsp bovis AF2122/97
agcgcguauggcucacccc

SEQ ID NO: 3131582 - RNA, 13 nt, Mycobacterium bovis subsp bovis AF2122/97
agcgcgucgccga

SEQ ID NO: 3131583 - RNA, 15 nt, Mycobacterium bovis subsp bovis AF2122/97
agcgcgucgccgaaa

SEQ ID NO: 3131584 - RNA, 12 nt, Mycobacterium bovis subsp bovis AF2122/97
agcgcgucgcgg

SEQ ID NO: 3131585 - RNA, 22 nt, Mycobacterium bovis subsp bovis AF2122/97
agcgcgucgcgggauugcgcgc

SEQ ID NO: 3131586 - RNA, 17 nt, Mycobacterium bovis subsp bovis AF2122/97
agcgcgucggagccggg

SEQ ID NO: 3131587 - RNA, 15 nt, Mycobacterium bovis subsp bovis AF2122/97
agcgcgucggucacc

SEQ ID NO: 3131588 - RNA, 14 nt, Mycobacterium bovis subsp bovis AF2122/97
agcgcgucgucacg

SEQ ID NO: 3131589 - RNA, 24 nt, Mycobacterium bovis subsp bovis AF2122/97
agcgcgucgucacgaucgugccgg

SEQ ID NO: 3131590 - RNA, 22 nt, Mycobacterium bovis subsp bovis AF2122/97
agcgcgucguccagggcgacga

SEQ ID NO: 3131591 - RNA, 23 nt, Mycobacterium bovis subsp bovis AF2122/97
agcgcgugcugcagaucggccgg

SEQ ID NO: 3131592 - RNA, 18 nt, Mycobacterium bovis subsp bovis AF2122/97
agcgcgugcuguggaugc

SEQ ID NO: 3131593 - RNA, 15 nt, Mycobacterium bovis subsp bovis AF2122/97
agcgcguucggcacc

SEQ ID NO: 3131594 - RNA, 16 nt, Mycobacterium bovis subsp bovis AF2122/97
agcgcguucggcaccu

SEQ ID NO: 3131595 - RNA, 18 nt, Mycobacterium bovis subsp bovis AF2122/97
agcgcguucggcaccugg

SEQ ID NO: 3131596 - RNA, 13 nt, Mycobacterium bovis subsp bovis AF2122/97
agcgcuagccggg

SEQ ID NO: 3131597 - RNA, 18 nt, Mycobacterium bovis subsp bovis AF2122/97
agcgcuauaggccgcaug

SEQ ID NO: 3131598 - RNA, 22 nt, Mycobacterium bovis subsp bovis AF2122/97
agcgcucaaugaucgcggcggc

SEQ ID NO: 3131599 - RNA, 15 nt, Mycobacterium bovis subsp bovis AF2122/97
agcgcucaccggcgu

SEQ ID NO: 3131600 - RNA, 13 nt, Mycobacterium bovis subsp bovis AF2122/97
agcgcuccagcac

SEQ ID NO: 3131601 - RNA, 16 nt, Mycobacterium bovis subsp bovis AF2122/97
agcgcuccagccgcgc

SEQ ID NO: 3131602 - RNA, 17 nt, Mycobacterium bovis subsp bovis AF2122/97
agcgcucggcagccggc

SEQ ID NO: 3131603 - RNA, 16 nt, Mycobacterium bovis subsp bovis AF2122/97
agcgcucgugaccgaa

SEQ ID NO: 3131604 - RNA, 13 nt, Mycobacterium bovis subsp bovis AF2122/97
agcgcucguuccg

SEQ ID NO: 3131605 - RNA, 16 nt, Mycobacterium bovis subsp bovis AF2122/97
agcgcugagccgcuca

SEQ ID NO: 3131606 - RNA, 13 nt, Mycobacterium bovis subsp bovis AF2122/97
agcgcugccaccg

SEQ ID NO: 3131607 - RNA, 21 nt, Mycobacterium bovis subsp bovis AF2122/97
agcgcugccaccgcgguggcg

SEQ ID NO: 3131608 - RNA, 13 nt, Mycobacterium bovis subsp bovis AF2122/97
agcgcugcugccg

SEQ ID NO: 3131609 - RNA, 19 nt, Mycobacterium bovis subsp bovis AF2122/97
agcgcuggcaggccgggca

SEQ ID NO: 3131610 - RNA, 20 nt, Mycobacterium bovis subsp bovis AF2122/97
agcgcuggcaggccgggcac

SEQ ID NO: 3131611 - RNA, 16 nt, Mycobacterium bovis subsp bovis AF2122/97
agcgcuggcuacgccu

SEQ ID NO: 3131612 - RNA, 15 nt, Mycobacterium bovis subsp bovis AF2122/97
agcgcugggcccagg

SEQ ID NO: 3131613 - RNA, 21 nt, Mycobacterium bovis subsp bovis AF2122/97
agcgcugucguaccgcggauc

SEQ ID NO: 3131614 - RNA, 19 nt, Mycobacterium bovis subsp bovis AF2122/97
agcgcuucaaagaucgccu

SEQ ID NO: 3131615 - RNA, 18 nt, Mycobacterium bovis subsp bovis AF2122/97
agcgcuucggcggucgcc

SEQ ID NO: 3131616 - RNA, 19 nt, Mycobacterium bovis subsp bovis AF2122/97
agcgcuucggcggucgccg

SEQ ID NO: 3131617 - RNA, 22 nt, Mycobacterium bovis subsp bovis AF2122/97
agcgcuucggcggucgccgcgc

SEQ ID NO: 3131618 - RNA, 23 nt, Mycobacterium bovis subsp bovis AF2122/97
agcgcuucggcggucgccgcgcg

SEQ ID NO: 3131619 - RNA, 15 nt, Mycobacterium bovis subsp bovis AF2122/97
agcgcuucgucgccg

SEQ ID NO: 3131620 - RNA, 20 nt, Mycobacterium bovis subsp bovis AF2122/97
agcgcuugaccccgccgaac

SEQ ID NO: 3131621 - RNA, 22 nt, Mycobacterium bovis subsp bovis AF2122/97
agcgcuugaccccgccgaacgg

SEQ ID NO: 3131622 - RNA, 20 nt, Mycobacterium bovis subsp bovis AF2122/97
agcgcuugacccgcggaccg

SEQ ID NO: 3131623 - RNA, 23 nt, Mycobacterium bovis subsp bovis AF2122/97
agcgcuuggucaaaaagcucggc

SEQ ID NO: 3131624 - RNA, 22 nt, Mycobacterium bovis subsp bovis AF2122/97
agcggaaaacccagaucggcga

SEQ ID NO: 3131625 - RNA, 14 nt, Mycobacterium bovis subsp bovis AF2122/97
agcggaaaaucacc

SEQ ID NO: 3131626 - RNA, 16 nt, Mycobacterium bovis subsp bovis AF2122/97
agcggaauggcgccgg

SEQ ID NO: 3131627 - RNA, 23 nt, Mycobacterium bovis subsp bovis AF2122/97
agcggaauggcgccggccggcgc

SEQ ID NO: 3131628 - RNA, 18 nt, Mycobacterium bovis subsp bovis AF2122/97
agcggaccaccgcucgcc

SEQ ID NO: 3131629 - RNA, 19 nt, Mycobacterium bovis subsp bovis AF2122/97
agcggaccaccgcucgcca

SEQ ID NO: 3131630 - RNA, 12 nt, Mycobacterium bovis subsp bovis AF2122/97
agcggacccgac

SEQ ID NO: 3131631 - RNA, 21 nt, Mycobacterium bovis subsp bovis AF2122/97
agcggaccgagccgaucugcu

SEQ ID NO: 3131632 - RNA, 23 nt, Mycobacterium bovis subsp bovis AF2122/97
agcggaccgaugacgaucggcgg

SEQ ID NO: 3131633 - RNA, 12 nt, Mycobacterium bovis subsp bovis AF2122/97
agcggaccgcug

SEQ ID NO: 3131634 - RNA, 13 nt, Mycobacterium bovis subsp bovis AF2122/97
agcggaccugcga

SEQ ID NO: 3131635 - RNA, 15 nt, Mycobacterium bovis subsp bovis AF2122/97
agcggagacugguug

SEQ ID NO: 3131636 - RNA, 14 nt, Mycobacterium bovis subsp bovis AF2122/97
agcggagccgccga

SEQ ID NO: 3131637 - RNA, 23 nt, Mycobacterium bovis subsp bovis AF2122/97
agcggagccggcgcauaacacaa

SEQ ID NO: 3131638 - RNA, 14 nt, Mycobacterium bovis subsp bovis AF2122/97
agcggagcgcccuu

SEQ ID NO: 3131639 - RNA, 17 nt, Mycobacterium bovis subsp bovis AF2122/97
agcggaucaagcgcaca

SEQ ID NO: 3131640 - RNA, 12 nt, Mycobacterium bovis subsp bovis AF2122/97
agcggaucccgc

SEQ ID NO: 3131641 - RNA, 17 nt, Mycobacterium bovis subsp bovis AF2122/97
agcggaucgcggucagc

SEQ ID NO: 3131642 - RNA, 22 nt, Mycobacterium bovis subsp bovis AF2122/97
agcggaucgucguugucagcga

SEQ ID NO: 3131643 - RNA, 11 nt, Mycobacterium bovis subsp bovis AF2122/97
agcggaucugg

SEQ ID NO: 3131644 - RNA, 23 nt, Mycobacterium bovis subsp bovis AF2122/97
agcggaugggcugaggaacgccg

SEQ ID NO: 3131645 - RNA, 18 nt, Mycobacterium bovis subsp bovis AF2122/97
agcggauucacgcaccgg

SEQ ID NO: 3131646 - RNA, 17 nt, Mycobacterium bovis subsp bovis AF2122/97
agcggauucagcgucgc

SEQ ID NO: 3131647 - RNA, 19 nt, Mycobacterium bovis subsp bovis AF2122/97
agcggauucagcgucgcca

SEQ ID NO: 3131648 - RNA, 15 nt, Mycobacterium bovis subsp bovis AF2122/97
agcggcaaagccggg

SEQ ID NO: 3131649 - RNA, 23 nt, Mycobacterium bovis subsp bovis AF2122/97
agcggcaaggucaacgggaggug

SEQ ID NO: 3131650 - RNA, 14 nt, Mycobacterium bovis subsp bovis AF2122/97
agcggcaaucgggu

SEQ ID NO: 3131651 - RNA, 17 nt, Mycobacterium bovis subsp bovis AF2122/97
agcggcaaucgggucug

SEQ ID NO: 3131652 - RNA, 15 nt, Mycobacterium bovis subsp bovis AF2122/97
agcggcaauggccag

SEQ ID NO: 3131653 - RNA, 16 nt, Mycobacterium bovis subsp bovis AF2122/97
agcggcaauggccagc

SEQ ID NO: 3131654 - RNA, 18 nt, Mycobacterium bovis subsp bovis AF2122/97
agcggcaauggccagcac

SEQ ID NO: 3131655 - RNA, 19 nt, Mycobacterium bovis subsp bovis AF2122/97
agcggcaauggccagcacc

SEQ ID NO: 3131656 - RNA, 21 nt, Mycobacterium bovis subsp bovis AF2122/97
agcggcaauggccagcaccac

SEQ ID NO: 3131657 - RNA, 23 nt, Mycobacterium bovis subsp bovis AF2122/97
agcggcacacccaucaccgccag

SEQ ID NO: 3131658 - RNA, 23 nt, Mycobacterium bovis subsp bovis AF2122/97
agcggcacaucaugggcgcugcc

SEQ ID NO: 3131659 - RNA, 13 nt, Mycobacterium bovis subsp bovis AF2122/97
agcggcaccgcgc

SEQ ID NO: 3131660 - RNA, 20 nt, Mycobacterium bovis subsp bovis AF2122/97
agcggcugcugcgcggugcc

SEQ ID NO: 3131661 - RNA, 21 nt, Mycobacterium bovis subsp bovis AF2122/97
agcggcugcugcgcggugccg

SEQ ID NO: 3131662 - RNA, 17 nt, Mycobacterium bovis subsp bovis AF2122/97
agcggcuugcccaggcg

SEQ ID NO: 3131663 - RNA, 17 nt, Mycobacterium bovis subsp bovis AF2122/97
agcggcuuggccgggag

SEQ ID NO: 3131664 - RNA, 18 nt, Mycobacterium bovis subsp bovis AF2122/97
agcggcuugggauuuggg

SEQ ID NO: 3131665 - RNA, 16 nt, Mycobacterium bovis subsp bovis AF2122/97
agcgggaacacaccgc

SEQ ID NO: 3131666 - RNA, 18 nt, Mycobacterium bovis subsp bovis AF2122/97
agcgggaaggcucaccac

SEQ ID NO: 3131667 - RNA, 21 nt, Mycobacterium bovis subsp bovis AF2122/97
agcgggaaggguggaccgggg

SEQ ID NO: 3131668 - RNA, 16 nt, Mycobacterium bovis subsp bovis AF2122/97
agcgggacugcagcgc

SEQ ID NO: 3131669 - RNA, 22 nt, Mycobacterium bovis subsp bovis AF2122/97
agcgggacugcggaagccaccg

SEQ ID NO: 3131670 - RNA, 23 nt, Mycobacterium bovis subsp bovis AF2122/97
agcgggaggaugucgagcccguc

SEQ ID NO: 3131671 - RNA, 18 nt, Mycobacterium bovis subsp bovis AF2122/97
agcgggcaagaugaucgc

SEQ ID NO: 3131672 - RNA, 15 nt, Mycobacterium bovis subsp bovis AF2122/97
agcgggcaagucgcc

SEQ ID NO: 3131673 - RNA, 13 nt, Mycobacterium bovis subsp bovis AF2122/97
agcgggcaccgaa

SEQ ID NO: 3131674 - RNA, 17 nt, Mycobacterium bovis subsp bovis AF2122/97
agcgggcacgccgccga

SEQ ID NO: 3131675 - RNA, 21 nt, Mycobacterium bovis subsp bovis AF2122/97
agcgggcagcaggcgaugcgc

SEQ ID NO: 3131676 - RNA, 21 nt, Mycobacterium bovis subsp bovis AF2122/97
agcgggcauaacccgcaccgg

SEQ ID NO: 3131677 - RNA, 12 nt, Mycobacterium bovis subsp bovis AF2122/97
agcgggcaucgc

SEQ ID NO: 3131678 - RNA, 20 nt, Mycobacterium bovis subsp bovis AF2122/97
agcgggccacugagccacag

SEQ ID NO: 3131679 - RNA, 13 nt, Mycobacterium bovis subsp bovis AF2122/97
agcgggccagcac

SEQ ID NO: 3131680 - RNA, 17 nt, Mycobacterium bovis subsp bovis AF2122/97
agcgggccagcacccgc

SEQ ID NO: 3131681 - RNA, 18 nt, Mycobacterium bovis subsp bovis AF2122/97
agcgggccagcacccgcu

SEQ ID NO: 3131682 - RNA, 13 nt, Mycobacterium bovis subsp bovis AF2122/97
agcgggcccgcag

SEQ ID NO: 3131683 - RNA, 13 nt, Mycobacterium bovis subsp bovis AF2122/97
agcgggccgcccu

SEQ ID NO: 3131684 - RNA, 19 nt, Mycobacterium bovis subsp bovis AF2122/97
agcgggcgaugagcgcgau

SEQ ID NO: 3131685 - RNA, 22 nt, Mycobacterium bovis subsp bovis AF2122/97
agcgggcgaugagcgcgaucuc

SEQ ID NO: 3131686 - RNA, 17 nt, Mycobacterium bovis subsp bovis AF2122/97
agcgggcgaugccgaug

SEQ ID NO: 3131687 - RNA, 14 nt, Mycobacterium bovis subsp bovis AF2122/97
agcgggcgucgcgg

SEQ ID NO: 3131688 - RNA, 23 nt, Mycobacterium bovis subsp bovis AF2122/97
agcgggcgucgcgguagccuggc

SEQ ID NO: 3131689 - RNA, 16 nt, Mycobacterium bovis subsp bovis AF2122/97
agcgggcuccggcucg

SEQ ID NO: 3131690 - RNA, 12 nt, Mycobacterium bovis subsp bovis AF2122/97
agcgggcugcgc

SEQ ID NO: 3131691 - RNA, 19 nt, Mycobacterium bovis subsp bovis AF2122/97
agcggggauguccgcggcc

SEQ ID NO: 3131692 - RNA, 22 nt, Mycobacterium bovis subsp bovis AF2122/97
agcggggauguccgcggccacc

SEQ ID NO: 3131693 - RNA, 22 nt, Mycobacterium bovis subsp bovis AF2122/97
agcggggcuagucgggguggga

SEQ ID NO: 3131694 - RNA, 16 nt, Mycobacterium bovis subsp bovis AF2122/97
agcgggggcagcgcga

SEQ ID NO: 3131695 - RNA, 14 nt, Mycobacterium bovis subsp bovis AF2122/97
agcggggucuugac

SEQ ID NO: 3131696 - RNA, 16 nt, Mycobacterium bovis subsp bovis AF2122/97
agcggggucuugacgg

SEQ ID NO: 3131697 - RNA, 18 nt, Mycobacterium bovis subsp bovis AF2122/97
agcgggucagcucgaccu

SEQ ID NO: 3131698 - RNA, 18 nt, Mycobacterium bovis subsp bovis AF2122/97
agcggguccccaccgguu

SEQ ID NO: 3131699 - RNA, 20 nt, Mycobacterium bovis subsp bovis AF2122/97
agcggguccuucugccggga

SEQ ID NO: 3131700 - RNA, 16 nt, Mycobacterium bovis subsp bovis AF2122/97
agcgggucgccgggcc

SEQ ID NO: 3131701 - RNA, 13 nt, Mycobacterium bovis subsp bovis AF2122/97
agcgggucgcggg

SEQ ID NO: 3131702 - RNA, 20 nt, Mycobacterium bovis subsp bovis AF2122/97
agcgggugaaucgacaccgc

SEQ ID NO: 3131703 - RNA, 20 nt, Mycobacterium bovis subsp bovis AF2122/97
agcggguuguggcacccggc

SEQ ID NO: 3131704 - RNA, 17 nt, Mycobacterium bovis subsp bovis AF2122/97
agcggguuugccgggcg

SEQ ID NO: 3131705 - RNA, 20 nt, Mycobacterium bovis subsp bovis AF2122/97
agcgguaagcgcaucgagca

SEQ ID NO: 3131706 - RNA, 21 nt, Mycobacterium bovis subsp bovis AF2122/97
agcgguaaugccagcggcaca

SEQ ID NO: 3131707 - RNA, 22 nt, Mycobacterium bovis subsp bovis AF2122/97
agcgguaaugccagcggcacac

SEQ ID NO: 3131708 - RNA, 12 nt, Mycobacterium bovis subsp bovis AF2122/97
agcgguagccga

SEQ ID NO: 3131709 - RNA, 23 nt, Mycobacterium bovis subsp bovis AF2122/97
agcgguaucccccagccgcggcg

SEQ ID NO: 3131710 - RNA, 14 nt, Mycobacterium bovis subsp bovis AF2122/97
agcggucagccggc

SEQ ID NO: 3131711 - RNA, 16 nt, Mycobacterium bovis subsp bovis AF2122/97
agcggucagccggcca

SEQ ID NO: 3131712 - RNA, 14 nt, Mycobacterium bovis subsp bovis AF2122/97
agcgguccagccac

SEQ ID NO: 3131713 - RNA, 19 nt, Mycobacterium bovis subsp bovis AF2122/97
agcgguccagcgucgccgc

SEQ ID NO: 3131714 - RNA, 20 nt, Mycobacterium bovis subsp bovis AF2122/97
agcgguccggauugaagucg

SEQ ID NO: 3131715 - RNA, 16 nt, Mycobacterium bovis subsp bovis AF2122/97
agcggucggcgaccac

SEQ ID NO: 3131716 - RNA, 17 nt, Mycobacterium bovis subsp bovis AF2122/97
agcggucggucaccaug

SEQ ID NO: 3131717 - RNA, 21 nt, Mycobacterium bovis subsp bovis AF2122/97
agcggucuccccagagcuggu

SEQ ID NO: 3131718 - RNA, 19 nt, Mycobacterium bovis subsp bovis AF2122/97
agcggucugugcugcgcug

SEQ ID NO: 3131719 - RNA, 13 nt, Mycobacterium bovis subsp bovis AF2122/97
agcggugacccac

SEQ ID NO: 3131720 - RNA, 18 nt, Mycobacterium bovis subsp bovis AF2122/97
agcggugcagcccgccgg

SEQ ID NO: 3131721 - RNA, 17 nt, Mycobacterium bovis subsp bovis AF2122/97
agcggugccauuguaaa

SEQ ID NO: 3131722 - RNA, 13 nt, Mycobacterium bovis subsp bovis AF2122/97
agcggugccggcg

SEQ ID NO: 3131723 - RNA, 12 nt, Mycobacterium bovis subsp bovis AF2122/97
agcggugcuggu

SEQ ID NO: 3131724 - RNA, 15 nt, Mycobacterium bovis subsp bovis AF2122/97
agcgguggccuccca

SEQ ID NO: 3131725 - RNA, 23 nt, Mycobacterium bovis subsp bovis AF2122/97
agcgguggcgucgucggcgggcu

SEQ ID NO: 3131726 - RNA, 16 nt, Mycobacterium bovis subsp bovis AF2122/97
agcgguggucggcgcg

SEQ ID NO: 3131727 - RNA, 20 nt, Mycobacterium bovis subsp bovis AF2122/97
agcgguggucggcgcgccgu

SEQ ID NO: 3131728 - RNA, 17 nt, Mycobacterium bovis subsp bovis AF2122/97
agcgguguagccggcgc

SEQ ID NO: 3131729 - RNA, 15 nt, Mycobacterium bovis subsp bovis AF2122/97
agcggugugggauga

SEQ ID NO: 3131730 - RNA, 17 nt, Mycobacterium bovis subsp bovis AF2122/97
agcgguguugccggaga

SEQ ID NO: 3131731 - RNA, 19 nt, Mycobacterium bovis subsp bovis AF2122/97
agcgguguugccggagacg

SEQ ID NO: 3131732 - RNA, 20 nt, Mycobacterium bovis subsp bovis AF2122/97
agcgguuagaucacccgcag

SEQ ID NO: 3131733 - RNA, 22 nt, Mycobacterium bovis subsp bovis AF2122/97
agcgguuagaucacccgcagcc

SEQ ID NO: 3131734 - RNA, 20 nt, Mycobacterium bovis subsp bovis AF2122/97
agcgguuauguauccgcgcc

SEQ ID NO: 3131735 - RNA, 19 nt, Mycobacterium bovis subsp bovis AF2122/97
agcgguugacccacagcau

SEQ ID NO: 3131736 - RNA, 13 nt, Mycobacterium bovis subsp bovis AF2122/97
agcgguugccguc

SEQ ID NO: 3131737 - RNA, 16 nt, Mycobacterium bovis subsp bovis AF2122/97
agcgguugccuucuug

SEQ ID NO: 3131738 - RNA, 22 nt, Mycobacterium bovis subsp bovis AF2122/97
agcgguugccuucuuggcggga

SEQ ID NO: 3131739 - RNA, 22 nt, Mycobacterium bovis subsp bovis AF2122/97
agcgguuuccgcacgaucgccc

SEQ ID NO: 3131740 - RNA, 23 nt, Mycobacterium bovis subsp bovis AF2122/97
agcgguuucgaauguuucggcga

SEQ ID NO: 3131741 - RNA, 19 nt, Mycobacterium bovis subsp bovis AF2122/97
agcguaaugcugcugcagc

SEQ ID NO: 3131742 - RNA, 20 nt, Mycobacterium bovis subsp bovis AF2122/97
agcguaaugcugcugcagca

SEQ ID NO: 3131743 - RNA, 17 nt, Mycobacterium bovis subsp bovis AF2122/97
agcguaucggccggcag

SEQ ID NO: 3131744 - RNA, 18 nt, Mycobacterium bovis subsp bovis AF2122/97
agcguauuggacgcugcc

SEQ ID NO: 3131745 - RNA, 20 nt, Mycobacterium bovis subsp bovis AF2122/97
agcguauuggacgcugccgc

SEQ ID NO: 3131746 - RNA, 16 nt, Mycobacterium bovis subsp bovis AF2122/97
agcuagaccgaucacc

SEQ ID NO: 3131747 - RNA, 14 nt, Mycobacterium bovis subsp bovis AF2122/97
agcuagcccggcag

SEQ ID NO: 3131748 - RNA, 15 nt, Mycobacterium bovis subsp bovis AF2122/97
agcuagcccggcagc

SEQ ID NO: 3131749 - RNA, 22 nt, Mycobacterium bovis subsp bovis AF2122/97
agcuagcccggcagcacgugga

SEQ ID NO: 3131750 - RNA, 19 nt, Mycobacterium bovis subsp bovis AF2122/97
agcuagcgcccgcgagaga

SEQ ID NO: 3131751 - RNA, 17 nt, Mycobacterium bovis subsp bovis AF2122/97
agcuagcgcgggcucac

SEQ ID NO: 3131752 - RNA, 19 nt, Mycobacterium bovis subsp bovis AF2122/97
agcuaucccaggggcaccg

SEQ ID NO: 3131753 - RNA, 21 nt, Mycobacterium bovis subsp bovis AF2122/97
agcuaugucaccugggccagc

SEQ ID NO: 3131754 - RNA, 15 nt, Mycobacterium bovis subsp bovis AF2122/97
agcucaaccaccucg

SEQ ID NO: 3131755 - RNA, 16 nt, Mycobacterium bovis subsp bovis AF2122/97
agcucaaccaccucgc

SEQ ID NO: 3131756 - RNA, 22 nt, Mycobacterium bovis subsp bovis AF2122/97
agcucaauggcuucgaagcgau

SEQ ID NO: 3131757 - RNA, 16 nt, Mycobacterium bovis subsp bovis AF2122/97
agcucaccacaucggu

SEQ ID NO: 3131758 - RNA, 15 nt, Mycobacterium bovis subsp bovis AF2122/97
agcucaccacccgca

SEQ ID NO: 3131759 - RNA, 19 nt, Mycobacterium bovis subsp bovis AF2122/97
agcucacccggagcacccg

SEQ ID NO: 3131760 - RNA, 13 nt, Mycobacterium bovis subsp bovis AF2122/97
agcucaccgacgg

SEQ ID NO: 3131761 - RNA, 13 nt, Mycobacterium bovis subsp bovis AF2122/97
agcucaccgcaca

SEQ ID NO: 3131762 - RNA, 18 nt, Mycobacterium bovis subsp bovis AF2122/97
agcucaccuuccucgaaa

SEQ ID NO: 3131763 - RNA, 22 nt, Mycobacterium bovis subsp bovis AF2122/97
agcucacgugcugccgauagcg

SEQ ID NO: 3131764 - RNA, 19 nt, Mycobacterium bovis subsp bovis AF2122/97
agcucacuucacgccgccc

SEQ ID NO: 3131765 - RNA, 23 nt, Mycobacterium bovis subsp bovis AF2122/97
agcucacuucacgccgccccugc

SEQ ID NO: 3131766 - RNA, 14 nt, Mycobacterium bovis subsp bovis AF2122/97
agcucagcugcgga

SEQ ID NO: 3131767 - RNA, 18 nt, Mycobacterium bovis subsp bovis AF2122/97
agcucagugaugcgcccc

SEQ ID NO: 3131768 - RNA, 13 nt, Mycobacterium bovis subsp bovis AF2122/97
agcucaucaccgg

SEQ ID NO: 3131769 - RNA, 13 nt, Mycobacterium bovis subsp bovis AF2122/97
agcucaucgacga

SEQ ID NO: 3131770 - RNA, 14 nt, Mycobacterium bovis subsp bovis AF2122/97
agcucccacaggac

SEQ ID NO: 3131771 - RNA, 17 nt, Mycobacterium bovis subsp bovis AF2122/97
agcuccccgaccgaacc

SEQ ID NO: 3131772 - RNA, 17 nt, Mycobacterium bovis subsp bovis AF2122/97
agcucccgccacgucgc

SEQ ID NO: 3131773 - RNA, 17 nt, Mycobacterium bovis subsp bovis AF2122/97
agcucccugggcgucga

SEQ ID NO: 3131774 - RNA, 19 nt, Mycobacterium bovis subsp bovis AF2122/97
agcucccugggcgucgacc

SEQ ID NO: 3131775 - RNA, 20 nt, Mycobacterium bovis subsp bovis AF2122/97
agcucccugggcgucgacca

SEQ ID NO: 3131776 - RNA, 13 nt, Mycobacterium bovis subsp bovis AF2122/97
agcuccgccgccg

SEQ ID NO: 3131777 - RNA, 22 nt, Mycobacterium bovis subsp bovis AF2122/97
agcuccgccgccgacggaucgc

SEQ ID NO: 3131778 - RNA, 16 nt, Mycobacterium bovis subsp bovis AF2122/97
agcuccgccugccgcu

SEQ ID NO: 3131779 - RNA, 21 nt, Mycobacterium bovis subsp bovis AF2122/97
agcuccgggucgacgacgucg

SEQ ID NO: 3131780 - RNA, 24 nt, Mycobacterium bovis subsp bovis AF2122/97
agcuccgggugcagaucgccccag

SEQ ID NO: 3131781 - RNA, 12 nt, Mycobacterium bovis subsp bovis AF2122/97
agcuccgucgcg

SEQ ID NO: 3131782 - RNA, 14 nt, Mycobacterium bovis subsp bovis AF2122/97
agcuccgucgcggc

SEQ ID NO: 3131783 - RNA, 15 nt, Mycobacterium bovis subsp bovis AF2122/97
agcuccgucgcggcc

SEQ ID NO: 3131784 - RNA, 23 nt, Mycobacterium bovis subsp bovis AF2122/97
agcuccguggugcuagcgccgcc

SEQ ID NO: 3131785 - RNA, 22 nt, Mycobacterium bovis subsp bovis AF2122/97
agcuccgugucggacaaggacu

SEQ ID NO: 3131786 - RNA, 22 nt, Mycobacterium bovis subsp bovis AF2122/97
agcuccuauggcaagcggccgc

SEQ ID NO: 3131787 - RNA, 13 nt, Mycobacterium bovis subsp bovis AF2122/97
agcuccucagcca

SEQ ID NO: 3131788 - RNA, 17 nt, Mycobacterium bovis subsp bovis AF2122/97
agcuccucagccaccgc

SEQ ID NO: 3131789 - RNA, 14 nt, Mycobacterium bovis subsp bovis AF2122/97
agcuccucgcccag

SEQ ID NO: 3131790 - RNA, 20 nt, Mycobacterium bovis subsp bovis AF2122/97
agcuccucgcgcucgccggu

SEQ ID NO: 3131791 - RNA, 16 nt, Mycobacterium bovis subsp bovis AF2122/97
agcuccugcaugccgg

SEQ ID NO: 3131792 - RNA, 14 nt, Mycobacterium bovis subsp bovis AF2122/97
agcucgaagcccgg

SEQ ID NO: 3131793 - RNA, 17 nt, Mycobacterium bovis subsp bovis AF2122/97
agcucgaagcccggaca

SEQ ID NO: 3131794 - RNA, 12 nt, Mycobacterium bovis subsp bovis AF2122/97
agcucgaaguug

SEQ ID NO: 3131795 - RNA, 14 nt, Mycobacterium bovis subsp bovis AF2122/97
agcucgaccgcccg

SEQ ID NO: 3131796 - RNA, 20 nt, Mycobacterium bovis subsp bovis AF2122/97
agcucgaccugaggcaccuc

SEQ ID NO: 3131797 - RNA, 16 nt, Mycobacterium bovis subsp bovis AF2122/97
agcucgagcgccucgg

SEQ ID NO: 3131798 - RNA, 15 nt, Mycobacterium bovis subsp bovis AF2122/97
agcucgaggaccacc

SEQ ID NO: 3131799 - RNA, 19 nt, Mycobacterium bovis subsp bovis AF2122/97
agcucgaggaccaccuggu

SEQ ID NO: 3131800 - RNA, 24 nt, Mycobacterium bovis subsp bovis AF2122/97
agcucgaggcccgggugcuacugg

SEQ ID NO: 3131801 - RNA, 14 nt, Mycobacterium bovis subsp bovis AF2122/97
agcucgauccgcag

SEQ ID NO: 3131802 - RNA, 17 nt, Mycobacterium bovis subsp bovis AF2122/97
agcucgcaaccgagaug

SEQ ID NO: 3131803 - RNA, 18 nt, Mycobacterium bovis subsp bovis AF2122/97
agcucgcacucguugccg

SEQ ID NO: 3131804 - RNA, 12 nt, Mycobacterium bovis subsp bovis AF2122/97
agcucgccggca

SEQ ID NO: 3131805 - RNA, 22 nt, Mycobacterium bovis subsp bovis AF2122/97
agcucgcgcacccagcccagcc

SEQ ID NO: 3131806 - RNA, 16 nt, Mycobacterium bovis subsp bovis AF2122/97
agcucgcgcacgucga

SEQ ID NO: 3131807 - RNA, 22 nt, Mycobacterium bovis subsp bovis AF2122/97
agcucgcgcucgcucacgccgu

SEQ ID NO: 3131808 - RNA, 15 nt, Mycobacterium bovis subsp bovis AF2122/97
agcucgcggcgcagg

SEQ ID NO: 3131809 - RNA, 19 nt, Mycobacterium bovis subsp bovis AF2122/97
agcucgcgggccgcgucga

SEQ ID NO: 3131810 - RNA, 23 nt, Mycobacterium bovis subsp bovis AF2122/97
agcucgcgguagucguugccgau

SEQ ID NO: 3131811 - RNA, 23 nt, Mycobacterium bovis subsp bovis AF2122/97
agcucgcgguuuuggucgcgaug

SEQ ID NO: 3131812 - RNA, 15 nt, Mycobacterium bovis subsp bovis AF2122/97
agcucgcugacggca

SEQ ID NO: 3131813 - RNA, 20 nt, Mycobacterium bovis subsp bovis AF2122/97
agcucgcugauaguggcgcg

SEQ ID NO: 3131814 - RNA, 12 nt, Mycobacterium bovis subsp bovis AF2122/97
agcucggccacc

SEQ ID NO: 3131815 - RNA, 16 nt, Mycobacterium bovis subsp bovis AF2122/97
agcucggccaccagcg

SEQ ID NO: 3131816 - RNA, 15 nt, Mycobacterium bovis subsp bovis AF2122/97
agcucggccagcacg

SEQ ID NO: 3131817 - RNA, 19 nt, Mycobacterium bovis subsp bovis AF2122/97
agcucggccagcacgccgc

SEQ ID NO: 3131818 - RNA, 21 nt, Mycobacterium bovis subsp bovis AF2122/97
agcucggccagcacgccgccg

SEQ ID NO: 3131819 - RNA, 12 nt, Mycobacterium bovis subsp bovis AF2122/97
agcucggccagg

SEQ ID NO: 3131820 - RNA, 17 nt, Mycobacterium bovis subsp bovis AF2122/97
agcucggccagugccgg

SEQ ID NO: 3131821 - RNA, 21 nt, Mycobacterium bovis subsp bovis AF2122/97
agcucggcccagcgcgccagc

SEQ ID NO: 3131822 - RNA, 15 nt, Mycobacterium bovis subsp bovis AF2122/97
agcucggccgaggcg

SEQ ID NO: 3131823 - RNA, 16 nt, Mycobacterium bovis subsp bovis AF2122/97
agcucggcgcccagcu

SEQ ID NO: 3131824 - RNA, 17 nt, Mycobacterium bovis subsp bovis AF2122/97
agcucggcgcccagcuc

SEQ ID NO: 3131825 - RNA, 19 nt, Mycobacterium bovis subsp bovis AF2122/97
agcucggcgcccagcucgu

SEQ ID NO: 3131826 - RNA, 20 nt, Mycobacterium bovis subsp bovis AF2122/97
agcucggcgcccagcucguc

SEQ ID NO: 3131827 - RNA, 17 nt, Mycobacterium bovis subsp bovis AF2122/97
agcucggcggcagcggc

SEQ ID NO: 3131828 - RNA, 18 nt, Mycobacterium bovis subsp bovis AF2122/97
agcucggcggcagcggcg

SEQ ID NO: 3131829 - RNA, 15 nt, Mycobacterium bovis subsp bovis AF2122/97
agcucggcggcuacc

SEQ ID NO: 3131830 - RNA, 14 nt, Mycobacterium bovis subsp bovis AF2122/97
agcucggcugcucg

SEQ ID NO: 3131831 - RNA, 13 nt, Mycobacterium bovis subsp bovis AF2122/97
agcucgggcaggg

SEQ ID NO: 3131832 - RNA, 24 nt, Mycobacterium bovis subsp bovis AF2122/97
agcucgggcagggaccgcaucggu

SEQ ID NO: 3131833 - RNA, 13 nt, Mycobacterium bovis subsp bovis AF2122/97
agcuggcggcagc

SEQ ID NO: 3131834 - RNA, 18 nt, Mycobacterium bovis subsp bovis AF2122/97
agcuggcgguugcccgag

SEQ ID NO: 3131835 - RNA, 16 nt, Mycobacterium bovis subsp bovis AF2122/97
agcuggcgugcagcag

SEQ ID NO: 3131836 - RNA, 17 nt, Mycobacterium bovis subsp bovis AF2122/97
agcuggcguucccgcuc

SEQ ID NO: 3131837 - RNA, 15 nt, Mycobacterium bovis subsp bovis AF2122/97
agcuggcuacgggcc

SEQ ID NO: 3131838 - RNA, 13 nt, Mycobacterium bovis subsp bovis AF2122/97
agcugggcagcca

SEQ ID NO: 3131839 - RNA, 20 nt, Mycobacterium bovis subsp bovis AF2122/97
agcugggcaucaccgccgcg

SEQ ID NO: 3131840 - RNA, 23 nt, Mycobacterium bovis subsp bovis AF2122/97
agcugggcaucaccgccgcggcc

SEQ ID NO: 3131841 - RNA, 18 nt, Mycobacterium bovis subsp bovis AF2122/97
agcuggggaacagcagcg

SEQ ID NO: 3131842 - RNA, 22 nt, Mycobacterium bovis subsp bovis AF2122/97
agcuggggcggauaugaugauc

SEQ ID NO: 3131843 - RNA, 17 nt, Mycobacterium bovis subsp bovis AF2122/97
agcugggucaugccgua

SEQ ID NO: 3131844 - RNA, 17 nt, Mycobacterium bovis subsp bovis AF2122/97
agcugggucccgcuggc

SEQ ID NO: 3131845 - RNA, 19 nt, Mycobacterium bovis subsp bovis AF2122/97
agcugggugaccucgucga

SEQ ID NO: 3131846 - RNA, 17 nt, Mycobacterium bovis subsp bovis AF2122/97
agcugguagcgcaccac

SEQ ID NO: 3131847 - RNA, 21 nt, Mycobacterium bovis subsp bovis AF2122/97
agcugguaggucaccggucac

SEQ ID NO: 3131848 - RNA, 12 nt, Mycobacterium bovis subsp bovis AF2122/97
agcuggucccac

SEQ ID NO: 3131849 - RNA, 23 nt, Mycobacterium bovis subsp bovis AF2122/97
agcuggucccacaccuccucgag

SEQ ID NO: 3131850 - RNA, 15 nt, Mycobacterium bovis subsp bovis AF2122/97
agcuggucggugggc

SEQ ID NO: 3131851 - RNA, 15 nt, Mycobacterium bovis subsp bovis AF2122/97
agcuggugagccaga

SEQ ID NO: 3131852 - RNA, 20 nt, Mycobacterium bovis subsp bovis AF2122/97
agcuggugcguagcccaccc

SEQ ID NO: 3131853 - RNA, 18 nt, Mycobacterium bovis subsp bovis AF2122/97
agcuguagaccuggccgu

SEQ ID NO: 3131854 - RNA, 22 nt, Mycobacterium bovis subsp bovis AF2122/97
agcuguaggcgaccagauagaa

SEQ ID NO: 3131855 - RNA, 20 nt, Mycobacterium bovis subsp bovis AF2122/97
agcugucauccccggccagc

SEQ ID NO: 3131856 - RNA, 22 nt, Mycobacterium bovis subsp bovis AF2122/97
agcugucauccccggccagccu

SEQ ID NO: 3131857 - RNA, 16 nt, Mycobacterium bovis subsp bovis AF2122/97
agcuguccucgcgggc

SEQ ID NO: 3131858 - RNA, 18 nt, Mycobacterium bovis subsp bovis AF2122/97
agcuguccucgcgggcuu

SEQ ID NO: 3131859 - RNA, 20 nt, Mycobacterium bovis subsp bovis AF2122/97
agcugucgcaacgcaucgau

SEQ ID NO: 3131860 - RNA, 22 nt, Mycobacterium bovis subsp bovis AF2122/97
agcugucggcgaccgagacggc

SEQ ID NO: 3131861 - RNA, 21 nt, Mycobacterium bovis subsp bovis AF2122/97
agcuguugaccguguggccgu

SEQ ID NO: 3131862 - RNA, 21 nt, Mycobacterium bovis subsp bovis AF2122/97
agcuguugacuaccaccgcgu

SEQ ID NO: 3131863 - RNA, 14 nt, Mycobacterium bovis subsp bovis AF2122/97
agcuguugcggggu

SEQ ID NO: 3131864 - RNA, 22 nt, Mycobacterium bovis subsp bovis AF2122/97
agcuguuggcguggaucuuggc

SEQ ID NO: 3131865 - RNA, 23 nt, Mycobacterium bovis subsp bovis AF2122/97
agcuguugguuuuguaguccgca

SEQ ID NO: 3131866 - RNA, 15 nt, Mycobacterium bovis subsp bovis AF2122/97
agcuguugucgcgga

SEQ ID NO: 3131867 - RNA, 22 nt, Mycobacterium bovis subsp bovis AF2122/97
agcuguuuggggucgcgcugcc

SEQ ID NO: 3131868 - RNA, 15 nt, Mycobacterium bovis subsp bovis AF2122/97
agcuucaacaccggc

SEQ ID NO: 3131869 - RNA, 16 nt, Mycobacterium bovis subsp bovis AF2122/97
agcuuccaaacccggu

SEQ ID NO: 3131870 - RNA, 15 nt, Mycobacterium bovis subsp bovis AF2122/97
agcuuccgguccagc

SEQ ID NO: 3131871 - RNA, 18 nt, Mycobacterium bovis subsp bovis AF2122/97
agcuuccgguccagcggc

SEQ ID NO: 3131872 - RNA, 21 nt, Mycobacterium bovis subsp bovis AF2122/97
agcuuccgguccagcggccgc

SEQ ID NO: 3131873 - RNA, 12 nt, Mycobacterium bovis subsp bovis AF2122/97
agcuucgccagg

SEQ ID NO: 3131874 - RNA, 15 nt, Mycobacterium bovis subsp bovis AF2122/97
agcuucgcuugccga

SEQ ID NO: 3131875 - RNA, 19 nt, Mycobacterium bovis subsp bovis AF2122/97
agcuucucgucggugcgcg

SEQ ID NO: 3131876 - RNA, 15 nt, Mycobacterium bovis subsp bovis AF2122/97
agcuugacccacgag

SEQ ID NO: 3131877 - RNA, 17 nt, Mycobacterium bovis subsp bovis AF2122/97
agcuugaccgaccacgc

SEQ ID NO: 3131878 - RNA, 19 nt, Mycobacterium bovis subsp bovis AF2122/97
agcuugaccgaccacgcga

SEQ ID NO: 3131879 - RNA, 19 nt, Mycobacterium bovis subsp bovis AF2122/97
agcuugacguugccgggcu

SEQ ID NO: 3131880 - RNA, 19 nt, Mycobacterium bovis subsp bovis AF2122/97
agcuugagcacacguccgg

SEQ ID NO: 3131881 - RNA, 21 nt, Mycobacterium bovis subsp bovis AF2122/97
agcuugagcgugagcgccgcg

SEQ ID NO: 3131882 - RNA, 17 nt, Mycobacterium bovis subsp bovis AF2122/97
agcuugcccgacggcgu

SEQ ID NO: 3131883 - RNA, 17 nt, Mycobacterium bovis subsp bovis AF2122/97
agcuugcccgagcccag

SEQ ID NO: 3131884 - RNA, 15 nt, Mycobacterium bovis subsp bovis AF2122/97
agcuuggacaccagu

SEQ ID NO: 3131885 - RNA, 14 nt, Mycobacterium bovis subsp bovis AF2122/97
agcuuggagaggcg

SEQ ID NO: 3131886 - RNA, 19 nt, Mycobacterium bovis subsp bovis AF2122/97
agcuuggagaggcggugca

SEQ ID NO: 3131887 - RNA, 22 nt, Mycobacterium bovis subsp bovis AF2122/97
agcuuggagaggcggugcagcu

SEQ ID NO: 3131888 - RNA, 12 nt, Mycobacterium bovis subsp bovis AF2122/97
agcuuggccagc

SEQ ID NO: 3131889 - RNA, 14 nt, Mycobacterium bovis subsp bovis AF2122/97
agcuuggccagcca

SEQ ID NO: 3131890 - RNA, 14 nt, Mycobacterium bovis subsp bovis AF2122/97
agcuuggccgccgc

SEQ ID NO: 3131891 - RNA, 18 nt, Mycobacterium bovis subsp bovis AF2122/97
agcuuggccucagccacc

SEQ ID NO: 3131892 - RNA, 23 nt, Mycobacterium bovis subsp bovis AF2122/97
agcuuggcggccagcguguccca

SEQ ID NO: 3131893 - RNA, 23 nt, Mycobacterium bovis subsp bovis AF2122/97
agcuuggucgccaugucggccag

SEQ ID NO: 3131894 - RNA, 17 nt, Mycobacterium bovis subsp bovis AF2122/97
agcuuggucgccgggca

SEQ ID NO: 3131895 - RNA, 21 nt, Mycobacterium bovis subsp bovis AF2122/97
agcuuguccagauaucgaagc

SEQ ID NO: 3131896 - RNA, 13 nt, Mycobacterium bovis subsp bovis AF2122/97
agcuuguugcagc

SEQ ID NO: 3131897 - RNA, 14 nt, Mycobacterium bovis subsp bovis AF2122/97
agcuuguugcagcg

SEQ ID NO: 3131898 - RNA, 13 nt, Mycobacterium bovis subsp bovis AF2122/97
agcuuguuuucca

SEQ ID NO: 3131899 - RNA, 13 nt, Mycobacterium bovis subsp bovis AF2122/97
agcuuuaucggcc

SEQ ID NO: 3131900 - RNA, 15 nt, Mycobacterium bovis subsp bovis AF2122/97
agcuuucccguugcu

SEQ ID NO: 3131901 - RNA, 22 nt, Mycobacterium bovis subsp bovis AF2122/97
agcuuucgcgucacccggggcu

SEQ ID NO: 3131902 - RNA, 21 nt, Mycobacterium bovis subsp bovis AF2122/97
agcuuucuuggcgggcgccuu

SEQ ID NO: 3131903 - RNA, 20 nt, Mycobacterium bovis subsp bovis AF2122/97
aggaaacgagcgaaggugaa

SEQ ID NO: 3131904 - RNA, 19 nt, Mycobacterium bovis subsp bovis AF2122/97
aggaaagucaccguccacg

SEQ ID NO: 3131905 - RNA, 15 nt, Mycobacterium bovis subsp bovis AF2122/97
aggaaccacccaccg

SEQ ID NO: 3131906 - RNA, 22 nt, Mycobacterium bovis subsp bovis AF2122/97
aggaaccacccaccggccacca

SEQ ID NO: 3131907 - RNA, 16 nt, Mycobacterium bovis subsp bovis AF2122/97
aggaaccccgcgcggu

SEQ ID NO: 3131908 - RNA, 19 nt, Mycobacterium bovis subsp bovis AF2122/97
aggaacccgaacaacgccg

SEQ ID NO: 3131909 - RNA, 13 nt, Mycobacterium bovis subsp bovis AF2122/97
aggaacccgugga

SEQ ID NO: 3131910 - RNA, 17 nt, Mycobacterium bovis subsp bovis AF2122/97
aggaacccuccggaccc

SEQ ID NO: 3131911 - RNA, 18 nt, Mycobacterium bovis subsp bovis AF2122/97
aggaacccuccggaccca

SEQ ID NO: 3131912 - RNA, 14 nt, Mycobacterium bovis subsp bovis AF2122/97
aggaaccgggcaaa

SEQ ID NO: 3131913 - RNA, 22 nt, Mycobacterium bovis subsp bovis AF2122/97
aggaaccgggcaaaucaagcac

SEQ ID NO: 3131914 - RNA, 23 nt, Mycobacterium bovis subsp bovis AF2122/97
aggaaccgggcaaaucaagcaca

SEQ ID NO: 3131915 - RNA, 22 nt, Mycobacterium bovis subsp bovis AF2122/97
aggaaccgucgaagaugaccug

SEQ ID NO: 3131916 - RNA, 14 nt, Mycobacterium bovis subsp bovis AF2122/97
aggaacgccggcau

SEQ ID NO: 3131917 - RNA, 17 nt, Mycobacterium bovis subsp bovis AF2122/97
aggaacggcucggccgg

SEQ ID NO: 3131918 - RNA, 19 nt, Mycobacterium bovis subsp bovis AF2122/97
aggaacuacccgccagcaa

SEQ ID NO: 3131919 - RNA, 13 nt, Mycobacterium bovis subsp bovis AF2122/97
aggaucgcggcgc

SEQ ID NO: 3131920 - RNA, 15 nt, Mycobacterium bovis subsp bovis AF2122/97
aggaucgcggcgccg

SEQ ID NO: 3131921 - RNA, 17 nt, Mycobacterium bovis subsp bovis AF2122/97
aggaucgcguccgccuc

SEQ ID NO: 3131922 - RNA, 23 nt, Mycobacterium bovis subsp bovis AF2122/97
aggaucgcguggcgcaccaccgc

SEQ ID NO: 3131923 - RNA, 17 nt, Mycobacterium bovis subsp bovis AF2122/97
aggaucggauggcggcc

SEQ ID NO: 3131924 - RNA, 14 nt, Mycobacterium bovis subsp bovis AF2122/97
aggaucggcagcag

SEQ ID NO: 3131925 - RNA, 19 nt, Mycobacterium bovis subsp bovis AF2122/97
aggaucgguuucugcggcc

SEQ ID NO: 3131926 - RNA, 21 nt, Mycobacterium bovis subsp bovis AF2122/97
aggaucgguuucugcggcccc

SEQ ID NO: 3131927 - RNA, 15 nt, Mycobacterium bovis subsp bovis AF2122/97
aggaucucgcggucc

SEQ ID NO: 3131928 - RNA, 19 nt, Mycobacterium bovis subsp bovis AF2122/97
aggaucucggcgugcuggu

SEQ ID NO: 3131929 - RNA, 19 nt, Mycobacterium bovis subsp bovis AF2122/97
aggaucuguuugggcaucu

SEQ ID NO: 3131930 - RNA, 18 nt, Mycobacterium bovis subsp bovis AF2122/97
aggaugcaucgcaacgag

SEQ ID NO: 3131931 - RNA, 13 nt, Mycobacterium bovis subsp bovis AF2122/97
aggaugcggcccc

SEQ ID NO: 3131932 - RNA, 16 nt, Mycobacterium bovis subsp bovis AF2122/97
aggauggucagcagcu

SEQ ID NO: 3131933 - RNA, 23 nt, Mycobacterium bovis subsp bovis AF2122/97
aggauguaguuggugaugccgau

SEQ ID NO: 3131934 - RNA, 12 nt, Mycobacterium bovis subsp bovis AF2122/97
aggaugucgaug

SEQ ID NO: 3131935 - RNA, 20 nt, Mycobacterium bovis subsp bovis AF2122/97
aggaugugguuggugcuggc

SEQ ID NO: 3131936 - RNA, 23 nt, Mycobacterium bovis subsp bovis AF2122/97
aggauucagccgguggucugcgc

SEQ ID NO: 3131937 - RNA, 23 nt, Mycobacterium bovis subsp bovis AF2122/97
aggauucgcgcgaauguccggca

SEQ ID NO: 3131938 - RNA, 16 nt, Mycobacterium bovis subsp bovis AF2122/97
aggauucggcggucgc

SEQ ID NO: 3131939 - RNA, 13 nt, Mycobacterium bovis subsp bovis AF2122/97
aggauugccgagc

SEQ ID NO: 3131940 - RNA, 22 nt, Mycobacterium bovis subsp bovis AF2122/97
aggauuuucucggggugguggu

SEQ ID NO: 3131941 - RNA, 23 nt, Mycobacterium bovis subsp bovis AF2122/97
aggcaacccagaaguagguuuuc

SEQ ID NO: 3131942 - RNA, 15 nt, Mycobacterium bovis subsp bovis AF2122/97
aggcaagcaaccggu

SEQ ID NO: 3131943 - RNA, 15 nt, Mycobacterium bovis subsp bovis AF2122/97
aggcaagccagcacu

SEQ ID NO: 3131944 - RNA, 19 nt, Mycobacterium bovis subsp bovis AF2122/97
aggcaaggucaacccgcac

SEQ ID NO: 3131945 - RNA, 17 nt, Mycobacterium bovis subsp bovis AF2122/97
aggcaauggcgugcggu

SEQ ID NO: 3131946 - RNA, 17 nt, Mycobacterium bovis subsp bovis AF2122/97
aggcacaacaucgccgc

SEQ ID NO: 3131947 - RNA, 18 nt, Mycobacterium bovis subsp bovis AF2122/97
aggcacaaucaccgccgc

SEQ ID NO: 3131948 - RNA, 16 nt, Mycobacterium bovis subsp bovis AF2122/97
aggcacccuguacgaa

SEQ ID NO: 3131949 - RNA, 17 nt, Mycobacterium bovis subsp bovis AF2122/97
aggcaccgaaaaacacc

SEQ ID NO: 3131950 - RNA, 19 nt, Mycobacterium bovis subsp bovis AF2122/97
aggcaccgaaaaacaccag

SEQ ID NO: 3131951 - RNA, 22 nt, Mycobacterium bovis subsp bovis AF2122/97
aggcaccgaaaaacaccagcga

SEQ ID NO: 3131952 - RNA, 13 nt, Mycobacterium bovis subsp bovis AF2122/97
aggcaccgacauc

SEQ ID NO: 3131953 - RNA, 21 nt, Mycobacterium bovis subsp bovis AF2122/97
aggcaccgaucggugccggcc

SEQ ID NO: 3131954 - RNA, 22 nt, Mycobacterium bovis subsp bovis AF2122/97
aggcaccgaucggugccggccu

SEQ ID NO: 3131955 - RNA, 13 nt, Mycobacterium bovis subsp bovis AF2122/97
aggcacguucagc

SEQ ID NO: 3131956 - RNA, 19 nt, Mycobacterium bovis subsp bovis AF2122/97
aggcacguucagccaggcg

SEQ ID NO: 3131957 - RNA, 20 nt, Mycobacterium bovis subsp bovis AF2122/97
aggcacguucagccaggcgu

SEQ ID NO: 3131958 - RNA, 22 nt, Mycobacterium bovis subsp bovis AF2122/97
aggcacguucagccaggcgugc

SEQ ID NO: 3131959 - RNA, 22 nt, Mycobacterium bovis subsp bovis AF2122/97
aggcacucccggaguggccagu

SEQ ID NO: 3131960 - RNA, 15 nt, Mycobacterium bovis subsp bovis AF2122/97
aggcacugcgaucgc

SEQ ID NO: 3131961 - RNA, 18 nt, Mycobacterium bovis subsp bovis AF2122/97
aggcagcuccgccgccga

SEQ ID NO: 3131962 - RNA, 16 nt, Mycobacterium bovis subsp bovis AF2122/97
aggcaguccaccgcgc

SEQ ID NO: 3131963 - RNA, 17 nt, Mycobacterium bovis subsp bovis AF2122/97
aggcaguccaccgcgcg

SEQ ID NO: 3131964 - RNA, 11 nt, Mycobacterium bovis subsp bovis AF2122/97
aggcagugagg

SEQ ID NO: 3131965 - RNA, 14 nt, Mycobacterium bovis subsp bovis AF2122/97
aggcaucguccacg

SEQ ID NO: 3131966 - RNA, 14 nt, Mycobacterium bovis subsp bovis AF2122/97
aggcaugccacaca

SEQ ID NO: 3131967 - RNA, 23 nt, Mycobacterium bovis subsp bovis AF2122/97
aggcaugccacacacugccggac

SEQ ID NO: 3131968 - RNA, 17 nt, Mycobacterium bovis subsp bovis AF2122/97
aggcauucccgcggcaa

SEQ ID NO: 3131969 - RNA, 20 nt, Mycobacterium bovis subsp bovis AF2122/97
aggcauucccgcggcaacgc

SEQ ID NO: 3131970 - RNA, 15 nt, Mycobacterium bovis subsp bovis AF2122/97
aggcauucucccggu

SEQ ID NO: 3131971 - RNA, 13 nt, Mycobacterium bovis subsp bovis AF2122/97
aggccaacggcgc

SEQ ID NO: 3131972 - RNA, 14 nt, Mycobacterium bovis subsp bovis AF2122/97
aggccaacggcgcu

SEQ ID NO: 3131973 - RNA, 13 nt, Mycobacterium bovis subsp bovis AF2122/97
aggccaacugggc

SEQ ID NO: 3131974 - RNA, 18 nt, Mycobacterium bovis subsp bovis AF2122/97
aggccaacuuggcggcca

SEQ ID NO: 3131975 - RNA, 20 nt, Mycobacterium bovis subsp bovis AF2122/97
aggccaacuuggcggccagc

SEQ ID NO: 3131976 - RNA, 21 nt, Mycobacterium bovis subsp bovis AF2122/97
aggccaacuuggcggccagcc

SEQ ID NO: 3131977 - RNA, 17 nt, Mycobacterium bovis subsp bovis AF2122/97
aggccaagauggcgcgc

SEQ ID NO: 3131978 - RNA, 22 nt, Mycobacterium bovis subsp bovis AF2122/97
aggccaagccgcggcuaggcca

SEQ ID NO: 3131979 - RNA, 18 nt, Mycobacterium bovis subsp bovis AF2122/97
aggccaagguggccacca

SEQ ID NO: 3131980 - RNA, 15 nt, Mycobacterium bovis subsp bovis AF2122/97
aggccacagcccggc

SEQ ID NO: 3131981 - RNA, 18 nt, Mycobacterium bovis subsp bovis AF2122/97
aggccacagcccggcgau

SEQ ID NO: 3131982 - RNA, 19 nt, Mycobacterium bovis subsp bovis AF2122/97
aggccaccacugcgcccgc

SEQ ID NO: 3131983 - RNA, 20 nt, Mycobacterium bovis subsp bovis AF2122/97
aggccaccacugcgcccgcc

SEQ ID NO: 3131984 - RNA, 21 nt, Mycobacterium bovis subsp bovis AF2122/97
aggccacccgcgaagccgcca

SEQ ID NO: 3131985 - RNA, 17 nt, Mycobacterium bovis subsp bovis AF2122/97
aggccaccgcagacgcc

SEQ ID NO: 3131986 - RNA, 23 nt, Mycobacterium bovis subsp bovis AF2122/97
aggccaccggcggugccgguggu

SEQ ID NO: 3131987 - RNA, 21 nt, Mycobacterium bovis subsp bovis AF2122/97
aggccaccuccgaggccgcca

SEQ ID NO: 3131988 - RNA, 21 nt, Mycobacterium bovis subsp bovis AF2122/97
aggccacgcaccgggugcagg

SEQ ID NO: 3131989 - RNA, 13 nt, Mycobacterium bovis subsp bovis AF2122/97
aggccacggggau

SEQ ID NO: 3131990 - RNA, 18 nt, Mycobacterium bovis subsp bovis AF2122/97
aggccacguagcagcgcc

SEQ ID NO: 3131991 - RNA, 22 nt, Mycobacterium bovis subsp bovis AF2122/97
aggccacguagcagcgccggca

SEQ ID NO: 3131992 - RNA, 21 nt, Mycobacterium bovis subsp bovis AF2122/97
aggccagagucgcccgcacac

SEQ ID NO: 3131993 - RNA, 21 nt, Mycobacterium bovis subsp bovis AF2122/97
aggccagaguuugcgaugccc

SEQ ID NO: 3131994 - RNA, 18 nt, Mycobacterium bovis subsp bovis AF2122/97
aggccagcacggcgacga

SEQ ID NO: 3131995 - RNA, 13 nt, Mycobacterium bovis subsp bovis AF2122/97
aggccagcccggc

SEQ ID NO: 3131996 - RNA, 21 nt, Mycobacterium bovis subsp bovis AF2122/97
aggccagcgaaucgcugguga

SEQ ID NO: 3131997 - RNA, 21 nt, Mycobacterium bovis subsp bovis AF2122/97
aggccagcgcucaccggcguc

SEQ ID NO: 3131998 - RNA, 15 nt, Mycobacterium bovis subsp bovis AF2122/97
aggccaggaucuccc

SEQ ID NO: 3131999 - RNA, 18 nt, Mycobacterium bovis subsp bovis AF2122/97
aggccaguuuggcgcuuu

SEQ ID NO: 3132000 - RNA, 14 nt, Mycobacterium bovis subsp bovis AF2122/97
aggcccaacgcgau

SEQ ID NO: 3132001 - RNA, 16 nt, Mycobacterium bovis subsp bovis AF2122/97
aggcccaccauggcug

SEQ ID NO: 3132002 - RNA, 21 nt, Mycobacterium bovis subsp bovis AF2122/97
aggcccacggcagcgccgguc

SEQ ID NO: 3132003 - RNA, 19 nt, Mycobacterium bovis subsp bovis AF2122/97
aggcccacggcgaccagga

SEQ ID NO: 3132004 - RNA, 22 nt, Mycobacterium bovis subsp bovis AF2122/97
aggcccagcaaccgcucggcga

SEQ ID NO: 3132005 - RNA, 21 nt, Mycobacterium bovis subsp bovis AF2122/97
aggccggcgucgaucaacaac

SEQ ID NO: 3132006 - RNA, 17 nt, Mycobacterium bovis subsp bovis AF2122/97
aggccggcuaccgcgcu

SEQ ID NO: 3132007 - RNA, 13 nt, Mycobacterium bovis subsp bovis AF2122/97
aggccggcucgcu

SEQ ID NO: 3132008 - RNA, 19 nt, Mycobacterium bovis subsp bovis AF2122/97
aggccgggacagcgccggg

SEQ ID NO: 3132009 - RNA, 20 nt, Mycobacterium bovis subsp bovis AF2122/97
aggccgggacagcgccgggg

SEQ ID NO: 3132010 - RNA, 16 nt, Mycobacterium bovis subsp bovis AF2122/97
aggccgggccggccac

SEQ ID NO: 3132011 - RNA, 18 nt, Mycobacterium bovis subsp bovis AF2122/97
aggccgggcgcaagcagc

SEQ ID NO: 3132012 - RNA, 20 nt, Mycobacterium bovis subsp bovis AF2122/97
aggccgggcgcaagcagccc

SEQ ID NO: 3132013 - RNA, 21 nt, Mycobacterium bovis subsp bovis AF2122/97
aggccggggcggaaccuguca

SEQ ID NO: 3132014 - RNA, 15 nt, Mycobacterium bovis subsp bovis AF2122/97
aggccggggcgucgc

SEQ ID NO: 3132015 - RNA, 16 nt, Mycobacterium bovis subsp bovis AF2122/97
aggccggguggccacg

SEQ ID NO: 3132016 - RNA, 21 nt, Mycobacterium bovis subsp bovis AF2122/97
aggccggguggccacgcccag

SEQ ID NO: 3132017 - RNA, 11 nt, Mycobacterium bovis subsp bovis AF2122/97
aggccggugaa

SEQ ID NO: 3132018 - RNA, 18 nt, Mycobacterium bovis subsp bovis AF2122/97
aggccggugaacggcagc

SEQ ID NO: 3132019 - RNA, 23 nt, Mycobacterium bovis subsp bovis AF2122/97
aggccggugaacggcagcacggu

SEQ ID NO: 3132020 - RNA, 23 nt, Mycobacterium bovis subsp bovis AF2122/97
aggccgguucccuuguucccgaa

SEQ ID NO: 3132021 - RNA, 21 nt, Mycobacterium bovis subsp bovis AF2122/97
aggccgguuugcacgcaccac

SEQ ID NO: 3132022 - RNA, 16 nt, Mycobacterium bovis subsp bovis AF2122/97
aggccguacgacggca

SEQ ID NO: 3132023 - RNA, 18 nt, Mycobacterium bovis subsp bovis AF2122/97
aggccguacgacggcaau

SEQ ID NO: 3132024 - RNA, 16 nt, Mycobacterium bovis subsp bovis AF2122/97
aggccguaguggccgg

SEQ ID NO: 3132025 - RNA, 13 nt, Mycobacterium bovis subsp bovis AF2122/97
aggccgucaccga

SEQ ID NO: 3132026 - RNA, 16 nt, Mycobacterium bovis subsp bovis AF2122/97
aggccgucaccgacgc

SEQ ID NO: 3132027 - RNA, 13 nt, Mycobacterium bovis subsp bovis AF2122/97
aggccgucaggcg

SEQ ID NO: 3132028 - RNA, 14 nt, Mycobacterium bovis subsp bovis AF2122/97
aggccgucaggcgu

SEQ ID NO: 3132029 - RNA, 23 nt, Mycobacterium bovis subsp bovis AF2122/97
aggccgucgaacgguagcacggu

SEQ ID NO: 3132030 - RNA, 19 nt, Mycobacterium bovis subsp bovis AF2122/97
aggccguggcggacggcgu

SEQ ID NO: 3132031 - RNA, 22 nt, Mycobacterium bovis subsp bovis AF2122/97
aggccguggcggacggcgucga

SEQ ID NO: 3132032 - RNA, 15 nt, Mycobacterium bovis subsp bovis AF2122/97
aggccuaccaggcgc

SEQ ID NO: 3132033 - RNA, 17 nt, Mycobacterium bovis subsp bovis AF2122/97
aggccuaguccggcacu

SEQ ID NO: 3132034 - RNA, 13 nt, Mycobacterium bovis subsp bovis AF2122/97
aggccuccaaaau

SEQ ID NO: 3132035 - RNA, 21 nt, Mycobacterium bovis subsp bovis AF2122/97
aggccuccgcugccgcccgcg

SEQ ID NO: 3132036 - RNA, 15 nt, Mycobacterium bovis subsp bovis AF2122/97
aggccucgaccgcgg

SEQ ID NO: 3132037 - RNA, 22 nt, Mycobacterium bovis subsp bovis AF2122/97
aggccucgcaccggauccacgg

SEQ ID NO: 3132038 - RNA, 13 nt, Mycobacterium bovis subsp bovis AF2122/97
aggccucggcagc

SEQ ID NO: 3132039 - RNA, 15 nt, Mycobacterium bovis subsp bovis AF2122/97
aggccucggcagcaa

SEQ ID NO: 3132040 - RNA, 17 nt, Mycobacterium bovis subsp bovis AF2122/97
aggccucggcgccgccc

SEQ ID NO: 3132041 - RNA, 20 nt, Mycobacterium bovis subsp bovis AF2122/97
aggccucggcgccgcccagc

SEQ ID NO: 3132042 - RNA, 13 nt, Mycobacterium bovis subsp bovis AF2122/97
aggccucggcggc

SEQ ID NO: 3132043 - RNA, 19 nt, Mycobacterium bovis subsp bovis AF2122/97
aggccugacugaauuuggu

SEQ ID NO: 3132044 - RNA, 21 nt, Mycobacterium bovis subsp bovis AF2122/97
aggccugagcgugucuggcga

SEQ ID NO: 3132045 - RNA, 18 nt, Mycobacterium bovis subsp bovis AF2122/97
aggccugcccccggcgcg

SEQ ID NO: 3132046 - RNA, 17 nt, Mycobacterium bovis subsp bovis AF2122/97
aggccuggcgagccagc

SEQ ID NO: 3132047 - RNA, 14 nt, Mycobacterium bovis subsp bovis AF2122/97
aggccuucagcggu

SEQ ID NO: 3132048 - RNA, 15 nt, Mycobacterium bovis subsp bovis AF2122/97
aggccuucgccgacu

SEQ ID NO: 3132049 - RNA, 16 nt, Mycobacterium bovis subsp bovis AF2122/97
aggccuucgccgacua

SEQ ID NO: 3132050 - RNA, 20 nt, Mycobacterium bovis subsp bovis AF2122/97
aggccuugacguagaagucg

SEQ ID NO: 3132051 - RNA, 18 nt, Mycobacterium bovis subsp bovis AF2122/97
aggccuugcucagccggc

SEQ ID NO: 3132052 - RNA, 20 nt, Mycobacterium bovis subsp bovis AF2122/97
aggcgaaaauugcuccacca

SEQ ID NO: 3132053 - RNA, 22 nt, Mycobacterium bovis subsp bovis AF2122/97
aggcgaaauagcccaagccgau

SEQ ID NO: 3132054 - RNA, 15 nt, Mycobacterium bovis subsp bovis AF2122/97
aggcgaacagggcug

SEQ ID NO: 3132055 - RNA, 17 nt, Mycobacterium bovis subsp bovis AF2122/97
aggcgaagguccgugcc

SEQ ID NO: 3132056 - RNA, 20 nt, Mycobacterium bovis subsp bovis AF2122/97
aggcgaccagauagaacaac

SEQ ID NO: 3132057 - RNA, 19 nt, Mycobacterium bovis subsp bovis AF2122/97
aggcgacccgcugggucga

SEQ ID NO: 3132058 - RNA, 13 nt, Mycobacterium bovis subsp bovis AF2122/97
aggcgaccgggga

SEQ ID NO: 3132059 - RNA, 20 nt, Mycobacterium bovis subsp bovis AF2122/97
aggcgacgagcacacaacac

SEQ ID NO: 3132060 - RNA, 13 nt, Mycobacterium bovis subsp bovis AF2122/97
aggcgacggcccu

SEQ ID NO: 3132061 - RNA, 16 nt, Mycobacterium bovis subsp bovis AF2122/97
aggcgacggcucuacc

SEQ ID NO: 3132062 - RNA, 22 nt, Mycobacterium bovis subsp bovis AF2122/97
aggcgacggcucuaccgguccg

SEQ ID NO: 3132063 - RNA, 15 nt, Mycobacterium bovis subsp bovis AF2122/97
aggcgacgguuccca

SEQ ID NO: 3132064 - RNA, 17 nt, Mycobacterium bovis subsp bovis AF2122/97
aggcgacucggugcggu

SEQ ID NO: 3132065 - RNA, 16 nt, Mycobacterium bovis subsp bovis AF2122/97
aggcgagaagcgucgc

SEQ ID NO: 3132066 - RNA, 13 nt, Mycobacterium bovis subsp bovis AF2122/97
aggcgagccggcg

SEQ ID NO: 3132067 - RNA, 15 nt, Mycobacterium bovis subsp bovis AF2122/97
aggcgagccggcgcg

SEQ ID NO: 3132068 - RNA, 14 nt, Mycobacterium bovis subsp bovis AF2122/97
aggcgaguucgcgc

SEQ ID NO: 3132069 - RNA, 21 nt, Mycobacterium bovis subsp bovis AF2122/97
aggcgaguucgcgcacgucgg

SEQ ID NO: 3132070 - RNA, 20 nt, Mycobacterium bovis subsp bovis AF2122/97
aggcgauaaagccgcugaac

SEQ ID NO: 3132071 - RNA, 17 nt, Mycobacterium bovis subsp bovis AF2122/97
aggcgauaucgaucgga

SEQ ID NO: 3132072 - RNA, 18 nt, Mycobacterium bovis subsp bovis AF2122/97
aggcgauaucgcccggaa

SEQ ID NO: 3132073 - RNA, 12 nt, Mycobacterium bovis subsp bovis AF2122/97
aggcgaucagga

SEQ ID NO: 3132074 - RNA, 14 nt, Mycobacterium bovis subsp bovis AF2122/97
aggcgaucaggaug

SEQ ID NO: 3132075 - RNA, 13 nt, Mycobacterium bovis subsp bovis AF2122/97
aggcgaucgcauc

SEQ ID NO: 3132076 - RNA, 14 nt, Mycobacterium bovis subsp bovis AF2122/97
aggcgaucgcaucc

SEQ ID NO: 3132077 - RNA, 21 nt, Mycobacterium bovis subsp bovis AF2122/97
aggcgaucgcccggccccgca

SEQ ID NO: 3132078 - RNA, 17 nt, Mycobacterium bovis subsp bovis AF2122/97
aggcgaucugcuaccag

SEQ ID NO: 3132079 - RNA, 19 nt, Mycobacterium bovis subsp bovis AF2122/97
aggcgaucugcuaccagag

SEQ ID NO: 3132080 - RNA, 17 nt, Mycobacterium bovis subsp bovis AF2122/97
aggcgaugcgccaggcu

SEQ ID NO: 3132081 - RNA, 23 nt, Mycobacterium bovis subsp bovis AF2122/97
aggcgauugcagcuucggccagc

SEQ ID NO: 3132082 - RNA, 14 nt, Mycobacterium bovis subsp bovis AF2122/97
aggcgauugcccgc

SEQ ID NO: 3132083 - RNA, 17 nt, Mycobacterium bovis subsp bovis AF2122/97
aggcgauugcgccgcac

SEQ ID NO: 3132084 - RNA, 20 nt, Mycobacterium bovis subsp bovis AF2122/97
aggcgcaagaaugccgccga

SEQ ID NO: 3132085 - RNA, 14 nt, Mycobacterium bovis subsp bovis AF2122/97
aggcgcaccaggcg

SEQ ID NO: 3132086 - RNA, 22 nt, Mycobacterium bovis subsp bovis AF2122/97
aggcgcagauuccucuucaggc

SEQ ID NO: 3132087 - RNA, 15 nt, Mycobacterium bovis subsp bovis AF2122/97
aggcgcagcgccagc

SEQ ID NO: 3132088 - RNA, 14 nt, Mycobacterium bovis subsp bovis AF2122/97
aggcgcagcugggu

SEQ ID NO: 3132089 - RNA, 19 nt, Mycobacterium bovis subsp bovis AF2122/97
aggcgcauagggccaccgc

SEQ ID NO: 3132090 - RNA, 23 nt, Mycobacterium bovis subsp bovis AF2122/97
aggcgcauagggccaccgccgcc

SEQ ID NO: 3132091 - RNA, 22 nt, Mycobacterium bovis subsp bovis AF2122/97
aggcgccacugcuuccggaaca

SEQ ID NO: 3132092 - RNA, 11 nt, Mycobacterium bovis subsp bovis AF2122/97
aggcuggaggu

SEQ ID NO: 3132093 - RNA, 14 nt, Mycobacterium bovis subsp bovis AF2122/97
aggcuggaggugaa

SEQ ID NO: 3132094 - RNA, 18 nt, Mycobacterium bovis subsp bovis AF2122/97
aggcuggaggugaacucg

SEQ ID NO: 3132095 - RNA, 16 nt, Mycobacterium bovis subsp bovis AF2122/97
aggcuggcgagggcug

SEQ ID NO: 3132096 - RNA, 14 nt, Mycobacterium bovis subsp bovis AF2122/97
aggcuggcgauggc

SEQ ID NO: 3132097 - RNA, 16 nt, Mycobacterium bovis subsp bovis AF2122/97
aggcuggcugccacga

SEQ ID NO: 3132098 - RNA, 14 nt, Mycobacterium bovis subsp bovis AF2122/97
aggcugguccgggu

SEQ ID NO: 3132099 - RNA, 16 nt, Mycobacterium bovis subsp bovis AF2122/97
aggcuggucugcaggc

SEQ ID NO: 3132100 - RNA, 17 nt, Mycobacterium bovis subsp bovis AF2122/97
aggcuggucugcaggcg

SEQ ID NO: 3132101 - RNA, 17 nt, Mycobacterium bovis subsp bovis AF2122/97
aggcugguuucggccgc

SEQ ID NO: 3132102 - RNA, 22 nt, Mycobacterium bovis subsp bovis AF2122/97
aggcuguaacacccggccgccg

SEQ ID NO: 3132103 - RNA, 19 nt, Mycobacterium bovis subsp bovis AF2122/97
aggcuguccagcagcgaaa

SEQ ID NO: 3132104 - RNA, 16 nt, Mycobacterium bovis subsp bovis AF2122/97
aggcugucgagucggu

SEQ ID NO: 3132105 - RNA, 13 nt, Mycobacterium bovis subsp bovis AF2122/97
aggcugucgcggg

SEQ ID NO: 3132106 - RNA, 24 nt, Mycobacterium bovis subsp bovis AF2122/97
aggcugucgcgggccaccaccgag

SEQ ID NO: 3132107 - RNA, 20 nt, Mycobacterium bovis subsp bovis AF2122/97
aggcugugccccagggcagu

SEQ ID NO: 3132108 - RNA, 15 nt, Mycobacterium bovis subsp bovis AF2122/97
aggcugugccggcca

SEQ ID NO: 3132109 - RNA, 21 nt, Mycobacterium bovis subsp bovis AF2122/97
aggcuguggccagcaucauca

SEQ ID NO: 3132110 - RNA, 15 nt, Mycobacterium bovis subsp bovis AF2122/97
aggcuuacaugcccu

SEQ ID NO: 3132111 - RNA, 17 nt, Mycobacterium bovis subsp bovis AF2122/97
aggcuuccagccacagc

SEQ ID NO: 3132112 - RNA, 23 nt, Mycobacterium bovis subsp bovis AF2122/97
aggcuuccagccacagcccggcg

SEQ ID NO: 3132113 - RNA, 23 nt, Mycobacterium bovis subsp bovis AF2122/97
aggcuucgcuggcuugggccagc

SEQ ID NO: 3132114 - RNA, 20 nt, Mycobacterium bovis subsp bovis AF2122/97
aggcuucggcggccgagcgc

SEQ ID NO: 3132115 - RNA, 20 nt, Mycobacterium bovis subsp bovis AF2122/97
aggcuucggugacccgggcg

SEQ ID NO: 3132116 - RNA, 22 nt, Mycobacterium bovis subsp bovis AF2122/97
aggcuucggugacccgggcggc

SEQ ID NO: 3132117 - RNA, 15 nt, Mycobacterium bovis subsp bovis AF2122/97
aggcuugcaaggucg

SEQ ID NO: 3132118 - RNA, 20 nt, Mycobacterium bovis subsp bovis AF2122/97
aggcuuucgauauagccgcc

SEQ ID NO: 3132119 - RNA, 22 nt, Mycobacterium bovis subsp bovis AF2122/97
aggcuuucgauauagccgccgg

SEQ ID NO: 3132120 - RNA, 17 nt, Mycobacterium bovis subsp bovis AF2122/97
agggaauagcggcgccc

SEQ ID NO: 3132121 - RNA, 22 nt, Mycobacterium bovis subsp bovis AF2122/97
agggaauccgaacucgcgggcg

SEQ ID NO: 3132122 - RNA, 13 nt, Mycobacterium bovis subsp bovis AF2122/97
agggacccggcgc

SEQ ID NO: 3132123 - RNA, 14 nt, Mycobacterium bovis subsp bovis AF2122/97
agggaccgcaucgg

SEQ ID NO: 3132124 - RNA, 23 nt, Mycobacterium bovis subsp bovis AF2122/97
agggaccgguuauacguauguca

SEQ ID NO: 3132125 - RNA, 21 nt, Mycobacterium bovis subsp bovis AF2122/97
agggacugugggggcgcaccg

SEQ ID NO: 3132126 - RNA, 19 nt, Mycobacterium bovis subsp bovis AF2122/97
agggagcgccgcagggucc

SEQ ID NO: 3132127 - RNA, 14 nt, Mycobacterium bovis subsp bovis AF2122/97
agggauagcagugc

SEQ ID NO: 3132128 - RNA, 23 nt, Mycobacterium bovis subsp bovis AF2122/97
agggauccacgcaaacggggaug

SEQ ID NO: 3132129 - RNA, 20 nt, Mycobacterium bovis subsp bovis AF2122/97
agggauccgaagagccagca

SEQ ID NO: 3132130 - RNA, 19 nt, Mycobacterium bovis subsp bovis AF2122/97
agggaucuagaggcggccc

SEQ ID NO: 3132131 - RNA, 20 nt, Mycobacterium bovis subsp bovis AF2122/97
agggaucuagaggcggcccc

SEQ ID NO: 3132132 - RNA, 23 nt, Mycobacterium bovis subsp bovis AF2122/97
agggaucuagaggcggcccccgg

SEQ ID NO: 3132133 - RNA, 15 nt, Mycobacterium bovis subsp bovis AF2122/97
agggaugaucaccgg

SEQ ID NO: 3132134 - RNA, 24 nt, Mycobacterium bovis subsp bovis AF2122/97
agggcaacggacgggaucgcccag

SEQ ID NO: 3132135 - RNA, 14 nt, Mycobacterium bovis subsp bovis AF2122/97
agggcaccggcgau

SEQ ID NO: 3132136 - RNA, 15 nt, Mycobacterium bovis subsp bovis AF2122/97
agggcaccggcgauc

SEQ ID NO: 3132137 - RNA, 22 nt, Mycobacterium bovis subsp bovis AF2122/97
agggcacggcgguguguuccaa

SEQ ID NO: 3132138 - RNA, 20 nt, Mycobacterium bovis subsp bovis AF2122/97
agggcagcagcccgggcagc

SEQ ID NO: 3132139 - RNA, 16 nt, Mycobacterium bovis subsp bovis AF2122/97
agggcagcgccaggcc

SEQ ID NO: 3132140 - RNA, 20 nt, Mycobacterium bovis subsp bovis AF2122/97
agggcagcgccaggccguug

SEQ ID NO: 3132141 - RNA, 21 nt, Mycobacterium bovis subsp bovis AF2122/97
agggcaguagugaucgaucgc

SEQ ID NO: 3132142 - RNA, 13 nt, Mycobacterium bovis subsp bovis AF2122/97
agggcaucgagac

SEQ ID NO: 3132143 - RNA, 19 nt, Mycobacterium bovis subsp bovis AF2122/97
agggcaucgggccuagccg

SEQ ID NO: 3132144 - RNA, 13 nt, Mycobacterium bovis subsp bovis AF2122/97
agggcaucgucgc

SEQ ID NO: 3132145 - RNA, 16 nt, Mycobacterium bovis subsp bovis AF2122/97
agggcaucgucgccga

SEQ ID NO: 3132146 - RNA, 19 nt, Mycobacterium bovis subsp bovis AF2122/97
agggcauugcggcccgcga

SEQ ID NO: 3132147 - RNA, 14 nt, Mycobacterium bovis subsp bovis AF2122/97
agggccaccaccac

SEQ ID NO: 3132148 - RNA, 16 nt, Mycobacterium bovis subsp bovis AF2122/97
agggccaccaccacgg

SEQ ID NO: 3132149 - RNA, 21 nt, Mycobacterium bovis subsp bovis AF2122/97
agggccaccgccgccugcccg

SEQ ID NO: 3132150 - RNA, 13 nt, Mycobacterium bovis subsp bovis AF2122/97
agggccaccgcgc

SEQ ID NO: 3132151 - RNA, 14 nt, Mycobacterium bovis subsp bovis AF2122/97
agggccagaccgaa

SEQ ID NO: 3132152 - RNA, 18 nt, Mycobacterium bovis subsp bovis AF2122/97
agggccagaucgccgggc

SEQ ID NO: 3132153 - RNA, 23 nt, Mycobacterium bovis subsp bovis AF2122/97
agggccagcgccucggcaucgcc

SEQ ID NO: 3132154 - RNA, 18 nt, Mycobacterium bovis subsp bovis AF2122/97
agggccagcggcagccug

SEQ ID NO: 3132155 - RNA, 22 nt, Mycobacterium bovis subsp bovis AF2122/97
agggccagcggcagccuggccu

SEQ ID NO: 3132156 - RNA, 16 nt, Mycobacterium bovis subsp bovis AF2122/97
agggccaggacaacca

SEQ ID NO: 3132157 - RNA, 13 nt, Mycobacterium bovis subsp bovis AF2122/97
agggcccuggcgg

SEQ ID NO: 3132158 - RNA, 16 nt, Mycobacterium bovis subsp bovis AF2122/97
agggcccuggcggccc

SEQ ID NO: 3132159 - RNA, 17 nt, Mycobacterium bovis subsp bovis AF2122/97
agggcccuggcggcccg

SEQ ID NO: 3132160 - RNA, 12 nt, Mycobacterium bovis subsp bovis AF2122/97
agggccgccauc

SEQ ID NO: 3132161 - RNA, 18 nt, Mycobacterium bovis subsp bovis AF2122/97
agggccgccgaagcucau

SEQ ID NO: 3132162 - RNA, 11 nt, Mycobacterium bovis subsp bovis AF2122/97
agggccgccgc

SEQ ID NO: 3132163 - RNA, 23 nt, Mycobacterium bovis subsp bovis AF2122/97
agggccgccgcgaacgggucggg

SEQ ID NO: 3132164 - RNA, 19 nt, Mycobacterium bovis subsp bovis AF2122/97
agggccgccgcugccgccu

SEQ ID NO: 3132165 - RNA, 15 nt, Mycobacterium bovis subsp bovis AF2122/97
agggccgccgcuggu

SEQ ID NO: 3132166 - RNA, 14 nt, Mycobacterium bovis subsp bovis AF2122/97
agggccgcgaucga

SEQ ID NO: 3132167 - RNA, 20 nt, Mycobacterium bovis subsp bovis AF2122/97
agggccgcgaucgacggugu

SEQ ID NO: 3132168 - RNA, 15 nt, Mycobacterium bovis subsp bovis AF2122/97
agggccggcaccgca

SEQ ID NO: 3132169 - RNA, 16 nt, Mycobacterium bovis subsp bovis AF2122/97
agggccggcaccgcag

SEQ ID NO: 3132170 - RNA, 23 nt, Mycobacterium bovis subsp bovis AF2122/97
agggccggguggccacgaauccg

SEQ ID NO: 3132171 - RNA, 17 nt, Mycobacterium bovis subsp bovis AF2122/97
agggccggugacucaga

SEQ ID NO: 3132172 - RNA, 11 nt, Mycobacterium bovis subsp bovis AF2122/97
agggccguucc

SEQ ID NO: 3132173 - RNA, 16 nt, Mycobacterium bovis subsp bovis AF2122/97
agggccuccacccgcc

SEQ ID NO: 3132174 - RNA, 21 nt, Mycobacterium bovis subsp bovis AF2122/97
agggccugccgcacugggcga

SEQ ID NO: 3132175 - RNA, 14 nt, Mycobacterium bovis subsp bovis AF2122/97
agggccuggccaca

SEQ ID NO: 3132176 - RNA, 16 nt, Mycobacterium bovis subsp bovis AF2122/97
agggccuguuuaccuu

SEQ ID NO: 3132177 - RNA, 15 nt, Mycobacterium bovis subsp bovis AF2122/97
agggccuuggcggga

SEQ ID NO: 3132178 - RNA, 20 nt, Mycobacterium bovis subsp bovis AF2122/97
aggguuuccaagucggagcg

SEQ ID NO: 3132179 - RNA, 20 nt, Mycobacterium bovis subsp bovis AF2122/97
agguaagcagccagcaacac

SEQ ID NO: 3132180 - RNA, 15 nt, Mycobacterium bovis subsp bovis AF2122/97
agguacaucaccacg

SEQ ID NO: 3132181 - RNA, 14 nt, Mycobacterium bovis subsp bovis AF2122/97
agguagcgcgcaac

SEQ ID NO: 3132182 - RNA, 21 nt, Mycobacterium bovis subsp bovis AF2122/97
agguagcggguugggaccgaa

SEQ ID NO: 3132183 - RNA, 15 nt, Mycobacterium bovis subsp bovis AF2122/97
agguaggacucacgc

SEQ ID NO: 3132184 - RNA, 12 nt, Mycobacterium bovis subsp bovis AF2122/97
agguaggcgcga

SEQ ID NO: 3132185 - RNA, 14 nt, Mycobacterium bovis subsp bovis AF2122/97
agguagucggcgcg

SEQ ID NO: 3132186 - RNA, 22 nt, Mycobacterium bovis subsp bovis AF2122/97
agguaguucgacugaaucaugg

SEQ ID NO: 3132187 - RNA, 17 nt, Mycobacterium bovis subsp bovis AF2122/97
agguauaaacgcggcgc

SEQ ID NO: 3132188 - RNA, 13 nt, Mycobacterium bovis subsp bovis AF2122/97
agguaugcgguug

SEQ ID NO: 3132189 - RNA, 19 nt, Mycobacterium bovis subsp bovis AF2122/97
aggucaacgccacgccgau

SEQ ID NO: 3132190 - RNA, 21 nt, Mycobacterium bovis subsp bovis AF2122/97
aggucaacgggaggugguuca

SEQ ID NO: 3132191 - RNA, 24 nt, Mycobacterium bovis subsp bovis AF2122/97
aggucacacguuggcagcccucug

SEQ ID NO: 3132192 - RNA, 19 nt, Mycobacterium bovis subsp bovis AF2122/97
aggucacccaucaacgccg

SEQ ID NO: 3132193 - RNA, 17 nt, Mycobacterium bovis subsp bovis AF2122/97
aggucaccggccgccga

SEQ ID NO: 3132194 - RNA, 14 nt, Mycobacterium bovis subsp bovis AF2122/97
aggucagccgcgcg

SEQ ID NO: 3132195 - RNA, 19 nt, Mycobacterium bovis subsp bovis AF2122/97
aggucagccgcgcggguca

SEQ ID NO: 3132196 - RNA, 17 nt, Mycobacterium bovis subsp bovis AF2122/97
aggucauagccguugcg

SEQ ID NO: 3132197 - RNA, 18 nt, Mycobacterium bovis subsp bovis AF2122/97
aggucauauugugggugc

SEQ ID NO: 3132198 - RNA, 13 nt, Mycobacterium bovis subsp bovis AF2122/97
aggucaucgggca

SEQ ID NO: 3132199 - RNA, 22 nt, Mycobacterium bovis subsp bovis AF2122/97
agguccaaguccuccacggcgg

SEQ ID NO: 3132200 - RNA, 16 nt, Mycobacterium bovis subsp bovis AF2122/97
agguccaccccgccga

SEQ ID NO: 3132201 - RNA, 19 nt, Mycobacterium bovis subsp bovis AF2122/97
agguccccacauggcccgg

SEQ ID NO: 3132202 - RNA, 21 nt, Mycobacterium bovis subsp bovis AF2122/97
agguccccgacaacggcggca

SEQ ID NO: 3132203 - RNA, 15 nt, Mycobacterium bovis subsp bovis AF2122/97
aggucccggcuggga

SEQ ID NO: 3132204 - RNA, 12 nt, Mycobacterium bovis subsp bovis AF2122/97
aggucccgugcg

SEQ ID NO: 3132205 - RNA, 18 nt, Mycobacterium bovis subsp bovis AF2122/97
agguccgcacgaucugca

SEQ ID NO: 3132206 - RNA, 15 nt, Mycobacterium bovis subsp bovis AF2122/97
agguccgccggugcc

SEQ ID NO: 3132207 - RNA, 20 nt, Mycobacterium bovis subsp bovis AF2122/97
agguccgccggugccgccgu

SEQ ID NO: 3132208 - RNA, 12 nt, Mycobacterium bovis subsp bovis AF2122/97
agguccgcggcc

SEQ ID NO: 3132209 - RNA, 20 nt, Mycobacterium bovis subsp bovis AF2122/97
agguccggggaaagccgcag

SEQ ID NO: 3132210 - RNA, 21 nt, Mycobacterium bovis subsp bovis AF2122/97
agguccggggaaagccgcagc

SEQ ID NO: 3132211 - RNA, 17 nt, Mycobacterium bovis subsp bovis AF2122/97
agguccucgagguccuc

SEQ ID NO: 3132212 - RNA, 20 nt, Mycobacterium bovis subsp bovis AF2122/97
agguccucgagguccucguc

SEQ ID NO: 3132213 - RNA, 15 nt, Mycobacterium bovis subsp bovis AF2122/97
agguccucgucgucg

SEQ ID NO: 3132214 - RNA, 16 nt, Mycobacterium bovis subsp bovis AF2122/97
aggucgaaccgccggc

SEQ ID NO: 3132215 - RNA, 24 nt, Mycobacterium bovis subsp bovis AF2122/97
aggucgacaccgcggugccccgga

SEQ ID NO: 3132216 - RNA, 18 nt, Mycobacterium bovis subsp bovis AF2122/97
aggucgacggaaucgucg

SEQ ID NO: 3132217 - RNA, 18 nt, Mycobacterium bovis subsp bovis AF2122/97
aggucgacgggcacgcgg

SEQ ID NO: 3132218 - RNA, 17 nt, Mycobacterium bovis subsp bovis AF2122/97
aggucgagcgaccccac

SEQ ID NO: 3132219 - RNA, 21 nt, Mycobacterium bovis subsp bovis AF2122/97
aggucgagcgccuuugcccga

SEQ ID NO: 3132220 - RNA, 19 nt, Mycobacterium bovis subsp bovis AF2122/97
aggucgagcuuuucgaccu

SEQ ID NO: 3132221 - RNA, 23 nt, Mycobacterium bovis subsp bovis AF2122/97
aggucgaggcaggccucggcgcc

SEQ ID NO: 3132222 - RNA, 15 nt, Mycobacterium bovis subsp bovis AF2122/97
aggucgaucaggggc

SEQ ID NO: 3132223 - RNA, 21 nt, Mycobacterium bovis subsp bovis AF2122/97
aggucgaucaggggcccaccc

SEQ ID NO: 3132224 - RNA, 23 nt, Mycobacterium bovis subsp bovis AF2122/97
aggucgaugcugccagccauggc

SEQ ID NO: 3132225 - RNA, 19 nt, Mycobacterium bovis subsp bovis AF2122/97
aggucgccagcucggcacc

SEQ ID NO: 3132226 - RNA, 20 nt, Mycobacterium bovis subsp bovis AF2122/97
aggucgccgcaacaugggug

SEQ ID NO: 3132227 - RNA, 13 nt, Mycobacterium bovis subsp bovis AF2122/97
aggucgccggcca

SEQ ID NO: 3132228 - RNA, 16 nt, Mycobacterium bovis subsp bovis AF2122/97
aggucgccggccacga

SEQ ID NO: 3132229 - RNA, 21 nt, Mycobacterium bovis subsp bovis AF2122/97
aggucgccuucccagccgacg

SEQ ID NO: 3132230 - RNA, 18 nt, Mycobacterium bovis subsp bovis AF2122/97
aggucgcgauagccgccg

SEQ ID NO: 3132231 - RNA, 22 nt, Mycobacterium bovis subsp bovis AF2122/97
aggucgcgauagccgccgcggu

SEQ ID NO: 3132232 - RNA, 15 nt, Mycobacterium bovis subsp bovis AF2122/97
aggucgcggucgagc

SEQ ID NO: 3132233 - RNA, 17 nt, Mycobacterium bovis subsp bovis AF2122/97
aggucgcggucgagcag

SEQ ID NO: 3132234 - RNA, 18 nt, Mycobacterium bovis subsp bovis AF2122/97
aggucgcggucuuugagc

SEQ ID NO: 3132235 - RNA, 21 nt, Mycobacterium bovis subsp bovis AF2122/97
aggucgcggucuuugagccgg

SEQ ID NO: 3132236 - RNA, 21 nt, Mycobacterium bovis subsp bovis AF2122/97
aggucggcgaacaaccgccgc

SEQ ID NO: 3132237 - RNA, 14 nt, Mycobacterium bovis subsp bovis AF2122/97
aggucggcgaucug

SEQ ID NO: 3132238 - RNA, 15 nt, Mycobacterium bovis subsp bovis AF2122/97
aggucggcgaucugc

SEQ ID NO: 3132239 - RNA, 19 nt, Mycobacterium bovis subsp bovis AF2122/97
aggucggggaacgcggcga

SEQ ID NO: 3132240 - RNA, 15 nt, Mycobacterium bovis subsp bovis AF2122/97
aggucgguccgcacu

SEQ ID NO: 3132241 - RNA, 21 nt, Mycobacterium bovis subsp bovis AF2122/97
aggucggugggcggcgagcgc

SEQ ID NO: 3132242 - RNA, 21 nt, Mycobacterium bovis subsp bovis AF2122/97
aggucggugugcaucgccggc

SEQ ID NO: 3132243 - RNA, 21 nt, Mycobacterium bovis subsp bovis AF2122/97
aggucgguguuuggccgccga

SEQ ID NO: 3132244 - RNA, 22 nt, Mycobacterium bovis subsp bovis AF2122/97
aggucgucacgccccucacgug

SEQ ID NO: 3132245 - RNA, 20 nt, Mycobacterium bovis subsp bovis AF2122/97
aggucuccaucaaccgcgcu

SEQ ID NO: 3132246 - RNA, 22 nt, Mycobacterium bovis subsp bovis AF2122/97
aggucucgaaagccgcggccga

SEQ ID NO: 3132247 - RNA, 18 nt, Mycobacterium bovis subsp bovis AF2122/97
aggucuggccugccccag

SEQ ID NO: 3132248 - RNA, 18 nt, Mycobacterium bovis subsp bovis AF2122/97
aggucuucgaccacgguc

SEQ ID NO: 3132249 - RNA, 18 nt, Mycobacterium bovis subsp bovis AF2122/97
aggugaaccccgccggca

SEQ ID NO: 3132250 - RNA, 18 nt, Mycobacterium bovis subsp bovis AF2122/97
aggugaacgacaugggca

SEQ ID NO: 3132251 - RNA, 22 nt, Mycobacterium bovis subsp bovis AF2122/97
aggugaacgccggugcgcugga

SEQ ID NO: 3132252 - RNA, 19 nt, Mycobacterium bovis subsp bovis AF2122/97
aggugaacgcugucccagc

SEQ ID NO: 3132253 - RNA, 17 nt, Mycobacterium bovis subsp bovis AF2122/97
aggugaaucgacugauc

SEQ ID NO: 3132254 - RNA, 15 nt, Mycobacterium bovis subsp bovis AF2122/97
aggugacaaaucggc

SEQ ID NO: 3132255 - RNA, 17 nt, Mycobacterium bovis subsp bovis AF2122/97
aggugacaaaucggcca

SEQ ID NO: 3132256 - RNA, 15 nt, Mycobacterium bovis subsp bovis AF2122/97
aggugacgacgucgu

SEQ ID NO: 3132257 - RNA, 21 nt, Mycobacterium bovis subsp bovis AF2122/97
aggugacgaucaggucgccga

SEQ ID NO: 3132258 - RNA, 21 nt, Mycobacterium bovis subsp bovis AF2122/97
aggugacgaucgacagccccg

SEQ ID NO: 3132259 - RNA, 15 nt, Mycobacterium bovis subsp bovis AF2122/97
aggugacgccgccag

SEQ ID NO: 3132260 - RNA, 18 nt, Mycobacterium bovis subsp bovis AF2122/97
aggugacguucgaugccc

SEQ ID NO: 3132261 - RNA, 19 nt, Mycobacterium bovis subsp bovis AF2122/97
aggugagcagcaagaccgc

SEQ ID NO: 3132262 - RNA, 15 nt, Mycobacterium bovis subsp bovis AF2122/97
aggugaucagcagga

SEQ ID NO: 3132263 - RNA, 15 nt, Mycobacterium bovis subsp bovis AF2122/97
aggugaugccgccgu

SEQ ID NO: 3132264 - RNA, 21 nt, Mycobacterium bovis subsp bovis AF2122/97
aguaccagcccaccggcgccg

SEQ ID NO: 3132265 - RNA, 16 nt, Mycobacterium bovis subsp bovis AF2122/97
aguaccccuuggacug

SEQ ID NO: 3132266 - RNA, 23 nt, Mycobacterium bovis subsp bovis AF2122/97
aguaccgcgcguugaagucgccg

SEQ ID NO: 3132267 - RNA, 20 nt, Mycobacterium bovis subsp bovis AF2122/97
aguaccggccagccgcggcc

SEQ ID NO: 3132268 - RNA, 13 nt, Mycobacterium bovis subsp bovis AF2122/97
aguacgggccucc

SEQ ID NO: 3132269 - RNA, 20 nt, Mycobacterium bovis subsp bovis AF2122/97
aguacggugguaagacgccg

SEQ ID NO: 3132270 - RNA, 13 nt, Mycobacterium bovis subsp bovis AF2122/97
aguacgugcacag

SEQ ID NO: 3132271 - RNA, 12 nt, Mycobacterium bovis subsp bovis AF2122/97
aguacuccagcc

SEQ ID NO: 3132272 - RNA, 20 nt, Mycobacterium bovis subsp bovis AF2122/97
aguacucgcgcagguagcca

SEQ ID NO: 3132273 - RNA, 21 nt, Mycobacterium bovis subsp bovis AF2122/97
aguacuuuuggguucgucgac

SEQ ID NO: 3132274 - RNA, 13 nt, Mycobacterium bovis subsp bovis AF2122/97
aguagaucggauc

SEQ ID NO: 3132275 - RNA, 23 nt, Mycobacterium bovis subsp bovis AF2122/97
aguagccgaccaggaccaccgca

SEQ ID NO: 3132276 - RNA, 17 nt, Mycobacterium bovis subsp bovis AF2122/97
aguagccgacgucgccg

SEQ ID NO: 3132277 - RNA, 14 nt, Mycobacterium bovis subsp bovis AF2122/97
aguagccgcuagga

SEQ ID NO: 3132278 - RNA, 20 nt, Mycobacterium bovis subsp bovis AF2122/97
aguagccggucggcaccacc

SEQ ID NO: 3132279 - RNA, 14 nt, Mycobacterium bovis subsp bovis AF2122/97
aguagccguagccg

SEQ ID NO: 3132280 - RNA, 19 nt, Mycobacterium bovis subsp bovis AF2122/97
aguagcgcaaugcggcccg

SEQ ID NO: 3132281 - RNA, 11 nt, Mycobacterium bovis subsp bovis AF2122/97
aguagcugacc

SEQ ID NO: 3132282 - RNA, 22 nt, Mycobacterium bovis subsp bovis AF2122/97
aguaggccaccacugcgcccgc

SEQ ID NO: 3132283 - RNA, 17 nt, Mycobacterium bovis subsp bovis AF2122/97
aguagucgcuggccaga

SEQ ID NO: 3132284 - RNA, 16 nt, Mycobacterium bovis subsp bovis AF2122/97
aguagucggccgauga

SEQ ID NO: 3132285 - RNA, 17 nt, Mycobacterium bovis subsp bovis AF2122/97
aguagucggcgccgaga

SEQ ID NO: 3132286 - RNA, 15 nt, Mycobacterium bovis subsp bovis AF2122/97
aguagugcaggugcc

SEQ ID NO: 3132287 - RNA, 13 nt, Mycobacterium bovis subsp bovis AF2122/97
aguaguggccgcc

SEQ ID NO: 3132288 - RNA, 15 nt, Mycobacterium bovis subsp bovis AF2122/97
aguaguggccgccac

SEQ ID NO: 3132289 - RNA, 23 nt, Mycobacterium bovis subsp bovis AF2122/97
aguaguggccgccacccgcaacu

SEQ ID NO: 3132290 - RNA, 16 nt, Mycobacterium bovis subsp bovis AF2122/97
aguaguggugggcgug

SEQ ID NO: 3132291 - RNA, 11 nt, Mycobacterium bovis subsp bovis AF2122/97
aguauggccgc

SEQ ID NO: 3132292 - RNA, 19 nt, Mycobacterium bovis subsp bovis AF2122/97
aguauggccgccaccgcga

SEQ ID NO: 3132293 - RNA, 19 nt, Mycobacterium bovis subsp bovis AF2122/97
agucaacagggccaggaca

SEQ ID NO: 3132294 - RNA, 15 nt, Mycobacterium bovis subsp bovis AF2122/97
agucaacucaccguc

SEQ ID NO: 3132295 - RNA, 17 nt, Mycobacterium bovis subsp bovis AF2122/97
agucaacuucgacaacg

SEQ ID NO: 3132296 - RNA, 21 nt, Mycobacterium bovis subsp bovis AF2122/97
agucaaucgcgucaucaacgu

SEQ ID NO: 3132297 - RNA, 14 nt, Mycobacterium bovis subsp bovis AF2122/97
agucacagcucacc

SEQ ID NO: 3132298 - RNA, 15 nt, Mycobacterium bovis subsp bovis AF2122/97
agucacgcacccggc

SEQ ID NO: 3132299 - RNA, 21 nt, Mycobacterium bovis subsp bovis AF2122/97
agucacgcagccgcgcgguga

SEQ ID NO: 3132300 - RNA, 13 nt, Mycobacterium bovis subsp bovis AF2122/97
agucacggcggcu

SEQ ID NO: 3132301 - RNA, 11 nt, Mycobacterium bovis subsp bovis AF2122/97
agucagaaccg

SEQ ID NO: 3132302 - RNA, 18 nt, Mycobacterium bovis subsp bovis AF2122/97
agucagaaccgacggcca

SEQ ID NO: 3132303 - RNA, 22 nt, Mycobacterium bovis subsp bovis AF2122/97
agucagacgacgaugaugccgu

SEQ ID NO: 3132304 - RNA, 16 nt, Mycobacterium bovis subsp bovis AF2122/97
agucagcuccgcgcag

SEQ ID NO: 3132305 - RNA, 17 nt, Mycobacterium bovis subsp bovis AF2122/97
agucaggaaaccggcgc

SEQ ID NO: 3132306 - RNA, 21 nt, Mycobacterium bovis subsp bovis AF2122/97
agucauccaggucgccuuccc

SEQ ID NO: 3132307 - RNA, 18 nt, Mycobacterium bovis subsp bovis AF2122/97
agucauguccauagccgg

SEQ ID NO: 3132308 - RNA, 17 nt, Mycobacterium bovis subsp bovis AF2122/97
aguccaacucggccaac

SEQ ID NO: 3132309 - RNA, 13 nt, Mycobacterium bovis subsp bovis AF2122/97
aguccaagauguc

SEQ ID NO: 3132310 - RNA, 21 nt, Mycobacterium bovis subsp bovis AF2122/97
aguccacauaugucccaugga

SEQ ID NO: 3132311 - RNA, 14 nt, Mycobacterium bovis subsp bovis AF2122/97
aguccaccaccugg

SEQ ID NO: 3132312 - RNA, 21 nt, Mycobacterium bovis subsp bovis AF2122/97
aguccaccaccuggccggcca

SEQ ID NO: 3132313 - RNA, 20 nt, Mycobacterium bovis subsp bovis AF2122/97
aguccaccgcgcggcgcagc

SEQ ID NO: 3132314 - RNA, 15 nt, Mycobacterium bovis subsp bovis AF2122/97
aguccacgcaccacg

SEQ ID NO: 3132315 - RNA, 23 nt, Mycobacterium bovis subsp bovis AF2122/97
aguccagcagcgacgcugccgcc

SEQ ID NO: 3132316 - RNA, 15 nt, Mycobacterium bovis subsp bovis AF2122/97
aguccagcuggccgg

SEQ ID NO: 3132317 - RNA, 23 nt, Mycobacterium bovis subsp bovis AF2122/97
aguccagcuggccgggugcgugc

SEQ ID NO: 3132318 - RNA, 15 nt, Mycobacterium bovis subsp bovis AF2122/97
aguccaggccggcag

SEQ ID NO: 3132319 - RNA, 16 nt, Mycobacterium bovis subsp bovis AF2122/97
aguccaggccggcagc

SEQ ID NO: 3132320 - RNA, 20 nt, Mycobacterium bovis subsp bovis AF2122/97
aguccaggccggcagcuugc

SEQ ID NO: 3132321 - RNA, 12 nt, Mycobacterium bovis subsp bovis AF2122/97
aguccaggccgu

SEQ ID NO: 3132322 - RNA, 22 nt, Mycobacterium bovis subsp bovis AF2122/97
aguccaggcugaucccgaugcu

SEQ ID NO: 3132323 - RNA, 18 nt, Mycobacterium bovis subsp bovis AF2122/97
agucccacugccacuccu

SEQ ID NO: 3132324 - RNA, 15 nt, Mycobacterium bovis subsp bovis AF2122/97
agucccacugggccg

SEQ ID NO: 3132325 - RNA, 13 nt, Mycobacterium bovis subsp bovis AF2122/97
aguccccgccggc

SEQ ID NO: 3132326 - RNA, 14 nt, Mycobacterium bovis subsp bovis AF2122/97
aguccccgccggcc

SEQ ID NO: 3132327 - RNA, 15 nt, Mycobacterium bovis subsp bovis AF2122/97
aguccgacaccacgg

SEQ ID NO: 3132328 - RNA, 14 nt, Mycobacterium bovis subsp bovis AF2122/97
aguccgacaccggc

SEQ ID NO: 3132329 - RNA, 18 nt, Mycobacterium bovis subsp bovis AF2122/97
aguccgagggcgucgccg

SEQ ID NO: 3132330 - RNA, 22 nt, Mycobacterium bovis subsp bovis AF2122/97
aguccgagggcgucgccgccgu

SEQ ID NO: 3132331 - RNA, 18 nt, Mycobacterium bovis subsp bovis AF2122/97
aguccgaugccggaaugc

SEQ ID NO: 3132332 - RNA, 18 nt, Mycobacterium bovis subsp bovis AF2122/97
aguccgaugggaaucagu

SEQ ID NO: 3132333 - RNA, 23 nt, Mycobacterium bovis subsp bovis AF2122/97
aguccgauuuugugagccaggcg

SEQ ID NO: 3132334 - RNA, 15 nt, Mycobacterium bovis subsp bovis AF2122/97
aguccgcauggucag

SEQ ID NO: 3132335 - RNA, 12 nt, Mycobacterium bovis subsp bovis AF2122/97
aguccgccgccu

SEQ ID NO: 3132336 - RNA, 14 nt, Mycobacterium bovis subsp bovis AF2122/97
aguccgccgccugc

SEQ ID NO: 3132337 - RNA, 17 nt, Mycobacterium bovis subsp bovis AF2122/97
aguccgccgccugcgca

SEQ ID NO: 3132338 - RNA, 15 nt, Mycobacterium bovis subsp bovis AF2122/97
aguccgcgauggccg

SEQ ID NO: 3132339 - RNA, 14 nt, Mycobacterium bovis subsp bovis AF2122/97
aguccgcgccgacg

SEQ ID NO: 3132340 - RNA, 15 nt, Mycobacterium bovis subsp bovis AF2122/97
aguccgcgccgacgg

SEQ ID NO: 3132341 - RNA, 16 nt, Mycobacterium bovis subsp bovis AF2122/97
aguccgcgccgacggc

SEQ ID NO: 3132342 - RNA, 19 nt, Mycobacterium bovis subsp bovis AF2122/97
aguccgcgccgacggccag

SEQ ID NO: 3132343 - RNA, 22 nt, Mycobacterium bovis subsp bovis AF2122/97
aguccgcgccgacggccagcag

SEQ ID NO: 3132344 - RNA, 22 nt, Mycobacterium bovis subsp bovis AF2122/97
aguccgcggaucaccaucgccg

SEQ ID NO: 3132345 - RNA, 20 nt, Mycobacterium bovis subsp bovis AF2122/97
aguccggacggcagccgggc

SEQ ID NO: 3132346 - RNA, 13 nt, Mycobacterium bovis subsp bovis AF2122/97
aguccggcccccg

SEQ ID NO: 3132347 - RNA, 22 nt, Mycobacterium bovis subsp bovis AF2122/97
aguccggcucauccgacgggau

SEQ ID NO: 3132348 - RNA, 20 nt, Mycobacterium bovis subsp bovis AF2122/97
aguccggcuuaccggcgggc

SEQ ID NO: 3132349 - RNA, 24 nt, Mycobacterium bovis subsp bovis AF2122/97
aguccggcuuaccggcgggcgaac

SEQ ID NO: 3132350 - RNA, 14 nt, Mycobacterium bovis subsp bovis AF2122/97
aguccgguagcagc

SEQ ID NO: 3132351 - RNA, 23 nt, Mycobacterium bovis subsp bovis AF2122/97
agucgucguguuggccgggucgu

SEQ ID NO: 3132352 - RNA, 22 nt, Mycobacterium bovis subsp bovis AF2122/97
agucgucuucgucauggccggc

SEQ ID NO: 3132353 - RNA, 24 nt, Mycobacterium bovis subsp bovis AF2122/97
agucgugaucgcguuuguggcugg

SEQ ID NO: 3132354 - RNA, 15 nt, Mycobacterium bovis subsp bovis AF2122/97
agucguuccgccgcc

SEQ ID NO: 3132355 - RNA, 18 nt, Mycobacterium bovis subsp bovis AF2122/97
agucucaagguuucgaca

SEQ ID NO: 3132356 - RNA, 14 nt, Mycobacterium bovis subsp bovis AF2122/97
agucucccggccgc

SEQ ID NO: 3132357 - RNA, 20 nt, Mycobacterium bovis subsp bovis AF2122/97
agucuccggcgucggcggcc

SEQ ID NO: 3132358 - RNA, 15 nt, Mycobacterium bovis subsp bovis AF2122/97
agucucgacaaagcg

SEQ ID NO: 3132359 - RNA, 22 nt, Mycobacterium bovis subsp bovis AF2122/97
agucucgacaaagcggcugccc

SEQ ID NO: 3132360 - RNA, 17 nt, Mycobacterium bovis subsp bovis AF2122/97
agucugauggccucgcg

SEQ ID NO: 3132361 - RNA, 15 nt, Mycobacterium bovis subsp bovis AF2122/97
agucugggcgaucgc

SEQ ID NO: 3132362 - RNA, 15 nt, Mycobacterium bovis subsp bovis AF2122/97
agucuucaacgucga

SEQ ID NO: 3132363 - RNA, 14 nt, Mycobacterium bovis subsp bovis AF2122/97
agucuucggcgaca

SEQ ID NO: 3132364 - RNA, 21 nt, Mycobacterium bovis subsp bovis AF2122/97
agucuugaccgcaccggccgc

SEQ ID NO: 3132365 - RNA, 17 nt, Mycobacterium bovis subsp bovis AF2122/97
agucuuucgcuucgccc

SEQ ID NO: 3132366 - RNA, 16 nt, Mycobacterium bovis subsp bovis AF2122/97
agugaaauugccgccg

SEQ ID NO: 3132367 - RNA, 21 nt, Mycobacterium bovis subsp bovis AF2122/97
agugaacguaucgccucgagg

SEQ ID NO: 3132368 - RNA, 22 nt, Mycobacterium bovis subsp bovis AF2122/97
agugaaguuguuggccagaccg

SEQ ID NO: 3132369 - RNA, 20 nt, Mycobacterium bovis subsp bovis AF2122/97
agugaauaccccagaccgcc

SEQ ID NO: 3132370 - RNA, 14 nt, Mycobacterium bovis subsp bovis AF2122/97
agugaccacgcugc

SEQ ID NO: 3132371 - RNA, 21 nt, Mycobacterium bovis subsp bovis AF2122/97
agugaccgcagucccagcaca

SEQ ID NO: 3132372 - RNA, 13 nt, Mycobacterium bovis subsp bovis AF2122/97
agugaccugggcg

SEQ ID NO: 3132373 - RNA, 18 nt, Mycobacterium bovis subsp bovis AF2122/97
agugacgccacgaccgcc

SEQ ID NO: 3132374 - RNA, 20 nt, Mycobacterium bovis subsp bovis AF2122/97
agugacgccacgaccgccga

SEQ ID NO: 3132375 - RNA, 19 nt, Mycobacterium bovis subsp bovis AF2122/97
agugacugguauuucccuu

SEQ ID NO: 3132376 - RNA, 16 nt, Mycobacterium bovis subsp bovis AF2122/97
agugagcgaucgggug

SEQ ID NO: 3132377 - RNA, 13 nt, Mycobacterium bovis subsp bovis AF2122/97
agugagcucggcu

SEQ ID NO: 3132378 - RNA, 19 nt, Mycobacterium bovis subsp bovis AF2122/97
agugaggccgaccagcaca

SEQ ID NO: 3132379 - RNA, 17 nt, Mycobacterium bovis subsp bovis AF2122/97
agugaggcgcuggcccg

SEQ ID NO: 3132380 - RNA, 20 nt, Mycobacterium bovis subsp bovis AF2122/97
agugaggcgcuggcccgcca

SEQ ID NO: 3132381 - RNA, 15 nt, Mycobacterium bovis subsp bovis AF2122/97
agugaucaccaaccc

SEQ ID NO: 3132382 - RNA, 20 nt, Mycobacterium bovis subsp bovis AF2122/97
agugaucgaucgcggcgccc

SEQ ID NO: 3132383 - RNA, 23 nt, Mycobacterium bovis subsp bovis AF2122/97
agugcaagaccgcaucggcagcc

SEQ ID NO: 3132384 - RNA, 17 nt, Mycobacterium bovis subsp bovis AF2122/97
agugcacccggaucugg

SEQ ID NO: 3132385 - RNA, 13 nt, Mycobacterium bovis subsp bovis AF2122/97
agugcacccgggc

SEQ ID NO: 3132386 - RNA, 17 nt, Mycobacterium bovis subsp bovis AF2122/97
agugcacccgggccgcc

SEQ ID NO: 3132387 - RNA, 14 nt, Mycobacterium bovis subsp bovis AF2122/97
agugcaccgccugc

SEQ ID NO: 3132388 - RNA, 20 nt, Mycobacterium bovis subsp bovis AF2122/97
agugcaccgcgucguagcca

SEQ ID NO: 3132389 - RNA, 23 nt, Mycobacterium bovis subsp bovis AF2122/97
agugcacggacaguuccccgggc

SEQ ID NO: 3132390 - RNA, 14 nt, Mycobacterium bovis subsp bovis AF2122/97
agugcacgucggcg

SEQ ID NO: 3132391 - RNA, 17 nt, Mycobacterium bovis subsp bovis AF2122/97
agugcagacaggcggcg

SEQ ID NO: 3132392 - RNA, 20 nt, Mycobacterium bovis subsp bovis AF2122/97
agugcagacaggcggcggcc

SEQ ID NO: 3132393 - RNA, 21 nt, Mycobacterium bovis subsp bovis AF2122/97
agugcagacaggcggcggccu

SEQ ID NO: 3132394 - RNA, 19 nt, Mycobacterium bovis subsp bovis AF2122/97
agugcagcgaucccggcaa

SEQ ID NO: 3132395 - RNA, 15 nt, Mycobacterium bovis subsp bovis AF2122/97
agugcagcucgauac

SEQ ID NO: 3132396 - RNA, 14 nt, Mycobacterium bovis subsp bovis AF2122/97
agugcaggcggccg

SEQ ID NO: 3132397 - RNA, 16 nt, Mycobacterium bovis subsp bovis AF2122/97
agugcaggcggccgcc

SEQ ID NO: 3132398 - RNA, 12 nt, Mycobacterium bovis subsp bovis AF2122/97
agugcagggcug

SEQ ID NO: 3132399 - RNA, 22 nt, Mycobacterium bovis subsp bovis AF2122/97
agugcaggugcccggccaaaau

SEQ ID NO: 3132400 - RNA, 18 nt, Mycobacterium bovis subsp bovis AF2122/97
agugcagguuggccugcu

SEQ ID NO: 3132401 - RNA, 18 nt, Mycobacterium bovis subsp bovis AF2122/97
agugcaguuccgcggggc

SEQ ID NO: 3132402 - RNA, 21 nt, Mycobacterium bovis subsp bovis AF2122/97
agugcauaucaaccccggugc

SEQ ID NO: 3132403 - RNA, 18 nt, Mycobacterium bovis subsp bovis AF2122/97
agugcaucgaucaccgcu

SEQ ID NO: 3132404 - RNA, 20 nt, Mycobacterium bovis subsp bovis AF2122/97
agugccaauuccagcccccc

SEQ ID NO: 3132405 - RNA, 22 nt, Mycobacterium bovis subsp bovis AF2122/97
agugccaauuccagccccccgg

SEQ ID NO: 3132406 - RNA, 18 nt, Mycobacterium bovis subsp bovis AF2122/97
agugccagaacccggaca

SEQ ID NO: 3132407 - RNA, 24 nt, Mycobacterium bovis subsp bovis AF2122/97
agugccagcguccgucucgcaggc

SEQ ID NO: 3132408 - RNA, 14 nt, Mycobacterium bovis subsp bovis AF2122/97
agugccaggaucgc

SEQ ID NO: 3132409 - RNA, 21 nt, Mycobacterium bovis subsp bovis AF2122/97
agugccaggaucgcggcgccg

SEQ ID NO: 3132410 - RNA, 17 nt, Mycobacterium bovis subsp bovis AF2122/97
agugccaguccgauggu

SEQ ID NO: 3132411 - RNA, 15 nt, Mycobacterium bovis subsp bovis AF2122/97
agugcccagcgaugc

SEQ ID NO: 3132412 - RNA, 16 nt, Mycobacterium bovis subsp bovis AF2122/97
agugcccauagccggu

SEQ ID NO: 3132413 - RNA, 20 nt, Mycobacterium bovis subsp bovis AF2122/97
agugccccgcagcacucgcc

SEQ ID NO: 3132414 - RNA, 20 nt, Mycobacterium bovis subsp bovis AF2122/97
agugcccggccaaccaccaa

SEQ ID NO: 3132415 - RNA, 15 nt, Mycobacterium bovis subsp bovis AF2122/97
agugccgcacccaga

SEQ ID NO: 3132416 - RNA, 20 nt, Mycobacterium bovis subsp bovis AF2122/97
agugccgcacccagaccgcc

SEQ ID NO: 3132417 - RNA, 22 nt, Mycobacterium bovis subsp bovis AF2122/97
agugccgcacccagaccgccga

SEQ ID NO: 3132418 - RNA, 14 nt, Mycobacterium bovis subsp bovis AF2122/97
agugccgccaccgc

SEQ ID NO: 3132419 - RNA, 14 nt, Mycobacterium bovis subsp bovis AF2122/97
agugccgccggcca

SEQ ID NO: 3132420 - RNA, 13 nt, Mycobacterium bovis subsp bovis AF2122/97
agugccgcgucga

SEQ ID NO: 3132421 - RNA, 21 nt, Mycobacterium bovis subsp bovis AF2122/97
agugccgcgucgaguggccgu

SEQ ID NO: 3132422 - RNA, 11 nt, Mycobacterium bovis subsp bovis AF2122/97
agugccggcgc

SEQ ID NO: 3132423 - RNA, 16 nt, Mycobacterium bovis subsp bovis AF2122/97
agugccucgcguucgc

SEQ ID NO: 3132424 - RNA, 20 nt, Mycobacterium bovis subsp bovis AF2122/97
agugcgacucugcgucugcu

SEQ ID NO: 3132425 - RNA, 22 nt, Mycobacterium bovis subsp bovis AF2122/97
agugcgacugcgaaugcugggc

SEQ ID NO: 3132426 - RNA, 23 nt, Mycobacterium bovis subsp bovis AF2122/97
agugcgacugcgaaugcugggcc

SEQ ID NO: 3132427 - RNA, 18 nt, Mycobacterium bovis subsp bovis AF2122/97
agugcgcacgguuggcgc

SEQ ID NO: 3132428 - RNA, 21 nt, Mycobacterium bovis subsp bovis AF2122/97
agugcgcagaacaccaccgcc

SEQ ID NO: 3132429 - RNA, 15 nt, Mycobacterium bovis subsp bovis AF2122/97
agugcgcaucgccgg

SEQ ID NO: 3132430 - RNA, 12 nt, Mycobacterium bovis subsp bovis AF2122/97
agugcgccggcu

SEQ ID NO: 3132431 - RNA, 18 nt, Mycobacterium bovis subsp bovis AF2122/97
agugcgcggaucaacagg

SEQ ID NO: 3132432 - RNA, 14 nt, Mycobacterium bovis subsp bovis AF2122/97
agugcgcggcgucg

SEQ ID NO: 3132433 - RNA, 20 nt, Mycobacterium bovis subsp bovis AF2122/97
agugcgcgugcccgugguga

SEQ ID NO: 3132434 - RNA, 18 nt, Mycobacterium bovis subsp bovis AF2122/97
agugcggaacggccagga

SEQ ID NO: 3132435 - RNA, 22 nt, Mycobacterium bovis subsp bovis AF2122/97
agugcggacaucguugacccgg

SEQ ID NO: 3132436 - RNA, 18 nt, Mycobacterium bovis subsp bovis AF2122/97
agugcggacuucgccgcc

SEQ ID NO: 3132437 - RNA, 14 nt, Mycobacterium bovis subsp bovis AF2122/97
aguucacccaucau

SEQ ID NO: 3132438 - RNA, 13 nt, Mycobacterium bovis subsp bovis AF2122/97
aguucaccgcgcu

SEQ ID NO: 3132439 - RNA, 16 nt, Mycobacterium bovis subsp bovis AF2122/97
aguucagcacgugggc

SEQ ID NO: 3132440 - RNA, 19 nt, Mycobacterium bovis subsp bovis AF2122/97
aguucagccaggccgcaau

SEQ ID NO: 3132441 - RNA, 15 nt, Mycobacterium bovis subsp bovis AF2122/97
aguuccaauccggaa

SEQ ID NO: 3132442 - RNA, 22 nt, Mycobacterium bovis subsp bovis AF2122/97
aguucccuacacccauuacuga

SEQ ID NO: 3132443 - RNA, 12 nt, Mycobacterium bovis subsp bovis AF2122/97
aguuccgcugcg

SEQ ID NO: 3132444 - RNA, 15 nt, Mycobacterium bovis subsp bovis AF2122/97
aguuccgggguggac

SEQ ID NO: 3132445 - RNA, 22 nt, Mycobacterium bovis subsp bovis AF2122/97
aguuccggucgacuccagcacc

SEQ ID NO: 3132446 - RNA, 11 nt, Mycobacterium bovis subsp bovis AF2122/97
aguuccucuac

SEQ ID NO: 3132447 - RNA, 18 nt, Mycobacterium bovis subsp bovis AF2122/97
aguuccugacgccauuca

SEQ ID NO: 3132448 - RNA, 17 nt, Mycobacterium bovis subsp bovis AF2122/97
aguuccugcacggucaa

SEQ ID NO: 3132449 - RNA, 20 nt, Mycobacterium bovis subsp bovis AF2122/97
aguuccuugagacgccgggg

SEQ ID NO: 3132450 - RNA, 18 nt, Mycobacterium bovis subsp bovis AF2122/97
aguuccuugaugcggccg

SEQ ID NO: 3132451 - RNA, 15 nt, Mycobacterium bovis subsp bovis AF2122/97
aguucgagcugccag

SEQ ID NO: 3132452 - RNA, 16 nt, Mycobacterium bovis subsp bovis AF2122/97
aguucgcagucgauga

SEQ ID NO: 3132453 - RNA, 21 nt, Mycobacterium bovis subsp bovis AF2122/97
aguucgcaugcuugaaaccca

SEQ ID NO: 3132454 - RNA, 15 nt, Mycobacterium bovis subsp bovis AF2122/97
aguucgcugaccgcu

SEQ ID NO: 3132455 - RNA, 16 nt, Mycobacterium bovis subsp bovis AF2122/97
aguucggccaccaacc

SEQ ID NO: 3132456 - RNA, 21 nt, Mycobacterium bovis subsp bovis AF2122/97
aguucggccgucauggcccga

SEQ ID NO: 3132457 - RNA, 16 nt, Mycobacterium bovis subsp bovis AF2122/97
aguucggcgagcacau

SEQ ID NO: 3132458 - RNA, 14 nt, Mycobacterium bovis subsp bovis AF2122/97
aguucggcggccag

SEQ ID NO: 3132459 - RNA, 19 nt, Mycobacterium bovis subsp bovis AF2122/97
aguucggcgucguccgcgc

SEQ ID NO: 3132460 - RNA, 20 nt, Mycobacterium bovis subsp bovis AF2122/97
aguucggcgucguccgcgcc

SEQ ID NO: 3132461 - RNA, 18 nt, Mycobacterium bovis subsp bovis AF2122/97
aguucgggcaacggcagc

SEQ ID NO: 3132462 - RNA, 21 nt, Mycobacterium bovis subsp bovis AF2122/97
aguucgggcaacggcagcccg

SEQ ID NO: 3132463 - RNA, 17 nt, Mycobacterium bovis subsp bovis AF2122/97
aguucggugagccgggc

SEQ ID NO: 3132464 - RNA, 20 nt, Mycobacterium bovis subsp bovis AF2122/97
aguucgguguagaucagcaa

SEQ ID NO: 3132465 - RNA, 22 nt, Mycobacterium bovis subsp bovis AF2122/97
aguucgucaccguuggccgcgc

SEQ ID NO: 3132466 - RNA, 14 nt, Mycobacterium bovis subsp bovis AF2122/97
aguucguggcuggc

SEQ ID NO: 3132467 - RNA, 21 nt, Mycobacterium bovis subsp bovis AF2122/97
aguucuccagcucgaacaggu

SEQ ID NO: 3132468 - RNA, 23 nt, Mycobacterium bovis subsp bovis AF2122/97
aguucucgcgcuugcgccgccca

SEQ ID NO: 3132469 - RNA, 20 nt, Mycobacterium bovis subsp bovis AF2122/97
aguucugcacagugcggccc

SEQ ID NO: 3132470 - RNA, 19 nt, Mycobacterium bovis subsp bovis AF2122/97
aguucugcgcucccguacg

SEQ ID NO: 3132471 - RNA, 20 nt, Mycobacterium bovis subsp bovis AF2122/97
aguucuggaauccggccaga

SEQ ID NO: 3132472 - RNA, 16 nt, Mycobacterium bovis subsp bovis AF2122/97
aguucuucgcgaagaa

SEQ ID NO: 3132473 - RNA, 22 nt, Mycobacterium bovis subsp bovis AF2122/97
aguucuuggucaggcuggaggu

SEQ ID NO: 3132474 - RNA, 21 nt, Mycobacterium bovis subsp bovis AF2122/97
aguugaacaauccgguguuga

SEQ ID NO: 3132475 - RNA, 21 nt, Mycobacterium bovis subsp bovis AF2122/97
aguugaacguucccucggcac

SEQ ID NO: 3132476 - RNA, 13 nt, Mycobacterium bovis subsp bovis AF2122/97
aguugaagaagcc

SEQ ID NO: 3132477 - RNA, 11 nt, Mycobacterium bovis subsp bovis AF2122/97
aguugaagaau

SEQ ID NO: 3132478 - RNA, 17 nt, Mycobacterium bovis subsp bovis AF2122/97
aguugaaggugccggcg

SEQ ID NO: 3132479 - RNA, 15 nt, Mycobacterium bovis subsp bovis AF2122/97
aguugaccaggccga

SEQ ID NO: 3132480 - RNA, 19 nt, Mycobacterium bovis subsp bovis AF2122/97
aguugaccgccgugggugu

SEQ ID NO: 3132481 - RNA, 14 nt, Mycobacterium bovis subsp bovis AF2122/97
aguugagcagcuug

SEQ ID NO: 3132482 - RNA, 15 nt, Mycobacterium bovis subsp bovis AF2122/97
aguugagcagcuugg

SEQ ID NO: 3132483 - RNA, 22 nt, Mycobacterium bovis subsp bovis AF2122/97
aguugcaacggguacacccgcu

SEQ ID NO: 3132484 - RNA, 16 nt, Mycobacterium bovis subsp bovis AF2122/97
aguugcagcgggccac

SEQ ID NO: 3132485 - RNA, 23 nt, Mycobacterium bovis subsp bovis AF2122/97
aguugccaacacauugccggcca

SEQ ID NO: 3132486 - RNA, 16 nt, Mycobacterium bovis subsp bovis AF2122/97
aguugccggucaggca

SEQ ID NO: 3132487 - RNA, 15 nt, Mycobacterium bovis subsp bovis AF2122/97
aguugcgaaccauga

SEQ ID NO: 3132488 - RNA, 16 nt, Mycobacterium bovis subsp bovis AF2122/97
aguugcgcggcagugg

SEQ ID NO: 3132489 - RNA, 13 nt, Mycobacterium bovis subsp bovis AF2122/97
aguugcgcggcau

SEQ ID NO: 3132490 - RNA, 13 nt, Mycobacterium bovis subsp bovis AF2122/97
aguugcggcuggc

SEQ ID NO: 3132491 - RNA, 15 nt, Mycobacterium bovis subsp bovis AF2122/97
aguugcucgacacug

SEQ ID NO: 3132492 - RNA, 18 nt, Mycobacterium bovis subsp bovis AF2122/97
aguugcucggccgaugcg

SEQ ID NO: 3132493 - RNA, 18 nt, Mycobacterium bovis subsp bovis AF2122/97
aguuggccaugcaccgau

SEQ ID NO: 3132494 - RNA, 13 nt, Mycobacterium bovis subsp bovis AF2122/97
aguuggccggcca

SEQ ID NO: 3132495 - RNA, 14 nt, Mycobacterium bovis subsp bovis AF2122/97
aguuggccguggcg

SEQ ID NO: 3132496 - RNA, 18 nt, Mycobacterium bovis subsp bovis AF2122/97
aguuggcgaccugcgcga

SEQ ID NO: 3132497 - RNA, 21 nt, Mycobacterium bovis subsp bovis AF2122/97
aguuggcgcccgaagccgggc

SEQ ID NO: 3132498 - RNA, 23 nt, Mycobacterium bovis subsp bovis AF2122/97
aguuggcguugucgguuggcagc

SEQ ID NO: 3132499 - RNA, 16 nt, Mycobacterium bovis subsp bovis AF2122/97
aguugguagccgcccu

SEQ ID NO: 3132500 - RNA, 21 nt, Mycobacterium bovis subsp bovis AF2122/97
aguuggucacgaagaccaggc

SEQ ID NO: 3132501 - RNA, 21 nt, Mycobacterium bovis subsp bovis AF2122/97
aguugguccaggugaccgaga

SEQ ID NO: 3132502 - RNA, 13 nt, Mycobacterium bovis subsp bovis AF2122/97
aguuggucgcggu

SEQ ID NO: 3132503 - RNA, 23 nt, Mycobacterium bovis subsp bovis AF2122/97
aguugguguuauugaugcccgac

SEQ ID NO: 3132504 - RNA, 23 nt, Mycobacterium bovis subsp bovis AF2122/97
aguugucuggucauggccgaaca

SEQ ID NO: 3132505 - RNA, 16 nt, Mycobacterium bovis subsp bovis AF2122/97
aguugugcggccaggc

SEQ ID NO: 3132506 - RNA, 20 nt, Mycobacterium bovis subsp bovis AF2122/97
aguuguugcaggagccggca

SEQ ID NO: 3132507 - RNA, 15 nt, Mycobacterium bovis subsp bovis AF2122/97
aguuguuggccagac

SEQ ID NO: 3132508 - RNA, 21 nt, Mycobacterium bovis subsp bovis AF2122/97
aguuguuggccagaccgcgcg

SEQ ID NO: 3132509 - RNA, 13 nt, Mycobacterium bovis subsp bovis AF2122/97
aguuuaccgugcc

SEQ ID NO: 3132510 - RNA, 16 nt, Mycobacterium bovis subsp bovis AF2122/97
aguuuccagaugcacg

SEQ ID NO: 3132511 - RNA, 16 nt, Mycobacterium bovis subsp bovis AF2122/97
aguuucccuuaccaga

SEQ ID NO: 3132512 - RNA, 15 nt, Mycobacterium bovis subsp bovis AF2122/97
aguuugaccaccugg

SEQ ID NO: 3132513 - RNA, 20 nt, Mycobacterium bovis subsp bovis AF2122/97
aguuuuucgggguggcggca

SEQ ID NO: 3132514 - RNA, 10 nt, Mycobacterium bovis subsp bovis AF2122/97
auaaaugccg

SEQ ID NO: 3132515 - RNA, 16 nt, Mycobacterium bovis subsp bovis AF2122/97
auaacccaaccgcgcc

SEQ ID NO: 3132516 - RNA, 10 nt, Mycobacterium bovis subsp bovis AF2122/97
auaacccagc

SEQ ID NO: 3132517 - RNA, 13 nt, Mycobacterium bovis subsp bovis AF2122/97
auaacccagcacc

SEQ ID NO: 3132518 - RNA, 17 nt, Mycobacterium bovis subsp bovis AF2122/97
auaacccagcaccacaa

SEQ ID NO: 3132519 - RNA, 13 nt, Mycobacterium bovis subsp bovis AF2122/97
auaacccuggccg

SEQ ID NO: 3132520 - RNA, 14 nt, Mycobacterium bovis subsp bovis AF2122/97
auaacgacucgaga

SEQ ID NO: 3132521 - RNA, 22 nt, Mycobacterium bovis subsp bovis AF2122/97
auaagcccccgcacgcucgccc

SEQ ID NO: 3132522 - RNA, 18 nt, Mycobacterium bovis subsp bovis AF2122/97
auaagggagaccgcggcc

SEQ ID NO: 3132523 - RNA, 17 nt, Mycobacterium bovis subsp bovis AF2122/97
auaagguucgugcguug

SEQ ID NO: 3132524 - RNA, 19 nt, Mycobacterium bovis subsp bovis AF2122/97
auauagggcuccucgugca

SEQ ID NO: 3132525 - RNA, 13 nt, Mycobacterium bovis subsp bovis AF2122/97
auaucacaacugc

SEQ ID NO: 3132526 - RNA, 18 nt, Mycobacterium bovis subsp bovis AF2122/97
auaucauuacucaacagu

SEQ ID NO: 3132527 - RNA, 23 nt, Mycobacterium bovis subsp bovis AF2122/97
auauccggacuugaccagagcac

SEQ ID NO: 3132528 - RNA, 22 nt, Mycobacterium bovis subsp bovis AF2122/97
auauccgugaauggcagcacga

SEQ ID NO: 3132529 - RNA, 12 nt, Mycobacterium bovis subsp bovis AF2122/97
auaucgaugcgg

SEQ ID NO: 3132530 - RNA, 22 nt, Mycobacterium bovis subsp bovis AF2122/97
auaucgcccaccacgaacacgu

SEQ ID NO: 3132531 - RNA, 22 nt, Mycobacterium bovis subsp bovis AF2122/97
auaucggcacggucacacgcca

SEQ ID NO: 3132532 - RNA, 21 nt, Mycobacterium bovis subsp bovis AF2122/97
auaucgggagcggcugcggca

SEQ ID NO: 3132533 - RNA, 15 nt, Mycobacterium bovis subsp bovis AF2122/97
auaucggugaccgug

SEQ ID NO: 3132534 - RNA, 19 nt, Mycobacterium bovis subsp bovis AF2122/97
auaucuuuagcgcgugcug

SEQ ID NO: 3132535 - RNA, 16 nt, Mycobacterium bovis subsp bovis AF2122/97
auaugacggcagacca

SEQ ID NO: 3132536 - RNA, 16 nt, Mycobacterium bovis subsp bovis AF2122/97
auaugcaggacucgcg

SEQ ID NO: 3132537 - RNA, 21 nt, Mycobacterium bovis subsp bovis AF2122/97
auaugcgugagcugcucgagc

SEQ ID NO: 3132538 - RNA, 17 nt, Mycobacterium bovis subsp bovis AF2122/97
auauggaccgccgccga

SEQ ID NO: 3132539 - RNA, 18 nt, Mycobacterium bovis subsp bovis AF2122/97
auauggcagugucguggu

SEQ ID NO: 3132540 - RNA, 16 nt, Mycobacterium bovis subsp bovis AF2122/97
auauucgcugggcgca

SEQ ID NO: 3132541 - RNA, 11 nt, Mycobacterium bovis subsp bovis AF2122/97
auauugccauc

SEQ ID NO: 3132542 - RNA, 12 nt, Mycobacterium bovis subsp bovis AF2122/97
auauugcggugc

SEQ ID NO: 3132543 - RNA, 16 nt, Mycobacterium bovis subsp bovis AF2122/97
auauuggacgcgcaug

SEQ ID NO: 3132544 - RNA, 21 nt, Mycobacterium bovis subsp bovis AF2122/97
auauuucuaaauaccuuuggc

SEQ ID NO: 3132545 - RNA, 15 nt, Mycobacterium bovis subsp bovis AF2122/97
aucaaacccccgggg

SEQ ID NO: 3132546 - RNA, 17 nt, Mycobacterium bovis subsp bovis AF2122/97
aucaaacccccggggcg

SEQ ID NO: 3132547 - RNA, 15 nt, Mycobacterium bovis subsp bovis AF2122/97
aucaaaccggcggcg

SEQ ID NO: 3132548 - RNA, 14 nt, Mycobacterium bovis subsp bovis AF2122/97
aucaaagccagcac

SEQ ID NO: 3132549 - RNA, 19 nt, Mycobacterium bovis subsp bovis AF2122/97
aucaacaacagccgcagcc

SEQ ID NO: 3132550 - RNA, 22 nt, Mycobacterium bovis subsp bovis AF2122/97
aucaacaaggggcagcacguca

SEQ ID NO: 3132551 - RNA, 15 nt, Mycobacterium bovis subsp bovis AF2122/97
aucaacaccaacgac

SEQ ID NO: 3132552 - RNA, 14 nt, Mycobacterium bovis subsp bovis AF2122/97
aucaacaggccucg

SEQ ID NO: 3132553 - RNA, 12 nt, Mycobacterium bovis subsp bovis AF2122/97
aucaacaucggc

SEQ ID NO: 3132554 - RNA, 14 nt, Mycobacterium bovis subsp bovis AF2122/97
aucaacaucggccc

SEQ ID NO: 3132555 - RNA, 18 nt, Mycobacterium bovis subsp bovis AF2122/97
aucaaccgggucagccca

SEQ ID NO: 3132556 - RNA, 23 nt, Mycobacterium bovis subsp bovis AF2122/97
aucaacgaacggauaccugggac

SEQ ID NO: 3132557 - RNA, 14 nt, Mycobacterium bovis subsp bovis AF2122/97
aucaacgacaccag

SEQ ID NO: 3132558 - RNA, 16 nt, Mycobacterium bovis subsp bovis AF2122/97
aucaacgacaccagau

SEQ ID NO: 3132559 - RNA, 21 nt, Mycobacterium bovis subsp bovis AF2122/97
aucaacgcaaugccaaucgca

SEQ ID NO: 3132560 - RNA, 18 nt, Mycobacterium bovis subsp bovis AF2122/97
aucaacgcgucgcccgca

SEQ ID NO: 3132561 - RNA, 17 nt, Mycobacterium bovis subsp bovis AF2122/97
aucaacgcguugcacag

SEQ ID NO: 3132562 - RNA, 19 nt, Mycobacterium bovis subsp bovis AF2122/97
aucaacgcguugcacagca

SEQ ID NO: 3132563 - RNA, 22 nt, Mycobacterium bovis subsp bovis AF2122/97
aucaacggaacaucgucaucga

SEQ ID NO: 3132564 - RNA, 21 nt, Mycobacterium bovis subsp bovis AF2122/97
aucaacggaaugaaggcaccg

SEQ ID NO: 3132565 - RNA, 19 nt, Mycobacterium bovis subsp bovis AF2122/97
aucaagaaguacagcuggc

SEQ ID NO: 3132566 - RNA, 15 nt, Mycobacterium bovis subsp bovis AF2122/97
aucaagcacagcccg

SEQ ID NO: 3132567 - RNA, 16 nt, Mycobacterium bovis subsp bovis AF2122/97
aucaagcacagcccgg

SEQ ID NO: 3132568 - RNA, 19 nt, Mycobacterium bovis subsp bovis AF2122/97
aucaagccuucgucgaugc

SEQ ID NO: 3132569 - RNA, 21 nt, Mycobacterium bovis subsp bovis AF2122/97
aucaagccuucgucgaugcgg

SEQ ID NO: 3132570 - RNA, 22 nt, Mycobacterium bovis subsp bovis AF2122/97
aucaaggagauccagggccuuc

SEQ ID NO: 3132571 - RNA, 14 nt, Mycobacterium bovis subsp bovis AF2122/97
aucaaggccaccuc

SEQ ID NO: 3132572 - RNA, 15 nt, Mycobacterium bovis subsp bovis AF2122/97
aucaagggugcgucg

SEQ ID NO: 3132573 - RNA, 15 nt, Mycobacterium bovis subsp bovis AF2122/97
aucaagguguugcgg

SEQ ID NO: 3132574 - RNA, 17 nt, Mycobacterium bovis subsp bovis AF2122/97
aucaagugcgguccggc

SEQ ID NO: 3132575 - RNA, 17 nt, Mycobacterium bovis subsp bovis AF2122/97
aucaaugcggucccucc

SEQ ID NO: 3132576 - RNA, 20 nt, Mycobacterium bovis subsp bovis AF2122/97
aucaaugcugcguccuggau

SEQ ID NO: 3132577 - RNA, 16 nt, Mycobacterium bovis subsp bovis AF2122/97
aucacaccauuggcca

SEQ ID NO: 3132578 - RNA, 17 nt, Mycobacterium bovis subsp bovis AF2122/97
aucacacccaucacccu

SEQ ID NO: 3132579 - RNA, 20 nt, Mycobacterium bovis subsp bovis AF2122/97
aucacaccgagcgcaaucga

SEQ ID NO: 3132580 - RNA, 16 nt, Mycobacterium bovis subsp bovis AF2122/97
aucacacguccgcgca

SEQ ID NO: 3132581 - RNA, 21 nt, Mycobacterium bovis subsp bovis AF2122/97
aucacacguccgcgcaccgca

SEQ ID NO: 3132582 - RNA, 14 nt, Mycobacterium bovis subsp bovis AF2122/97
aucacaucaaaguc

SEQ ID NO: 3132583 - RNA, 23 nt, Mycobacterium bovis subsp bovis AF2122/97
aucacaucgcccggaaccggcgu

SEQ ID NO: 3132584 - RNA, 15 nt, Mycobacterium bovis subsp bovis AF2122/97
aucaccacaccggca

SEQ ID NO: 3132585 - RNA, 17 nt, Mycobacterium bovis subsp bovis AF2122/97
aucaccacaccggcagc

SEQ ID NO: 3132586 - RNA, 17 nt, Mycobacterium bovis subsp bovis AF2122/97
aucaccacccgaccgcc

SEQ ID NO: 3132587 - RNA, 19 nt, Mycobacterium bovis subsp bovis AF2122/97
aucaccacccgaccgccau

SEQ ID NO: 3132588 - RNA, 13 nt, Mycobacterium bovis subsp bovis AF2122/97
aucaccaccgacc

SEQ ID NO: 3132589 - RNA, 23 nt, Mycobacterium bovis subsp bovis AF2122/97
aucaccaccgaccuggacgcggc

SEQ ID NO: 3132590 - RNA, 13 nt, Mycobacterium bovis subsp bovis AF2122/97
aucaccaccggca

SEQ ID NO: 3132591 - RNA, 15 nt, Mycobacterium bovis subsp bovis AF2122/97
aucaccauaggcaag

SEQ ID NO: 3132592 - RNA, 18 nt, Mycobacterium bovis subsp bovis AF2122/97
aucaccauccagcccauc

SEQ ID NO: 3132593 - RNA, 19 nt, Mycobacterium bovis subsp bovis AF2122/97
aucaccaucgccgccgcgc

SEQ ID NO: 3132594 - RNA, 15 nt, Mycobacterium bovis subsp bovis AF2122/97
aucacccacucgccg

SEQ ID NO: 3132595 - RNA, 21 nt, Mycobacterium bovis subsp bovis AF2122/97
aucacccacucgccgagcugg

SEQ ID NO: 3132596 - RNA, 14 nt, Mycobacterium bovis subsp bovis AF2122/97
aucacccccuggac

SEQ ID NO: 3132597 - RNA, 15 nt, Mycobacterium bovis subsp bovis AF2122/97
aucaccccggcggcc

SEQ ID NO: 3132598 - RNA, 14 nt, Mycobacterium bovis subsp bovis AF2122/97
aucacccgccgcgu

SEQ ID NO: 3132599 - RNA, 18 nt, Mycobacterium bovis subsp bovis AF2122/97
aucaccgacaccgugccg

SEQ ID NO: 3132600 - RNA, 14 nt, Mycobacterium bovis subsp bovis AF2122/97
aucaccgaccaacg

SEQ ID NO: 3132601 - RNA, 18 nt, Mycobacterium bovis subsp bovis AF2122/97
aucaccgaccaacgcggu

SEQ ID NO: 3132602 - RNA, 20 nt, Mycobacterium bovis subsp bovis AF2122/97
aucaccgagucgacggccag

SEQ ID NO: 3132603 - RNA, 14 nt, Mycobacterium bovis subsp bovis AF2122/97
aucaccgccaccac

SEQ ID NO: 3132604 - RNA, 22 nt, Mycobacterium bovis subsp bovis AF2122/97
aucaccgccaccaccagggcaa

SEQ ID NO: 3132605 - RNA, 13 nt, Mycobacterium bovis subsp bovis AF2122/97
aucaccgccgcgg

SEQ ID NO: 3132606 - RNA, 15 nt, Mycobacterium bovis subsp bovis AF2122/97
aucaccgccgcggcc

SEQ ID NO: 3132607 - RNA, 23 nt, Mycobacterium bovis subsp bovis AF2122/97
aucaccgccuuugccgccggcac

SEQ ID NO: 3132608 - RNA, 22 nt, Mycobacterium bovis subsp bovis AF2122/97
aucaccgcgccagccuccacca

SEQ ID NO: 3132609 - RNA, 21 nt, Mycobacterium bovis subsp bovis AF2122/97
aucaccgcgcccgccgcggca

SEQ ID NO: 3132610 - RNA, 14 nt, Mycobacterium bovis subsp bovis AF2122/97
aucagcuuuugcac

SEQ ID NO: 3132611 - RNA, 18 nt, Mycobacterium bovis subsp bovis AF2122/97
aucaggaaccgcucguca

SEQ ID NO: 3132612 - RNA, 16 nt, Mycobacterium bovis subsp bovis AF2122/97
aucaggccgacgucga

SEQ ID NO: 3132613 - RNA, 19 nt, Mycobacterium bovis subsp bovis AF2122/97
aucaggccgacgucgacca

SEQ ID NO: 3132614 - RNA, 24 nt, Mycobacterium bovis subsp bovis AF2122/97
aucaggccgacgucgaccacugcc

SEQ ID NO: 3132615 - RNA, 16 nt, Mycobacterium bovis subsp bovis AF2122/97
aucaggccgaugacga

SEQ ID NO: 3132616 - RNA, 14 nt, Mycobacterium bovis subsp bovis AF2122/97
aucaggccgucgcc

SEQ ID NO: 3132617 - RNA, 22 nt, Mycobacterium bovis subsp bovis AF2122/97
aucaggccuugggauaggccgu

SEQ ID NO: 3132618 - RNA, 19 nt, Mycobacterium bovis subsp bovis AF2122/97
aucaggcucgccgaugcug

SEQ ID NO: 3132619 - RNA, 23 nt, Mycobacterium bovis subsp bovis AF2122/97
aucagggucugcgccgccggcgg

SEQ ID NO: 3132620 - RNA, 14 nt, Mycobacterium bovis subsp bovis AF2122/97
aucaggguggcgcg

SEQ ID NO: 3132621 - RNA, 16 nt, Mycobacterium bovis subsp bovis AF2122/97
aucagggugucgaaga

SEQ ID NO: 3132622 - RNA, 18 nt, Mycobacterium bovis subsp bovis AF2122/97
aucagguacgccaggugc

SEQ ID NO: 3132623 - RNA, 20 nt, Mycobacterium bovis subsp bovis AF2122/97
aucaggucgccgagaccggc

SEQ ID NO: 3132624 - RNA, 13 nt, Mycobacterium bovis subsp bovis AF2122/97
aucaggucggcga

SEQ ID NO: 3132625 - RNA, 17 nt, Mycobacterium bovis subsp bovis AF2122/97
aucaggucgucacgccc

SEQ ID NO: 3132626 - RNA, 22 nt, Mycobacterium bovis subsp bovis AF2122/97
aucaggucgucguccuguccgg

SEQ ID NO: 3132627 - RNA, 21 nt, Mycobacterium bovis subsp bovis AF2122/97
aucaggucuucgauggccaug

SEQ ID NO: 3132628 - RNA, 23 nt, Mycobacterium bovis subsp bovis AF2122/97
aucaggugcgccuggcuggccag

SEQ ID NO: 3132629 - RNA, 18 nt, Mycobacterium bovis subsp bovis AF2122/97
aucagguucgucaggucc

SEQ ID NO: 3132630 - RNA, 22 nt, Mycobacterium bovis subsp bovis AF2122/97
aucaguagcagcggcucggcgg

SEQ ID NO: 3132631 - RNA, 20 nt, Mycobacterium bovis subsp bovis AF2122/97
aucagugaagacaccaggcc

SEQ ID NO: 3132632 - RNA, 21 nt, Mycobacterium bovis subsp bovis AF2122/97
aucagugaagacaccaggccc

SEQ ID NO: 3132633 - RNA, 17 nt, Mycobacterium bovis subsp bovis AF2122/97
aucaguuccuguagccg

SEQ ID NO: 3132634 - RNA, 17 nt, Mycobacterium bovis subsp bovis AF2122/97
aucaguugcacaccgau

SEQ ID NO: 3132635 - RNA, 22 nt, Mycobacterium bovis subsp bovis AF2122/97
aucauacgacagcccgccggcg

SEQ ID NO: 3132636 - RNA, 21 nt, Mycobacterium bovis subsp bovis AF2122/97
aucauagacagggccgcucgc

SEQ ID NO: 3132637 - RNA, 21 nt, Mycobacterium bovis subsp bovis AF2122/97
aucauauccgccccagcugcg

SEQ ID NO: 3132638 - RNA, 14 nt, Mycobacterium bovis subsp bovis AF2122/97
aucaucaccggcau

SEQ ID NO: 3132639 - RNA, 13 nt, Mycobacterium bovis subsp bovis AF2122/97
aucaucagcggcg

SEQ ID NO: 3132640 - RNA, 17 nt, Mycobacterium bovis subsp bovis AF2122/97
aucaucaugucggcgca

SEQ ID NO: 3132641 - RNA, 21 nt, Mycobacterium bovis subsp bovis AF2122/97
aucaucccguauucgaugccg

SEQ ID NO: 3132642 - RNA, 22 nt, Mycobacterium bovis subsp bovis AF2122/97
aucauccuucgccggcgccagc

SEQ ID NO: 3132643 - RNA, 15 nt, Mycobacterium bovis subsp bovis AF2122/97
aucaucgccgcggcc

SEQ ID NO: 3132644 - RNA, 23 nt, Mycobacterium bovis subsp bovis AF2122/97
aucaucgccgcggccagguugau

SEQ ID NO: 3132645 - RNA, 14 nt, Mycobacterium bovis subsp bovis AF2122/97
aucaucgcuuggcc

SEQ ID NO: 3132646 - RNA, 16 nt, Mycobacterium bovis subsp bovis AF2122/97
aucaucgggguggcca

SEQ ID NO: 3132647 - RNA, 21 nt, Mycobacterium bovis subsp bovis AF2122/97
aucaucucgguggacggcagg

SEQ ID NO: 3132648 - RNA, 22 nt, Mycobacterium bovis subsp bovis AF2122/97
aucaucucgguggacggcaggc

SEQ ID NO: 3132649 - RNA, 16 nt, Mycobacterium bovis subsp bovis AF2122/97
aucaucuggucgacca

SEQ ID NO: 3132650 - RNA, 21 nt, Mycobacterium bovis subsp bovis AF2122/97
aucaugaacgcaagcagcgcg

SEQ ID NO: 3132651 - RNA, 12 nt, Mycobacterium bovis subsp bovis AF2122/97
aucaugaccauc

SEQ ID NO: 3132652 - RNA, 13 nt, Mycobacterium bovis subsp bovis AF2122/97
aucaugagcagca

SEQ ID NO: 3132653 - RNA, 16 nt, Mycobacterium bovis subsp bovis AF2122/97
aucauggauaauccau

SEQ ID NO: 3132654 - RNA, 23 nt, Mycobacterium bovis subsp bovis AF2122/97
aucauggcgagcguuuggacggg

SEQ ID NO: 3132655 - RNA, 19 nt, Mycobacterium bovis subsp bovis AF2122/97
aucaugucgaagaaccggc

SEQ ID NO: 3132656 - RNA, 14 nt, Mycobacterium bovis subsp bovis AF2122/97
aucaugucggcgca

SEQ ID NO: 3132657 - RNA, 19 nt, Mycobacterium bovis subsp bovis AF2122/97
aucaugucggcgcaggcgu

SEQ ID NO: 3132658 - RNA, 13 nt, Mycobacterium bovis subsp bovis AF2122/97
aucaugugccagu

SEQ ID NO: 3132659 - RNA, 14 nt, Mycobacterium bovis subsp bovis AF2122/97
aucaugugcgcgac

SEQ ID NO: 3132660 - RNA, 12 nt, Mycobacterium bovis subsp bovis AF2122/97
aucauguggugg

SEQ ID NO: 3132661 - RNA, 12 nt, Mycobacterium bovis subsp bovis AF2122/97
aucauguucggc

SEQ ID NO: 3132662 - RNA, 20 nt, Mycobacterium bovis subsp bovis AF2122/97
aucauguucuuuugcgucug

SEQ ID NO: 3132663 - RNA, 23 nt, Mycobacterium bovis subsp bovis AF2122/97
aucauguucuuuugcgucugcug

SEQ ID NO: 3132664 - RNA, 20 nt, Mycobacterium bovis subsp bovis AF2122/97
aucauuacucaacaguucac

SEQ ID NO: 3132665 - RNA, 18 nt, Mycobacterium bovis subsp bovis AF2122/97
aucauugcaugguuucgu

SEQ ID NO: 3132666 - RNA, 13 nt, Mycobacterium bovis subsp bovis AF2122/97
auccaacgcacgc

SEQ ID NO: 3132667 - RNA, 20 nt, Mycobacterium bovis subsp bovis AF2122/97
auccaagaaagugcacacaa

SEQ ID NO: 3132668 - RNA, 15 nt, Mycobacterium bovis subsp bovis AF2122/97
auccaaggcucagca

SEQ ID NO: 3132669 - RNA, 18 nt, Mycobacterium bovis subsp bovis AF2122/97
auccaaggcucagcagcg

SEQ ID NO: 3132670 - RNA, 23 nt, Mycobacterium bovis subsp bovis AF2122/97
auccaauccacgguugccggcgg

SEQ ID NO: 3132671 - RNA, 19 nt, Mycobacterium bovis subsp bovis AF2122/97
auccacaauccgcucgguc

SEQ ID NO: 3132672 - RNA, 18 nt, Mycobacterium bovis subsp bovis AF2122/97
auccacacacagccggug

SEQ ID NO: 3132673 - RNA, 14 nt, Mycobacterium bovis subsp bovis AF2122/97
auccacaccgcggc

SEQ ID NO: 3132674 - RNA, 15 nt, Mycobacterium bovis subsp bovis AF2122/97
auccacaccgcggcg

SEQ ID NO: 3132675 - RNA, 16 nt, Mycobacterium bovis subsp bovis AF2122/97
auccacaccgcggcgg

SEQ ID NO: 3132676 - RNA, 20 nt, Mycobacterium bovis subsp bovis AF2122/97
auccacaggcugaagacgaa

SEQ ID NO: 3132677 - RNA, 21 nt, Mycobacterium bovis subsp bovis AF2122/97
auccacaggcugaagacgaau

SEQ ID NO: 3132678 - RNA, 19 nt, Mycobacterium bovis subsp bovis AF2122/97
auccacccauagacccggc

SEQ ID NO: 3132679 - RNA, 14 nt, Mycobacterium bovis subsp bovis AF2122/97
auccacccgacgac

SEQ ID NO: 3132680 - RNA, 23 nt, Mycobacterium bovis subsp bovis AF2122/97
auccacgacaucguaggccggca

SEQ ID NO: 3132681 - RNA, 12 nt, Mycobacterium bovis subsp bovis AF2122/97
auccacgccgac

SEQ ID NO: 3132682 - RNA, 19 nt, Mycobacterium bovis subsp bovis AF2122/97
auccacggagaccggccgg

SEQ ID NO: 3132683 - RNA, 12 nt, Mycobacterium bovis subsp bovis AF2122/97
auccacggcgau

SEQ ID NO: 3132684 - RNA, 21 nt, Mycobacterium bovis subsp bovis AF2122/97
auccacggcgaugcagccaca

SEQ ID NO: 3132685 - RNA, 17 nt, Mycobacterium bovis subsp bovis AF2122/97
auccacgguugccggcg

SEQ ID NO: 3132686 - RNA, 13 nt, Mycobacterium bovis subsp bovis AF2122/97
auccacgucgcgg

SEQ ID NO: 3132687 - RNA, 14 nt, Mycobacterium bovis subsp bovis AF2122/97
auccacuccggcga

SEQ ID NO: 3132688 - RNA, 12 nt, Mycobacterium bovis subsp bovis AF2122/97
auccacugccgc

SEQ ID NO: 3132689 - RNA, 23 nt, Mycobacterium bovis subsp bovis AF2122/97
auccacugccgcgcgcccgccuc

SEQ ID NO: 3132690 - RNA, 13 nt, Mycobacterium bovis subsp bovis AF2122/97
auccacugcggcg

SEQ ID NO: 3132691 - RNA, 18 nt, Mycobacterium bovis subsp bovis AF2122/97
auccacuucagcacccgg

SEQ ID NO: 3132692 - RNA, 17 nt, Mycobacterium bovis subsp bovis AF2122/97
auccacuugaaguucuu

SEQ ID NO: 3132693 - RNA, 17 nt, Mycobacterium bovis subsp bovis AF2122/97
auccagaaacugcucgg

SEQ ID NO: 3132694 - RNA, 18 nt, Mycobacterium bovis subsp bovis AF2122/97
auccagaaguaggcgacc

SEQ ID NO: 3132695 - RNA, 21 nt, Mycobacterium bovis subsp bovis AF2122/97
auccagaccaugcgcagagua

SEQ ID NO: 3132696 - RNA, 15 nt, Mycobacterium bovis subsp bovis AF2122/97
aucccgucccagcug

SEQ ID NO: 3132697 - RNA, 15 nt, Mycobacterium bovis subsp bovis AF2122/97
aucccguccgcgccc

SEQ ID NO: 3132698 - RNA, 13 nt, Mycobacterium bovis subsp bovis AF2122/97
aucccgucgggca

SEQ ID NO: 3132699 - RNA, 21 nt, Mycobacterium bovis subsp bovis AF2122/97
aucccuccgccaaggaggcca

SEQ ID NO: 3132700 - RNA, 23 nt, Mycobacterium bovis subsp bovis AF2122/97
aucccugaaauaccaguccggcg

SEQ ID NO: 3132701 - RNA, 16 nt, Mycobacterium bovis subsp bovis AF2122/97
aucccugugccagcag

SEQ ID NO: 3132702 - RNA, 22 nt, Mycobacterium bovis subsp bovis AF2122/97
aucccugugccagcagcagcgc

SEQ ID NO: 3132703 - RNA, 21 nt, Mycobacterium bovis subsp bovis AF2122/97
auccgaacucgcgggcgacca

SEQ ID NO: 3132704 - RNA, 23 nt, Mycobacterium bovis subsp bovis AF2122/97
auccgaacucgcgggcgaccacc

SEQ ID NO: 3132705 - RNA, 22 nt, Mycobacterium bovis subsp bovis AF2122/97
auccgaacuucgugggggaccu

SEQ ID NO: 3132706 - RNA, 17 nt, Mycobacterium bovis subsp bovis AF2122/97
auccgaagagccagcaa

SEQ ID NO: 3132707 - RNA, 19 nt, Mycobacterium bovis subsp bovis AF2122/97
auccgacaagcugucggcg

SEQ ID NO: 3132708 - RNA, 17 nt, Mycobacterium bovis subsp bovis AF2122/97
auccgacagcagccggu

SEQ ID NO: 3132709 - RNA, 21 nt, Mycobacterium bovis subsp bovis AF2122/97
auccgacagcagccggugccg

SEQ ID NO: 3132710 - RNA, 13 nt, Mycobacterium bovis subsp bovis AF2122/97
auccgaccacucc

SEQ ID NO: 3132711 - RNA, 18 nt, Mycobacterium bovis subsp bovis AF2122/97
auccgaccccgcgccgac

SEQ ID NO: 3132712 - RNA, 13 nt, Mycobacterium bovis subsp bovis AF2122/97
auccgaccugcuc

SEQ ID NO: 3132713 - RNA, 14 nt, Mycobacterium bovis subsp bovis AF2122/97
auccgacgaccgca

SEQ ID NO: 3132714 - RNA, 15 nt, Mycobacterium bovis subsp bovis AF2122/97
auccgacgaccgcau

SEQ ID NO: 3132715 - RNA, 15 nt, Mycobacterium bovis subsp bovis AF2122/97
auccgacgucgacga

SEQ ID NO: 3132716 - RNA, 14 nt, Mycobacterium bovis subsp bovis AF2122/97
auccgagaccgcgu

SEQ ID NO: 3132717 - RNA, 14 nt, Mycobacterium bovis subsp bovis AF2122/97
auccgagccgcgau

SEQ ID NO: 3132718 - RNA, 14 nt, Mycobacterium bovis subsp bovis AF2122/97
auccgagcgcggcg

SEQ ID NO: 3132719 - RNA, 16 nt, Mycobacterium bovis subsp bovis AF2122/97
auccgagugaucgggu

SEQ ID NO: 3132720 - RNA, 16 nt, Mycobacterium bovis subsp bovis AF2122/97
auccgaguugucgccg

SEQ ID NO: 3132721 - RNA, 17 nt, Mycobacterium bovis subsp bovis AF2122/97
auccgaguugucgccgg

SEQ ID NO: 3132722 - RNA, 20 nt, Mycobacterium bovis subsp bovis AF2122/97
auccgauaaauggccgauga

SEQ ID NO: 3132723 - RNA, 20 nt, Mycobacterium bovis subsp bovis AF2122/97
auccgaucaccucggcgacg

SEQ ID NO: 3132724 - RNA, 12 nt, Mycobacterium bovis subsp bovis AF2122/97
auccgauccgca

SEQ ID NO: 3132725 - RNA, 16 nt, Mycobacterium bovis subsp bovis AF2122/97
auccgcaacagcucgg

SEQ ID NO: 3132726 - RNA, 19 nt, Mycobacterium bovis subsp bovis AF2122/97
auccgcaccgaaaccaugc

SEQ ID NO: 3132727 - RNA, 16 nt, Mycobacterium bovis subsp bovis AF2122/97
auccgcacgcaaugcg

SEQ ID NO: 3132728 - RNA, 13 nt, Mycobacterium bovis subsp bovis AF2122/97
auccgccagaccg

SEQ ID NO: 3132729 - RNA, 17 nt, Mycobacterium bovis subsp bovis AF2122/97
auccgccagaccgcggc

SEQ ID NO: 3132730 - RNA, 23 nt, Mycobacterium bovis subsp bovis AF2122/97
auccgccauuucucguacccggc

SEQ ID NO: 3132731 - RNA, 14 nt, Mycobacterium bovis subsp bovis AF2122/97
auccgccccagcug

SEQ ID NO: 3132732 - RNA, 15 nt, Mycobacterium bovis subsp bovis AF2122/97
auccgccccgcccgc

SEQ ID NO: 3132733 - RNA, 14 nt, Mycobacterium bovis subsp bovis AF2122/97
auccgcccgagccg

SEQ ID NO: 3132734 - RNA, 19 nt, Mycobacterium bovis subsp bovis AF2122/97
auccgccgcccccgcccgu

SEQ ID NO: 3132735 - RNA, 20 nt, Mycobacterium bovis subsp bovis AF2122/97
auccgccgggcgccgugccc

SEQ ID NO: 3132736 - RNA, 14 nt, Mycobacterium bovis subsp bovis AF2122/97
auccgcgacggcgc

SEQ ID NO: 3132737 - RNA, 18 nt, Mycobacterium bovis subsp bovis AF2122/97
auccgcgauucgaccggu

SEQ ID NO: 3132738 - RNA, 19 nt, Mycobacterium bovis subsp bovis AF2122/97
auccgcgcgcauauccgca

SEQ ID NO: 3132739 - RNA, 20 nt, Mycobacterium bovis subsp bovis AF2122/97
auccgcgcgcauauccgcag

SEQ ID NO: 3132740 - RNA, 22 nt, Mycobacterium bovis subsp bovis AF2122/97
auccgcggcaugcaaugcuggc

SEQ ID NO: 3132741 - RNA, 22 nt, Mycobacterium bovis subsp bovis AF2122/97
auccgcgguuggcaguggcgcg

SEQ ID NO: 3132742 - RNA, 22 nt, Mycobacterium bovis subsp bovis AF2122/97
auccgcguggugcugaccgcgc

SEQ ID NO: 3132743 - RNA, 17 nt, Mycobacterium bovis subsp bovis AF2122/97
auccgcucacccgcccg

SEQ ID NO: 3132744 - RNA, 21 nt, Mycobacterium bovis subsp bovis AF2122/97
auccggaucccaccaccgcuc

SEQ ID NO: 3132745 - RNA, 17 nt, Mycobacterium bovis subsp bovis AF2122/97
auccggaucggccuguc

SEQ ID NO: 3132746 - RNA, 22 nt, Mycobacterium bovis subsp bovis AF2122/97
auccggcaaccaccggccgcgc

SEQ ID NO: 3132747 - RNA, 16 nt, Mycobacterium bovis subsp bovis AF2122/97
auccggcaagccgggg

SEQ ID NO: 3132748 - RNA, 17 nt, Mycobacterium bovis subsp bovis AF2122/97
auccggcauacaucgcc

SEQ ID NO: 3132749 - RNA, 21 nt, Mycobacterium bovis subsp bovis AF2122/97
auccggccagaguuaccaggu

SEQ ID NO: 3132750 - RNA, 15 nt, Mycobacterium bovis subsp bovis AF2122/97
auccggcccaccggu

SEQ ID NO: 3132751 - RNA, 17 nt, Mycobacterium bovis subsp bovis AF2122/97
auccggcccaccggucg

SEQ ID NO: 3132752 - RNA, 18 nt, Mycobacterium bovis subsp bovis AF2122/97
auccggcccaccggucgc

SEQ ID NO: 3132753 - RNA, 13 nt, Mycobacterium bovis subsp bovis AF2122/97
auccggccgucgg

SEQ ID NO: 3132754 - RNA, 21 nt, Mycobacterium bovis subsp bovis AF2122/97
auccggcgggugccgagcugg

SEQ ID NO: 3132755 - RNA, 22 nt, Mycobacterium bovis subsp bovis AF2122/97
auccggcgggugccgagcuggc

SEQ ID NO: 3132756 - RNA, 19 nt, Mycobacterium bovis subsp bovis AF2122/97
auccgggcaaccgaugacg

SEQ ID NO: 3132757 - RNA, 22 nt, Mycobacterium bovis subsp bovis AF2122/97
auccgggcaaccgaugacgcgu

SEQ ID NO: 3132758 - RNA, 19 nt, Mycobacterium bovis subsp bovis AF2122/97
auccgggccuugcgcgcgc

SEQ ID NO: 3132759 - RNA, 17 nt, Mycobacterium bovis subsp bovis AF2122/97
auccgggcgaccaccac

SEQ ID NO: 3132760 - RNA, 22 nt, Mycobacterium bovis subsp bovis AF2122/97
auccgguauucgguggagcgcg

SEQ ID NO: 3132761 - RNA, 21 nt, Mycobacterium bovis subsp bovis AF2122/97
auccggucccgccgugccgcg

SEQ ID NO: 3132762 - RNA, 20 nt, Mycobacterium bovis subsp bovis AF2122/97
auccggucgaugaccucguc

SEQ ID NO: 3132763 - RNA, 19 nt, Mycobacterium bovis subsp bovis AF2122/97
auccggucgaugucagcca

SEQ ID NO: 3132764 - RNA, 13 nt, Mycobacterium bovis subsp bovis AF2122/97
auccggucggcca

SEQ ID NO: 3132765 - RNA, 17 nt, Mycobacterium bovis subsp bovis AF2122/97
auccggucggccaggcc

SEQ ID NO: 3132766 - RNA, 17 nt, Mycobacterium bovis subsp bovis AF2122/97
auccggucggcccacac

SEQ ID NO: 3132767 - RNA, 19 nt, Mycobacterium bovis subsp bovis AF2122/97
auccggucuccgcugauga

SEQ ID NO: 3132768 - RNA, 20 nt, Mycobacterium bovis subsp bovis AF2122/97
auccggucuccgcugaugag

SEQ ID NO: 3132769 - RNA, 14 nt, Mycobacterium bovis subsp bovis AF2122/97
auccggugaugacc

SEQ ID NO: 3132770 - RNA, 16 nt, Mycobacterium bovis subsp bovis AF2122/97
auccggugccgcgauc

SEQ ID NO: 3132771 - RNA, 18 nt, Mycobacterium bovis subsp bovis AF2122/97
auccggugccgcgaucgc

SEQ ID NO: 3132772 - RNA, 19 nt, Mycobacterium bovis subsp bovis AF2122/97
auccgguggcuggccgcca

SEQ ID NO: 3132773 - RNA, 18 nt, Mycobacterium bovis subsp bovis AF2122/97
auccgguggugcucgucg

SEQ ID NO: 3132774 - RNA, 13 nt, Mycobacterium bovis subsp bovis AF2122/97
auccgguguugag

SEQ ID NO: 3132775 - RNA, 15 nt, Mycobacterium bovis subsp bovis AF2122/97
auccgguguugagau

SEQ ID NO: 3132776 - RNA, 18 nt, Mycobacterium bovis subsp bovis AF2122/97
auccgguucgccgccguu

SEQ ID NO: 3132777 - RNA, 15 nt, Mycobacterium bovis subsp bovis AF2122/97
auccguacaguccac

SEQ ID NO: 3132778 - RNA, 12 nt, Mycobacterium bovis subsp bovis AF2122/97
auccgucccagg

SEQ ID NO: 3132779 - RNA, 16 nt, Mycobacterium bovis subsp bovis AF2122/97
auccgucccaggugca

SEQ ID NO: 3132780 - RNA, 16 nt, Mycobacterium bovis subsp bovis AF2122/97
auccgucgcguugagc

SEQ ID NO: 3132781 - RNA, 14 nt, Mycobacterium bovis subsp bovis AF2122/97
auccgucggcggag

SEQ ID NO: 3132782 - RNA, 13 nt, Mycobacterium bovis subsp bovis AF2122/97
aucgagcaccgca

SEQ ID NO: 3132783 - RNA, 17 nt, Mycobacterium bovis subsp bovis AF2122/97
aucgagcaggccgccca

SEQ ID NO: 3132784 - RNA, 22 nt, Mycobacterium bovis subsp bovis AF2122/97
aucgagcaguuccagcucgcgg

SEQ ID NO: 3132785 - RNA, 18 nt, Mycobacterium bovis subsp bovis AF2122/97
aucgagcgggaucgggcc

SEQ ID NO: 3132786 - RNA, 16 nt, Mycobacterium bovis subsp bovis AF2122/97
aucgagcugaccuggu

SEQ ID NO: 3132787 - RNA, 20 nt, Mycobacterium bovis subsp bovis AF2122/97
aucgagcugacgauggccag

SEQ ID NO: 3132788 - RNA, 16 nt, Mycobacterium bovis subsp bovis AF2122/97
aucgaggagaugccga

SEQ ID NO: 3132789 - RNA, 18 nt, Mycobacterium bovis subsp bovis AF2122/97
aucgaggagaugccgacg

SEQ ID NO: 3132790 - RNA, 18 nt, Mycobacterium bovis subsp bovis AF2122/97
aucgaggaguuggugcag

SEQ ID NO: 3132791 - RNA, 23 nt, Mycobacterium bovis subsp bovis AF2122/97
aucgaggccacgccagcucgccg

SEQ ID NO: 3132792 - RNA, 14 nt, Mycobacterium bovis subsp bovis AF2122/97
aucgaggccgacga

SEQ ID NO: 3132793 - RNA, 22 nt, Mycobacterium bovis subsp bovis AF2122/97
aucgagggggacgcugaucgaa

SEQ ID NO: 3132794 - RNA, 12 nt, Mycobacterium bovis subsp bovis AF2122/97
aucgagguugac

SEQ ID NO: 3132795 - RNA, 23 nt, Mycobacterium bovis subsp bovis AF2122/97
aucgagucgcgaacucaugcccg

SEQ ID NO: 3132796 - RNA, 19 nt, Mycobacterium bovis subsp bovis AF2122/97
aucgaguuccgcaucggcc

SEQ ID NO: 3132797 - RNA, 12 nt, Mycobacterium bovis subsp bovis AF2122/97
aucgaguucggc

SEQ ID NO: 3132798 - RNA, 14 nt, Mycobacterium bovis subsp bovis AF2122/97
aucgaguucggccc

SEQ ID NO: 3132799 - RNA, 22 nt, Mycobacterium bovis subsp bovis AF2122/97
aucgaucagcaacucggccacg

SEQ ID NO: 3132800 - RNA, 23 nt, Mycobacterium bovis subsp bovis AF2122/97
aucgaucagcaacucggccacgg

SEQ ID NO: 3132801 - RNA, 23 nt, Mycobacterium bovis subsp bovis AF2122/97
aucgaucgaauuaaagccaccag

SEQ ID NO: 3132802 - RNA, 19 nt, Mycobacterium bovis subsp bovis AF2122/97
aucgaucggaucgaugccu

SEQ ID NO: 3132803 - RNA, 20 nt, Mycobacterium bovis subsp bovis AF2122/97
aucgaucguguacugcuccu

SEQ ID NO: 3132804 - RNA, 17 nt, Mycobacterium bovis subsp bovis AF2122/97
aucgauuccgccgcacu

SEQ ID NO: 3132805 - RNA, 19 nt, Mycobacterium bovis subsp bovis AF2122/97
aucgauugcguagcggguc

SEQ ID NO: 3132806 - RNA, 11 nt, Mycobacterium bovis subsp bovis AF2122/97
aucgauuugga

SEQ ID NO: 3132807 - RNA, 16 nt, Mycobacterium bovis subsp bovis AF2122/97
aucgcaagcgcggcga

SEQ ID NO: 3132808 - RNA, 21 nt, Mycobacterium bovis subsp bovis AF2122/97
aucgcaagcgcggcgaagccg

SEQ ID NO: 3132809 - RNA, 18 nt, Mycobacterium bovis subsp bovis AF2122/97
aucgcaaugaccugcagc

SEQ ID NO: 3132810 - RNA, 20 nt, Mycobacterium bovis subsp bovis AF2122/97
aucgcaaugaccugcagcgc

SEQ ID NO: 3132811 - RNA, 17 nt, Mycobacterium bovis subsp bovis AF2122/97
aucgcaaugggcucaca

SEQ ID NO: 3132812 - RNA, 15 nt, Mycobacterium bovis subsp bovis AF2122/97
aucgcacaccaacac

SEQ ID NO: 3132813 - RNA, 20 nt, Mycobacterium bovis subsp bovis AF2122/97
aucgcacaccaacaccgcgg

SEQ ID NO: 3132814 - RNA, 15 nt, Mycobacterium bovis subsp bovis AF2122/97
aucgcacagcgcgau

SEQ ID NO: 3132815 - RNA, 13 nt, Mycobacterium bovis subsp bovis AF2122/97
aucgcacccacca

SEQ ID NO: 3132816 - RNA, 22 nt, Mycobacterium bovis subsp bovis AF2122/97
aucgcaccgugugggccccgcc

SEQ ID NO: 3132817 - RNA, 14 nt, Mycobacterium bovis subsp bovis AF2122/97
aucgcaccuccggc

SEQ ID NO: 3132818 - RNA, 20 nt, Mycobacterium bovis subsp bovis AF2122/97
aucgcacgaaaucagcccgc

SEQ ID NO: 3132819 - RNA, 13 nt, Mycobacterium bovis subsp bovis AF2122/97
aucgcacgccagc

SEQ ID NO: 3132820 - RNA, 17 nt, Mycobacterium bovis subsp bovis AF2122/97
aucgcacgcugcucgac

SEQ ID NO: 3132821 - RNA, 19 nt, Mycobacterium bovis subsp bovis AF2122/97
aucgcacggaugaugccgg

SEQ ID NO: 3132822 - RNA, 20 nt, Mycobacterium bovis subsp bovis AF2122/97
aucgcagaacggaccucggc

SEQ ID NO: 3132823 - RNA, 21 nt, Mycobacterium bovis subsp bovis AF2122/97
aucgcagaacggaccucggcg

SEQ ID NO: 3132824 - RNA, 19 nt, Mycobacterium bovis subsp bovis AF2122/97
aucgcagacacugcugcgg

SEQ ID NO: 3132825 - RNA, 19 nt, Mycobacterium bovis subsp bovis AF2122/97
aucgcagacggcugccacg

SEQ ID NO: 3132826 - RNA, 17 nt, Mycobacterium bovis subsp bovis AF2122/97
aucgcagauggcgaggu

SEQ ID NO: 3132827 - RNA, 11 nt, Mycobacterium bovis subsp bovis AF2122/97
aucgcaggcac

SEQ ID NO: 3132828 - RNA, 16 nt, Mycobacterium bovis subsp bovis AF2122/97
aucgcaggcaccccga

SEQ ID NO: 3132829 - RNA, 18 nt, Mycobacterium bovis subsp bovis AF2122/97
aucgcaggcaccccgauc

SEQ ID NO: 3132830 - RNA, 21 nt, Mycobacterium bovis subsp bovis AF2122/97
aucgcagggaucaccccggcc

SEQ ID NO: 3132831 - RNA, 13 nt, Mycobacterium bovis subsp bovis AF2122/97
aucgcauccccag

SEQ ID NO: 3132832 - RNA, 16 nt, Mycobacterium bovis subsp bovis AF2122/97
aucgcauccccagcac

SEQ ID NO: 3132833 - RNA, 12 nt, Mycobacterium bovis subsp bovis AF2122/97
aucgcauccgcg

SEQ ID NO: 3132834 - RNA, 14 nt, Mycobacterium bovis subsp bovis AF2122/97
aucgcaucggcggg

SEQ ID NO: 3132835 - RNA, 18 nt, Mycobacterium bovis subsp bovis AF2122/97
aucgcauggucuucgcgg

SEQ ID NO: 3132836 - RNA, 15 nt, Mycobacterium bovis subsp bovis AF2122/97
aucgccaaauccggu

SEQ ID NO: 3132837 - RNA, 15 nt, Mycobacterium bovis subsp bovis AF2122/97
aucgccaaugcccag

SEQ ID NO: 3132838 - RNA, 18 nt, Mycobacterium bovis subsp bovis AF2122/97
aucgccaaugcgggaaac

SEQ ID NO: 3132839 - RNA, 11 nt, Mycobacterium bovis subsp bovis AF2122/97
aucgccacagu

SEQ ID NO: 3132840 - RNA, 13 nt, Mycobacterium bovis subsp bovis AF2122/97
aucgccaccaccc

SEQ ID NO: 3132841 - RNA, 15 nt, Mycobacterium bovis subsp bovis AF2122/97
aucgccaccgcguca

SEQ ID NO: 3132842 - RNA, 13 nt, Mycobacterium bovis subsp bovis AF2122/97
aucgccaccggua

SEQ ID NO: 3132843 - RNA, 19 nt, Mycobacterium bovis subsp bovis AF2122/97
aucgccacgacaggucgcc

SEQ ID NO: 3132844 - RNA, 17 nt, Mycobacterium bovis subsp bovis AF2122/97
aucgccagcgccggcca

SEQ ID NO: 3132845 - RNA, 13 nt, Mycobacterium bovis subsp bovis AF2122/97
aucgccagcggca

SEQ ID NO: 3132846 - RNA, 14 nt, Mycobacterium bovis subsp bovis AF2122/97
aucgccagcggcaa

SEQ ID NO: 3132847 - RNA, 14 nt, Mycobacterium bovis subsp bovis AF2122/97
aucgccaggcccug

SEQ ID NO: 3132848 - RNA, 21 nt, Mycobacterium bovis subsp bovis AF2122/97
aucgccaggcccugaaucuug

SEQ ID NO: 3132849 - RNA, 21 nt, Mycobacterium bovis subsp bovis AF2122/97
aucgccaggccgagcccggug

SEQ ID NO: 3132850 - RNA, 22 nt, Mycobacterium bovis subsp bovis AF2122/97
aucgccaucgguugacccggca

SEQ ID NO: 3132851 - RNA, 20 nt, Mycobacterium bovis subsp bovis AF2122/97
aucgccaucguuucacccgg

SEQ ID NO: 3132852 - RNA, 22 nt, Mycobacterium bovis subsp bovis AF2122/97
aucgccaugauggacagcugcg

SEQ ID NO: 3132853 - RNA, 20 nt, Mycobacterium bovis subsp bovis AF2122/97
aucgccauguaucugggcga

SEQ ID NO: 3132854 - RNA, 15 nt, Mycobacterium bovis subsp bovis AF2122/97
aucgcccaacaacgc

SEQ ID NO: 3132855 - RNA, 19 nt, Mycobacterium bovis subsp bovis AF2122/97
aucgcccaauuucgugccg

SEQ ID NO: 3132856 - RNA, 21 nt, Mycobacterium bovis subsp bovis AF2122/97
aucgcccaauuucgugccgaa

SEQ ID NO: 3132857 - RNA, 17 nt, Mycobacterium bovis subsp bovis AF2122/97
aucgcccauuucggcac

SEQ ID NO: 3132858 - RNA, 21 nt, Mycobacterium bovis subsp bovis AF2122/97
aucgcccgaguugaagaagcc

SEQ ID NO: 3132859 - RNA, 17 nt, Mycobacterium bovis subsp bovis AF2122/97
aucgcccgaugcgccag

SEQ ID NO: 3132860 - RNA, 17 nt, Mycobacterium bovis subsp bovis AF2122/97
aucgcccgcugagcacu

SEQ ID NO: 3132861 - RNA, 13 nt, Mycobacterium bovis subsp bovis AF2122/97
aucgcccggcccc

SEQ ID NO: 3132862 - RNA, 15 nt, Mycobacterium bovis subsp bovis AF2122/97
aucgcccggccccgc

SEQ ID NO: 3132863 - RNA, 16 nt, Mycobacterium bovis subsp bovis AF2122/97
aucgcccggccccgca

SEQ ID NO: 3132864 - RNA, 13 nt, Mycobacterium bovis subsp bovis AF2122/97
aucgcccgggcgg

SEQ ID NO: 3132865 - RNA, 23 nt, Mycobacterium bovis subsp bovis AF2122/97
aucgcccgggcgggauccaccca

SEQ ID NO: 3132866 - RNA, 20 nt, Mycobacterium bovis subsp bovis AF2122/97
aucgcccgguucagcgcugg

SEQ ID NO: 3132867 - RNA, 17 nt, Mycobacterium bovis subsp bovis AF2122/97
aucgcccucgucgcggg

SEQ ID NO: 3132868 - RNA, 23 nt, Mycobacterium bovis subsp bovis AF2122/97
aucgcccucgucgcgggccaccg

SEQ ID NO: 3132869 - RNA, 23 nt, Mycobacterium bovis subsp bovis AF2122/97
aucgcggcggccuccaccacguc

SEQ ID NO: 3132870 - RNA, 22 nt, Mycobacterium bovis subsp bovis AF2122/97
aucgcggcggcgauccggucgg

SEQ ID NO: 3132871 - RNA, 22 nt, Mycobacterium bovis subsp bovis AF2122/97
aucgcggucaaauccagcagcc

SEQ ID NO: 3132872 - RNA, 23 nt, Mycobacterium bovis subsp bovis AF2122/97
aucgcggucaaauccagcagcca

SEQ ID NO: 3132873 - RNA, 14 nt, Mycobacterium bovis subsp bovis AF2122/97
aucgcggucagcgg

SEQ ID NO: 3132874 - RNA, 16 nt, Mycobacterium bovis subsp bovis AF2122/97
aucgcgguccaacagc

SEQ ID NO: 3132875 - RNA, 14 nt, Mycobacterium bovis subsp bovis AF2122/97
aucgcggucgccac

SEQ ID NO: 3132876 - RNA, 16 nt, Mycobacterium bovis subsp bovis AF2122/97
aucgcggugaccggcu

SEQ ID NO: 3132877 - RNA, 14 nt, Mycobacterium bovis subsp bovis AF2122/97
aucgcgguggcggu

SEQ ID NO: 3132878 - RNA, 21 nt, Mycobacterium bovis subsp bovis AF2122/97
aucgcggugggccccgauccc

SEQ ID NO: 3132879 - RNA, 14 nt, Mycobacterium bovis subsp bovis AF2122/97
aucgcggugugccg

SEQ ID NO: 3132880 - RNA, 18 nt, Mycobacterium bovis subsp bovis AF2122/97
aucgcguacguacugcuu

SEQ ID NO: 3132881 - RNA, 17 nt, Mycobacterium bovis subsp bovis AF2122/97
aucgcguagcuggccag

SEQ ID NO: 3132882 - RNA, 15 nt, Mycobacterium bovis subsp bovis AF2122/97
aucgcguccaugcgg

SEQ ID NO: 3132883 - RNA, 21 nt, Mycobacterium bovis subsp bovis AF2122/97
aucgcgucgagcgccggccgc

SEQ ID NO: 3132884 - RNA, 20 nt, Mycobacterium bovis subsp bovis AF2122/97
aucgcgucggcgaugaacag

SEQ ID NO: 3132885 - RNA, 17 nt, Mycobacterium bovis subsp bovis AF2122/97
aucgcgucgggcucggc

SEQ ID NO: 3132886 - RNA, 13 nt, Mycobacterium bovis subsp bovis AF2122/97
aucgcgugcgacg

SEQ ID NO: 3132887 - RNA, 13 nt, Mycobacterium bovis subsp bovis AF2122/97
aucgcgugcugga

SEQ ID NO: 3132888 - RNA, 14 nt, Mycobacterium bovis subsp bovis AF2122/97
aucgcguggaucgc

SEQ ID NO: 3132889 - RNA, 16 nt, Mycobacterium bovis subsp bovis AF2122/97
aucgcguggaucgcgc

SEQ ID NO: 3132890 - RNA, 19 nt, Mycobacterium bovis subsp bovis AF2122/97
aucgcguggcgcaccaccg

SEQ ID NO: 3132891 - RNA, 17 nt, Mycobacterium bovis subsp bovis AF2122/97
aucgcuacgucgaccga

SEQ ID NO: 3132892 - RNA, 21 nt, Mycobacterium bovis subsp bovis AF2122/97
aucgcucauucgugcccgggc

SEQ ID NO: 3132893 - RNA, 14 nt, Mycobacterium bovis subsp bovis AF2122/97
aucgcuccgcggcg

SEQ ID NO: 3132894 - RNA, 19 nt, Mycobacterium bovis subsp bovis AF2122/97
aucgcuccgcggcgcagca

SEQ ID NO: 3132895 - RNA, 17 nt, Mycobacterium bovis subsp bovis AF2122/97
aucgcuccggcccugcc

SEQ ID NO: 3132896 - RNA, 22 nt, Mycobacterium bovis subsp bovis AF2122/97
aucgcuccggcccugccgccgg

SEQ ID NO: 3132897 - RNA, 16 nt, Mycobacterium bovis subsp bovis AF2122/97
aucgcucucggucagu

SEQ ID NO: 3132898 - RNA, 21 nt, Mycobacterium bovis subsp bovis AF2122/97
aucgcucucggucaguuccuc

SEQ ID NO: 3132899 - RNA, 18 nt, Mycobacterium bovis subsp bovis AF2122/97
aucgcucugugucgccga

SEQ ID NO: 3132900 - RNA, 14 nt, Mycobacterium bovis subsp bovis AF2122/97
aucgcugaccgcgu

SEQ ID NO: 3132901 - RNA, 22 nt, Mycobacterium bovis subsp bovis AF2122/97
aucgcugaccgcguagaccagu

SEQ ID NO: 3132902 - RNA, 13 nt, Mycobacterium bovis subsp bovis AF2122/97
aucgcugccagcg

SEQ ID NO: 3132903 - RNA, 19 nt, Mycobacterium bovis subsp bovis AF2122/97
aucgcugccagcggccggg

SEQ ID NO: 3132904 - RNA, 14 nt, Mycobacterium bovis subsp bovis AF2122/97
aucgcugccgccga

SEQ ID NO: 3132905 - RNA, 15 nt, Mycobacterium bovis subsp bovis AF2122/97
aucgcuggccgcgag

SEQ ID NO: 3132906 - RNA, 13 nt, Mycobacterium bovis subsp bovis AF2122/97
aucgcuggcgacc

SEQ ID NO: 3132907 - RNA, 15 nt, Mycobacterium bovis subsp bovis AF2122/97
aucgcuggugaaguc

SEQ ID NO: 3132908 - RNA, 13 nt, Mycobacterium bovis subsp bovis AF2122/97
aucgcuguaggca

SEQ ID NO: 3132909 - RNA, 14 nt, Mycobacterium bovis subsp bovis AF2122/97
aucgcuucgagcau

SEQ ID NO: 3132910 - RNA, 21 nt, Mycobacterium bovis subsp bovis AF2122/97
aucggaaacggagccgagccg

SEQ ID NO: 3132911 - RNA, 23 nt, Mycobacterium bovis subsp bovis AF2122/97
aucggaaccguuugacgcgcucg

SEQ ID NO: 3132912 - RNA, 12 nt, Mycobacterium bovis subsp bovis AF2122/97
aucggaagaaac

SEQ ID NO: 3132913 - RNA, 19 nt, Mycobacterium bovis subsp bovis AF2122/97
aucggacagcgccuggccg

SEQ ID NO: 3132914 - RNA, 16 nt, Mycobacterium bovis subsp bovis AF2122/97
aucggaccgaccggcu

SEQ ID NO: 3132915 - RNA, 21 nt, Mycobacterium bovis subsp bovis AF2122/97
aucggacucggaauucggcgu

SEQ ID NO: 3132916 - RNA, 14 nt, Mycobacterium bovis subsp bovis AF2122/97
aucggagccgucga

SEQ ID NO: 3132917 - RNA, 19 nt, Mycobacterium bovis subsp bovis AF2122/97
aucggaggaaccccgcgcg

SEQ ID NO: 3132918 - RNA, 23 nt, Mycobacterium bovis subsp bovis AF2122/97
aucggagucuucaacgucgagau

SEQ ID NO: 3132919 - RNA, 14 nt, Mycobacterium bovis subsp bovis AF2122/97
aucggaugaccagu

SEQ ID NO: 3132920 - RNA, 17 nt, Mycobacterium bovis subsp bovis AF2122/97
aucggauggcggccaca

SEQ ID NO: 3132921 - RNA, 18 nt, Mycobacterium bovis subsp bovis AF2122/97
aucggauugcagaauccg

SEQ ID NO: 3132922 - RNA, 17 nt, Mycobacterium bovis subsp bovis AF2122/97
aucggauuuuccgccug

SEQ ID NO: 3132923 - RNA, 15 nt, Mycobacterium bovis subsp bovis AF2122/97
aucggcaaucagguc

SEQ ID NO: 3132924 - RNA, 22 nt, Mycobacterium bovis subsp bovis AF2122/97
aucggcacaggcggccagcauc

SEQ ID NO: 3132925 - RNA, 23 nt, Mycobacterium bovis subsp bovis AF2122/97
aucggcaccccacgccugccgaa

SEQ ID NO: 3132926 - RNA, 13 nt, Mycobacterium bovis subsp bovis AF2122/97
aucggcaccccgg

SEQ ID NO: 3132927 - RNA, 15 nt, Mycobacterium bovis subsp bovis AF2122/97
aucggcaccgucucg

SEQ ID NO: 3132928 - RNA, 14 nt, Mycobacterium bovis subsp bovis AF2122/97
aucggcaccgugcg

SEQ ID NO: 3132929 - RNA, 20 nt, Mycobacterium bovis subsp bovis AF2122/97
aucggcacuagcgagccggc

SEQ ID NO: 3132930 - RNA, 17 nt, Mycobacterium bovis subsp bovis AF2122/97
aucggcagaauccgguc

SEQ ID NO: 3132931 - RNA, 13 nt, Mycobacterium bovis subsp bovis AF2122/97
aucggcagcagcg

SEQ ID NO: 3132932 - RNA, 12 nt, Mycobacterium bovis subsp bovis AF2122/97
aucggcagcagg

SEQ ID NO: 3132933 - RNA, 20 nt, Mycobacterium bovis subsp bovis AF2122/97
aucggcagccccugccgauc

SEQ ID NO: 3132934 - RNA, 20 nt, Mycobacterium bovis subsp bovis AF2122/97
aucggcagcguggacaucgg

SEQ ID NO: 3132935 - RNA, 18 nt, Mycobacterium bovis subsp bovis AF2122/97
aucggcaggguggccagc

SEQ ID NO: 3132936 - RNA, 17 nt, Mycobacterium bovis subsp bovis AF2122/97
aucggcagucccagcgc

SEQ ID NO: 3132937 - RNA, 20 nt, Mycobacterium bovis subsp bovis AF2122/97
aucggcagucccagcgccgc

SEQ ID NO: 3132938 - RNA, 23 nt, Mycobacterium bovis subsp bovis AF2122/97
aucggcagucccagcgccgcaca

SEQ ID NO: 3132939 - RNA, 15 nt, Mycobacterium bovis subsp bovis AF2122/97
aucggcauacccauc

SEQ ID NO: 3132940 - RNA, 17 nt, Mycobacterium bovis subsp bovis AF2122/97
aucggcauacccaucaa

SEQ ID NO: 3132941 - RNA, 22 nt, Mycobacterium bovis subsp bovis AF2122/97
aucggcauacccaucaacaucg

SEQ ID NO: 3132942 - RNA, 19 nt, Mycobacterium bovis subsp bovis AF2122/97
aucggcaucgacugccagc

SEQ ID NO: 3132943 - RNA, 13 nt, Mycobacterium bovis subsp bovis AF2122/97
aucggcaucggcg

SEQ ID NO: 3132944 - RNA, 17 nt, Mycobacterium bovis subsp bovis AF2122/97
aucggcaucggcgacga

SEQ ID NO: 3132945 - RNA, 19 nt, Mycobacterium bovis subsp bovis AF2122/97
aucggcaucggcgacgaac

SEQ ID NO: 3132946 - RNA, 21 nt, Mycobacterium bovis subsp bovis AF2122/97
aucggcauguuccuugcggcc

SEQ ID NO: 3132947 - RNA, 15 nt, Mycobacterium bovis subsp bovis AF2122/97
aucggccaacagguc

SEQ ID NO: 3132948 - RNA, 13 nt, Mycobacterium bovis subsp bovis AF2122/97
aucggccaccugu

SEQ ID NO: 3132949 - RNA, 18 nt, Mycobacterium bovis subsp bovis AF2122/97
aucggccaccuguuggca

SEQ ID NO: 3132950 - RNA, 20 nt, Mycobacterium bovis subsp bovis AF2122/97
aucggccacgucccagagaa

SEQ ID NO: 3132951 - RNA, 18 nt, Mycobacterium bovis subsp bovis AF2122/97
aucggccacuugacaggc

SEQ ID NO: 3132952 - RNA, 14 nt, Mycobacterium bovis subsp bovis AF2122/97
aucggccagcuuga

SEQ ID NO: 3132953 - RNA, 20 nt, Mycobacterium bovis subsp bovis AF2122/97
aucggccaucaugagcgacc

SEQ ID NO: 3132954 - RNA, 17 nt, Mycobacterium bovis subsp bovis AF2122/97
aucggccaucucgucga

SEQ ID NO: 3132955 - RNA, 15 nt, Mycobacterium bovis subsp bovis AF2122/97
aucggcccgaucacc

SEQ ID NO: 3132956 - RNA, 19 nt, Mycobacterium bovis subsp bovis AF2122/97
aucuccacccgccggccgu

SEQ ID NO: 3132957 - RNA, 13 nt, Mycobacterium bovis subsp bovis AF2122/97
aucuccaccgucg

SEQ ID NO: 3132958 - RNA, 18 nt, Mycobacterium bovis subsp bovis AF2122/97
aucuccaccgucgccgcc

SEQ ID NO: 3132959 - RNA, 19 nt, Mycobacterium bovis subsp bovis AF2122/97
aucuccaccgucgccgccg

SEQ ID NO: 3132960 - RNA, 15 nt, Mycobacterium bovis subsp bovis AF2122/97
aucuccaccuucugg

SEQ ID NO: 3132961 - RNA, 19 nt, Mycobacterium bovis subsp bovis AF2122/97
aucucccauacgccggccg

SEQ ID NO: 3132962 - RNA, 18 nt, Mycobacterium bovis subsp bovis AF2122/97
aucuccccgaccgcgccc

SEQ ID NO: 3132963 - RNA, 22 nt, Mycobacterium bovis subsp bovis AF2122/97
aucuccccgaccgcgcccgcgg

SEQ ID NO: 3132964 - RNA, 17 nt, Mycobacterium bovis subsp bovis AF2122/97
aucuccccguccugcca

SEQ ID NO: 3132965 - RNA, 22 nt, Mycobacterium bovis subsp bovis AF2122/97
aucuccgccgucgccaccggua

SEQ ID NO: 3132966 - RNA, 18 nt, Mycobacterium bovis subsp bovis AF2122/97
aucuccgcgucggucagc

SEQ ID NO: 3132967 - RNA, 21 nt, Mycobacterium bovis subsp bovis AF2122/97
aucuccggcggaucugggcuu

SEQ ID NO: 3132968 - RNA, 20 nt, Mycobacterium bovis subsp bovis AF2122/97
aucuccggcuggcccaccuc

SEQ ID NO: 3132969 - RNA, 19 nt, Mycobacterium bovis subsp bovis AF2122/97
aucuccgggucgaugucgg

SEQ ID NO: 3132970 - RNA, 16 nt, Mycobacterium bovis subsp bovis AF2122/97
aucuccgucggccagg

SEQ ID NO: 3132971 - RNA, 18 nt, Mycobacterium bovis subsp bovis AF2122/97
aucuccuccaccagugcc

SEQ ID NO: 3132972 - RNA, 23 nt, Mycobacterium bovis subsp bovis AF2122/97
aucuccuccuugagccgggcaac

SEQ ID NO: 3132973 - RNA, 21 nt, Mycobacterium bovis subsp bovis AF2122/97
aucuccucgaguugcgcggca

SEQ ID NO: 3132974 - RNA, 23 nt, Mycobacterium bovis subsp bovis AF2122/97
aucuccucuugcaccagggccuc

SEQ ID NO: 3132975 - RNA, 19 nt, Mycobacterium bovis subsp bovis AF2122/97
aucucgaaggccgccaacc

SEQ ID NO: 3132976 - RNA, 16 nt, Mycobacterium bovis subsp bovis AF2122/97
aucucgacaucggcca

SEQ ID NO: 3132977 - RNA, 22 nt, Mycobacterium bovis subsp bovis AF2122/97
aucucgacaucggccagcuuga

SEQ ID NO: 3132978 - RNA, 20 nt, Mycobacterium bovis subsp bovis AF2122/97
aucucgaccucgucggccga

SEQ ID NO: 3132979 - RNA, 17 nt, Mycobacterium bovis subsp bovis AF2122/97
aucucgacggccucguc

SEQ ID NO: 3132980 - RNA, 18 nt, Mycobacterium bovis subsp bovis AF2122/97
aucucgacggccucgucg

SEQ ID NO: 3132981 - RNA, 14 nt, Mycobacterium bovis subsp bovis AF2122/97
aucucgagccgcgg

SEQ ID NO: 3132982 - RNA, 16 nt, Mycobacterium bovis subsp bovis AF2122/97
aucucgagccgcggca

SEQ ID NO: 3132983 - RNA, 16 nt, Mycobacterium bovis subsp bovis AF2122/97
aucucgauuaucgcgc

SEQ ID NO: 3132984 - RNA, 15 nt, Mycobacterium bovis subsp bovis AF2122/97
aucucgcaaggggga

SEQ ID NO: 3132985 - RNA, 17 nt, Mycobacterium bovis subsp bovis AF2122/97
aucucgcaccgcgccgu

SEQ ID NO: 3132986 - RNA, 20 nt, Mycobacterium bovis subsp bovis AF2122/97
aucucgcccaccuccugguu

SEQ ID NO: 3132987 - RNA, 20 nt, Mycobacterium bovis subsp bovis AF2122/97
aucucgccccagugcucauc

SEQ ID NO: 3132988 - RNA, 22 nt, Mycobacterium bovis subsp bovis AF2122/97
aucucgccggcgaagaccgccg

SEQ ID NO: 3132989 - RNA, 22 nt, Mycobacterium bovis subsp bovis AF2122/97
aucucgccguacaucagcgcga

SEQ ID NO: 3132990 - RNA, 22 nt, Mycobacterium bovis subsp bovis AF2122/97
aucucgcgggcccgcgcggcgg

SEQ ID NO: 3132991 - RNA, 13 nt, Mycobacterium bovis subsp bovis AF2122/97
aucucggccagga

SEQ ID NO: 3132992 - RNA, 15 nt, Mycobacterium bovis subsp bovis AF2122/97
aucucggcgaacgcg

SEQ ID NO: 3132993 - RNA, 20 nt, Mycobacterium bovis subsp bovis AF2122/97
aucucggcgagcaccgugcc

SEQ ID NO: 3132994 - RNA, 13 nt, Mycobacterium bovis subsp bovis AF2122/97
aucucggcggcca

SEQ ID NO: 3132995 - RNA, 17 nt, Mycobacterium bovis subsp bovis AF2122/97
aucucggcggccaacag

SEQ ID NO: 3132996 - RNA, 17 nt, Mycobacterium bovis subsp bovis AF2122/97
aucucggcggccgcgug

SEQ ID NO: 3132997 - RNA, 23 nt, Mycobacterium bovis subsp bovis AF2122/97
aucucggcggccgcgugcucgcc

SEQ ID NO: 3132998 - RNA, 20 nt, Mycobacterium bovis subsp bovis AF2122/97
aucucgggcaggccgucgag

SEQ ID NO: 3132999 - RNA, 16 nt, Mycobacterium bovis subsp bovis AF2122/97
aucucggugguggcca

SEQ ID NO: 3133000 - RNA, 16 nt, Mycobacterium bovis subsp bovis AF2122/97
aucucguagccgccgu

SEQ ID NO: 3133001 - RNA, 23 nt, Mycobacterium bovis subsp bovis AF2122/97
aucucguagccgccgucgccggu

SEQ ID NO: 3133002 - RNA, 13 nt, Mycobacterium bovis subsp bovis AF2122/97
aucucgucgaucu

SEQ ID NO: 3133003 - RNA, 15 nt, Mycobacterium bovis subsp bovis AF2122/97
aucucgucgaucucg

SEQ ID NO: 3133004 - RNA, 18 nt, Mycobacterium bovis subsp bovis AF2122/97
aucucgucgaucucgcga

SEQ ID NO: 3133005 - RNA, 21 nt, Mycobacterium bovis subsp bovis AF2122/97
aucucguggaucugccucucg

SEQ ID NO: 3133006 - RNA, 15 nt, Mycobacterium bovis subsp bovis AF2122/97
aucucuugcaaccug

SEQ ID NO: 3133007 - RNA, 21 nt, Mycobacterium bovis subsp bovis AF2122/97
aucugaagagcggagccggcg

SEQ ID NO: 3133008 - RNA, 22 nt, Mycobacterium bovis subsp bovis AF2122/97
aucugaagagcggagccggcgc

SEQ ID NO: 3133009 - RNA, 22 nt, Mycobacterium bovis subsp bovis AF2122/97
aucugaugacgguguggaaacc

SEQ ID NO: 3133010 - RNA, 20 nt, Mycobacterium bovis subsp bovis AF2122/97
aucugcacauucagcgccgc

SEQ ID NO: 3133011 - RNA, 17 nt, Mycobacterium bovis subsp bovis AF2122/97
aucugcacgcgcucgcg

SEQ ID NO: 3133012 - RNA, 23 nt, Mycobacterium bovis subsp bovis AF2122/97
aucugcagcacucggugucggcc

SEQ ID NO: 3133013 - RNA, 16 nt, Mycobacterium bovis subsp bovis AF2122/97
aucugccacguugauc

SEQ ID NO: 3133014 - RNA, 15 nt, Mycobacterium bovis subsp bovis AF2122/97
aucugcccggugauc

SEQ ID NO: 3133015 - RNA, 14 nt, Mycobacterium bovis subsp bovis AF2122/97
aucugccgccgcgg

SEQ ID NO: 3133016 - RNA, 16 nt, Mycobacterium bovis subsp bovis AF2122/97
aucugccgccgcggcc

SEQ ID NO: 3133017 - RNA, 17 nt, Mycobacterium bovis subsp bovis AF2122/97
aucugccgccgcggcca

SEQ ID NO: 3133018 - RNA, 21 nt, Mycobacterium bovis subsp bovis AF2122/97
aucugccgccgcggccacaac

SEQ ID NO: 3133019 - RNA, 13 nt, Mycobacterium bovis subsp bovis AF2122/97
aucugccggccgg

SEQ ID NO: 3133020 - RNA, 17 nt, Mycobacterium bovis subsp bovis AF2122/97
aucugcgacaagaccgg

SEQ ID NO: 3133021 - RNA, 14 nt, Mycobacterium bovis subsp bovis AF2122/97
aucugcgccaucac

SEQ ID NO: 3133022 - RNA, 20 nt, Mycobacterium bovis subsp bovis AF2122/97
aucugcgccgcgcgcggcgu

SEQ ID NO: 3133023 - RNA, 19 nt, Mycobacterium bovis subsp bovis AF2122/97
aucugcgcgucaggccagc

SEQ ID NO: 3133024 - RNA, 22 nt, Mycobacterium bovis subsp bovis AF2122/97
aucugcggaggcgaccccggcc

SEQ ID NO: 3133025 - RNA, 13 nt, Mycobacterium bovis subsp bovis AF2122/97
aucugcggcgccc

SEQ ID NO: 3133026 - RNA, 19 nt, Mycobacterium bovis subsp bovis AF2122/97
aucugcuagcuuggcggcc

SEQ ID NO: 3133027 - RNA, 20 nt, Mycobacterium bovis subsp bovis AF2122/97
aucugcuagcuuggcggcca

SEQ ID NO: 3133028 - RNA, 22 nt, Mycobacterium bovis subsp bovis AF2122/97
aucugcuagcuuggcggccagc

SEQ ID NO: 3133029 - RNA, 13 nt, Mycobacterium bovis subsp bovis AF2122/97
aucugcuccgcag

SEQ ID NO: 3133030 - RNA, 20 nt, Mycobacterium bovis subsp bovis AF2122/97
aucugcuccucggucagcgg

SEQ ID NO: 3133031 - RNA, 18 nt, Mycobacterium bovis subsp bovis AF2122/97
aucugcucggcaucgagc

SEQ ID NO: 3133032 - RNA, 15 nt, Mycobacterium bovis subsp bovis AF2122/97
aucugcuuggugacc

SEQ ID NO: 3133033 - RNA, 17 nt, Mycobacterium bovis subsp bovis AF2122/97
aucuggauggcgcucac

SEQ ID NO: 3133034 - RNA, 20 nt, Mycobacterium bovis subsp bovis AF2122/97
aucuggaugucccaugcacg

SEQ ID NO: 3133035 - RNA, 24 nt, Mycobacterium bovis subsp bovis AF2122/97
aucuggaugucccaugcacggccg

SEQ ID NO: 3133036 - RNA, 23 nt, Mycobacterium bovis subsp bovis AF2122/97
aucuggccgaagcccgaucggcg

SEQ ID NO: 3133037 - RNA, 21 nt, Mycobacterium bovis subsp bovis AF2122/97
aucuggcgcugcuggcagacc

SEQ ID NO: 3133038 - RNA, 16 nt, Mycobacterium bovis subsp bovis AF2122/97
aucuggcggauggccg

SEQ ID NO: 3133039 - RNA, 18 nt, Mycobacterium bovis subsp bovis AF2122/97
aucuggggguagccgccg

SEQ ID NO: 3133040 - RNA, 21 nt, Mycobacterium bovis subsp bovis AF2122/97
aucuggggguagccgccggcg

SEQ ID NO: 3133041 - RNA, 22 nt, Mycobacterium bovis subsp bovis AF2122/97
aucuggggguagccgccggcgc

SEQ ID NO: 3133042 - RNA, 12 nt, Mycobacterium bovis subsp bovis AF2122/97
augagcccagcc

SEQ ID NO: 3133043 - RNA, 16 nt, Mycobacterium bovis subsp bovis AF2122/97
augagccggcgccgcc

SEQ ID NO: 3133044 - RNA, 21 nt, Mycobacterium bovis subsp bovis AF2122/97
augagccgggugcgagcgaca

SEQ ID NO: 3133045 - RNA, 16 nt, Mycobacterium bovis subsp bovis AF2122/97
augagcgccacgccga

SEQ ID NO: 3133046 - RNA, 14 nt, Mycobacterium bovis subsp bovis AF2122/97
augagcgcgaagua

SEQ ID NO: 3133047 - RNA, 15 nt, Mycobacterium bovis subsp bovis AF2122/97
augagcgcgaaguac

SEQ ID NO: 3133048 - RNA, 20 nt, Mycobacterium bovis subsp bovis AF2122/97
augagcgcgcccaaccuggg

SEQ ID NO: 3133049 - RNA, 13 nt, Mycobacterium bovis subsp bovis AF2122/97
augagcgcucggg

SEQ ID NO: 3133050 - RNA, 16 nt, Mycobacterium bovis subsp bovis AF2122/97
augagcggcgcggcaa

SEQ ID NO: 3133051 - RNA, 18 nt, Mycobacterium bovis subsp bovis AF2122/97
augagcgugccgcagcgg

SEQ ID NO: 3133052 - RNA, 14 nt, Mycobacterium bovis subsp bovis AF2122/97
augagcucggccau

SEQ ID NO: 3133053 - RNA, 23 nt, Mycobacterium bovis subsp bovis AF2122/97
augaggcugccgaaguugaagaa

SEQ ID NO: 3133054 - RNA, 13 nt, Mycobacterium bovis subsp bovis AF2122/97
augaggucaacgc

SEQ ID NO: 3133055 - RNA, 23 nt, Mycobacterium bovis subsp bovis AF2122/97
augagguucaucgccggcgcgcc

SEQ ID NO: 3133056 - RNA, 16 nt, Mycobacterium bovis subsp bovis AF2122/97
augauagcggcgcagc

SEQ ID NO: 3133057 - RNA, 15 nt, Mycobacterium bovis subsp bovis AF2122/97
augaucacaccgagc

SEQ ID NO: 3133058 - RNA, 13 nt, Mycobacterium bovis subsp bovis AF2122/97
augaucaugaacg

SEQ ID NO: 3133059 - RNA, 15 nt, Mycobacterium bovis subsp bovis AF2122/97
augaucccgccaccg

SEQ ID NO: 3133060 - RNA, 15 nt, Mycobacterium bovis subsp bovis AF2122/97
augauccgccggcaa

SEQ ID NO: 3133061 - RNA, 15 nt, Mycobacterium bovis subsp bovis AF2122/97
augaucgaacacggc

SEQ ID NO: 3133062 - RNA, 22 nt, Mycobacterium bovis subsp bovis AF2122/97
augaucgcaccgagguugcgcg

SEQ ID NO: 3133063 - RNA, 14 nt, Mycobacterium bovis subsp bovis AF2122/97
augaucucaccacg

SEQ ID NO: 3133064 - RNA, 15 nt, Mycobacterium bovis subsp bovis AF2122/97
augaucucacccagc

SEQ ID NO: 3133065 - RNA, 17 nt, Mycobacterium bovis subsp bovis AF2122/97
augaucucggcaaggac

SEQ ID NO: 3133066 - RNA, 20 nt, Mycobacterium bovis subsp bovis AF2122/97
augaucucggcgaacgcgaa

SEQ ID NO: 3133067 - RNA, 15 nt, Mycobacterium bovis subsp bovis AF2122/97
augaucuggugcgcg

SEQ ID NO: 3133068 - RNA, 22 nt, Mycobacterium bovis subsp bovis AF2122/97
augaucuugccacuccaggagc

SEQ ID NO: 3133069 - RNA, 15 nt, Mycobacterium bovis subsp bovis AF2122/97
augaugaacagacgc

SEQ ID NO: 3133070 - RNA, 13 nt, Mycobacterium bovis subsp bovis AF2122/97
augaugaccggca

SEQ ID NO: 3133071 - RNA, 19 nt, Mycobacterium bovis subsp bovis AF2122/97
augaugccacccucggugu

SEQ ID NO: 3133072 - RNA, 10 nt, Mycobacterium bovis subsp bovis AF2122/97
augaugccgg

SEQ ID NO: 3133073 - RNA, 13 nt, Mycobacterium bovis subsp bovis AF2122/97
augaugccggcgu

SEQ ID NO: 3133074 - RNA, 13 nt, Mycobacterium bovis subsp bovis AF2122/97
augaugccggugu

SEQ ID NO: 3133075 - RNA, 22 nt, Mycobacterium bovis subsp bovis AF2122/97
augaugccgucgucgucgcugu

SEQ ID NO: 3133076 - RNA, 13 nt, Mycobacterium bovis subsp bovis AF2122/97
augaugcucgaug

SEQ ID NO: 3133077 - RNA, 18 nt, Mycobacterium bovis subsp bovis AF2122/97
augauggacaccagccag

SEQ ID NO: 3133078 - RNA, 15 nt, Mycobacterium bovis subsp bovis AF2122/97
augauggccgcggcu

SEQ ID NO: 3133079 - RNA, 23 nt, Mycobacterium bovis subsp bovis AF2122/97
augauggccgucagccaggugcc

SEQ ID NO: 3133080 - RNA, 15 nt, Mycobacterium bovis subsp bovis AF2122/97
augauggcgcgaucg

SEQ ID NO: 3133081 - RNA, 16 nt, Mycobacterium bovis subsp bovis AF2122/97
augauggcgcgaucgg

SEQ ID NO: 3133082 - RNA, 19 nt, Mycobacterium bovis subsp bovis AF2122/97
augauggcuccggccgcgu

SEQ ID NO: 3133083 - RNA, 16 nt, Mycobacterium bovis subsp bovis AF2122/97
augauguccucccauc

SEQ ID NO: 3133084 - RNA, 16 nt, Mycobacterium bovis subsp bovis AF2122/97
augauguugaaacacc

SEQ ID NO: 3133085 - RNA, 20 nt, Mycobacterium bovis subsp bovis AF2122/97
augauguugagcuggaccuc

SEQ ID NO: 3133086 - RNA, 18 nt, Mycobacterium bovis subsp bovis AF2122/97
augauguuuuccccgccc

SEQ ID NO: 3133087 - RNA, 17 nt, Mycobacterium bovis subsp bovis AF2122/97
augauucacgcucggcg

SEQ ID NO: 3133088 - RNA, 19 nt, Mycobacterium bovis subsp bovis AF2122/97
augauuucgucgaucggcu

SEQ ID NO: 3133089 - RNA, 14 nt, Mycobacterium bovis subsp bovis AF2122/97
augcaacaccgcac

SEQ ID NO: 3133090 - RNA, 17 nt, Mycobacterium bovis subsp bovis AF2122/97
augcaacaccgcaccgg

SEQ ID NO: 3133091 - RNA, 15 nt, Mycobacterium bovis subsp bovis AF2122/97
augcaacccggugau

SEQ ID NO: 3133092 - RNA, 16 nt, Mycobacterium bovis subsp bovis AF2122/97
augcaacgccaaaaug

SEQ ID NO: 3133093 - RNA, 16 nt, Mycobacterium bovis subsp bovis AF2122/97
augcaacucggcagau

SEQ ID NO: 3133094 - RNA, 18 nt, Mycobacterium bovis subsp bovis AF2122/97
augcaagccgacaucggc

SEQ ID NO: 3133095 - RNA, 20 nt, Mycobacterium bovis subsp bovis AF2122/97
augcaaggaaaagccuggcc

SEQ ID NO: 3133096 - RNA, 16 nt, Mycobacterium bovis subsp bovis AF2122/97
augcacaaccgcugcu

SEQ ID NO: 3133097 - RNA, 16 nt, Mycobacterium bovis subsp bovis AF2122/97
augcaccccaugaccg

SEQ ID NO: 3133098 - RNA, 19 nt, Mycobacterium bovis subsp bovis AF2122/97
augcaccccaugaccggga

SEQ ID NO: 3133099 - RNA, 18 nt, Mycobacterium bovis subsp bovis AF2122/97
augcacccgcaccgguga

SEQ ID NO: 3133100 - RNA, 12 nt, Mycobacterium bovis subsp bovis AF2122/97
augcacccggua

SEQ ID NO: 3133101 - RNA, 15 nt, Mycobacterium bovis subsp bovis AF2122/97
augcaccgaugccga

SEQ ID NO: 3133102 - RNA, 22 nt, Mycobacterium bovis subsp bovis AF2122/97
augcaccguuguaugcugcgcg

SEQ ID NO: 3133103 - RNA, 17 nt, Mycobacterium bovis subsp bovis AF2122/97
augcaccucgcccugca

SEQ ID NO: 3133104 - RNA, 20 nt, Mycobacterium bovis subsp bovis AF2122/97
augcaccucgcccugcagac

SEQ ID NO: 3133105 - RNA, 14 nt, Mycobacterium bovis subsp bovis AF2122/97
augcacgaucgcca

SEQ ID NO: 3133106 - RNA, 17 nt, Mycobacterium bovis subsp bovis AF2122/97
augcacgcccaggcgac

SEQ ID NO: 3133107 - RNA, 18 nt, Mycobacterium bovis subsp bovis AF2122/97
augcacgucaucggcugg

SEQ ID NO: 3133108 - RNA, 21 nt, Mycobacterium bovis subsp bovis AF2122/97
augcacgucaucggcuggccg

SEQ ID NO: 3133109 - RNA, 20 nt, Mycobacterium bovis subsp bovis AF2122/97
augcagccccacuucgggcg

SEQ ID NO: 3133110 - RNA, 21 nt, Mycobacterium bovis subsp bovis AF2122/97
augcagcgguccagacaucag

SEQ ID NO: 3133111 - RNA, 15 nt, Mycobacterium bovis subsp bovis AF2122/97
augcaggacucgcgu

SEQ ID NO: 3133112 - RNA, 20 nt, Mycobacterium bovis subsp bovis AF2122/97
augcagggcccgcaacaucg

SEQ ID NO: 3133113 - RNA, 22 nt, Mycobacterium bovis subsp bovis AF2122/97
augcagggcccgcaacaucggg

SEQ ID NO: 3133114 - RNA, 24 nt, Mycobacterium bovis subsp bovis AF2122/97
augcagggcccgcaacaucggguc

SEQ ID NO: 3133115 - RNA, 16 nt, Mycobacterium bovis subsp bovis AF2122/97
augcagguggagugca

SEQ ID NO: 3133116 - RNA, 20 nt, Mycobacterium bovis subsp bovis AF2122/97
augcaguaucgaggccgacg

SEQ ID NO: 3133117 - RNA, 16 nt, Mycobacterium bovis subsp bovis AF2122/97
augcagugacagugcg

SEQ ID NO: 3133118 - RNA, 16 nt, Mycobacterium bovis subsp bovis AF2122/97
augcauccagcugcug

SEQ ID NO: 3133119 - RNA, 23 nt, Mycobacterium bovis subsp bovis AF2122/97
augcaucgcaacgagucuuucca

SEQ ID NO: 3133120 - RNA, 16 nt, Mycobacterium bovis subsp bovis AF2122/97
augcaucgcggcggcg

SEQ ID NO: 3133121 - RNA, 17 nt, Mycobacterium bovis subsp bovis AF2122/97
augccaagcuccaacca

SEQ ID NO: 3133122 - RNA, 22 nt, Mycobacterium bovis subsp bovis AF2122/97
augccacacacugccggacagc

SEQ ID NO: 3133123 - RNA, 14 nt, Mycobacterium bovis subsp bovis AF2122/97
augccacaucguuc

SEQ ID NO: 3133124 - RNA, 14 nt, Mycobacterium bovis subsp bovis AF2122/97
augccaccgagcaa

SEQ ID NO: 3133125 - RNA, 16 nt, Mycobacterium bovis subsp bovis AF2122/97
augccaccgcggccgc

SEQ ID NO: 3133126 - RNA, 23 nt, Mycobacterium bovis subsp bovis AF2122/97
augccacgucccaggacuccggc

SEQ ID NO: 3133127 - RNA, 20 nt, Mycobacterium bovis subsp bovis AF2122/97
augccacuaggaagguggcc

SEQ ID NO: 3133128 - RNA, 16 nt, Mycobacterium bovis subsp bovis AF2122/97
augccagcggcacacc

SEQ ID NO: 3133129 - RNA, 18 nt, Mycobacterium bovis subsp bovis AF2122/97
augcgacagcgcugggcc

SEQ ID NO: 3133130 - RNA, 21 nt, Mycobacterium bovis subsp bovis AF2122/97
augcgacccgcagaccgccac

SEQ ID NO: 3133131 - RNA, 11 nt, Mycobacterium bovis subsp bovis AF2122/97
augcgaccgcc

SEQ ID NO: 3133132 - RNA, 15 nt, Mycobacterium bovis subsp bovis AF2122/97
augcgaccgccggac

SEQ ID NO: 3133133 - RNA, 15 nt, Mycobacterium bovis subsp bovis AF2122/97
augcgagcgcgccgg

SEQ ID NO: 3133134 - RNA, 18 nt, Mycobacterium bovis subsp bovis AF2122/97
augcgagcgcgccggcca

SEQ ID NO: 3133135 - RNA, 23 nt, Mycobacterium bovis subsp bovis AF2122/97
augcgauaacccgcaucggaauc

SEQ ID NO: 3133136 - RNA, 20 nt, Mycobacterium bovis subsp bovis AF2122/97
augcgaucgacgauccacuu

SEQ ID NO: 3133137 - RNA, 12 nt, Mycobacterium bovis subsp bovis AF2122/97
augcgaugcggu

SEQ ID NO: 3133138 - RNA, 16 nt, Mycobacterium bovis subsp bovis AF2122/97
augcgauggccgacgc

SEQ ID NO: 3133139 - RNA, 19 nt, Mycobacterium bovis subsp bovis AF2122/97
augcgauuccgcgucugcu

SEQ ID NO: 3133140 - RNA, 20 nt, Mycobacterium bovis subsp bovis AF2122/97
augcgauuccgcgucugcuc

SEQ ID NO: 3133141 - RNA, 21 nt, Mycobacterium bovis subsp bovis AF2122/97
augcgauucugcguccugcuc

SEQ ID NO: 3133142 - RNA, 17 nt, Mycobacterium bovis subsp bovis AF2122/97
augcgauucugcgucug

SEQ ID NO: 3133143 - RNA, 15 nt, Mycobacterium bovis subsp bovis AF2122/97
augcgauugccgucg

SEQ ID NO: 3133144 - RNA, 16 nt, Mycobacterium bovis subsp bovis AF2122/97
augcgcaaccgcggcc

SEQ ID NO: 3133145 - RNA, 14 nt, Mycobacterium bovis subsp bovis AF2122/97
augcgcaccagcac

SEQ ID NO: 3133146 - RNA, 17 nt, Mycobacterium bovis subsp bovis AF2122/97
augcgcaccagcaccug

SEQ ID NO: 3133147 - RNA, 17 nt, Mycobacterium bovis subsp bovis AF2122/97
augcgcaccagcggcug

SEQ ID NO: 3133148 - RNA, 20 nt, Mycobacterium bovis subsp bovis AF2122/97
augcgcacucuagccgggug

SEQ ID NO: 3133149 - RNA, 16 nt, Mycobacterium bovis subsp bovis AF2122/97
augcgccagcgagcgc

SEQ ID NO: 3133150 - RNA, 16 nt, Mycobacterium bovis subsp bovis AF2122/97
augcgccgcacggcga

SEQ ID NO: 3133151 - RNA, 17 nt, Mycobacterium bovis subsp bovis AF2122/97
augcgccgcacggcgac

SEQ ID NO: 3133152 - RNA, 12 nt, Mycobacterium bovis subsp bovis AF2122/97
augcgcgaucgu

SEQ ID NO: 3133153 - RNA, 13 nt, Mycobacterium bovis subsp bovis AF2122/97
augcgcgccggcu

SEQ ID NO: 3133154 - RNA, 11 nt, Mycobacterium bovis subsp bovis AF2122/97
augcgcggcgg

SEQ ID NO: 3133155 - RNA, 17 nt, Mycobacterium bovis subsp bovis AF2122/97
augcgcggugaccgggu

SEQ ID NO: 3133156 - RNA, 14 nt, Mycobacterium bovis subsp bovis AF2122/97
augcgcguccccag

SEQ ID NO: 3133157 - RNA, 16 nt, Mycobacterium bovis subsp bovis AF2122/97
augcgcguccccagcg

SEQ ID NO: 3133158 - RNA, 21 nt, Mycobacterium bovis subsp bovis AF2122/97
augcgcguuacccaucgccac

SEQ ID NO: 3133159 - RNA, 14 nt, Mycobacterium bovis subsp bovis AF2122/97
augcgcucacugca

SEQ ID NO: 3133160 - RNA, 18 nt, Mycobacterium bovis subsp bovis AF2122/97
augcgcucacugcagcgc

SEQ ID NO: 3133161 - RNA, 19 nt, Mycobacterium bovis subsp bovis AF2122/97
augcgcucacugcagcgcc

SEQ ID NO: 3133162 - RNA, 19 nt, Mycobacterium bovis subsp bovis AF2122/97
augcgcucggccugcugcu

SEQ ID NO: 3133163 - RNA, 15 nt, Mycobacterium bovis subsp bovis AF2122/97
augcgcugccgccgu

SEQ ID NO: 3133164 - RNA, 20 nt, Mycobacterium bovis subsp bovis AF2122/97
augcgcugcucacgcagcag

SEQ ID NO: 3133165 - RNA, 16 nt, Mycobacterium bovis subsp bovis AF2122/97
augcgcuggcgccgcc

SEQ ID NO: 3133166 - RNA, 18 nt, Mycobacterium bovis subsp bovis AF2122/97
augcgcuggcgccgccgg

SEQ ID NO: 3133167 - RNA, 12 nt, Mycobacterium bovis subsp bovis AF2122/97
augcgcugggcc

SEQ ID NO: 3133168 - RNA, 22 nt, Mycobacterium bovis subsp bovis AF2122/97
augcgcugucgcccucgaucgc

SEQ ID NO: 3133169 - RNA, 18 nt, Mycobacterium bovis subsp bovis AF2122/97
augcgcuuccaucgccac

SEQ ID NO: 3133170 - RNA, 15 nt, Mycobacterium bovis subsp bovis AF2122/97
augcggaaaucggac

SEQ ID NO: 3133171 - RNA, 21 nt, Mycobacterium bovis subsp bovis AF2122/97
augcggaacgccgagcacgcc

SEQ ID NO: 3133172 - RNA, 22 nt, Mycobacterium bovis subsp bovis AF2122/97
augcggcaggugcccaucgggu

SEQ ID NO: 3133173 - RNA, 14 nt, Mycobacterium bovis subsp bovis AF2122/97
augcggccccgaca

SEQ ID NO: 3133174 - RNA, 20 nt, Mycobacterium bovis subsp bovis AF2122/97
augcggcccggguggcccgg

SEQ ID NO: 3133175 - RNA, 23 nt, Mycobacterium bovis subsp bovis AF2122/97
augcggccgcggaugcucagguc

SEQ ID NO: 3133176 - RNA, 13 nt, Mycobacterium bovis subsp bovis AF2122/97
augcggccggaug

SEQ ID NO: 3133177 - RNA, 22 nt, Mycobacterium bovis subsp bovis AF2122/97
augcggccggauguugaccggc

SEQ ID NO: 3133178 - RNA, 23 nt, Mycobacterium bovis subsp bovis AF2122/97
augcggcggcgcucgucgaucuc

SEQ ID NO: 3133179 - RNA, 14 nt, Mycobacterium bovis subsp bovis AF2122/97
augcgggcagcgau

SEQ ID NO: 3133180 - RNA, 16 nt, Mycobacterium bovis subsp bovis AF2122/97
augcgggccgccaggc

SEQ ID NO: 3133181 - RNA, 17 nt, Mycobacterium bovis subsp bovis AF2122/97
augcgggccgccaggcg

SEQ ID NO: 3133182 - RNA, 19 nt, Mycobacterium bovis subsp bovis AF2122/97
augcgggccgccaggcggc

SEQ ID NO: 3133183 - RNA, 21 nt, Mycobacterium bovis subsp bovis AF2122/97
augcgggccgccaggcggccg

SEQ ID NO: 3133184 - RNA, 19 nt, Mycobacterium bovis subsp bovis AF2122/97
augcgggcgaucucgaugu

SEQ ID NO: 3133185 - RNA, 12 nt, Mycobacterium bovis subsp bovis AF2122/97
augcgggcuggg

SEQ ID NO: 3133186 - RNA, 21 nt, Mycobacterium bovis subsp bovis AF2122/97
augcgggcugugaacagcgcg

SEQ ID NO: 3133187 - RNA, 22 nt, Mycobacterium bovis subsp bovis AF2122/97
augcgggcugugaacagcgcgu

SEQ ID NO: 3133188 - RNA, 21 nt, Mycobacterium bovis subsp bovis AF2122/97
augcgggucugacaucggcca

SEQ ID NO: 3133189 - RNA, 16 nt, Mycobacterium bovis subsp bovis AF2122/97
augcgguagucgccga

SEQ ID NO: 3133190 - RNA, 13 nt, Mycobacterium bovis subsp bovis AF2122/97
augcggucccucc

SEQ ID NO: 3133191 - RNA, 17 nt, Mycobacterium bovis subsp bovis AF2122/97
augcgguccucgaucgg

SEQ ID NO: 3133192 - RNA, 21 nt, Mycobacterium bovis subsp bovis AF2122/97
augcggucgucacggaccgcc

SEQ ID NO: 3133193 - RNA, 22 nt, Mycobacterium bovis subsp bovis AF2122/97
augcggugguaggacgccagca

SEQ ID NO: 3133194 - RNA, 19 nt, Mycobacterium bovis subsp bovis AF2122/97
augcgguguagggcggcgu

SEQ ID NO: 3133195 - RNA, 18 nt, Mycobacterium bovis subsp bovis AF2122/97
augcgguuagcagccgcu

SEQ ID NO: 3133196 - RNA, 20 nt, Mycobacterium bovis subsp bovis AF2122/97
augcgguugcauaccgccgg

SEQ ID NO: 3133197 - RNA, 14 nt, Mycobacterium bovis subsp bovis AF2122/97
augcgguuugccgg

SEQ ID NO: 3133198 - RNA, 21 nt, Mycobacterium bovis subsp bovis AF2122/97
augcgguuuggaucacccgcc

SEQ ID NO: 3133199 - RNA, 23 nt, Mycobacterium bovis subsp bovis AF2122/97
augcguagacauuggcuccgaac

SEQ ID NO: 3133200 - RNA, 16 nt, Mycobacterium bovis subsp bovis AF2122/97
augcguagugcggcgu

SEQ ID NO: 3133201 - RNA, 12 nt, Mycobacterium bovis subsp bovis AF2122/97
augcgucugcuc

SEQ ID NO: 3133202 - RNA, 19 nt, Mycobacterium bovis subsp bovis AF2122/97
augcgucugcucgccgggg

SEQ ID NO: 3133203 - RNA, 20 nt, Mycobacterium bovis subsp bovis AF2122/97
augcgugaccagucgcggcg

SEQ ID NO: 3133204 - RNA, 13 nt, Mycobacterium bovis subsp bovis AF2122/97
augcgugccggca

SEQ ID NO: 3133205 - RNA, 23 nt, Mycobacterium bovis subsp bovis AF2122/97
augcgugucuccuuguccugccu

SEQ ID NO: 3133206 - RNA, 18 nt, Mycobacterium bovis subsp bovis AF2122/97
augcucaaugugccgccg

SEQ ID NO: 3133207 - RNA, 11 nt, Mycobacterium bovis subsp bovis AF2122/97
augcucagguc

SEQ ID NO: 3133208 - RNA, 17 nt, Mycobacterium bovis subsp bovis AF2122/97
augcucaggucaccggc

SEQ ID NO: 3133209 - RNA, 20 nt, Mycobacterium bovis subsp bovis AF2122/97
augcucaggucaccggccgc

SEQ ID NO: 3133210 - RNA, 15 nt, Mycobacterium bovis subsp bovis AF2122/97
augcucgacaaccac

SEQ ID NO: 3133211 - RNA, 18 nt, Mycobacterium bovis subsp bovis AF2122/97
augcucgccguugauguc

SEQ ID NO: 3133212 - RNA, 16 nt, Mycobacterium bovis subsp bovis AF2122/97
augcucgucuugggcc

SEQ ID NO: 3133213 - RNA, 18 nt, Mycobacterium bovis subsp bovis AF2122/97
augcucgucuugggccgg

SEQ ID NO: 3133214 - RNA, 20 nt, Mycobacterium bovis subsp bovis AF2122/97
augcucgucuugggccggga

SEQ ID NO: 3133215 - RNA, 12 nt, Mycobacterium bovis subsp bovis AF2122/97
auggcgcgaccg

SEQ ID NO: 3133216 - RNA, 16 nt, Mycobacterium bovis subsp bovis AF2122/97
auggcgcugauggugc

SEQ ID NO: 3133217 - RNA, 23 nt, Mycobacterium bovis subsp bovis AF2122/97
auggcgcugauggugcugcggcg

SEQ ID NO: 3133218 - RNA, 24 nt, Mycobacterium bovis subsp bovis AF2122/97
auggcgcugggauguucgaucagc

SEQ ID NO: 3133219 - RNA, 19 nt, Mycobacterium bovis subsp bovis AF2122/97
auggcggcauagccgaaca

SEQ ID NO: 3133220 - RNA, 23 nt, Mycobacterium bovis subsp bovis AF2122/97
auggcggcauagccgaacagcgg

SEQ ID NO: 3133221 - RNA, 24 nt, Mycobacterium bovis subsp bovis AF2122/97
auggcggcauagccgaacagcgga

SEQ ID NO: 3133222 - RNA, 12 nt, Mycobacterium bovis subsp bovis AF2122/97
auggcggccacc

SEQ ID NO: 3133223 - RNA, 20 nt, Mycobacterium bovis subsp bovis AF2122/97
auggcggccaccgucagcgc

SEQ ID NO: 3133224 - RNA, 21 nt, Mycobacterium bovis subsp bovis AF2122/97
auggcggccaccgucagcgcg

SEQ ID NO: 3133225 - RNA, 15 nt, Mycobacterium bovis subsp bovis AF2122/97
auggcggcgacccgu

SEQ ID NO: 3133226 - RNA, 24 nt, Mycobacterium bovis subsp bovis AF2122/97
auggcggcgcaccuugaccgucgc

SEQ ID NO: 3133227 - RNA, 23 nt, Mycobacterium bovis subsp bovis AF2122/97
auggcggcuucgacgucggcgac

SEQ ID NO: 3133228 - RNA, 19 nt, Mycobacterium bovis subsp bovis AF2122/97
auggcggugggcuuggcgc

SEQ ID NO: 3133229 - RNA, 15 nt, Mycobacterium bovis subsp bovis AF2122/97
auggcgucaagcaca

SEQ ID NO: 3133230 - RNA, 18 nt, Mycobacterium bovis subsp bovis AF2122/97
auggcgucaugaacgauc

SEQ ID NO: 3133231 - RNA, 16 nt, Mycobacterium bovis subsp bovis AF2122/97
auggcgucgccggcac

SEQ ID NO: 3133232 - RNA, 20 nt, Mycobacterium bovis subsp bovis AF2122/97
auggcgucgccggcaccggc

SEQ ID NO: 3133233 - RNA, 15 nt, Mycobacterium bovis subsp bovis AF2122/97
auggcgucgccggcc

SEQ ID NO: 3133234 - RNA, 23 nt, Mycobacterium bovis subsp bovis AF2122/97
auggcgucggccaggaucaaccg

SEQ ID NO: 3133235 - RNA, 15 nt, Mycobacterium bovis subsp bovis AF2122/97
auggcguuugccggc

SEQ ID NO: 3133236 - RNA, 18 nt, Mycobacterium bovis subsp bovis AF2122/97
auggcguuugccggccga

SEQ ID NO: 3133237 - RNA, 18 nt, Mycobacterium bovis subsp bovis AF2122/97
auggcucaccagcuccuc

SEQ ID NO: 3133238 - RNA, 17 nt, Mycobacterium bovis subsp bovis AF2122/97
auggcucacccaggcgc

SEQ ID NO: 3133239 - RNA, 22 nt, Mycobacterium bovis subsp bovis AF2122/97
auggcucacccaggcgccgaug

SEQ ID NO: 3133240 - RNA, 17 nt, Mycobacterium bovis subsp bovis AF2122/97
auggcucacgcuccgcc

SEQ ID NO: 3133241 - RNA, 14 nt, Mycobacterium bovis subsp bovis AF2122/97
auggcucgccgaaa

SEQ ID NO: 3133242 - RNA, 15 nt, Mycobacterium bovis subsp bovis AF2122/97
auggcugagcccgcc

SEQ ID NO: 3133243 - RNA, 20 nt, Mycobacterium bovis subsp bovis AF2122/97
auggcugagcccgccgcgac

SEQ ID NO: 3133244 - RNA, 21 nt, Mycobacterium bovis subsp bovis AF2122/97
auggcugagcccgccgcgacc

SEQ ID NO: 3133245 - RNA, 18 nt, Mycobacterium bovis subsp bovis AF2122/97
auggcuggccagcacgcc

SEQ ID NO: 3133246 - RNA, 23 nt, Mycobacterium bovis subsp bovis AF2122/97
auggcuucgaagcgaucgccggc

SEQ ID NO: 3133247 - RNA, 16 nt, Mycobacterium bovis subsp bovis AF2122/97
auggcuugcucugcgc

SEQ ID NO: 3133248 - RNA, 17 nt, Mycobacterium bovis subsp bovis AF2122/97
auggcuuggaccagcgu

SEQ ID NO: 3133249 - RNA, 23 nt, Mycobacterium bovis subsp bovis AF2122/97
auggcuuggugcccaaggcagac

SEQ ID NO: 3133250 - RNA, 21 nt, Mycobacterium bovis subsp bovis AF2122/97
augggacacaauccacgucgc

SEQ ID NO: 3133251 - RNA, 22 nt, Mycobacterium bovis subsp bovis AF2122/97
augggacacaauccacgucgcg

SEQ ID NO: 3133252 - RNA, 22 nt, Mycobacterium bovis subsp bovis AF2122/97
augggaccuugaucgagcaggg

SEQ ID NO: 3133253 - RNA, 17 nt, Mycobacterium bovis subsp bovis AF2122/97
augggagucgucguguu

SEQ ID NO: 3133254 - RNA, 14 nt, Mycobacterium bovis subsp bovis AF2122/97
augggauaccccuc

SEQ ID NO: 3133255 - RNA, 23 nt, Mycobacterium bovis subsp bovis AF2122/97
augggauucggccagacgcucuu

SEQ ID NO: 3133256 - RNA, 14 nt, Mycobacterium bovis subsp bovis AF2122/97
augggcagccgccc

SEQ ID NO: 3133257 - RNA, 22 nt, Mycobacterium bovis subsp bovis AF2122/97
augggcagccgcccgcccaccu

SEQ ID NO: 3133258 - RNA, 20 nt, Mycobacterium bovis subsp bovis AF2122/97
augggcccagcggccgcgau

SEQ ID NO: 3133259 - RNA, 20 nt, Mycobacterium bovis subsp bovis AF2122/97
augggcgauaaggaccgcgc

SEQ ID NO: 3133260 - RNA, 23 nt, Mycobacterium bovis subsp bovis AF2122/97
augggcgccaucccgccgcccgc

SEQ ID NO: 3133261 - RNA, 18 nt, Mycobacterium bovis subsp bovis AF2122/97
augggcgcguagcucagc

SEQ ID NO: 3133262 - RNA, 20 nt, Mycobacterium bovis subsp bovis AF2122/97
augggcgguuccacgcugcc

SEQ ID NO: 3133263 - RNA, 14 nt, Mycobacterium bovis subsp bovis AF2122/97
augggcuaccgaga

SEQ ID NO: 3133264 - RNA, 19 nt, Mycobacterium bovis subsp bovis AF2122/97
augggcucacacauagcga

SEQ ID NO: 3133265 - RNA, 20 nt, Mycobacterium bovis subsp bovis AF2122/97
augggcugaggaacgccggc

SEQ ID NO: 3133266 - RNA, 15 nt, Mycobacterium bovis subsp bovis AF2122/97
augggguuaggagug

SEQ ID NO: 3133267 - RNA, 21 nt, Mycobacterium bovis subsp bovis AF2122/97
auggguacccgaucacucgga

SEQ ID NO: 3133268 - RNA, 15 nt, Mycobacterium bovis subsp bovis AF2122/97
augggucaccucgga

SEQ ID NO: 3133269 - RNA, 14 nt, Mycobacterium bovis subsp bovis AF2122/97
augggucaggccga

SEQ ID NO: 3133270 - RNA, 22 nt, Mycobacterium bovis subsp bovis AF2122/97
augggucuggcaggccagcaug

SEQ ID NO: 3133271 - RNA, 20 nt, Mycobacterium bovis subsp bovis AF2122/97
augggugaaucgacagguca

SEQ ID NO: 3133272 - RNA, 18 nt, Mycobacterium bovis subsp bovis AF2122/97
augggugagcacgauauu

SEQ ID NO: 3133273 - RNA, 14 nt, Mycobacterium bovis subsp bovis AF2122/97
auggguggccagca

SEQ ID NO: 3133274 - RNA, 19 nt, Mycobacterium bovis subsp bovis AF2122/97
auggguguugcuggccgcg

SEQ ID NO: 3133275 - RNA, 21 nt, Mycobacterium bovis subsp bovis AF2122/97
auggguugacguaggcggcgg

SEQ ID NO: 3133276 - RNA, 21 nt, Mycobacterium bovis subsp bovis AF2122/97
augguacccgcgccgcgcauc

SEQ ID NO: 3133277 - RNA, 17 nt, Mycobacterium bovis subsp bovis AF2122/97
auggucaaugccggccg

SEQ ID NO: 3133278 - RNA, 22 nt, Mycobacterium bovis subsp bovis AF2122/97
auggucaccaagacaccggccu

SEQ ID NO: 3133279 - RNA, 22 nt, Mycobacterium bovis subsp bovis AF2122/97
auggucacccacguugaugaug

SEQ ID NO: 3133280 - RNA, 21 nt, Mycobacterium bovis subsp bovis AF2122/97
auggucaccgucugcaccggc

SEQ ID NO: 3133281 - RNA, 13 nt, Mycobacterium bovis subsp bovis AF2122/97
auggucagcagaa

SEQ ID NO: 3133282 - RNA, 14 nt, Mycobacterium bovis subsp bovis AF2122/97
auggucaggcggcc

SEQ ID NO: 3133283 - RNA, 22 nt, Mycobacterium bovis subsp bovis AF2122/97
augguccagcacaucggcgagc

SEQ ID NO: 3133284 - RNA, 23 nt, Mycobacterium bovis subsp bovis AF2122/97
augguccagcacaucggcgagca

SEQ ID NO: 3133285 - RNA, 13 nt, Mycobacterium bovis subsp bovis AF2122/97
augguccggccgc

SEQ ID NO: 3133286 - RNA, 22 nt, Mycobacterium bovis subsp bovis AF2122/97
auggucgacgaacaccccgggc

SEQ ID NO: 3133287 - RNA, 15 nt, Mycobacterium bovis subsp bovis AF2122/97
auggucgggcggcgu

SEQ ID NO: 3133288 - RNA, 13 nt, Mycobacterium bovis subsp bovis AF2122/97
auggucuccacca

SEQ ID NO: 3133289 - RNA, 18 nt, Mycobacterium bovis subsp bovis AF2122/97
auggugaacgcgaauacc

SEQ ID NO: 3133290 - RNA, 21 nt, Mycobacterium bovis subsp bovis AF2122/97
auggugaauaucucgccguac

SEQ ID NO: 3133291 - RNA, 21 nt, Mycobacterium bovis subsp bovis AF2122/97
auggugaccagcaggccgggc

SEQ ID NO: 3133292 - RNA, 14 nt, Mycobacterium bovis subsp bovis AF2122/97
auggugauggggga

SEQ ID NO: 3133293 - RNA, 20 nt, Mycobacterium bovis subsp bovis AF2122/97
auggugaugggggagccggu

SEQ ID NO: 3133294 - RNA, 15 nt, Mycobacterium bovis subsp bovis AF2122/97
auggugcgcccgccg

SEQ ID NO: 3133295 - RNA, 15 nt, Mycobacterium bovis subsp bovis AF2122/97
auggugcgccgggcg

SEQ ID NO: 3133296 - RNA, 16 nt, Mycobacterium bovis subsp bovis AF2122/97
auggugcgccgggcgu

SEQ ID NO: 3133297 - RNA, 21 nt, Mycobacterium bovis subsp bovis AF2122/97
auggugcgccgggcguccgcc

SEQ ID NO: 3133298 - RNA, 18 nt, Mycobacterium bovis subsp bovis AF2122/97
auggugcggccgcggcga

SEQ ID NO: 3133299 - RNA, 18 nt, Mycobacterium bovis subsp bovis AF2122/97
auggugcggucuggcgac

SEQ ID NO: 3133300 - RNA, 16 nt, Mycobacterium bovis subsp bovis AF2122/97
augugaacgcacccga

SEQ ID NO: 3133301 - RNA, 20 nt, Mycobacterium bovis subsp bovis AF2122/97
augugacaucgggccgccga

SEQ ID NO: 3133302 - RNA, 21 nt, Mycobacterium bovis subsp bovis AF2122/97
augugacaucgggccgccgag

SEQ ID NO: 3133303 - RNA, 22 nt, Mycobacterium bovis subsp bovis AF2122/97
augugcaggacguuugagaccc

SEQ ID NO: 3133304 - RNA, 20 nt, Mycobacterium bovis subsp bovis AF2122/97
augugccgauuggccugcca

SEQ ID NO: 3133305 - RNA, 18 nt, Mycobacterium bovis subsp bovis AF2122/97
augugcgagaagcaggga

SEQ ID NO: 3133306 - RNA, 19 nt, Mycobacterium bovis subsp bovis AF2122/97
augugcggcugcaccggcu

SEQ ID NO: 3133307 - RNA, 21 nt, Mycobacterium bovis subsp bovis AF2122/97
augugcggugaccgugaacgg

SEQ ID NO: 3133308 - RNA, 12 nt, Mycobacterium bovis subsp bovis AF2122/97
auguggccgccg

SEQ ID NO: 3133309 - RNA, 14 nt, Mycobacterium bovis subsp bovis AF2122/97
auguggccgugggu

SEQ ID NO: 3133310 - RNA, 18 nt, Mycobacterium bovis subsp bovis AF2122/97
augugggcgcgucgacaa

SEQ ID NO: 3133311 - RNA, 22 nt, Mycobacterium bovis subsp bovis AF2122/97
auguggggucagugcgggcggc

SEQ ID NO: 3133312 - RNA, 16 nt, Mycobacterium bovis subsp bovis AF2122/97
augugugagucccacg

SEQ ID NO: 3133313 - RNA, 15 nt, Mycobacterium bovis subsp bovis AF2122/97
auguguuugaucacc

SEQ ID NO: 3133314 - RNA, 17 nt, Mycobacterium bovis subsp bovis AF2122/97
auguucaucgcagucau

SEQ ID NO: 3133315 - RNA, 16 nt, Mycobacterium bovis subsp bovis AF2122/97
auguucugcgggggua

SEQ ID NO: 3133316 - RNA, 18 nt, Mycobacterium bovis subsp bovis AF2122/97
auguugaaaaggcgcugg

SEQ ID NO: 3133317 - RNA, 13 nt, Mycobacterium bovis subsp bovis AF2122/97
auguugaccggcu

SEQ ID NO: 3133318 - RNA, 20 nt, Mycobacterium bovis subsp bovis AF2122/97
auguugaucguugugcaccc

SEQ ID NO: 3133319 - RNA, 14 nt, Mycobacterium bovis subsp bovis AF2122/97
auguugcagaacuc

SEQ ID NO: 3133320 - RNA, 15 nt, Mycobacterium bovis subsp bovis AF2122/97
auguugccgccgcgg

SEQ ID NO: 3133321 - RNA, 17 nt, Mycobacterium bovis subsp bovis AF2122/97
auguugccgccgcggcg

SEQ ID NO: 3133322 - RNA, 18 nt, Mycobacterium bovis subsp bovis AF2122/97
auguugcgacggccggca

SEQ ID NO: 3133323 - RNA, 18 nt, Mycobacterium bovis subsp bovis AF2122/97
auguuggcagggccagcg

SEQ ID NO: 3133324 - RNA, 15 nt, Mycobacterium bovis subsp bovis AF2122/97
auguuggccgccaca

SEQ ID NO: 3133325 - RNA, 19 nt, Mycobacterium bovis subsp bovis AF2122/97
auguuggccgccacaccgc

SEQ ID NO: 3133326 - RNA, 11 nt, Mycobacterium bovis subsp bovis AF2122/97
auguuggugau

SEQ ID NO: 3133327 - RNA, 23 nt, Mycobacterium bovis subsp bovis AF2122/97
auguuggugucaaugacaccggg

SEQ ID NO: 3133328 - RNA, 17 nt, Mycobacterium bovis subsp bovis AF2122/97
auguugguuugccggcg

SEQ ID NO: 3133329 - RNA, 19 nt, Mycobacterium bovis subsp bovis AF2122/97
auguuuguguucgccggca

SEQ ID NO: 3133330 - RNA, 16 nt, Mycobacterium bovis subsp bovis AF2122/97
auguuuugcugcaugc

SEQ ID NO: 3133331 - RNA, 17 nt, Mycobacterium bovis subsp bovis AF2122/97
auguuuuuggccgcggu

SEQ ID NO: 3133332 - RNA, 17 nt, Mycobacterium bovis subsp bovis AF2122/97
auuaccggcacgccggc

SEQ ID NO: 3133333 - RNA, 12 nt, Mycobacterium bovis subsp bovis AF2122/97
auuacggugauc

SEQ ID NO: 3133334 - RNA, 16 nt, Mycobacterium bovis subsp bovis AF2122/97
auuacggugaucgccg

SEQ ID NO: 3133335 - RNA, 14 nt, Mycobacterium bovis subsp bovis AF2122/97
auuacuucggccac

SEQ ID NO: 3133336 - RNA, 19 nt, Mycobacterium bovis subsp bovis AF2122/97
auuagcccacccauggccu

SEQ ID NO: 3133337 - RNA, 20 nt, Mycobacterium bovis subsp bovis AF2122/97
auuaggggcuuuugcgucug

SEQ ID NO: 3133338 - RNA, 21 nt, Mycobacterium bovis subsp bovis AF2122/97
auuaguuucguccccagaccg

SEQ ID NO: 3133339 - RNA, 16 nt, Mycobacterium bovis subsp bovis AF2122/97
auucaacagcaccgcg

SEQ ID NO: 3133340 - RNA, 15 nt, Mycobacterium bovis subsp bovis AF2122/97
auucaccacuccggc

SEQ ID NO: 3133341 - RNA, 11 nt, Mycobacterium bovis subsp bovis AF2122/97
auucaccgcgu

SEQ ID NO: 3133342 - RNA, 14 nt, Mycobacterium bovis subsp bovis AF2122/97
auucacgagccgcu

SEQ ID NO: 3133343 - RNA, 16 nt, Mycobacterium bovis subsp bovis AF2122/97
auucacgaugcucgcc

SEQ ID NO: 3133344 - RNA, 14 nt, Mycobacterium bovis subsp bovis AF2122/97
auucacgcaccaca

SEQ ID NO: 3133345 - RNA, 22 nt, Mycobacterium bovis subsp bovis AF2122/97
auucacgcucggcguccgccca

SEQ ID NO: 3133346 - RNA, 19 nt, Mycobacterium bovis subsp bovis AF2122/97
auucagcgguuggacaacg

SEQ ID NO: 3133347 - RNA, 19 nt, Mycobacterium bovis subsp bovis AF2122/97
auucauccaccccugagcu

SEQ ID NO: 3133348 - RNA, 14 nt, Mycobacterium bovis subsp bovis AF2122/97
auucaugccggugu

SEQ ID NO: 3133349 - RNA, 13 nt, Mycobacterium bovis subsp bovis AF2122/97
auucauggcggca

SEQ ID NO: 3133350 - RNA, 13 nt, Mycobacterium bovis subsp bovis AF2122/97
auuccaccgccga

SEQ ID NO: 3133351 - RNA, 20 nt, Mycobacterium bovis subsp bovis AF2122/97
auuccaccgccgacgcccga

SEQ ID NO: 3133352 - RNA, 23 nt, Mycobacterium bovis subsp bovis AF2122/97
auuccaccgccgagaugcugguc

SEQ ID NO: 3133353 - RNA, 16 nt, Mycobacterium bovis subsp bovis AF2122/97
auuccacgaucggcuc

SEQ ID NO: 3133354 - RNA, 15 nt, Mycobacterium bovis subsp bovis AF2122/97
auuccacugggccug

SEQ ID NO: 3133355 - RNA, 16 nt, Mycobacterium bovis subsp bovis AF2122/97
auuccagccagccgcc

SEQ ID NO: 3133356 - RNA, 13 nt, Mycobacterium bovis subsp bovis AF2122/97
auuccagccggug

SEQ ID NO: 3133357 - RNA, 20 nt, Mycobacterium bovis subsp bovis AF2122/97
auuccagccggugccgccgu

SEQ ID NO: 3133358 - RNA, 24 nt, Mycobacterium bovis subsp bovis AF2122/97
auuccagcgcguaguccgcauccg

SEQ ID NO: 3133359 - RNA, 12 nt, Mycobacterium bovis subsp bovis AF2122/97
auucccagucca

SEQ ID NO: 3133360 - RNA, 12 nt, Mycobacterium bovis subsp bovis AF2122/97
auuccccagccg

SEQ ID NO: 3133361 - RNA, 13 nt, Mycobacterium bovis subsp bovis AF2122/97
auuccccagccgc

SEQ ID NO: 3133362 - RNA, 15 nt, Mycobacterium bovis subsp bovis AF2122/97
auuccccagccgcau

SEQ ID NO: 3133363 - RNA, 17 nt, Mycobacterium bovis subsp bovis AF2122/97
auucccgcccagcagca

SEQ ID NO: 3133364 - RNA, 18 nt, Mycobacterium bovis subsp bovis AF2122/97
auucccgccuucucccgc

SEQ ID NO: 3133365 - RNA, 13 nt, Mycobacterium bovis subsp bovis AF2122/97
auucccgcuuggc

SEQ ID NO: 3133366 - RNA, 16 nt, Mycobacterium bovis subsp bovis AF2122/97
auucccuacgccgcca

SEQ ID NO: 3133367 - RNA, 17 nt, Mycobacterium bovis subsp bovis AF2122/97
auuccgaccccgccgag

SEQ ID NO: 3133368 - RNA, 12 nt, Mycobacterium bovis subsp bovis AF2122/97
auuccgcagaga

SEQ ID NO: 3133369 - RNA, 13 nt, Mycobacterium bovis subsp bovis AF2122/97
auuccgcagagac

SEQ ID NO: 3133370 - RNA, 18 nt, Mycobacterium bovis subsp bovis AF2122/97
auuccgcgcguccgucgg

SEQ ID NO: 3133371 - RNA, 17 nt, Mycobacterium bovis subsp bovis AF2122/97
auuccgcgucugcucgg

SEQ ID NO: 3133372 - RNA, 16 nt, Mycobacterium bovis subsp bovis AF2122/97
auuccgcuaccgcaca

SEQ ID NO: 3133373 - RNA, 22 nt, Mycobacterium bovis subsp bovis AF2122/97
auuccgcucacgaagaccgcgu

SEQ ID NO: 3133374 - RNA, 17 nt, Mycobacterium bovis subsp bovis AF2122/97
auuccggcgcggccggc

SEQ ID NO: 3133375 - RNA, 19 nt, Mycobacterium bovis subsp bovis AF2122/97
auuccggcgcggccggccg

SEQ ID NO: 3133376 - RNA, 21 nt, Mycobacterium bovis subsp bovis AF2122/97
auuccggcggagcgggccagc

SEQ ID NO: 3133377 - RNA, 16 nt, Mycobacterium bovis subsp bovis AF2122/97
auuccggcggccacgc

SEQ ID NO: 3133378 - RNA, 17 nt, Mycobacterium bovis subsp bovis AF2122/97
auuccgggugcgaucgc

SEQ ID NO: 3133379 - RNA, 15 nt, Mycobacterium bovis subsp bovis AF2122/97
auuccgguggcaucc

SEQ ID NO: 3133380 - RNA, 12 nt, Mycobacterium bovis subsp bovis AF2122/97
auuccguagccg

SEQ ID NO: 3133381 - RNA, 18 nt, Mycobacterium bovis subsp bovis AF2122/97
auuccguagccggcggug

SEQ ID NO: 3133382 - RNA, 18 nt, Mycobacterium bovis subsp bovis AF2122/97
auuccucaaggucggcca

SEQ ID NO: 3133383 - RNA, 21 nt, Mycobacterium bovis subsp bovis AF2122/97
auuccucaaggucggccaggc

SEQ ID NO: 3133384 - RNA, 16 nt, Mycobacterium bovis subsp bovis AF2122/97
auuccucuguacccca

SEQ ID NO: 3133385 - RNA, 13 nt, Mycobacterium bovis subsp bovis AF2122/97
auuccuugaugcc

SEQ ID NO: 3133386 - RNA, 20 nt, Mycobacterium bovis subsp bovis AF2122/97
auucgaagggguacccgccc

SEQ ID NO: 3133387 - RNA, 14 nt, Mycobacterium bovis subsp bovis AF2122/97
auuggacagcgcga

SEQ ID NO: 3133388 - RNA, 21 nt, Mycobacterium bovis subsp bovis AF2122/97
auuggaccgagacuugcuggc

SEQ ID NO: 3133389 - RNA, 15 nt, Mycobacterium bovis subsp bovis AF2122/97
auuggacgcgcaugc

SEQ ID NO: 3133390 - RNA, 21 nt, Mycobacterium bovis subsp bovis AF2122/97
auuggacgcgcaugccccgac

SEQ ID NO: 3133391 - RNA, 20 nt, Mycobacterium bovis subsp bovis AF2122/97
auuggaugccauaggacagg

SEQ ID NO: 3133392 - RNA, 21 nt, Mycobacterium bovis subsp bovis AF2122/97
auuggcaggcauggcgccguu

SEQ ID NO: 3133393 - RNA, 12 nt, Mycobacterium bovis subsp bovis AF2122/97
auuggcaucgug

SEQ ID NO: 3133394 - RNA, 23 nt, Mycobacterium bovis subsp bovis AF2122/97
auuggccaaccccauggccagcg

SEQ ID NO: 3133395 - RNA, 17 nt, Mycobacterium bovis subsp bovis AF2122/97
auuggcccaccgccguu

SEQ ID NO: 3133396 - RNA, 12 nt, Mycobacterium bovis subsp bovis AF2122/97
auuggcgcagca

SEQ ID NO: 3133397 - RNA, 13 nt, Mycobacterium bovis subsp bovis AF2122/97
auuggcgccgaug

SEQ ID NO: 3133398 - RNA, 14 nt, Mycobacterium bovis subsp bovis AF2122/97
auuggcgccgucac

SEQ ID NO: 3133399 - RNA, 21 nt, Mycobacterium bovis subsp bovis AF2122/97
auuggcgccgucaccgaucga

SEQ ID NO: 3133400 - RNA, 24 nt, Mycobacterium bovis subsp bovis AF2122/97
auuggcgccgucaccgaucgaaca

SEQ ID NO: 3133401 - RNA, 16 nt, Mycobacterium bovis subsp bovis AF2122/97
auuggcgucagcagca

SEQ ID NO: 3133402 - RNA, 17 nt, Mycobacterium bovis subsp bovis AF2122/97
auuggcgucagcagcaa

SEQ ID NO: 3133403 - RNA, 18 nt, Mycobacterium bovis subsp bovis AF2122/97
auuggcgucagcagcaac

SEQ ID NO: 3133404 - RNA, 14 nt, Mycobacterium bovis subsp bovis AF2122/97
auuggcgucgucgc

SEQ ID NO: 3133405 - RNA, 19 nt, Mycobacterium bovis subsp bovis AF2122/97
auuggcugugaucgagucg

SEQ ID NO: 3133406 - RNA, 15 nt, Mycobacterium bovis subsp bovis AF2122/97
auuggcuuagcggcu

SEQ ID NO: 3133407 - RNA, 17 nt, Mycobacterium bovis subsp bovis AF2122/97
auugggaguccggccga

SEQ ID NO: 3133408 - RNA, 20 nt, Mycobacterium bovis subsp bovis AF2122/97
auugggcgauucugcgucug

SEQ ID NO: 3133409 - RNA, 20 nt, Mycobacterium bovis subsp bovis AF2122/97
auugggcgauuuugcgucug

SEQ ID NO: 3133410 - RNA, 13 nt, Mycobacterium bovis subsp bovis AF2122/97
auugguaccggcu

SEQ ID NO: 3133411 - RNA, 17 nt, Mycobacterium bovis subsp bovis AF2122/97
auuggucgagucgauga

SEQ ID NO: 3133412 - RNA, 21 nt, Mycobacterium bovis subsp bovis AF2122/97
auuggugaguagauugcugac

SEQ ID NO: 3133413 - RNA, 18 nt, Mycobacterium bovis subsp bovis AF2122/97
auuggugggccagcagca

SEQ ID NO: 3133414 - RNA, 16 nt, Mycobacterium bovis subsp bovis AF2122/97
auugucaacgaauggu

SEQ ID NO: 3133415 - RNA, 13 nt, Mycobacterium bovis subsp bovis AF2122/97
auuguccggccgg

SEQ ID NO: 3133416 - RNA, 16 nt, Mycobacterium bovis subsp bovis AF2122/97
auugucgaucaccugc

SEQ ID NO: 3133417 - RNA, 21 nt, Mycobacterium bovis subsp bovis AF2122/97
auugugcggccccgucgccga

SEQ ID NO: 3133418 - RNA, 13 nt, Mycobacterium bovis subsp bovis AF2122/97
auugugcucgccg

SEQ ID NO: 3133419 - RNA, 22 nt, Mycobacterium bovis subsp bovis AF2122/97
auugugucccauggugagcugu

SEQ ID NO: 3133420 - RNA, 14 nt, Mycobacterium bovis subsp bovis AF2122/97
auuguugaagaaag

SEQ ID NO: 3133421 - RNA, 16 nt, Mycobacterium bovis subsp bovis AF2122/97
auuuauugagucggcu

SEQ ID NO: 3133422 - RNA, 16 nt, Mycobacterium bovis subsp bovis AF2122/97
auuucaccgaagccau

SEQ ID NO: 3133423 - RNA, 14 nt, Mycobacterium bovis subsp bovis AF2122/97
auuuccaccacgcg

SEQ ID NO: 3133424 - RNA, 21 nt, Mycobacterium bovis subsp bovis AF2122/97
auuuccaccacgcgcguuuag

SEQ ID NO: 3133425 - RNA, 22 nt, Mycobacterium bovis subsp bovis AF2122/97
auuucgacacgaaggucgcggu

SEQ ID NO: 3133426 - RNA, 18 nt, Mycobacterium bovis subsp bovis AF2122/97
auuucgacgagacgaacc

SEQ ID NO: 3133427 - RNA, 12 nt, Mycobacterium bovis subsp bovis AF2122/97
auuucgagcucg

SEQ ID NO: 3133428 - RNA, 17 nt, Mycobacterium bovis subsp bovis AF2122/97
auuucgaucacaucguu

SEQ ID NO: 3133429 - RNA, 17 nt, Mycobacterium bovis subsp bovis AF2122/97
auuucgcgucugcucgc

SEQ ID NO: 3133430 - RNA, 16 nt, Mycobacterium bovis subsp bovis AF2122/97
auuucgcugguggaca

SEQ ID NO: 3133431 - RNA, 20 nt, Mycobacterium bovis subsp bovis AF2122/97
auuucgguaauggccgccgg

SEQ ID NO: 3133432 - RNA, 17 nt, Mycobacterium bovis subsp bovis AF2122/97
auuucgugccgaaaugg

SEQ ID NO: 3133433 - RNA, 19 nt, Mycobacterium bovis subsp bovis AF2122/97
auuucgugucgcugcggcg

SEQ ID NO: 3133434 - RNA, 16 nt, Mycobacterium bovis subsp bovis AF2122/97
auuucguugagaacau

SEQ ID NO: 3133435 - RNA, 20 nt, Mycobacterium bovis subsp bovis AF2122/97
auuucguuggauccacaccc

SEQ ID NO: 3133436 - RNA, 20 nt, Mycobacterium bovis subsp bovis AF2122/97
auuucuagguggacgugcag

SEQ ID NO: 3133437 - RNA, 19 nt, Mycobacterium bovis subsp bovis AF2122/97
auuucugggccgcuccacc

SEQ ID NO: 3133438 - RNA, 13 nt, Mycobacterium bovis subsp bovis AF2122/97
auuugaugagcaa

SEQ ID NO: 3133439 - RNA, 20 nt, Mycobacterium bovis subsp bovis AF2122/97
auuugccccguugagcagca

SEQ ID NO: 3133440 - RNA, 21 nt, Mycobacterium bovis subsp bovis AF2122/97
auuugccccguugagcagcac

SEQ ID NO: 3133441 - RNA, 14 nt, Mycobacterium bovis subsp bovis AF2122/97
auuugggcgagucg

SEQ ID NO: 3133442 - RNA, 14 nt, Mycobacterium bovis subsp bovis AF2122/97
auuugucggcgccu

SEQ ID NO: 3133443 - RNA, 19 nt, Mycobacterium bovis subsp bovis AF2122/97
auuuucacugugccgcugc

SEQ ID NO: 3133444 - RNA, 19 nt, Mycobacterium bovis subsp bovis AF2122/97
auuuucucggggugguggu

SEQ ID NO: 3133445 - RNA, 21 nt, Mycobacterium bovis subsp bovis AF2122/97
auuuugccggauucuccgccc

SEQ ID NO: 3133446 - RNA, 20 nt, Mycobacterium bovis subsp bovis AF2122/97
auuuuggcaagcugccccgc

SEQ ID NO: 3133447 - RNA, 12 nt, Mycobacterium bovis subsp bovis AF2122/97
auuuuggcugca

SEQ ID NO: 3133448 - RNA, 16 nt, Mycobacterium bovis subsp bovis AF2122/97
auuuuucgaccagccc

SEQ ID NO: 3133449 - RNA, 22 nt, Mycobacterium bovis subsp bovis AF2122/97
auuuuuguuguuauuuuuggcc

SEQ ID NO: 3133450 - RNA, 19 nt, Mycobacterium bovis subsp bovis AF2122/97
caaaaaguagcugcggucg

SEQ ID NO: 3133451 - RNA, 20 nt, Mycobacterium bovis subsp bovis AF2122/97
caaaaaucgucggaaucauc

SEQ ID NO: 3133452 - RNA, 16 nt, Mycobacterium bovis subsp bovis AF2122/97
caaaacccgagccugg

SEQ ID NO: 3133453 - RNA, 14 nt, Mycobacterium bovis subsp bovis AF2122/97
caaaacccgcucca

SEQ ID NO: 3133454 - RNA, 18 nt, Mycobacterium bovis subsp bovis AF2122/97
caaaacccgcuccacccc

SEQ ID NO: 3133455 - RNA, 14 nt, Mycobacterium bovis subsp bovis AF2122/97
caaaaccugggaug

SEQ ID NO: 3133456 - RNA, 15 nt, Mycobacterium bovis subsp bovis AF2122/97
caaaacgagcuucca

SEQ ID NO: 3133457 - RNA, 16 nt, Mycobacterium bovis subsp bovis AF2122/97
caaaacggucgaccgu

SEQ ID NO: 3133458 - RNA, 19 nt, Mycobacterium bovis subsp bovis AF2122/97
caaaagcccgguacgccgc

SEQ ID NO: 3133459 - RNA, 14 nt, Mycobacterium bovis subsp bovis AF2122/97
caaaaggaagaccu

SEQ ID NO: 3133460 - RNA, 17 nt, Mycobacterium bovis subsp bovis AF2122/97
caaaaggaucaacgugc

SEQ ID NO: 3133461 - RNA, 16 nt, Mycobacterium bovis subsp bovis AF2122/97
caaaagggcggcagcg

SEQ ID NO: 3133462 - RNA, 15 nt, Mycobacterium bovis subsp bovis AF2122/97
caaaauacuccgcga

SEQ ID NO: 3133463 - RNA, 15 nt, Mycobacterium bovis subsp bovis AF2122/97
caaaaucagcagccc

SEQ ID NO: 3133464 - RNA, 14 nt, Mycobacterium bovis subsp bovis AF2122/97
caaaaucagggugc

SEQ ID NO: 3133465 - RNA, 22 nt, Mycobacterium bovis subsp bovis AF2122/97
caaaaucgcacgguuugcgguu

SEQ ID NO: 3133466 - RNA, 20 nt, Mycobacterium bovis subsp bovis AF2122/97
caaaaucgcccaauucggca

SEQ ID NO: 3133467 - RNA, 15 nt, Mycobacterium bovis subsp bovis AF2122/97
caaaaucgcggccac

SEQ ID NO: 3133468 - RNA, 17 nt, Mycobacterium bovis subsp bovis AF2122/97
caaaaucgucagcgccg

SEQ ID NO: 3133469 - RNA, 19 nt, Mycobacterium bovis subsp bovis AF2122/97
caaaaugccuuggcagccc

SEQ ID NO: 3133470 - RNA, 20 nt, Mycobacterium bovis subsp bovis AF2122/97
caaaauugcuuggccgcgca

SEQ ID NO: 3133471 - RNA, 15 nt, Mycobacterium bovis subsp bovis AF2122/97
caaacaccagcccgg

SEQ ID NO: 3133472 - RNA, 23 nt, Mycobacterium bovis subsp bovis AF2122/97
caaacaccccggccuugccaccg

SEQ ID NO: 3133473 - RNA, 22 nt, Mycobacterium bovis subsp bovis AF2122/97
caaacacccuugcccacggcga

SEQ ID NO: 3133474 - RNA, 19 nt, Mycobacterium bovis subsp bovis AF2122/97
caaacaucgcacccaccac

SEQ ID NO: 3133475 - RNA, 14 nt, Mycobacterium bovis subsp bovis AF2122/97
caaaccaagcgcgc

SEQ ID NO: 3133476 - RNA, 17 nt, Mycobacterium bovis subsp bovis AF2122/97
caaacccaacaccagca

SEQ ID NO: 3133477 - RNA, 14 nt, Mycobacterium bovis subsp bovis AF2122/97
caaacccagcgacg

SEQ ID NO: 3133478 - RNA, 22 nt, Mycobacterium bovis subsp bovis AF2122/97
caaacccgccgacaaaagccag

SEQ ID NO: 3133479 - RNA, 16 nt, Mycobacterium bovis subsp bovis AF2122/97
caaacccggcgggccc

SEQ ID NO: 3133480 - RNA, 21 nt, Mycobacterium bovis subsp bovis AF2122/97
caaacccggcgggcccgccgg

SEQ ID NO: 3133481 - RNA, 14 nt, Mycobacterium bovis subsp bovis AF2122/97
caaacccguugaag

SEQ ID NO: 3133482 - RNA, 21 nt, Mycobacterium bovis subsp bovis AF2122/97
caaacccguugaagacggcca

SEQ ID NO: 3133483 - RNA, 21 nt, Mycobacterium bovis subsp bovis AF2122/97
caaacgacagcccuaucagcc

SEQ ID NO: 3133484 - RNA, 20 nt, Mycobacterium bovis subsp bovis AF2122/97
caaacgacucgcgguggccg

SEQ ID NO: 3133485 - RNA, 21 nt, Mycobacterium bovis subsp bovis AF2122/97
caaacgacucgcgguggccga

SEQ ID NO: 3133486 - RNA, 21 nt, Mycobacterium bovis subsp bovis AF2122/97
caaacgaggauucauggcggc

SEQ ID NO: 3133487 - RNA, 19 nt, Mycobacterium bovis subsp bovis AF2122/97
caaacgcaaagacagcgcg

SEQ ID NO: 3133488 - RNA, 20 nt, Mycobacterium bovis subsp bovis AF2122/97
caaacgcaaagacagcgcgg

SEQ ID NO: 3133489 - RNA, 22 nt, Mycobacterium bovis subsp bovis AF2122/97
caaacgccgcccgccggugauc

SEQ ID NO: 3133490 - RNA, 14 nt, Mycobacterium bovis subsp bovis AF2122/97
caaacggaacagcc

SEQ ID NO: 3133491 - RNA, 18 nt, Mycobacterium bovis subsp bovis AF2122/97
caaacggaauguagccga

SEQ ID NO: 3133492 - RNA, 20 nt, Mycobacterium bovis subsp bovis AF2122/97
caaacggcuuggcugccucc

SEQ ID NO: 3133493 - RNA, 19 nt, Mycobacterium bovis subsp bovis AF2122/97
caaacgggcgugggccgcu

SEQ ID NO: 3133494 - RNA, 20 nt, Mycobacterium bovis subsp bovis AF2122/97
caaacguguugaccgggucg

SEQ ID NO: 3133495 - RNA, 19 nt, Mycobacterium bovis subsp bovis AF2122/97
caaacuaacggcagccacc

SEQ ID NO: 3133496 - RNA, 17 nt, Mycobacterium bovis subsp bovis AF2122/97
caaacuauugcaccguc

SEQ ID NO: 3133497 - RNA, 15 nt, Mycobacterium bovis subsp bovis AF2122/97
caaacuccugcagga

SEQ ID NO: 3133498 - RNA, 19 nt, Mycobacterium bovis subsp bovis AF2122/97
caaacugggaugugccgcg

SEQ ID NO: 3133499 - RNA, 22 nt, Mycobacterium bovis subsp bovis AF2122/97
caaacugggaugugccgcgcac

SEQ ID NO: 3133500 - RNA, 18 nt, Mycobacterium bovis subsp bovis AF2122/97
caaacugggcaccggcgg

SEQ ID NO: 3133501 - RNA, 16 nt, Mycobacterium bovis subsp bovis AF2122/97
caaagaaguggucggc

SEQ ID NO: 3133502 - RNA, 21 nt, Mycobacterium bovis subsp bovis AF2122/97
caaagaaguggucggcccgcu

SEQ ID NO: 3133503 - RNA, 22 nt, Mycobacterium bovis subsp bovis AF2122/97
caaagaauucguucagcgccag

SEQ ID NO: 3133504 - RNA, 22 nt, Mycobacterium bovis subsp bovis AF2122/97
caaagacccgacgccacgcguc

SEQ ID NO: 3133505 - RNA, 19 nt, Mycobacterium bovis subsp bovis AF2122/97
caaagacgccgucggcgcc

SEQ ID NO: 3133506 - RNA, 22 nt, Mycobacterium bovis subsp bovis AF2122/97
caaagcacuucacgaguagcgg

SEQ ID NO: 3133507 - RNA, 11 nt, Mycobacterium bovis subsp bovis AF2122/97
caaagcccaca

SEQ ID NO: 3133508 - RNA, 14 nt, Mycobacterium bovis subsp bovis AF2122/97
caaagcccgacaug

SEQ ID NO: 3133509 - RNA, 19 nt, Mycobacterium bovis subsp bovis AF2122/97
caaagcccgacgcgaagcu

SEQ ID NO: 3133510 - RNA, 20 nt, Mycobacterium bovis subsp bovis AF2122/97
caaagccgggauugccgcca

SEQ ID NO: 3133511 - RNA, 22 nt, Mycobacterium bovis subsp bovis AF2122/97
caaagccgucagcucaccaccc

SEQ ID NO: 3133512 - RNA, 15 nt, Mycobacterium bovis subsp bovis AF2122/97
caaagccgucgacgc

SEQ ID NO: 3133513 - RNA, 17 nt, Mycobacterium bovis subsp bovis AF2122/97
caaagccgucgacgcgg

SEQ ID NO: 3133514 - RNA, 19 nt, Mycobacterium bovis subsp bovis AF2122/97
caaagccgucgcgacgucg

SEQ ID NO: 3133515 - RNA, 12 nt, Mycobacterium bovis subsp bovis AF2122/97
caaagccgugcc

SEQ ID NO: 3133516 - RNA, 17 nt, Mycobacterium bovis subsp bovis AF2122/97
caaagcgacagcgcggc

SEQ ID NO: 3133517 - RNA, 19 nt, Mycobacterium bovis subsp bovis AF2122/97
caaagcgacagcgcggcgc

SEQ ID NO: 3133518 - RNA, 17 nt, Mycobacterium bovis subsp bovis AF2122/97
caaagcgccagcagcca

SEQ ID NO: 3133519 - RNA, 16 nt, Mycobacterium bovis subsp bovis AF2122/97
caaaggauucgcgcga

SEQ ID NO: 3133520 - RNA, 22 nt, Mycobacterium bovis subsp bovis AF2122/97
caaaggccccggugacgccguc

SEQ ID NO: 3133521 - RNA, 16 nt, Mycobacterium bovis subsp bovis AF2122/97
caaaggccuugacgua

SEQ ID NO: 3133522 - RNA, 19 nt, Mycobacterium bovis subsp bovis AF2122/97
caaaggcgccgggucacgu

SEQ ID NO: 3133523 - RNA, 22 nt, Mycobacterium bovis subsp bovis AF2122/97
caaaggcuguaacacccggccg

SEQ ID NO: 3133524 - RNA, 23 nt, Mycobacterium bovis subsp bovis AF2122/97
caaaggcuguaacacccggccgc

SEQ ID NO: 3133525 - RNA, 21 nt, Mycobacterium bovis subsp bovis AF2122/97
caaaggcuugcggaacgaaag

SEQ ID NO: 3133526 - RNA, 14 nt, Mycobacterium bovis subsp bovis AF2122/97
caaagggaguguuu

SEQ ID NO: 3133527 - RNA, 21 nt, Mycobacterium bovis subsp bovis AF2122/97
caaaguacgcccuggaaugcc

SEQ ID NO: 3133528 - RNA, 15 nt, Mycobacterium bovis subsp bovis AF2122/97
caaaguaucgcagca

SEQ ID NO: 3133529 - RNA, 23 nt, Mycobacterium bovis subsp bovis AF2122/97
caaaguucgacgagaagacaccg

SEQ ID NO: 3133530 - RNA, 17 nt, Mycobacterium bovis subsp bovis AF2122/97
caaaguuggccgcccga

SEQ ID NO: 3133531 - RNA, 11 nt, Mycobacterium bovis subsp bovis AF2122/97
caaauaggacu

SEQ ID NO: 3133532 - RNA, 15 nt, Mycobacterium bovis subsp bovis AF2122/97
caaauaggacugcgc

SEQ ID NO: 3133533 - RNA, 14 nt, Mycobacterium bovis subsp bovis AF2122/97
caaaucaagcacag

SEQ ID NO: 3133534 - RNA, 17 nt, Mycobacterium bovis subsp bovis AF2122/97
caaaucaagcacagccc

SEQ ID NO: 3133535 - RNA, 19 nt, Mycobacterium bovis subsp bovis AF2122/97
caaaucaagcacagcccgg

SEQ ID NO: 3133536 - RNA, 20 nt, Mycobacterium bovis subsp bovis AF2122/97
caaaucaagcacagcccggc

SEQ ID NO: 3133537 - RNA, 21 nt, Mycobacterium bovis subsp bovis AF2122/97
caaaucaagcacagcccggcg

SEQ ID NO: 3133538 - RNA, 22 nt, Mycobacterium bovis subsp bovis AF2122/97
caaaucaagcacagcccggcga

SEQ ID NO: 3133539 - RNA, 22 nt, Mycobacterium bovis subsp bovis AF2122/97
caaaucaagcacagcccggcua

SEQ ID NO: 3133540 - RNA, 18 nt, Mycobacterium bovis subsp bovis AF2122/97
caaaucagaugcgaaggc

SEQ ID NO: 3133541 - RNA, 22 nt, Mycobacterium bovis subsp bovis AF2122/97
caaaucagaugcgaaggcaucg

SEQ ID NO: 3133542 - RNA, 17 nt, Mycobacterium bovis subsp bovis AF2122/97
caaaucgaugaccgucg

SEQ ID NO: 3133543 - RNA, 23 nt, Mycobacterium bovis subsp bovis AF2122/97
caaaucgauguccaaugcaccgu

SEQ ID NO: 3133544 - RNA, 13 nt, Mycobacterium bovis subsp bovis AF2122/97
caaaucggcaucg

SEQ ID NO: 3133545 - RNA, 17 nt, Mycobacterium bovis subsp bovis AF2122/97
caaaucggcaucggcga

SEQ ID NO: 3133546 - RNA, 15 nt, Mycobacterium bovis subsp bovis AF2122/97
caaaucgucgauggu

SEQ ID NO: 3133547 - RNA, 15 nt, Mycobacterium bovis subsp bovis AF2122/97
caaaugaaccgcacc

SEQ ID NO: 3133548 - RNA, 15 nt, Mycobacterium bovis subsp bovis AF2122/97
caaaugccugcuggu

SEQ ID NO: 3133549 - RNA, 14 nt, Mycobacterium bovis subsp bovis AF2122/97
caaaugcgcugucg

SEQ ID NO: 3133550 - RNA, 14 nt, Mycobacterium bovis subsp bovis AF2122/97
caaaugggguguuu

SEQ ID NO: 3133551 - RNA, 21 nt, Mycobacterium bovis subsp bovis AF2122/97
caaauggugagcucgcgcaga

SEQ ID NO: 3133552 - RNA, 19 nt, Mycobacterium bovis subsp bovis AF2122/97
caaaugugcgagaagcagg

SEQ ID NO: 3133553 - RNA, 14 nt, Mycobacterium bovis subsp bovis AF2122/97
caacaaaaggccau

SEQ ID NO: 3133554 - RNA, 18 nt, Mycobacterium bovis subsp bovis AF2122/97
caacaaaaggccauccga

SEQ ID NO: 3133555 - RNA, 14 nt, Mycobacterium bovis subsp bovis AF2122/97
caacaaacccggcc

SEQ ID NO: 3133556 - RNA, 22 nt, Mycobacterium bovis subsp bovis AF2122/97
caacaaaggccggguggccacg

SEQ ID NO: 3133557 - RNA, 13 nt, Mycobacterium bovis subsp bovis AF2122/97
caacaacagccgc

SEQ ID NO: 3133558 - RNA, 18 nt, Mycobacterium bovis subsp bovis AF2122/97
caacaacccaacaaaagg

SEQ ID NO: 3133559 - RNA, 21 nt, Mycobacterium bovis subsp bovis AF2122/97
caacaacgauguggccguggg

SEQ ID NO: 3133560 - RNA, 15 nt, Mycobacterium bovis subsp bovis AF2122/97
caacaucggcccgcu

SEQ ID NO: 3133561 - RNA, 16 nt, Mycobacterium bovis subsp bovis AF2122/97
caacaucggcccgcug

SEQ ID NO: 3133562 - RNA, 20 nt, Mycobacterium bovis subsp bovis AF2122/97
caacaucggcccgcugacca

SEQ ID NO: 3133563 - RNA, 22 nt, Mycobacterium bovis subsp bovis AF2122/97
caacaucgggucgcugccggcu

SEQ ID NO: 3133564 - RNA, 21 nt, Mycobacterium bovis subsp bovis AF2122/97
caacaucuugccgucggccgg

SEQ ID NO: 3133565 - RNA, 18 nt, Mycobacterium bovis subsp bovis AF2122/97
caacaugucaccugcauc

SEQ ID NO: 3133566 - RNA, 16 nt, Mycobacterium bovis subsp bovis AF2122/97
caacauguugucgucg

SEQ ID NO: 3133567 - RNA, 22 nt, Mycobacterium bovis subsp bovis AF2122/97
caacauguugucgucgccgccg

SEQ ID NO: 3133568 - RNA, 16 nt, Mycobacterium bovis subsp bovis AF2122/97
caacauuggugaggug

SEQ ID NO: 3133569 - RNA, 22 nt, Mycobacterium bovis subsp bovis AF2122/97
caacauuggugagguggucagc

SEQ ID NO: 3133570 - RNA, 16 nt, Mycobacterium bovis subsp bovis AF2122/97
caacauuuucgcccgc

SEQ ID NO: 3133571 - RNA, 18 nt, Mycobacterium bovis subsp bovis AF2122/97
caaccaaccgcgcgagcc

SEQ ID NO: 3133572 - RNA, 22 nt, Mycobacterium bovis subsp bovis AF2122/97
caaccacccacccgcaccaccg

SEQ ID NO: 3133573 - RNA, 22 nt, Mycobacterium bovis subsp bovis AF2122/97
caaccaccgaaggugcgcguga

SEQ ID NO: 3133574 - RNA, 15 nt, Mycobacterium bovis subsp bovis AF2122/97
caaccaccggccgcg

SEQ ID NO: 3133575 - RNA, 15 nt, Mycobacterium bovis subsp bovis AF2122/97
caaccaccgguccag

SEQ ID NO: 3133576 - RNA, 21 nt, Mycobacterium bovis subsp bovis AF2122/97
caaccaccgguccagcgccgg

SEQ ID NO: 3133577 - RNA, 22 nt, Mycobacterium bovis subsp bovis AF2122/97
caaccaccgguccagcgccgga

SEQ ID NO: 3133578 - RNA, 16 nt, Mycobacterium bovis subsp bovis AF2122/97
caaccaccucgccaac

SEQ ID NO: 3133579 - RNA, 19 nt, Mycobacterium bovis subsp bovis AF2122/97
caaccaccucgccaacauc

SEQ ID NO: 3133580 - RNA, 23 nt, Mycobacterium bovis subsp bovis AF2122/97
caaccacgaaagcguaaggccgg

SEQ ID NO: 3133581 - RNA, 14 nt, Mycobacterium bovis subsp bovis AF2122/97
caaccacggccgcc

SEQ ID NO: 3133582 - RNA, 18 nt, Mycobacterium bovis subsp bovis AF2122/97
caaccacggccgccgcgu

SEQ ID NO: 3133583 - RNA, 17 nt, Mycobacterium bovis subsp bovis AF2122/97
caaccacggcggcauca

SEQ ID NO: 3133584 - RNA, 18 nt, Mycobacterium bovis subsp bovis AF2122/97
caaccacuuuccggccga

SEQ ID NO: 3133585 - RNA, 11 nt, Mycobacterium bovis subsp bovis AF2122/97
caaccagcaga

SEQ ID NO: 3133586 - RNA, 12 nt, Mycobacterium bovis subsp bovis AF2122/97
caaccagcagca

SEQ ID NO: 3133587 - RNA, 18 nt, Mycobacterium bovis subsp bovis AF2122/97
caaccagcccggccgccg

SEQ ID NO: 3133588 - RNA, 18 nt, Mycobacterium bovis subsp bovis AF2122/97
caaccagccuuuccggcc

SEQ ID NO: 3133589 - RNA, 16 nt, Mycobacterium bovis subsp bovis AF2122/97
caaccagcgagcccag

SEQ ID NO: 3133590 - RNA, 18 nt, Mycobacterium bovis subsp bovis AF2122/97
caaccagcgagcccagcu

SEQ ID NO: 3133591 - RNA, 21 nt, Mycobacterium bovis subsp bovis AF2122/97
caaccagcgagcccagcugcg

SEQ ID NO: 3133592 - RNA, 16 nt, Mycobacterium bovis subsp bovis AF2122/97
caaccagcuagaccag

SEQ ID NO: 3133593 - RNA, 18 nt, Mycobacterium bovis subsp bovis AF2122/97
caaccagcuucucagcac

SEQ ID NO: 3133594 - RNA, 23 nt, Mycobacterium bovis subsp bovis AF2122/97
caaccaugcgguuagcagccgcu

SEQ ID NO: 3133595 - RNA, 19 nt, Mycobacterium bovis subsp bovis AF2122/97
caaccauguuaacgcgcgu

SEQ ID NO: 3133596 - RNA, 17 nt, Mycobacterium bovis subsp bovis AF2122/97
caacccaacaaaaggcc

SEQ ID NO: 3133597 - RNA, 21 nt, Mycobacterium bovis subsp bovis AF2122/97
caacccacacgcccucgacgc

SEQ ID NO: 3133598 - RNA, 21 nt, Mycobacterium bovis subsp bovis AF2122/97
caacccaccccccagcgccgc

SEQ ID NO: 3133599 - RNA, 23 nt, Mycobacterium bovis subsp bovis AF2122/97
caacccacucgcagcagcaucug

SEQ ID NO: 3133600 - RNA, 16 nt, Mycobacterium bovis subsp bovis AF2122/97
caaccccaacaucccg

SEQ ID NO: 3133601 - RNA, 14 nt, Mycobacterium bovis subsp bovis AF2122/97
caacccccgccggc

SEQ ID NO: 3133602 - RNA, 18 nt, Mycobacterium bovis subsp bovis AF2122/97
caacccccgccggcgccc

SEQ ID NO: 3133603 - RNA, 13 nt, Mycobacterium bovis subsp bovis AF2122/97
caaccccgccggc

SEQ ID NO: 3133604 - RNA, 12 nt, Mycobacterium bovis subsp bovis AF2122/97
caaccccgcggu

SEQ ID NO: 3133605 - RNA, 14 nt, Mycobacterium bovis subsp bovis AF2122/97
caaccccguccucg

SEQ ID NO: 3133606 - RNA, 16 nt, Mycobacterium bovis subsp bovis AF2122/97
caaccccuggggugcu

SEQ ID NO: 3133607 - RNA, 18 nt, Mycobacterium bovis subsp bovis AF2122/97
caacccgaucucugcggc

SEQ ID NO: 3133608 - RNA, 18 nt, Mycobacterium bovis subsp bovis AF2122/97
caacccgcaccccggccg

SEQ ID NO: 3133609 - RNA, 12 nt, Mycobacterium bovis subsp bovis AF2122/97
caacccgcucgg

SEQ ID NO: 3133610 - RNA, 18 nt, Mycobacterium bovis subsp bovis AF2122/97
caacccggacgaacgccg

SEQ ID NO: 3133611 - RNA, 18 nt, Mycobacterium bovis subsp bovis AF2122/97
caacccggauaggacgaa

SEQ ID NO: 3133612 - RNA, 13 nt, Mycobacterium bovis subsp bovis AF2122/97
caacccggcgucg

SEQ ID NO: 3133613 - RNA, 15 nt, Mycobacterium bovis subsp bovis AF2122/97
caacccgggccgcca

SEQ ID NO: 3133614 - RNA, 22 nt, Mycobacterium bovis subsp bovis AF2122/97
caacccggugucgugggcaccu

SEQ ID NO: 3133615 - RNA, 15 nt, Mycobacterium bovis subsp bovis AF2122/97
caacccgucgagccg

SEQ ID NO: 3133616 - RNA, 22 nt, Mycobacterium bovis subsp bovis AF2122/97
caacccgucgagccgugccucg

SEQ ID NO: 3133617 - RNA, 18 nt, Mycobacterium bovis subsp bovis AF2122/97
caacccgucuuaucggcg

SEQ ID NO: 3133618 - RNA, 21 nt, Mycobacterium bovis subsp bovis AF2122/97
caacccgucuuaucggcgucg

SEQ ID NO: 3133619 - RNA, 11 nt, Mycobacterium bovis subsp bovis AF2122/97
caacccuaggg

SEQ ID NO: 3133620 - RNA, 23 nt, Mycobacterium bovis subsp bovis AF2122/97
caacccuagggcggugccgccgg

SEQ ID NO: 3133621 - RNA, 15 nt, Mycobacterium bovis subsp bovis AF2122/97
caacccugccgcgau

SEQ ID NO: 3133622 - RNA, 16 nt, Mycobacterium bovis subsp bovis AF2122/97
caacccugcggcgucg

SEQ ID NO: 3133623 - RNA, 20 nt, Mycobacterium bovis subsp bovis AF2122/97
caaccgaauugaacugagga

SEQ ID NO: 3133624 - RNA, 14 nt, Mycobacterium bovis subsp bovis AF2122/97
caaccgacgggucg

SEQ ID NO: 3133625 - RNA, 14 nt, Mycobacterium bovis subsp bovis AF2122/97
caaccgagcggucg

SEQ ID NO: 3133626 - RNA, 14 nt, Mycobacterium bovis subsp bovis AF2122/97
caaccgaucggucg

SEQ ID NO: 3133627 - RNA, 14 nt, Mycobacterium bovis subsp bovis AF2122/97
caaccgaugacgcg

SEQ ID NO: 3133628 - RNA, 13 nt, Mycobacterium bovis subsp bovis AF2122/97
caaccgcaccgca

SEQ ID NO: 3133629 - RNA, 19 nt, Mycobacterium bovis subsp bovis AF2122/97
caaccgcaggccgaagacg

SEQ ID NO: 3133630 - RNA, 20 nt, Mycobacterium bovis subsp bovis AF2122/97
caaccgcaggccgaagacgu

SEQ ID NO: 3133631 - RNA, 21 nt, Mycobacterium bovis subsp bovis AF2122/97
caaccgcauucggacgccacg

SEQ ID NO: 3133632 - RNA, 19 nt, Mycobacterium bovis subsp bovis AF2122/97
caaccgccaucgucgaaga

SEQ ID NO: 3133633 - RNA, 21 nt, Mycobacterium bovis subsp bovis AF2122/97
caaccgccaucgucgaagacc

SEQ ID NO: 3133634 - RNA, 22 nt, Mycobacterium bovis subsp bovis AF2122/97
caaccgccaucgucgaagaccu

SEQ ID NO: 3133635 - RNA, 22 nt, Mycobacterium bovis subsp bovis AF2122/97
caaccgccgugugccacggggc

SEQ ID NO: 3133636 - RNA, 14 nt, Mycobacterium bovis subsp bovis AF2122/97
caaccgcgcgagcc

SEQ ID NO: 3133637 - RNA, 17 nt, Mycobacterium bovis subsp bovis AF2122/97
caaccgcgcgagccucg

SEQ ID NO: 3133638 - RNA, 19 nt, Mycobacterium bovis subsp bovis AF2122/97
caaccgcgucgaagccggg

SEQ ID NO: 3133639 - RNA, 22 nt, Mycobacterium bovis subsp bovis AF2122/97
caaccgcgugcgucagcgccuu

SEQ ID NO: 3133640 - RNA, 19 nt, Mycobacterium bovis subsp bovis AF2122/97
caaccgcucaucgaucaca

SEQ ID NO: 3133641 - RNA, 15 nt, Mycobacterium bovis subsp bovis AF2122/97
caaccgcugcugcug

SEQ ID NO: 3133642 - RNA, 16 nt, Mycobacterium bovis subsp bovis AF2122/97
caaccgcugucaccgu

SEQ ID NO: 3133643 - RNA, 17 nt, Mycobacterium bovis subsp bovis AF2122/97
caaccgcugucaccgua

SEQ ID NO: 3133644 - RNA, 19 nt, Mycobacterium bovis subsp bovis AF2122/97
caaccgcugucaccguacg

SEQ ID NO: 3133645 - RNA, 23 nt, Mycobacterium bovis subsp bovis AF2122/97
caaccgcuuugaauugcgcgccc

SEQ ID NO: 3133646 - RNA, 17 nt, Mycobacterium bovis subsp bovis AF2122/97
caacgauugcgaagggc

SEQ ID NO: 3133647 - RNA, 16 nt, Mycobacterium bovis subsp bovis AF2122/97
caacgcaaucgacuga

SEQ ID NO: 3133648 - RNA, 14 nt, Mycobacterium bovis subsp bovis AF2122/97
caacgcacgccaca

SEQ ID NO: 3133649 - RNA, 15 nt, Mycobacterium bovis subsp bovis AF2122/97
caacgcacgccacau

SEQ ID NO: 3133650 - RNA, 18 nt, Mycobacterium bovis subsp bovis AF2122/97
caacgcaucgaugcgugc

SEQ ID NO: 3133651 - RNA, 18 nt, Mycobacterium bovis subsp bovis AF2122/97
caacgccaaaacggucga

SEQ ID NO: 3133652 - RNA, 14 nt, Mycobacterium bovis subsp bovis AF2122/97
caacgccaaaaugg

SEQ ID NO: 3133653 - RNA, 15 nt, Mycobacterium bovis subsp bovis AF2122/97
caacgccaaaauggu

SEQ ID NO: 3133654 - RNA, 15 nt, Mycobacterium bovis subsp bovis AF2122/97
caacgccaccgucgc

SEQ ID NO: 3133655 - RNA, 13 nt, Mycobacterium bovis subsp bovis AF2122/97
caacgccacgccg

SEQ ID NO: 3133656 - RNA, 14 nt, Mycobacterium bovis subsp bovis AF2122/97
caacgccacgccga

SEQ ID NO: 3133657 - RNA, 23 nt, Mycobacterium bovis subsp bovis AF2122/97
caacgccacgccgaugauggaca

SEQ ID NO: 3133658 - RNA, 17 nt, Mycobacterium bovis subsp bovis AF2122/97
caacgccagcaccagcg

SEQ ID NO: 3133659 - RNA, 18 nt, Mycobacterium bovis subsp bovis AF2122/97
caacgccaucaccccggc

SEQ ID NO: 3133660 - RNA, 19 nt, Mycobacterium bovis subsp bovis AF2122/97
caacgcccaccacgcgacg

SEQ ID NO: 3133661 - RNA, 17 nt, Mycobacterium bovis subsp bovis AF2122/97
caacgcccgcaucgccu

SEQ ID NO: 3133662 - RNA, 14 nt, Mycobacterium bovis subsp bovis AF2122/97
caacgcccgggcga

SEQ ID NO: 3133663 - RNA, 16 nt, Mycobacterium bovis subsp bovis AF2122/97
caacgcccguguugaa

SEQ ID NO: 3133664 - RNA, 17 nt, Mycobacterium bovis subsp bovis AF2122/97
caacgccgccagccugg

SEQ ID NO: 3133665 - RNA, 13 nt, Mycobacterium bovis subsp bovis AF2122/97
caacgccgcgacg

SEQ ID NO: 3133666 - RNA, 12 nt, Mycobacterium bovis subsp bovis AF2122/97
caacgccggcga

SEQ ID NO: 3133667 - RNA, 17 nt, Mycobacterium bovis subsp bovis AF2122/97
caacgccucgauggcgg

SEQ ID NO: 3133668 - RNA, 23 nt, Mycobacterium bovis subsp bovis AF2122/97
caacgccucgauggcgguggcga

SEQ ID NO: 3133669 - RNA, 14 nt, Mycobacterium bovis subsp bovis AF2122/97
caacgccucugcuc

SEQ ID NO: 3133670 - RNA, 18 nt, Mycobacterium bovis subsp bovis AF2122/97
caacgccucugcucagcc

SEQ ID NO: 3133671 - RNA, 20 nt, Mycobacterium bovis subsp bovis AF2122/97
caacgccucugcucagccgu

SEQ ID NO: 3133672 - RNA, 13 nt, Mycobacterium bovis subsp bovis AF2122/97
caacgccugcgag

SEQ ID NO: 3133673 - RNA, 18 nt, Mycobacterium bovis subsp bovis AF2122/97
caacgcgaaccggccauc

SEQ ID NO: 3133674 - RNA, 22 nt, Mycobacterium bovis subsp bovis AF2122/97
caacgcgauguccagguggcgc

SEQ ID NO: 3133675 - RNA, 13 nt, Mycobacterium bovis subsp bovis AF2122/97
caacgcgcaacca

SEQ ID NO: 3133676 - RNA, 22 nt, Mycobacterium bovis subsp bovis AF2122/97
caacgcgcaccuggcgcgcgca

SEQ ID NO: 3133677 - RNA, 16 nt, Mycobacterium bovis subsp bovis AF2122/97
caacgcgcacgcgugc

SEQ ID NO: 3133678 - RNA, 20 nt, Mycobacterium bovis subsp bovis AF2122/97
caacgcgcagagcguuccgc

SEQ ID NO: 3133679 - RNA, 17 nt, Mycobacterium bovis subsp bovis AF2122/97
caacgcgcggcucgaau

SEQ ID NO: 3133680 - RNA, 20 nt, Mycobacterium bovis subsp bovis AF2122/97
caacgcggcgaagugcaccc

SEQ ID NO: 3133681 - RNA, 19 nt, Mycobacterium bovis subsp bovis AF2122/97
caacgcgggaacgaugccg

SEQ ID NO: 3133682 - RNA, 16 nt, Mycobacterium bovis subsp bovis AF2122/97
caacgcgggcgcuugc

SEQ ID NO: 3133683 - RNA, 18 nt, Mycobacterium bovis subsp bovis AF2122/97
caacgcgggugccgggca

SEQ ID NO: 3133684 - RNA, 18 nt, Mycobacterium bovis subsp bovis AF2122/97
caacgcgguaaagccccg

SEQ ID NO: 3133685 - RNA, 15 nt, Mycobacterium bovis subsp bovis AF2122/97
caacgcggucugcuc

SEQ ID NO: 3133686 - RNA, 19 nt, Mycobacterium bovis subsp bovis AF2122/97
caacgcggucugcuccagg

SEQ ID NO: 3133687 - RNA, 20 nt, Mycobacterium bovis subsp bovis AF2122/97
caacgcggucugcuccaggc

SEQ ID NO: 3133688 - RNA, 19 nt, Mycobacterium bovis subsp bovis AF2122/97
caacgcggugccgggaucg

SEQ ID NO: 3133689 - RNA, 19 nt, Mycobacterium bovis subsp bovis AF2122/97
caacgcgguggaccgcucg

SEQ ID NO: 3133690 - RNA, 23 nt, Mycobacterium bovis subsp bovis AF2122/97
caacgcgguggaccgcucgaugu

SEQ ID NO: 3133691 - RNA, 15 nt, Mycobacterium bovis subsp bovis AF2122/97
caacgcggugggcac

SEQ ID NO: 3133692 - RNA, 18 nt, Mycobacterium bovis subsp bovis AF2122/97
caacgcggugggcacagc

SEQ ID NO: 3133693 - RNA, 19 nt, Mycobacterium bovis subsp bovis AF2122/97
caacgcggugggcacagcc

SEQ ID NO: 3133694 - RNA, 20 nt, Mycobacterium bovis subsp bovis AF2122/97
caacgcguauucggcaucgc

SEQ ID NO: 3133695 - RNA, 23 nt, Mycobacterium bovis subsp bovis AF2122/97
caacgcgucccgccgcaccgccg

SEQ ID NO: 3133696 - RNA, 14 nt, Mycobacterium bovis subsp bovis AF2122/97
caacgcgucggucg

SEQ ID NO: 3133697 - RNA, 15 nt, Mycobacterium bovis subsp bovis AF2122/97
caacgcgugcgcauc

SEQ ID NO: 3133698 - RNA, 21 nt, Mycobacterium bovis subsp bovis AF2122/97
caacgcguugcacagcagcgg

SEQ ID NO: 3133699 - RNA, 22 nt, Mycobacterium bovis subsp bovis AF2122/97
caacgcguugcacagcagcggu

SEQ ID NO: 3133700 - RNA, 12 nt, Mycobacterium bovis subsp bovis AF2122/97
caacgcugcggc

SEQ ID NO: 3133701 - RNA, 22 nt, Mycobacterium bovis subsp bovis AF2122/97
caacgcugcggcaggucgaugc

SEQ ID NO: 3133702 - RNA, 13 nt, Mycobacterium bovis subsp bovis AF2122/97
caacgcuggaggc

SEQ ID NO: 3133703 - RNA, 20 nt, Mycobacterium bovis subsp bovis AF2122/97
caacgcuggaggcgaucugc

SEQ ID NO: 3133704 - RNA, 13 nt, Mycobacterium bovis subsp bovis AF2122/97
caacgcugggcgg

SEQ ID NO: 3133705 - RNA, 16 nt, Mycobacterium bovis subsp bovis AF2122/97
caacgcuucggcacgc

SEQ ID NO: 3133706 - RNA, 14 nt, Mycobacterium bovis subsp bovis AF2122/97
caacgcuucggcag

SEQ ID NO: 3133707 - RNA, 19 nt, Mycobacterium bovis subsp bovis AF2122/97
caacggaacaucgucaucg

SEQ ID NO: 3133708 - RNA, 21 nt, Mycobacterium bovis subsp bovis AF2122/97
caacggaaucucuucggcggu

SEQ ID NO: 3133709 - RNA, 17 nt, Mycobacterium bovis subsp bovis AF2122/97
caacggacgggaucgcc

SEQ ID NO: 3133710 - RNA, 18 nt, Mycobacterium bovis subsp bovis AF2122/97
caacggagcgagcucagc

SEQ ID NO: 3133711 - RNA, 15 nt, Mycobacterium bovis subsp bovis AF2122/97
caacggaggugccgg

SEQ ID NO: 3133712 - RNA, 16 nt, Mycobacterium bovis subsp bovis AF2122/97
caacggaggugccggc

SEQ ID NO: 3133713 - RNA, 17 nt, Mycobacterium bovis subsp bovis AF2122/97
caacggaggugccggcg

SEQ ID NO: 3133714 - RNA, 20 nt, Mycobacterium bovis subsp bovis AF2122/97
caacggaggugccggcgcca

SEQ ID NO: 3133715 - RNA, 18 nt, Mycobacterium bovis subsp bovis AF2122/97
caacggauaucagcaaca

SEQ ID NO: 3133716 - RNA, 18 nt, Mycobacterium bovis subsp bovis AF2122/97
caacggcacccgaaaacu

SEQ ID NO: 3133717 - RNA, 17 nt, Mycobacterium bovis subsp bovis AF2122/97
caacggcacccugcggc

SEQ ID NO: 3133718 - RNA, 21 nt, Mycobacterium bovis subsp bovis AF2122/97
caacggcagaucccacgccag

SEQ ID NO: 3133719 - RNA, 13 nt, Mycobacterium bovis subsp bovis AF2122/97
caacggcagcccg

SEQ ID NO: 3133720 - RNA, 19 nt, Mycobacterium bovis subsp bovis AF2122/97
caacggcagcccguggucg

SEQ ID NO: 3133721 - RNA, 15 nt, Mycobacterium bovis subsp bovis AF2122/97
caacggcccccccca

SEQ ID NO: 3133722 - RNA, 23 nt, Mycobacterium bovis subsp bovis AF2122/97
caacggcgcgccgaccaccgcug

SEQ ID NO: 3133723 - RNA, 16 nt, Mycobacterium bovis subsp bovis AF2122/97
caacggcgcggcaagg

SEQ ID NO: 3133724 - RNA, 13 nt, Mycobacterium bovis subsp bovis AF2122/97
caacggcggaucg

SEQ ID NO: 3133725 - RNA, 19 nt, Mycobacterium bovis subsp bovis AF2122/97
caacggcggaucggcggcc

SEQ ID NO: 3133726 - RNA, 20 nt, Mycobacterium bovis subsp bovis AF2122/97
caacggcggaucggcggccg

SEQ ID NO: 3133727 - RNA, 22 nt, Mycobacterium bovis subsp bovis AF2122/97
caacggcggaucggcggccggc

SEQ ID NO: 3133728 - RNA, 14 nt, Mycobacterium bovis subsp bovis AF2122/97
caacggcggcaacg

SEQ ID NO: 3133729 - RNA, 15 nt, Mycobacterium bovis subsp bovis AF2122/97
caacggcggcaacgg

SEQ ID NO: 3133730 - RNA, 19 nt, Mycobacterium bovis subsp bovis AF2122/97
caacggcggcaacggcggc

SEQ ID NO: 3133731 - RNA, 15 nt, Mycobacterium bovis subsp bovis AF2122/97
caacggcggcaucgg

SEQ ID NO: 3133732 - RNA, 17 nt, Mycobacterium bovis subsp bovis AF2122/97
caacggcggcgacggcg

SEQ ID NO: 3133733 - RNA, 18 nt, Mycobacterium bovis subsp bovis AF2122/97
caacugauggcgcgcaac

SEQ ID NO: 3133734 - RNA, 17 nt, Mycobacterium bovis subsp bovis AF2122/97
caacugcagauaggacc

SEQ ID NO: 3133735 - RNA, 20 nt, Mycobacterium bovis subsp bovis AF2122/97
caacugcagauaggacccag

SEQ ID NO: 3133736 - RNA, 17 nt, Mycobacterium bovis subsp bovis AF2122/97
caacugccgagcagacg

SEQ ID NO: 3133737 - RNA, 14 nt, Mycobacterium bovis subsp bovis AF2122/97
caacugcgccguuc

SEQ ID NO: 3133738 - RNA, 13 nt, Mycobacterium bovis subsp bovis AF2122/97
caacugcucgacg

SEQ ID NO: 3133739 - RNA, 23 nt, Mycobacterium bovis subsp bovis AF2122/97
caacuggccgcgucgcugagcaa

SEQ ID NO: 3133740 - RNA, 20 nt, Mycobacterium bovis subsp bovis AF2122/97
caacugggccgagcgcgccg

SEQ ID NO: 3133741 - RNA, 15 nt, Mycobacterium bovis subsp bovis AF2122/97
caacuggucgccaac

SEQ ID NO: 3133742 - RNA, 20 nt, Mycobacterium bovis subsp bovis AF2122/97
caacuggucgccaacgccag

SEQ ID NO: 3133743 - RNA, 21 nt, Mycobacterium bovis subsp bovis AF2122/97
caacuggugggccaucgucag

SEQ ID NO: 3133744 - RNA, 22 nt, Mycobacterium bovis subsp bovis AF2122/97
caacuggugggccaucgucagg

SEQ ID NO: 3133745 - RNA, 12 nt, Mycobacterium bovis subsp bovis AF2122/97
caacuucaccac

SEQ ID NO: 3133746 - RNA, 14 nt, Mycobacterium bovis subsp bovis AF2122/97
caacuuggcggcca

SEQ ID NO: 3133747 - RNA, 18 nt, Mycobacterium bovis subsp bovis AF2122/97
caacuuggcggccagccg

SEQ ID NO: 3133748 - RNA, 19 nt, Mycobacterium bovis subsp bovis AF2122/97
caacuuggcggccagccgc

SEQ ID NO: 3133749 - RNA, 21 nt, Mycobacterium bovis subsp bovis AF2122/97
caacuuggcggccagccgcuc

SEQ ID NO: 3133750 - RNA, 15 nt, Mycobacterium bovis subsp bovis AF2122/97
caacuugggcccgcu

SEQ ID NO: 3133751 - RNA, 21 nt, Mycobacterium bovis subsp bovis AF2122/97
caacuuggggucguucgccga

SEQ ID NO: 3133752 - RNA, 15 nt, Mycobacterium bovis subsp bovis AF2122/97
caagaaccacgacgu

SEQ ID NO: 3133753 - RNA, 15 nt, Mycobacterium bovis subsp bovis AF2122/97
caagaaggagaucga

SEQ ID NO: 3133754 - RNA, 15 nt, Mycobacterium bovis subsp bovis AF2122/97
caagaaggccagcgc

SEQ ID NO: 3133755 - RNA, 19 nt, Mycobacterium bovis subsp bovis AF2122/97
caagaaggccagcgcgccc

SEQ ID NO: 3133756 - RNA, 17 nt, Mycobacterium bovis subsp bovis AF2122/97
caagaaguacagcuggc

SEQ ID NO: 3133757 - RNA, 17 nt, Mycobacterium bovis subsp bovis AF2122/97
caagaaucaccggcaau

SEQ ID NO: 3133758 - RNA, 14 nt, Mycobacterium bovis subsp bovis AF2122/97
caagaauucaccac

SEQ ID NO: 3133759 - RNA, 12 nt, Mycobacterium bovis subsp bovis AF2122/97
caagacagccug

SEQ ID NO: 3133760 - RNA, 21 nt, Mycobacterium bovis subsp bovis AF2122/97
caagaccaagugucgccgcuc

SEQ ID NO: 3133761 - RNA, 20 nt, Mycobacterium bovis subsp bovis AF2122/97
caagaccgcgccaacuccga

SEQ ID NO: 3133762 - RNA, 18 nt, Mycobacterium bovis subsp bovis AF2122/97
caagacgaugcuggcggc

SEQ ID NO: 3133763 - RNA, 19 nt, Mycobacterium bovis subsp bovis AF2122/97
caagacgucggcguggucg

SEQ ID NO: 3133764 - RNA, 16 nt, Mycobacterium bovis subsp bovis AF2122/97
caagacguugcgcucg

SEQ ID NO: 3133765 - RNA, 22 nt, Mycobacterium bovis subsp bovis AF2122/97
caagagugcucagcgcgcgccg

SEQ ID NO: 3133766 - RNA, 22 nt, Mycobacterium bovis subsp bovis AF2122/97
caagaucaccuucgucgcggcc

SEQ ID NO: 3133767 - RNA, 24 nt, Mycobacterium bovis subsp bovis AF2122/97
caagaucaccuucgucgcggccgc

SEQ ID NO: 3133768 - RNA, 20 nt, Mycobacterium bovis subsp bovis AF2122/97
caagaucagacccagcgcgg

SEQ ID NO: 3133769 - RNA, 14 nt, Mycobacterium bovis subsp bovis AF2122/97
caagaucggcagcg

SEQ ID NO: 3133770 - RNA, 16 nt, Mycobacterium bovis subsp bovis AF2122/97
caagaucggcgccccu

SEQ ID NO: 3133771 - RNA, 12 nt, Mycobacterium bovis subsp bovis AF2122/97
caagaugaucgc

SEQ ID NO: 3133772 - RNA, 17 nt, Mycobacterium bovis subsp bovis AF2122/97
caagaugccugacacga

SEQ ID NO: 3133773 - RNA, 20 nt, Mycobacterium bovis subsp bovis AF2122/97
caagauggcccgucgugacc

SEQ ID NO: 3133774 - RNA, 14 nt, Mycobacterium bovis subsp bovis AF2122/97
caagauggcgcgcu

SEQ ID NO: 3133775 - RNA, 13 nt, Mycobacterium bovis subsp bovis AF2122/97
caagauguccggu

SEQ ID NO: 3133776 - RNA, 18 nt, Mycobacterium bovis subsp bovis AF2122/97
caagauuaccgaagcccg

SEQ ID NO: 3133777 - RNA, 14 nt, Mycobacterium bovis subsp bovis AF2122/97
caagauugaacgag

SEQ ID NO: 3133778 - RNA, 12 nt, Mycobacterium bovis subsp bovis AF2122/97
caagcaaccggu

SEQ ID NO: 3133779 - RNA, 17 nt, Mycobacterium bovis subsp bovis AF2122/97
caagcaaccggugcgca

SEQ ID NO: 3133780 - RNA, 23 nt, Mycobacterium bovis subsp bovis AF2122/97
caagcaaccggugcgcauccguc

SEQ ID NO: 3133781 - RNA, 15 nt, Mycobacterium bovis subsp bovis AF2122/97
caagcaaguccaccg

SEQ ID NO: 3133782 - RNA, 12 nt, Mycobacterium bovis subsp bovis AF2122/97
caagcacaccgc

SEQ ID NO: 3133783 - RNA, 14 nt, Mycobacterium bovis subsp bovis AF2122/97
caagcacaccgcca

SEQ ID NO: 3133784 - RNA, 15 nt, Mycobacterium bovis subsp bovis AF2122/97
caagcacaccgccag

SEQ ID NO: 3133785 - RNA, 17 nt, Mycobacterium bovis subsp bovis AF2122/97
caagcacaccgccagcg

SEQ ID NO: 3133786 - RNA, 22 nt, Mycobacterium bovis subsp bovis AF2122/97
caagcacacuggccacaaucgc

SEQ ID NO: 3133787 - RNA, 15 nt, Mycobacterium bovis subsp bovis AF2122/97
caagcacagcccggc

SEQ ID NO: 3133788 - RNA, 19 nt, Mycobacterium bovis subsp bovis AF2122/97
caagcacagcccggcgacg

SEQ ID NO: 3133789 - RNA, 16 nt, Mycobacterium bovis subsp bovis AF2122/97
caagcacagcccggcu

SEQ ID NO: 3133790 - RNA, 14 nt, Mycobacterium bovis subsp bovis AF2122/97
caagcacgcgacgg

SEQ ID NO: 3133791 - RNA, 22 nt, Mycobacterium bovis subsp bovis AF2122/97
caagcacgguggccgagccgcg

SEQ ID NO: 3133792 - RNA, 23 nt, Mycobacterium bovis subsp bovis AF2122/97
caagcacgguggccgagccgcgg

SEQ ID NO: 3133793 - RNA, 14 nt, Mycobacterium bovis subsp bovis AF2122/97
caagcagcccgggu

SEQ ID NO: 3133794 - RNA, 16 nt, Mycobacterium bovis subsp bovis AF2122/97
caagcagcccggguga

SEQ ID NO: 3133795 - RNA, 12 nt, Mycobacterium bovis subsp bovis AF2122/97
caagcagcgcga

SEQ ID NO: 3133796 - RNA, 14 nt, Mycobacterium bovis subsp bovis AF2122/97
caagcagcguggcg

SEQ ID NO: 3133797 - RNA, 12 nt, Mycobacterium bovis subsp bovis AF2122/97
caagccaagcgu

SEQ ID NO: 3133798 - RNA, 17 nt, Mycobacterium bovis subsp bovis AF2122/97
caagccagcacugccau

SEQ ID NO: 3133799 - RNA, 19 nt, Mycobacterium bovis subsp bovis AF2122/97
caagccagcaucggcagca

SEQ ID NO: 3133800 - RNA, 14 nt, Mycobacterium bovis subsp bovis AF2122/97
caagccagcguugg

SEQ ID NO: 3133801 - RNA, 16 nt, Mycobacterium bovis subsp bovis AF2122/97
caagccagcguuggcg

SEQ ID NO: 3133802 - RNA, 18 nt, Mycobacterium bovis subsp bovis AF2122/97
caagccagcguuggcggc

SEQ ID NO: 3133803 - RNA, 18 nt, Mycobacterium bovis subsp bovis AF2122/97
caagccauucacgagccg

SEQ ID NO: 3133804 - RNA, 19 nt, Mycobacterium bovis subsp bovis AF2122/97
caagccauucacgagccgc

SEQ ID NO: 3133805 - RNA, 12 nt, Mycobacterium bovis subsp bovis AF2122/97
caagcccaaaaa

SEQ ID NO: 3133806 - RNA, 23 nt, Mycobacterium bovis subsp bovis AF2122/97
caagcccaaaaagaccgccgcug

SEQ ID NO: 3133807 - RNA, 14 nt, Mycobacterium bovis subsp bovis AF2122/97
caagccgacaucgg

SEQ ID NO: 3133808 - RNA, 18 nt, Mycobacterium bovis subsp bovis AF2122/97
caagccgacaucggcggc

SEQ ID NO: 3133809 - RNA, 14 nt, Mycobacterium bovis subsp bovis AF2122/97
caagccgaucggug

SEQ ID NO: 3133810 - RNA, 22 nt, Mycobacterium bovis subsp bovis AF2122/97
caagccgauugcuucuucgggc

SEQ ID NO: 3133811 - RNA, 11 nt, Mycobacterium bovis subsp bovis AF2122/97
caagccgccgg

SEQ ID NO: 3133812 - RNA, 15 nt, Mycobacterium bovis subsp bovis AF2122/97
caagccgccggcgcc

SEQ ID NO: 3133813 - RNA, 22 nt, Mycobacterium bovis subsp bovis AF2122/97
caagccgcugauguacccggcg

SEQ ID NO: 3133814 - RNA, 13 nt, Mycobacterium bovis subsp bovis AF2122/97
caagccggccacg

SEQ ID NO: 3133815 - RNA, 12 nt, Mycobacterium bovis subsp bovis AF2122/97
caagccggcgag

SEQ ID NO: 3133816 - RNA, 18 nt, Mycobacterium bovis subsp bovis AF2122/97
caagccggcgcccgccgc

SEQ ID NO: 3133817 - RNA, 20 nt, Mycobacterium bovis subsp bovis AF2122/97
caagccggggaacuuaccga

SEQ ID NO: 3133818 - RNA, 20 nt, Mycobacterium bovis subsp bovis AF2122/97
caagccgggugggagcagcc

SEQ ID NO: 3133819 - RNA, 22 nt, Mycobacterium bovis subsp bovis AF2122/97
caagccguagaccaggcccagg

SEQ ID NO: 3133820 - RNA, 16 nt, Mycobacterium bovis subsp bovis AF2122/97
caagguggcaugcgac

SEQ ID NO: 3133821 - RNA, 13 nt, Mycobacterium bovis subsp bovis AF2122/97
caagguggccacc

SEQ ID NO: 3133822 - RNA, 14 nt, Mycobacterium bovis subsp bovis AF2122/97
caagguggccacca

SEQ ID NO: 3133823 - RNA, 19 nt, Mycobacterium bovis subsp bovis AF2122/97
caagguggccaccaaacgc

SEQ ID NO: 3133824 - RNA, 23 nt, Mycobacterium bovis subsp bovis AF2122/97
caagguggcggccaguucggcgg

SEQ ID NO: 3133825 - RNA, 17 nt, Mycobacterium bovis subsp bovis AF2122/97
caagguguccagcaccu

SEQ ID NO: 3133826 - RNA, 21 nt, Mycobacterium bovis subsp bovis AF2122/97
caagguguccagcaccugccg

SEQ ID NO: 3133827 - RNA, 18 nt, Mycobacterium bovis subsp bovis AF2122/97
caagguuucgacaucacu

SEQ ID NO: 3133828 - RNA, 14 nt, Mycobacterium bovis subsp bovis AF2122/97
caaguacgcgaccg

SEQ ID NO: 3133829 - RNA, 20 nt, Mycobacterium bovis subsp bovis AF2122/97
caaguagccgucgucgucga

SEQ ID NO: 3133830 - RNA, 15 nt, Mycobacterium bovis subsp bovis AF2122/97
caaguagucgaaggu

SEQ ID NO: 3133831 - RNA, 16 nt, Mycobacterium bovis subsp bovis AF2122/97
caagucaacaccgcgg

SEQ ID NO: 3133832 - RNA, 17 nt, Mycobacterium bovis subsp bovis AF2122/97
caagucaacaccgcggc

SEQ ID NO: 3133833 - RNA, 17 nt, Mycobacterium bovis subsp bovis AF2122/97
caagucacagcucacca

SEQ ID NO: 3133834 - RNA, 16 nt, Mycobacterium bovis subsp bovis AF2122/97
caagucaccauagcuc

SEQ ID NO: 3133835 - RNA, 20 nt, Mycobacterium bovis subsp bovis AF2122/97
caagucaccauagcucaggg

SEQ ID NO: 3133836 - RNA, 21 nt, Mycobacterium bovis subsp bovis AF2122/97
caagucagaacggcggcagcg

SEQ ID NO: 3133837 - RNA, 14 nt, Mycobacterium bovis subsp bovis AF2122/97
caaguccagcagcg

SEQ ID NO: 3133838 - RNA, 15 nt, Mycobacterium bovis subsp bovis AF2122/97
caaguccagcagcga

SEQ ID NO: 3133839 - RNA, 16 nt, Mycobacterium bovis subsp bovis AF2122/97
caaguccggucgcggc

SEQ ID NO: 3133840 - RNA, 15 nt, Mycobacterium bovis subsp bovis AF2122/97
caagucgacacgccg

SEQ ID NO: 3133841 - RNA, 19 nt, Mycobacterium bovis subsp bovis AF2122/97
caagucgaccaugagccgg

SEQ ID NO: 3133842 - RNA, 20 nt, Mycobacterium bovis subsp bovis AF2122/97
caagucgaccaugagccggc

SEQ ID NO: 3133843 - RNA, 20 nt, Mycobacterium bovis subsp bovis AF2122/97
caagucgacgguggcgccgu

SEQ ID NO: 3133844 - RNA, 14 nt, Mycobacterium bovis subsp bovis AF2122/97
caagucgauguaca

SEQ ID NO: 3133845 - RNA, 21 nt, Mycobacterium bovis subsp bovis AF2122/97
caagucgauguacaccgugcg

SEQ ID NO: 3133846 - RNA, 16 nt, Mycobacterium bovis subsp bovis AF2122/97
caagucgcccagccga

SEQ ID NO: 3133847 - RNA, 20 nt, Mycobacterium bovis subsp bovis AF2122/97
caagucgccgaggcaaccga

SEQ ID NO: 3133848 - RNA, 16 nt, Mycobacterium bovis subsp bovis AF2122/97
caagucggcgcuggcc

SEQ ID NO: 3133849 - RNA, 23 nt, Mycobacterium bovis subsp bovis AF2122/97
caagucggcgcuggccgucgaag

SEQ ID NO: 3133850 - RNA, 15 nt, Mycobacterium bovis subsp bovis AF2122/97
caagucucccggccg

SEQ ID NO: 3133851 - RNA, 15 nt, Mycobacterium bovis subsp bovis AF2122/97
caagucugucuggcc

SEQ ID NO: 3133852 - RNA, 16 nt, Mycobacterium bovis subsp bovis AF2122/97
caagucugugcucacg

SEQ ID NO: 3133853 - RNA, 17 nt, Mycobacterium bovis subsp bovis AF2122/97
caagucugugcucacgg

SEQ ID NO: 3133854 - RNA, 20 nt, Mycobacterium bovis subsp bovis AF2122/97
caagucugugcucacggcgg

SEQ ID NO: 3133855 - RNA, 23 nt, Mycobacterium bovis subsp bovis AF2122/97
caagugccggcgcggagugccca

SEQ ID NO: 3133856 - RNA, 19 nt, Mycobacterium bovis subsp bovis AF2122/97
caagugcgguccggcuucg

SEQ ID NO: 3133857 - RNA, 19 nt, Mycobacterium bovis subsp bovis AF2122/97
caagugcuuccggccauug

SEQ ID NO: 3133858 - RNA, 13 nt, Mycobacterium bovis subsp bovis AF2122/97
caaguggcgcucg

SEQ ID NO: 3133859 - RNA, 15 nt, Mycobacterium bovis subsp bovis AF2122/97
caagugggccggcgg

SEQ ID NO: 3133860 - RNA, 14 nt, Mycobacterium bovis subsp bovis AF2122/97
caagugguccaagu

SEQ ID NO: 3133861 - RNA, 20 nt, Mycobacterium bovis subsp bovis AF2122/97
caaguggucgaugaaccaau

SEQ ID NO: 3133862 - RNA, 19 nt, Mycobacterium bovis subsp bovis AF2122/97
caaguggugguaggccggg

SEQ ID NO: 3133863 - RNA, 23 nt, Mycobacterium bovis subsp bovis AF2122/97
caaguggugguaggccgggagga

SEQ ID NO: 3133864 - RNA, 15 nt, Mycobacterium bovis subsp bovis AF2122/97
caagugucgccgcuc

SEQ ID NO: 3133865 - RNA, 17 nt, Mycobacterium bovis subsp bovis AF2122/97
caagugucgccgcucgg

SEQ ID NO: 3133866 - RNA, 21 nt, Mycobacterium bovis subsp bovis AF2122/97
caagugucuccggcaacagca

SEQ ID NO: 3133867 - RNA, 19 nt, Mycobacterium bovis subsp bovis AF2122/97
caaguucgccagcaacguc

SEQ ID NO: 3133868 - RNA, 20 nt, Mycobacterium bovis subsp bovis AF2122/97
caaguucgccgauaucgcag

SEQ ID NO: 3133869 - RNA, 17 nt, Mycobacterium bovis subsp bovis AF2122/97
caaguugagcagcuugg

SEQ ID NO: 3133870 - RNA, 17 nt, Mycobacterium bovis subsp bovis AF2122/97
caaguugguucaccgcg

SEQ ID NO: 3133871 - RNA, 18 nt, Mycobacterium bovis subsp bovis AF2122/97
caaguugguucaccgcga

SEQ ID NO: 3133872 - RNA, 18 nt, Mycobacterium bovis subsp bovis AF2122/97
caauacacccaacucaug

SEQ ID NO: 3133873 - RNA, 23 nt, Mycobacterium bovis subsp bovis AF2122/97
caauacccgagcguccggugguc

SEQ ID NO: 3133874 - RNA, 17 nt, Mycobacterium bovis subsp bovis AF2122/97
caauacccgccgcgaug

SEQ ID NO: 3133875 - RNA, 16 nt, Mycobacterium bovis subsp bovis AF2122/97
caauaccgcacccgcu

SEQ ID NO: 3133876 - RNA, 16 nt, Mycobacterium bovis subsp bovis AF2122/97
caauaccgccagcgcc

SEQ ID NO: 3133877 - RNA, 21 nt, Mycobacterium bovis subsp bovis AF2122/97
caauaccgccagcgccaccgu

SEQ ID NO: 3133878 - RNA, 22 nt, Mycobacterium bovis subsp bovis AF2122/97
caauaccugagcgcgcgcggug

SEQ ID NO: 3133879 - RNA, 19 nt, Mycobacterium bovis subsp bovis AF2122/97
caauacggucagcagacug

SEQ ID NO: 3133880 - RNA, 22 nt, Mycobacterium bovis subsp bovis AF2122/97
caauagaagcacgucgucgcgg

SEQ ID NO: 3133881 - RNA, 20 nt, Mycobacterium bovis subsp bovis AF2122/97
caauagcgacagcagcgcca

SEQ ID NO: 3133882 - RNA, 23 nt, Mycobacterium bovis subsp bovis AF2122/97
caauagcugcgcgaagccaccag

SEQ ID NO: 3133883 - RNA, 15 nt, Mycobacterium bovis subsp bovis AF2122/97
caauaggcuccagcg

SEQ ID NO: 3133884 - RNA, 22 nt, Mycobacterium bovis subsp bovis AF2122/97
caauaggcuccagcgcgcgccg

SEQ ID NO: 3133885 - RNA, 21 nt, Mycobacterium bovis subsp bovis AF2122/97
caauaggugucgacgcgggcg

SEQ ID NO: 3133886 - RNA, 13 nt, Mycobacterium bovis subsp bovis AF2122/97
caauaguguguuu

SEQ ID NO: 3133887 - RNA, 16 nt, Mycobacterium bovis subsp bovis AF2122/97
caaucaacgucacccc

SEQ ID NO: 3133888 - RNA, 17 nt, Mycobacterium bovis subsp bovis AF2122/97
caaucaacgucaccccc

SEQ ID NO: 3133889 - RNA, 21 nt, Mycobacterium bovis subsp bovis AF2122/97
caaucacauagccggucagua

SEQ ID NO: 3133890 - RNA, 12 nt, Mycobacterium bovis subsp bovis AF2122/97
caaucaccaacg

SEQ ID NO: 3133891 - RNA, 20 nt, Mycobacterium bovis subsp bovis AF2122/97
caaucaccgccgcgaccgcc

SEQ ID NO: 3133892 - RNA, 13 nt, Mycobacterium bovis subsp bovis AF2122/97
caaucaccgccgg

SEQ ID NO: 3133893 - RNA, 15 nt, Mycobacterium bovis subsp bovis AF2122/97
caaucagaacgucgg

SEQ ID NO: 3133894 - RNA, 18 nt, Mycobacterium bovis subsp bovis AF2122/97
caaucagcccgacaccgu

SEQ ID NO: 3133895 - RNA, 15 nt, Mycobacterium bovis subsp bovis AF2122/97
caaucaggucgucgg

SEQ ID NO: 3133896 - RNA, 17 nt, Mycobacterium bovis subsp bovis AF2122/97
caaucaugucagcgcug

SEQ ID NO: 3133897 - RNA, 13 nt, Mycobacterium bovis subsp bovis AF2122/97
caauccacagauu

SEQ ID NO: 3133898 - RNA, 20 nt, Mycobacterium bovis subsp bovis AF2122/97
caauccaggccaccccgacc

SEQ ID NO: 3133899 - RNA, 18 nt, Mycobacterium bovis subsp bovis AF2122/97
caaucccgccaucugccu

SEQ ID NO: 3133900 - RNA, 22 nt, Mycobacterium bovis subsp bovis AF2122/97
caauccgcaaaacgagcuucca

SEQ ID NO: 3133901 - RNA, 14 nt, Mycobacterium bovis subsp bovis AF2122/97
caauccgcacagcg

SEQ ID NO: 3133902 - RNA, 18 nt, Mycobacterium bovis subsp bovis AF2122/97
caauccgcacagcgacga

SEQ ID NO: 3133903 - RNA, 18 nt, Mycobacterium bovis subsp bovis AF2122/97
caauccgcccuaaugaag

SEQ ID NO: 3133904 - RNA, 23 nt, Mycobacterium bovis subsp bovis AF2122/97
caauccgcccuugccgccuuggc

SEQ ID NO: 3133905 - RNA, 14 nt, Mycobacterium bovis subsp bovis AF2122/97
caauccggcugcgg

SEQ ID NO: 3133906 - RNA, 21 nt, Mycobacterium bovis subsp bovis AF2122/97
caauugcgguucgaacgcgau

SEQ ID NO: 3133907 - RNA, 18 nt, Mycobacterium bovis subsp bovis AF2122/97
caauugcucguagcccag

SEQ ID NO: 3133908 - RNA, 13 nt, Mycobacterium bovis subsp bovis AF2122/97
caauuggcgucgu

SEQ ID NO: 3133909 - RNA, 23 nt, Mycobacterium bovis subsp bovis AF2122/97
caauuggcgucgucggcggcgac

SEQ ID NO: 3133910 - RNA, 15 nt, Mycobacterium bovis subsp bovis AF2122/97
caauugucaagccgu

SEQ ID NO: 3133911 - RNA, 16 nt, Mycobacterium bovis subsp bovis AF2122/97
caauuuucugcugcug

SEQ ID NO: 3133912 - RNA, 17 nt, Mycobacterium bovis subsp bovis AF2122/97
cacaaaauacuccgcga

SEQ ID NO: 3133913 - RNA, 18 nt, Mycobacterium bovis subsp bovis AF2122/97
cacaaacauacgccaccc

SEQ ID NO: 3133914 - RNA, 13 nt, Mycobacterium bovis subsp bovis AF2122/97
cacaaacccagca

SEQ ID NO: 3133915 - RNA, 14 nt, Mycobacterium bovis subsp bovis AF2122/97
cacaaaggcgccgg

SEQ ID NO: 3133916 - RNA, 12 nt, Mycobacterium bovis subsp bovis AF2122/97
cacaacaccggc

SEQ ID NO: 3133917 - RNA, 14 nt, Mycobacterium bovis subsp bovis AF2122/97
cacaacaccggcgu

SEQ ID NO: 3133918 - RNA, 19 nt, Mycobacterium bovis subsp bovis AF2122/97
cacaacaucgccgcagugc

SEQ ID NO: 3133919 - RNA, 21 nt, Mycobacterium bovis subsp bovis AF2122/97
cacaacccgucgagccgugcc

SEQ ID NO: 3133920 - RNA, 15 nt, Mycobacterium bovis subsp bovis AF2122/97
cacaaccgcugcugc

SEQ ID NO: 3133921 - RNA, 17 nt, Mycobacterium bovis subsp bovis AF2122/97
cacaaccgugagcacca

SEQ ID NO: 3133922 - RNA, 20 nt, Mycobacterium bovis subsp bovis AF2122/97
cacaaccgugagcaccagca

SEQ ID NO: 3133923 - RNA, 17 nt, Mycobacterium bovis subsp bovis AF2122/97
cacaacgacgaauaagu

SEQ ID NO: 3133924 - RNA, 13 nt, Mycobacterium bovis subsp bovis AF2122/97
cacaacgccagga

SEQ ID NO: 3133925 - RNA, 14 nt, Mycobacterium bovis subsp bovis AF2122/97
cacaacgcccacca

SEQ ID NO: 3133926 - RNA, 13 nt, Mycobacterium bovis subsp bovis AF2122/97
cacaacgcgacgc

SEQ ID NO: 3133927 - RNA, 15 nt, Mycobacterium bovis subsp bovis AF2122/97
cacaacgcgugacca

SEQ ID NO: 3133928 - RNA, 22 nt, Mycobacterium bovis subsp bovis AF2122/97
cacaacggauaucagcaacagc

SEQ ID NO: 3133929 - RNA, 14 nt, Mycobacterium bovis subsp bovis AF2122/97
cacaacgucuucac

SEQ ID NO: 3133930 - RNA, 15 nt, Mycobacterium bovis subsp bovis AF2122/97
cacaacguugcaccg

SEQ ID NO: 3133931 - RNA, 22 nt, Mycobacterium bovis subsp bovis AF2122/97
cacaacugauggcgcgcaacga

SEQ ID NO: 3133932 - RNA, 21 nt, Mycobacterium bovis subsp bovis AF2122/97
cacaacugcccgacgaccauu

SEQ ID NO: 3133933 - RNA, 19 nt, Mycobacterium bovis subsp bovis AF2122/97
cacaagccccgcgcguucg

SEQ ID NO: 3133934 - RNA, 17 nt, Mycobacterium bovis subsp bovis AF2122/97
cacaagccgugcagcuc

SEQ ID NO: 3133935 - RNA, 16 nt, Mycobacterium bovis subsp bovis AF2122/97
cacaagccugccggcu

SEQ ID NO: 3133936 - RNA, 17 nt, Mycobacterium bovis subsp bovis AF2122/97
cacaagccugccggcug

SEQ ID NO: 3133937 - RNA, 13 nt, Mycobacterium bovis subsp bovis AF2122/97
cacaagcgauggc

SEQ ID NO: 3133938 - RNA, 17 nt, Mycobacterium bovis subsp bovis AF2122/97
cacaagcgauggcacca

SEQ ID NO: 3133939 - RNA, 23 nt, Mycobacterium bovis subsp bovis AF2122/97
cacaagcgauggcaccacuacau

SEQ ID NO: 3133940 - RNA, 15 nt, Mycobacterium bovis subsp bovis AF2122/97
cacaagcugacacga

SEQ ID NO: 3133941 - RNA, 20 nt, Mycobacterium bovis subsp bovis AF2122/97
cacaagcugacacgacgaac

SEQ ID NO: 3133942 - RNA, 17 nt, Mycobacterium bovis subsp bovis AF2122/97
cacaaguaccgcaucga

SEQ ID NO: 3133943 - RNA, 13 nt, Mycobacterium bovis subsp bovis AF2122/97
cacaagucgacac

SEQ ID NO: 3133944 - RNA, 18 nt, Mycobacterium bovis subsp bovis AF2122/97
cacaauaggcuccagcgc

SEQ ID NO: 3133945 - RNA, 20 nt, Mycobacterium bovis subsp bovis AF2122/97
cacaaucagcccgacaccgu

SEQ ID NO: 3133946 - RNA, 17 nt, Mycobacterium bovis subsp bovis AF2122/97
cacaauccacgucgcgg

SEQ ID NO: 3133947 - RNA, 16 nt, Mycobacterium bovis subsp bovis AF2122/97
cacaaucgcagauugu

SEQ ID NO: 3133948 - RNA, 20 nt, Mycobacterium bovis subsp bovis AF2122/97
cacaaucgguugcacccgcg

SEQ ID NO: 3133949 - RNA, 17 nt, Mycobacterium bovis subsp bovis AF2122/97
cacaaugcuucggcguc

SEQ ID NO: 3133950 - RNA, 18 nt, Mycobacterium bovis subsp bovis AF2122/97
cacaauggcggcgccguc

SEQ ID NO: 3133951 - RNA, 23 nt, Mycobacterium bovis subsp bovis AF2122/97
cacaauggcucugaggucaccgg

SEQ ID NO: 3133952 - RNA, 16 nt, Mycobacterium bovis subsp bovis AF2122/97
cacacaauucgggcgu

SEQ ID NO: 3133953 - RNA, 19 nt, Mycobacterium bovis subsp bovis AF2122/97
cacacacccgacacggcuc

SEQ ID NO: 3133954 - RNA, 23 nt, Mycobacterium bovis subsp bovis AF2122/97
cacacacugccggacagccacgc

SEQ ID NO: 3133955 - RNA, 22 nt, Mycobacterium bovis subsp bovis AF2122/97
cacacagaggucggucagccac

SEQ ID NO: 3133956 - RNA, 23 nt, Mycobacterium bovis subsp bovis AF2122/97
cacacagaggucggucagccacc

SEQ ID NO: 3133957 - RNA, 21 nt, Mycobacterium bovis subsp bovis AF2122/97
cacacaggcggcgaacugccu

SEQ ID NO: 3133958 - RNA, 17 nt, Mycobacterium bovis subsp bovis AF2122/97
cacacagguccugcgcc

SEQ ID NO: 3133959 - RNA, 22 nt, Mycobacterium bovis subsp bovis AF2122/97
cacacagguccugcgccgcacg

SEQ ID NO: 3133960 - RNA, 17 nt, Mycobacterium bovis subsp bovis AF2122/97
cacacauagcgauucgc

SEQ ID NO: 3133961 - RNA, 15 nt, Mycobacterium bovis subsp bovis AF2122/97
cacaccaacaccgcg

SEQ ID NO: 3133962 - RNA, 17 nt, Mycobacterium bovis subsp bovis AF2122/97
cacaccaaggccgagcg

SEQ ID NO: 3133963 - RNA, 13 nt, Mycobacterium bovis subsp bovis AF2122/97
cacaccaccgccg

SEQ ID NO: 3133964 - RNA, 17 nt, Mycobacterium bovis subsp bovis AF2122/97
cacaccacgauggcggc

SEQ ID NO: 3133965 - RNA, 12 nt, Mycobacterium bovis subsp bovis AF2122/97
cacaccagcgca

SEQ ID NO: 3133966 - RNA, 19 nt, Mycobacterium bovis subsp bovis AF2122/97
cacaccagcgggcaucgcg

SEQ ID NO: 3133967 - RNA, 14 nt, Mycobacterium bovis subsp bovis AF2122/97
cacaccagcggucg

SEQ ID NO: 3133968 - RNA, 21 nt, Mycobacterium bovis subsp bovis AF2122/97
cacaccaggccgagccgcccg

SEQ ID NO: 3133969 - RNA, 19 nt, Mycobacterium bovis subsp bovis AF2122/97
cacaccaugguuggcgacu

SEQ ID NO: 3133970 - RNA, 14 nt, Mycobacterium bovis subsp bovis AF2122/97
cacacccacaccca

SEQ ID NO: 3133971 - RNA, 23 nt, Mycobacterium bovis subsp bovis AF2122/97
cacacccagcgugcccgccaccg

SEQ ID NO: 3133972 - RNA, 15 nt, Mycobacterium bovis subsp bovis AF2122/97
cacacccaucaccgc

SEQ ID NO: 3133973 - RNA, 21 nt, Mycobacterium bovis subsp bovis AF2122/97
cacacccaucaccgccagccc

SEQ ID NO: 3133974 - RNA, 13 nt, Mycobacterium bovis subsp bovis AF2122/97
cacaccccaggca

SEQ ID NO: 3133975 - RNA, 18 nt, Mycobacterium bovis subsp bovis AF2122/97
cacaccccaggcacccug

SEQ ID NO: 3133976 - RNA, 13 nt, Mycobacterium bovis subsp bovis AF2122/97
cacacccggcaca

SEQ ID NO: 3133977 - RNA, 23 nt, Mycobacterium bovis subsp bovis AF2122/97
cacacccgucaugcccaccgccu

SEQ ID NO: 3133978 - RNA, 13 nt, Mycobacterium bovis subsp bovis AF2122/97
cacacccugcagc

SEQ ID NO: 3133979 - RNA, 18 nt, Mycobacterium bovis subsp bovis AF2122/97
cacaccgacagcacccaa

SEQ ID NO: 3133980 - RNA, 15 nt, Mycobacterium bovis subsp bovis AF2122/97
cacaccgacgccgcc

SEQ ID NO: 3133981 - RNA, 18 nt, Mycobacterium bovis subsp bovis AF2122/97
cacaccgacgccgccagg

SEQ ID NO: 3133982 - RNA, 17 nt, Mycobacterium bovis subsp bovis AF2122/97
cacaccgagcacgggua

SEQ ID NO: 3133983 - RNA, 14 nt, Mycobacterium bovis subsp bovis AF2122/97
cacaccgagcgcaa

SEQ ID NO: 3133984 - RNA, 16 nt, Mycobacterium bovis subsp bovis AF2122/97
cacaccgagcgcaauc

SEQ ID NO: 3133985 - RNA, 13 nt, Mycobacterium bovis subsp bovis AF2122/97
cacaccgaucggc

SEQ ID NO: 3133986 - RNA, 15 nt, Mycobacterium bovis subsp bovis AF2122/97
cacaccgaucggcaa

SEQ ID NO: 3133987 - RNA, 14 nt, Mycobacterium bovis subsp bovis AF2122/97
cacaccgccagcgg

SEQ ID NO: 3133988 - RNA, 12 nt, Mycobacterium bovis subsp bovis AF2122/97
cacaccgccgcc

SEQ ID NO: 3133989 - RNA, 13 nt, Mycobacterium bovis subsp bovis AF2122/97
cacaccgccgcca

SEQ ID NO: 3133990 - RNA, 12 nt, Mycobacterium bovis subsp bovis AF2122/97
cacaccgcggcg

SEQ ID NO: 3133991 - RNA, 14 nt, Mycobacterium bovis subsp bovis AF2122/97
cacaccggcacugc

SEQ ID NO: 3133992 - RNA, 20 nt, Mycobacterium bovis subsp bovis AF2122/97
cacaccggcuuugcuugccg

SEQ ID NO: 3133993 - RNA, 15 nt, Mycobacterium bovis subsp bovis AF2122/97
cacaggccgccuggg

SEQ ID NO: 3133994 - RNA, 19 nt, Mycobacterium bovis subsp bovis AF2122/97
cacaggcgacggcccucga

SEQ ID NO: 3133995 - RNA, 14 nt, Mycobacterium bovis subsp bovis AF2122/97
cacaggcgcgaucg

SEQ ID NO: 3133996 - RNA, 12 nt, Mycobacterium bovis subsp bovis AF2122/97
cacaggcggcca

SEQ ID NO: 3133997 - RNA, 17 nt, Mycobacterium bovis subsp bovis AF2122/97
cacaggcguccaucgcc

SEQ ID NO: 3133998 - RNA, 13 nt, Mycobacterium bovis subsp bovis AF2122/97
cacaggcugaaga

SEQ ID NO: 3133999 - RNA, 12 nt, Mycobacterium bovis subsp bovis AF2122/97
cacaggcuggcg

SEQ ID NO: 3134000 - RNA, 14 nt, Mycobacterium bovis subsp bovis AF2122/97
cacaggggcagcgc

SEQ ID NO: 3134001 - RNA, 18 nt, Mycobacterium bovis subsp bovis AF2122/97
cacaggggcagcgcggcc

SEQ ID NO: 3134002 - RNA, 19 nt, Mycobacterium bovis subsp bovis AF2122/97
cacaggggcagcgcggcca

SEQ ID NO: 3134003 - RNA, 21 nt, Mycobacterium bovis subsp bovis AF2122/97
cacaggggcagcgcggccacc

SEQ ID NO: 3134004 - RNA, 22 nt, Mycobacterium bovis subsp bovis AF2122/97
cacagguagaccgucuccaucg

SEQ ID NO: 3134005 - RNA, 20 nt, Mycobacterium bovis subsp bovis AF2122/97
cacagguccugcgccgcacg

SEQ ID NO: 3134006 - RNA, 22 nt, Mycobacterium bovis subsp bovis AF2122/97
cacaggugccaaacgccgcccg

SEQ ID NO: 3134007 - RNA, 15 nt, Mycobacterium bovis subsp bovis AF2122/97
cacagguuugcgccg

SEQ ID NO: 3134008 - RNA, 22 nt, Mycobacterium bovis subsp bovis AF2122/97
cacagguuugcgccgcgcagcg

SEQ ID NO: 3134009 - RNA, 14 nt, Mycobacterium bovis subsp bovis AF2122/97
cacagucgccggcc

SEQ ID NO: 3134010 - RNA, 15 nt, Mycobacterium bovis subsp bovis AF2122/97
cacagucgccggccg

SEQ ID NO: 3134011 - RNA, 17 nt, Mycobacterium bovis subsp bovis AF2122/97
cacagucgccggccggc

SEQ ID NO: 3134012 - RNA, 14 nt, Mycobacterium bovis subsp bovis AF2122/97
cacagucgcucgcu

SEQ ID NO: 3134013 - RNA, 15 nt, Mycobacterium bovis subsp bovis AF2122/97
cacagucgugagcca

SEQ ID NO: 3134014 - RNA, 19 nt, Mycobacterium bovis subsp bovis AF2122/97
cacaguggcucgcggaugc

SEQ ID NO: 3134015 - RNA, 19 nt, Mycobacterium bovis subsp bovis AF2122/97
cacaguuaucagccgcgcg

SEQ ID NO: 3134016 - RNA, 13 nt, Mycobacterium bovis subsp bovis AF2122/97
cacauacaccggc

SEQ ID NO: 3134017 - RNA, 17 nt, Mycobacterium bovis subsp bovis AF2122/97
cacauaccaccacgugg

SEQ ID NO: 3134018 - RNA, 18 nt, Mycobacterium bovis subsp bovis AF2122/97
cacauagcgauucgcgcu

SEQ ID NO: 3134019 - RNA, 17 nt, Mycobacterium bovis subsp bovis AF2122/97
cacauaugugcccggcg

SEQ ID NO: 3134020 - RNA, 18 nt, Mycobacterium bovis subsp bovis AF2122/97
cacaucagccgcaccagu

SEQ ID NO: 3134021 - RNA, 14 nt, Mycobacterium bovis subsp bovis AF2122/97
cacaucaggucggc

SEQ ID NO: 3134022 - RNA, 19 nt, Mycobacterium bovis subsp bovis AF2122/97
cacaucaugggcgcugcca

SEQ ID NO: 3134023 - RNA, 13 nt, Mycobacterium bovis subsp bovis AF2122/97
cacauccacgcac

SEQ ID NO: 3134024 - RNA, 20 nt, Mycobacterium bovis subsp bovis AF2122/97
cacauccacgcacucacuac

SEQ ID NO: 3134025 - RNA, 13 nt, Mycobacterium bovis subsp bovis AF2122/97
cacauccaguaac

SEQ ID NO: 3134026 - RNA, 23 nt, Mycobacterium bovis subsp bovis AF2122/97
cacauccaguaaccguccgcgga

SEQ ID NO: 3134027 - RNA, 19 nt, Mycobacterium bovis subsp bovis AF2122/97
cacauccgcuugcggggcc

SEQ ID NO: 3134028 - RNA, 15 nt, Mycobacterium bovis subsp bovis AF2122/97
cacauccggucagau

SEQ ID NO: 3134029 - RNA, 14 nt, Mycobacterium bovis subsp bovis AF2122/97
cacauccuggcggc

SEQ ID NO: 3134030 - RNA, 21 nt, Mycobacterium bovis subsp bovis AF2122/97
cacauccuggcggcugcagcc

SEQ ID NO: 3134031 - RNA, 16 nt, Mycobacterium bovis subsp bovis AF2122/97
cacaucgaugucggcu

SEQ ID NO: 3134032 - RNA, 14 nt, Mycobacterium bovis subsp bovis AF2122/97
cacaucgccggagu

SEQ ID NO: 3134033 - RNA, 20 nt, Mycobacterium bovis subsp bovis AF2122/97
cacaucgcucaucgucaccu

SEQ ID NO: 3134034 - RNA, 22 nt, Mycobacterium bovis subsp bovis AF2122/97
cacaucggccucugaccagccg

SEQ ID NO: 3134035 - RNA, 19 nt, Mycobacterium bovis subsp bovis AF2122/97
cacaucggcucugauggug

SEQ ID NO: 3134036 - RNA, 22 nt, Mycobacterium bovis subsp bovis AF2122/97
cacaucgguguggcccaacacc

SEQ ID NO: 3134037 - RNA, 16 nt, Mycobacterium bovis subsp bovis AF2122/97
cacaucgucacugcca

SEQ ID NO: 3134038 - RNA, 17 nt, Mycobacterium bovis subsp bovis AF2122/97
cacaucgucacugccac

SEQ ID NO: 3134039 - RNA, 12 nt, Mycobacterium bovis subsp bovis AF2122/97
cacaucgucggc

SEQ ID NO: 3134040 - RNA, 19 nt, Mycobacterium bovis subsp bovis AF2122/97
cacaucguucaugaucggc

SEQ ID NO: 3134041 - RNA, 19 nt, Mycobacterium bovis subsp bovis AF2122/97
cacaucguugucauagaaa

SEQ ID NO: 3134042 - RNA, 19 nt, Mycobacterium bovis subsp bovis AF2122/97
cacaugaccugauccggcc

SEQ ID NO: 3134043 - RNA, 12 nt, Mycobacterium bovis subsp bovis AF2122/97
cacaugacgauc

SEQ ID NO: 3134044 - RNA, 18 nt, Mycobacterium bovis subsp bovis AF2122/97
cacaugacgaucgcggcg

SEQ ID NO: 3134045 - RNA, 23 nt, Mycobacterium bovis subsp bovis AF2122/97
cacaugcaagccgacaucggcgg

SEQ ID NO: 3134046 - RNA, 13 nt, Mycobacterium bovis subsp bovis AF2122/97
cacaugcgccgaa

SEQ ID NO: 3134047 - RNA, 16 nt, Mycobacterium bovis subsp bovis AF2122/97
cacaugcgcguccagc

SEQ ID NO: 3134048 - RNA, 19 nt, Mycobacterium bovis subsp bovis AF2122/97
cacaugcgcguccagcugg

SEQ ID NO: 3134049 - RNA, 13 nt, Mycobacterium bovis subsp bovis AF2122/97
cacaugcucaggg

SEQ ID NO: 3134050 - RNA, 19 nt, Mycobacterium bovis subsp bovis AF2122/97
cacaugcucgacgcccgcc

SEQ ID NO: 3134051 - RNA, 17 nt, Mycobacterium bovis subsp bovis AF2122/97
cacauggaacucacccu

SEQ ID NO: 3134052 - RNA, 19 nt, Mycobacterium bovis subsp bovis AF2122/97
cacauggaacucacccuau

SEQ ID NO: 3134053 - RNA, 19 nt, Mycobacterium bovis subsp bovis AF2122/97
cacauggcccggaggccgc

SEQ ID NO: 3134054 - RNA, 15 nt, Mycobacterium bovis subsp bovis AF2122/97
cacauggcggcccgg

SEQ ID NO: 3134055 - RNA, 19 nt, Mycobacterium bovis subsp bovis AF2122/97
cacaugggagccguucggu

SEQ ID NO: 3134056 - RNA, 19 nt, Mycobacterium bovis subsp bovis AF2122/97
cacauguugucgacggucg

SEQ ID NO: 3134057 - RNA, 16 nt, Mycobacterium bovis subsp bovis AF2122/97
cacauuccgcaguccc

SEQ ID NO: 3134058 - RNA, 12 nt, Mycobacterium bovis subsp bovis AF2122/97
cacauugaccag

SEQ ID NO: 3134059 - RNA, 21 nt, Mycobacterium bovis subsp bovis AF2122/97
cacauugaucgacggccagcc

SEQ ID NO: 3134060 - RNA, 20 nt, Mycobacterium bovis subsp bovis AF2122/97
cacauugccggccaccagcc

SEQ ID NO: 3134061 - RNA, 15 nt, Mycobacterium bovis subsp bovis AF2122/97
cacauuggcgaucag

SEQ ID NO: 3134062 - RNA, 22 nt, Mycobacterium bovis subsp bovis AF2122/97
cacauuggugauggccgacguc

SEQ ID NO: 3134063 - RNA, 18 nt, Mycobacterium bovis subsp bovis AF2122/97
cacauuuuuguuguuauu

SEQ ID NO: 3134064 - RNA, 23 nt, Mycobacterium bovis subsp bovis AF2122/97
caccaaaugccccgaaccgcgcu

SEQ ID NO: 3134065 - RNA, 20 nt, Mycobacterium bovis subsp bovis AF2122/97
caccaacaccagcgcguugc

SEQ ID NO: 3134066 - RNA, 17 nt, Mycobacterium bovis subsp bovis AF2122/97
caccaacaccgcggcgc

SEQ ID NO: 3134067 - RNA, 15 nt, Mycobacterium bovis subsp bovis AF2122/97
caccaaccagugcag

SEQ ID NO: 3134068 - RNA, 17 nt, Mycobacterium bovis subsp bovis AF2122/97
caccaacccacccccca

SEQ ID NO: 3134069 - RNA, 22 nt, Mycobacterium bovis subsp bovis AF2122/97
caccaacccaccccccagcgcc

SEQ ID NO: 3134070 - RNA, 19 nt, Mycobacterium bovis subsp bovis AF2122/97
caccaacccguguggcacg

SEQ ID NO: 3134071 - RNA, 15 nt, Mycobacterium bovis subsp bovis AF2122/97
caccaaccucaucgc

SEQ ID NO: 3134072 - RNA, 22 nt, Mycobacterium bovis subsp bovis AF2122/97
caccaaccucaucgcggucgcc

SEQ ID NO: 3134073 - RNA, 14 nt, Mycobacterium bovis subsp bovis AF2122/97
caccaaccugagca

SEQ ID NO: 3134074 - RNA, 14 nt, Mycobacterium bovis subsp bovis AF2122/97
caccaacgccaccg

SEQ ID NO: 3134075 - RNA, 16 nt, Mycobacterium bovis subsp bovis AF2122/97
caccaacgccaccguc

SEQ ID NO: 3134076 - RNA, 17 nt, Mycobacterium bovis subsp bovis AF2122/97
caccaacgcgaucaggc

SEQ ID NO: 3134077 - RNA, 13 nt, Mycobacterium bovis subsp bovis AF2122/97
caccaacucgacg

SEQ ID NO: 3134078 - RNA, 18 nt, Mycobacterium bovis subsp bovis AF2122/97
caccaagacaccggccug

SEQ ID NO: 3134079 - RNA, 13 nt, Mycobacterium bovis subsp bovis AF2122/97
caccaagacgcca

SEQ ID NO: 3134080 - RNA, 15 nt, Mycobacterium bovis subsp bovis AF2122/97
caccaccggcaccgc

SEQ ID NO: 3134081 - RNA, 13 nt, Mycobacterium bovis subsp bovis AF2122/97
caccaccggcccc

SEQ ID NO: 3134082 - RNA, 15 nt, Mycobacterium bovis subsp bovis AF2122/97
caccaccggccccac

SEQ ID NO: 3134083 - RNA, 18 nt, Mycobacterium bovis subsp bovis AF2122/97
caccaccggccccaccga

SEQ ID NO: 3134084 - RNA, 20 nt, Mycobacterium bovis subsp bovis AF2122/97
caccaccggccccaccggca

SEQ ID NO: 3134085 - RNA, 12 nt, Mycobacterium bovis subsp bovis AF2122/97
caccaccggcgc

SEQ ID NO: 3134086 - RNA, 13 nt, Mycobacterium bovis subsp bovis AF2122/97
caccaccggcgcc

SEQ ID NO: 3134087 - RNA, 15 nt, Mycobacterium bovis subsp bovis AF2122/97
caccaccggcgccgc

SEQ ID NO: 3134088 - RNA, 18 nt, Mycobacterium bovis subsp bovis AF2122/97
caccaccggcgccgccgu

SEQ ID NO: 3134089 - RNA, 19 nt, Mycobacterium bovis subsp bovis AF2122/97
caccaccggcgccgccguu

SEQ ID NO: 3134090 - RNA, 21 nt, Mycobacterium bovis subsp bovis AF2122/97
caccaccggcgccgccguugc

SEQ ID NO: 3134091 - RNA, 14 nt, Mycobacterium bovis subsp bovis AF2122/97
caccaccggcgccu

SEQ ID NO: 3134092 - RNA, 14 nt, Mycobacterium bovis subsp bovis AF2122/97
caccaccggcuccc

SEQ ID NO: 3134093 - RNA, 20 nt, Mycobacterium bovis subsp bovis AF2122/97
caccaccggcucccgggggc

SEQ ID NO: 3134094 - RNA, 20 nt, Mycobacterium bovis subsp bovis AF2122/97
caccaccgucgagccggaca

SEQ ID NO: 3134095 - RNA, 17 nt, Mycobacterium bovis subsp bovis AF2122/97
caccaccguggccgugu

SEQ ID NO: 3134096 - RNA, 19 nt, Mycobacterium bovis subsp bovis AF2122/97
caccaccguggcgcccgcg

SEQ ID NO: 3134097 - RNA, 19 nt, Mycobacterium bovis subsp bovis AF2122/97
caccaccuccccgaucugc

SEQ ID NO: 3134098 - RNA, 13 nt, Mycobacterium bovis subsp bovis AF2122/97
caccaccucguca

SEQ ID NO: 3134099 - RNA, 22 nt, Mycobacterium bovis subsp bovis AF2122/97
caccaccuggccggccaucuug

SEQ ID NO: 3134100 - RNA, 16 nt, Mycobacterium bovis subsp bovis AF2122/97
caccaccuggugcaac

SEQ ID NO: 3134101 - RNA, 18 nt, Mycobacterium bovis subsp bovis AF2122/97
caccaccuggugcaaccg

SEQ ID NO: 3134102 - RNA, 13 nt, Mycobacterium bovis subsp bovis AF2122/97
caccaccuuggau

SEQ ID NO: 3134103 - RNA, 18 nt, Mycobacterium bovis subsp bovis AF2122/97
caccacgaacacguucgg

SEQ ID NO: 3134104 - RNA, 23 nt, Mycobacterium bovis subsp bovis AF2122/97
caccacgaacacguucggguacc

SEQ ID NO: 3134105 - RNA, 16 nt, Mycobacterium bovis subsp bovis AF2122/97
caccacgaacucggcc

SEQ ID NO: 3134106 - RNA, 22 nt, Mycobacterium bovis subsp bovis AF2122/97
caccacgaacucggccgggcgg

SEQ ID NO: 3134107 - RNA, 23 nt, Mycobacterium bovis subsp bovis AF2122/97
caccacgaccgacaccccgaugc

SEQ ID NO: 3134108 - RNA, 13 nt, Mycobacterium bovis subsp bovis AF2122/97
caccacgaccgcg

SEQ ID NO: 3134109 - RNA, 15 nt, Mycobacterium bovis subsp bovis AF2122/97
caccacgagcagccg

SEQ ID NO: 3134110 - RNA, 19 nt, Mycobacterium bovis subsp bovis AF2122/97
caccacgaucaacucgugc

SEQ ID NO: 3134111 - RNA, 12 nt, Mycobacterium bovis subsp bovis AF2122/97
caccacgaucgc

SEQ ID NO: 3134112 - RNA, 13 nt, Mycobacterium bovis subsp bovis AF2122/97
caccacgaucgca

SEQ ID NO: 3134113 - RNA, 14 nt, Mycobacterium bovis subsp bovis AF2122/97
caccacgaucgcag

SEQ ID NO: 3134114 - RNA, 14 nt, Mycobacterium bovis subsp bovis AF2122/97
caccacgaucgcga

SEQ ID NO: 3134115 - RNA, 16 nt, Mycobacterium bovis subsp bovis AF2122/97
caccacgauggcggcc

SEQ ID NO: 3134116 - RNA, 19 nt, Mycobacterium bovis subsp bovis AF2122/97
caccacgauggcggccacc

SEQ ID NO: 3134117 - RNA, 22 nt, Mycobacterium bovis subsp bovis AF2122/97
caccacgauggcggccaccguc

SEQ ID NO: 3134118 - RNA, 20 nt, Mycobacterium bovis subsp bovis AF2122/97
caccacgcaugcgcgcgccg

SEQ ID NO: 3134119 - RNA, 14 nt, Mycobacterium bovis subsp bovis AF2122/97
caccacgccagccc

SEQ ID NO: 3134120 - RNA, 20 nt, Mycobacterium bovis subsp bovis AF2122/97
caccacgccagcccguccgg

SEQ ID NO: 3134121 - RNA, 15 nt, Mycobacterium bovis subsp bovis AF2122/97
caccacgcccgacga

SEQ ID NO: 3134122 - RNA, 17 nt, Mycobacterium bovis subsp bovis AF2122/97
caccacgcccgacgagg

SEQ ID NO: 3134123 - RNA, 19 nt, Mycobacterium bovis subsp bovis AF2122/97
caccacgccguagcgcagc

SEQ ID NO: 3134124 - RNA, 12 nt, Mycobacterium bovis subsp bovis AF2122/97
caccacgcgacg

SEQ ID NO: 3134125 - RNA, 17 nt, Mycobacterium bovis subsp bovis AF2122/97
caccacgcgccgcacau

SEQ ID NO: 3134126 - RNA, 21 nt, Mycobacterium bovis subsp bovis AF2122/97
caccacgcgcguuuagucucc

SEQ ID NO: 3134127 - RNA, 13 nt, Mycobacterium bovis subsp bovis AF2122/97
caccacgcuggcc

SEQ ID NO: 3134128 - RNA, 15 nt, Mycobacterium bovis subsp bovis AF2122/97
caccacggaccagcg

SEQ ID NO: 3134129 - RNA, 12 nt, Mycobacterium bovis subsp bovis AF2122/97
caccacggccag

SEQ ID NO: 3134130 - RNA, 14 nt, Mycobacterium bovis subsp bovis AF2122/97
caccacggccagaa

SEQ ID NO: 3134131 - RNA, 14 nt, Mycobacterium bovis subsp bovis AF2122/97
caccacggccgccg

SEQ ID NO: 3134132 - RNA, 15 nt, Mycobacterium bovis subsp bovis AF2122/97
caccacggcgcgcgc

SEQ ID NO: 3134133 - RNA, 19 nt, Mycobacterium bovis subsp bovis AF2122/97
caccacggcgcgcgcgccg

SEQ ID NO: 3134134 - RNA, 14 nt, Mycobacterium bovis subsp bovis AF2122/97
caccacggcggcca

SEQ ID NO: 3134135 - RNA, 14 nt, Mycobacterium bovis subsp bovis AF2122/97
caccacggcguugc

SEQ ID NO: 3134136 - RNA, 16 nt, Mycobacterium bovis subsp bovis AF2122/97
caccacggcguugccg

SEQ ID NO: 3134137 - RNA, 18 nt, Mycobacterium bovis subsp bovis AF2122/97
caccacggcguugccgcc

SEQ ID NO: 3134138 - RNA, 20 nt, Mycobacterium bovis subsp bovis AF2122/97
caccacggcguugccgccgg

SEQ ID NO: 3134139 - RNA, 22 nt, Mycobacterium bovis subsp bovis AF2122/97
caccacggcguugccgccggcu

SEQ ID NO: 3134140 - RNA, 23 nt, Mycobacterium bovis subsp bovis AF2122/97
caccacggcguugccgccggcuc

SEQ ID NO: 3134141 - RNA, 17 nt, Mycobacterium bovis subsp bovis AF2122/97
caccacggucaagccgg

SEQ ID NO: 3134142 - RNA, 20 nt, Mycobacterium bovis subsp bovis AF2122/97
caccacggucaagccggcgc

SEQ ID NO: 3134143 - RNA, 21 nt, Mycobacterium bovis subsp bovis AF2122/97
caccacggugacuaccgugca

SEQ ID NO: 3134144 - RNA, 16 nt, Mycobacterium bovis subsp bovis AF2122/97
caccacggugccgacg

SEQ ID NO: 3134145 - RNA, 22 nt, Mycobacterium bovis subsp bovis AF2122/97
caccacgguggccgcugccagc

SEQ ID NO: 3134146 - RNA, 23 nt, Mycobacterium bovis subsp bovis AF2122/97
caccacgguggccgcugccagcc

SEQ ID NO: 3134147 - RNA, 18 nt, Mycobacterium bovis subsp bovis AF2122/97
caccacgguuggccacca

SEQ ID NO: 3134148 - RNA, 20 nt, Mycobacterium bovis subsp bovis AF2122/97
caccacgguuggccaccagc

SEQ ID NO: 3134149 - RNA, 16 nt, Mycobacterium bovis subsp bovis AF2122/97
caccacgucgaccgaa

SEQ ID NO: 3134150 - RNA, 14 nt, Mycobacterium bovis subsp bovis AF2122/97
caccacgugcgcca

SEQ ID NO: 3134151 - RNA, 14 nt, Mycobacterium bovis subsp bovis AF2122/97
caccacguggcccu

SEQ ID NO: 3134152 - RNA, 16 nt, Mycobacterium bovis subsp bovis AF2122/97
caccacguggcccucc

SEQ ID NO: 3134153 - RNA, 23 nt, Mycobacterium bovis subsp bovis AF2122/97
caccacuagcggcucaccgcgca

SEQ ID NO: 3134154 - RNA, 20 nt, Mycobacterium bovis subsp bovis AF2122/97
caccacuaggucgccggcca

SEQ ID NO: 3134155 - RNA, 23 nt, Mycobacterium bovis subsp bovis AF2122/97
caccacuaggucgccggccacga

SEQ ID NO: 3134156 - RNA, 23 nt, Mycobacterium bovis subsp bovis AF2122/97
caccacuccggcguugacgauca

SEQ ID NO: 3134157 - RNA, 17 nt, Mycobacterium bovis subsp bovis AF2122/97
caccacucggucguugc

SEQ ID NO: 3134158 - RNA, 16 nt, Mycobacterium bovis subsp bovis AF2122/97
caccacugcgcccgcc

SEQ ID NO: 3134159 - RNA, 18 nt, Mycobacterium bovis subsp bovis AF2122/97
caccacugcgcccgccac

SEQ ID NO: 3134160 - RNA, 18 nt, Mycobacterium bovis subsp bovis AF2122/97
caccacuucggcgccgcg

SEQ ID NO: 3134161 - RNA, 22 nt, Mycobacterium bovis subsp bovis AF2122/97
caccacuucggcgccgcgccgu

SEQ ID NO: 3134162 - RNA, 22 nt, Mycobacterium bovis subsp bovis AF2122/97
caccacuuggguggcgccguug

SEQ ID NO: 3134163 - RNA, 21 nt, Mycobacterium bovis subsp bovis AF2122/97
caccagaaaacauugcggccc

SEQ ID NO: 3134164 - RNA, 22 nt, Mycobacterium bovis subsp bovis AF2122/97
caccagaaaacauugcggcccu

SEQ ID NO: 3134165 - RNA, 13 nt, Mycobacterium bovis subsp bovis AF2122/97
caccagaaacacc

SEQ ID NO: 3134166 - RNA, 16 nt, Mycobacterium bovis subsp bovis AF2122/97
caccaggggcgcguca

SEQ ID NO: 3134167 - RNA, 17 nt, Mycobacterium bovis subsp bovis AF2122/97
caccagggugccgggca

SEQ ID NO: 3134168 - RNA, 17 nt, Mycobacterium bovis subsp bovis AF2122/97
caccaggguguauggcc

SEQ ID NO: 3134169 - RNA, 19 nt, Mycobacterium bovis subsp bovis AF2122/97
caccaggguuggcaccguc

SEQ ID NO: 3134170 - RNA, 19 nt, Mycobacterium bovis subsp bovis AF2122/97
caccagguacgcgaucagc

SEQ ID NO: 3134171 - RNA, 22 nt, Mycobacterium bovis subsp bovis AF2122/97
caccaggucauugccggcgacg

SEQ ID NO: 3134172 - RNA, 16 nt, Mycobacterium bovis subsp bovis AF2122/97
caccagguccaccccg

SEQ ID NO: 3134173 - RNA, 18 nt, Mycobacterium bovis subsp bovis AF2122/97
caccagguccaccccgcc

SEQ ID NO: 3134174 - RNA, 19 nt, Mycobacterium bovis subsp bovis AF2122/97
caccaggucuucgaccacg

SEQ ID NO: 3134175 - RNA, 22 nt, Mycobacterium bovis subsp bovis AF2122/97
caccaggucuucgaccacgguc

SEQ ID NO: 3134176 - RNA, 23 nt, Mycobacterium bovis subsp bovis AF2122/97
caccaggucuucgaccacggucu

SEQ ID NO: 3134177 - RNA, 16 nt, Mycobacterium bovis subsp bovis AF2122/97
caccagguugcaaccu

SEQ ID NO: 3134178 - RNA, 23 nt, Mycobacterium bovis subsp bovis AF2122/97
caccagguugcaaccuugggcgc

SEQ ID NO: 3134179 - RNA, 21 nt, Mycobacterium bovis subsp bovis AF2122/97
caccagguugugauccugggu

SEQ ID NO: 3134180 - RNA, 14 nt, Mycobacterium bovis subsp bovis AF2122/97
caccaguaccaccg

SEQ ID NO: 3134181 - RNA, 16 nt, Mycobacterium bovis subsp bovis AF2122/97
caccaguaccaccggc

SEQ ID NO: 3134182 - RNA, 15 nt, Mycobacterium bovis subsp bovis AF2122/97
caccagucacgccca

SEQ ID NO: 3134183 - RNA, 13 nt, Mycobacterium bovis subsp bovis AF2122/97
caccaguccagcg

SEQ ID NO: 3134184 - RNA, 14 nt, Mycobacterium bovis subsp bovis AF2122/97
caccaguccagcgg

SEQ ID NO: 3134185 - RNA, 20 nt, Mycobacterium bovis subsp bovis AF2122/97
caccagucgccccaagcgcc

SEQ ID NO: 3134186 - RNA, 15 nt, Mycobacterium bovis subsp bovis AF2122/97
caccagucgcgcagc

SEQ ID NO: 3134187 - RNA, 22 nt, Mycobacterium bovis subsp bovis AF2122/97
caccagucgcugauugcggucg

SEQ ID NO: 3134188 - RNA, 16 nt, Mycobacterium bovis subsp bovis AF2122/97
caccagugcaucgauc

SEQ ID NO: 3134189 - RNA, 15 nt, Mycobacterium bovis subsp bovis AF2122/97
caccagugccccgcc

SEQ ID NO: 3134190 - RNA, 15 nt, Mycobacterium bovis subsp bovis AF2122/97
caccaguggcgccca

SEQ ID NO: 3134191 - RNA, 13 nt, Mycobacterium bovis subsp bovis AF2122/97
caccaguggcgcg

SEQ ID NO: 3134192 - RNA, 19 nt, Mycobacterium bovis subsp bovis AF2122/97
caccaguguggcgaugacc

SEQ ID NO: 3134193 - RNA, 18 nt, Mycobacterium bovis subsp bovis AF2122/97
caccaguuugugccgccg

SEQ ID NO: 3134194 - RNA, 22 nt, Mycobacterium bovis subsp bovis AF2122/97
caccaguuugugccgccgcggc

SEQ ID NO: 3134195 - RNA, 17 nt, Mycobacterium bovis subsp bovis AF2122/97
caccauacucaccgacg

SEQ ID NO: 3134196 - RNA, 24 nt, Mycobacterium bovis subsp bovis AF2122/97
caccaucaaggacucggacgcgcc

SEQ ID NO: 3134197 - RNA, 18 nt, Mycobacterium bovis subsp bovis AF2122/97
caccaucaccgccuuugc

SEQ ID NO: 3134198 - RNA, 22 nt, Mycobacterium bovis subsp bovis AF2122/97
caccaucaccgccuuugccgcc

SEQ ID NO: 3134199 - RNA, 14 nt, Mycobacterium bovis subsp bovis AF2122/97
caccaucaccggug

SEQ ID NO: 3134200 - RNA, 14 nt, Mycobacterium bovis subsp bovis AF2122/97
caccaucaccucgc

SEQ ID NO: 3134201 - RNA, 15 nt, Mycobacterium bovis subsp bovis AF2122/97
caccaucacgguggc

SEQ ID NO: 3134202 - RNA, 14 nt, Mycobacterium bovis subsp bovis AF2122/97
caccaucaucaccu

SEQ ID NO: 3134203 - RNA, 13 nt, Mycobacterium bovis subsp bovis AF2122/97
caccauccagccc

SEQ ID NO: 3134204 - RNA, 22 nt, Mycobacterium bovis subsp bovis AF2122/97
caccauccagcccaucccgauc

SEQ ID NO: 3134205 - RNA, 14 nt, Mycobacterium bovis subsp bovis AF2122/97
caccauccccggca

SEQ ID NO: 3134206 - RNA, 16 nt, Mycobacterium bovis subsp bovis AF2122/97
caccaucgccgccgcg

SEQ ID NO: 3134207 - RNA, 19 nt, Mycobacterium bovis subsp bovis AF2122/97
caccaucgccgccgcgcgu

SEQ ID NO: 3134208 - RNA, 20 nt, Mycobacterium bovis subsp bovis AF2122/97
caccaucgccgccgcgcguu

SEQ ID NO: 3134209 - RNA, 22 nt, Mycobacterium bovis subsp bovis AF2122/97
caccaucgccgccguugccgcc

SEQ ID NO: 3134210 - RNA, 23 nt, Mycobacterium bovis subsp bovis AF2122/97
caccaucgccgccguugccgccg

SEQ ID NO: 3134211 - RNA, 18 nt, Mycobacterium bovis subsp bovis AF2122/97
caccaucgccucggcgcu

SEQ ID NO: 3134212 - RNA, 19 nt, Mycobacterium bovis subsp bovis AF2122/97
caccaucgcggccgcuggg

SEQ ID NO: 3134213 - RNA, 22 nt, Mycobacterium bovis subsp bovis AF2122/97
caccaucgguaucgagggcagc

SEQ ID NO: 3134214 - RNA, 22 nt, Mycobacterium bovis subsp bovis AF2122/97
caccaucguugccggugccgcc

SEQ ID NO: 3134215 - RNA, 16 nt, Mycobacterium bovis subsp bovis AF2122/97
caccaucuccgccguc

SEQ ID NO: 3134216 - RNA, 18 nt, Mycobacterium bovis subsp bovis AF2122/97
caccaucuccgccgucgc

SEQ ID NO: 3134217 - RNA, 14 nt, Mycobacterium bovis subsp bovis AF2122/97
caccaugaucaggc

SEQ ID NO: 3134218 - RNA, 22 nt, Mycobacterium bovis subsp bovis AF2122/97
caccaugaucaggccccacacg

SEQ ID NO: 3134219 - RNA, 17 nt, Mycobacterium bovis subsp bovis AF2122/97
caccaugauugccagga

SEQ ID NO: 3134220 - RNA, 13 nt, Mycobacterium bovis subsp bovis AF2122/97
caccauggcgccg

SEQ ID NO: 3134221 - RNA, 17 nt, Mycobacterium bovis subsp bovis AF2122/97
caccauggcgccgcgcc

SEQ ID NO: 3134222 - RNA, 19 nt, Mycobacterium bovis subsp bovis AF2122/97
caccauggcgccgcgccga

SEQ ID NO: 3134223 - RNA, 18 nt, Mycobacterium bovis subsp bovis AF2122/97
caccaugggucuggcagg

SEQ ID NO: 3134224 - RNA, 21 nt, Mycobacterium bovis subsp bovis AF2122/97
caccaugggucuggcaggcca

SEQ ID NO: 3134225 - RNA, 19 nt, Mycobacterium bovis subsp bovis AF2122/97
caccaugguggugaugcca

SEQ ID NO: 3134226 - RNA, 21 nt, Mycobacterium bovis subsp bovis AF2122/97
caccauguacaggcuguccag

SEQ ID NO: 3134227 - RNA, 16 nt, Mycobacterium bovis subsp bovis AF2122/97
caccaugucggccacc

SEQ ID NO: 3134228 - RNA, 19 nt, Mycobacterium bovis subsp bovis AF2122/97
caccaugucggccacccgg

SEQ ID NO: 3134229 - RNA, 13 nt, Mycobacterium bovis subsp bovis AF2122/97
caccaugucggug

SEQ ID NO: 3134230 - RNA, 17 nt, Mycobacterium bovis subsp bovis AF2122/97
caccauucccggaccca

SEQ ID NO: 3134231 - RNA, 16 nt, Mycobacterium bovis subsp bovis AF2122/97
caccauucgcgggccg

SEQ ID NO: 3134232 - RNA, 17 nt, Mycobacterium bovis subsp bovis AF2122/97
caccauucgcgggccga

SEQ ID NO: 3134233 - RNA, 13 nt, Mycobacterium bovis subsp bovis AF2122/97
caccauuggccaa

SEQ ID NO: 3134234 - RNA, 19 nt, Mycobacterium bovis subsp bovis AF2122/97
caccauuggccaagucagc

SEQ ID NO: 3134235 - RNA, 22 nt, Mycobacterium bovis subsp bovis AF2122/97
caccauuguuccguccccgacg

SEQ ID NO: 3134236 - RNA, 16 nt, Mycobacterium bovis subsp bovis AF2122/97
cacccaaaccggcccg

SEQ ID NO: 3134237 - RNA, 21 nt, Mycobacterium bovis subsp bovis AF2122/97
cacccaaaccggcccgcagca

SEQ ID NO: 3134238 - RNA, 20 nt, Mycobacterium bovis subsp bovis AF2122/97
cacccaacagcccaccggug

SEQ ID NO: 3134239 - RNA, 17 nt, Mycobacterium bovis subsp bovis AF2122/97
cacccaaccaggccgcg

SEQ ID NO: 3134240 - RNA, 18 nt, Mycobacterium bovis subsp bovis AF2122/97
cacccaaccaggccgcga

SEQ ID NO: 3134241 - RNA, 14 nt, Mycobacterium bovis subsp bovis AF2122/97
cacccaaccccgcc

SEQ ID NO: 3134242 - RNA, 19 nt, Mycobacterium bovis subsp bovis AF2122/97
cacccaaccccgccggccg

SEQ ID NO: 3134243 - RNA, 22 nt, Mycobacterium bovis subsp bovis AF2122/97
cacccaacgcggugggcacagc

SEQ ID NO: 3134244 - RNA, 23 nt, Mycobacterium bovis subsp bovis AF2122/97
cacccaacggugggugggcgccg

SEQ ID NO: 3134245 - RNA, 18 nt, Mycobacterium bovis subsp bovis AF2122/97
cacccaacucaugggcca

SEQ ID NO: 3134246 - RNA, 21 nt, Mycobacterium bovis subsp bovis AF2122/97
cacccaacucaugggccaacu

SEQ ID NO: 3134247 - RNA, 20 nt, Mycobacterium bovis subsp bovis AF2122/97
cacccaagcucggucaacgc

SEQ ID NO: 3134248 - RNA, 18 nt, Mycobacterium bovis subsp bovis AF2122/97
cacccaaugccaccgcgg

SEQ ID NO: 3134249 - RNA, 21 nt, Mycobacterium bovis subsp bovis AF2122/97
cacccaaugccaccgcggccg

SEQ ID NO: 3134250 - RNA, 23 nt, Mycobacterium bovis subsp bovis AF2122/97
cacccaaugccaccgcggccgcg

SEQ ID NO: 3134251 - RNA, 17 nt, Mycobacterium bovis subsp bovis AF2122/97
cacccaauggagccgcg

SEQ ID NO: 3134252 - RNA, 14 nt, Mycobacterium bovis subsp bovis AF2122/97
cacccccgauagcg

SEQ ID NO: 3134253 - RNA, 17 nt, Mycobacterium bovis subsp bovis AF2122/97
cacccccgucgaucagc

SEQ ID NO: 3134254 - RNA, 17 nt, Mycobacterium bovis subsp bovis AF2122/97
cacccccgucgccaccg

SEQ ID NO: 3134255 - RNA, 22 nt, Mycobacterium bovis subsp bovis AF2122/97
cacccccgucugcgugggccug

SEQ ID NO: 3134256 - RNA, 14 nt, Mycobacterium bovis subsp bovis AF2122/97
cacccccugcaccg

SEQ ID NO: 3134257 - RNA, 13 nt, Mycobacterium bovis subsp bovis AF2122/97
caccccgaagaug

SEQ ID NO: 3134258 - RNA, 20 nt, Mycobacterium bovis subsp bovis AF2122/97
caccccgaagcucaucaccg

SEQ ID NO: 3134259 - RNA, 14 nt, Mycobacterium bovis subsp bovis AF2122/97
caccccgaccacca

SEQ ID NO: 3134260 - RNA, 17 nt, Mycobacterium bovis subsp bovis AF2122/97
caccccgaccaccagag

SEQ ID NO: 3134261 - RNA, 16 nt, Mycobacterium bovis subsp bovis AF2122/97
caccccgaccucccgg

SEQ ID NO: 3134262 - RNA, 14 nt, Mycobacterium bovis subsp bovis AF2122/97
caccccgacguucg

SEQ ID NO: 3134263 - RNA, 16 nt, Mycobacterium bovis subsp bovis AF2122/97
caccccgagcucacca

SEQ ID NO: 3134264 - RNA, 16 nt, Mycobacterium bovis subsp bovis AF2122/97
caccccgaggccgacc

SEQ ID NO: 3134265 - RNA, 13 nt, Mycobacterium bovis subsp bovis AF2122/97
caccccgauccgc

SEQ ID NO: 3134266 - RNA, 17 nt, Mycobacterium bovis subsp bovis AF2122/97
caccccgauccgccacg

SEQ ID NO: 3134267 - RNA, 18 nt, Mycobacterium bovis subsp bovis AF2122/97
caccccgauccgccacga

SEQ ID NO: 3134268 - RNA, 22 nt, Mycobacterium bovis subsp bovis AF2122/97
caccccgaucuggcguagugcu

SEQ ID NO: 3134269 - RNA, 19 nt, Mycobacterium bovis subsp bovis AF2122/97
caccccgauucgugucggu

SEQ ID NO: 3134270 - RNA, 16 nt, Mycobacterium bovis subsp bovis AF2122/97
caccccgccaugcggc

SEQ ID NO: 3134271 - RNA, 22 nt, Mycobacterium bovis subsp bovis AF2122/97
caccccgccaugcggcgcgucg

SEQ ID NO: 3134272 - RNA, 21 nt, Mycobacterium bovis subsp bovis AF2122/97
caccccgcgaaccucacagcu

SEQ ID NO: 3134273 - RNA, 16 nt, Mycobacterium bovis subsp bovis AF2122/97
caccccgcgcgccagc

SEQ ID NO: 3134274 - RNA, 16 nt, Mycobacterium bovis subsp bovis AF2122/97
caccccgcuuggaccg

SEQ ID NO: 3134275 - RNA, 15 nt, Mycobacterium bovis subsp bovis AF2122/97
caccccggccaaccc

SEQ ID NO: 3134276 - RNA, 12 nt, Mycobacterium bovis subsp bovis AF2122/97
caccccggccgc

SEQ ID NO: 3134277 - RNA, 13 nt, Mycobacterium bovis subsp bovis AF2122/97
caccccggccgcg

SEQ ID NO: 3134278 - RNA, 13 nt, Mycobacterium bovis subsp bovis AF2122/97
caccccggccggc

SEQ ID NO: 3134279 - RNA, 13 nt, Mycobacterium bovis subsp bovis AF2122/97
caccccggcggcc

SEQ ID NO: 3134280 - RNA, 15 nt, Mycobacterium bovis subsp bovis AF2122/97
caccccggcggcguc

SEQ ID NO: 3134281 - RNA, 15 nt, Mycobacterium bovis subsp bovis AF2122/97
caccccggcucggcc

SEQ ID NO: 3134282 - RNA, 19 nt, Mycobacterium bovis subsp bovis AF2122/97
caccccggcucggccaccg

SEQ ID NO: 3134283 - RNA, 22 nt, Mycobacterium bovis subsp bovis AF2122/97
caccccggguacgccgggcacg

SEQ ID NO: 3134284 - RNA, 22 nt, Mycobacterium bovis subsp bovis AF2122/97
caccccggucgaggucggcgau

SEQ ID NO: 3134285 - RNA, 16 nt, Mycobacterium bovis subsp bovis AF2122/97
caccccggucggagcg

SEQ ID NO: 3134286 - RNA, 15 nt, Mycobacterium bovis subsp bovis AF2122/97
caccccggucggccc

SEQ ID NO: 3134287 - RNA, 16 nt, Mycobacterium bovis subsp bovis AF2122/97
caccccggucggcccg

SEQ ID NO: 3134288 - RNA, 19 nt, Mycobacterium bovis subsp bovis AF2122/97
caccccggugcccgcggug

SEQ ID NO: 3134289 - RNA, 17 nt, Mycobacterium bovis subsp bovis AF2122/97
caccccguagcggucuc

SEQ ID NO: 3134290 - RNA, 22 nt, Mycobacterium bovis subsp bovis AF2122/97
caccccguaggugcacaacccg

SEQ ID NO: 3134291 - RNA, 16 nt, Mycobacterium bovis subsp bovis AF2122/97
caccccgucggggucg

SEQ ID NO: 3134292 - RNA, 22 nt, Mycobacterium bovis subsp bovis AF2122/97
caccccugagcucccgccggga

SEQ ID NO: 3134293 - RNA, 20 nt, Mycobacterium bovis subsp bovis AF2122/97
caccccugcgguccgcugcc

SEQ ID NO: 3134294 - RNA, 21 nt, Mycobacterium bovis subsp bovis AF2122/97
caccccuucgccagcgccacu

SEQ ID NO: 3134295 - RNA, 14 nt, Mycobacterium bovis subsp bovis AF2122/97
cacccgaaacaccg

SEQ ID NO: 3134296 - RNA, 19 nt, Mycobacterium bovis subsp bovis AF2122/97
cacccgaauuugucggcga

SEQ ID NO: 3134297 - RNA, 18 nt, Mycobacterium bovis subsp bovis AF2122/97
cacccgagcaacggcggc

SEQ ID NO: 3134298 - RNA, 19 nt, Mycobacterium bovis subsp bovis AF2122/97
cacccgagccaucaccgca

SEQ ID NO: 3134299 - RNA, 14 nt, Mycobacterium bovis subsp bovis AF2122/97
cacccgagccgcac

SEQ ID NO: 3134300 - RNA, 16 nt, Mycobacterium bovis subsp bovis AF2122/97
cacccgauuggccaac

SEQ ID NO: 3134301 - RNA, 20 nt, Mycobacterium bovis subsp bovis AF2122/97
cacccgcaaugcgcgcgaug

SEQ ID NO: 3134302 - RNA, 13 nt, Mycobacterium bovis subsp bovis AF2122/97
cacccgcaccacc

SEQ ID NO: 3134303 - RNA, 14 nt, Mycobacterium bovis subsp bovis AF2122/97
cacccgcaccaccg

SEQ ID NO: 3134304 - RNA, 16 nt, Mycobacterium bovis subsp bovis AF2122/97
cacccgcaccgccggc

SEQ ID NO: 3134305 - RNA, 17 nt, Mycobacterium bovis subsp bovis AF2122/97
cacccgcaccggugacg

SEQ ID NO: 3134306 - RNA, 23 nt, Mycobacterium bovis subsp bovis AF2122/97
cacccgcaccggugacgcacagc

SEQ ID NO: 3134307 - RNA, 18 nt, Mycobacterium bovis subsp bovis AF2122/97
cacccgcaccucaccggg

SEQ ID NO: 3134308 - RNA, 20 nt, Mycobacterium bovis subsp bovis AF2122/97
cacccgcaccucaccggguu

SEQ ID NO: 3134309 - RNA, 23 nt, Mycobacterium bovis subsp bovis AF2122/97
cacccgcacggccuccggaccga

SEQ ID NO: 3134310 - RNA, 13 nt, Mycobacterium bovis subsp bovis AF2122/97
cacccgcacucca

SEQ ID NO: 3134311 - RNA, 17 nt, Mycobacterium bovis subsp bovis AF2122/97
cacccgcagccgcgcgg

SEQ ID NO: 3134312 - RNA, 20 nt, Mycobacterium bovis subsp bovis AF2122/97
cacccgcaggucgaucugcg

SEQ ID NO: 3134313 - RNA, 22 nt, Mycobacterium bovis subsp bovis AF2122/97
cacccgcaggucgaucugcgcc

SEQ ID NO: 3134314 - RNA, 23 nt, Mycobacterium bovis subsp bovis AF2122/97
cacccgcaggucgaucugcgcca

SEQ ID NO: 3134315 - RNA, 20 nt, Mycobacterium bovis subsp bovis AF2122/97
cacccgcauggcagcggcgg

SEQ ID NO: 3134316 - RNA, 21 nt, Mycobacterium bovis subsp bovis AF2122/97
cacccgcauggcagcggcggu

SEQ ID NO: 3134317 - RNA, 13 nt, Mycobacterium bovis subsp bovis AF2122/97
cacccgccagaug

SEQ ID NO: 3134318 - RNA, 14 nt, Mycobacterium bovis subsp bovis AF2122/97
cacccgccaggccg

SEQ ID NO: 3134319 - RNA, 15 nt, Mycobacterium bovis subsp bovis AF2122/97
cacccgccaggccgc

SEQ ID NO: 3134320 - RNA, 21 nt, Mycobacterium bovis subsp bovis AF2122/97
cacccgccaggccgcgcgaca

SEQ ID NO: 3134321 - RNA, 20 nt, Mycobacterium bovis subsp bovis AF2122/97
cacccgccagggcggcaucc

SEQ ID NO: 3134322 - RNA, 13 nt, Mycobacterium bovis subsp bovis AF2122/97
cacccgcccgggc

SEQ ID NO: 3134323 - RNA, 15 nt, Mycobacterium bovis subsp bovis AF2122/97
cacccgcccgggcgu

SEQ ID NO: 3134324 - RNA, 15 nt, Mycobacterium bovis subsp bovis AF2122/97
cacccgccgccgccc

SEQ ID NO: 3134325 - RNA, 16 nt, Mycobacterium bovis subsp bovis AF2122/97
cacccgccgccgcccg

SEQ ID NO: 3134326 - RNA, 21 nt, Mycobacterium bovis subsp bovis AF2122/97
cacccgccggucaaacugcca

SEQ ID NO: 3134327 - RNA, 19 nt, Mycobacterium bovis subsp bovis AF2122/97
cacccgccucaucuccugu

SEQ ID NO: 3134328 - RNA, 14 nt, Mycobacterium bovis subsp bovis AF2122/97
cacccgcgaacgcg

SEQ ID NO: 3134329 - RNA, 12 nt, Mycobacterium bovis subsp bovis AF2122/97
cacccgcgccgc

SEQ ID NO: 3134330 - RNA, 14 nt, Mycobacterium bovis subsp bovis AF2122/97
cacccgcgccgccc

SEQ ID NO: 3134331 - RNA, 15 nt, Mycobacterium bovis subsp bovis AF2122/97
cacccgcgccgcccg

SEQ ID NO: 3134332 - RNA, 15 nt, Mycobacterium bovis subsp bovis AF2122/97
cacccgcgccuaccc

SEQ ID NO: 3134333 - RNA, 18 nt, Mycobacterium bovis subsp bovis AF2122/97
cacccgcgccuacccuuc

SEQ ID NO: 3134334 - RNA, 22 nt, Mycobacterium bovis subsp bovis AF2122/97
cacccgcgcgaugcuggcgaac

SEQ ID NO: 3134335 - RNA, 23 nt, Mycobacterium bovis subsp bovis AF2122/97
cacccgcgcgaugcuggcgaacu

SEQ ID NO: 3134336 - RNA, 14 nt, Mycobacterium bovis subsp bovis AF2122/97
cacccgcggcgaac

SEQ ID NO: 3134337 - RNA, 14 nt, Mycobacterium bovis subsp bovis AF2122/97
cacccgcggcgccg

SEQ ID NO: 3134338 - RNA, 15 nt, Mycobacterium bovis subsp bovis AF2122/97
cacccgcggcgccgu

SEQ ID NO: 3134339 - RNA, 17 nt, Mycobacterium bovis subsp bovis AF2122/97
caccgaaaaacaccagc

SEQ ID NO: 3134340 - RNA, 16 nt, Mycobacterium bovis subsp bovis AF2122/97
caccgaaaaguccgcc

SEQ ID NO: 3134341 - RNA, 18 nt, Mycobacterium bovis subsp bovis AF2122/97
caccgaaaccaugccgcc

SEQ ID NO: 3134342 - RNA, 19 nt, Mycobacterium bovis subsp bovis AF2122/97
caccgaaaccaugccgccg

SEQ ID NO: 3134343 - RNA, 22 nt, Mycobacterium bovis subsp bovis AF2122/97
caccgaaaccaugccgccgaag

SEQ ID NO: 3134344 - RNA, 17 nt, Mycobacterium bovis subsp bovis AF2122/97
caccgaaacgaugcggc

SEQ ID NO: 3134345 - RNA, 15 nt, Mycobacterium bovis subsp bovis AF2122/97
caccgaaacgccgac

SEQ ID NO: 3134346 - RNA, 23 nt, Mycobacterium bovis subsp bovis AF2122/97
caccgaaauugcccuagcagcaa

SEQ ID NO: 3134347 - RNA, 18 nt, Mycobacterium bovis subsp bovis AF2122/97
caccgaacagucgcagcc

SEQ ID NO: 3134348 - RNA, 17 nt, Mycobacterium bovis subsp bovis AF2122/97
caccgaacgcggccacc

SEQ ID NO: 3134349 - RNA, 20 nt, Mycobacterium bovis subsp bovis AF2122/97
caccgaacgcggccaccgac

SEQ ID NO: 3134350 - RNA, 23 nt, Mycobacterium bovis subsp bovis AF2122/97
caccgaacuccuuaucgucgacg

SEQ ID NO: 3134351 - RNA, 21 nt, Mycobacterium bovis subsp bovis AF2122/97
caccgaacuugcggaccuggc

SEQ ID NO: 3134352 - RNA, 21 nt, Mycobacterium bovis subsp bovis AF2122/97
caccgaagauggccagcgcgg

SEQ ID NO: 3134353 - RNA, 22 nt, Mycobacterium bovis subsp bovis AF2122/97
caccgaagccgccgggugcgcc

SEQ ID NO: 3134354 - RNA, 15 nt, Mycobacterium bovis subsp bovis AF2122/97
caccgaagucgauga

SEQ ID NO: 3134355 - RNA, 17 nt, Mycobacterium bovis subsp bovis AF2122/97
caccgaauaccgccgcg

SEQ ID NO: 3134356 - RNA, 19 nt, Mycobacterium bovis subsp bovis AF2122/97
caccgaauaccgccgcgca

SEQ ID NO: 3134357 - RNA, 21 nt, Mycobacterium bovis subsp bovis AF2122/97
caccgaauaccgccgcgcagc

SEQ ID NO: 3134358 - RNA, 15 nt, Mycobacterium bovis subsp bovis AF2122/97
caccgaaugcggguc

SEQ ID NO: 3134359 - RNA, 20 nt, Mycobacterium bovis subsp bovis AF2122/97
caccgacaagaauggccgcc

SEQ ID NO: 3134360 - RNA, 23 nt, Mycobacterium bovis subsp bovis AF2122/97
caccgacaauucaacacacggcg

SEQ ID NO: 3134361 - RNA, 13 nt, Mycobacterium bovis subsp bovis AF2122/97
caccgacaccggc

SEQ ID NO: 3134362 - RNA, 14 nt, Mycobacterium bovis subsp bovis AF2122/97
caccgacaccggcc

SEQ ID NO: 3134363 - RNA, 16 nt, Mycobacterium bovis subsp bovis AF2122/97
caccgacaccggccgc

SEQ ID NO: 3134364 - RNA, 17 nt, Mycobacterium bovis subsp bovis AF2122/97
caccgacaccggccgcg

SEQ ID NO: 3134365 - RNA, 20 nt, Mycobacterium bovis subsp bovis AF2122/97
caccgacaccggccgcgacg

SEQ ID NO: 3134366 - RNA, 12 nt, Mycobacterium bovis subsp bovis AF2122/97
caccgacaccgu

SEQ ID NO: 3134367 - RNA, 14 nt, Mycobacterium bovis subsp bovis AF2122/97
caccgacaccgugc

SEQ ID NO: 3134368 - RNA, 17 nt, Mycobacterium bovis subsp bovis AF2122/97
caccgacaccgugccgc

SEQ ID NO: 3134369 - RNA, 14 nt, Mycobacterium bovis subsp bovis AF2122/97
caccgacaccgugu

SEQ ID NO: 3134370 - RNA, 17 nt, Mycobacterium bovis subsp bovis AF2122/97
caccgacaccguguugc

SEQ ID NO: 3134371 - RNA, 14 nt, Mycobacterium bovis subsp bovis AF2122/97
caccgacagcaccc

SEQ ID NO: 3134372 - RNA, 21 nt, Mycobacterium bovis subsp bovis AF2122/97
caccgacagcacccaaugcca

SEQ ID NO: 3134373 - RNA, 21 nt, Mycobacterium bovis subsp bovis AF2122/97
caccgacagcacccggccacc

SEQ ID NO: 3134374 - RNA, 16 nt, Mycobacterium bovis subsp bovis AF2122/97
caccgacagccccauc

SEQ ID NO: 3134375 - RNA, 18 nt, Mycobacterium bovis subsp bovis AF2122/97
caccgacaucgucaucca

SEQ ID NO: 3134376 - RNA, 21 nt, Mycobacterium bovis subsp bovis AF2122/97
caccgacaucgucauccaggg

SEQ ID NO: 3134377 - RNA, 22 nt, Mycobacterium bovis subsp bovis AF2122/97
caccgacauguguggcagcccc

SEQ ID NO: 3134378 - RNA, 17 nt, Mycobacterium bovis subsp bovis AF2122/97
caccgacauuggugugg

SEQ ID NO: 3134379 - RNA, 18 nt, Mycobacterium bovis subsp bovis AF2122/97
caccgacauuggugugga

SEQ ID NO: 3134380 - RNA, 23 nt, Mycobacterium bovis subsp bovis AF2122/97
caccgaccccggaacgaccccac

SEQ ID NO: 3134381 - RNA, 13 nt, Mycobacterium bovis subsp bovis AF2122/97
caccgaccgcacc

SEQ ID NO: 3134382 - RNA, 22 nt, Mycobacterium bovis subsp bovis AF2122/97
caccgaccgcaccgugccgacg

SEQ ID NO: 3134383 - RNA, 13 nt, Mycobacterium bovis subsp bovis AF2122/97
caccgaccgcaug

SEQ ID NO: 3134384 - RNA, 14 nt, Mycobacterium bovis subsp bovis AF2122/97
caccgaccgcauga

SEQ ID NO: 3134385 - RNA, 14 nt, Mycobacterium bovis subsp bovis AF2122/97
caccgaccgggucg

SEQ ID NO: 3134386 - RNA, 21 nt, Mycobacterium bovis subsp bovis AF2122/97
caccgaccgggucgcaaccgc

SEQ ID NO: 3134387 - RNA, 17 nt, Mycobacterium bovis subsp bovis AF2122/97
caccgacgacggcgacg

SEQ ID NO: 3134388 - RNA, 21 nt, Mycobacterium bovis subsp bovis AF2122/97
caccgacgacggcgacggcgc

SEQ ID NO: 3134389 - RNA, 17 nt, Mycobacterium bovis subsp bovis AF2122/97
caccgacgaggacguca

SEQ ID NO: 3134390 - RNA, 18 nt, Mycobacterium bovis subsp bovis AF2122/97
caccgacgcacaggcgac

SEQ ID NO: 3134391 - RNA, 13 nt, Mycobacterium bovis subsp bovis AF2122/97
caccgacgccgcc

SEQ ID NO: 3134392 - RNA, 14 nt, Mycobacterium bovis subsp bovis AF2122/97
caccgacgccgcca

SEQ ID NO: 3134393 - RNA, 16 nt, Mycobacterium bovis subsp bovis AF2122/97
caccgacgccgccagg

SEQ ID NO: 3134394 - RNA, 22 nt, Mycobacterium bovis subsp bovis AF2122/97
caccgacgccgccagguccgcc

SEQ ID NO: 3134395 - RNA, 15 nt, Mycobacterium bovis subsp bovis AF2122/97
caccgacgcgcccgc

SEQ ID NO: 3134396 - RNA, 19 nt, Mycobacterium bovis subsp bovis AF2122/97
caccgacgcggucggcggc

SEQ ID NO: 3134397 - RNA, 15 nt, Mycobacterium bovis subsp bovis AF2122/97
caccgacgcugacca

SEQ ID NO: 3134398 - RNA, 16 nt, Mycobacterium bovis subsp bovis AF2122/97
caccgacgcugaccaa

SEQ ID NO: 3134399 - RNA, 21 nt, Mycobacterium bovis subsp bovis AF2122/97
caccgacgggauauccggucg

SEQ ID NO: 3134400 - RNA, 22 nt, Mycobacterium bovis subsp bovis AF2122/97
caccgacgggauauccggucgc

SEQ ID NO: 3134401 - RNA, 21 nt, Mycobacterium bovis subsp bovis AF2122/97
caccgacgucaggcucacguc

SEQ ID NO: 3134402 - RNA, 14 nt, Mycobacterium bovis subsp bovis AF2122/97
caccgacgucgcca

SEQ ID NO: 3134403 - RNA, 18 nt, Mycobacterium bovis subsp bovis AF2122/97
caccgacgucggcuucac

SEQ ID NO: 3134404 - RNA, 22 nt, Mycobacterium bovis subsp bovis AF2122/97
caccgacguggccagcccgccc

SEQ ID NO: 3134405 - RNA, 15 nt, Mycobacterium bovis subsp bovis AF2122/97
caccgacugcacaua

SEQ ID NO: 3134406 - RNA, 21 nt, Mycobacterium bovis subsp bovis AF2122/97
caccgacugcugucaccgcaa

SEQ ID NO: 3134407 - RNA, 14 nt, Mycobacterium bovis subsp bovis AF2122/97
caccgacuucagca

SEQ ID NO: 3134408 - RNA, 17 nt, Mycobacterium bovis subsp bovis AF2122/97
caccgacuucagcaacg

SEQ ID NO: 3134409 - RNA, 19 nt, Mycobacterium bovis subsp bovis AF2122/97
caccgagaucaugccggcg

SEQ ID NO: 3134410 - RNA, 15 nt, Mycobacterium bovis subsp bovis AF2122/97
caccgagaucggaca

SEQ ID NO: 3134411 - RNA, 21 nt, Mycobacterium bovis subsp bovis AF2122/97
caccgagaugcgcaauagacc

SEQ ID NO: 3134412 - RNA, 16 nt, Mycobacterium bovis subsp bovis AF2122/97
caccgagcaccugacc

SEQ ID NO: 3134413 - RNA, 13 nt, Mycobacterium bovis subsp bovis AF2122/97
caccgagcaucuc

SEQ ID NO: 3134414 - RNA, 15 nt, Mycobacterium bovis subsp bovis AF2122/97
caccgagcaucucgu

SEQ ID NO: 3134415 - RNA, 18 nt, Mycobacterium bovis subsp bovis AF2122/97
caccgagcccgaucgcgg

SEQ ID NO: 3134416 - RNA, 19 nt, Mycobacterium bovis subsp bovis AF2122/97
caccgagcccgaucgcggc

SEQ ID NO: 3134417 - RNA, 23 nt, Mycobacterium bovis subsp bovis AF2122/97
caccgagcccgaucgcggcccgg

SEQ ID NO: 3134418 - RNA, 22 nt, Mycobacterium bovis subsp bovis AF2122/97
caccgagcccuccagggcccug

SEQ ID NO: 3134419 - RNA, 14 nt, Mycobacterium bovis subsp bovis AF2122/97
caccgagcggugaa

SEQ ID NO: 3134420 - RNA, 22 nt, Mycobacterium bovis subsp bovis AF2122/97
caccgagcggugaauucggcga

SEQ ID NO: 3134421 - RNA, 20 nt, Mycobacterium bovis subsp bovis AF2122/97
caccgaggccgccgagauga

SEQ ID NO: 3134422 - RNA, 21 nt, Mycobacterium bovis subsp bovis AF2122/97
caccgaggccgccgagaugau

SEQ ID NO: 3134423 - RNA, 19 nt, Mycobacterium bovis subsp bovis AF2122/97
caccgaggucgagcgaccc

SEQ ID NO: 3134424 - RNA, 21 nt, Mycobacterium bovis subsp bovis AF2122/97
caccgaggucgagcgacccca

SEQ ID NO: 3134425 - RNA, 22 nt, Mycobacterium bovis subsp bovis AF2122/97
caccgccgccgccgacgccgcc

SEQ ID NO: 3134426 - RNA, 17 nt, Mycobacterium bovis subsp bovis AF2122/97
caccgccgccggcaccg

SEQ ID NO: 3134427 - RNA, 19 nt, Mycobacterium bovis subsp bovis AF2122/97
caccgccgccggcaccgcc

SEQ ID NO: 3134428 - RNA, 12 nt, Mycobacterium bovis subsp bovis AF2122/97
caccgccgccug

SEQ ID NO: 3134429 - RNA, 19 nt, Mycobacterium bovis subsp bovis AF2122/97
caccgccgccugcccggcc

SEQ ID NO: 3134430 - RNA, 20 nt, Mycobacterium bovis subsp bovis AF2122/97
caccgccgccugcccggccc

SEQ ID NO: 3134431 - RNA, 13 nt, Mycobacterium bovis subsp bovis AF2122/97
caccgccgcgacc

SEQ ID NO: 3134432 - RNA, 16 nt, Mycobacterium bovis subsp bovis AF2122/97
caccgccgcgaccgcc

SEQ ID NO: 3134433 - RNA, 19 nt, Mycobacterium bovis subsp bovis AF2122/97
caccgccgcgaccgccucg

SEQ ID NO: 3134434 - RNA, 13 nt, Mycobacterium bovis subsp bovis AF2122/97
caccgccgcgccg

SEQ ID NO: 3134435 - RNA, 19 nt, Mycobacterium bovis subsp bovis AF2122/97
caccgccgcgccggcggcc

SEQ ID NO: 3134436 - RNA, 15 nt, Mycobacterium bovis subsp bovis AF2122/97
caccgccgcgcgaca

SEQ ID NO: 3134437 - RNA, 19 nt, Mycobacterium bovis subsp bovis AF2122/97
caccgccgcggccgccguc

SEQ ID NO: 3134438 - RNA, 23 nt, Mycobacterium bovis subsp bovis AF2122/97
caccgccgcggccgccguccccg

SEQ ID NO: 3134439 - RNA, 14 nt, Mycobacterium bovis subsp bovis AF2122/97
caccgccgcgucga

SEQ ID NO: 3134440 - RNA, 16 nt, Mycobacterium bovis subsp bovis AF2122/97
caccgccgcgucgagc

SEQ ID NO: 3134441 - RNA, 23 nt, Mycobacterium bovis subsp bovis AF2122/97
caccgccgcuaccgcccgcgcca

SEQ ID NO: 3134442 - RNA, 20 nt, Mycobacterium bovis subsp bovis AF2122/97
caccgccggcaauaccgcca

SEQ ID NO: 3134443 - RNA, 17 nt, Mycobacterium bovis subsp bovis AF2122/97
caccgccggcaccgccg

SEQ ID NO: 3134444 - RNA, 18 nt, Mycobacterium bovis subsp bovis AF2122/97
caccgccggcaccgccgg

SEQ ID NO: 3134445 - RNA, 20 nt, Mycobacterium bovis subsp bovis AF2122/97
caccgccggcaccgccggcg

SEQ ID NO: 3134446 - RNA, 13 nt, Mycobacterium bovis subsp bovis AF2122/97
caccgccggcagc

SEQ ID NO: 3134447 - RNA, 21 nt, Mycobacterium bovis subsp bovis AF2122/97
caccgccggcagcaucggcac

SEQ ID NO: 3134448 - RNA, 14 nt, Mycobacterium bovis subsp bovis AF2122/97
caccgccggcccgc

SEQ ID NO: 3134449 - RNA, 14 nt, Mycobacterium bovis subsp bovis AF2122/97
caccgccggcgacg

SEQ ID NO: 3134450 - RNA, 14 nt, Mycobacterium bovis subsp bovis AF2122/97
caccgccggcgcca

SEQ ID NO: 3134451 - RNA, 16 nt, Mycobacterium bovis subsp bovis AF2122/97
caccgccggcgccacc

SEQ ID NO: 3134452 - RNA, 19 nt, Mycobacterium bovis subsp bovis AF2122/97
caccgccggcgccaccguc

SEQ ID NO: 3134453 - RNA, 22 nt, Mycobacterium bovis subsp bovis AF2122/97
caccgccggcgccaccgucgcc

SEQ ID NO: 3134454 - RNA, 14 nt, Mycobacterium bovis subsp bovis AF2122/97
caccgccggcgccc

SEQ ID NO: 3134455 - RNA, 18 nt, Mycobacterium bovis subsp bovis AF2122/97
caccgccggcgcccaggc

SEQ ID NO: 3134456 - RNA, 19 nt, Mycobacterium bovis subsp bovis AF2122/97
caccgccggcuccgccguu

SEQ ID NO: 3134457 - RNA, 20 nt, Mycobacterium bovis subsp bovis AF2122/97
caccgccggcuccgccguug

SEQ ID NO: 3134458 - RNA, 22 nt, Mycobacterium bovis subsp bovis AF2122/97
caccgccggggcugguguagac

SEQ ID NO: 3134459 - RNA, 16 nt, Mycobacterium bovis subsp bovis AF2122/97
caccgccggggugugc

SEQ ID NO: 3134460 - RNA, 10 nt, Mycobacterium bovis subsp bovis AF2122/97
caccgccggu

SEQ ID NO: 3134461 - RNA, 19 nt, Mycobacterium bovis subsp bovis AF2122/97
caccgccggugccgccauc

SEQ ID NO: 3134462 - RNA, 18 nt, Mycobacterium bovis subsp bovis AF2122/97
caccgccggugcugacga

SEQ ID NO: 3134463 - RNA, 13 nt, Mycobacterium bovis subsp bovis AF2122/97
caccgccgucggg

SEQ ID NO: 3134464 - RNA, 16 nt, Mycobacterium bovis subsp bovis AF2122/97
caccgccgucggguug

SEQ ID NO: 3134465 - RNA, 18 nt, Mycobacterium bovis subsp bovis AF2122/97
caccgccguugccgaucg

SEQ ID NO: 3134466 - RNA, 17 nt, Mycobacterium bovis subsp bovis AF2122/97
caccgccguugccgccg

SEQ ID NO: 3134467 - RNA, 18 nt, Mycobacterium bovis subsp bovis AF2122/97
caccgccguugccgccgg

SEQ ID NO: 3134468 - RNA, 19 nt, Mycobacterium bovis subsp bovis AF2122/97
caccgccguugccgccggc

SEQ ID NO: 3134469 - RNA, 20 nt, Mycobacterium bovis subsp bovis AF2122/97
caccgccguugccgccggcg

SEQ ID NO: 3134470 - RNA, 21 nt, Mycobacterium bovis subsp bovis AF2122/97
caccgccguugccgccggcgc

SEQ ID NO: 3134471 - RNA, 23 nt, Mycobacterium bovis subsp bovis AF2122/97
caccgccguugccgccggcgccg

SEQ ID NO: 3134472 - RNA, 18 nt, Mycobacterium bovis subsp bovis AF2122/97
caccgccguugccguaca

SEQ ID NO: 3134473 - RNA, 21 nt, Mycobacterium bovis subsp bovis AF2122/97
caccgccguugggccgcgccc

SEQ ID NO: 3134474 - RNA, 16 nt, Mycobacterium bovis subsp bovis AF2122/97
caccgccugcgccgcc

SEQ ID NO: 3134475 - RNA, 17 nt, Mycobacterium bovis subsp bovis AF2122/97
caccgccugcgccgccc

SEQ ID NO: 3134476 - RNA, 19 nt, Mycobacterium bovis subsp bovis AF2122/97
caccgccugcgccgcccgc

SEQ ID NO: 3134477 - RNA, 23 nt, Mycobacterium bovis subsp bovis AF2122/97
caccgccugcgccgcccgcgcca

SEQ ID NO: 3134478 - RNA, 16 nt, Mycobacterium bovis subsp bovis AF2122/97
caccgccugcucggcg

SEQ ID NO: 3134479 - RNA, 21 nt, Mycobacterium bovis subsp bovis AF2122/97
caccgccuggaucagcgcguu

SEQ ID NO: 3134480 - RNA, 15 nt, Mycobacterium bovis subsp bovis AF2122/97
caccgccugggcggc

SEQ ID NO: 3134481 - RNA, 18 nt, Mycobacterium bovis subsp bovis AF2122/97
caccgccugugccgccgg

SEQ ID NO: 3134482 - RNA, 15 nt, Mycobacterium bovis subsp bovis AF2122/97
caccgccuuugccgc

SEQ ID NO: 3134483 - RNA, 21 nt, Mycobacterium bovis subsp bovis AF2122/97
caccgccuuugccgccggcac

SEQ ID NO: 3134484 - RNA, 24 nt, Mycobacterium bovis subsp bovis AF2122/97
caccgccuuugccgccggcaccgc

SEQ ID NO: 3134485 - RNA, 17 nt, Mycobacterium bovis subsp bovis AF2122/97
caccgcgaaagcaccga

SEQ ID NO: 3134486 - RNA, 21 nt, Mycobacterium bovis subsp bovis AF2122/97
caccgcgaacuugcugacgaa

SEQ ID NO: 3134487 - RNA, 17 nt, Mycobacterium bovis subsp bovis AF2122/97
caccgcgaccaucgcga

SEQ ID NO: 3134488 - RNA, 22 nt, Mycobacterium bovis subsp bovis AF2122/97
caccgcgaccaucgcgacggca

SEQ ID NO: 3134489 - RNA, 14 nt, Mycobacterium bovis subsp bovis AF2122/97
caccgcgacgacga

SEQ ID NO: 3134490 - RNA, 13 nt, Mycobacterium bovis subsp bovis AF2122/97
caccgcgaucacc

SEQ ID NO: 3134491 - RNA, 17 nt, Mycobacterium bovis subsp bovis AF2122/97
caccgcgaucaccaccg

SEQ ID NO: 3134492 - RNA, 22 nt, Mycobacterium bovis subsp bovis AF2122/97
caccgcgauuagcaaaccgacc

SEQ ID NO: 3134493 - RNA, 17 nt, Mycobacterium bovis subsp bovis AF2122/97
caccgcgcaacccggac

SEQ ID NO: 3134494 - RNA, 14 nt, Mycobacterium bovis subsp bovis AF2122/97
caccgcgccagccu

SEQ ID NO: 3134495 - RNA, 19 nt, Mycobacterium bovis subsp bovis AF2122/97
caccgcgcccaccagcggc

SEQ ID NO: 3134496 - RNA, 23 nt, Mycobacterium bovis subsp bovis AF2122/97
caccgcgcccaccagcggcggca

SEQ ID NO: 3134497 - RNA, 13 nt, Mycobacterium bovis subsp bovis AF2122/97
caccgcgcccgcc

SEQ ID NO: 3134498 - RNA, 14 nt, Mycobacterium bovis subsp bovis AF2122/97
caccgcgccgacga

SEQ ID NO: 3134499 - RNA, 14 nt, Mycobacterium bovis subsp bovis AF2122/97
caccgcgccgagca

SEQ ID NO: 3134500 - RNA, 15 nt, Mycobacterium bovis subsp bovis AF2122/97
caccgcgccgagcag

SEQ ID NO: 3134501 - RNA, 16 nt, Mycobacterium bovis subsp bovis AF2122/97
caccgcgccgagcaga

SEQ ID NO: 3134502 - RNA, 12 nt, Mycobacterium bovis subsp bovis AF2122/97
caccgcgccgcg

SEQ ID NO: 3134503 - RNA, 14 nt, Mycobacterium bovis subsp bovis AF2122/97
caccgcgccgcgcc

SEQ ID NO: 3134504 - RNA, 22 nt, Mycobacterium bovis subsp bovis AF2122/97
caccgcgccgcgccgcgccgcc

SEQ ID NO: 3134505 - RNA, 21 nt, Mycobacterium bovis subsp bovis AF2122/97
caccgcgccggagaucgucgc

SEQ ID NO: 3134506 - RNA, 13 nt, Mycobacterium bovis subsp bovis AF2122/97
caccgcgccggcg

SEQ ID NO: 3134507 - RNA, 14 nt, Mycobacterium bovis subsp bovis AF2122/97
caccgcgccggcgg

SEQ ID NO: 3134508 - RNA, 15 nt, Mycobacterium bovis subsp bovis AF2122/97
caccgcgccggcgga

SEQ ID NO: 3134509 - RNA, 15 nt, Mycobacterium bovis subsp bovis AF2122/97
caccgcgccggcggc

SEQ ID NO: 3134510 - RNA, 16 nt, Mycobacterium bovis subsp bovis AF2122/97
caccgcgccggcggca

SEQ ID NO: 3134511 - RNA, 20 nt, Mycobacterium bovis subsp bovis AF2122/97
caccggaauccuggccgccg

SEQ ID NO: 3134512 - RNA, 22 nt, Mycobacterium bovis subsp bovis AF2122/97
caccggaauccuggccgccgcc

SEQ ID NO: 3134513 - RNA, 23 nt, Mycobacterium bovis subsp bovis AF2122/97
caccggaauccuggccgccgccc

SEQ ID NO: 3134514 - RNA, 21 nt, Mycobacterium bovis subsp bovis AF2122/97
caccggaaucgaugaucgagg

SEQ ID NO: 3134515 - RNA, 15 nt, Mycobacterium bovis subsp bovis AF2122/97
caccggaccaccgcc

SEQ ID NO: 3134516 - RNA, 19 nt, Mycobacterium bovis subsp bovis AF2122/97
caccggaccaccgccgaag

SEQ ID NO: 3134517 - RNA, 14 nt, Mycobacterium bovis subsp bovis AF2122/97
caccggaccgacca

SEQ ID NO: 3134518 - RNA, 19 nt, Mycobacterium bovis subsp bovis AF2122/97
caccggaccgaccaccgcg

SEQ ID NO: 3134519 - RNA, 22 nt, Mycobacterium bovis subsp bovis AF2122/97
caccggacgaaacgaucgcgcc

SEQ ID NO: 3134520 - RNA, 23 nt, Mycobacterium bovis subsp bovis AF2122/97
caccggacgaaacgaucgcgcca

SEQ ID NO: 3134521 - RNA, 15 nt, Mycobacterium bovis subsp bovis AF2122/97
caccggacugcgccg

SEQ ID NO: 3134522 - RNA, 14 nt, Mycobacterium bovis subsp bovis AF2122/97
caccggagccgaac

SEQ ID NO: 3134523 - RNA, 15 nt, Mycobacterium bovis subsp bovis AF2122/97
caccggagcgccgag

SEQ ID NO: 3134524 - RNA, 16 nt, Mycobacterium bovis subsp bovis AF2122/97
caccggagcgccgagc

SEQ ID NO: 3134525 - RNA, 14 nt, Mycobacterium bovis subsp bovis AF2122/97
caccggaggccgcc

SEQ ID NO: 3134526 - RNA, 15 nt, Mycobacterium bovis subsp bovis AF2122/97
caccggaggccgccg

SEQ ID NO: 3134527 - RNA, 16 nt, Mycobacterium bovis subsp bovis AF2122/97
caccggaggccgccgc

SEQ ID NO: 3134528 - RNA, 22 nt, Mycobacterium bovis subsp bovis AF2122/97
caccggaggccgccgcgccggu

SEQ ID NO: 3134529 - RNA, 18 nt, Mycobacterium bovis subsp bovis AF2122/97
caccggaggugcgccgcg

SEQ ID NO: 3134530 - RNA, 16 nt, Mycobacterium bovis subsp bovis AF2122/97
caccggagucgcccgg

SEQ ID NO: 3134531 - RNA, 16 nt, Mycobacterium bovis subsp bovis AF2122/97
caccggauacagccac

SEQ ID NO: 3134532 - RNA, 20 nt, Mycobacterium bovis subsp bovis AF2122/97
caccggauacagccacgcaa

SEQ ID NO: 3134533 - RNA, 22 nt, Mycobacterium bovis subsp bovis AF2122/97
caccggauccacggagaccggc

SEQ ID NO: 3134534 - RNA, 16 nt, Mycobacterium bovis subsp bovis AF2122/97
caccggaucgccgucg

SEQ ID NO: 3134535 - RNA, 22 nt, Mycobacterium bovis subsp bovis AF2122/97
caccggaucgucgaacagcacc

SEQ ID NO: 3134536 - RNA, 23 nt, Mycobacterium bovis subsp bovis AF2122/97
caccggaucgucgaacagcaccg

SEQ ID NO: 3134537 - RNA, 23 nt, Mycobacterium bovis subsp bovis AF2122/97
caccggaugauguggugugccug

SEQ ID NO: 3134538 - RNA, 14 nt, Mycobacterium bovis subsp bovis AF2122/97
caccggcaacaucg

SEQ ID NO: 3134539 - RNA, 22 nt, Mycobacterium bovis subsp bovis AF2122/97
caccggcaagccacgccggucg

SEQ ID NO: 3134540 - RNA, 14 nt, Mycobacterium bovis subsp bovis AF2122/97
caccggcaauaccg

SEQ ID NO: 3134541 - RNA, 15 nt, Mycobacterium bovis subsp bovis AF2122/97
caccggcaaucggcg

SEQ ID NO: 3134542 - RNA, 18 nt, Mycobacterium bovis subsp bovis AF2122/97
caccggcaaucggcggca

SEQ ID NO: 3134543 - RNA, 13 nt, Mycobacterium bovis subsp bovis AF2122/97
caccggcaccacg

SEQ ID NO: 3134544 - RNA, 21 nt, Mycobacterium bovis subsp bovis AF2122/97
caccggcacccccgucgccac

SEQ ID NO: 3134545 - RNA, 22 nt, Mycobacterium bovis subsp bovis AF2122/97
caccggcacccccgucgccacc

SEQ ID NO: 3134546 - RNA, 13 nt, Mycobacterium bovis subsp bovis AF2122/97
caccggcacccgc

SEQ ID NO: 3134547 - RNA, 17 nt, Mycobacterium bovis subsp bovis AF2122/97
caccggcacccgcacgg

SEQ ID NO: 3134548 - RNA, 14 nt, Mycobacterium bovis subsp bovis AF2122/97
caccggcaccgccu

SEQ ID NO: 3134549 - RNA, 20 nt, Mycobacterium bovis subsp bovis AF2122/97
caccggcaccgccugcgccg

SEQ ID NO: 3134550 - RNA, 13 nt, Mycobacterium bovis subsp bovis AF2122/97
caccggcaccgcu

SEQ ID NO: 3134551 - RNA, 14 nt, Mycobacterium bovis subsp bovis AF2122/97
caccggcacugccc

SEQ ID NO: 3134552 - RNA, 22 nt, Mycobacterium bovis subsp bovis AF2122/97
caccggcacugcccagcagacc

SEQ ID NO: 3134553 - RNA, 18 nt, Mycobacterium bovis subsp bovis AF2122/97
caccggcagcgcgaucga

SEQ ID NO: 3134554 - RNA, 18 nt, Mycobacterium bovis subsp bovis AF2122/97
caccggcauacagccggc

SEQ ID NO: 3134555 - RNA, 14 nt, Mycobacterium bovis subsp bovis AF2122/97
caccggcaugcgug

SEQ ID NO: 3134556 - RNA, 17 nt, Mycobacterium bovis subsp bovis AF2122/97
caccggcaugcgugccg

SEQ ID NO: 3134557 - RNA, 21 nt, Mycobacterium bovis subsp bovis AF2122/97
caccggcaugcgugccggcag

SEQ ID NO: 3134558 - RNA, 22 nt, Mycobacterium bovis subsp bovis AF2122/97
caccggcaugcgugccggcagc

SEQ ID NO: 3134559 - RNA, 15 nt, Mycobacterium bovis subsp bovis AF2122/97
caccggccaccagcc

SEQ ID NO: 3134560 - RNA, 16 nt, Mycobacterium bovis subsp bovis AF2122/97
caccggccaccagccc

SEQ ID NO: 3134561 - RNA, 16 nt, Mycobacterium bovis subsp bovis AF2122/97
caccggccaccagggc

SEQ ID NO: 3134562 - RNA, 21 nt, Mycobacterium bovis subsp bovis AF2122/97
caccggccaccagggccaccg

SEQ ID NO: 3134563 - RNA, 12 nt, Mycobacterium bovis subsp bovis AF2122/97
caccggccagcg

SEQ ID NO: 3134564 - RNA, 15 nt, Mycobacterium bovis subsp bovis AF2122/97
caccggccaggccgg

SEQ ID NO: 3134565 - RNA, 17 nt, Mycobacterium bovis subsp bovis AF2122/97
caccggccaggccggcg

SEQ ID NO: 3134566 - RNA, 19 nt, Mycobacterium bovis subsp bovis AF2122/97
caccggccaggccggcggc

SEQ ID NO: 3134567 - RNA, 20 nt, Mycobacterium bovis subsp bovis AF2122/97
caccggccccaccgacagcc

SEQ ID NO: 3134568 - RNA, 20 nt, Mycobacterium bovis subsp bovis AF2122/97
caccggccccaccggcaccc

SEQ ID NO: 3134569 - RNA, 16 nt, Mycobacterium bovis subsp bovis AF2122/97
caccggcccucgccag

SEQ ID NO: 3134570 - RNA, 18 nt, Mycobacterium bovis subsp bovis AF2122/97
caccggcccucgccagag

SEQ ID NO: 3134571 - RNA, 12 nt, Mycobacterium bovis subsp bovis AF2122/97
caccggccggcg

SEQ ID NO: 3134572 - RNA, 16 nt, Mycobacterium bovis subsp bovis AF2122/97
caccggccgguccacg

SEQ ID NO: 3134573 - RNA, 13 nt, Mycobacterium bovis subsp bovis AF2122/97
caccggccguccc

SEQ ID NO: 3134574 - RNA, 20 nt, Mycobacterium bovis subsp bovis AF2122/97
caccggccgugccgccgaca

SEQ ID NO: 3134575 - RNA, 22 nt, Mycobacterium bovis subsp bovis AF2122/97
caccggccgugccgccgacacc

SEQ ID NO: 3134576 - RNA, 23 nt, Mycobacterium bovis subsp bovis AF2122/97
caccggccgugccgccgacacca

SEQ ID NO: 3134577 - RNA, 16 nt, Mycobacterium bovis subsp bovis AF2122/97
caccggccugcgcgac

SEQ ID NO: 3134578 - RNA, 20 nt, Mycobacterium bovis subsp bovis AF2122/97
caccggccugcgcgaccgac

SEQ ID NO: 3134579 - RNA, 18 nt, Mycobacterium bovis subsp bovis AF2122/97
caccggcgacgccggccu

SEQ ID NO: 3134580 - RNA, 18 nt, Mycobacterium bovis subsp bovis AF2122/97
caccggcgagugcugucg

SEQ ID NO: 3134581 - RNA, 18 nt, Mycobacterium bovis subsp bovis AF2122/97
caccggcgaucugcucga

SEQ ID NO: 3134582 - RNA, 19 nt, Mycobacterium bovis subsp bovis AF2122/97
caccggcgcaccggagucg

SEQ ID NO: 3134583 - RNA, 19 nt, Mycobacterium bovis subsp bovis AF2122/97
caccggcgcaccgucgcgg

SEQ ID NO: 3134584 - RNA, 13 nt, Mycobacterium bovis subsp bovis AF2122/97
caccggcgccacc

SEQ ID NO: 3134585 - RNA, 19 nt, Mycobacterium bovis subsp bovis AF2122/97
caccggcgccaccggcgcc

SEQ ID NO: 3134586 - RNA, 20 nt, Mycobacterium bovis subsp bovis AF2122/97
caccggcgccaccggcgccg

SEQ ID NO: 3134587 - RNA, 12 nt, Mycobacterium bovis subsp bovis AF2122/97
caccggcgccca

SEQ ID NO: 3134588 - RNA, 21 nt, Mycobacterium bovis subsp bovis AF2122/97
caccggcgcccagcgccucga

SEQ ID NO: 3134589 - RNA, 13 nt, Mycobacterium bovis subsp bovis AF2122/97
caccggcgccgcc

SEQ ID NO: 3134590 - RNA, 20 nt, Mycobacterium bovis subsp bovis AF2122/97
caccggcgccgcccgcgcca

SEQ ID NO: 3134591 - RNA, 14 nt, Mycobacterium bovis subsp bovis AF2122/97
caccggcgccgccg

SEQ ID NO: 3134592 - RNA, 15 nt, Mycobacterium bovis subsp bovis AF2122/97
caccggcgccgccgg

SEQ ID NO: 3134593 - RNA, 18 nt, Mycobacterium bovis subsp bovis AF2122/97
caccggcgccgccggcac

SEQ ID NO: 3134594 - RNA, 16 nt, Mycobacterium bovis subsp bovis AF2122/97
caccggcgccgccguc

SEQ ID NO: 3134595 - RNA, 16 nt, Mycobacterium bovis subsp bovis AF2122/97
caccggcgccguguca

SEQ ID NO: 3134596 - RNA, 14 nt, Mycobacterium bovis subsp bovis AF2122/97
caccggcgcgaccg

SEQ ID NO: 3134597 - RNA, 14 nt, Mycobacterium bovis subsp bovis AF2122/97
caccggucaccgcg

SEQ ID NO: 3134598 - RNA, 17 nt, Mycobacterium bovis subsp bovis AF2122/97
caccggucaccgcgcag

SEQ ID NO: 3134599 - RNA, 13 nt, Mycobacterium bovis subsp bovis AF2122/97
caccggucagcga

SEQ ID NO: 3134600 - RNA, 19 nt, Mycobacterium bovis subsp bovis AF2122/97
caccggucagcgacgcacg

SEQ ID NO: 3134601 - RNA, 20 nt, Mycobacterium bovis subsp bovis AF2122/97
caccggucagcgacgcacgc

SEQ ID NO: 3134602 - RNA, 14 nt, Mycobacterium bovis subsp bovis AF2122/97
caccgguccagcgc

SEQ ID NO: 3134603 - RNA, 17 nt, Mycobacterium bovis subsp bovis AF2122/97
caccggucccugcgccg

SEQ ID NO: 3134604 - RNA, 20 nt, Mycobacterium bovis subsp bovis AF2122/97
caccggucccugcgccguca

SEQ ID NO: 3134605 - RNA, 15 nt, Mycobacterium bovis subsp bovis AF2122/97
caccggucgccgcga

SEQ ID NO: 3134606 - RNA, 16 nt, Mycobacterium bovis subsp bovis AF2122/97
caccggucgccgcgaa

SEQ ID NO: 3134607 - RNA, 14 nt, Mycobacterium bovis subsp bovis AF2122/97
caccggucggcagc

SEQ ID NO: 3134608 - RNA, 17 nt, Mycobacterium bovis subsp bovis AF2122/97
caccggucggcagcuuc

SEQ ID NO: 3134609 - RNA, 21 nt, Mycobacterium bovis subsp bovis AF2122/97
caccggugacgcacagcagca

SEQ ID NO: 3134610 - RNA, 22 nt, Mycobacterium bovis subsp bovis AF2122/97
caccggugacgcacagcagcac

SEQ ID NO: 3134611 - RNA, 23 nt, Mycobacterium bovis subsp bovis AF2122/97
caccggugacgcacagcagcacc

SEQ ID NO: 3134612 - RNA, 16 nt, Mycobacterium bovis subsp bovis AF2122/97
caccggugcccaccac

SEQ ID NO: 3134613 - RNA, 18 nt, Mycobacterium bovis subsp bovis AF2122/97
caccggugcccaccaccg

SEQ ID NO: 3134614 - RNA, 15 nt, Mycobacterium bovis subsp bovis AF2122/97
caccggugccgcccg

SEQ ID NO: 3134615 - RNA, 16 nt, Mycobacterium bovis subsp bovis AF2122/97
caccggugccgcccgc

SEQ ID NO: 3134616 - RNA, 22 nt, Mycobacterium bovis subsp bovis AF2122/97
caccggugccgcccgcgccgcc

SEQ ID NO: 3134617 - RNA, 23 nt, Mycobacterium bovis subsp bovis AF2122/97
caccggugccgcccgcgccgccg

SEQ ID NO: 3134618 - RNA, 14 nt, Mycobacterium bovis subsp bovis AF2122/97
caccggugccgccg

SEQ ID NO: 3134619 - RNA, 16 nt, Mycobacterium bovis subsp bovis AF2122/97
caccggugccgccguu

SEQ ID NO: 3134620 - RNA, 15 nt, Mycobacterium bovis subsp bovis AF2122/97
caccggugccggcga

SEQ ID NO: 3134621 - RNA, 17 nt, Mycobacterium bovis subsp bovis AF2122/97
caccggugccggcgacg

SEQ ID NO: 3134622 - RNA, 19 nt, Mycobacterium bovis subsp bovis AF2122/97
caccggugccggcgacgcu

SEQ ID NO: 3134623 - RNA, 16 nt, Mycobacterium bovis subsp bovis AF2122/97
caccggugcgcuggag

SEQ ID NO: 3134624 - RNA, 14 nt, Mycobacterium bovis subsp bovis AF2122/97
caccggugcucguc

SEQ ID NO: 3134625 - RNA, 16 nt, Mycobacterium bovis subsp bovis AF2122/97
caccgguggacccggc

SEQ ID NO: 3134626 - RNA, 19 nt, Mycobacterium bovis subsp bovis AF2122/97
caccgguggacccggcggu

SEQ ID NO: 3134627 - RNA, 12 nt, Mycobacterium bovis subsp bovis AF2122/97
caccgguggcgc

SEQ ID NO: 3134628 - RNA, 15 nt, Mycobacterium bovis subsp bovis AF2122/97
caccgguggcgcccu

SEQ ID NO: 3134629 - RNA, 17 nt, Mycobacterium bovis subsp bovis AF2122/97
caccgguggcuucaacc

SEQ ID NO: 3134630 - RNA, 12 nt, Mycobacterium bovis subsp bovis AF2122/97
caccggugucgg

SEQ ID NO: 3134631 - RNA, 13 nt, Mycobacterium bovis subsp bovis AF2122/97
caccggugucggc

SEQ ID NO: 3134632 - RNA, 17 nt, Mycobacterium bovis subsp bovis AF2122/97
caccggugucggccagc

SEQ ID NO: 3134633 - RNA, 18 nt, Mycobacterium bovis subsp bovis AF2122/97
caccggugucggccagca

SEQ ID NO: 3134634 - RNA, 20 nt, Mycobacterium bovis subsp bovis AF2122/97
caccggugucggccagcaac

SEQ ID NO: 3134635 - RNA, 16 nt, Mycobacterium bovis subsp bovis AF2122/97
caccggugucuucugc

SEQ ID NO: 3134636 - RNA, 20 nt, Mycobacterium bovis subsp bovis AF2122/97
caccggugucuucugccauc

SEQ ID NO: 3134637 - RNA, 21 nt, Mycobacterium bovis subsp bovis AF2122/97
caccgguucggggggcagguc

SEQ ID NO: 3134638 - RNA, 16 nt, Mycobacterium bovis subsp bovis AF2122/97
caccgguuucgucggu

SEQ ID NO: 3134639 - RNA, 16 nt, Mycobacterium bovis subsp bovis AF2122/97
caccgguuugacgucc

SEQ ID NO: 3134640 - RNA, 19 nt, Mycobacterium bovis subsp bovis AF2122/97
caccgguuugacguccagg

SEQ ID NO: 3134641 - RNA, 20 nt, Mycobacterium bovis subsp bovis AF2122/97
caccgguuugacguccaggg

SEQ ID NO: 3134642 - RNA, 20 nt, Mycobacterium bovis subsp bovis AF2122/97
caccgguuuggagcucaucg

SEQ ID NO: 3134643 - RNA, 21 nt, Mycobacterium bovis subsp bovis AF2122/97
caccgguuuggagcucaucga

SEQ ID NO: 3134644 - RNA, 18 nt, Mycobacterium bovis subsp bovis AF2122/97
caccguaaacagcgcgcc

SEQ ID NO: 3134645 - RNA, 22 nt, Mycobacterium bovis subsp bovis AF2122/97
caccguaauuucuucacggucg

SEQ ID NO: 3134646 - RNA, 15 nt, Mycobacterium bovis subsp bovis AF2122/97
caccguaccgacgaa

SEQ ID NO: 3134647 - RNA, 21 nt, Mycobacterium bovis subsp bovis AF2122/97
caccguagagcaugccgcccg

SEQ ID NO: 3134648 - RNA, 14 nt, Mycobacterium bovis subsp bovis AF2122/97
caccguagccagca

SEQ ID NO: 3134649 - RNA, 15 nt, Mycobacterium bovis subsp bovis AF2122/97
caccguagccgaggg

SEQ ID NO: 3134650 - RNA, 16 nt, Mycobacterium bovis subsp bovis AF2122/97
caccguagccgcugca

SEQ ID NO: 3134651 - RNA, 17 nt, Mycobacterium bovis subsp bovis AF2122/97
caccguaggcgaucuca

SEQ ID NO: 3134652 - RNA, 24 nt, Mycobacterium bovis subsp bovis AF2122/97
caccguaguaguucagccaggccg

SEQ ID NO: 3134653 - RNA, 15 nt, Mycobacterium bovis subsp bovis AF2122/97
caccgucacccccga

SEQ ID NO: 3134654 - RNA, 15 nt, Mycobacterium bovis subsp bovis AF2122/97
caccgucaccgagcc

SEQ ID NO: 3134655 - RNA, 13 nt, Mycobacterium bovis subsp bovis AF2122/97
caccgucaccgcc

SEQ ID NO: 3134656 - RNA, 14 nt, Mycobacterium bovis subsp bovis AF2122/97
caccgucaccgccg

SEQ ID NO: 3134657 - RNA, 15 nt, Mycobacterium bovis subsp bovis AF2122/97
caccgucaccgccgg

SEQ ID NO: 3134658 - RNA, 22 nt, Mycobacterium bovis subsp bovis AF2122/97
caccgucaccgccggcaccgcc

SEQ ID NO: 3134659 - RNA, 20 nt, Mycobacterium bovis subsp bovis AF2122/97
caccgucacgaucagggcga

SEQ ID NO: 3134660 - RNA, 17 nt, Mycobacterium bovis subsp bovis AF2122/97
caccgucacgccaccgc

SEQ ID NO: 3134661 - RNA, 20 nt, Mycobacterium bovis subsp bovis AF2122/97
caccgucacggucgcggauc

SEQ ID NO: 3134662 - RNA, 17 nt, Mycobacterium bovis subsp bovis AF2122/97
caccgucagcgcgaccg

SEQ ID NO: 3134663 - RNA, 22 nt, Mycobacterium bovis subsp bovis AF2122/97
caccgucaggggaguugcgacg

SEQ ID NO: 3134664 - RNA, 16 nt, Mycobacterium bovis subsp bovis AF2122/97
caccgucaugccgacg

SEQ ID NO: 3134665 - RNA, 19 nt, Mycobacterium bovis subsp bovis AF2122/97
caccgucaugccgacgaca

SEQ ID NO: 3134666 - RNA, 21 nt, Mycobacterium bovis subsp bovis AF2122/97
caccgucaugccgacgacaac

SEQ ID NO: 3134667 - RNA, 16 nt, Mycobacterium bovis subsp bovis AF2122/97
caccgucaugccguug

SEQ ID NO: 3134668 - RNA, 23 nt, Mycobacterium bovis subsp bovis AF2122/97
caccgucauggcgggugcggcga

SEQ ID NO: 3134669 - RNA, 17 nt, Mycobacterium bovis subsp bovis AF2122/97
caccgucauugccacca

SEQ ID NO: 3134670 - RNA, 23 nt, Mycobacterium bovis subsp bovis AF2122/97
caccguccagcagcucggggcga

SEQ ID NO: 3134671 - RNA, 15 nt, Mycobacterium bovis subsp bovis AF2122/97
caccgucccuguguc

SEQ ID NO: 3134672 - RNA, 22 nt, Mycobacterium bovis subsp bovis AF2122/97
caccgucccugugucgccgucg

SEQ ID NO: 3134673 - RNA, 16 nt, Mycobacterium bovis subsp bovis AF2122/97
caccguccgucggcgc

SEQ ID NO: 3134674 - RNA, 18 nt, Mycobacterium bovis subsp bovis AF2122/97
caccguccucggucacga

SEQ ID NO: 3134675 - RNA, 14 nt, Mycobacterium bovis subsp bovis AF2122/97
caccgucgacgaca

SEQ ID NO: 3134676 - RNA, 15 nt, Mycobacterium bovis subsp bovis AF2122/97
caccgucgagccgga

SEQ ID NO: 3134677 - RNA, 14 nt, Mycobacterium bovis subsp bovis AF2122/97
caccgucgcaccca

SEQ ID NO: 3134678 - RNA, 14 nt, Mycobacterium bovis subsp bovis AF2122/97
caccgucgcggcgg

SEQ ID NO: 3134679 - RNA, 15 nt, Mycobacterium bovis subsp bovis AF2122/97
caccgucgcggcggc

SEQ ID NO: 3134680 - RNA, 18 nt, Mycobacterium bovis subsp bovis AF2122/97
caccgucgcugcccgcgc

SEQ ID NO: 3134681 - RNA, 23 nt, Mycobacterium bovis subsp bovis AF2122/97
caccgucgcugcccgcgcggcca

SEQ ID NO: 3134682 - RNA, 14 nt, Mycobacterium bovis subsp bovis AF2122/97
caccgucggcagca

SEQ ID NO: 3134683 - RNA, 23 nt, Mycobacterium bovis subsp bovis AF2122/97
caccgucgggcccagccggaccg

SEQ ID NO: 3134684 - RNA, 17 nt, Mycobacterium bovis subsp bovis AF2122/97
caccucccacgccgccg

SEQ ID NO: 3134685 - RNA, 20 nt, Mycobacterium bovis subsp bovis AF2122/97
caccucccagggcucggcgg

SEQ ID NO: 3134686 - RNA, 13 nt, Mycobacterium bovis subsp bovis AF2122/97
caccuccccgauc

SEQ ID NO: 3134687 - RNA, 13 nt, Mycobacterium bovis subsp bovis AF2122/97
caccucccgcagc

SEQ ID NO: 3134688 - RNA, 14 nt, Mycobacterium bovis subsp bovis AF2122/97
caccucccgcagcc

SEQ ID NO: 3134689 - RNA, 16 nt, Mycobacterium bovis subsp bovis AF2122/97
caccucccgcagccgg

SEQ ID NO: 3134690 - RNA, 17 nt, Mycobacterium bovis subsp bovis AF2122/97
caccucccgcagccggg

SEQ ID NO: 3134691 - RNA, 15 nt, Mycobacterium bovis subsp bovis AF2122/97
caccuccgacggccg

SEQ ID NO: 3134692 - RNA, 16 nt, Mycobacterium bovis subsp bovis AF2122/97
caccuccgacggccgc

SEQ ID NO: 3134693 - RNA, 18 nt, Mycobacterium bovis subsp bovis AF2122/97
caccuccgacggccgcgg

SEQ ID NO: 3134694 - RNA, 21 nt, Mycobacterium bovis subsp bovis AF2122/97
caccuccgacggccgcggcgu

SEQ ID NO: 3134695 - RNA, 16 nt, Mycobacterium bovis subsp bovis AF2122/97
caccuccgaggccgcc

SEQ ID NO: 3134696 - RNA, 19 nt, Mycobacterium bovis subsp bovis AF2122/97
caccuccgaggccgccauc

SEQ ID NO: 3134697 - RNA, 13 nt, Mycobacterium bovis subsp bovis AF2122/97
caccuccgcgacg

SEQ ID NO: 3134698 - RNA, 17 nt, Mycobacterium bovis subsp bovis AF2122/97
caccuccgcgacggcgg

SEQ ID NO: 3134699 - RNA, 18 nt, Mycobacterium bovis subsp bovis AF2122/97
caccuccgcgacggcggc

SEQ ID NO: 3134700 - RNA, 22 nt, Mycobacterium bovis subsp bovis AF2122/97
caccuccgcguccaaggcgcgc

SEQ ID NO: 3134701 - RNA, 16 nt, Mycobacterium bovis subsp bovis AF2122/97
caccuccucgagcagg

SEQ ID NO: 3134702 - RNA, 20 nt, Mycobacterium bovis subsp bovis AF2122/97
caccuccucgagcaggaugc

SEQ ID NO: 3134703 - RNA, 18 nt, Mycobacterium bovis subsp bovis AF2122/97
caccucgaagugcaggug

SEQ ID NO: 3134704 - RNA, 15 nt, Mycobacterium bovis subsp bovis AF2122/97
caccucgacggugac

SEQ ID NO: 3134705 - RNA, 22 nt, Mycobacterium bovis subsp bovis AF2122/97
caccucgacggugacgaccacg

SEQ ID NO: 3134706 - RNA, 17 nt, Mycobacterium bovis subsp bovis AF2122/97
caccucgagcgcggcga

SEQ ID NO: 3134707 - RNA, 19 nt, Mycobacterium bovis subsp bovis AF2122/97
caccucgagcgcggcgauc

SEQ ID NO: 3134708 - RNA, 17 nt, Mycobacterium bovis subsp bovis AF2122/97
caccucgaucgcgccgu

SEQ ID NO: 3134709 - RNA, 12 nt, Mycobacterium bovis subsp bovis AF2122/97
caccucgaugcc

SEQ ID NO: 3134710 - RNA, 16 nt, Mycobacterium bovis subsp bovis AF2122/97
caccucgaugccgccc

SEQ ID NO: 3134711 - RNA, 17 nt, Mycobacterium bovis subsp bovis AF2122/97
caccucgaugccgcccg

SEQ ID NO: 3134712 - RNA, 20 nt, Mycobacterium bovis subsp bovis AF2122/97
caccucgccaacaucccaac

SEQ ID NO: 3134713 - RNA, 22 nt, Mycobacterium bovis subsp bovis AF2122/97
caccucgccaacaucccaacac

SEQ ID NO: 3134714 - RNA, 16 nt, Mycobacterium bovis subsp bovis AF2122/97
caccucgcccucccgg

SEQ ID NO: 3134715 - RNA, 14 nt, Mycobacterium bovis subsp bovis AF2122/97
caccucgccggccg

SEQ ID NO: 3134716 - RNA, 13 nt, Mycobacterium bovis subsp bovis AF2122/97
caccucgccggcg

SEQ ID NO: 3134717 - RNA, 22 nt, Mycobacterium bovis subsp bovis AF2122/97
caccucggccagcuccgccugc

SEQ ID NO: 3134718 - RNA, 11 nt, Mycobacterium bovis subsp bovis AF2122/97
caccucggcga

SEQ ID NO: 3134719 - RNA, 23 nt, Mycobacterium bovis subsp bovis AF2122/97
caccucggcgacgucggcggcua

SEQ ID NO: 3134720 - RNA, 21 nt, Mycobacterium bovis subsp bovis AF2122/97
caccucggcuuugccgcugug

SEQ ID NO: 3134721 - RNA, 14 nt, Mycobacterium bovis subsp bovis AF2122/97
caccucgggcgccc

SEQ ID NO: 3134722 - RNA, 23 nt, Mycobacterium bovis subsp bovis AF2122/97
caccucggguguggucaccaggc

SEQ ID NO: 3134723 - RNA, 22 nt, Mycobacterium bovis subsp bovis AF2122/97
caccucggugaccaggccggcc

SEQ ID NO: 3134724 - RNA, 23 nt, Mycobacterium bovis subsp bovis AF2122/97
caccucggugaccaggccggccc

SEQ ID NO: 3134725 - RNA, 17 nt, Mycobacterium bovis subsp bovis AF2122/97
caccucggugccggccg

SEQ ID NO: 3134726 - RNA, 18 nt, Mycobacterium bovis subsp bovis AF2122/97
caccucggugccggccgc

SEQ ID NO: 3134727 - RNA, 19 nt, Mycobacterium bovis subsp bovis AF2122/97
caccucggugccggccgca

SEQ ID NO: 3134728 - RNA, 23 nt, Mycobacterium bovis subsp bovis AF2122/97
caccucguguccggggaccucgg

SEQ ID NO: 3134729 - RNA, 17 nt, Mycobacterium bovis subsp bovis AF2122/97
caccucucgcuugccga

SEQ ID NO: 3134730 - RNA, 23 nt, Mycobacterium bovis subsp bovis AF2122/97
caccucuucgaucuguuccugca

SEQ ID NO: 3134731 - RNA, 20 nt, Mycobacterium bovis subsp bovis AF2122/97
caccucuucucggacacgcu

SEQ ID NO: 3134732 - RNA, 14 nt, Mycobacterium bovis subsp bovis AF2122/97
caccugaaaccacu

SEQ ID NO: 3134733 - RNA, 15 nt, Mycobacterium bovis subsp bovis AF2122/97
caccugaaagcuacc

SEQ ID NO: 3134734 - RNA, 17 nt, Mycobacterium bovis subsp bovis AF2122/97
caccugacgugcggcgc

SEQ ID NO: 3134735 - RNA, 15 nt, Mycobacterium bovis subsp bovis AF2122/97
caccugagccucagu

SEQ ID NO: 3134736 - RNA, 16 nt, Mycobacterium bovis subsp bovis AF2122/97
caccugcaucgucgcc

SEQ ID NO: 3134737 - RNA, 15 nt, Mycobacterium bovis subsp bovis AF2122/97
caccugcaugugugu

SEQ ID NO: 3134738 - RNA, 17 nt, Mycobacterium bovis subsp bovis AF2122/97
caccugccgacucaucg

SEQ ID NO: 3134739 - RNA, 19 nt, Mycobacterium bovis subsp bovis AF2122/97
caccugccgacucaucggc

SEQ ID NO: 3134740 - RNA, 20 nt, Mycobacterium bovis subsp bovis AF2122/97
caccugccgacucaucggcc

SEQ ID NO: 3134741 - RNA, 23 nt, Mycobacterium bovis subsp bovis AF2122/97
caccugccgacucaucggccgcg

SEQ ID NO: 3134742 - RNA, 22 nt, Mycobacterium bovis subsp bovis AF2122/97
caccugcgaugaugugcgacca

SEQ ID NO: 3134743 - RNA, 16 nt, Mycobacterium bovis subsp bovis AF2122/97
caccugcgcgcggccg

SEQ ID NO: 3134744 - RNA, 17 nt, Mycobacterium bovis subsp bovis AF2122/97
caccugcgcgcggccgc

SEQ ID NO: 3134745 - RNA, 18 nt, Mycobacterium bovis subsp bovis AF2122/97
caccugcgcgcggccgcg

SEQ ID NO: 3134746 - RNA, 20 nt, Mycobacterium bovis subsp bovis AF2122/97
caccugcgcgcggccgcgcu

SEQ ID NO: 3134747 - RNA, 22 nt, Mycobacterium bovis subsp bovis AF2122/97
caccugcgcgcggccgcgcugc

SEQ ID NO: 3134748 - RNA, 21 nt, Mycobacterium bovis subsp bovis AF2122/97
caccugcggcugcuuggucgc

SEQ ID NO: 3134749 - RNA, 13 nt, Mycobacterium bovis subsp bovis AF2122/97
caccugcgggccc

SEQ ID NO: 3134750 - RNA, 16 nt, Mycobacterium bovis subsp bovis AF2122/97
caccugcgggcccacg

SEQ ID NO: 3134751 - RNA, 20 nt, Mycobacterium bovis subsp bovis AF2122/97
caccugcgggcccacgccca

SEQ ID NO: 3134752 - RNA, 20 nt, Mycobacterium bovis subsp bovis AF2122/97
caccugcgggugcgucgaug

SEQ ID NO: 3134753 - RNA, 14 nt, Mycobacterium bovis subsp bovis AF2122/97
caccugcucgucgg

SEQ ID NO: 3134754 - RNA, 17 nt, Mycobacterium bovis subsp bovis AF2122/97
caccugcuggaagccgu

SEQ ID NO: 3134755 - RNA, 14 nt, Mycobacterium bovis subsp bovis AF2122/97
caccugcuggccgu

SEQ ID NO: 3134756 - RNA, 21 nt, Mycobacterium bovis subsp bovis AF2122/97
caccugcuggccguaacgcgg

SEQ ID NO: 3134757 - RNA, 20 nt, Mycobacterium bovis subsp bovis AF2122/97
caccuggaaggucagcgccc

SEQ ID NO: 3134758 - RNA, 16 nt, Mycobacterium bovis subsp bovis AF2122/97
caccuggauccaccag

SEQ ID NO: 3134759 - RNA, 14 nt, Mycobacterium bovis subsp bovis AF2122/97
caccuggccgcccg

SEQ ID NO: 3134760 - RNA, 15 nt, Mycobacterium bovis subsp bovis AF2122/97
caccuggccgcccgc

SEQ ID NO: 3134761 - RNA, 13 nt, Mycobacterium bovis subsp bovis AF2122/97
caccuggcgcagc

SEQ ID NO: 3134762 - RNA, 15 nt, Mycobacterium bovis subsp bovis AF2122/97
caccuggcgcgcgca

SEQ ID NO: 3134763 - RNA, 16 nt, Mycobacterium bovis subsp bovis AF2122/97
caccuggcgugucgcc

SEQ ID NO: 3134764 - RNA, 20 nt, Mycobacterium bovis subsp bovis AF2122/97
caccuggcgugucgccgcca

SEQ ID NO: 3134765 - RNA, 23 nt, Mycobacterium bovis subsp bovis AF2122/97
caccuggcgugucgccgccacca

SEQ ID NO: 3134766 - RNA, 15 nt, Mycobacterium bovis subsp bovis AF2122/97
caccugggccagcag

SEQ ID NO: 3134767 - RNA, 17 nt, Mycobacterium bovis subsp bovis AF2122/97
caccugggccagcagcc

SEQ ID NO: 3134768 - RNA, 13 nt, Mycobacterium bovis subsp bovis AF2122/97
caccugggcgcgc

SEQ ID NO: 3134769 - RNA, 20 nt, Mycobacterium bovis subsp bovis AF2122/97
caccugggcgcgcuggcggg

SEQ ID NO: 3134770 - RNA, 13 nt, Mycobacterium bovis subsp bovis AF2122/97
cacgacgggccga

SEQ ID NO: 3134771 - RNA, 16 nt, Mycobacterium bovis subsp bovis AF2122/97
cacgacgucggugaac

SEQ ID NO: 3134772 - RNA, 15 nt, Mycobacterium bovis subsp bovis AF2122/97
cacgacguucgacga

SEQ ID NO: 3134773 - RNA, 21 nt, Mycobacterium bovis subsp bovis AF2122/97
cacgacguugcgaggccgcac

SEQ ID NO: 3134774 - RNA, 22 nt, Mycobacterium bovis subsp bovis AF2122/97
cacgacguugcgaggccgcacg

SEQ ID NO: 3134775 - RNA, 20 nt, Mycobacterium bovis subsp bovis AF2122/97
cacgacugucccgcgcaacc

SEQ ID NO: 3134776 - RNA, 16 nt, Mycobacterium bovis subsp bovis AF2122/97
cacgagagcgcugucc

SEQ ID NO: 3134777 - RNA, 20 nt, Mycobacterium bovis subsp bovis AF2122/97
cacgagagcgcugucccgaa

SEQ ID NO: 3134778 - RNA, 17 nt, Mycobacterium bovis subsp bovis AF2122/97
cacgagcaacgggcgaa

SEQ ID NO: 3134779 - RNA, 13 nt, Mycobacterium bovis subsp bovis AF2122/97
cacgagcacggga

SEQ ID NO: 3134780 - RNA, 22 nt, Mycobacterium bovis subsp bovis AF2122/97
cacgagcacgggacuucgugcc

SEQ ID NO: 3134781 - RNA, 13 nt, Mycobacterium bovis subsp bovis AF2122/97
cacgagcagccga

SEQ ID NO: 3134782 - RNA, 16 nt, Mycobacterium bovis subsp bovis AF2122/97
cacgagcagccgaugc

SEQ ID NO: 3134783 - RNA, 18 nt, Mycobacterium bovis subsp bovis AF2122/97
cacgagcgcauguugcag

SEQ ID NO: 3134784 - RNA, 13 nt, Mycobacterium bovis subsp bovis AF2122/97
cacgagcggcggu

SEQ ID NO: 3134785 - RNA, 15 nt, Mycobacterium bovis subsp bovis AF2122/97
cacgagcggcggugg

SEQ ID NO: 3134786 - RNA, 18 nt, Mycobacterium bovis subsp bovis AF2122/97
cacgaggacccgucgagc

SEQ ID NO: 3134787 - RNA, 13 nt, Mycobacterium bovis subsp bovis AF2122/97
cacgaggcaucgu

SEQ ID NO: 3134788 - RNA, 19 nt, Mycobacterium bovis subsp bovis AF2122/97
cacgaggcaucguccacgc

SEQ ID NO: 3134789 - RNA, 21 nt, Mycobacterium bovis subsp bovis AF2122/97
cacgaggcaucguccacgcag

SEQ ID NO: 3134790 - RNA, 22 nt, Mycobacterium bovis subsp bovis AF2122/97
cacgaggcaucguccacgcaga

SEQ ID NO: 3134791 - RNA, 13 nt, Mycobacterium bovis subsp bovis AF2122/97
cacgaggcguuca

SEQ ID NO: 3134792 - RNA, 21 nt, Mycobacterium bovis subsp bovis AF2122/97
cacgagggccacguagcagca

SEQ ID NO: 3134793 - RNA, 15 nt, Mycobacterium bovis subsp bovis AF2122/97
cacgagguugggccg

SEQ ID NO: 3134794 - RNA, 17 nt, Mycobacterium bovis subsp bovis AF2122/97
cacgaguacagaucgag

SEQ ID NO: 3134795 - RNA, 22 nt, Mycobacterium bovis subsp bovis AF2122/97
cacgaguccgcggaucaccauc

SEQ ID NO: 3134796 - RNA, 21 nt, Mycobacterium bovis subsp bovis AF2122/97
cacgagucgccagaccgcacc

SEQ ID NO: 3134797 - RNA, 14 nt, Mycobacterium bovis subsp bovis AF2122/97
cacgaguuggccaa

SEQ ID NO: 3134798 - RNA, 14 nt, Mycobacterium bovis subsp bovis AF2122/97
cacgauagccaccg

SEQ ID NO: 3134799 - RNA, 19 nt, Mycobacterium bovis subsp bovis AF2122/97
cacgauaucgaugcggcga

SEQ ID NO: 3134800 - RNA, 19 nt, Mycobacterium bovis subsp bovis AF2122/97
cacgauaucgggcucagcg

SEQ ID NO: 3134801 - RNA, 14 nt, Mycobacterium bovis subsp bovis AF2122/97
cacgaucaaccggg

SEQ ID NO: 3134802 - RNA, 16 nt, Mycobacterium bovis subsp bovis AF2122/97
cacgaucagggcgaug

SEQ ID NO: 3134803 - RNA, 23 nt, Mycobacterium bovis subsp bovis AF2122/97
cacgaucaucgggguggccacca

SEQ ID NO: 3134804 - RNA, 16 nt, Mycobacterium bovis subsp bovis AF2122/97
cacgauccgcgguagc

SEQ ID NO: 3134805 - RNA, 13 nt, Mycobacterium bovis subsp bovis AF2122/97
cacgaucgccaac

SEQ ID NO: 3134806 - RNA, 17 nt, Mycobacterium bovis subsp bovis AF2122/97
cacgaucgcggugaugg

SEQ ID NO: 3134807 - RNA, 17 nt, Mycobacterium bovis subsp bovis AF2122/97
cacgaucgucgcggcca

SEQ ID NO: 3134808 - RNA, 16 nt, Mycobacterium bovis subsp bovis AF2122/97
cacgaucucguggauc

SEQ ID NO: 3134809 - RNA, 19 nt, Mycobacterium bovis subsp bovis AF2122/97
cacgaucucguggaucugc

SEQ ID NO: 3134810 - RNA, 22 nt, Mycobacterium bovis subsp bovis AF2122/97
cacgaucucguggaucugccuc

SEQ ID NO: 3134811 - RNA, 23 nt, Mycobacterium bovis subsp bovis AF2122/97
cacgaucucguggaucugccucu

SEQ ID NO: 3134812 - RNA, 20 nt, Mycobacterium bovis subsp bovis AF2122/97
cacgaucugcaggcccaggc

SEQ ID NO: 3134813 - RNA, 21 nt, Mycobacterium bovis subsp bovis AF2122/97
cacgaucugcaggcccaggcu

SEQ ID NO: 3134814 - RNA, 18 nt, Mycobacterium bovis subsp bovis AF2122/97
cacgaucugcgcgucagg

SEQ ID NO: 3134815 - RNA, 14 nt, Mycobacterium bovis subsp bovis AF2122/97
cacgaugaucccaa

SEQ ID NO: 3134816 - RNA, 20 nt, Mycobacterium bovis subsp bovis AF2122/97
cacgaugaucuugccgcggc

SEQ ID NO: 3134817 - RNA, 23 nt, Mycobacterium bovis subsp bovis AF2122/97
cacgaugaucuugccgcggcgca

SEQ ID NO: 3134818 - RNA, 23 nt, Mycobacterium bovis subsp bovis AF2122/97
cacgaugcccaagcccucgacgu

SEQ ID NO: 3134819 - RNA, 16 nt, Mycobacterium bovis subsp bovis AF2122/97
cacgaugcgcacaccg

SEQ ID NO: 3134820 - RNA, 18 nt, Mycobacterium bovis subsp bovis AF2122/97
cacgaugcgguucucgag

SEQ ID NO: 3134821 - RNA, 13 nt, Mycobacterium bovis subsp bovis AF2122/97
cacgauggccguc

SEQ ID NO: 3134822 - RNA, 17 nt, Mycobacterium bovis subsp bovis AF2122/97
cacgauggccgucgauc

SEQ ID NO: 3134823 - RNA, 12 nt, Mycobacterium bovis subsp bovis AF2122/97
cacgauggcggc

SEQ ID NO: 3134824 - RNA, 14 nt, Mycobacterium bovis subsp bovis AF2122/97
cacgauggcggcca

SEQ ID NO: 3134825 - RNA, 18 nt, Mycobacterium bovis subsp bovis AF2122/97
cacgaugucgaugccgug

SEQ ID NO: 3134826 - RNA, 17 nt, Mycobacterium bovis subsp bovis AF2122/97
cacgaugucgucgauga

SEQ ID NO: 3134827 - RNA, 16 nt, Mycobacterium bovis subsp bovis AF2122/97
cacgcaacaccgccaa

SEQ ID NO: 3134828 - RNA, 19 nt, Mycobacterium bovis subsp bovis AF2122/97
cacgcaaccggcggacacc

SEQ ID NO: 3134829 - RNA, 19 nt, Mycobacterium bovis subsp bovis AF2122/97
cacgcaagggaauccgaac

SEQ ID NO: 3134830 - RNA, 18 nt, Mycobacterium bovis subsp bovis AF2122/97
cacgcaaugucggcaggg

SEQ ID NO: 3134831 - RNA, 18 nt, Mycobacterium bovis subsp bovis AF2122/97
cacgcacaaguucuucga

SEQ ID NO: 3134832 - RNA, 17 nt, Mycobacterium bovis subsp bovis AF2122/97
cacgcacacgaucgcgg

SEQ ID NO: 3134833 - RNA, 20 nt, Mycobacterium bovis subsp bovis AF2122/97
cacgcacagcaacgcccaac

SEQ ID NO: 3134834 - RNA, 13 nt, Mycobacterium bovis subsp bovis AF2122/97
cacgcacccggca

SEQ ID NO: 3134835 - RNA, 23 nt, Mycobacterium bovis subsp bovis AF2122/97
cacgcacccggcgcaacaaccgg

SEQ ID NO: 3134836 - RNA, 13 nt, Mycobacterium bovis subsp bovis AF2122/97
cacgcaccgcggu

SEQ ID NO: 3134837 - RNA, 21 nt, Mycobacterium bovis subsp bovis AF2122/97
cacgcaccgggugcaggugau

SEQ ID NO: 3134838 - RNA, 14 nt, Mycobacterium bovis subsp bovis AF2122/97
cacgcacgccgcgu

SEQ ID NO: 3134839 - RNA, 15 nt, Mycobacterium bovis subsp bovis AF2122/97
cacgcacucacuacc

SEQ ID NO: 3134840 - RNA, 16 nt, Mycobacterium bovis subsp bovis AF2122/97
cacgcacucccgagcc

SEQ ID NO: 3134841 - RNA, 21 nt, Mycobacterium bovis subsp bovis AF2122/97
cacgcacugaugucacccgcc

SEQ ID NO: 3134842 - RNA, 22 nt, Mycobacterium bovis subsp bovis AF2122/97
cacgcagcacccugcgggccga

SEQ ID NO: 3134843 - RNA, 12 nt, Mycobacterium bovis subsp bovis AF2122/97
cacgcagcacgg

SEQ ID NO: 3134844 - RNA, 13 nt, Mycobacterium bovis subsp bovis AF2122/97
cacgcagcccguc

SEQ ID NO: 3134845 - RNA, 16 nt, Mycobacterium bovis subsp bovis AF2122/97
cacgcagccgcgcggu

SEQ ID NO: 3134846 - RNA, 19 nt, Mycobacterium bovis subsp bovis AF2122/97
cacgcagccgcgcggugau

SEQ ID NO: 3134847 - RNA, 12 nt, Mycobacterium bovis subsp bovis AF2122/97
cacgcagcgcca

SEQ ID NO: 3134848 - RNA, 21 nt, Mycobacterium bovis subsp bovis AF2122/97
cacgcaggaaaaccccggcca

SEQ ID NO: 3134849 - RNA, 23 nt, Mycobacterium bovis subsp bovis AF2122/97
cacgcaggaaaaccccggccacc

SEQ ID NO: 3134850 - RNA, 14 nt, Mycobacterium bovis subsp bovis AF2122/97
cacgcagucgggca

SEQ ID NO: 3134851 - RNA, 16 nt, Mycobacterium bovis subsp bovis AF2122/97
cacgcagucgggcagc

SEQ ID NO: 3134852 - RNA, 17 nt, Mycobacterium bovis subsp bovis AF2122/97
cacgcagucgggcagcg

SEQ ID NO: 3134853 - RNA, 19 nt, Mycobacterium bovis subsp bovis AF2122/97
cacgcauaucgcuugaacg

SEQ ID NO: 3134854 - RNA, 17 nt, Mycobacterium bovis subsp bovis AF2122/97
cacgcaugagggcaucg

SEQ ID NO: 3134855 - RNA, 12 nt, Mycobacterium bovis subsp bovis AF2122/97
cacgcaugcgcg

SEQ ID NO: 3134856 - RNA, 13 nt, Mycobacterium bovis subsp bovis AF2122/97
cacgcaugggcca

SEQ ID NO: 3134857 - RNA, 19 nt, Mycobacterium bovis subsp bovis AF2122/97
cacgccuggcuacgcgcgc

SEQ ID NO: 3134858 - RNA, 15 nt, Mycobacterium bovis subsp bovis AF2122/97
cacgccugggcgacg

SEQ ID NO: 3134859 - RNA, 16 nt, Mycobacterium bovis subsp bovis AF2122/97
cacgccugggcgacga

SEQ ID NO: 3134860 - RNA, 15 nt, Mycobacterium bovis subsp bovis AF2122/97
cacgccuugagccga

SEQ ID NO: 3134861 - RNA, 18 nt, Mycobacterium bovis subsp bovis AF2122/97
cacgcgaaaugccugcgc

SEQ ID NO: 3134862 - RNA, 15 nt, Mycobacterium bovis subsp bovis AF2122/97
cacgcgaaugacgau

SEQ ID NO: 3134863 - RNA, 22 nt, Mycobacterium bovis subsp bovis AF2122/97
cacgcgaaugacgauccagccc

SEQ ID NO: 3134864 - RNA, 12 nt, Mycobacterium bovis subsp bovis AF2122/97
cacgcgaccacc

SEQ ID NO: 3134865 - RNA, 16 nt, Mycobacterium bovis subsp bovis AF2122/97
cacgcgaccaccgccg

SEQ ID NO: 3134866 - RNA, 18 nt, Mycobacterium bovis subsp bovis AF2122/97
cacgcgaccaccgccgag

SEQ ID NO: 3134867 - RNA, 20 nt, Mycobacterium bovis subsp bovis AF2122/97
cacgcgaccaccgccgagcc

SEQ ID NO: 3134868 - RNA, 16 nt, Mycobacterium bovis subsp bovis AF2122/97
cacgcgacgcggggcu

SEQ ID NO: 3134869 - RNA, 22 nt, Mycobacterium bovis subsp bovis AF2122/97
cacgcgacuugcaccccgucuc

SEQ ID NO: 3134870 - RNA, 15 nt, Mycobacterium bovis subsp bovis AF2122/97
cacgcgauggccauc

SEQ ID NO: 3134871 - RNA, 20 nt, Mycobacterium bovis subsp bovis AF2122/97
cacgcgauggccaucaucga

SEQ ID NO: 3134872 - RNA, 15 nt, Mycobacterium bovis subsp bovis AF2122/97
cacgcgcaacucgcc

SEQ ID NO: 3134873 - RNA, 17 nt, Mycobacterium bovis subsp bovis AF2122/97
cacgcgcacucgacgcc

SEQ ID NO: 3134874 - RNA, 19 nt, Mycobacterium bovis subsp bovis AF2122/97
cacgcgcaguuuggcggcg

SEQ ID NO: 3134875 - RNA, 13 nt, Mycobacterium bovis subsp bovis AF2122/97
cacgcgcccgcac

SEQ ID NO: 3134876 - RNA, 15 nt, Mycobacterium bovis subsp bovis AF2122/97
cacgcgcccgcacca

SEQ ID NO: 3134877 - RNA, 18 nt, Mycobacterium bovis subsp bovis AF2122/97
cacgcgcccgcaccaccg

SEQ ID NO: 3134878 - RNA, 21 nt, Mycobacterium bovis subsp bovis AF2122/97
cacgcgcccgcaccaccggcc

SEQ ID NO: 3134879 - RNA, 15 nt, Mycobacterium bovis subsp bovis AF2122/97
cacgcgcgcaggccg

SEQ ID NO: 3134880 - RNA, 15 nt, Mycobacterium bovis subsp bovis AF2122/97
cacgcgcggaucggc

SEQ ID NO: 3134881 - RNA, 19 nt, Mycobacterium bovis subsp bovis AF2122/97
cacgcgcggaucggcggcc

SEQ ID NO: 3134882 - RNA, 21 nt, Mycobacterium bovis subsp bovis AF2122/97
cacgcgcggaucggcggccgc

SEQ ID NO: 3134883 - RNA, 22 nt, Mycobacterium bovis subsp bovis AF2122/97
cacgcgcggaucggcggccgcg

SEQ ID NO: 3134884 - RNA, 15 nt, Mycobacterium bovis subsp bovis AF2122/97
cacgcgcggcgucgu

SEQ ID NO: 3134885 - RNA, 13 nt, Mycobacterium bovis subsp bovis AF2122/97
cacgcgcgucggu

SEQ ID NO: 3134886 - RNA, 23 nt, Mycobacterium bovis subsp bovis AF2122/97
cacgcgcguuuagucuccggcgu

SEQ ID NO: 3134887 - RNA, 14 nt, Mycobacterium bovis subsp bovis AF2122/97
cacgcgcucaccga

SEQ ID NO: 3134888 - RNA, 17 nt, Mycobacterium bovis subsp bovis AF2122/97
cacgcgcucaccgacgc

SEQ ID NO: 3134889 - RNA, 17 nt, Mycobacterium bovis subsp bovis AF2122/97
cacgcgcucggugccgc

SEQ ID NO: 3134890 - RNA, 24 nt, Mycobacterium bovis subsp bovis AF2122/97
cacgcggaaaccaucgccagccgg

SEQ ID NO: 3134891 - RNA, 18 nt, Mycobacterium bovis subsp bovis AF2122/97
cacgcggaccucgaagcc

SEQ ID NO: 3134892 - RNA, 13 nt, Mycobacterium bovis subsp bovis AF2122/97
cacgcgggcguug

SEQ ID NO: 3134893 - RNA, 16 nt, Mycobacterium bovis subsp bovis AF2122/97
cacgcgggugccgacg

SEQ ID NO: 3134894 - RNA, 19 nt, Mycobacterium bovis subsp bovis AF2122/97
cacgcgggugccgacgucg

SEQ ID NO: 3134895 - RNA, 17 nt, Mycobacterium bovis subsp bovis AF2122/97
cacgcggguugcgcggc

SEQ ID NO: 3134896 - RNA, 18 nt, Mycobacterium bovis subsp bovis AF2122/97
cacgcggguugcgcggcu

SEQ ID NO: 3134897 - RNA, 14 nt, Mycobacterium bovis subsp bovis AF2122/97
cacgcguacgucgg

SEQ ID NO: 3134898 - RNA, 23 nt, Mycobacterium bovis subsp bovis AF2122/97
cacgcguacgucgguccacccaa

SEQ ID NO: 3134899 - RNA, 17 nt, Mycobacterium bovis subsp bovis AF2122/97
cacgcgucgugccacuu

SEQ ID NO: 3134900 - RNA, 16 nt, Mycobacterium bovis subsp bovis AF2122/97
cacgcgugacucggcc

SEQ ID NO: 3134901 - RNA, 18 nt, Mycobacterium bovis subsp bovis AF2122/97
cacgcgugacucggccga

SEQ ID NO: 3134902 - RNA, 21 nt, Mycobacterium bovis subsp bovis AF2122/97
cacgcgugacucggccgacga

SEQ ID NO: 3134903 - RNA, 23 nt, Mycobacterium bovis subsp bovis AF2122/97
cacgcgugcaccauacucaccga

SEQ ID NO: 3134904 - RNA, 20 nt, Mycobacterium bovis subsp bovis AF2122/97
cacgcgugccgcaaccggcg

SEQ ID NO: 3134905 - RNA, 22 nt, Mycobacterium bovis subsp bovis AF2122/97
cacgcguuccauggcccgcucg

SEQ ID NO: 3134906 - RNA, 20 nt, Mycobacterium bovis subsp bovis AF2122/97
cacgcguuccuccagcagcg

SEQ ID NO: 3134907 - RNA, 17 nt, Mycobacterium bovis subsp bovis AF2122/97
cacgcguugacgaucuc

SEQ ID NO: 3134908 - RNA, 20 nt, Mycobacterium bovis subsp bovis AF2122/97
cacgcguuucgaaccgcacg

SEQ ID NO: 3134909 - RNA, 23 nt, Mycobacterium bovis subsp bovis AF2122/97
cacgcuagccgacagcucaucga

SEQ ID NO: 3134910 - RNA, 17 nt, Mycobacterium bovis subsp bovis AF2122/97
cacgcucaacccgugcg

SEQ ID NO: 3134911 - RNA, 14 nt, Mycobacterium bovis subsp bovis AF2122/97
cacgcucacccggc

SEQ ID NO: 3134912 - RNA, 18 nt, Mycobacterium bovis subsp bovis AF2122/97
cacgcucacccggcgucu

SEQ ID NO: 3134913 - RNA, 18 nt, Mycobacterium bovis subsp bovis AF2122/97
cacgcucaugaccgcucg

SEQ ID NO: 3134914 - RNA, 15 nt, Mycobacterium bovis subsp bovis AF2122/97
cacgcuccagcucgg

SEQ ID NO: 3134915 - RNA, 17 nt, Mycobacterium bovis subsp bovis AF2122/97
cacgcuccagcucggcc

SEQ ID NO: 3134916 - RNA, 18 nt, Mycobacterium bovis subsp bovis AF2122/97
cacgcuccagcucggcca

SEQ ID NO: 3134917 - RNA, 23 nt, Mycobacterium bovis subsp bovis AF2122/97
cacgcuccgccggguuggcgccg

SEQ ID NO: 3134918 - RNA, 12 nt, Mycobacterium bovis subsp bovis AF2122/97
cacgcucgcccu

SEQ ID NO: 3134919 - RNA, 11 nt, Mycobacterium bovis subsp bovis AF2122/97
cacgcucggcg

SEQ ID NO: 3134920 - RNA, 17 nt, Mycobacterium bovis subsp bovis AF2122/97
cacgcucggcguccgcc

SEQ ID NO: 3134921 - RNA, 20 nt, Mycobacterium bovis subsp bovis AF2122/97
cacgcucggcguccgcccag

SEQ ID NO: 3134922 - RNA, 21 nt, Mycobacterium bovis subsp bovis AF2122/97
cacgcucggcguccgcccagc

SEQ ID NO: 3134923 - RNA, 22 nt, Mycobacterium bovis subsp bovis AF2122/97
cacgcucggcguccgcccagca

SEQ ID NO: 3134924 - RNA, 13 nt, Mycobacterium bovis subsp bovis AF2122/97
cacgcucggcgug

SEQ ID NO: 3134925 - RNA, 14 nt, Mycobacterium bovis subsp bovis AF2122/97
cacgcucggcgugu

SEQ ID NO: 3134926 - RNA, 18 nt, Mycobacterium bovis subsp bovis AF2122/97
cacgcucugcgccacagc

SEQ ID NO: 3134927 - RNA, 17 nt, Mycobacterium bovis subsp bovis AF2122/97
cacgcugaauuccacug

SEQ ID NO: 3134928 - RNA, 23 nt, Mycobacterium bovis subsp bovis AF2122/97
cacgcugaauuccacugcgccac

SEQ ID NO: 3134929 - RNA, 22 nt, Mycobacterium bovis subsp bovis AF2122/97
cacgcugcccaaaaggaagacc

SEQ ID NO: 3134930 - RNA, 15 nt, Mycobacterium bovis subsp bovis AF2122/97
cacgcugcccacggg

SEQ ID NO: 3134931 - RNA, 21 nt, Mycobacterium bovis subsp bovis AF2122/97
cacgcugcccacgggccggcc

SEQ ID NO: 3134932 - RNA, 22 nt, Mycobacterium bovis subsp bovis AF2122/97
cacgcugcccacgggccggccg

SEQ ID NO: 3134933 - RNA, 13 nt, Mycobacterium bovis subsp bovis AF2122/97
cacgcugccccgc

SEQ ID NO: 3134934 - RNA, 18 nt, Mycobacterium bovis subsp bovis AF2122/97
cacgcugccccgccgcca

SEQ ID NO: 3134935 - RNA, 14 nt, Mycobacterium bovis subsp bovis AF2122/97
cacgcugcucgacg

SEQ ID NO: 3134936 - RNA, 13 nt, Mycobacterium bovis subsp bovis AF2122/97
cacgcugcugcgg

SEQ ID NO: 3134937 - RNA, 18 nt, Mycobacterium bovis subsp bovis AF2122/97
cacgcugcugcgggugau

SEQ ID NO: 3134938 - RNA, 18 nt, Mycobacterium bovis subsp bovis AF2122/97
cacgcuggaacuuggcgu

SEQ ID NO: 3134939 - RNA, 18 nt, Mycobacterium bovis subsp bovis AF2122/97
cacgcuggccuccagcuu

SEQ ID NO: 3134940 - RNA, 13 nt, Mycobacterium bovis subsp bovis AF2122/97
cacgcuggccucg

SEQ ID NO: 3134941 - RNA, 14 nt, Mycobacterium bovis subsp bovis AF2122/97
cacgcuggcgcccc

SEQ ID NO: 3134942 - RNA, 16 nt, Mycobacterium bovis subsp bovis AF2122/97
cacgcuguccgcguga

SEQ ID NO: 3134943 - RNA, 15 nt, Mycobacterium bovis subsp bovis AF2122/97
cacggcggcccgcuc

SEQ ID NO: 3134944 - RNA, 16 nt, Mycobacterium bovis subsp bovis AF2122/97
cacggcggcccgcucg

SEQ ID NO: 3134945 - RNA, 12 nt, Mycobacterium bovis subsp bovis AF2122/97
cacggcggcgaa

SEQ ID NO: 3134946 - RNA, 15 nt, Mycobacterium bovis subsp bovis AF2122/97
cacggcgggcgaccc

SEQ ID NO: 3134947 - RNA, 17 nt, Mycobacterium bovis subsp bovis AF2122/97
cacggcgggcgacccgu

SEQ ID NO: 3134948 - RNA, 16 nt, Mycobacterium bovis subsp bovis AF2122/97
cacggcgggcgagcca

SEQ ID NO: 3134949 - RNA, 18 nt, Mycobacterium bovis subsp bovis AF2122/97
cacggcgguugccccgac

SEQ ID NO: 3134950 - RNA, 22 nt, Mycobacterium bovis subsp bovis AF2122/97
cacggcgguugccccgaccgcc

SEQ ID NO: 3134951 - RNA, 15 nt, Mycobacterium bovis subsp bovis AF2122/97
cacggcgucgacugg

SEQ ID NO: 3134952 - RNA, 12 nt, Mycobacterium bovis subsp bovis AF2122/97
cacggcgucgau

SEQ ID NO: 3134953 - RNA, 13 nt, Mycobacterium bovis subsp bovis AF2122/97
cacggcgucgaug

SEQ ID NO: 3134954 - RNA, 14 nt, Mycobacterium bovis subsp bovis AF2122/97
cacggcgucgaugu

SEQ ID NO: 3134955 - RNA, 22 nt, Mycobacterium bovis subsp bovis AF2122/97
cacggcgucggccacccggucc

SEQ ID NO: 3134956 - RNA, 17 nt, Mycobacterium bovis subsp bovis AF2122/97
cacggcgucggccaccg

SEQ ID NO: 3134957 - RNA, 18 nt, Mycobacterium bovis subsp bovis AF2122/97
cacggcgucggccaccgc

SEQ ID NO: 3134958 - RNA, 20 nt, Mycobacterium bovis subsp bovis AF2122/97
cacggcgucggccaccgccu

SEQ ID NO: 3134959 - RNA, 17 nt, Mycobacterium bovis subsp bovis AF2122/97
cacggcgucuuccucgg

SEQ ID NO: 3134960 - RNA, 22 nt, Mycobacterium bovis subsp bovis AF2122/97
cacggcgucuuccucggccacc

SEQ ID NO: 3134961 - RNA, 22 nt, Mycobacterium bovis subsp bovis AF2122/97
cacggcgugaaaaacgcccgcg

SEQ ID NO: 3134962 - RNA, 15 nt, Mycobacterium bovis subsp bovis AF2122/97
cacggcgugaccacu

SEQ ID NO: 3134963 - RNA, 15 nt, Mycobacterium bovis subsp bovis AF2122/97
cacggcguggucggc

SEQ ID NO: 3134964 - RNA, 20 nt, Mycobacterium bovis subsp bovis AF2122/97
cacggcguggucggcaaagc

SEQ ID NO: 3134965 - RNA, 16 nt, Mycobacterium bovis subsp bovis AF2122/97
cacggcguugccgccg

SEQ ID NO: 3134966 - RNA, 12 nt, Mycobacterium bovis subsp bovis AF2122/97
cacggcugccca

SEQ ID NO: 3134967 - RNA, 21 nt, Mycobacterium bovis subsp bovis AF2122/97
cacggcugcccaugguggcga

SEQ ID NO: 3134968 - RNA, 19 nt, Mycobacterium bovis subsp bovis AF2122/97
cacggcuucgaccaucacc

SEQ ID NO: 3134969 - RNA, 15 nt, Mycobacterium bovis subsp bovis AF2122/97
cacggcuucgccgcg

SEQ ID NO: 3134970 - RNA, 18 nt, Mycobacterium bovis subsp bovis AF2122/97
cacggcuucgcgguuggc

SEQ ID NO: 3134971 - RNA, 14 nt, Mycobacterium bovis subsp bovis AF2122/97
cacggcuucggcga

SEQ ID NO: 3134972 - RNA, 20 nt, Mycobacterium bovis subsp bovis AF2122/97
cacggcuucggcgagcgcau

SEQ ID NO: 3134973 - RNA, 21 nt, Mycobacterium bovis subsp bovis AF2122/97
cacggcuuugcggcgcgacca

SEQ ID NO: 3134974 - RNA, 18 nt, Mycobacterium bovis subsp bovis AF2122/97
cacggcuuuucgacgcug

SEQ ID NO: 3134975 - RNA, 22 nt, Mycobacterium bovis subsp bovis AF2122/97
cacggcuuuucgacgcuguggc

SEQ ID NO: 3134976 - RNA, 13 nt, Mycobacterium bovis subsp bovis AF2122/97
cacgggaagccgc

SEQ ID NO: 3134977 - RNA, 15 nt, Mycobacterium bovis subsp bovis AF2122/97
cacgggaagccgcgc

SEQ ID NO: 3134978 - RNA, 16 nt, Mycobacterium bovis subsp bovis AF2122/97
cacgggaagccgcgcc

SEQ ID NO: 3134979 - RNA, 23 nt, Mycobacterium bovis subsp bovis AF2122/97
cacgggaguacgggagccggcug

SEQ ID NO: 3134980 - RNA, 18 nt, Mycobacterium bovis subsp bovis AF2122/97
cacgggaucgaucugcgg

SEQ ID NO: 3134981 - RNA, 14 nt, Mycobacterium bovis subsp bovis AF2122/97
cacgggaucugcgg

SEQ ID NO: 3134982 - RNA, 20 nt, Mycobacterium bovis subsp bovis AF2122/97
cacgggaucugcggaggcga

SEQ ID NO: 3134983 - RNA, 17 nt, Mycobacterium bovis subsp bovis AF2122/97
cacgggaugcaugucuu

SEQ ID NO: 3134984 - RNA, 19 nt, Mycobacterium bovis subsp bovis AF2122/97
cacgggccaccagcgucgc

SEQ ID NO: 3134985 - RNA, 12 nt, Mycobacterium bovis subsp bovis AF2122/97
cacgggcccagg

SEQ ID NO: 3134986 - RNA, 18 nt, Mycobacterium bovis subsp bovis AF2122/97
cacgggcccaggacagca

SEQ ID NO: 3134987 - RNA, 21 nt, Mycobacterium bovis subsp bovis AF2122/97
cacgggcccaggacagcagcc

SEQ ID NO: 3134988 - RNA, 12 nt, Mycobacterium bovis subsp bovis AF2122/97
cacgggcggcca

SEQ ID NO: 3134989 - RNA, 14 nt, Mycobacterium bovis subsp bovis AF2122/97
cacgggcggccacc

SEQ ID NO: 3134990 - RNA, 15 nt, Mycobacterium bovis subsp bovis AF2122/97
cacgggcggccaugg

SEQ ID NO: 3134991 - RNA, 17 nt, Mycobacterium bovis subsp bovis AF2122/97
cacgggcggccauggca

SEQ ID NO: 3134992 - RNA, 15 nt, Mycobacterium bovis subsp bovis AF2122/97
cacgggcucgcugca

SEQ ID NO: 3134993 - RNA, 20 nt, Mycobacterium bovis subsp bovis AF2122/97
cacgggcucgcugcaccagc

SEQ ID NO: 3134994 - RNA, 14 nt, Mycobacterium bovis subsp bovis AF2122/97
cacggggaccgggc

SEQ ID NO: 3134995 - RNA, 17 nt, Mycobacterium bovis subsp bovis AF2122/97
cacggggauuggcgacg

SEQ ID NO: 3134996 - RNA, 19 nt, Mycobacterium bovis subsp bovis AF2122/97
cacggguagcguccagguc

SEQ ID NO: 3134997 - RNA, 20 nt, Mycobacterium bovis subsp bovis AF2122/97
cacggguagcugccgcggcc

SEQ ID NO: 3134998 - RNA, 19 nt, Mycobacterium bovis subsp bovis AF2122/97
cacgguagacaagucggcg

SEQ ID NO: 3134999 - RNA, 16 nt, Mycobacterium bovis subsp bovis AF2122/97
cacggucaacgugaug

SEQ ID NO: 3135000 - RNA, 16 nt, Mycobacterium bovis subsp bovis AF2122/97
cacggucaagccggcg

SEQ ID NO: 3135001 - RNA, 18 nt, Mycobacterium bovis subsp bovis AF2122/97
cacggucaagccggcgcc

SEQ ID NO: 3135002 - RNA, 19 nt, Mycobacterium bovis subsp bovis AF2122/97
cacggucaauugugcggcc

SEQ ID NO: 3135003 - RNA, 21 nt, Mycobacterium bovis subsp bovis AF2122/97
cacggucaauugugcggcccc

SEQ ID NO: 3135004 - RNA, 22 nt, Mycobacterium bovis subsp bovis AF2122/97
cacggucaauugugcggccccg

SEQ ID NO: 3135005 - RNA, 12 nt, Mycobacterium bovis subsp bovis AF2122/97
cacggucacacg

SEQ ID NO: 3135006 - RNA, 15 nt, Mycobacterium bovis subsp bovis AF2122/97
cacggucacacgcca

SEQ ID NO: 3135007 - RNA, 13 nt, Mycobacterium bovis subsp bovis AF2122/97
cacggucaccggc

SEQ ID NO: 3135008 - RNA, 19 nt, Mycobacterium bovis subsp bovis AF2122/97
cacggucagcacgcugacc

SEQ ID NO: 3135009 - RNA, 19 nt, Mycobacterium bovis subsp bovis AF2122/97
cacggucagcucgcugacg

SEQ ID NO: 3135010 - RNA, 17 nt, Mycobacterium bovis subsp bovis AF2122/97
cacggucaucucggugg

SEQ ID NO: 3135011 - RNA, 13 nt, Mycobacterium bovis subsp bovis AF2122/97
cacggucaugccg

SEQ ID NO: 3135012 - RNA, 16 nt, Mycobacterium bovis subsp bovis AF2122/97
cacggucaugccgccg

SEQ ID NO: 3135013 - RNA, 17 nt, Mycobacterium bovis subsp bovis AF2122/97
cacgguccacgguggcg

SEQ ID NO: 3135014 - RNA, 24 nt, Mycobacterium bovis subsp bovis AF2122/97
cacgguccacgguggcgccgaacg

SEQ ID NO: 3135015 - RNA, 16 nt, Mycobacterium bovis subsp bovis AF2122/97
cacgguccggcccacc

SEQ ID NO: 3135016 - RNA, 12 nt, Mycobacterium bovis subsp bovis AF2122/97
cacggucgacga

SEQ ID NO: 3135017 - RNA, 19 nt, Mycobacterium bovis subsp bovis AF2122/97
cacggucgcccgaucggcg

SEQ ID NO: 3135018 - RNA, 20 nt, Mycobacterium bovis subsp bovis AF2122/97
cacggucgcccgaucggcgg

SEQ ID NO: 3135019 - RNA, 14 nt, Mycobacterium bovis subsp bovis AF2122/97
cacggucgccgacc

SEQ ID NO: 3135020 - RNA, 15 nt, Mycobacterium bovis subsp bovis AF2122/97
cacggucgccgacca

SEQ ID NO: 3135021 - RNA, 12 nt, Mycobacterium bovis subsp bovis AF2122/97
cacggucggcgg

SEQ ID NO: 3135022 - RNA, 21 nt, Mycobacterium bovis subsp bovis AF2122/97
cacggucugccacgaggcauc

SEQ ID NO: 3135023 - RNA, 23 nt, Mycobacterium bovis subsp bovis AF2122/97
cacggucugccacgaggcaucgu

SEQ ID NO: 3135024 - RNA, 16 nt, Mycobacterium bovis subsp bovis AF2122/97
cacggugaccacgccg

SEQ ID NO: 3135025 - RNA, 17 nt, Mycobacterium bovis subsp bovis AF2122/97
cacggugaccacgccgu

SEQ ID NO: 3135026 - RNA, 22 nt, Mycobacterium bovis subsp bovis AF2122/97
cacggugagccgguggcccgcc

SEQ ID NO: 3135027 - RNA, 15 nt, Mycobacterium bovis subsp bovis AF2122/97
cacggugaucagcag

SEQ ID NO: 3135028 - RNA, 14 nt, Mycobacterium bovis subsp bovis AF2122/97
cacggugcccaggg

SEQ ID NO: 3135029 - RNA, 16 nt, Mycobacterium bovis subsp bovis AF2122/97
cacggugccgacgaug

SEQ ID NO: 3135030 - RNA, 15 nt, Mycobacterium bovis subsp bovis AF2122/97
cacgucgucgcggga

SEQ ID NO: 3135031 - RNA, 18 nt, Mycobacterium bovis subsp bovis AF2122/97
cacgucgucgcgggaaaa

SEQ ID NO: 3135032 - RNA, 21 nt, Mycobacterium bovis subsp bovis AF2122/97
cacgucgucgucccagggcug

SEQ ID NO: 3135033 - RNA, 23 nt, Mycobacterium bovis subsp bovis AF2122/97
cacgucguugggcaugucgccga

SEQ ID NO: 3135034 - RNA, 23 nt, Mycobacterium bovis subsp bovis AF2122/97
cacgucguugugcagaucgucgc

SEQ ID NO: 3135035 - RNA, 19 nt, Mycobacterium bovis subsp bovis AF2122/97
cacgucguuuggccucagc

SEQ ID NO: 3135036 - RNA, 17 nt, Mycobacterium bovis subsp bovis AF2122/97
cacgucuaacacgcggu

SEQ ID NO: 3135037 - RNA, 16 nt, Mycobacterium bovis subsp bovis AF2122/97
cacgucuaucggcgaa

SEQ ID NO: 3135038 - RNA, 23 nt, Mycobacterium bovis subsp bovis AF2122/97
cacgucuccuguggggauuccgc

SEQ ID NO: 3135039 - RNA, 17 nt, Mycobacterium bovis subsp bovis AF2122/97
cacgucuccuucggcga

SEQ ID NO: 3135040 - RNA, 23 nt, Mycobacterium bovis subsp bovis AF2122/97
cacgucuccuucggcgacugcgc

SEQ ID NO: 3135041 - RNA, 15 nt, Mycobacterium bovis subsp bovis AF2122/97
cacgucucgaucagg

SEQ ID NO: 3135042 - RNA, 17 nt, Mycobacterium bovis subsp bovis AF2122/97
cacgugaaggcgauggc

SEQ ID NO: 3135043 - RNA, 15 nt, Mycobacterium bovis subsp bovis AF2122/97
cacgugagugccggc

SEQ ID NO: 3135044 - RNA, 23 nt, Mycobacterium bovis subsp bovis AF2122/97
cacgugagugccggcgugcgcga

SEQ ID NO: 3135045 - RNA, 20 nt, Mycobacterium bovis subsp bovis AF2122/97
cacgugauagcuugcgucgc

SEQ ID NO: 3135046 - RNA, 17 nt, Mycobacterium bovis subsp bovis AF2122/97
cacgugaucagaucggg

SEQ ID NO: 3135047 - RNA, 16 nt, Mycobacterium bovis subsp bovis AF2122/97
cacgugaucgacgacc

SEQ ID NO: 3135048 - RNA, 17 nt, Mycobacterium bovis subsp bovis AF2122/97
cacgugaucgacgaccg

SEQ ID NO: 3135049 - RNA, 22 nt, Mycobacterium bovis subsp bovis AF2122/97
cacgugaugcccuggggguggc

SEQ ID NO: 3135050 - RNA, 17 nt, Mycobacterium bovis subsp bovis AF2122/97
cacgugcccgcgcggcg

SEQ ID NO: 3135051 - RNA, 19 nt, Mycobacterium bovis subsp bovis AF2122/97
cacgugcccgcgcggcgca

SEQ ID NO: 3135052 - RNA, 16 nt, Mycobacterium bovis subsp bovis AF2122/97
cacguggaccacggcg

SEQ ID NO: 3135053 - RNA, 20 nt, Mycobacterium bovis subsp bovis AF2122/97
cacguggauguguagguggg

SEQ ID NO: 3135054 - RNA, 18 nt, Mycobacterium bovis subsp bovis AF2122/97
cacgugggccaacgacgc

SEQ ID NO: 3135055 - RNA, 15 nt, Mycobacterium bovis subsp bovis AF2122/97
cacgugggccaugcu

SEQ ID NO: 3135056 - RNA, 16 nt, Mycobacterium bovis subsp bovis AF2122/97
cacgugggccaugcua

SEQ ID NO: 3135057 - RNA, 14 nt, Mycobacterium bovis subsp bovis AF2122/97
cacgugguccaacc

SEQ ID NO: 3135058 - RNA, 19 nt, Mycobacterium bovis subsp bovis AF2122/97
cacgugguccaaccgggcc

SEQ ID NO: 3135059 - RNA, 20 nt, Mycobacterium bovis subsp bovis AF2122/97
cacgugguccaaccgggccg

SEQ ID NO: 3135060 - RNA, 19 nt, Mycobacterium bovis subsp bovis AF2122/97
cacguggucgagcaggcga

SEQ ID NO: 3135061 - RNA, 14 nt, Mycobacterium bovis subsp bovis AF2122/97
cacguggucggcca

SEQ ID NO: 3135062 - RNA, 15 nt, Mycobacterium bovis subsp bovis AF2122/97
cacguggugggcgca

SEQ ID NO: 3135063 - RNA, 14 nt, Mycobacterium bovis subsp bovis AF2122/97
cacguuauucaugc

SEQ ID NO: 3135064 - RNA, 12 nt, Mycobacterium bovis subsp bovis AF2122/97
cacguucaccgc

SEQ ID NO: 3135065 - RNA, 18 nt, Mycobacterium bovis subsp bovis AF2122/97
cacguucaccgcgcgcuc

SEQ ID NO: 3135066 - RNA, 17 nt, Mycobacterium bovis subsp bovis AF2122/97
cacguucagcccaugcc

SEQ ID NO: 3135067 - RNA, 20 nt, Mycobacterium bovis subsp bovis AF2122/97
cacguucaguuccgcggcga

SEQ ID NO: 3135068 - RNA, 12 nt, Mycobacterium bovis subsp bovis AF2122/97
cacguucggcga

SEQ ID NO: 3135069 - RNA, 22 nt, Mycobacterium bovis subsp bovis AF2122/97
cacguucggcgacgcgccgguu

SEQ ID NO: 3135070 - RNA, 14 nt, Mycobacterium bovis subsp bovis AF2122/97
cacguucggcgaug

SEQ ID NO: 3135071 - RNA, 12 nt, Mycobacterium bovis subsp bovis AF2122/97
cacguucggcgc

SEQ ID NO: 3135072 - RNA, 22 nt, Mycobacterium bovis subsp bovis AF2122/97
cacguucggcgcugccaggccg

SEQ ID NO: 3135073 - RNA, 15 nt, Mycobacterium bovis subsp bovis AF2122/97
cacguucggcgucgu

SEQ ID NO: 3135074 - RNA, 14 nt, Mycobacterium bovis subsp bovis AF2122/97
cacguucggcugcg

SEQ ID NO: 3135075 - RNA, 15 nt, Mycobacterium bovis subsp bovis AF2122/97
cacguucggcugcga

SEQ ID NO: 3135076 - RNA, 19 nt, Mycobacterium bovis subsp bovis AF2122/97
cacguugcagcucgauccg

SEQ ID NO: 3135077 - RNA, 17 nt, Mycobacterium bovis subsp bovis AF2122/97
cacguuggcggccagcg

SEQ ID NO: 3135078 - RNA, 16 nt, Mycobacterium bovis subsp bovis AF2122/97
cacguuguccgcgacg

SEQ ID NO: 3135079 - RNA, 19 nt, Mycobacterium bovis subsp bovis AF2122/97
cacguugugcagcgcguca

SEQ ID NO: 3135080 - RNA, 15 nt, Mycobacterium bovis subsp bovis AF2122/97
cacguuguucaccga

SEQ ID NO: 3135081 - RNA, 20 nt, Mycobacterium bovis subsp bovis AF2122/97
cacguuguucaccgacgcga

SEQ ID NO: 3135082 - RNA, 19 nt, Mycobacterium bovis subsp bovis AF2122/97
cacuaaccgaauuguugua

SEQ ID NO: 3135083 - RNA, 20 nt, Mycobacterium bovis subsp bovis AF2122/97
cacuaccccacaagcgaugg

SEQ ID NO: 3135084 - RNA, 18 nt, Mycobacterium bovis subsp bovis AF2122/97
cacuacccgcaacgaggc

SEQ ID NO: 3135085 - RNA, 20 nt, Mycobacterium bovis subsp bovis AF2122/97
cacuacccgcaacgaggcaa

SEQ ID NO: 3135086 - RNA, 19 nt, Mycobacterium bovis subsp bovis AF2122/97
cacuacggccuggccaccu

SEQ ID NO: 3135087 - RNA, 21 nt, Mycobacterium bovis subsp bovis AF2122/97
cacuacggccuggccaccugg

SEQ ID NO: 3135088 - RNA, 22 nt, Mycobacterium bovis subsp bovis AF2122/97
cacuacggccuggccaccuggu

SEQ ID NO: 3135089 - RNA, 24 nt, Mycobacterium bovis subsp bovis AF2122/97
cacuacgggucuggccaacgccgg

SEQ ID NO: 3135090 - RNA, 19 nt, Mycobacterium bovis subsp bovis AF2122/97
cacuacuccggucccgcau

SEQ ID NO: 3135091 - RNA, 19 nt, Mycobacterium bovis subsp bovis AF2122/97
cacuagcagggggacccgg

SEQ ID NO: 3135092 - RNA, 16 nt, Mycobacterium bovis subsp bovis AF2122/97
cacuagcccgaccggu

SEQ ID NO: 3135093 - RNA, 16 nt, Mycobacterium bovis subsp bovis AF2122/97
cacuagcccugagcga

SEQ ID NO: 3135094 - RNA, 19 nt, Mycobacterium bovis subsp bovis AF2122/97
cacuaguucgagcugccag

SEQ ID NO: 3135095 - RNA, 23 nt, Mycobacterium bovis subsp bovis AF2122/97
cacuaguucgagcugccaggccc

SEQ ID NO: 3135096 - RNA, 22 nt, Mycobacterium bovis subsp bovis AF2122/97
cacucaaccugaaccggccgcg

SEQ ID NO: 3135097 - RNA, 21 nt, Mycobacterium bovis subsp bovis AF2122/97
cacucacauuggccaggucgg

SEQ ID NO: 3135098 - RNA, 13 nt, Mycobacterium bovis subsp bovis AF2122/97
cacucacccagcu

SEQ ID NO: 3135099 - RNA, 14 nt, Mycobacterium bovis subsp bovis AF2122/97
cacucacccgggca

SEQ ID NO: 3135100 - RNA, 22 nt, Mycobacterium bovis subsp bovis AF2122/97
cacucagcccgacaccgaucgg

SEQ ID NO: 3135101 - RNA, 20 nt, Mycobacterium bovis subsp bovis AF2122/97
cacucauagaacucgccgcu

SEQ ID NO: 3135102 - RNA, 19 nt, Mycobacterium bovis subsp bovis AF2122/97
cacucaucggugugcaucg

SEQ ID NO: 3135103 - RNA, 20 nt, Mycobacterium bovis subsp bovis AF2122/97
cacucaugaugccggacgcc

SEQ ID NO: 3135104 - RNA, 22 nt, Mycobacterium bovis subsp bovis AF2122/97
cacuccaaauggugagcucgcg

SEQ ID NO: 3135105 - RNA, 14 nt, Mycobacterium bovis subsp bovis AF2122/97
cacuccaccgcugg

SEQ ID NO: 3135106 - RNA, 15 nt, Mycobacterium bovis subsp bovis AF2122/97
cacuccacgaucggc

SEQ ID NO: 3135107 - RNA, 18 nt, Mycobacterium bovis subsp bovis AF2122/97
cacuccagcagcucgccg

SEQ ID NO: 3135108 - RNA, 20 nt, Mycobacterium bovis subsp bovis AF2122/97
cacuccagcagcucgccggc

SEQ ID NO: 3135109 - RNA, 20 nt, Mycobacterium bovis subsp bovis AF2122/97
cacuccagcgaaccgacccg

SEQ ID NO: 3135110 - RNA, 23 nt, Mycobacterium bovis subsp bovis AF2122/97
cacuccagcgaaccgacccggcc

SEQ ID NO: 3135111 - RNA, 14 nt, Mycobacterium bovis subsp bovis AF2122/97
cacuccagcggcgg

SEQ ID NO: 3135112 - RNA, 17 nt, Mycobacterium bovis subsp bovis AF2122/97
cacuccaggagccgagg

SEQ ID NO: 3135113 - RNA, 15 nt, Mycobacterium bovis subsp bovis AF2122/97
cacuccaugauccag

SEQ ID NO: 3135114 - RNA, 14 nt, Mycobacterium bovis subsp bovis AF2122/97
cacucccauccgcc

SEQ ID NO: 3135115 - RNA, 17 nt, Mycobacterium bovis subsp bovis AF2122/97
cacuccccagccccacc

SEQ ID NO: 3135116 - RNA, 21 nt, Mycobacterium bovis subsp bovis AF2122/97
cacugccggcacgccgaccgg

SEQ ID NO: 3135117 - RNA, 18 nt, Mycobacterium bovis subsp bovis AF2122/97
cacugccggcagcgcccc

SEQ ID NO: 3135118 - RNA, 12 nt, Mycobacterium bovis subsp bovis AF2122/97
cacugccgggug

SEQ ID NO: 3135119 - RNA, 22 nt, Mycobacterium bovis subsp bovis AF2122/97
cacugccgggugggcaagcuga

SEQ ID NO: 3135120 - RNA, 23 nt, Mycobacterium bovis subsp bovis AF2122/97
cacugccggugggcguucccccg

SEQ ID NO: 3135121 - RNA, 18 nt, Mycobacterium bovis subsp bovis AF2122/97
cacugccguugccgccgg

SEQ ID NO: 3135122 - RNA, 18 nt, Mycobacterium bovis subsp bovis AF2122/97
cacugccuuaaccgagcc

SEQ ID NO: 3135123 - RNA, 19 nt, Mycobacterium bovis subsp bovis AF2122/97
cacugccuuaaccgagccg

SEQ ID NO: 3135124 - RNA, 22 nt, Mycobacterium bovis subsp bovis AF2122/97
cacugccuuaaccgagccgacc

SEQ ID NO: 3135125 - RNA, 17 nt, Mycobacterium bovis subsp bovis AF2122/97
cacugcgaacccugcgc

SEQ ID NO: 3135126 - RNA, 18 nt, Mycobacterium bovis subsp bovis AF2122/97
cacugcgaaucuccgcgc

SEQ ID NO: 3135127 - RNA, 19 nt, Mycobacterium bovis subsp bovis AF2122/97
cacugcgaccgucccggcc

SEQ ID NO: 3135128 - RNA, 15 nt, Mycobacterium bovis subsp bovis AF2122/97
cacugcgagcgcagc

SEQ ID NO: 3135129 - RNA, 18 nt, Mycobacterium bovis subsp bovis AF2122/97
cacugcgaucgcgacccg

SEQ ID NO: 3135130 - RNA, 22 nt, Mycobacterium bovis subsp bovis AF2122/97
cacugcgaucgcgacccgaucg

SEQ ID NO: 3135131 - RNA, 13 nt, Mycobacterium bovis subsp bovis AF2122/97
cacugcgcccgcc

SEQ ID NO: 3135132 - RNA, 15 nt, Mycobacterium bovis subsp bovis AF2122/97
cacugcgcccgccac

SEQ ID NO: 3135133 - RNA, 16 nt, Mycobacterium bovis subsp bovis AF2122/97
cacugcgcccgccacg

SEQ ID NO: 3135134 - RNA, 14 nt, Mycobacterium bovis subsp bovis AF2122/97
cacugcgccggccg

SEQ ID NO: 3135135 - RNA, 16 nt, Mycobacterium bovis subsp bovis AF2122/97
cacugcgccggccggc

SEQ ID NO: 3135136 - RNA, 15 nt, Mycobacterium bovis subsp bovis AF2122/97
cacugcgccgugacc

SEQ ID NO: 3135137 - RNA, 23 nt, Mycobacterium bovis subsp bovis AF2122/97
cacugcgcgucgagcgaccccca

SEQ ID NO: 3135138 - RNA, 18 nt, Mycobacterium bovis subsp bovis AF2122/97
cacugcgcgugcucgacg

SEQ ID NO: 3135139 - RNA, 22 nt, Mycobacterium bovis subsp bovis AF2122/97
cacugcgcgugcucgacgcgca

SEQ ID NO: 3135140 - RNA, 13 nt, Mycobacterium bovis subsp bovis AF2122/97
cacugcggcagcg

SEQ ID NO: 3135141 - RNA, 17 nt, Mycobacterium bovis subsp bovis AF2122/97
cacugcggcagguucgg

SEQ ID NO: 3135142 - RNA, 20 nt, Mycobacterium bovis subsp bovis AF2122/97
cacugcggcauggcaggcga

SEQ ID NO: 3135143 - RNA, 12 nt, Mycobacterium bovis subsp bovis AF2122/97
cacugcggccag

SEQ ID NO: 3135144 - RNA, 18 nt, Mycobacterium bovis subsp bovis AF2122/97
cacugcggccugcucgac

SEQ ID NO: 3135145 - RNA, 20 nt, Mycobacterium bovis subsp bovis AF2122/97
cacugcggccugcucgacca

SEQ ID NO: 3135146 - RNA, 22 nt, Mycobacterium bovis subsp bovis AF2122/97
cacugcguuccaucgccgacgc

SEQ ID NO: 3135147 - RNA, 14 nt, Mycobacterium bovis subsp bovis AF2122/97
cacugcucgucgcg

SEQ ID NO: 3135148 - RNA, 11 nt, Mycobacterium bovis subsp bovis AF2122/97
cacugcugcgg

SEQ ID NO: 3135149 - RNA, 17 nt, Mycobacterium bovis subsp bovis AF2122/97
cacuggaauggaucucg

SEQ ID NO: 3135150 - RNA, 13 nt, Mycobacterium bovis subsp bovis AF2122/97
cacuggauccggg

SEQ ID NO: 3135151 - RNA, 17 nt, Mycobacterium bovis subsp bovis AF2122/97
cacuggauggcucgccg

SEQ ID NO: 3135152 - RNA, 20 nt, Mycobacterium bovis subsp bovis AF2122/97
cacuggauggcucgccgaaa

SEQ ID NO: 3135153 - RNA, 13 nt, Mycobacterium bovis subsp bovis AF2122/97
cacuggccgucgg

SEQ ID NO: 3135154 - RNA, 22 nt, Mycobacterium bovis subsp bovis AF2122/97
cacuggcgaaccagaguucggc

SEQ ID NO: 3135155 - RNA, 19 nt, Mycobacterium bovis subsp bovis AF2122/97
cacuggcgauaucggcccc

SEQ ID NO: 3135156 - RNA, 22 nt, Mycobacterium bovis subsp bovis AF2122/97
cacuggcgauaucggcccccaa

SEQ ID NO: 3135157 - RNA, 19 nt, Mycobacterium bovis subsp bovis AF2122/97
cacuggcgccggugccgcc

SEQ ID NO: 3135158 - RNA, 20 nt, Mycobacterium bovis subsp bovis AF2122/97
cacuggcgccggugccgccg

SEQ ID NO: 3135159 - RNA, 15 nt, Mycobacterium bovis subsp bovis AF2122/97
cacuggcggaccggu

SEQ ID NO: 3135160 - RNA, 23 nt, Mycobacterium bovis subsp bovis AF2122/97
cacuggcggaccgguaggcaccg

SEQ ID NO: 3135161 - RNA, 21 nt, Mycobacterium bovis subsp bovis AF2122/97
cacuggcgucuuggggcguug

SEQ ID NO: 3135162 - RNA, 22 nt, Mycobacterium bovis subsp bovis AF2122/97
cacugggaugaguucgucgugg

SEQ ID NO: 3135163 - RNA, 12 nt, Mycobacterium bovis subsp bovis AF2122/97
cacugggcgaug

SEQ ID NO: 3135164 - RNA, 20 nt, Mycobacterium bovis subsp bovis AF2122/97
cacugggcuggccagcacgc

SEQ ID NO: 3135165 - RNA, 16 nt, Mycobacterium bovis subsp bovis AF2122/97
cacuggggucugaugg

SEQ ID NO: 3135166 - RNA, 16 nt, Mycobacterium bovis subsp bovis AF2122/97
cacuggggugcugcgc

SEQ ID NO: 3135167 - RNA, 14 nt, Mycobacterium bovis subsp bovis AF2122/97
cacuggguccacgc

SEQ ID NO: 3135168 - RNA, 22 nt, Mycobacterium bovis subsp bovis AF2122/97
cacuggguccacgcgcucggug

SEQ ID NO: 3135169 - RNA, 18 nt, Mycobacterium bovis subsp bovis AF2122/97
cacugggugcgucgaccc

SEQ ID NO: 3135170 - RNA, 22 nt, Mycobacterium bovis subsp bovis AF2122/97
cacugggugcgucgacccagcu

SEQ ID NO: 3135171 - RNA, 14 nt, Mycobacterium bovis subsp bovis AF2122/97
cacuggucaacacg

SEQ ID NO: 3135172 - RNA, 14 nt, Mycobacterium bovis subsp bovis AF2122/97
cacuggucaacggg

SEQ ID NO: 3135173 - RNA, 16 nt, Mycobacterium bovis subsp bovis AF2122/97
cacuggucgcggcgcu

SEQ ID NO: 3135174 - RNA, 19 nt, Mycobacterium bovis subsp bovis AF2122/97
cacuggucgcggcgcuggc

SEQ ID NO: 3135175 - RNA, 12 nt, Mycobacterium bovis subsp bovis AF2122/97
cacuggugaucu

SEQ ID NO: 3135176 - RNA, 16 nt, Mycobacterium bovis subsp bovis AF2122/97
cacuggugcagcgccg

SEQ ID NO: 3135177 - RNA, 18 nt, Mycobacterium bovis subsp bovis AF2122/97
cacuggugcagcgccgac

SEQ ID NO: 3135178 - RNA, 20 nt, Mycobacterium bovis subsp bovis AF2122/97
cacuggugcagcgccgacag

SEQ ID NO: 3135179 - RNA, 21 nt, Mycobacterium bovis subsp bovis AF2122/97
cacuggugcccgacccgccga

SEQ ID NO: 3135180 - RNA, 21 nt, Mycobacterium bovis subsp bovis AF2122/97
cacugguugggcgagaccgcg

SEQ ID NO: 3135181 - RNA, 19 nt, Mycobacterium bovis subsp bovis AF2122/97
cacugucgauuugaucgac

SEQ ID NO: 3135182 - RNA, 22 nt, Mycobacterium bovis subsp bovis AF2122/97
cacugugcccucaacgucccag

SEQ ID NO: 3135183 - RNA, 18 nt, Mycobacterium bovis subsp bovis AF2122/97
cacugugccgcugcaucc

SEQ ID NO: 3135184 - RNA, 15 nt, Mycobacterium bovis subsp bovis AF2122/97
cacuguuacggccac

SEQ ID NO: 3135185 - RNA, 24 nt, Mycobacterium bovis subsp bovis AF2122/97
cacuguuacggccacaccgucacg

SEQ ID NO: 3135186 - RNA, 15 nt, Mycobacterium bovis subsp bovis AF2122/97
cacuguugaagaagc

SEQ ID NO: 3135187 - RNA, 16 nt, Mycobacterium bovis subsp bovis AF2122/97
cacuguuggugccgcc

SEQ ID NO: 3135188 - RNA, 23 nt, Mycobacterium bovis subsp bovis AF2122/97
cacuguuggugccgccaccaccg

SEQ ID NO: 3135189 - RNA, 19 nt, Mycobacterium bovis subsp bovis AF2122/97
cacuuagcccgauggugcc

SEQ ID NO: 3135190 - RNA, 13 nt, Mycobacterium bovis subsp bovis AF2122/97
cacuuagcuggcg

SEQ ID NO: 3135191 - RNA, 19 nt, Mycobacterium bovis subsp bovis AF2122/97
cacuucacgaguagcgguu

SEQ ID NO: 3135192 - RNA, 16 nt, Mycobacterium bovis subsp bovis AF2122/97
cacuucagcacccggc

SEQ ID NO: 3135193 - RNA, 18 nt, Mycobacterium bovis subsp bovis AF2122/97
cacuucauggggcuaugg

SEQ ID NO: 3135194 - RNA, 14 nt, Mycobacterium bovis subsp bovis AF2122/97
cacuuccaagccga

SEQ ID NO: 3135195 - RNA, 18 nt, Mycobacterium bovis subsp bovis AF2122/97
cacuuccggauucggacu

SEQ ID NO: 3135196 - RNA, 22 nt, Mycobacterium bovis subsp bovis AF2122/97
cacuuccgggcagcugggcagg

SEQ ID NO: 3135197 - RNA, 13 nt, Mycobacterium bovis subsp bovis AF2122/97
cacuuccgggcga

SEQ ID NO: 3135198 - RNA, 20 nt, Mycobacterium bovis subsp bovis AF2122/97
cacuucgcuuucccgucggc

SEQ ID NO: 3135199 - RNA, 14 nt, Mycobacterium bovis subsp bovis AF2122/97
cacuucggcgucca

SEQ ID NO: 3135200 - RNA, 21 nt, Mycobacterium bovis subsp bovis AF2122/97
cacuucggugccgugaucggc

SEQ ID NO: 3135201 - RNA, 21 nt, Mycobacterium bovis subsp bovis AF2122/97
cacuucuuucgaaaugagguc

SEQ ID NO: 3135202 - RNA, 16 nt, Mycobacterium bovis subsp bovis AF2122/97
cagaccaccgccugga

SEQ ID NO: 3135203 - RNA, 12 nt, Mycobacterium bovis subsp bovis AF2122/97
cagaccaccgug

SEQ ID NO: 3135204 - RNA, 12 nt, Mycobacterium bovis subsp bovis AF2122/97
cagaccagacug

SEQ ID NO: 3135205 - RNA, 18 nt, Mycobacterium bovis subsp bovis AF2122/97
cagaccagggcagcggcc

SEQ ID NO: 3135206 - RNA, 19 nt, Mycobacterium bovis subsp bovis AF2122/97
cagaccagggcagcggcca

SEQ ID NO: 3135207 - RNA, 13 nt, Mycobacterium bovis subsp bovis AF2122/97
cagacccaccacc

SEQ ID NO: 3135208 - RNA, 16 nt, Mycobacterium bovis subsp bovis AF2122/97
cagacccaccaccgca

SEQ ID NO: 3135209 - RNA, 21 nt, Mycobacterium bovis subsp bovis AF2122/97
cagacccaccaccgcaaccaa

SEQ ID NO: 3135210 - RNA, 17 nt, Mycobacterium bovis subsp bovis AF2122/97
cagacccgagcgcucga

SEQ ID NO: 3135211 - RNA, 13 nt, Mycobacterium bovis subsp bovis AF2122/97
cagacccgugccg

SEQ ID NO: 3135212 - RNA, 16 nt, Mycobacterium bovis subsp bovis AF2122/97
cagacccgugccguca

SEQ ID NO: 3135213 - RNA, 22 nt, Mycobacterium bovis subsp bovis AF2122/97
cagacccuggccgucccaccag

SEQ ID NO: 3135214 - RNA, 14 nt, Mycobacterium bovis subsp bovis AF2122/97
cagaccgaccucgg

SEQ ID NO: 3135215 - RNA, 15 nt, Mycobacterium bovis subsp bovis AF2122/97
cagaccgaucggcag

SEQ ID NO: 3135216 - RNA, 18 nt, Mycobacterium bovis subsp bovis AF2122/97
cagaccgaucggcaggcc

SEQ ID NO: 3135217 - RNA, 19 nt, Mycobacterium bovis subsp bovis AF2122/97
cagaccgaucggcaggccg

SEQ ID NO: 3135218 - RNA, 20 nt, Mycobacterium bovis subsp bovis AF2122/97
cagaccgaucggcaggccgc

SEQ ID NO: 3135219 - RNA, 23 nt, Mycobacterium bovis subsp bovis AF2122/97
cagaccgccacacggggccgcca

SEQ ID NO: 3135220 - RNA, 13 nt, Mycobacterium bovis subsp bovis AF2122/97
cagaccgccgacg

SEQ ID NO: 3135221 - RNA, 17 nt, Mycobacterium bovis subsp bovis AF2122/97
cagaccgccgacgccgu

SEQ ID NO: 3135222 - RNA, 19 nt, Mycobacterium bovis subsp bovis AF2122/97
cagaccgccgacgccguug

SEQ ID NO: 3135223 - RNA, 17 nt, Mycobacterium bovis subsp bovis AF2122/97
cagaccgcggcggccga

SEQ ID NO: 3135224 - RNA, 15 nt, Mycobacterium bovis subsp bovis AF2122/97
cagaccggaaacagc

SEQ ID NO: 3135225 - RNA, 17 nt, Mycobacterium bovis subsp bovis AF2122/97
cagaccggaaacagcau

SEQ ID NO: 3135226 - RNA, 24 nt, Mycobacterium bovis subsp bovis AF2122/97
cagaccggccacccacauggcggc

SEQ ID NO: 3135227 - RNA, 14 nt, Mycobacterium bovis subsp bovis AF2122/97
cagaccggccgacg

SEQ ID NO: 3135228 - RNA, 14 nt, Mycobacterium bovis subsp bovis AF2122/97
cagaccggcgccgu

SEQ ID NO: 3135229 - RNA, 15 nt, Mycobacterium bovis subsp bovis AF2122/97
cagaccggcgccgua

SEQ ID NO: 3135230 - RNA, 16 nt, Mycobacterium bovis subsp bovis AF2122/97
cagaccggcucgucgg

SEQ ID NO: 3135231 - RNA, 16 nt, Mycobacterium bovis subsp bovis AF2122/97
cagaccggugcugucg

SEQ ID NO: 3135232 - RNA, 19 nt, Mycobacterium bovis subsp bovis AF2122/97
cagaccggugcugucgacg

SEQ ID NO: 3135233 - RNA, 14 nt, Mycobacterium bovis subsp bovis AF2122/97
cagaccguagcggc

SEQ ID NO: 3135234 - RNA, 17 nt, Mycobacterium bovis subsp bovis AF2122/97
cagaccguagcggccgg

SEQ ID NO: 3135235 - RNA, 14 nt, Mycobacterium bovis subsp bovis AF2122/97
cagaccguccagca

SEQ ID NO: 3135236 - RNA, 23 nt, Mycobacterium bovis subsp bovis AF2122/97
cagaccgugacguagggcagcgc

SEQ ID NO: 3135237 - RNA, 20 nt, Mycobacterium bovis subsp bovis AF2122/97
cagaccuagcaccgcgccga

SEQ ID NO: 3135238 - RNA, 22 nt, Mycobacterium bovis subsp bovis AF2122/97
cagaccuagcaccgcgccgaac

SEQ ID NO: 3135239 - RNA, 13 nt, Mycobacterium bovis subsp bovis AF2122/97
cagacgaccaggg

SEQ ID NO: 3135240 - RNA, 17 nt, Mycobacterium bovis subsp bovis AF2122/97
cagacgaccagggcggu

SEQ ID NO: 3135241 - RNA, 18 nt, Mycobacterium bovis subsp bovis AF2122/97
cagacgacgaucgcgucg

SEQ ID NO: 3135242 - RNA, 18 nt, Mycobacterium bovis subsp bovis AF2122/97
cagacgauggccagguug

SEQ ID NO: 3135243 - RNA, 13 nt, Mycobacterium bovis subsp bovis AF2122/97
cagacgauucggc

SEQ ID NO: 3135244 - RNA, 15 nt, Mycobacterium bovis subsp bovis AF2122/97
cagacgauucggcgg

SEQ ID NO: 3135245 - RNA, 18 nt, Mycobacterium bovis subsp bovis AF2122/97
cagacgcaaaaucgcacg

SEQ ID NO: 3135246 - RNA, 20 nt, Mycobacterium bovis subsp bovis AF2122/97
cagacgcaaaaucgcacggu

SEQ ID NO: 3135247 - RNA, 20 nt, Mycobacterium bovis subsp bovis AF2122/97
cagacgcaaaaucgcccaau

SEQ ID NO: 3135248 - RNA, 19 nt, Mycobacterium bovis subsp bovis AF2122/97
cagacgcaaaaucgcccau

SEQ ID NO: 3135249 - RNA, 19 nt, Mycobacterium bovis subsp bovis AF2122/97
cagacgcagaagcccccaa

SEQ ID NO: 3135250 - RNA, 19 nt, Mycobacterium bovis subsp bovis AF2122/97
cagacgcagaaucgcacgc

SEQ ID NO: 3135251 - RNA, 18 nt, Mycobacterium bovis subsp bovis AF2122/97
cagacgcagaaucgccca

SEQ ID NO: 3135252 - RNA, 20 nt, Mycobacterium bovis subsp bovis AF2122/97
cagacgcagagucgcacugc

SEQ ID NO: 3135253 - RNA, 17 nt, Mycobacterium bovis subsp bovis AF2122/97
cagacgcauaagccccc

SEQ ID NO: 3135254 - RNA, 22 nt, Mycobacterium bovis subsp bovis AF2122/97
cagacgcauaagcccccgacac

SEQ ID NO: 3135255 - RNA, 15 nt, Mycobacterium bovis subsp bovis AF2122/97
cagacgccccuuccc

SEQ ID NO: 3135256 - RNA, 16 nt, Mycobacterium bovis subsp bovis AF2122/97
cagacgccccuucccu

SEQ ID NO: 3135257 - RNA, 21 nt, Mycobacterium bovis subsp bovis AF2122/97
cagacgccguagccggccggc

SEQ ID NO: 3135258 - RNA, 19 nt, Mycobacterium bovis subsp bovis AF2122/97
cagacgcgaaaucccccga

SEQ ID NO: 3135259 - RNA, 15 nt, Mycobacterium bovis subsp bovis AF2122/97
cagacgcggaaucgc

SEQ ID NO: 3135260 - RNA, 22 nt, Mycobacterium bovis subsp bovis AF2122/97
cagacgcggaaucgcaccgugu

SEQ ID NO: 3135261 - RNA, 17 nt, Mycobacterium bovis subsp bovis AF2122/97
cagacgcguuucgucga

SEQ ID NO: 3135262 - RNA, 18 nt, Mycobacterium bovis subsp bovis AF2122/97
cagacgcguuucgucgac

SEQ ID NO: 3135263 - RNA, 19 nt, Mycobacterium bovis subsp bovis AF2122/97
cagacgcuaaagcccccgc

SEQ ID NO: 3135264 - RNA, 20 nt, Mycobacterium bovis subsp bovis AF2122/97
cagacgcuaaagcccccgca

SEQ ID NO: 3135265 - RNA, 14 nt, Mycobacterium bovis subsp bovis AF2122/97
cagacggcucagcg

SEQ ID NO: 3135266 - RNA, 20 nt, Mycobacterium bovis subsp bovis AF2122/97
cagacggcugccacgcgucg

SEQ ID NO: 3135267 - RNA, 17 nt, Mycobacterium bovis subsp bovis AF2122/97
cagacggggucgcccgg

SEQ ID NO: 3135268 - RNA, 20 nt, Mycobacterium bovis subsp bovis AF2122/97
cagacggggucgcccggggc

SEQ ID NO: 3135269 - RNA, 23 nt, Mycobacterium bovis subsp bovis AF2122/97
cagacggggucgcccggggcgca

SEQ ID NO: 3135270 - RNA, 20 nt, Mycobacterium bovis subsp bovis AF2122/97
cagacggguggcccgaccgg

SEQ ID NO: 3135271 - RNA, 22 nt, Mycobacterium bovis subsp bovis AF2122/97
cagacggugaagccgagcgccc

SEQ ID NO: 3135272 - RNA, 19 nt, Mycobacterium bovis subsp bovis AF2122/97
cagacggugcagcuccccg

SEQ ID NO: 3135273 - RNA, 20 nt, Mycobacterium bovis subsp bovis AF2122/97
cagacguaaaagcccccauu

SEQ ID NO: 3135274 - RNA, 19 nt, Mycobacterium bovis subsp bovis AF2122/97
cagacguaaaagcccccgc

SEQ ID NO: 3135275 - RNA, 20 nt, Mycobacterium bovis subsp bovis AF2122/97
cagacguaaaagcccccgca

SEQ ID NO: 3135276 - RNA, 17 nt, Mycobacterium bovis subsp bovis AF2122/97
cagacgucaugcggaua

SEQ ID NO: 3135277 - RNA, 17 nt, Mycobacterium bovis subsp bovis AF2122/97
cagacgugguagccggc

SEQ ID NO: 3135278 - RNA, 19 nt, Mycobacterium bovis subsp bovis AF2122/97
cagacgugguagccggcga

SEQ ID NO: 3135279 - RNA, 24 nt, Mycobacterium bovis subsp bovis AF2122/97
cagacguuccaucacggaccaggc

SEQ ID NO: 3135280 - RNA, 13 nt, Mycobacterium bovis subsp bovis AF2122/97
cagacuccggugu

SEQ ID NO: 3135281 - RNA, 14 nt, Mycobacterium bovis subsp bovis AF2122/97
cagacucgcggucg

SEQ ID NO: 3135282 - RNA, 20 nt, Mycobacterium bovis subsp bovis AF2122/97
cagagaacuccgccaccauc

SEQ ID NO: 3135283 - RNA, 16 nt, Mycobacterium bovis subsp bovis AF2122/97
cagagacaugccggcg

SEQ ID NO: 3135284 - RNA, 16 nt, Mycobacterium bovis subsp bovis AF2122/97
cagagacgaucaucuc

SEQ ID NO: 3135285 - RNA, 17 nt, Mycobacterium bovis subsp bovis AF2122/97
cagagaucagcacccaa

SEQ ID NO: 3135286 - RNA, 17 nt, Mycobacterium bovis subsp bovis AF2122/97
cagagcacgcgcggcgu

SEQ ID NO: 3135287 - RNA, 23 nt, Mycobacterium bovis subsp bovis AF2122/97
cagagcacgggcucgcugcacca

SEQ ID NO: 3135288 - RNA, 17 nt, Mycobacterium bovis subsp bovis AF2122/97
cagaugagucaaaaucc

SEQ ID NO: 3135289 - RNA, 13 nt, Mycobacterium bovis subsp bovis AF2122/97
cagaugcaccucg

SEQ ID NO: 3135290 - RNA, 24 nt, Mycobacterium bovis subsp bovis AF2122/97
cagaugcaccucgcccugcagacg

SEQ ID NO: 3135291 - RNA, 15 nt, Mycobacterium bovis subsp bovis AF2122/97
cagaugcagcggucc

SEQ ID NO: 3135292 - RNA, 16 nt, Mycobacterium bovis subsp bovis AF2122/97
cagaugcagcggucca

SEQ ID NO: 3135293 - RNA, 17 nt, Mycobacterium bovis subsp bovis AF2122/97
cagaugcauccagcugc

SEQ ID NO: 3135294 - RNA, 15 nt, Mycobacterium bovis subsp bovis AF2122/97
cagaugcccagcagg

SEQ ID NO: 3135295 - RNA, 15 nt, Mycobacterium bovis subsp bovis AF2122/97
cagaugccgggcuga

SEQ ID NO: 3135296 - RNA, 19 nt, Mycobacterium bovis subsp bovis AF2122/97
cagaugcgaaagugguggc

SEQ ID NO: 3135297 - RNA, 18 nt, Mycobacterium bovis subsp bovis AF2122/97
cagaugcgaaggcaucgc

SEQ ID NO: 3135298 - RNA, 13 nt, Mycobacterium bovis subsp bovis AF2122/97
cagaugcuggugu

SEQ ID NO: 3135299 - RNA, 18 nt, Mycobacterium bovis subsp bovis AF2122/97
cagauggcauugcgccca

SEQ ID NO: 3135300 - RNA, 19 nt, Mycobacterium bovis subsp bovis AF2122/97
cagauggcauugcgcccac

SEQ ID NO: 3135301 - RNA, 23 nt, Mycobacterium bovis subsp bovis AF2122/97
cagauggcgaggucggugagguc

SEQ ID NO: 3135302 - RNA, 13 nt, Mycobacterium bovis subsp bovis AF2122/97
cagauggcggccg

SEQ ID NO: 3135303 - RNA, 18 nt, Mycobacterium bovis subsp bovis AF2122/97
cagaugggcgucggucac

SEQ ID NO: 3135304 - RNA, 12 nt, Mycobacterium bovis subsp bovis AF2122/97
cagauggggcuc

SEQ ID NO: 3135305 - RNA, 16 nt, Mycobacterium bovis subsp bovis AF2122/97
cagauggucacccacg

SEQ ID NO: 3135306 - RNA, 22 nt, Mycobacterium bovis subsp bovis AF2122/97
cagauggucucgaacuccaugc

SEQ ID NO: 3135307 - RNA, 12 nt, Mycobacterium bovis subsp bovis AF2122/97
cagauggugaac

SEQ ID NO: 3135308 - RNA, 15 nt, Mycobacterium bovis subsp bovis AF2122/97
cagaugguggcaugc

SEQ ID NO: 3135309 - RNA, 20 nt, Mycobacterium bovis subsp bovis AF2122/97
cagaugguuggaucgccacc

SEQ ID NO: 3135310 - RNA, 22 nt, Mycobacterium bovis subsp bovis AF2122/97
cagaugguuggaucgccaccgg

SEQ ID NO: 3135311 - RNA, 20 nt, Mycobacterium bovis subsp bovis AF2122/97
cagauguaccucaucgcaga

SEQ ID NO: 3135312 - RNA, 20 nt, Mycobacterium bovis subsp bovis AF2122/97
cagauguguccggcaucggu

SEQ ID NO: 3135313 - RNA, 14 nt, Mycobacterium bovis subsp bovis AF2122/97
cagauucgccgccc

SEQ ID NO: 3135314 - RNA, 23 nt, Mycobacterium bovis subsp bovis AF2122/97
cagauucggugccagcaggccga

SEQ ID NO: 3135315 - RNA, 14 nt, Mycobacterium bovis subsp bovis AF2122/97
cagauugauuuaac

SEQ ID NO: 3135316 - RNA, 19 nt, Mycobacterium bovis subsp bovis AF2122/97
cagauugccugggcggccg

SEQ ID NO: 3135317 - RNA, 17 nt, Mycobacterium bovis subsp bovis AF2122/97
cagauugucgacgguca

SEQ ID NO: 3135318 - RNA, 22 nt, Mycobacterium bovis subsp bovis AF2122/97
cagauugucgacggucaccggc

SEQ ID NO: 3135319 - RNA, 18 nt, Mycobacterium bovis subsp bovis AF2122/97
cagauuucugggagccgg

SEQ ID NO: 3135320 - RNA, 15 nt, Mycobacterium bovis subsp bovis AF2122/97
cagauuugcuccagc

SEQ ID NO: 3135321 - RNA, 16 nt, Mycobacterium bovis subsp bovis AF2122/97
cagauuugcuccagcg

SEQ ID NO: 3135322 - RNA, 15 nt, Mycobacterium bovis subsp bovis AF2122/97
cagcaaaaaccagcg

SEQ ID NO: 3135323 - RNA, 16 nt, Mycobacterium bovis subsp bovis AF2122/97
cagcaaaaaccagcgu

SEQ ID NO: 3135324 - RNA, 14 nt, Mycobacterium bovis subsp bovis AF2122/97
cagcaaaacccgcu

SEQ ID NO: 3135325 - RNA, 22 nt, Mycobacterium bovis subsp bovis AF2122/97
cagcaaaggggugugugcugcc

SEQ ID NO: 3135326 - RNA, 23 nt, Mycobacterium bovis subsp bovis AF2122/97
cagcaacaacgucugcagccucg

SEQ ID NO: 3135327 - RNA, 14 nt, Mycobacterium bovis subsp bovis AF2122/97
cagcaacagcgagc

SEQ ID NO: 3135328 - RNA, 22 nt, Mycobacterium bovis subsp bovis AF2122/97
cagcaacagcgagcgguugauc

SEQ ID NO: 3135329 - RNA, 13 nt, Mycobacterium bovis subsp bovis AF2122/97
cagcaacaggccc

SEQ ID NO: 3135330 - RNA, 16 nt, Mycobacterium bovis subsp bovis AF2122/97
cagcaacaucuugccg

SEQ ID NO: 3135331 - RNA, 17 nt, Mycobacterium bovis subsp bovis AF2122/97
cagcaaccaccccaggg

SEQ ID NO: 3135332 - RNA, 15 nt, Mycobacterium bovis subsp bovis AF2122/97
cagcaacccgccguu

SEQ ID NO: 3135333 - RNA, 22 nt, Mycobacterium bovis subsp bovis AF2122/97
cagcaacccgccguugccaccg

SEQ ID NO: 3135334 - RNA, 21 nt, Mycobacterium bovis subsp bovis AF2122/97
cagcaacgacaaaccgggcgu

SEQ ID NO: 3135335 - RNA, 21 nt, Mycobacterium bovis subsp bovis AF2122/97
cagcaacgcauuguccugaaa

SEQ ID NO: 3135336 - RNA, 15 nt, Mycobacterium bovis subsp bovis AF2122/97
cagcaacgcggugcc

SEQ ID NO: 3135337 - RNA, 13 nt, Mycobacterium bovis subsp bovis AF2122/97
cagcaacggcagc

SEQ ID NO: 3135338 - RNA, 14 nt, Mycobacterium bovis subsp bovis AF2122/97
cagcaacggcagcg

SEQ ID NO: 3135339 - RNA, 18 nt, Mycobacterium bovis subsp bovis AF2122/97
cagcaacggcagcgaggc

SEQ ID NO: 3135340 - RNA, 14 nt, Mycobacterium bovis subsp bovis AF2122/97
cagcaacggcaucc

SEQ ID NO: 3135341 - RNA, 13 nt, Mycobacterium bovis subsp bovis AF2122/97
cagcaacggcggc

SEQ ID NO: 3135342 - RNA, 14 nt, Mycobacterium bovis subsp bovis AF2122/97
cagcaacgucacgu

SEQ ID NO: 3135343 - RNA, 17 nt, Mycobacterium bovis subsp bovis AF2122/97
cagcaacgucacgucga

SEQ ID NO: 3135344 - RNA, 16 nt, Mycobacterium bovis subsp bovis AF2122/97
cagcaacgucgguaaa

SEQ ID NO: 3135345 - RNA, 19 nt, Mycobacterium bovis subsp bovis AF2122/97
cagcaacgugugcaccauc

SEQ ID NO: 3135346 - RNA, 20 nt, Mycobacterium bovis subsp bovis AF2122/97
cagcaacucgacgucaugca

SEQ ID NO: 3135347 - RNA, 14 nt, Mycobacterium bovis subsp bovis AF2122/97
cagcaacucggcca

SEQ ID NO: 3135348 - RNA, 16 nt, Mycobacterium bovis subsp bovis AF2122/97
cagcaacucggccacg

SEQ ID NO: 3135349 - RNA, 20 nt, Mycobacterium bovis subsp bovis AF2122/97
cagcaacugccgcacccggu

SEQ ID NO: 3135350 - RNA, 16 nt, Mycobacterium bovis subsp bovis AF2122/97
cagcaacugggcggcc

SEQ ID NO: 3135351 - RNA, 19 nt, Mycobacterium bovis subsp bovis AF2122/97
cagcaacugggcggccugg

SEQ ID NO: 3135352 - RNA, 21 nt, Mycobacterium bovis subsp bovis AF2122/97
cagcaacuuugagcagaaggc

SEQ ID NO: 3135353 - RNA, 14 nt, Mycobacterium bovis subsp bovis AF2122/97
cagcaagacgauga

SEQ ID NO: 3135354 - RNA, 16 nt, Mycobacterium bovis subsp bovis AF2122/97
cagcaagaucggcagc

SEQ ID NO: 3135355 - RNA, 23 nt, Mycobacterium bovis subsp bovis AF2122/97
cagcaagccagcaucggcagcag

SEQ ID NO: 3135356 - RNA, 11 nt, Mycobacterium bovis subsp bovis AF2122/97
cagcaagccgc

SEQ ID NO: 3135357 - RNA, 14 nt, Mycobacterium bovis subsp bovis AF2122/97
cagcaaggccagca

SEQ ID NO: 3135358 - RNA, 16 nt, Mycobacterium bovis subsp bovis AF2122/97
cagcaaguacgcgucg

SEQ ID NO: 3135359 - RNA, 18 nt, Mycobacterium bovis subsp bovis AF2122/97
cagcaaguacgcgucggu

SEQ ID NO: 3135360 - RNA, 16 nt, Mycobacterium bovis subsp bovis AF2122/97
cagcaaguucgucggg

SEQ ID NO: 3135361 - RNA, 20 nt, Mycobacterium bovis subsp bovis AF2122/97
cagcaaguucgucgggaucg

SEQ ID NO: 3135362 - RNA, 22 nt, Mycobacterium bovis subsp bovis AF2122/97
cagcaauaccugagcgcgcgcg

SEQ ID NO: 3135363 - RNA, 15 nt, Mycobacterium bovis subsp bovis AF2122/97
cagcaauacggcggc

SEQ ID NO: 3135364 - RNA, 20 nt, Mycobacterium bovis subsp bovis AF2122/97
cagcaauacggcggcgccgc

SEQ ID NO: 3135365 - RNA, 16 nt, Mycobacterium bovis subsp bovis AF2122/97
cagcaaucagccgccu

SEQ ID NO: 3135366 - RNA, 17 nt, Mycobacterium bovis subsp bovis AF2122/97
cagcaaucagccgccuu

SEQ ID NO: 3135367 - RNA, 18 nt, Mycobacterium bovis subsp bovis AF2122/97
cagcaaucagccgccuuc

SEQ ID NO: 3135368 - RNA, 18 nt, Mycobacterium bovis subsp bovis AF2122/97
cagcaauccaaggcucag

SEQ ID NO: 3135369 - RNA, 14 nt, Mycobacterium bovis subsp bovis AF2122/97
cagcaauccgcaaa

SEQ ID NO: 3135370 - RNA, 15 nt, Mycobacterium bovis subsp bovis AF2122/97
cagcaaugcccgcac

SEQ ID NO: 3135371 - RNA, 14 nt, Mycobacterium bovis subsp bovis AF2122/97
cagcaaugccgacu

SEQ ID NO: 3135372 - RNA, 23 nt, Mycobacterium bovis subsp bovis AF2122/97
cagcaauugcaccuucuccaccg

SEQ ID NO: 3135373 - RNA, 22 nt, Mycobacterium bovis subsp bovis AF2122/97
cagcaauuuuccgucgauggac

SEQ ID NO: 3135374 - RNA, 14 nt, Mycobacterium bovis subsp bovis AF2122/97
cagcacaaacccag

SEQ ID NO: 3135375 - RNA, 12 nt, Mycobacterium bovis subsp bovis AF2122/97
cagcaccgcuac

SEQ ID NO: 3135376 - RNA, 16 nt, Mycobacterium bovis subsp bovis AF2122/97
cagcaccgcuggcagc

SEQ ID NO: 3135377 - RNA, 20 nt, Mycobacterium bovis subsp bovis AF2122/97
cagcaccgcuggcagcgacu

SEQ ID NO: 3135378 - RNA, 14 nt, Mycobacterium bovis subsp bovis AF2122/97
cagcaccgcuucuu

SEQ ID NO: 3135379 - RNA, 13 nt, Mycobacterium bovis subsp bovis AF2122/97
cagcaccggaucg

SEQ ID NO: 3135380 - RNA, 18 nt, Mycobacterium bovis subsp bovis AF2122/97
cagcaccggaucgaccaa

SEQ ID NO: 3135381 - RNA, 22 nt, Mycobacterium bovis subsp bovis AF2122/97
cagcaccggcgcgggcacgccc

SEQ ID NO: 3135382 - RNA, 13 nt, Mycobacterium bovis subsp bovis AF2122/97
cagcaccggcucg

SEQ ID NO: 3135383 - RNA, 18 nt, Mycobacterium bovis subsp bovis AF2122/97
cagcaccggcucgacugc

SEQ ID NO: 3135384 - RNA, 22 nt, Mycobacterium bovis subsp bovis AF2122/97
cagcaccgggaugugcggcugc

SEQ ID NO: 3135385 - RNA, 15 nt, Mycobacterium bovis subsp bovis AF2122/97
cagcaccggggacag

SEQ ID NO: 3135386 - RNA, 14 nt, Mycobacterium bovis subsp bovis AF2122/97
cagcaccguccucg

SEQ ID NO: 3135387 - RNA, 19 nt, Mycobacterium bovis subsp bovis AF2122/97
cagcaccgucggcaccagc

SEQ ID NO: 3135388 - RNA, 16 nt, Mycobacterium bovis subsp bovis AF2122/97
cagcaccgucgggccc

SEQ ID NO: 3135389 - RNA, 15 nt, Mycobacterium bovis subsp bovis AF2122/97
cagcaccgugacagc

SEQ ID NO: 3135390 - RNA, 22 nt, Mycobacterium bovis subsp bovis AF2122/97
cagcaccgugacagcggcauug

SEQ ID NO: 3135391 - RNA, 14 nt, Mycobacterium bovis subsp bovis AF2122/97
cagcaccguucgca

SEQ ID NO: 3135392 - RNA, 17 nt, Mycobacterium bovis subsp bovis AF2122/97
cagcaccguucgcagca

SEQ ID NO: 3135393 - RNA, 16 nt, Mycobacterium bovis subsp bovis AF2122/97
cagcaccuagucgcgg

SEQ ID NO: 3135394 - RNA, 19 nt, Mycobacterium bovis subsp bovis AF2122/97
cagcaccuagucgcggccg

SEQ ID NO: 3135395 - RNA, 13 nt, Mycobacterium bovis subsp bovis AF2122/97
cagcaccuccgua

SEQ ID NO: 3135396 - RNA, 18 nt, Mycobacterium bovis subsp bovis AF2122/97
cagcaccucgaccgccaa

SEQ ID NO: 3135397 - RNA, 22 nt, Mycobacterium bovis subsp bovis AF2122/97
cagcaccucggucccguugccg

SEQ ID NO: 3135398 - RNA, 22 nt, Mycobacterium bovis subsp bovis AF2122/97
cagcaccugccguuccggcugc

SEQ ID NO: 3135399 - RNA, 22 nt, Mycobacterium bovis subsp bovis AF2122/97
cagcacgaccugguuauucgac

SEQ ID NO: 3135400 - RNA, 15 nt, Mycobacterium bovis subsp bovis AF2122/97
cagcacgacgacaac

SEQ ID NO: 3135401 - RNA, 13 nt, Mycobacterium bovis subsp bovis AF2122/97
cagcacgacgugc

SEQ ID NO: 3135402 - RNA, 15 nt, Mycobacterium bovis subsp bovis AF2122/97
cagcacgccagcccc

SEQ ID NO: 3135403 - RNA, 13 nt, Mycobacterium bovis subsp bovis AF2122/97
cagcacgcccgaa

SEQ ID NO: 3135404 - RNA, 13 nt, Mycobacterium bovis subsp bovis AF2122/97
cagcacgcccgcg

SEQ ID NO: 3135405 - RNA, 18 nt, Mycobacterium bovis subsp bovis AF2122/97
cagcacgcccgcgcugac

SEQ ID NO: 3135406 - RNA, 22 nt, Mycobacterium bovis subsp bovis AF2122/97
cagcacgcccucgacgcgcucg

SEQ ID NO: 3135407 - RNA, 14 nt, Mycobacterium bovis subsp bovis AF2122/97
cagcacgccgccgg

SEQ ID NO: 3135408 - RNA, 17 nt, Mycobacterium bovis subsp bovis AF2122/97
cagcacgccgccggccg

SEQ ID NO: 3135409 - RNA, 21 nt, Mycobacterium bovis subsp bovis AF2122/97
cagcacgccgccggccgccag

SEQ ID NO: 3135410 - RNA, 12 nt, Mycobacterium bovis subsp bovis AF2122/97
cagcacgccggg

SEQ ID NO: 3135411 - RNA, 13 nt, Mycobacterium bovis subsp bovis AF2122/97
cagcacgccgggu

SEQ ID NO: 3135412 - RNA, 15 nt, Mycobacterium bovis subsp bovis AF2122/97
cagcacgccguccag

SEQ ID NO: 3135413 - RNA, 17 nt, Mycobacterium bovis subsp bovis AF2122/97
cagcacgccguccaggu

SEQ ID NO: 3135414 - RNA, 16 nt, Mycobacterium bovis subsp bovis AF2122/97
cagcacgcgcgcgacc

SEQ ID NO: 3135415 - RNA, 21 nt, Mycobacterium bovis subsp bovis AF2122/97
cagcacgcucgugacgaucag

SEQ ID NO: 3135416 - RNA, 19 nt, Mycobacterium bovis subsp bovis AF2122/97
cagcacgcugaccacaacc

SEQ ID NO: 3135417 - RNA, 21 nt, Mycobacterium bovis subsp bovis AF2122/97
cagcacgcugaccacaaccgu

SEQ ID NO: 3135418 - RNA, 13 nt, Mycobacterium bovis subsp bovis AF2122/97
cagcacgcuggcg

SEQ ID NO: 3135419 - RNA, 17 nt, Mycobacterium bovis subsp bovis AF2122/97
cagcacgcuggcguugu

SEQ ID NO: 3135420 - RNA, 13 nt, Mycobacterium bovis subsp bovis AF2122/97
cagcacggcgccg

SEQ ID NO: 3135421 - RNA, 14 nt, Mycobacterium bovis subsp bovis AF2122/97
cagcacggcgccgc

SEQ ID NO: 3135422 - RNA, 15 nt, Mycobacterium bovis subsp bovis AF2122/97
cagcacggcgccgcc

SEQ ID NO: 3135423 - RNA, 19 nt, Mycobacterium bovis subsp bovis AF2122/97
cagcacggcgccgccacgg

SEQ ID NO: 3135424 - RNA, 16 nt, Mycobacterium bovis subsp bovis AF2122/97
cagcacggcggccacg

SEQ ID NO: 3135425 - RNA, 17 nt, Mycobacterium bovis subsp bovis AF2122/97
cagcacggcggccacgu

SEQ ID NO: 3135426 - RNA, 13 nt, Mycobacterium bovis subsp bovis AF2122/97
cagcacggcuucg

SEQ ID NO: 3135427 - RNA, 16 nt, Mycobacterium bovis subsp bovis AF2122/97
cagcacggcuucgcgg

SEQ ID NO: 3135428 - RNA, 19 nt, Mycobacterium bovis subsp bovis AF2122/97
cagcacggcuucgcgguug

SEQ ID NO: 3135429 - RNA, 18 nt, Mycobacterium bovis subsp bovis AF2122/97
cagcacgggugagcacca

SEQ ID NO: 3135430 - RNA, 20 nt, Mycobacterium bovis subsp bovis AF2122/97
cagcacgggugagcaccacg

SEQ ID NO: 3135431 - RNA, 20 nt, Mycobacterium bovis subsp bovis AF2122/97
cagcacggugaucagcagca

SEQ ID NO: 3135432 - RNA, 17 nt, Mycobacterium bovis subsp bovis AF2122/97
cagcacgguggcuucga

SEQ ID NO: 3135433 - RNA, 22 nt, Mycobacterium bovis subsp bovis AF2122/97
cagcacgguguacgcccgcucg

SEQ ID NO: 3135434 - RNA, 16 nt, Mycobacterium bovis subsp bovis AF2122/97
cagcacggugugcgau

SEQ ID NO: 3135435 - RNA, 20 nt, Mycobacterium bovis subsp bovis AF2122/97
cagcacgguguugcgcaccc

SEQ ID NO: 3135436 - RNA, 21 nt, Mycobacterium bovis subsp bovis AF2122/97
cagcacgguguugcgcacccg

SEQ ID NO: 3135437 - RNA, 23 nt, Mycobacterium bovis subsp bovis AF2122/97
cagcacgguguugcgcacccgcg

SEQ ID NO: 3135438 - RNA, 16 nt, Mycobacterium bovis subsp bovis AF2122/97
cagcacgguuguugua

SEQ ID NO: 3135439 - RNA, 16 nt, Mycobacterium bovis subsp bovis AF2122/97
cagcacguaacccagu

SEQ ID NO: 3135440 - RNA, 16 nt, Mycobacterium bovis subsp bovis AF2122/97
cagcacguaacgccgc

SEQ ID NO: 3135441 - RNA, 17 nt, Mycobacterium bovis subsp bovis AF2122/97
cagcacguaacgccgcu

SEQ ID NO: 3135442 - RNA, 18 nt, Mycobacterium bovis subsp bovis AF2122/97
cagcacguaacgccgcuc

SEQ ID NO: 3135443 - RNA, 13 nt, Mycobacterium bovis subsp bovis AF2122/97
cagcacguacugc

SEQ ID NO: 3135444 - RNA, 17 nt, Mycobacterium bovis subsp bovis AF2122/97
cagcacguccgcggagc

SEQ ID NO: 3135445 - RNA, 12 nt, Mycobacterium bovis subsp bovis AF2122/97
cagcacgucgca

SEQ ID NO: 3135446 - RNA, 12 nt, Mycobacterium bovis subsp bovis AF2122/97
cagcacgucgcg

SEQ ID NO: 3135447 - RNA, 20 nt, Mycobacterium bovis subsp bovis AF2122/97
cagcacgucguugugcagau

SEQ ID NO: 3135448 - RNA, 19 nt, Mycobacterium bovis subsp bovis AF2122/97
cagcacguggaccggcacg

SEQ ID NO: 3135449 - RNA, 17 nt, Mycobacterium bovis subsp bovis AF2122/97
cagcacgugggccaacg

SEQ ID NO: 3135450 - RNA, 19 nt, Mycobacterium bovis subsp bovis AF2122/97
cagcacuccaccgcuggcc

SEQ ID NO: 3135451 - RNA, 21 nt, Mycobacterium bovis subsp bovis AF2122/97
cagcacuccaccgcuggcccg

SEQ ID NO: 3135452 - RNA, 13 nt, Mycobacterium bovis subsp bovis AF2122/97
cagcacuccggcg

SEQ ID NO: 3135453 - RNA, 16 nt, Mycobacterium bovis subsp bovis AF2122/97
cagcacuccggcgacg

SEQ ID NO: 3135454 - RNA, 14 nt, Mycobacterium bovis subsp bovis AF2122/97
cagcacucgguguc

SEQ ID NO: 3135455 - RNA, 16 nt, Mycobacterium bovis subsp bovis AF2122/97
cagcacucuucgauga

SEQ ID NO: 3135456 - RNA, 22 nt, Mycobacterium bovis subsp bovis AF2122/97
cagcacucuucgaugaagcugg

SEQ ID NO: 3135457 - RNA, 16 nt, Mycobacterium bovis subsp bovis AF2122/97
cagcacugcggcagcg

SEQ ID NO: 3135458 - RNA, 19 nt, Mycobacterium bovis subsp bovis AF2122/97
cagcacuuccaagccgacc

SEQ ID NO: 3135459 - RNA, 22 nt, Mycobacterium bovis subsp bovis AF2122/97
cagcacuuggacccggccggcc

SEQ ID NO: 3135460 - RNA, 15 nt, Mycobacterium bovis subsp bovis AF2122/97
cagcagaaacaucga

SEQ ID NO: 3135461 - RNA, 18 nt, Mycobacterium bovis subsp bovis AF2122/97
cagcagaaucucgggucg

SEQ ID NO: 3135462 - RNA, 20 nt, Mycobacterium bovis subsp bovis AF2122/97
cagcaggaucggcagcagag

SEQ ID NO: 3135463 - RNA, 23 nt, Mycobacterium bovis subsp bovis AF2122/97
cagcaggaucggcagcagaguuc

SEQ ID NO: 3135464 - RNA, 16 nt, Mycobacterium bovis subsp bovis AF2122/97
cagcaggcccacccgg

SEQ ID NO: 3135465 - RNA, 19 nt, Mycobacterium bovis subsp bovis AF2122/97
cagcaggcccacccgggcg

SEQ ID NO: 3135466 - RNA, 15 nt, Mycobacterium bovis subsp bovis AF2122/97
cagcaggcccagcgg

SEQ ID NO: 3135467 - RNA, 19 nt, Mycobacterium bovis subsp bovis AF2122/97
cagcaggcccagcggaucg

SEQ ID NO: 3135468 - RNA, 14 nt, Mycobacterium bovis subsp bovis AF2122/97
cagcaggcccuggc

SEQ ID NO: 3135469 - RNA, 18 nt, Mycobacterium bovis subsp bovis AF2122/97
cagcaggcccuggccacc

SEQ ID NO: 3135470 - RNA, 19 nt, Mycobacterium bovis subsp bovis AF2122/97
cagcaggcccuggccaccc

SEQ ID NO: 3135471 - RNA, 20 nt, Mycobacterium bovis subsp bovis AF2122/97
cagcaggcccuggccaccca

SEQ ID NO: 3135472 - RNA, 14 nt, Mycobacterium bovis subsp bovis AF2122/97
cagcaggccgcgcu

SEQ ID NO: 3135473 - RNA, 18 nt, Mycobacterium bovis subsp bovis AF2122/97
cagcaggccgcgcucguc

SEQ ID NO: 3135474 - RNA, 20 nt, Mycobacterium bovis subsp bovis AF2122/97
cagcaggccgcgcucgucga

SEQ ID NO: 3135475 - RNA, 11 nt, Mycobacterium bovis subsp bovis AF2122/97
cagcaggccgg

SEQ ID NO: 3135476 - RNA, 17 nt, Mycobacterium bovis subsp bovis AF2122/97
cagcaggccgggacagc

SEQ ID NO: 3135477 - RNA, 15 nt, Mycobacterium bovis subsp bovis AF2122/97
cagcaggccgggcgc

SEQ ID NO: 3135478 - RNA, 16 nt, Mycobacterium bovis subsp bovis AF2122/97
cagcaggccgggcgca

SEQ ID NO: 3135479 - RNA, 21 nt, Mycobacterium bovis subsp bovis AF2122/97
cagcaggccgggcgcaagcag

SEQ ID NO: 3135480 - RNA, 22 nt, Mycobacterium bovis subsp bovis AF2122/97
cagcaggccgggcgcaagcagc

SEQ ID NO: 3135481 - RNA, 22 nt, Mycobacterium bovis subsp bovis AF2122/97
cagcaggccuccaagcccgccg

SEQ ID NO: 3135482 - RNA, 22 nt, Mycobacterium bovis subsp bovis AF2122/97
cagcaggcggcugaacggcagc

SEQ ID NO: 3135483 - RNA, 15 nt, Mycobacterium bovis subsp bovis AF2122/97
cagcaggcucgaacc

SEQ ID NO: 3135484 - RNA, 14 nt, Mycobacterium bovis subsp bovis AF2122/97
cagcagggcgcgca

SEQ ID NO: 3135485 - RNA, 14 nt, Mycobacterium bovis subsp bovis AF2122/97
cagcagggcggcgu

SEQ ID NO: 3135486 - RNA, 20 nt, Mycobacterium bovis subsp bovis AF2122/97
cagcagggcuucgugcacca

SEQ ID NO: 3135487 - RNA, 22 nt, Mycobacterium bovis subsp bovis AF2122/97
cagcaggggaucguccggccgg

SEQ ID NO: 3135488 - RNA, 19 nt, Mycobacterium bovis subsp bovis AF2122/97
cagcagguccgcggccgcg

SEQ ID NO: 3135489 - RNA, 17 nt, Mycobacterium bovis subsp bovis AF2122/97
cagcaggucgucggcgu

SEQ ID NO: 3135490 - RNA, 19 nt, Mycobacterium bovis subsp bovis AF2122/97
cagcaggucgucggcgucg

SEQ ID NO: 3135491 - RNA, 21 nt, Mycobacterium bovis subsp bovis AF2122/97
cagcaggucgucggcgucgcg

SEQ ID NO: 3135492 - RNA, 22 nt, Mycobacterium bovis subsp bovis AF2122/97
cagcaggucgucggcgucgcgg

SEQ ID NO: 3135493 - RNA, 18 nt, Mycobacterium bovis subsp bovis AF2122/97
cagcaggugcaucgccac

SEQ ID NO: 3135494 - RNA, 22 nt, Mycobacterium bovis subsp bovis AF2122/97
cagcaggugccaaccgcggcga

SEQ ID NO: 3135495 - RNA, 23 nt, Mycobacterium bovis subsp bovis AF2122/97
cagcaggugccaaccgcggcgau

SEQ ID NO: 3135496 - RNA, 16 nt, Mycobacterium bovis subsp bovis AF2122/97
cagcagguuggcgagc

SEQ ID NO: 3135497 - RNA, 17 nt, Mycobacterium bovis subsp bovis AF2122/97
cagcagguuggcgagcu

SEQ ID NO: 3135498 - RNA, 20 nt, Mycobacterium bovis subsp bovis AF2122/97
cagcagguuggucaccaccu

SEQ ID NO: 3135499 - RNA, 19 nt, Mycobacterium bovis subsp bovis AF2122/97
cagcagguuuucgaucugg

SEQ ID NO: 3135500 - RNA, 12 nt, Mycobacterium bovis subsp bovis AF2122/97
cagcaguacuaa

SEQ ID NO: 3135501 - RNA, 23 nt, Mycobacterium bovis subsp bovis AF2122/97
cagcaguacuaacaacaccacca

SEQ ID NO: 3135502 - RNA, 15 nt, Mycobacterium bovis subsp bovis AF2122/97
cagcagugccaccgg

SEQ ID NO: 3135503 - RNA, 19 nt, Mycobacterium bovis subsp bovis AF2122/97
cagcagugccgugcugaac

SEQ ID NO: 3135504 - RNA, 13 nt, Mycobacterium bovis subsp bovis AF2122/97
cagcagugcgggg

SEQ ID NO: 3135505 - RNA, 22 nt, Mycobacterium bovis subsp bovis AF2122/97
cagcaguggcgcauuggccuga

SEQ ID NO: 3135506 - RNA, 23 nt, Mycobacterium bovis subsp bovis AF2122/97
cagcaguucgccgcgcagcgugc

SEQ ID NO: 3135507 - RNA, 15 nt, Mycobacterium bovis subsp bovis AF2122/97
cagcaguucggcgau

SEQ ID NO: 3135508 - RNA, 14 nt, Mycobacterium bovis subsp bovis AF2122/97
cagcaguuucaccu

SEQ ID NO: 3135509 - RNA, 22 nt, Mycobacterium bovis subsp bovis AF2122/97
cagcaguuucaccuugcgcacc

SEQ ID NO: 3135510 - RNA, 23 nt, Mycobacterium bovis subsp bovis AF2122/97
cagcaguuucaccuugcgcacca

SEQ ID NO: 3135511 - RNA, 23 nt, Mycobacterium bovis subsp bovis AF2122/97
cagcauaucgauucgggcgucgg

SEQ ID NO: 3135512 - RNA, 14 nt, Mycobacterium bovis subsp bovis AF2122/97
cagcaucaacaccg

SEQ ID NO: 3135513 - RNA, 16 nt, Mycobacterium bovis subsp bovis AF2122/97
cagcaucaacaccggc

SEQ ID NO: 3135514 - RNA, 18 nt, Mycobacterium bovis subsp bovis AF2122/97
cagcaucaacaccggcug

SEQ ID NO: 3135515 - RNA, 20 nt, Mycobacterium bovis subsp bovis AF2122/97
cagcaucaaccguccccggc

SEQ ID NO: 3135516 - RNA, 13 nt, Mycobacterium bovis subsp bovis AF2122/97
cagcaucagcgcc

SEQ ID NO: 3135517 - RNA, 17 nt, Mycobacterium bovis subsp bovis AF2122/97
cagcaucagcgccagcg

SEQ ID NO: 3135518 - RNA, 17 nt, Mycobacterium bovis subsp bovis AF2122/97
cagcaucagcucgaugc

SEQ ID NO: 3135519 - RNA, 18 nt, Mycobacterium bovis subsp bovis AF2122/97
cagcaucagcucgaugcc

SEQ ID NO: 3135520 - RNA, 15 nt, Mycobacterium bovis subsp bovis AF2122/97
cagcauccccgcagc

SEQ ID NO: 3135521 - RNA, 19 nt, Mycobacterium bovis subsp bovis AF2122/97
cagcauccccgcagcgucc

SEQ ID NO: 3135522 - RNA, 13 nt, Mycobacterium bovis subsp bovis AF2122/97
cagcauccggccg

SEQ ID NO: 3135523 - RNA, 21 nt, Mycobacterium bovis subsp bovis AF2122/97
cagcauccggccgucaucugg

SEQ ID NO: 3135524 - RNA, 23 nt, Mycobacterium bovis subsp bovis AF2122/97
cagcauccggccgucaucuggaa

SEQ ID NO: 3135525 - RNA, 22 nt, Mycobacterium bovis subsp bovis AF2122/97
cagcaucgagcaguggccgccg

SEQ ID NO: 3135526 - RNA, 16 nt, Mycobacterium bovis subsp bovis AF2122/97
cagcaucggcaccccg

SEQ ID NO: 3135527 - RNA, 17 nt, Mycobacterium bovis subsp bovis AF2122/97
cagcaucggcaccccgg

SEQ ID NO: 3135528 - RNA, 18 nt, Mycobacterium bovis subsp bovis AF2122/97
cagcaucggcaccccggc

SEQ ID NO: 3135529 - RNA, 22 nt, Mycobacterium bovis subsp bovis AF2122/97
cagcaucggcaccccggccacu

SEQ ID NO: 3135530 - RNA, 16 nt, Mycobacterium bovis subsp bovis AF2122/97
cagcaucggcagcagc

SEQ ID NO: 3135531 - RNA, 17 nt, Mycobacterium bovis subsp bovis AF2122/97
cagcaucggcagcagcg

SEQ ID NO: 3135532 - RNA, 16 nt, Mycobacterium bovis subsp bovis AF2122/97
cagcaucggguggcga

SEQ ID NO: 3135533 - RNA, 14 nt, Mycobacterium bovis subsp bovis AF2122/97
cagcaucggucaca

SEQ ID NO: 3135534 - RNA, 17 nt, Mycobacterium bovis subsp bovis AF2122/97
cagcaucggucacaccg

SEQ ID NO: 3135535 - RNA, 15 nt, Mycobacterium bovis subsp bovis AF2122/97
cagcaucggugcggg

SEQ ID NO: 3135536 - RNA, 20 nt, Mycobacterium bovis subsp bovis AF2122/97
cagcaucggugcgggcgcca

SEQ ID NO: 3135537 - RNA, 19 nt, Mycobacterium bovis subsp bovis AF2122/97
cagcaucgucgccacgaug

SEQ ID NO: 3135538 - RNA, 16 nt, Mycobacterium bovis subsp bovis AF2122/97
cagcaucuccgucggc

SEQ ID NO: 3135539 - RNA, 19 nt, Mycobacterium bovis subsp bovis AF2122/97
cagcaucuccgucggccag

SEQ ID NO: 3135540 - RNA, 21 nt, Mycobacterium bovis subsp bovis AF2122/97
cagcaucuccgucggccaggc

SEQ ID NO: 3135541 - RNA, 16 nt, Mycobacterium bovis subsp bovis AF2122/97
cagcaucucgucgauc

SEQ ID NO: 3135542 - RNA, 23 nt, Mycobacterium bovis subsp bovis AF2122/97
cagcaucuggggguagccgccgg

SEQ ID NO: 3135543 - RNA, 16 nt, Mycobacterium bovis subsp bovis AF2122/97
cagcaucuuuggcggc

SEQ ID NO: 3135544 - RNA, 20 nt, Mycobacterium bovis subsp bovis AF2122/97
cagcaucuuuggcggccgca

SEQ ID NO: 3135545 - RNA, 15 nt, Mycobacterium bovis subsp bovis AF2122/97
cagcaugaagucccg

SEQ ID NO: 3135546 - RNA, 13 nt, Mycobacterium bovis subsp bovis AF2122/97
cagcaugacaccg

SEQ ID NO: 3135547 - RNA, 15 nt, Mycobacterium bovis subsp bovis AF2122/97
cagcaugacaccggc

SEQ ID NO: 3135548 - RNA, 12 nt, Mycobacterium bovis subsp bovis AF2122/97
cagccagccugc

SEQ ID NO: 3135549 - RNA, 14 nt, Mycobacterium bovis subsp bovis AF2122/97
cagccagccugcug

SEQ ID NO: 3135550 - RNA, 15 nt, Mycobacterium bovis subsp bovis AF2122/97
cagccagccugcugg

SEQ ID NO: 3135551 - RNA, 18 nt, Mycobacterium bovis subsp bovis AF2122/97
cagccagccugcuggccg

SEQ ID NO: 3135552 - RNA, 21 nt, Mycobacterium bovis subsp bovis AF2122/97
cagccagccugcuggccgcgg

SEQ ID NO: 3135553 - RNA, 16 nt, Mycobacterium bovis subsp bovis AF2122/97
cagccagcgauccagc

SEQ ID NO: 3135554 - RNA, 20 nt, Mycobacterium bovis subsp bovis AF2122/97
cagccagcgccaugcugucg

SEQ ID NO: 3135555 - RNA, 15 nt, Mycobacterium bovis subsp bovis AF2122/97
cagccagcgggcgau

SEQ ID NO: 3135556 - RNA, 16 nt, Mycobacterium bovis subsp bovis AF2122/97
cagccagcguccaugg

SEQ ID NO: 3135557 - RNA, 12 nt, Mycobacterium bovis subsp bovis AF2122/97
cagccaggaagc

SEQ ID NO: 3135558 - RNA, 14 nt, Mycobacterium bovis subsp bovis AF2122/97
cagccaggagccga

SEQ ID NO: 3135559 - RNA, 16 nt, Mycobacterium bovis subsp bovis AF2122/97
cagccaggagccgauc

SEQ ID NO: 3135560 - RNA, 17 nt, Mycobacterium bovis subsp bovis AF2122/97
cagccaggccagugcca

SEQ ID NO: 3135561 - RNA, 12 nt, Mycobacterium bovis subsp bovis AF2122/97
cagccaggccgc

SEQ ID NO: 3135562 - RNA, 15 nt, Mycobacterium bovis subsp bovis AF2122/97
cagccaggccgcaau

SEQ ID NO: 3135563 - RNA, 18 nt, Mycobacterium bovis subsp bovis AF2122/97
cagccaggccgcaaugcg

SEQ ID NO: 3135564 - RNA, 21 nt, Mycobacterium bovis subsp bovis AF2122/97
cagccaggccuuggugcggcc

SEQ ID NO: 3135565 - RNA, 23 nt, Mycobacterium bovis subsp bovis AF2122/97
cagccaggccuuggugcggccgg

SEQ ID NO: 3135566 - RNA, 16 nt, Mycobacterium bovis subsp bovis AF2122/97
cagccaggcgauugcc

SEQ ID NO: 3135567 - RNA, 17 nt, Mycobacterium bovis subsp bovis AF2122/97
cagccaggcgugcacag

SEQ ID NO: 3135568 - RNA, 12 nt, Mycobacterium bovis subsp bovis AF2122/97
cagccaggcugc

SEQ ID NO: 3135569 - RNA, 18 nt, Mycobacterium bovis subsp bovis AF2122/97
cagccagggucccgccgc

SEQ ID NO: 3135570 - RNA, 21 nt, Mycobacterium bovis subsp bovis AF2122/97
cagccagggucccgccgccug

SEQ ID NO: 3135571 - RNA, 23 nt, Mycobacterium bovis subsp bovis AF2122/97
cagccagggucccgccgccugga

SEQ ID NO: 3135572 - RNA, 15 nt, Mycobacterium bovis subsp bovis AF2122/97
cagccaggugcccaa

SEQ ID NO: 3135573 - RNA, 21 nt, Mycobacterium bovis subsp bovis AF2122/97
cagccaggugcccaagcaguc

SEQ ID NO: 3135574 - RNA, 22 nt, Mycobacterium bovis subsp bovis AF2122/97
cagccaggugcccaagcagucc

SEQ ID NO: 3135575 - RNA, 16 nt, Mycobacterium bovis subsp bovis AF2122/97
cagccaggugucgucg

SEQ ID NO: 3135576 - RNA, 19 nt, Mycobacterium bovis subsp bovis AF2122/97
cagccaguaaaaaggcagg

SEQ ID NO: 3135577 - RNA, 23 nt, Mycobacterium bovis subsp bovis AF2122/97
cagccaguaaaaaggcaggacug

SEQ ID NO: 3135578 - RNA, 19 nt, Mycobacterium bovis subsp bovis AF2122/97
cagccaguccagcgcgcca

SEQ ID NO: 3135579 - RNA, 23 nt, Mycobacterium bovis subsp bovis AF2122/97
cagccaguguugcaguggcgacg

SEQ ID NO: 3135580 - RNA, 15 nt, Mycobacterium bovis subsp bovis AF2122/97
cagccaucucuugca

SEQ ID NO: 3135581 - RNA, 14 nt, Mycobacterium bovis subsp bovis AF2122/97
cagccaugcggcug

SEQ ID NO: 3135582 - RNA, 18 nt, Mycobacterium bovis subsp bovis AF2122/97
cagccaugcucgucuugg

SEQ ID NO: 3135583 - RNA, 15 nt, Mycobacterium bovis subsp bovis AF2122/97
cagccauggcagcgc

SEQ ID NO: 3135584 - RNA, 18 nt, Mycobacterium bovis subsp bovis AF2122/97
cagccauggugggccuuc

SEQ ID NO: 3135585 - RNA, 20 nt, Mycobacterium bovis subsp bovis AF2122/97
cagccauggugggccuuccu

SEQ ID NO: 3135586 - RNA, 15 nt, Mycobacterium bovis subsp bovis AF2122/97
cagcccacaggcggc

SEQ ID NO: 3135587 - RNA, 21 nt, Mycobacterium bovis subsp bovis AF2122/97
cagcccacaggcggcgcugca

SEQ ID NO: 3135588 - RNA, 23 nt, Mycobacterium bovis subsp bovis AF2122/97
cagcccacaggcggcgcugcagc

SEQ ID NO: 3135589 - RNA, 19 nt, Mycobacterium bovis subsp bovis AF2122/97
cagcccaccggcgccgccg

SEQ ID NO: 3135590 - RNA, 21 nt, Mycobacterium bovis subsp bovis AF2122/97
cagcccaccggcgccgccggc

SEQ ID NO: 3135591 - RNA, 16 nt, Mycobacterium bovis subsp bovis AF2122/97
cagcccaccggugccg

SEQ ID NO: 3135592 - RNA, 19 nt, Mycobacterium bovis subsp bovis AF2122/97
cagcccaccggugccgccc

SEQ ID NO: 3135593 - RNA, 21 nt, Mycobacterium bovis subsp bovis AF2122/97
cagcccaccggugccgcccgc

SEQ ID NO: 3135594 - RNA, 22 nt, Mycobacterium bovis subsp bovis AF2122/97
cagcccaccggugccgcccgcg

SEQ ID NO: 3135595 - RNA, 20 nt, Mycobacterium bovis subsp bovis AF2122/97
cagcccacgaaugcaagacc

SEQ ID NO: 3135596 - RNA, 14 nt, Mycobacterium bovis subsp bovis AF2122/97
cagcccacucgucg

SEQ ID NO: 3135597 - RNA, 17 nt, Mycobacterium bovis subsp bovis AF2122/97
cagcccagcacgcuggc

SEQ ID NO: 3135598 - RNA, 19 nt, Mycobacterium bovis subsp bovis AF2122/97
cagcccagcacgcuggcgu

SEQ ID NO: 3135599 - RNA, 23 nt, Mycobacterium bovis subsp bovis AF2122/97
cagcccagcacgcuggcguuguu

SEQ ID NO: 3135600 - RNA, 17 nt, Mycobacterium bovis subsp bovis AF2122/97
cagcccagcagguucca

SEQ ID NO: 3135601 - RNA, 16 nt, Mycobacterium bovis subsp bovis AF2122/97
cagcccagccgccagc

SEQ ID NO: 3135602 - RNA, 13 nt, Mycobacterium bovis subsp bovis AF2122/97
cagcccagccggg

SEQ ID NO: 3135603 - RNA, 21 nt, Mycobacterium bovis subsp bovis AF2122/97
cagcccagccguucgucgcgg

SEQ ID NO: 3135604 - RNA, 17 nt, Mycobacterium bovis subsp bovis AF2122/97
cagcccaggccuuagau

SEQ ID NO: 3135605 - RNA, 17 nt, Mycobacterium bovis subsp bovis AF2122/97
cagcccaugcgccacgc

SEQ ID NO: 3135606 - RNA, 12 nt, Mycobacterium bovis subsp bovis AF2122/97
cagccccacccg

SEQ ID NO: 3135607 - RNA, 19 nt, Mycobacterium bovis subsp bovis AF2122/97
cagccccacccgccgccgc

SEQ ID NO: 3135608 - RNA, 13 nt, Mycobacterium bovis subsp bovis AF2122/97
cagccccagcuug

SEQ ID NO: 3135609 - RNA, 19 nt, Mycobacterium bovis subsp bovis AF2122/97
cagccccaucaccaccggc

SEQ ID NO: 3135610 - RNA, 17 nt, Mycobacterium bovis subsp bovis AF2122/97
cagccccaugaucuggu

SEQ ID NO: 3135611 - RNA, 19 nt, Mycobacterium bovis subsp bovis AF2122/97
cagccccauugccgucgcg

SEQ ID NO: 3135612 - RNA, 15 nt, Mycobacterium bovis subsp bovis AF2122/97
cagccccccggcgac

SEQ ID NO: 3135613 - RNA, 16 nt, Mycobacterium bovis subsp bovis AF2122/97
cagccccccggcgacg

SEQ ID NO: 3135614 - RNA, 14 nt, Mycobacterium bovis subsp bovis AF2122/97
cagccccgacugcg

SEQ ID NO: 3135615 - RNA, 15 nt, Mycobacterium bovis subsp bovis AF2122/97
cagccccgcgcccac

SEQ ID NO: 3135616 - RNA, 17 nt, Mycobacterium bovis subsp bovis AF2122/97
cagccccgcgcccaccc

SEQ ID NO: 3135617 - RNA, 21 nt, Mycobacterium bovis subsp bovis AF2122/97
cagccccgcgcccaccccggc

SEQ ID NO: 3135618 - RNA, 17 nt, Mycobacterium bovis subsp bovis AF2122/97
cagccccgcggccagca

SEQ ID NO: 3135619 - RNA, 21 nt, Mycobacterium bovis subsp bovis AF2122/97
cagccccgcuggucgaccggc

SEQ ID NO: 3135620 - RNA, 23 nt, Mycobacterium bovis subsp bovis AF2122/97
cagccccgcuggucgaccggcgu

SEQ ID NO: 3135621 - RNA, 22 nt, Mycobacterium bovis subsp bovis AF2122/97
cagcccgaacucguuggcgaac

SEQ ID NO: 3135622 - RNA, 13 nt, Mycobacterium bovis subsp bovis AF2122/97
cagcccgacaccg

SEQ ID NO: 3135623 - RNA, 15 nt, Mycobacterium bovis subsp bovis AF2122/97
cagcccgacaccgau

SEQ ID NO: 3135624 - RNA, 19 nt, Mycobacterium bovis subsp bovis AF2122/97
cagcccgacaccgaucgga

SEQ ID NO: 3135625 - RNA, 23 nt, Mycobacterium bovis subsp bovis AF2122/97
cagcccgacaccguccagcagcu

SEQ ID NO: 3135626 - RNA, 20 nt, Mycobacterium bovis subsp bovis AF2122/97
cagcccgacaguggucccgg

SEQ ID NO: 3135627 - RNA, 22 nt, Mycobacterium bovis subsp bovis AF2122/97
cagcccgagcucgggugcgaac

SEQ ID NO: 3135628 - RNA, 16 nt, Mycobacterium bovis subsp bovis AF2122/97
cagcccgauacgggug

SEQ ID NO: 3135629 - RNA, 18 nt, Mycobacterium bovis subsp bovis AF2122/97
cagcccgaugaucccgcc

SEQ ID NO: 3135630 - RNA, 22 nt, Mycobacterium bovis subsp bovis AF2122/97
cagcccgaugaucccgccaccg

SEQ ID NO: 3135631 - RNA, 23 nt, Mycobacterium bovis subsp bovis AF2122/97
cagcccgaugaucccgccaccga

SEQ ID NO: 3135632 - RNA, 12 nt, Mycobacterium bovis subsp bovis AF2122/97
cagcccgaugcc

SEQ ID NO: 3135633 - RNA, 20 nt, Mycobacterium bovis subsp bovis AF2122/97
cagcccgaugccgugcccgg

SEQ ID NO: 3135634 - RNA, 13 nt, Mycobacterium bovis subsp bovis AF2122/97
cagccgccgacuu

SEQ ID NO: 3135635 - RNA, 22 nt, Mycobacterium bovis subsp bovis AF2122/97
cagccgccgacuuccgcgucgc

SEQ ID NO: 3135636 - RNA, 13 nt, Mycobacterium bovis subsp bovis AF2122/97
cagccgccgccgg

SEQ ID NO: 3135637 - RNA, 15 nt, Mycobacterium bovis subsp bovis AF2122/97
cagccgccgccggca

SEQ ID NO: 3135638 - RNA, 13 nt, Mycobacterium bovis subsp bovis AF2122/97
cagccgccgccug

SEQ ID NO: 3135639 - RNA, 14 nt, Mycobacterium bovis subsp bovis AF2122/97
cagccgccgcgccc

SEQ ID NO: 3135640 - RNA, 17 nt, Mycobacterium bovis subsp bovis AF2122/97
cagccgccgcgccccgc

SEQ ID NO: 3135641 - RNA, 14 nt, Mycobacterium bovis subsp bovis AF2122/97
cagccgccugucgg

SEQ ID NO: 3135642 - RNA, 21 nt, Mycobacterium bovis subsp bovis AF2122/97
cagccgcgacacgugcaucug

SEQ ID NO: 3135643 - RNA, 11 nt, Mycobacterium bovis subsp bovis AF2122/97
cagccgcgacc

SEQ ID NO: 3135644 - RNA, 19 nt, Mycobacterium bovis subsp bovis AF2122/97
cagccgcgaccgcagcugg

SEQ ID NO: 3135645 - RNA, 17 nt, Mycobacterium bovis subsp bovis AF2122/97
cagccgcgacgcggcgu

SEQ ID NO: 3135646 - RNA, 22 nt, Mycobacterium bovis subsp bovis AF2122/97
cagccgcgacgcggcgucgguc

SEQ ID NO: 3135647 - RNA, 15 nt, Mycobacterium bovis subsp bovis AF2122/97
cagccgcgagccggu

SEQ ID NO: 3135648 - RNA, 19 nt, Mycobacterium bovis subsp bovis AF2122/97
cagccgcgccagcuccgug

SEQ ID NO: 3135649 - RNA, 14 nt, Mycobacterium bovis subsp bovis AF2122/97
cagccgcgccgacc

SEQ ID NO: 3135650 - RNA, 12 nt, Mycobacterium bovis subsp bovis AF2122/97
cagccgcgccgc

SEQ ID NO: 3135651 - RNA, 18 nt, Mycobacterium bovis subsp bovis AF2122/97
cagccgcgccgcggcccg

SEQ ID NO: 3135652 - RNA, 13 nt, Mycobacterium bovis subsp bovis AF2122/97
cagccgcgccggg

SEQ ID NO: 3135653 - RNA, 14 nt, Mycobacterium bovis subsp bovis AF2122/97
cagccgcgccgggu

SEQ ID NO: 3135654 - RNA, 18 nt, Mycobacterium bovis subsp bovis AF2122/97
cagccgcgcgggucacga

SEQ ID NO: 3135655 - RNA, 13 nt, Mycobacterium bovis subsp bovis AF2122/97
cagccgcgcggug

SEQ ID NO: 3135656 - RNA, 14 nt, Mycobacterium bovis subsp bovis AF2122/97
cagccgcgcguccg

SEQ ID NO: 3135657 - RNA, 15 nt, Mycobacterium bovis subsp bovis AF2122/97
cagccgcggccacau

SEQ ID NO: 3135658 - RNA, 13 nt, Mycobacterium bovis subsp bovis AF2122/97
cagccgcggcgcc

SEQ ID NO: 3135659 - RNA, 23 nt, Mycobacterium bovis subsp bovis AF2122/97
cagccgcggcgccuccgcucggu

SEQ ID NO: 3135660 - RNA, 20 nt, Mycobacterium bovis subsp bovis AF2122/97
cagccgcggcggcagcaccc

SEQ ID NO: 3135661 - RNA, 14 nt, Mycobacterium bovis subsp bovis AF2122/97
cagccgcgggccgc

SEQ ID NO: 3135662 - RNA, 15 nt, Mycobacterium bovis subsp bovis AF2122/97
cagccgcucacccgg

SEQ ID NO: 3135663 - RNA, 14 nt, Mycobacterium bovis subsp bovis AF2122/97
cagccgcucgacgg

SEQ ID NO: 3135664 - RNA, 15 nt, Mycobacterium bovis subsp bovis AF2122/97
cagccgcucgacggc

SEQ ID NO: 3135665 - RNA, 16 nt, Mycobacterium bovis subsp bovis AF2122/97
cagccgcucgacggcc

SEQ ID NO: 3135666 - RNA, 18 nt, Mycobacterium bovis subsp bovis AF2122/97
cagccgcucgacggcccg

SEQ ID NO: 3135667 - RNA, 12 nt, Mycobacterium bovis subsp bovis AF2122/97
cagccgcucgca

SEQ ID NO: 3135668 - RNA, 12 nt, Mycobacterium bovis subsp bovis AF2122/97
cagccgcugauc

SEQ ID NO: 3135669 - RNA, 21 nt, Mycobacterium bovis subsp bovis AF2122/97
cagccgcugaucugccgccgc

SEQ ID NO: 3135670 - RNA, 18 nt, Mycobacterium bovis subsp bovis AF2122/97
cagccgcuuggcgcggcc

SEQ ID NO: 3135671 - RNA, 16 nt, Mycobacterium bovis subsp bovis AF2122/97
cagccggaccgcgacg

SEQ ID NO: 3135672 - RNA, 23 nt, Mycobacterium bovis subsp bovis AF2122/97
cagccggaccgcgacggcgccgg

SEQ ID NO: 3135673 - RNA, 14 nt, Mycobacterium bovis subsp bovis AF2122/97
cagccggaccgugu

SEQ ID NO: 3135674 - RNA, 16 nt, Mycobacterium bovis subsp bovis AF2122/97
cagccggaccguguac

SEQ ID NO: 3135675 - RNA, 22 nt, Mycobacterium bovis subsp bovis AF2122/97
cagccggauaaucauccgagcg

SEQ ID NO: 3135676 - RNA, 19 nt, Mycobacterium bovis subsp bovis AF2122/97
cagccggcagcagcgggcg

SEQ ID NO: 3135677 - RNA, 18 nt, Mycobacterium bovis subsp bovis AF2122/97
cagccggcauagcggccc

SEQ ID NO: 3135678 - RNA, 19 nt, Mycobacterium bovis subsp bovis AF2122/97
cagccggccaauggccugc

SEQ ID NO: 3135679 - RNA, 23 nt, Mycobacterium bovis subsp bovis AF2122/97
cagccggccaauggccugcagcg

SEQ ID NO: 3135680 - RNA, 20 nt, Mycobacterium bovis subsp bovis AF2122/97
cagccggccauacgcgcgcg

SEQ ID NO: 3135681 - RNA, 21 nt, Mycobacterium bovis subsp bovis AF2122/97
cagccggccauacgcgcgcgg

SEQ ID NO: 3135682 - RNA, 13 nt, Mycobacterium bovis subsp bovis AF2122/97
cagccggcccugc

SEQ ID NO: 3135683 - RNA, 14 nt, Mycobacterium bovis subsp bovis AF2122/97
cagccggccgcgac

SEQ ID NO: 3135684 - RNA, 17 nt, Mycobacterium bovis subsp bovis AF2122/97
cagccggccugucccgc

SEQ ID NO: 3135685 - RNA, 23 nt, Mycobacterium bovis subsp bovis AF2122/97
cagccggccugucccgcacccgg

SEQ ID NO: 3135686 - RNA, 18 nt, Mycobacterium bovis subsp bovis AF2122/97
cagccggcgcacucccgg

SEQ ID NO: 3135687 - RNA, 22 nt, Mycobacterium bovis subsp bovis AF2122/97
cagccggcggagaaggcgacca

SEQ ID NO: 3135688 - RNA, 17 nt, Mycobacterium bovis subsp bovis AF2122/97
cagccggcuugggcggu

SEQ ID NO: 3135689 - RNA, 18 nt, Mycobacterium bovis subsp bovis AF2122/97
cagccgggcaaggcccgg

SEQ ID NO: 3135690 - RNA, 13 nt, Mycobacterium bovis subsp bovis AF2122/97
cagccgggcacca

SEQ ID NO: 3135691 - RNA, 18 nt, Mycobacterium bovis subsp bovis AF2122/97
cagccgggcggcagcggc

SEQ ID NO: 3135692 - RNA, 15 nt, Mycobacterium bovis subsp bovis AF2122/97
cagccgggcgucgcu

SEQ ID NO: 3135693 - RNA, 17 nt, Mycobacterium bovis subsp bovis AF2122/97
cagccgggcgucgcugg

SEQ ID NO: 3135694 - RNA, 19 nt, Mycobacterium bovis subsp bovis AF2122/97
cagccgggucuacagcguu

SEQ ID NO: 3135695 - RNA, 17 nt, Mycobacterium bovis subsp bovis AF2122/97
cagccgggugcgcaccc

SEQ ID NO: 3135696 - RNA, 12 nt, Mycobacterium bovis subsp bovis AF2122/97
cagccgguccag

SEQ ID NO: 3135697 - RNA, 16 nt, Mycobacterium bovis subsp bovis AF2122/97
cagccgguccagaccc

SEQ ID NO: 3135698 - RNA, 20 nt, Mycobacterium bovis subsp bovis AF2122/97
cagccgguccagacccagcu

SEQ ID NO: 3135699 - RNA, 23 nt, Mycobacterium bovis subsp bovis AF2122/97
cagccgguccagcagcucggccg

SEQ ID NO: 3135700 - RNA, 24 nt, Mycobacterium bovis subsp bovis AF2122/97
cagccgguccagcagcucggccga

SEQ ID NO: 3135701 - RNA, 16 nt, Mycobacterium bovis subsp bovis AF2122/97
cagccggugacguggu

SEQ ID NO: 3135702 - RNA, 18 nt, Mycobacterium bovis subsp bovis AF2122/97
cagccggugacguggugg

SEQ ID NO: 3135703 - RNA, 14 nt, Mycobacterium bovis subsp bovis AF2122/97
cagccggugccgcc

SEQ ID NO: 3135704 - RNA, 16 nt, Mycobacterium bovis subsp bovis AF2122/97
cagccggugccgccgu

SEQ ID NO: 3135705 - RNA, 17 nt, Mycobacterium bovis subsp bovis AF2122/97
cagccggugcgcugguu

SEQ ID NO: 3135706 - RNA, 20 nt, Mycobacterium bovis subsp bovis AF2122/97
cagccgguggucugcgcggu

SEQ ID NO: 3135707 - RNA, 21 nt, Mycobacterium bovis subsp bovis AF2122/97
cagccgguggucugcgcggug

SEQ ID NO: 3135708 - RNA, 16 nt, Mycobacterium bovis subsp bovis AF2122/97
cagccgguuaauggaa

SEQ ID NO: 3135709 - RNA, 20 nt, Mycobacterium bovis subsp bovis AF2122/97
cagccgguuggcugccggca

SEQ ID NO: 3135710 - RNA, 23 nt, Mycobacterium bovis subsp bovis AF2122/97
cagccguauugccuaucgacaac

SEQ ID NO: 3135711 - RNA, 16 nt, Mycobacterium bovis subsp bovis AF2122/97
cagccgucaccgcgac

SEQ ID NO: 3135712 - RNA, 17 nt, Mycobacterium bovis subsp bovis AF2122/97
cagccgucaccgcgacc

SEQ ID NO: 3135713 - RNA, 18 nt, Mycobacterium bovis subsp bovis AF2122/97
cagccgucaccgcgaccc

SEQ ID NO: 3135714 - RNA, 22 nt, Mycobacterium bovis subsp bovis AF2122/97
cagccgucaccgcgaccccugg

SEQ ID NO: 3135715 - RNA, 12 nt, Mycobacterium bovis subsp bovis AF2122/97
cagccguccggg

SEQ ID NO: 3135716 - RNA, 23 nt, Mycobacterium bovis subsp bovis AF2122/97
cagccguccgggcggccucccgg

SEQ ID NO: 3135717 - RNA, 14 nt, Mycobacterium bovis subsp bovis AF2122/97
cagccgucgcacca

SEQ ID NO: 3135718 - RNA, 14 nt, Mycobacterium bovis subsp bovis AF2122/97
cagccgucggcgcu

SEQ ID NO: 3135719 - RNA, 17 nt, Mycobacterium bovis subsp bovis AF2122/97
cagccgucggcgcugcg

SEQ ID NO: 3135720 - RNA, 22 nt, Mycobacterium bovis subsp bovis AF2122/97
cagccgucggcgcugcgcgcga

SEQ ID NO: 3135721 - RNA, 19 nt, Mycobacterium bovis subsp bovis AF2122/97
cagcgagaucagcaugccc

SEQ ID NO: 3135722 - RNA, 15 nt, Mycobacterium bovis subsp bovis AF2122/97
cagcgagcacacucc

SEQ ID NO: 3135723 - RNA, 17 nt, Mycobacterium bovis subsp bovis AF2122/97
cagcgagcauaccgccg

SEQ ID NO: 3135724 - RNA, 19 nt, Mycobacterium bovis subsp bovis AF2122/97
cagcgagcauaccgccgcu

SEQ ID NO: 3135725 - RNA, 23 nt, Mycobacterium bovis subsp bovis AF2122/97
cagcgagcccagcugcgccgaac

SEQ ID NO: 3135726 - RNA, 15 nt, Mycobacterium bovis subsp bovis AF2122/97
cagcgagcgccaggu

SEQ ID NO: 3135727 - RNA, 23 nt, Mycobacterium bovis subsp bovis AF2122/97
cagcgaggaauuccgcuaccgca

SEQ ID NO: 3135728 - RNA, 15 nt, Mycobacterium bovis subsp bovis AF2122/97
cagcgaggagcaggg

SEQ ID NO: 3135729 - RNA, 14 nt, Mycobacterium bovis subsp bovis AF2122/97
cagcgaggccagcg

SEQ ID NO: 3135730 - RNA, 15 nt, Mycobacterium bovis subsp bovis AF2122/97
cagcgaggccagcgg

SEQ ID NO: 3135731 - RNA, 16 nt, Mycobacterium bovis subsp bovis AF2122/97
cagcgaggccagcggu

SEQ ID NO: 3135732 - RNA, 14 nt, Mycobacterium bovis subsp bovis AF2122/97
cagcgagucgacgu

SEQ ID NO: 3135733 - RNA, 24 nt, Mycobacterium bovis subsp bovis AF2122/97
cagcgagucgggguacaggcugcu

SEQ ID NO: 3135734 - RNA, 17 nt, Mycobacterium bovis subsp bovis AF2122/97
cagcgaguugagcaugu

SEQ ID NO: 3135735 - RNA, 23 nt, Mycobacterium bovis subsp bovis AF2122/97
cagcgauauccacaauccgcucg

SEQ ID NO: 3135736 - RNA, 17 nt, Mycobacterium bovis subsp bovis AF2122/97
cagcgauaucggcggcu

SEQ ID NO: 3135737 - RNA, 14 nt, Mycobacterium bovis subsp bovis AF2122/97
cagcgauccaccaa

SEQ ID NO: 3135738 - RNA, 20 nt, Mycobacterium bovis subsp bovis AF2122/97
cagcgaucccggcaacaacg

SEQ ID NO: 3135739 - RNA, 15 nt, Mycobacterium bovis subsp bovis AF2122/97
cagcgaucccgguga

SEQ ID NO: 3135740 - RNA, 20 nt, Mycobacterium bovis subsp bovis AF2122/97
cagcgaucuugguggccuca

SEQ ID NO: 3135741 - RNA, 15 nt, Mycobacterium bovis subsp bovis AF2122/97
cagcgaugacgacca

SEQ ID NO: 3135742 - RNA, 20 nt, Mycobacterium bovis subsp bovis AF2122/97
cagcgaugcgcucacugcag

SEQ ID NO: 3135743 - RNA, 14 nt, Mycobacterium bovis subsp bovis AF2122/97
cagcgaugcggcgu

SEQ ID NO: 3135744 - RNA, 17 nt, Mycobacterium bovis subsp bovis AF2122/97
cagcgaugcggcguugg

SEQ ID NO: 3135745 - RNA, 15 nt, Mycobacterium bovis subsp bovis AF2122/97
cagcgaugcgguguc

SEQ ID NO: 3135746 - RNA, 16 nt, Mycobacterium bovis subsp bovis AF2122/97
cagcgaugcucacuac

SEQ ID NO: 3135747 - RNA, 23 nt, Mycobacterium bovis subsp bovis AF2122/97
cagcgauggguguugcuggccgc

SEQ ID NO: 3135748 - RNA, 20 nt, Mycobacterium bovis subsp bovis AF2122/97
cagcgcaaaaucaccggugu

SEQ ID NO: 3135749 - RNA, 23 nt, Mycobacterium bovis subsp bovis AF2122/97
cagcgcaaacaucuugucgaucu

SEQ ID NO: 3135750 - RNA, 14 nt, Mycobacterium bovis subsp bovis AF2122/97
cagcgcaacaucga

SEQ ID NO: 3135751 - RNA, 18 nt, Mycobacterium bovis subsp bovis AF2122/97
cagcgcaacaucgaaaac

SEQ ID NO: 3135752 - RNA, 21 nt, Mycobacterium bovis subsp bovis AF2122/97
cagcgcaaugcaucgcggcgg

SEQ ID NO: 3135753 - RNA, 22 nt, Mycobacterium bovis subsp bovis AF2122/97
cagcgcaaugcaucgcggcggc

SEQ ID NO: 3135754 - RNA, 18 nt, Mycobacterium bovis subsp bovis AF2122/97
cagcgcacacuaccgccg

SEQ ID NO: 3135755 - RNA, 20 nt, Mycobacterium bovis subsp bovis AF2122/97
cagcgcacccggucggcggc

SEQ ID NO: 3135756 - RNA, 21 nt, Mycobacterium bovis subsp bovis AF2122/97
cagcgcacccggucggcggca

SEQ ID NO: 3135757 - RNA, 13 nt, Mycobacterium bovis subsp bovis AF2122/97
cagcgcaccggcg

SEQ ID NO: 3135758 - RNA, 16 nt, Mycobacterium bovis subsp bovis AF2122/97
cagcgcaccggcguuc

SEQ ID NO: 3135759 - RNA, 22 nt, Mycobacterium bovis subsp bovis AF2122/97
cagcgcaccggcguucaccugc

SEQ ID NO: 3135760 - RNA, 17 nt, Mycobacterium bovis subsp bovis AF2122/97
cagcgcaccggugaugg

SEQ ID NO: 3135761 - RNA, 21 nt, Mycobacterium bovis subsp bovis AF2122/97
cagcgcacgauagccaccgac

SEQ ID NO: 3135762 - RNA, 22 nt, Mycobacterium bovis subsp bovis AF2122/97
cagcgcacgauagccaccgacg

SEQ ID NO: 3135763 - RNA, 14 nt, Mycobacterium bovis subsp bovis AF2122/97
cagcgcacgcagcc

SEQ ID NO: 3135764 - RNA, 16 nt, Mycobacterium bovis subsp bovis AF2122/97
cagcgcacgcagccga

SEQ ID NO: 3135765 - RNA, 15 nt, Mycobacterium bovis subsp bovis AF2122/97
cagcgcacgcucggc

SEQ ID NO: 3135766 - RNA, 18 nt, Mycobacterium bovis subsp bovis AF2122/97
cagcgcacgcucggcacg

SEQ ID NO: 3135767 - RNA, 14 nt, Mycobacterium bovis subsp bovis AF2122/97
cagcgcacggacca

SEQ ID NO: 3135768 - RNA, 20 nt, Mycobacterium bovis subsp bovis AF2122/97
cagcgcacggaccaucgcca

SEQ ID NO: 3135769 - RNA, 21 nt, Mycobacterium bovis subsp bovis AF2122/97
cagcgcacggaccaucgccag

SEQ ID NO: 3135770 - RNA, 19 nt, Mycobacterium bovis subsp bovis AF2122/97
cagcgcacuacucgaacaa

SEQ ID NO: 3135771 - RNA, 20 nt, Mycobacterium bovis subsp bovis AF2122/97
cagcgcacuacucgaacaac

SEQ ID NO: 3135772 - RNA, 22 nt, Mycobacterium bovis subsp bovis AF2122/97
cagcgcacuacucgaacaaccc

SEQ ID NO: 3135773 - RNA, 16 nt, Mycobacterium bovis subsp bovis AF2122/97
cagcgcacugcccggg

SEQ ID NO: 3135774 - RNA, 15 nt, Mycobacterium bovis subsp bovis AF2122/97
cagcgcacuggccgc

SEQ ID NO: 3135775 - RNA, 16 nt, Mycobacterium bovis subsp bovis AF2122/97
cagcgcacuggccgcu

SEQ ID NO: 3135776 - RNA, 23 nt, Mycobacterium bovis subsp bovis AF2122/97
cagcgcagcaacugggcggccug

SEQ ID NO: 3135777 - RNA, 16 nt, Mycobacterium bovis subsp bovis AF2122/97
cagcgcagcagcggca

SEQ ID NO: 3135778 - RNA, 18 nt, Mycobacterium bovis subsp bovis AF2122/97
cagcgcagcaucgucgcc

SEQ ID NO: 3135779 - RNA, 21 nt, Mycobacterium bovis subsp bovis AF2122/97
cagcgcagcaucgucgccacg

SEQ ID NO: 3135780 - RNA, 15 nt, Mycobacterium bovis subsp bovis AF2122/97
cagcgcagccgaucg

SEQ ID NO: 3135781 - RNA, 22 nt, Mycobacterium bovis subsp bovis AF2122/97
cagcgcaggauucugcugacca

SEQ ID NO: 3135782 - RNA, 18 nt, Mycobacterium bovis subsp bovis AF2122/97
cagcgcaggguucgucgg

SEQ ID NO: 3135783 - RNA, 20 nt, Mycobacterium bovis subsp bovis AF2122/97
cagcgcaguaacgucgucgc

SEQ ID NO: 3135784 - RNA, 22 nt, Mycobacterium bovis subsp bovis AF2122/97
cagcgcagucugauuccacauc

SEQ ID NO: 3135785 - RNA, 23 nt, Mycobacterium bovis subsp bovis AF2122/97
cagcgcagucugauuccacauca

SEQ ID NO: 3135786 - RNA, 13 nt, Mycobacterium bovis subsp bovis AF2122/97
cagcgcagugccu

SEQ ID NO: 3135787 - RNA, 16 nt, Mycobacterium bovis subsp bovis AF2122/97
cagcgcauccacaauc

SEQ ID NO: 3135788 - RNA, 18 nt, Mycobacterium bovis subsp bovis AF2122/97
cagcgcauccacaaucac

SEQ ID NO: 3135789 - RNA, 14 nt, Mycobacterium bovis subsp bovis AF2122/97
cagcgcaucgccgc

SEQ ID NO: 3135790 - RNA, 15 nt, Mycobacterium bovis subsp bovis AF2122/97
cagcgcaucgccgcu

SEQ ID NO: 3135791 - RNA, 14 nt, Mycobacterium bovis subsp bovis AF2122/97
cagcgcaucggcca

SEQ ID NO: 3135792 - RNA, 17 nt, Mycobacterium bovis subsp bovis AF2122/97
cagcgcaucggccagca

SEQ ID NO: 3135793 - RNA, 18 nt, Mycobacterium bovis subsp bovis AF2122/97
cagcgcauuuuccacauc

SEQ ID NO: 3135794 - RNA, 18 nt, Mycobacterium bovis subsp bovis AF2122/97
cagcgccaacgcccccau

SEQ ID NO: 3135795 - RNA, 19 nt, Mycobacterium bovis subsp bovis AF2122/97
cagcgccaacgcccccauc

SEQ ID NO: 3135796 - RNA, 20 nt, Mycobacterium bovis subsp bovis AF2122/97
cagcgccaagacgucggcgu

SEQ ID NO: 3135797 - RNA, 17 nt, Mycobacterium bovis subsp bovis AF2122/97
cagcgccaaugucagcu

SEQ ID NO: 3135798 - RNA, 21 nt, Mycobacterium bovis subsp bovis AF2122/97
cagcgccacauacaccggccg

SEQ ID NO: 3135799 - RNA, 22 nt, Mycobacterium bovis subsp bovis AF2122/97
cagcgccacauacaccggccgg

SEQ ID NO: 3135800 - RNA, 23 nt, Mycobacterium bovis subsp bovis AF2122/97
cagcgccacauacaccggccggu

SEQ ID NO: 3135801 - RNA, 13 nt, Mycobacterium bovis subsp bovis AF2122/97
cagcgccacccga

SEQ ID NO: 3135802 - RNA, 16 nt, Mycobacterium bovis subsp bovis AF2122/97
cagcgccacccgaucg

SEQ ID NO: 3135803 - RNA, 18 nt, Mycobacterium bovis subsp bovis AF2122/97
cagcgccacccgaucggg

SEQ ID NO: 3135804 - RNA, 20 nt, Mycobacterium bovis subsp bovis AF2122/97
cagcgccacccgaucgggcg

SEQ ID NO: 3135805 - RNA, 13 nt, Mycobacterium bovis subsp bovis AF2122/97
cagcgccacccgg

SEQ ID NO: 3135806 - RNA, 16 nt, Mycobacterium bovis subsp bovis AF2122/97
cagcgccacccggucc

SEQ ID NO: 3135807 - RNA, 16 nt, Mycobacterium bovis subsp bovis AF2122/97
cagcgcgaacgccugc

SEQ ID NO: 3135808 - RNA, 18 nt, Mycobacterium bovis subsp bovis AF2122/97
cagcgcgaaggucagcga

SEQ ID NO: 3135809 - RNA, 22 nt, Mycobacterium bovis subsp bovis AF2122/97
cagcgcgacaaaguucgacgag

SEQ ID NO: 3135810 - RNA, 12 nt, Mycobacterium bovis subsp bovis AF2122/97
cagcgcgacggu

SEQ ID NO: 3135811 - RNA, 17 nt, Mycobacterium bovis subsp bovis AF2122/97
cagcgcgacguccacca

SEQ ID NO: 3135812 - RNA, 21 nt, Mycobacterium bovis subsp bovis AF2122/97
cagcgcgacguccaccagccg

SEQ ID NO: 3135813 - RNA, 21 nt, Mycobacterium bovis subsp bovis AF2122/97
cagcgcgagaucagccggcag

SEQ ID NO: 3135814 - RNA, 19 nt, Mycobacterium bovis subsp bovis AF2122/97
cagcgcgaucaacgcguug

SEQ ID NO: 3135815 - RNA, 13 nt, Mycobacterium bovis subsp bovis AF2122/97
cagcgcgaucacc

SEQ ID NO: 3135816 - RNA, 15 nt, Mycobacterium bovis subsp bovis AF2122/97
cagcgcgaucaccga

SEQ ID NO: 3135817 - RNA, 19 nt, Mycobacterium bovis subsp bovis AF2122/97
cagcgcgaucugcucgccc

SEQ ID NO: 3135818 - RNA, 20 nt, Mycobacterium bovis subsp bovis AF2122/97
cagcgcgaucugcucgcccc

SEQ ID NO: 3135819 - RNA, 14 nt, Mycobacterium bovis subsp bovis AF2122/97
cagcgcgaugucgc

SEQ ID NO: 3135820 - RNA, 17 nt, Mycobacterium bovis subsp bovis AF2122/97
cagcgcgaugucgccgg

SEQ ID NO: 3135821 - RNA, 16 nt, Mycobacterium bovis subsp bovis AF2122/97
cagcgcgcacacggcu

SEQ ID NO: 3135822 - RNA, 12 nt, Mycobacterium bovis subsp bovis AF2122/97
cagcgcgccacc

SEQ ID NO: 3135823 - RNA, 13 nt, Mycobacterium bovis subsp bovis AF2122/97
cagcgcgccagcu

SEQ ID NO: 3135824 - RNA, 15 nt, Mycobacterium bovis subsp bovis AF2122/97
cagcgcgccagcuug

SEQ ID NO: 3135825 - RNA, 12 nt, Mycobacterium bovis subsp bovis AF2122/97
cagcgcgcccgc

SEQ ID NO: 3135826 - RNA, 17 nt, Mycobacterium bovis subsp bovis AF2122/97
cagcgcgcccgcggccg

SEQ ID NO: 3135827 - RNA, 21 nt, Mycobacterium bovis subsp bovis AF2122/97
cagcgcgcccgcggccgccag

SEQ ID NO: 3135828 - RNA, 13 nt, Mycobacterium bovis subsp bovis AF2122/97
cagcgcgccggcg

SEQ ID NO: 3135829 - RNA, 14 nt, Mycobacterium bovis subsp bovis AF2122/97
cagcgcgccggcgu

SEQ ID NO: 3135830 - RNA, 17 nt, Mycobacterium bovis subsp bovis AF2122/97
cagcgcgccggcgucgg

SEQ ID NO: 3135831 - RNA, 14 nt, Mycobacterium bovis subsp bovis AF2122/97
cagcgcgccguaga

SEQ ID NO: 3135832 - RNA, 16 nt, Mycobacterium bovis subsp bovis AF2122/97
cagcgcgcgccgagcc

SEQ ID NO: 3135833 - RNA, 13 nt, Mycobacterium bovis subsp bovis AF2122/97
cagcgcgcgccgc

SEQ ID NO: 3135834 - RNA, 15 nt, Mycobacterium bovis subsp bovis AF2122/97
cagcgcgcgccgcug

SEQ ID NO: 3135835 - RNA, 16 nt, Mycobacterium bovis subsp bovis AF2122/97
cagcgcgcgcugagcc

SEQ ID NO: 3135836 - RNA, 14 nt, Mycobacterium bovis subsp bovis AF2122/97
cagcgcgcugcagu

SEQ ID NO: 3135837 - RNA, 17 nt, Mycobacterium bovis subsp bovis AF2122/97
cagcgcgcugcgcgacu

SEQ ID NO: 3135838 - RNA, 14 nt, Mycobacterium bovis subsp bovis AF2122/97
cagcgcggcaccca

SEQ ID NO: 3135839 - RNA, 22 nt, Mycobacterium bovis subsp bovis AF2122/97
cagcgcggccaauugcgccgcc

SEQ ID NO: 3135840 - RNA, 13 nt, Mycobacterium bovis subsp bovis AF2122/97
cagcgcggccacg

SEQ ID NO: 3135841 - RNA, 13 nt, Mycobacterium bovis subsp bovis AF2122/97
cagcgcggccagu

SEQ ID NO: 3135842 - RNA, 20 nt, Mycobacterium bovis subsp bovis AF2122/97
cagcgcggccauuagcagca

SEQ ID NO: 3135843 - RNA, 23 nt, Mycobacterium bovis subsp bovis AF2122/97
cagcgcggccggaauacccggcc

SEQ ID NO: 3135844 - RNA, 19 nt, Mycobacterium bovis subsp bovis AF2122/97
cagcgcggccgggcgcccu

SEQ ID NO: 3135845 - RNA, 18 nt, Mycobacterium bovis subsp bovis AF2122/97
cagcgcggcgagggcggu

SEQ ID NO: 3135846 - RNA, 15 nt, Mycobacterium bovis subsp bovis AF2122/97
cagcgcggcgcacaa

SEQ ID NO: 3135847 - RNA, 18 nt, Mycobacterium bovis subsp bovis AF2122/97
cagcgcggcgcacaaccc

SEQ ID NO: 3135848 - RNA, 21 nt, Mycobacterium bovis subsp bovis AF2122/97
cagcgcggcgcccuggccgcc

SEQ ID NO: 3135849 - RNA, 16 nt, Mycobacterium bovis subsp bovis AF2122/97
cagcgcggcgcgacag

SEQ ID NO: 3135850 - RNA, 18 nt, Mycobacterium bovis subsp bovis AF2122/97
cagcgcggcgucgccuug

SEQ ID NO: 3135851 - RNA, 15 nt, Mycobacterium bovis subsp bovis AF2122/97
cagcgcggcuggggc

SEQ ID NO: 3135852 - RNA, 20 nt, Mycobacterium bovis subsp bovis AF2122/97
cagcgcggcuggggccccgc

SEQ ID NO: 3135853 - RNA, 18 nt, Mycobacterium bovis subsp bovis AF2122/97
cagcgcgggacacgucgc

SEQ ID NO: 3135854 - RNA, 21 nt, Mycobacterium bovis subsp bovis AF2122/97
cagcgcgggacacgucgcgcc

SEQ ID NO: 3135855 - RNA, 22 nt, Mycobacterium bovis subsp bovis AF2122/97
cagcgcgggacacgucgcgcca

SEQ ID NO: 3135856 - RNA, 20 nt, Mycobacterium bovis subsp bovis AF2122/97
cagcgcgguggucagcaccg

SEQ ID NO: 3135857 - RNA, 23 nt, Mycobacterium bovis subsp bovis AF2122/97
cagcgcgguguagagcgcaccgc

SEQ ID NO: 3135858 - RNA, 21 nt, Mycobacterium bovis subsp bovis AF2122/97
cagcgcguagcgggcgcccuu

SEQ ID NO: 3135859 - RNA, 18 nt, Mycobacterium bovis subsp bovis AF2122/97
cagcgcguaguccgcauc

SEQ ID NO: 3135860 - RNA, 21 nt, Mycobacterium bovis subsp bovis AF2122/97
cagcgcguauggcucaccccg

SEQ ID NO: 3135861 - RNA, 16 nt, Mycobacterium bovis subsp bovis AF2122/97
cagcgcgucgccgaaa

SEQ ID NO: 3135862 - RNA, 20 nt, Mycobacterium bovis subsp bovis AF2122/97
cagcgcgucgccgaaagccu

SEQ ID NO: 3135863 - RNA, 17 nt, Mycobacterium bovis subsp bovis AF2122/97
cagcgcgucggagccgg

SEQ ID NO: 3135864 - RNA, 15 nt, Mycobacterium bovis subsp bovis AF2122/97
cagcgcgucguccag

SEQ ID NO: 3135865 - RNA, 20 nt, Mycobacterium bovis subsp bovis AF2122/97
cagcgcgucguccagggcga

SEQ ID NO: 3135866 - RNA, 22 nt, Mycobacterium bovis subsp bovis AF2122/97
cagcgcgucucguugauacggc

SEQ ID NO: 3135867 - RNA, 19 nt, Mycobacterium bovis subsp bovis AF2122/97
cagcgcgugcuguggaugc

SEQ ID NO: 3135868 - RNA, 13 nt, Mycobacterium bovis subsp bovis AF2122/97
cagcgcguggaac

SEQ ID NO: 3135869 - RNA, 14 nt, Mycobacterium bovis subsp bovis AF2122/97
cagcgcguggaacu

SEQ ID NO: 3135870 - RNA, 23 nt, Mycobacterium bovis subsp bovis AF2122/97
cagcgcguggaacuugcgcaggu

SEQ ID NO: 3135871 - RNA, 19 nt, Mycobacterium bovis subsp bovis AF2122/97
cagcgcgugguaccgcuug

SEQ ID NO: 3135872 - RNA, 13 nt, Mycobacterium bovis subsp bovis AF2122/97
cagcgcuagccgg

SEQ ID NO: 3135873 - RNA, 20 nt, Mycobacterium bovis subsp bovis AF2122/97
cagcgcuagccgggcgcgcc

SEQ ID NO: 3135874 - RNA, 22 nt, Mycobacterium bovis subsp bovis AF2122/97
cagcgcuagccgggcgcgccgg

SEQ ID NO: 3135875 - RNA, 16 nt, Mycobacterium bovis subsp bovis AF2122/97
cagcgcucaccggcgu

SEQ ID NO: 3135876 - RNA, 15 nt, Mycobacterium bovis subsp bovis AF2122/97
cagcgcuccagcacc

SEQ ID NO: 3135877 - RNA, 16 nt, Mycobacterium bovis subsp bovis AF2122/97
cagcgcuccagcaccc

SEQ ID NO: 3135878 - RNA, 19 nt, Mycobacterium bovis subsp bovis AF2122/97
cagcgcuccagccgcgcgu

SEQ ID NO: 3135879 - RNA, 14 nt, Mycobacterium bovis subsp bovis AF2122/97
cagcgcugaccggc

SEQ ID NO: 3135880 - RNA, 18 nt, Mycobacterium bovis subsp bovis AF2122/97
cagcgcugagccgcucau

SEQ ID NO: 3135881 - RNA, 21 nt, Mycobacterium bovis subsp bovis AF2122/97
cagcgcugagccgcucaucga

SEQ ID NO: 3135882 - RNA, 17 nt, Mycobacterium bovis subsp bovis AF2122/97
cagcgcugccaccgcgg

SEQ ID NO: 3135883 - RNA, 18 nt, Mycobacterium bovis subsp bovis AF2122/97
cagcgcugccaccgcggu

SEQ ID NO: 3135884 - RNA, 21 nt, Mycobacterium bovis subsp bovis AF2122/97
cagcgcugccaccgcgguggc

SEQ ID NO: 3135885 - RNA, 14 nt, Mycobacterium bovis subsp bovis AF2122/97
cagcgcugcgaugg

SEQ ID NO: 3135886 - RNA, 17 nt, Mycobacterium bovis subsp bovis AF2122/97
cagcgcuggcaggccgg

SEQ ID NO: 3135887 - RNA, 16 nt, Mycobacterium bovis subsp bovis AF2122/97
cagcgcugggcccagg

SEQ ID NO: 3135888 - RNA, 19 nt, Mycobacterium bovis subsp bovis AF2122/97
cagcgcugucguaccgcgg

SEQ ID NO: 3135889 - RNA, 17 nt, Mycobacterium bovis subsp bovis AF2122/97
cagcgcuucacgggccg

SEQ ID NO: 3135890 - RNA, 21 nt, Mycobacterium bovis subsp bovis AF2122/97
cagcgcuucacgggccgucca

SEQ ID NO: 3135891 - RNA, 19 nt, Mycobacterium bovis subsp bovis AF2122/97
cagcgcuucggcggucgcc

SEQ ID NO: 3135892 - RNA, 15 nt, Mycobacterium bovis subsp bovis AF2122/97
cagcgcuucgucggc

SEQ ID NO: 3135893 - RNA, 16 nt, Mycobacterium bovis subsp bovis AF2122/97
cagcgcuucgucggcc

SEQ ID NO: 3135894 - RNA, 20 nt, Mycobacterium bovis subsp bovis AF2122/97
cagcggcucuauccggcgca

SEQ ID NO: 3135895 - RNA, 13 nt, Mycobacterium bovis subsp bovis AF2122/97
cagcggcugccca

SEQ ID NO: 3135896 - RNA, 12 nt, Mycobacterium bovis subsp bovis AF2122/97
cagcggcugggc

SEQ ID NO: 3135897 - RNA, 17 nt, Mycobacterium bovis subsp bovis AF2122/97
cagcggcuugcccaggc

SEQ ID NO: 3135898 - RNA, 18 nt, Mycobacterium bovis subsp bovis AF2122/97
cagcggcuugcccaggcg

SEQ ID NO: 3135899 - RNA, 15 nt, Mycobacterium bovis subsp bovis AF2122/97
cagcgggacaaaauc

SEQ ID NO: 3135900 - RNA, 21 nt, Mycobacterium bovis subsp bovis AF2122/97
cagcgggacugcggaagccac

SEQ ID NO: 3135901 - RNA, 14 nt, Mycobacterium bovis subsp bovis AF2122/97
cagcgggcacgccg

SEQ ID NO: 3135902 - RNA, 17 nt, Mycobacterium bovis subsp bovis AF2122/97
cagcgggcacgccgccg

SEQ ID NO: 3135903 - RNA, 17 nt, Mycobacterium bovis subsp bovis AF2122/97
cagcgggcagcaggcga

SEQ ID NO: 3135904 - RNA, 19 nt, Mycobacterium bovis subsp bovis AF2122/97
cagcgggcagcaggcgaug

SEQ ID NO: 3135905 - RNA, 17 nt, Mycobacterium bovis subsp bovis AF2122/97
cagcgggccgaagcccc

SEQ ID NO: 3135906 - RNA, 19 nt, Mycobacterium bovis subsp bovis AF2122/97
cagcgggcgaugagcgcga

SEQ ID NO: 3135907 - RNA, 12 nt, Mycobacterium bovis subsp bovis AF2122/97
cagcgggcgcgc

SEQ ID NO: 3135908 - RNA, 21 nt, Mycobacterium bovis subsp bovis AF2122/97
cagcgggcggugucgucaucg

SEQ ID NO: 3135909 - RNA, 14 nt, Mycobacterium bovis subsp bovis AF2122/97
cagcgggcugcgcu

SEQ ID NO: 3135910 - RNA, 13 nt, Mycobacterium bovis subsp bovis AF2122/97
cagcgggcuggcg

SEQ ID NO: 3135911 - RNA, 14 nt, Mycobacterium bovis subsp bovis AF2122/97
cagcgggcuggcga

SEQ ID NO: 3135912 - RNA, 18 nt, Mycobacterium bovis subsp bovis AF2122/97
cagcggggucuugacggc

SEQ ID NO: 3135913 - RNA, 14 nt, Mycobacterium bovis subsp bovis AF2122/97
cagcggguccccgg

SEQ ID NO: 3135914 - RNA, 24 nt, Mycobacterium bovis subsp bovis AF2122/97
cagcggguccccggucaggacggc

SEQ ID NO: 3135915 - RNA, 14 nt, Mycobacterium bovis subsp bovis AF2122/97
cagcgggucgccgg

SEQ ID NO: 3135916 - RNA, 13 nt, Mycobacterium bovis subsp bovis AF2122/97
cagcgggucgcgg

SEQ ID NO: 3135917 - RNA, 20 nt, Mycobacterium bovis subsp bovis AF2122/97
cagcgggucgcgggugccga

SEQ ID NO: 3135918 - RNA, 20 nt, Mycobacterium bovis subsp bovis AF2122/97
cagcgggugaaucgacaccg

SEQ ID NO: 3135919 - RNA, 21 nt, Mycobacterium bovis subsp bovis AF2122/97
cagcgggugaaucgacaccgc

SEQ ID NO: 3135920 - RNA, 17 nt, Mycobacterium bovis subsp bovis AF2122/97
cagcgggugagagaaaa

SEQ ID NO: 3135921 - RNA, 20 nt, Mycobacterium bovis subsp bovis AF2122/97
cagcggguucaacgcgcgca

SEQ ID NO: 3135922 - RNA, 17 nt, Mycobacterium bovis subsp bovis AF2122/97
cagcggguuugccgggc

SEQ ID NO: 3135923 - RNA, 19 nt, Mycobacterium bovis subsp bovis AF2122/97
cagcggguuugccgggcgc

SEQ ID NO: 3135924 - RNA, 20 nt, Mycobacterium bovis subsp bovis AF2122/97
cagcggguuugccgggcgcu

SEQ ID NO: 3135925 - RNA, 22 nt, Mycobacterium bovis subsp bovis AF2122/97
cagcgguaaugccagcggcaca

SEQ ID NO: 3135926 - RNA, 19 nt, Mycobacterium bovis subsp bovis AF2122/97
cagcgguaucccccagccg

SEQ ID NO: 3135927 - RNA, 22 nt, Mycobacterium bovis subsp bovis AF2122/97
cagcgguaucccccagccgcgg

SEQ ID NO: 3135928 - RNA, 24 nt, Mycobacterium bovis subsp bovis AF2122/97
cagcgguaucccccagccgcggcg

SEQ ID NO: 3135929 - RNA, 13 nt, Mycobacterium bovis subsp bovis AF2122/97
cagcggucagccg

SEQ ID NO: 3135930 - RNA, 17 nt, Mycobacterium bovis subsp bovis AF2122/97
cagcgguccagccaccg

SEQ ID NO: 3135931 - RNA, 18 nt, Mycobacterium bovis subsp bovis AF2122/97
cagcgguccagccaccgc

SEQ ID NO: 3135932 - RNA, 14 nt, Mycobacterium bovis subsp bovis AF2122/97
cagcgguccgccgc

SEQ ID NO: 3135933 - RNA, 16 nt, Mycobacterium bovis subsp bovis AF2122/97
cagcggucggcgacca

SEQ ID NO: 3135934 - RNA, 13 nt, Mycobacterium bovis subsp bovis AF2122/97
cagcggucggcgg

SEQ ID NO: 3135935 - RNA, 14 nt, Mycobacterium bovis subsp bovis AF2122/97
cagcggucggcggu

SEQ ID NO: 3135936 - RNA, 13 nt, Mycobacterium bovis subsp bovis AF2122/97
cagcggugcuggu

SEQ ID NO: 3135937 - RNA, 15 nt, Mycobacterium bovis subsp bovis AF2122/97
cagcgguggaccacc

SEQ ID NO: 3135938 - RNA, 16 nt, Mycobacterium bovis subsp bovis AF2122/97
cagcgguggaccaccg

SEQ ID NO: 3135939 - RNA, 17 nt, Mycobacterium bovis subsp bovis AF2122/97
cagcgguggcaagccua

SEQ ID NO: 3135940 - RNA, 16 nt, Mycobacterium bovis subsp bovis AF2122/97
cagcgguggucggcgc

SEQ ID NO: 3135941 - RNA, 22 nt, Mycobacterium bovis subsp bovis AF2122/97
cagcgguguagccggcgccgcc

SEQ ID NO: 3135942 - RNA, 13 nt, Mycobacterium bovis subsp bovis AF2122/97
cagcgguucggug

SEQ ID NO: 3135943 - RNA, 18 nt, Mycobacterium bovis subsp bovis AF2122/97
cagcgguucggugaucgg

SEQ ID NO: 3135944 - RNA, 19 nt, Mycobacterium bovis subsp bovis AF2122/97
cagcgguucggugaucggg

SEQ ID NO: 3135945 - RNA, 20 nt, Mycobacterium bovis subsp bovis AF2122/97
cagcgguucggugaucgggc

SEQ ID NO: 3135946 - RNA, 23 nt, Mycobacterium bovis subsp bovis AF2122/97
cagcgguucggugaucgggcagc

SEQ ID NO: 3135947 - RNA, 14 nt, Mycobacterium bovis subsp bovis AF2122/97
cagcgguugacccu

SEQ ID NO: 3135948 - RNA, 19 nt, Mycobacterium bovis subsp bovis AF2122/97
cagcgguugaugcggccgc

SEQ ID NO: 3135949 - RNA, 20 nt, Mycobacterium bovis subsp bovis AF2122/97
cagcgguuuuaggcagccca

SEQ ID NO: 3135950 - RNA, 15 nt, Mycobacterium bovis subsp bovis AF2122/97
cagcguaaauagcgc

SEQ ID NO: 3135951 - RNA, 16 nt, Mycobacterium bovis subsp bovis AF2122/97
cagcguaucggccggc

SEQ ID NO: 3135952 - RNA, 17 nt, Mycobacterium bovis subsp bovis AF2122/97
cagcguaucggccggca

SEQ ID NO: 3135953 - RNA, 19 nt, Mycobacterium bovis subsp bovis AF2122/97
cagcguaucggccggcaga

SEQ ID NO: 3135954 - RNA, 22 nt, Mycobacterium bovis subsp bovis AF2122/97
cagcguauuggacgcugccgca

SEQ ID NO: 3135955 - RNA, 15 nt, Mycobacterium bovis subsp bovis AF2122/97
cagcgucaccucacc

SEQ ID NO: 3135956 - RNA, 20 nt, Mycobacterium bovis subsp bovis AF2122/97
cagcgucaggugcgcgacca

SEQ ID NO: 3135957 - RNA, 16 nt, Mycobacterium bovis subsp bovis AF2122/97
cagcgucauccucguc

SEQ ID NO: 3135958 - RNA, 13 nt, Mycobacterium bovis subsp bovis AF2122/97
cagcguccaaccc

SEQ ID NO: 3135959 - RNA, 14 nt, Mycobacterium bovis subsp bovis AF2122/97
cagcguccaaccca

SEQ ID NO: 3135960 - RNA, 15 nt, Mycobacterium bovis subsp bovis AF2122/97
cagcguccagccgcc

SEQ ID NO: 3135961 - RNA, 18 nt, Mycobacterium bovis subsp bovis AF2122/97
cagcguccagccgcccuc

SEQ ID NO: 3135962 - RNA, 19 nt, Mycobacterium bovis subsp bovis AF2122/97
cagcguccagccgcccucg

SEQ ID NO: 3135963 - RNA, 21 nt, Mycobacterium bovis subsp bovis AF2122/97
cagcguccagccgcccucggg

SEQ ID NO: 3135964 - RNA, 17 nt, Mycobacterium bovis subsp bovis AF2122/97
cagcguccagcgccugc

SEQ ID NO: 3135965 - RNA, 18 nt, Mycobacterium bovis subsp bovis AF2122/97
cagcgucccggucgccaa

SEQ ID NO: 3135966 - RNA, 19 nt, Mycobacterium bovis subsp bovis AF2122/97
cagcgucccggucgccaaa

SEQ ID NO: 3135967 - RNA, 21 nt, Mycobacterium bovis subsp bovis AF2122/97
cagcguccuggcguagugcag

SEQ ID NO: 3135968 - RNA, 23 nt, Mycobacterium bovis subsp bovis AF2122/97
cagcguccuggcguagugcagcu

SEQ ID NO: 3135969 - RNA, 17 nt, Mycobacterium bovis subsp bovis AF2122/97
cagcgucgacgucagca

SEQ ID NO: 3135970 - RNA, 21 nt, Mycobacterium bovis subsp bovis AF2122/97
cagcgucgacugaacgguuuc

SEQ ID NO: 3135971 - RNA, 16 nt, Mycobacterium bovis subsp bovis AF2122/97
cagcgucgaucgugcg

SEQ ID NO: 3135972 - RNA, 21 nt, Mycobacterium bovis subsp bovis AF2122/97
cagcgucgcaaggcccgcacc

SEQ ID NO: 3135973 - RNA, 23 nt, Mycobacterium bovis subsp bovis AF2122/97
cagcgucgcacgcgcgcaggccg

SEQ ID NO: 3135974 - RNA, 20 nt, Mycobacterium bovis subsp bovis AF2122/97
cagcgucgcgauugccgcgg

SEQ ID NO: 3135975 - RNA, 14 nt, Mycobacterium bovis subsp bovis AF2122/97
cagcgucgcggcca

SEQ ID NO: 3135976 - RNA, 17 nt, Mycobacterium bovis subsp bovis AF2122/97
cagcgucgcggccacgg

SEQ ID NO: 3135977 - RNA, 18 nt, Mycobacterium bovis subsp bovis AF2122/97
cagcgucgcggccacggu

SEQ ID NO: 3135978 - RNA, 23 nt, Mycobacterium bovis subsp bovis AF2122/97
cagcgucgcggccacggucagcc

SEQ ID NO: 3135979 - RNA, 13 nt, Mycobacterium bovis subsp bovis AF2122/97
cagcgucggcgca

SEQ ID NO: 3135980 - RNA, 22 nt, Mycobacterium bovis subsp bovis AF2122/97
cagcugcggacuggcauccgcc

SEQ ID NO: 3135981 - RNA, 21 nt, Mycobacterium bovis subsp bovis AF2122/97
cagcugcggauacagccgccg

SEQ ID NO: 3135982 - RNA, 19 nt, Mycobacterium bovis subsp bovis AF2122/97
cagcugcggauccaccacg

SEQ ID NO: 3135983 - RNA, 19 nt, Mycobacterium bovis subsp bovis AF2122/97
cagcugcggcuccggcggc

SEQ ID NO: 3135984 - RNA, 20 nt, Mycobacterium bovis subsp bovis AF2122/97
cagcugcgggucgugccccg

SEQ ID NO: 3135985 - RNA, 22 nt, Mycobacterium bovis subsp bovis AF2122/97
cagcugcgggucgugccccggc

SEQ ID NO: 3135986 - RNA, 22 nt, Mycobacterium bovis subsp bovis AF2122/97
cagcugcggguucacuuccggg

SEQ ID NO: 3135987 - RNA, 23 nt, Mycobacterium bovis subsp bovis AF2122/97
cagcugcggguucacuuccgggc

SEQ ID NO: 3135988 - RNA, 15 nt, Mycobacterium bovis subsp bovis AF2122/97
cagcugcggucgcgg

SEQ ID NO: 3135989 - RNA, 19 nt, Mycobacterium bovis subsp bovis AF2122/97
cagcugcucggucaggcgg

SEQ ID NO: 3135990 - RNA, 17 nt, Mycobacterium bovis subsp bovis AF2122/97
cagcugcucgucgucga

SEQ ID NO: 3135991 - RNA, 23 nt, Mycobacterium bovis subsp bovis AF2122/97
cagcugcucgucgucgauccagc

SEQ ID NO: 3135992 - RNA, 20 nt, Mycobacterium bovis subsp bovis AF2122/97
cagcugcucuccgucgcgca

SEQ ID NO: 3135993 - RNA, 19 nt, Mycobacterium bovis subsp bovis AF2122/97
cagcugcugccgauacagc

SEQ ID NO: 3135994 - RNA, 17 nt, Mycobacterium bovis subsp bovis AF2122/97
cagcuggacggccucca

SEQ ID NO: 3135995 - RNA, 24 nt, Mycobacterium bovis subsp bovis AF2122/97
cagcuggacuccggucagcgcggc

SEQ ID NO: 3135996 - RNA, 20 nt, Mycobacterium bovis subsp bovis AF2122/97
cagcuggcauaggaucgcgc

SEQ ID NO: 3135997 - RNA, 16 nt, Mycobacterium bovis subsp bovis AF2122/97
cagcuggccgcggcga

SEQ ID NO: 3135998 - RNA, 21 nt, Mycobacterium bovis subsp bovis AF2122/97
cagcuggccgcggcgaguacu

SEQ ID NO: 3135999 - RNA, 18 nt, Mycobacterium bovis subsp bovis AF2122/97
cagcuggcgaaugcgggc

SEQ ID NO: 3136000 - RNA, 13 nt, Mycobacterium bovis subsp bovis AF2122/97
cagcuggcgacgg

SEQ ID NO: 3136001 - RNA, 17 nt, Mycobacterium bovis subsp bovis AF2122/97
cagcuggcgcagccugc

SEQ ID NO: 3136002 - RNA, 15 nt, Mycobacterium bovis subsp bovis AF2122/97
cagcuggcggcagcg

SEQ ID NO: 3136003 - RNA, 15 nt, Mycobacterium bovis subsp bovis AF2122/97
cagcuggcucaccga

SEQ ID NO: 3136004 - RNA, 17 nt, Mycobacterium bovis subsp bovis AF2122/97
cagcugggcaucaccgc

SEQ ID NO: 3136005 - RNA, 21 nt, Mycobacterium bovis subsp bovis AF2122/97
cagcugggcaucaucagcggc

SEQ ID NO: 3136006 - RNA, 20 nt, Mycobacterium bovis subsp bovis AF2122/97
cagcugggucccgcuggcau

SEQ ID NO: 3136007 - RNA, 20 nt, Mycobacterium bovis subsp bovis AF2122/97
cagcugguagcgcaccacac

SEQ ID NO: 3136008 - RNA, 14 nt, Mycobacterium bovis subsp bovis AF2122/97
cagcuggucggugg

SEQ ID NO: 3136009 - RNA, 13 nt, Mycobacterium bovis subsp bovis AF2122/97
cagcuggucgugg

SEQ ID NO: 3136010 - RNA, 16 nt, Mycobacterium bovis subsp bovis AF2122/97
cagcuggugagccaga

SEQ ID NO: 3136011 - RNA, 17 nt, Mycobacterium bovis subsp bovis AF2122/97
cagcugguugugcuggg

SEQ ID NO: 3136012 - RNA, 17 nt, Mycobacterium bovis subsp bovis AF2122/97
cagcugucccucgggau

SEQ ID NO: 3136013 - RNA, 23 nt, Mycobacterium bovis subsp bovis AF2122/97
cagcugucccucgggaucaccga

SEQ ID NO: 3136014 - RNA, 17 nt, Mycobacterium bovis subsp bovis AF2122/97
cagcuguccucgcgggc

SEQ ID NO: 3136015 - RNA, 13 nt, Mycobacterium bovis subsp bovis AF2122/97
cagcugucgggca

SEQ ID NO: 3136016 - RNA, 15 nt, Mycobacterium bovis subsp bovis AF2122/97
cagcugucgggcagc

SEQ ID NO: 3136017 - RNA, 18 nt, Mycobacterium bovis subsp bovis AF2122/97
cagcugugaacaggccga

SEQ ID NO: 3136018 - RNA, 15 nt, Mycobacterium bovis subsp bovis AF2122/97
cagcugugcgacccg

SEQ ID NO: 3136019 - RNA, 16 nt, Mycobacterium bovis subsp bovis AF2122/97
cagcuguucgagccgc

SEQ ID NO: 3136020 - RNA, 15 nt, Mycobacterium bovis subsp bovis AF2122/97
cagcuguucggccaa

SEQ ID NO: 3136021 - RNA, 18 nt, Mycobacterium bovis subsp bovis AF2122/97
cagcuguucggccaaccc

SEQ ID NO: 3136022 - RNA, 18 nt, Mycobacterium bovis subsp bovis AF2122/97
cagcuguugucgcggaag

SEQ ID NO: 3136023 - RNA, 19 nt, Mycobacterium bovis subsp bovis AF2122/97
cagcuucaaugucggugac

SEQ ID NO: 3136024 - RNA, 15 nt, Mycobacterium bovis subsp bovis AF2122/97
cagcuuccgcugaac

SEQ ID NO: 3136025 - RNA, 17 nt, Mycobacterium bovis subsp bovis AF2122/97
cagcuucgcgcagccgg

SEQ ID NO: 3136026 - RNA, 13 nt, Mycobacterium bovis subsp bovis AF2122/97
cagcuucggccag

SEQ ID NO: 3136027 - RNA, 16 nt, Mycobacterium bovis subsp bovis AF2122/97
cagcuucggcuggcgu

SEQ ID NO: 3136028 - RNA, 18 nt, Mycobacterium bovis subsp bovis AF2122/97
cagcuucggcuggcgugc

SEQ ID NO: 3136029 - RNA, 14 nt, Mycobacterium bovis subsp bovis AF2122/97
cagcuucucagcac

SEQ ID NO: 3136030 - RNA, 16 nt, Mycobacterium bovis subsp bovis AF2122/97
cagcuucucgccgacg

SEQ ID NO: 3136031 - RNA, 20 nt, Mycobacterium bovis subsp bovis AF2122/97
cagcuucuuaccgcgggccg

SEQ ID NO: 3136032 - RNA, 13 nt, Mycobacterium bovis subsp bovis AF2122/97
cagcuugacccac

SEQ ID NO: 3136033 - RNA, 14 nt, Mycobacterium bovis subsp bovis AF2122/97
cagcuugagcacac

SEQ ID NO: 3136034 - RNA, 15 nt, Mycobacterium bovis subsp bovis AF2122/97
cagcuugagcacacg

SEQ ID NO: 3136035 - RNA, 17 nt, Mycobacterium bovis subsp bovis AF2122/97
cagcuugcagugccgcc

SEQ ID NO: 3136036 - RNA, 21 nt, Mycobacterium bovis subsp bovis AF2122/97
cagcuugcagugccgccggcc

SEQ ID NO: 3136037 - RNA, 16 nt, Mycobacterium bovis subsp bovis AF2122/97
cagcuugccaaucacc

SEQ ID NO: 3136038 - RNA, 18 nt, Mycobacterium bovis subsp bovis AF2122/97
cagcuugccaaucaccgu

SEQ ID NO: 3136039 - RNA, 20 nt, Mycobacterium bovis subsp bovis AF2122/97
cagcuugcccgagcccagcc

SEQ ID NO: 3136040 - RNA, 22 nt, Mycobacterium bovis subsp bovis AF2122/97
cagcuugcccgagcccagccgg

SEQ ID NO: 3136041 - RNA, 14 nt, Mycobacterium bovis subsp bovis AF2122/97
cagcuugccgaccu

SEQ ID NO: 3136042 - RNA, 18 nt, Mycobacterium bovis subsp bovis AF2122/97
cagcuugcggagccgccg

SEQ ID NO: 3136043 - RNA, 13 nt, Mycobacterium bovis subsp bovis AF2122/97
cagcuugcugcgc

SEQ ID NO: 3136044 - RNA, 17 nt, Mycobacterium bovis subsp bovis AF2122/97
cagcuugcugcgcacca

SEQ ID NO: 3136045 - RNA, 20 nt, Mycobacterium bovis subsp bovis AF2122/97
cagcuugcugcgcaccaagg

SEQ ID NO: 3136046 - RNA, 17 nt, Mycobacterium bovis subsp bovis AF2122/97
cagcuuggagaucgccg

SEQ ID NO: 3136047 - RNA, 21 nt, Mycobacterium bovis subsp bovis AF2122/97
cagcuuggcauugaccaccga

SEQ ID NO: 3136048 - RNA, 16 nt, Mycobacterium bovis subsp bovis AF2122/97
cagcuuggccagccac

SEQ ID NO: 3136049 - RNA, 21 nt, Mycobacterium bovis subsp bovis AF2122/97
cagcuuggccucagccaccgg

SEQ ID NO: 3136050 - RNA, 22 nt, Mycobacterium bovis subsp bovis AF2122/97
cagcuuggccucagccaccggg

SEQ ID NO: 3136051 - RNA, 19 nt, Mycobacterium bovis subsp bovis AF2122/97
cagcuuggcgucgaugcgg

SEQ ID NO: 3136052 - RNA, 23 nt, Mycobacterium bovis subsp bovis AF2122/97
cagcuuggcgucgaugcgggcca

SEQ ID NO: 3136053 - RNA, 21 nt, Mycobacterium bovis subsp bovis AF2122/97
cagcuugucguagcgacgcca

SEQ ID NO: 3136054 - RNA, 20 nt, Mycobacterium bovis subsp bovis AF2122/97
cagcuugugggcgacggcga

SEQ ID NO: 3136055 - RNA, 20 nt, Mycobacterium bovis subsp bovis AF2122/97
cagcuuguuuuccaccagcg

SEQ ID NO: 3136056 - RNA, 21 nt, Mycobacterium bovis subsp bovis AF2122/97
cagcuuuaaucguggcacuga

SEQ ID NO: 3136057 - RNA, 15 nt, Mycobacterium bovis subsp bovis AF2122/97
cagcuuuaucggccc

SEQ ID NO: 3136058 - RNA, 18 nt, Mycobacterium bovis subsp bovis AF2122/97
cagcuuucuuggcgggcg

SEQ ID NO: 3136059 - RNA, 21 nt, Mycobacterium bovis subsp bovis AF2122/97
cagcuuugacgcccucggcga

SEQ ID NO: 3136060 - RNA, 17 nt, Mycobacterium bovis subsp bovis AF2122/97
cagcuuuguucccuuca

SEQ ID NO: 3136061 - RNA, 20 nt, Mycobacterium bovis subsp bovis AF2122/97
caggaaaaccccggccacca

SEQ ID NO: 3136062 - RNA, 14 nt, Mycobacterium bovis subsp bovis AF2122/97
caggaaaccggcgc

SEQ ID NO: 3136063 - RNA, 16 nt, Mycobacterium bovis subsp bovis AF2122/97
caggaaaccggcgcgg

SEQ ID NO: 3136064 - RNA, 20 nt, Mycobacterium bovis subsp bovis AF2122/97
caggaacaaguagccgucgu

SEQ ID NO: 3136065 - RNA, 20 nt, Mycobacterium bovis subsp bovis AF2122/97
caggaaccacccaccggcca

SEQ ID NO: 3136066 - RNA, 18 nt, Mycobacterium bovis subsp bovis AF2122/97
caggaugccugccacccg

SEQ ID NO: 3136067 - RNA, 20 nt, Mycobacterium bovis subsp bovis AF2122/97
caggaugccugccacccguu

SEQ ID NO: 3136068 - RNA, 15 nt, Mycobacterium bovis subsp bovis AF2122/97
caggauggugcggcc

SEQ ID NO: 3136069 - RNA, 19 nt, Mycobacterium bovis subsp bovis AF2122/97
caggauggugcggccgcgg

SEQ ID NO: 3136070 - RNA, 22 nt, Mycobacterium bovis subsp bovis AF2122/97
caggauggugcggccgcggcga

SEQ ID NO: 3136071 - RNA, 21 nt, Mycobacterium bovis subsp bovis AF2122/97
caggauguguugccagaucag

SEQ ID NO: 3136072 - RNA, 16 nt, Mycobacterium bovis subsp bovis AF2122/97
caggauguucaauccc

SEQ ID NO: 3136073 - RNA, 14 nt, Mycobacterium bovis subsp bovis AF2122/97
caggauucccaguc

SEQ ID NO: 3136074 - RNA, 16 nt, Mycobacterium bovis subsp bovis AF2122/97
caggauucccagucgc

SEQ ID NO: 3136075 - RNA, 18 nt, Mycobacterium bovis subsp bovis AF2122/97
caggauucccagucgcgg

SEQ ID NO: 3136076 - RNA, 19 nt, Mycobacterium bovis subsp bovis AF2122/97
caggauucugcugaccaug

SEQ ID NO: 3136077 - RNA, 17 nt, Mycobacterium bovis subsp bovis AF2122/97
caggauuggccgcugca

SEQ ID NO: 3136078 - RNA, 22 nt, Mycobacterium bovis subsp bovis AF2122/97
caggauuuucucgggguggugg

SEQ ID NO: 3136079 - RNA, 19 nt, Mycobacterium bovis subsp bovis AF2122/97
caggcaaccggucagccug

SEQ ID NO: 3136080 - RNA, 16 nt, Mycobacterium bovis subsp bovis AF2122/97
caggcaagccagcacu

SEQ ID NO: 3136081 - RNA, 18 nt, Mycobacterium bovis subsp bovis AF2122/97
caggcaagccagcacugc

SEQ ID NO: 3136082 - RNA, 18 nt, Mycobacterium bovis subsp bovis AF2122/97
caggcaaucgcgggcgau

SEQ ID NO: 3136083 - RNA, 15 nt, Mycobacterium bovis subsp bovis AF2122/97
caggcaaugcccgac

SEQ ID NO: 3136084 - RNA, 18 nt, Mycobacterium bovis subsp bovis AF2122/97
caggcaaugcccgaccgg

SEQ ID NO: 3136085 - RNA, 17 nt, Mycobacterium bovis subsp bovis AF2122/97
caggcacaacaucgccg

SEQ ID NO: 3136086 - RNA, 14 nt, Mycobacterium bovis subsp bovis AF2122/97
caggcacaacgcga

SEQ ID NO: 3136087 - RNA, 20 nt, Mycobacterium bovis subsp bovis AF2122/97
caggcacaacgcgacgccgc

SEQ ID NO: 3136088 - RNA, 15 nt, Mycobacterium bovis subsp bovis AF2122/97
caggcaccacgaccg

SEQ ID NO: 3136089 - RNA, 17 nt, Mycobacterium bovis subsp bovis AF2122/97
caggcaccccgaucacc

SEQ ID NO: 3136090 - RNA, 14 nt, Mycobacterium bovis subsp bovis AF2122/97
caggcacccuguac

SEQ ID NO: 3136091 - RNA, 18 nt, Mycobacterium bovis subsp bovis AF2122/97
caggcacguccgaucggc

SEQ ID NO: 3136092 - RNA, 13 nt, Mycobacterium bovis subsp bovis AF2122/97
caggcacuccagc

SEQ ID NO: 3136093 - RNA, 16 nt, Mycobacterium bovis subsp bovis AF2122/97
caggcagcuccgccgc

SEQ ID NO: 3136094 - RNA, 18 nt, Mycobacterium bovis subsp bovis AF2122/97
caggcagcuccgccgccg

SEQ ID NO: 3136095 - RNA, 21 nt, Mycobacterium bovis subsp bovis AF2122/97
caggcagcuccgccgccgacg

SEQ ID NO: 3136096 - RNA, 13 nt, Mycobacterium bovis subsp bovis AF2122/97
caggcagcucggc

SEQ ID NO: 3136097 - RNA, 14 nt, Mycobacterium bovis subsp bovis AF2122/97
caggcagcucggca

SEQ ID NO: 3136098 - RNA, 17 nt, Mycobacterium bovis subsp bovis AF2122/97
caggcagcucggcaacg

SEQ ID NO: 3136099 - RNA, 18 nt, Mycobacterium bovis subsp bovis AF2122/97
caggcagcucggcaacgu

SEQ ID NO: 3136100 - RNA, 21 nt, Mycobacterium bovis subsp bovis AF2122/97
caggcagcuugccaaucaccg

SEQ ID NO: 3136101 - RNA, 15 nt, Mycobacterium bovis subsp bovis AF2122/97
caggcagggcagccc

SEQ ID NO: 3136102 - RNA, 18 nt, Mycobacterium bovis subsp bovis AF2122/97
caggcagggcagcccggc

SEQ ID NO: 3136103 - RNA, 21 nt, Mycobacterium bovis subsp bovis AF2122/97
caggcagggcagcccggcgau

SEQ ID NO: 3136104 - RNA, 21 nt, Mycobacterium bovis subsp bovis AF2122/97
caggcagguuggccaccgccc

SEQ ID NO: 3136105 - RNA, 14 nt, Mycobacterium bovis subsp bovis AF2122/97
caggcaguccaccg

SEQ ID NO: 3136106 - RNA, 19 nt, Mycobacterium bovis subsp bovis AF2122/97
caggcaguccaccgcgcgg

SEQ ID NO: 3136107 - RNA, 22 nt, Mycobacterium bovis subsp bovis AF2122/97
caggcaguccaccgcgcggcgc

SEQ ID NO: 3136108 - RNA, 23 nt, Mycobacterium bovis subsp bovis AF2122/97
caggcaguccaccgcgcggcgca

SEQ ID NO: 3136109 - RNA, 22 nt, Mycobacterium bovis subsp bovis AF2122/97
caggcaucaccggaacccccag

SEQ ID NO: 3136110 - RNA, 20 nt, Mycobacterium bovis subsp bovis AF2122/97
caggcaucggaggaaccccg

SEQ ID NO: 3136111 - RNA, 21 nt, Mycobacterium bovis subsp bovis AF2122/97
caggcaucggaggaaccccgc

SEQ ID NO: 3136112 - RNA, 23 nt, Mycobacterium bovis subsp bovis AF2122/97
caggcaucggugagcccguugac

SEQ ID NO: 3136113 - RNA, 15 nt, Mycobacterium bovis subsp bovis AF2122/97
caggcaucguccgcc

SEQ ID NO: 3136114 - RNA, 13 nt, Mycobacterium bovis subsp bovis AF2122/97
caggcauggccug

SEQ ID NO: 3136115 - RNA, 13 nt, Mycobacterium bovis subsp bovis AF2122/97
caggcauggcgcc

SEQ ID NO: 3136116 - RNA, 17 nt, Mycobacterium bovis subsp bovis AF2122/97
caggcauggcgccguug

SEQ ID NO: 3136117 - RNA, 21 nt, Mycobacterium bovis subsp bovis AF2122/97
caggcauuuucacugugccgc

SEQ ID NO: 3136118 - RNA, 22 nt, Mycobacterium bovis subsp bovis AF2122/97
caggcauuuucacugugccgcu

SEQ ID NO: 3136119 - RNA, 17 nt, Mycobacterium bovis subsp bovis AF2122/97
caggccaacuuggcggc

SEQ ID NO: 3136120 - RNA, 20 nt, Mycobacterium bovis subsp bovis AF2122/97
caggccaacuuggcggccag

SEQ ID NO: 3136121 - RNA, 15 nt, Mycobacterium bovis subsp bovis AF2122/97
caggccaagguggcc

SEQ ID NO: 3136122 - RNA, 17 nt, Mycobacterium bovis subsp bovis AF2122/97
caggccaccccgaccuc

SEQ ID NO: 3136123 - RNA, 23 nt, Mycobacterium bovis subsp bovis AF2122/97
caggccaccccgaccucccggca

SEQ ID NO: 3136124 - RNA, 13 nt, Mycobacterium bovis subsp bovis AF2122/97
caggccaccgcag

SEQ ID NO: 3136125 - RNA, 23 nt, Mycobacterium bovis subsp bovis AF2122/97
caggccaccgcagacgccgucug

SEQ ID NO: 3136126 - RNA, 18 nt, Mycobacterium bovis subsp bovis AF2122/97
caggccacgcaccgggug

SEQ ID NO: 3136127 - RNA, 12 nt, Mycobacterium bovis subsp bovis AF2122/97
caggccacgggc

SEQ ID NO: 3136128 - RNA, 13 nt, Mycobacterium bovis subsp bovis AF2122/97
caggccacgggcg

SEQ ID NO: 3136129 - RNA, 13 nt, Mycobacterium bovis subsp bovis AF2122/97
caggccacugccg

SEQ ID NO: 3136130 - RNA, 23 nt, Mycobacterium bovis subsp bovis AF2122/97
caggccacugccgaccagcgcgc

SEQ ID NO: 3136131 - RNA, 23 nt, Mycobacterium bovis subsp bovis AF2122/97
caggccacugcguuccaucgccg

SEQ ID NO: 3136132 - RNA, 14 nt, Mycobacterium bovis subsp bovis AF2122/97
caggccagagucgc

SEQ ID NO: 3136133 - RNA, 20 nt, Mycobacterium bovis subsp bovis AF2122/97
caggccagagucgcccgcac

SEQ ID NO: 3136134 - RNA, 23 nt, Mycobacterium bovis subsp bovis AF2122/97
caggccagaguuugcgaugccca

SEQ ID NO: 3136135 - RNA, 23 nt, Mycobacterium bovis subsp bovis AF2122/97
caggccagcaugucgggccgcuc

SEQ ID NO: 3136136 - RNA, 17 nt, Mycobacterium bovis subsp bovis AF2122/97
caggccagcgcucaccg

SEQ ID NO: 3136137 - RNA, 19 nt, Mycobacterium bovis subsp bovis AF2122/97
caggccagcgcucaccggc

SEQ ID NO: 3136138 - RNA, 18 nt, Mycobacterium bovis subsp bovis AF2122/97
caggccagcggauuugcc

SEQ ID NO: 3136139 - RNA, 21 nt, Mycobacterium bovis subsp bovis AF2122/97
caggccagggcgguggccacc

SEQ ID NO: 3136140 - RNA, 19 nt, Mycobacterium bovis subsp bovis AF2122/97
caggccagggugaccaggc

SEQ ID NO: 3136141 - RNA, 21 nt, Mycobacterium bovis subsp bovis AF2122/97
caggccagggugaccaggccg

SEQ ID NO: 3136142 - RNA, 21 nt, Mycobacterium bovis subsp bovis AF2122/97
caggccagugccaccugggcg

SEQ ID NO: 3136143 - RNA, 18 nt, Mycobacterium bovis subsp bovis AF2122/97
caggccauccgggcugcc

SEQ ID NO: 3136144 - RNA, 23 nt, Mycobacterium bovis subsp bovis AF2122/97
caggccauccgggcugccaaggc

SEQ ID NO: 3136145 - RNA, 17 nt, Mycobacterium bovis subsp bovis AF2122/97
caggccaugggaaccga

SEQ ID NO: 3136146 - RNA, 13 nt, Mycobacterium bovis subsp bovis AF2122/97
caggcccacccgg

SEQ ID NO: 3136147 - RNA, 14 nt, Mycobacterium bovis subsp bovis AF2122/97
caggcccacccggg

SEQ ID NO: 3136148 - RNA, 17 nt, Mycobacterium bovis subsp bovis AF2122/97
caggcccacccgggcgu

SEQ ID NO: 3136149 - RNA, 13 nt, Mycobacterium bovis subsp bovis AF2122/97
caggcccagccga

SEQ ID NO: 3136150 - RNA, 17 nt, Mycobacterium bovis subsp bovis AF2122/97
caggcccagccgagcgg

SEQ ID NO: 3136151 - RNA, 21 nt, Mycobacterium bovis subsp bovis AF2122/97
caggcccagccgagcggcggc

SEQ ID NO: 3136152 - RNA, 17 nt, Mycobacterium bovis subsp bovis AF2122/97
caggccgucggcgucga

SEQ ID NO: 3136153 - RNA, 15 nt, Mycobacterium bovis subsp bovis AF2122/97
caggccgucgggggu

SEQ ID NO: 3136154 - RNA, 18 nt, Mycobacterium bovis subsp bovis AF2122/97
caggccgucguugccggc

SEQ ID NO: 3136155 - RNA, 14 nt, Mycobacterium bovis subsp bovis AF2122/97
caggccguggcacc

SEQ ID NO: 3136156 - RNA, 17 nt, Mycobacterium bovis subsp bovis AF2122/97
caggccguggcggacgg

SEQ ID NO: 3136157 - RNA, 23 nt, Mycobacterium bovis subsp bovis AF2122/97
caggccguggcggacggcgucga

SEQ ID NO: 3136158 - RNA, 19 nt, Mycobacterium bovis subsp bovis AF2122/97
caggccguguacgugcucg

SEQ ID NO: 3136159 - RNA, 22 nt, Mycobacterium bovis subsp bovis AF2122/97
caggccguugcuauucgccagc

SEQ ID NO: 3136160 - RNA, 13 nt, Mycobacterium bovis subsp bovis AF2122/97
caggccuaggucg

SEQ ID NO: 3136161 - RNA, 17 nt, Mycobacterium bovis subsp bovis AF2122/97
caggccuaggucgacgc

SEQ ID NO: 3136162 - RNA, 19 nt, Mycobacterium bovis subsp bovis AF2122/97
caggccuaggucgacgccg

SEQ ID NO: 3136163 - RNA, 20 nt, Mycobacterium bovis subsp bovis AF2122/97
caggccuaguccggcacugc

SEQ ID NO: 3136164 - RNA, 23 nt, Mycobacterium bovis subsp bovis AF2122/97
caggccuaguccggcacugcggc

SEQ ID NO: 3136165 - RNA, 20 nt, Mycobacterium bovis subsp bovis AF2122/97
caggccuccaaaaucgcggc

SEQ ID NO: 3136166 - RNA, 21 nt, Mycobacterium bovis subsp bovis AF2122/97
caggccuccaaaaucgcggcc

SEQ ID NO: 3136167 - RNA, 15 nt, Mycobacterium bovis subsp bovis AF2122/97
caggccuccaagccc

SEQ ID NO: 3136168 - RNA, 21 nt, Mycobacterium bovis subsp bovis AF2122/97
caggccuccaagcccgccgga

SEQ ID NO: 3136169 - RNA, 20 nt, Mycobacterium bovis subsp bovis AF2122/97
caggccuccucuugggucca

SEQ ID NO: 3136170 - RNA, 16 nt, Mycobacterium bovis subsp bovis AF2122/97
caggccucgaccgcgg

SEQ ID NO: 3136171 - RNA, 22 nt, Mycobacterium bovis subsp bovis AF2122/97
caggccucgcaccggauccacg

SEQ ID NO: 3136172 - RNA, 15 nt, Mycobacterium bovis subsp bovis AF2122/97
caggccucggcgccg

SEQ ID NO: 3136173 - RNA, 19 nt, Mycobacterium bovis subsp bovis AF2122/97
caggccuugaccucgggua

SEQ ID NO: 3136174 - RNA, 16 nt, Mycobacterium bovis subsp bovis AF2122/97
caggccuuggugcggc

SEQ ID NO: 3136175 - RNA, 18 nt, Mycobacterium bovis subsp bovis AF2122/97
caggccuuggugcggccg

SEQ ID NO: 3136176 - RNA, 19 nt, Mycobacterium bovis subsp bovis AF2122/97
caggccuuggugcggccgg

SEQ ID NO: 3136177 - RNA, 15 nt, Mycobacterium bovis subsp bovis AF2122/97
caggcgaacaccaga

SEQ ID NO: 3136178 - RNA, 18 nt, Mycobacterium bovis subsp bovis AF2122/97
caggcgaacaccagaugg

SEQ ID NO: 3136179 - RNA, 10 nt, Mycobacterium bovis subsp bovis AF2122/97
caggcgaacc

SEQ ID NO: 3136180 - RNA, 15 nt, Mycobacterium bovis subsp bovis AF2122/97
caggcgaaggcggcu

SEQ ID NO: 3136181 - RNA, 18 nt, Mycobacterium bovis subsp bovis AF2122/97
caggcgaagucgacucgc

SEQ ID NO: 3136182 - RNA, 23 nt, Mycobacterium bovis subsp bovis AF2122/97
caggcgaagucgacucgccacau

SEQ ID NO: 3136183 - RNA, 19 nt, Mycobacterium bovis subsp bovis AF2122/97
caggcgaccggggaucggg

SEQ ID NO: 3136184 - RNA, 20 nt, Mycobacterium bovis subsp bovis AF2122/97
caggcgaccggggaucgggg

SEQ ID NO: 3136185 - RNA, 23 nt, Mycobacterium bovis subsp bovis AF2122/97
caggcgacgagcacacaacaccc

SEQ ID NO: 3136186 - RNA, 22 nt, Mycobacterium bovis subsp bovis AF2122/97
caggcgagugaacucguccuga

SEQ ID NO: 3136187 - RNA, 19 nt, Mycobacterium bovis subsp bovis AF2122/97
caggcgaguuaggccgcca

SEQ ID NO: 3136188 - RNA, 18 nt, Mycobacterium bovis subsp bovis AF2122/97
caggcgauaaagccgcug

SEQ ID NO: 3136189 - RNA, 17 nt, Mycobacterium bovis subsp bovis AF2122/97
caggcgaucgcccggcc

SEQ ID NO: 3136190 - RNA, 18 nt, Mycobacterium bovis subsp bovis AF2122/97
caggcgaucgcccggccc

SEQ ID NO: 3136191 - RNA, 22 nt, Mycobacterium bovis subsp bovis AF2122/97
caggcgaucgcccggccccgca

SEQ ID NO: 3136192 - RNA, 14 nt, Mycobacterium bovis subsp bovis AF2122/97
caggcgaugcgcca

SEQ ID NO: 3136193 - RNA, 16 nt, Mycobacterium bovis subsp bovis AF2122/97
caggcgauugcccgcg

SEQ ID NO: 3136194 - RNA, 17 nt, Mycobacterium bovis subsp bovis AF2122/97
caggcgauugcccgcgc

SEQ ID NO: 3136195 - RNA, 14 nt, Mycobacterium bovis subsp bovis AF2122/97
caggcgcaccaggc

SEQ ID NO: 3136196 - RNA, 20 nt, Mycobacterium bovis subsp bovis AF2122/97
caggcgcaccaggcggccgu

SEQ ID NO: 3136197 - RNA, 19 nt, Mycobacterium bovis subsp bovis AF2122/97
caggcgcagauuccucuuc

SEQ ID NO: 3136198 - RNA, 14 nt, Mycobacterium bovis subsp bovis AF2122/97
caggcgcagcuggg

SEQ ID NO: 3136199 - RNA, 19 nt, Mycobacterium bovis subsp bovis AF2122/97
caggcgcauagggccaccg

SEQ ID NO: 3136200 - RNA, 20 nt, Mycobacterium bovis subsp bovis AF2122/97
caggcgcauagggccaccgc

SEQ ID NO: 3136201 - RNA, 23 nt, Mycobacterium bovis subsp bovis AF2122/97
caggcgcauagggccaccgccgc

SEQ ID NO: 3136202 - RNA, 15 nt, Mycobacterium bovis subsp bovis AF2122/97
caggcgccacccgaa

SEQ ID NO: 3136203 - RNA, 23 nt, Mycobacterium bovis subsp bovis AF2122/97
caggcgccacugcuuccggaaca

SEQ ID NO: 3136204 - RNA, 12 nt, Mycobacterium bovis subsp bovis AF2122/97
caggcgccgcua

SEQ ID NO: 3136205 - RNA, 21 nt, Mycobacterium bovis subsp bovis AF2122/97
caggcgccgucucgcggugcg

SEQ ID NO: 3136206 - RNA, 14 nt, Mycobacterium bovis subsp bovis AF2122/97
caggcgcgaucgcg

SEQ ID NO: 3136207 - RNA, 16 nt, Mycobacterium bovis subsp bovis AF2122/97
caggcgcgaucgcgcc

SEQ ID NO: 3136208 - RNA, 17 nt, Mycobacterium bovis subsp bovis AF2122/97
caggcgcgaucgcgccc

SEQ ID NO: 3136209 - RNA, 18 nt, Mycobacterium bovis subsp bovis AF2122/97
caggcgcgaucgcucauu

SEQ ID NO: 3136210 - RNA, 13 nt, Mycobacterium bovis subsp bovis AF2122/97
caggcgcgcacca

SEQ ID NO: 3136211 - RNA, 15 nt, Mycobacterium bovis subsp bovis AF2122/97
caggcgcgcaccacc

SEQ ID NO: 3136212 - RNA, 16 nt, Mycobacterium bovis subsp bovis AF2122/97
caggcgcgcaccaccg

SEQ ID NO: 3136213 - RNA, 17 nt, Mycobacterium bovis subsp bovis AF2122/97
caggcgcgcaccaccgc

SEQ ID NO: 3136214 - RNA, 17 nt, Mycobacterium bovis subsp bovis AF2122/97
caggcgcgccgcacccg

SEQ ID NO: 3136215 - RNA, 22 nt, Mycobacterium bovis subsp bovis AF2122/97
caggcgcgcuaccagcucacgg

SEQ ID NO: 3136216 - RNA, 15 nt, Mycobacterium bovis subsp bovis AF2122/97
caggcgcggcccagg

SEQ ID NO: 3136217 - RNA, 19 nt, Mycobacterium bovis subsp bovis AF2122/97
caggcgcucagcgcggcca

SEQ ID NO: 3136218 - RNA, 24 nt, Mycobacterium bovis subsp bovis AF2122/97
caggcgcucagcgcggccacgccg

SEQ ID NO: 3136219 - RNA, 20 nt, Mycobacterium bovis subsp bovis AF2122/97
caggcgcucaucacccagcg

SEQ ID NO: 3136220 - RNA, 22 nt, Mycobacterium bovis subsp bovis AF2122/97
caggcgcucgaaggccgcacuc

SEQ ID NO: 3136221 - RNA, 14 nt, Mycobacterium bovis subsp bovis AF2122/97
caggcgcugcagca

SEQ ID NO: 3136222 - RNA, 13 nt, Mycobacterium bovis subsp bovis AF2122/97
caggcgcugccgg

SEQ ID NO: 3136223 - RNA, 14 nt, Mycobacterium bovis subsp bovis AF2122/97
caggcggacgccgc

SEQ ID NO: 3136224 - RNA, 15 nt, Mycobacterium bovis subsp bovis AF2122/97
caggcggacgccgcg

SEQ ID NO: 3136225 - RNA, 18 nt, Mycobacterium bovis subsp bovis AF2122/97
caggcggacgccgcgccg

SEQ ID NO: 3136226 - RNA, 16 nt, Mycobacterium bovis subsp bovis AF2122/97
caggcggcagguucga

SEQ ID NO: 3136227 - RNA, 16 nt, Mycobacterium bovis subsp bovis AF2122/97
caggcggccagcaucg

SEQ ID NO: 3136228 - RNA, 14 nt, Mycobacterium bovis subsp bovis AF2122/97
caggcggccgagcu

SEQ ID NO: 3136229 - RNA, 16 nt, Mycobacterium bovis subsp bovis AF2122/97
caggcggccgagcugg

SEQ ID NO: 3136230 - RNA, 13 nt, Mycobacterium bovis subsp bovis AF2122/97
caggcggccgcca

SEQ ID NO: 3136231 - RNA, 13 nt, Mycobacterium bovis subsp bovis AF2122/97
caggcggccgccg

SEQ ID NO: 3136232 - RNA, 20 nt, Mycobacterium bovis subsp bovis AF2122/97
caggcggccgucgucggcca

SEQ ID NO: 3136233 - RNA, 15 nt, Mycobacterium bovis subsp bovis AF2122/97
caggcggcgaacugc

SEQ ID NO: 3136234 - RNA, 22 nt, Mycobacterium bovis subsp bovis AF2122/97
caggcggcgaacugccucagac

SEQ ID NO: 3136235 - RNA, 21 nt, Mycobacterium bovis subsp bovis AF2122/97
caggcggcgcgggucggcgac

SEQ ID NO: 3136236 - RNA, 14 nt, Mycobacterium bovis subsp bovis AF2122/97
caggcggcggaccc

SEQ ID NO: 3136237 - RNA, 15 nt, Mycobacterium bovis subsp bovis AF2122/97
caggcggcggacccg

SEQ ID NO: 3136238 - RNA, 23 nt, Mycobacterium bovis subsp bovis AF2122/97
cagggccaauuccaugacgggua

SEQ ID NO: 3136239 - RNA, 14 nt, Mycobacterium bovis subsp bovis AF2122/97
cagggccaccacca

SEQ ID NO: 3136240 - RNA, 15 nt, Mycobacterium bovis subsp bovis AF2122/97
cagggccaccaccac

SEQ ID NO: 3136241 - RNA, 18 nt, Mycobacterium bovis subsp bovis AF2122/97
cagggccaccaccacggc

SEQ ID NO: 3136242 - RNA, 12 nt, Mycobacterium bovis subsp bovis AF2122/97
cagggccaccgc

SEQ ID NO: 3136243 - RNA, 16 nt, Mycobacterium bovis subsp bovis AF2122/97
cagggccaccgcgccg

SEQ ID NO: 3136244 - RNA, 17 nt, Mycobacterium bovis subsp bovis AF2122/97
cagggccacuggccggu

SEQ ID NO: 3136245 - RNA, 16 nt, Mycobacterium bovis subsp bovis AF2122/97
cagggccagaucgccg

SEQ ID NO: 3136246 - RNA, 17 nt, Mycobacterium bovis subsp bovis AF2122/97
cagggccagaucgccgg

SEQ ID NO: 3136247 - RNA, 15 nt, Mycobacterium bovis subsp bovis AF2122/97
cagggccagcggcag

SEQ ID NO: 3136248 - RNA, 19 nt, Mycobacterium bovis subsp bovis AF2122/97
cagggccccaccgagcggu

SEQ ID NO: 3136249 - RNA, 18 nt, Mycobacterium bovis subsp bovis AF2122/97
cagggcccuagccggcgc

SEQ ID NO: 3136250 - RNA, 22 nt, Mycobacterium bovis subsp bovis AF2122/97
cagggcccuagccggcgcgccc

SEQ ID NO: 3136251 - RNA, 12 nt, Mycobacterium bovis subsp bovis AF2122/97
cagggcccugcu

SEQ ID NO: 3136252 - RNA, 15 nt, Mycobacterium bovis subsp bovis AF2122/97
cagggcccugcuggc

SEQ ID NO: 3136253 - RNA, 18 nt, Mycobacterium bovis subsp bovis AF2122/97
cagggcccugcuggccca

SEQ ID NO: 3136254 - RNA, 20 nt, Mycobacterium bovis subsp bovis AF2122/97
cagggcccugcuggcccaac

SEQ ID NO: 3136255 - RNA, 12 nt, Mycobacterium bovis subsp bovis AF2122/97
cagggccgccga

SEQ ID NO: 3136256 - RNA, 13 nt, Mycobacterium bovis subsp bovis AF2122/97
cagggccgccgcg

SEQ ID NO: 3136257 - RNA, 14 nt, Mycobacterium bovis subsp bovis AF2122/97
cagggccgccgcga

SEQ ID NO: 3136258 - RNA, 18 nt, Mycobacterium bovis subsp bovis AF2122/97
cagggccgccgcugccgc

SEQ ID NO: 3136259 - RNA, 19 nt, Mycobacterium bovis subsp bovis AF2122/97
cagggccgccgcugccgcc

SEQ ID NO: 3136260 - RNA, 19 nt, Mycobacterium bovis subsp bovis AF2122/97
cagggccgcucgccucgau

SEQ ID NO: 3136261 - RNA, 22 nt, Mycobacterium bovis subsp bovis AF2122/97
cagggccgcucgccucgauggc

SEQ ID NO: 3136262 - RNA, 12 nt, Mycobacterium bovis subsp bovis AF2122/97
cagggccggcac

SEQ ID NO: 3136263 - RNA, 17 nt, Mycobacterium bovis subsp bovis AF2122/97
cagggccggcaccgcag

SEQ ID NO: 3136264 - RNA, 15 nt, Mycobacterium bovis subsp bovis AF2122/97
cagggccuccacccg

SEQ ID NO: 3136265 - RNA, 16 nt, Mycobacterium bovis subsp bovis AF2122/97
cagggccuccacccgc

SEQ ID NO: 3136266 - RNA, 20 nt, Mycobacterium bovis subsp bovis AF2122/97
cagggccuccacccgccacg

SEQ ID NO: 3136267 - RNA, 21 nt, Mycobacterium bovis subsp bovis AF2122/97
cagggccucgaccgccagccg

SEQ ID NO: 3136268 - RNA, 22 nt, Mycobacterium bovis subsp bovis AF2122/97
cagggccucgaccgccagccgc

SEQ ID NO: 3136269 - RNA, 16 nt, Mycobacterium bovis subsp bovis AF2122/97
cagggccuggccacac

SEQ ID NO: 3136270 - RNA, 14 nt, Mycobacterium bovis subsp bovis AF2122/97
cagggccuucgggc

SEQ ID NO: 3136271 - RNA, 22 nt, Mycobacterium bovis subsp bovis AF2122/97
cagggccuugaucggcacaugc

SEQ ID NO: 3136272 - RNA, 16 nt, Mycobacterium bovis subsp bovis AF2122/97
cagggccuuggcaggu

SEQ ID NO: 3136273 - RNA, 21 nt, Mycobacterium bovis subsp bovis AF2122/97
cagggcgacgagaucugcgau

SEQ ID NO: 3136274 - RNA, 16 nt, Mycobacterium bovis subsp bovis AF2122/97
cagggcgacggccaca

SEQ ID NO: 3136275 - RNA, 16 nt, Mycobacterium bovis subsp bovis AF2122/97
cagggcgaucugcgcg

SEQ ID NO: 3136276 - RNA, 12 nt, Mycobacterium bovis subsp bovis AF2122/97
cagggcgccacg

SEQ ID NO: 3136277 - RNA, 13 nt, Mycobacterium bovis subsp bovis AF2122/97
cagggcgccgaau

SEQ ID NO: 3136278 - RNA, 15 nt, Mycobacterium bovis subsp bovis AF2122/97
cagggcgccgacgac

SEQ ID NO: 3136279 - RNA, 21 nt, Mycobacterium bovis subsp bovis AF2122/97
cagggcgccgacgacuccggc

SEQ ID NO: 3136280 - RNA, 22 nt, Mycobacterium bovis subsp bovis AF2122/97
cagggcgcgcaucugcucggca

SEQ ID NO: 3136281 - RNA, 15 nt, Mycobacterium bovis subsp bovis AF2122/97
cagggcggcaacggc

SEQ ID NO: 3136282 - RNA, 17 nt, Mycobacterium bovis subsp bovis AF2122/97
cagggcggcaacggcgg

SEQ ID NO: 3136283 - RNA, 18 nt, Mycobacterium bovis subsp bovis AF2122/97
cagggcggcaacggcggc

SEQ ID NO: 3136284 - RNA, 19 nt, Mycobacterium bovis subsp bovis AF2122/97
cagggcggcaacggcggca

SEQ ID NO: 3136285 - RNA, 20 nt, Mycobacterium bovis subsp bovis AF2122/97
cagggcggcaacggcggcaa

SEQ ID NO: 3136286 - RNA, 13 nt, Mycobacterium bovis subsp bovis AF2122/97
cagggcggcaucc

SEQ ID NO: 3136287 - RNA, 17 nt, Mycobacterium bovis subsp bovis AF2122/97
cagggcggccuccccga

SEQ ID NO: 3136288 - RNA, 19 nt, Mycobacterium bovis subsp bovis AF2122/97
cagggcggccuccccgacc

SEQ ID NO: 3136289 - RNA, 21 nt, Mycobacterium bovis subsp bovis AF2122/97
cagggcggcgaccucggcggc

SEQ ID NO: 3136290 - RNA, 18 nt, Mycobacterium bovis subsp bovis AF2122/97
cagggcggugcucuucgg

SEQ ID NO: 3136291 - RNA, 16 nt, Mycobacterium bovis subsp bovis AF2122/97
cagggcgguggccacc

SEQ ID NO: 3136292 - RNA, 19 nt, Mycobacterium bovis subsp bovis AF2122/97
cagggcgguggccacccgg

SEQ ID NO: 3136293 - RNA, 21 nt, Mycobacterium bovis subsp bovis AF2122/97
cagggcgguggccacccggcc

SEQ ID NO: 3136294 - RNA, 18 nt, Mycobacterium bovis subsp bovis AF2122/97
cagggcgucgaacucauc

SEQ ID NO: 3136295 - RNA, 20 nt, Mycobacterium bovis subsp bovis AF2122/97
cagggcgucggcgacgucca

SEQ ID NO: 3136296 - RNA, 14 nt, Mycobacterium bovis subsp bovis AF2122/97
cagggcugccgguu

SEQ ID NO: 3136297 - RNA, 13 nt, Mycobacterium bovis subsp bovis AF2122/97
cagggcugcgaug

SEQ ID NO: 3136298 - RNA, 16 nt, Mycobacterium bovis subsp bovis AF2122/97
cagggcugcgaugcgg

SEQ ID NO: 3136299 - RNA, 15 nt, Mycobacterium bovis subsp bovis AF2122/97
caggggacccggggc

SEQ ID NO: 3136300 - RNA, 16 nt, Mycobacterium bovis subsp bovis AF2122/97
caggggacgggcggcc

SEQ ID NO: 3136301 - RNA, 22 nt, Mycobacterium bovis subsp bovis AF2122/97
caggggaggcgaaaaacaccua

SEQ ID NO: 3136302 - RNA, 23 nt, Mycobacterium bovis subsp bovis AF2122/97
caggggaguugcuugcagggcca

SEQ ID NO: 3136303 - RNA, 16 nt, Mycobacterium bovis subsp bovis AF2122/97
caggggaucguccggc

SEQ ID NO: 3136304 - RNA, 18 nt, Mycobacterium bovis subsp bovis AF2122/97
caggggaucguccggccg

SEQ ID NO: 3136305 - RNA, 20 nt, Mycobacterium bovis subsp bovis AF2122/97
caggggccagcgcgccacga

SEQ ID NO: 3136306 - RNA, 12 nt, Mycobacterium bovis subsp bovis AF2122/97
caggggcgcagc

SEQ ID NO: 3136307 - RNA, 16 nt, Mycobacterium bovis subsp bovis AF2122/97
caggggcgcagcgcgg

SEQ ID NO: 3136308 - RNA, 17 nt, Mycobacterium bovis subsp bovis AF2122/97
caggggcgcagcgcggc

SEQ ID NO: 3136309 - RNA, 18 nt, Mycobacterium bovis subsp bovis AF2122/97
caggggcgcagcgcggca

SEQ ID NO: 3136310 - RNA, 14 nt, Mycobacterium bovis subsp bovis AF2122/97
caggggcuggugcu

SEQ ID NO: 3136311 - RNA, 23 nt, Mycobacterium bovis subsp bovis AF2122/97
caggggguggugucgcggccgcc

SEQ ID NO: 3136312 - RNA, 18 nt, Mycobacterium bovis subsp bovis AF2122/97
cagggguggcgcgggccg

SEQ ID NO: 3136313 - RNA, 17 nt, Mycobacterium bovis subsp bovis AF2122/97
caggguauccacgccgg

SEQ ID NO: 3136314 - RNA, 18 nt, Mycobacterium bovis subsp bovis AF2122/97
caggguauccacgccggg

SEQ ID NO: 3136315 - RNA, 17 nt, Mycobacterium bovis subsp bovis AF2122/97
cagggucaccucgucgc

SEQ ID NO: 3136316 - RNA, 14 nt, Mycobacterium bovis subsp bovis AF2122/97
cagggucacggucg

SEQ ID NO: 3136317 - RNA, 14 nt, Mycobacterium bovis subsp bovis AF2122/97
cagggucagcgccg

SEQ ID NO: 3136318 - RNA, 16 nt, Mycobacterium bovis subsp bovis AF2122/97
cagggucagcgccgcg

SEQ ID NO: 3136319 - RNA, 14 nt, Mycobacterium bovis subsp bovis AF2122/97
cagggucagcucgg

SEQ ID NO: 3136320 - RNA, 13 nt, Mycobacterium bovis subsp bovis AF2122/97
cagggucagcugg

SEQ ID NO: 3136321 - RNA, 20 nt, Mycobacterium bovis subsp bovis AF2122/97
cagggucccgccgccuggaa

SEQ ID NO: 3136322 - RNA, 21 nt, Mycobacterium bovis subsp bovis AF2122/97
cagggucgaguucgcagucga

SEQ ID NO: 3136323 - RNA, 16 nt, Mycobacterium bovis subsp bovis AF2122/97
cagggucugcgccgcc

SEQ ID NO: 3136324 - RNA, 19 nt, Mycobacterium bovis subsp bovis AF2122/97
cagggucugcgccgccggc

SEQ ID NO: 3136325 - RNA, 22 nt, Mycobacterium bovis subsp bovis AF2122/97
cagggucugcgccgccggcggc

SEQ ID NO: 3136326 - RNA, 13 nt, Mycobacterium bovis subsp bovis AF2122/97
cagggucugcuca

SEQ ID NO: 3136327 - RNA, 23 nt, Mycobacterium bovis subsp bovis AF2122/97
cagggugacuucgcugcgguggg

SEQ ID NO: 3136328 - RNA, 15 nt, Mycobacterium bovis subsp bovis AF2122/97
cagggugcccucggc

SEQ ID NO: 3136329 - RNA, 17 nt, Mycobacterium bovis subsp bovis AF2122/97
cagggugcccucggccg

SEQ ID NO: 3136330 - RNA, 18 nt, Mycobacterium bovis subsp bovis AF2122/97
cagggugcccucggccgc

SEQ ID NO: 3136331 - RNA, 19 nt, Mycobacterium bovis subsp bovis AF2122/97
cagggugcccucggccgcc

SEQ ID NO: 3136332 - RNA, 21 nt, Mycobacterium bovis subsp bovis AF2122/97
cagggugcccucggccgccug

SEQ ID NO: 3136333 - RNA, 18 nt, Mycobacterium bovis subsp bovis AF2122/97
cagggugccggcgccgcc

SEQ ID NO: 3136334 - RNA, 19 nt, Mycobacterium bovis subsp bovis AF2122/97
cagggugccggcgccgccc

SEQ ID NO: 3136335 - RNA, 14 nt, Mycobacterium bovis subsp bovis AF2122/97
cagggugccggcgg

SEQ ID NO: 3136336 - RNA, 15 nt, Mycobacterium bovis subsp bovis AF2122/97
cagggugccggcggu

SEQ ID NO: 3136337 - RNA, 18 nt, Mycobacterium bovis subsp bovis AF2122/97
cagggugccggcggugac

SEQ ID NO: 3136338 - RNA, 23 nt, Mycobacterium bovis subsp bovis AF2122/97
cagggugccggcggugacggcgg

SEQ ID NO: 3136339 - RNA, 15 nt, Mycobacterium bovis subsp bovis AF2122/97
cagggugccggucac

SEQ ID NO: 3136340 - RNA, 14 nt, Mycobacterium bovis subsp bovis AF2122/97
cagggugccgucgg

SEQ ID NO: 3136341 - RNA, 14 nt, Mycobacterium bovis subsp bovis AF2122/97
cagggugcgccggu

SEQ ID NO: 3136342 - RNA, 20 nt, Mycobacterium bovis subsp bovis AF2122/97
cagggugcgcuugcggccgc

SEQ ID NO: 3136343 - RNA, 23 nt, Mycobacterium bovis subsp bovis AF2122/97
cagggugcgcuugcggccgcgcg

SEQ ID NO: 3136344 - RNA, 21 nt, Mycobacterium bovis subsp bovis AF2122/97
caggguggcccggggacgggu

SEQ ID NO: 3136345 - RNA, 14 nt, Mycobacterium bovis subsp bovis AF2122/97
caggguggcgacgu

SEQ ID NO: 3136346 - RNA, 23 nt, Mycobacterium bovis subsp bovis AF2122/97
caggguggcgacgucaaacgcaa

SEQ ID NO: 3136347 - RNA, 17 nt, Mycobacterium bovis subsp bovis AF2122/97
caggguggggcgguggc

SEQ ID NO: 3136348 - RNA, 15 nt, Mycobacterium bovis subsp bovis AF2122/97
caggguguccgucga

SEQ ID NO: 3136349 - RNA, 18 nt, Mycobacterium bovis subsp bovis AF2122/97
caggguguccgucgaacc

SEQ ID NO: 3136350 - RNA, 17 nt, Mycobacterium bovis subsp bovis AF2122/97
cagggugucgaagagca

SEQ ID NO: 3136351 - RNA, 20 nt, Mycobacterium bovis subsp bovis AF2122/97
cagggugucgaagagcaggc

SEQ ID NO: 3136352 - RNA, 21 nt, Mycobacterium bovis subsp bovis AF2122/97
cagggugucgucuugcgucca

SEQ ID NO: 3136353 - RNA, 15 nt, Mycobacterium bovis subsp bovis AF2122/97
cagggugucugugau

SEQ ID NO: 3136354 - RNA, 18 nt, Mycobacterium bovis subsp bovis AF2122/97
cagggugugcgaacaagu

SEQ ID NO: 3136355 - RNA, 19 nt, Mycobacterium bovis subsp bovis AF2122/97
cagggugugcgucugcggc

SEQ ID NO: 3136356 - RNA, 21 nt, Mycobacterium bovis subsp bovis AF2122/97
caggguguucacguucagccc

SEQ ID NO: 3136357 - RNA, 19 nt, Mycobacterium bovis subsp bovis AF2122/97
caggguguugaucucgccg

SEQ ID NO: 3136358 - RNA, 20 nt, Mycobacterium bovis subsp bovis AF2122/97
caggguguuuauggcccugg

SEQ ID NO: 3136359 - RNA, 21 nt, Mycobacterium bovis subsp bovis AF2122/97
caggguuccggauccgaugac

SEQ ID NO: 3136360 - RNA, 23 nt, Mycobacterium bovis subsp bovis AF2122/97
caggguucgucgggacgccgccc

SEQ ID NO: 3136361 - RNA, 17 nt, Mycobacterium bovis subsp bovis AF2122/97
caggguugccaucaagg

SEQ ID NO: 3136362 - RNA, 15 nt, Mycobacterium bovis subsp bovis AF2122/97
caggguuggcaccgu

SEQ ID NO: 3136363 - RNA, 14 nt, Mycobacterium bovis subsp bovis AF2122/97
caggguuggcagcc

SEQ ID NO: 3136364 - RNA, 13 nt, Mycobacterium bovis subsp bovis AF2122/97
cagguaagcagcc

SEQ ID NO: 3136365 - RNA, 17 nt, Mycobacterium bovis subsp bovis AF2122/97
cagguaagcagccagca

SEQ ID NO: 3136366 - RNA, 13 nt, Mycobacterium bovis subsp bovis AF2122/97
cagguaagccaca

SEQ ID NO: 3136367 - RNA, 15 nt, Mycobacterium bovis subsp bovis AF2122/97
cagguaagccacaua

SEQ ID NO: 3136368 - RNA, 22 nt, Mycobacterium bovis subsp bovis AF2122/97
cagguaaugguggcguccaggg

SEQ ID NO: 3136369 - RNA, 16 nt, Mycobacterium bovis subsp bovis AF2122/97
cagguaauugccgacc

SEQ ID NO: 3136370 - RNA, 17 nt, Mycobacterium bovis subsp bovis AF2122/97
cagguaauugccgaccg

SEQ ID NO: 3136371 - RNA, 21 nt, Mycobacterium bovis subsp bovis AF2122/97
cagguaauugccgaccgccug

SEQ ID NO: 3136372 - RNA, 17 nt, Mycobacterium bovis subsp bovis AF2122/97
cagguacaucccggugu

SEQ ID NO: 3136373 - RNA, 22 nt, Mycobacterium bovis subsp bovis AF2122/97
cagguacaucccggugucgaug

SEQ ID NO: 3136374 - RNA, 16 nt, Mycobacterium bovis subsp bovis AF2122/97
cagguaccaccgcggu

SEQ ID NO: 3136375 - RNA, 14 nt, Mycobacterium bovis subsp bovis AF2122/97
cagguacgccaggu

SEQ ID NO: 3136376 - RNA, 18 nt, Mycobacterium bovis subsp bovis AF2122/97
cagguacgcgaucagcgc

SEQ ID NO: 3136377 - RNA, 14 nt, Mycobacterium bovis subsp bovis AF2122/97
cagguacucgcccc

SEQ ID NO: 3136378 - RNA, 23 nt, Mycobacterium bovis subsp bovis AF2122/97
cagguagaacuccucgcugucga

SEQ ID NO: 3136379 - RNA, 14 nt, Mycobacterium bovis subsp bovis AF2122/97
cagguagcgcucga

SEQ ID NO: 3136380 - RNA, 13 nt, Mycobacterium bovis subsp bovis AF2122/97
cagguaggcgcga

SEQ ID NO: 3136381 - RNA, 23 nt, Mycobacterium bovis subsp bovis AF2122/97
cagguagucgccggucaggcuca

SEQ ID NO: 3136382 - RNA, 23 nt, Mycobacterium bovis subsp bovis AF2122/97
cagguaucggggggucuugccga

SEQ ID NO: 3136383 - RNA, 23 nt, Mycobacterium bovis subsp bovis AF2122/97
cagguauuugccgugcucaccgg

SEQ ID NO: 3136384 - RNA, 18 nt, Mycobacterium bovis subsp bovis AF2122/97
caggucagccgcgcgggu

SEQ ID NO: 3136385 - RNA, 18 nt, Mycobacterium bovis subsp bovis AF2122/97
caggucauauugugggug

SEQ ID NO: 3136386 - RNA, 15 nt, Mycobacterium bovis subsp bovis AF2122/97
caggucaucggcggc

SEQ ID NO: 3136387 - RNA, 13 nt, Mycobacterium bovis subsp bovis AF2122/97
caggucaucggug

SEQ ID NO: 3136388 - RNA, 16 nt, Mycobacterium bovis subsp bovis AF2122/97
caggucauugccggcg

SEQ ID NO: 3136389 - RNA, 21 nt, Mycobacterium bovis subsp bovis AF2122/97
cagguccaaguccuccacggc

SEQ ID NO: 3136390 - RNA, 13 nt, Mycobacterium bovis subsp bovis AF2122/97
cagguccaccccg

SEQ ID NO: 3136391 - RNA, 16 nt, Mycobacterium bovis subsp bovis AF2122/97
cagguccaccgcugcc

SEQ ID NO: 3136392 - RNA, 19 nt, Mycobacterium bovis subsp bovis AF2122/97
cagguccaccgcugccggc

SEQ ID NO: 3136393 - RNA, 13 nt, Mycobacterium bovis subsp bovis AF2122/97
cagguccaucugg

SEQ ID NO: 3136394 - RNA, 18 nt, Mycobacterium bovis subsp bovis AF2122/97
cagguccgccggugccgc

SEQ ID NO: 3136395 - RNA, 19 nt, Mycobacterium bovis subsp bovis AF2122/97
cagguccgccggugccgcc

SEQ ID NO: 3136396 - RNA, 20 nt, Mycobacterium bovis subsp bovis AF2122/97
cagguccgccggugccgccg

SEQ ID NO: 3136397 - RNA, 21 nt, Mycobacterium bovis subsp bovis AF2122/97
cagguccgccggugccgccgu

SEQ ID NO: 3136398 - RNA, 14 nt, Mycobacterium bovis subsp bovis AF2122/97
cagguccgcggccg

SEQ ID NO: 3136399 - RNA, 15 nt, Mycobacterium bovis subsp bovis AF2122/97
cagguccgcggccgc

SEQ ID NO: 3136400 - RNA, 17 nt, Mycobacterium bovis subsp bovis AF2122/97
cagguccgcgugcugcc

SEQ ID NO: 3136401 - RNA, 21 nt, Mycobacterium bovis subsp bovis AF2122/97
cagguccggggaaagccgcag

SEQ ID NO: 3136402 - RNA, 23 nt, Mycobacterium bovis subsp bovis AF2122/97
cagguccuaggugugcgacgacg

SEQ ID NO: 3136403 - RNA, 18 nt, Mycobacterium bovis subsp bovis AF2122/97
cagguccugcgccgcacg

SEQ ID NO: 3136404 - RNA, 17 nt, Mycobacterium bovis subsp bovis AF2122/97
caggucgacaccgcggu

SEQ ID NO: 3136405 - RNA, 18 nt, Mycobacterium bovis subsp bovis AF2122/97
caggucgacaccgcggug

SEQ ID NO: 3136406 - RNA, 22 nt, Mycobacterium bovis subsp bovis AF2122/97
caggucgacaccgcggugcccc

SEQ ID NO: 3136407 - RNA, 21 nt, Mycobacterium bovis subsp bovis AF2122/97
caggucgacauaggccaccuc

SEQ ID NO: 3136408 - RNA, 15 nt, Mycobacterium bovis subsp bovis AF2122/97
caggucgagcaccgg

SEQ ID NO: 3136409 - RNA, 23 nt, Mycobacterium bovis subsp bovis AF2122/97
caggucgagcgcccacuggugau

SEQ ID NO: 3136410 - RNA, 22 nt, Mycobacterium bovis subsp bovis AF2122/97
caggucgauaccggcgugcagu

SEQ ID NO: 3136411 - RNA, 19 nt, Mycobacterium bovis subsp bovis AF2122/97
cagguguaggugccccacu

SEQ ID NO: 3136412 - RNA, 20 nt, Mycobacterium bovis subsp bovis AF2122/97
cagguguaggugccccacuc

SEQ ID NO: 3136413 - RNA, 17 nt, Mycobacterium bovis subsp bovis AF2122/97
caggugucgcugcugaa

SEQ ID NO: 3136414 - RNA, 20 nt, Mycobacterium bovis subsp bovis AF2122/97
caggugucgcugcugaacaa

SEQ ID NO: 3136415 - RNA, 22 nt, Mycobacterium bovis subsp bovis AF2122/97
caggugucgcugcugaacaacc

SEQ ID NO: 3136416 - RNA, 15 nt, Mycobacterium bovis subsp bovis AF2122/97
caggugucgucgauc

SEQ ID NO: 3136417 - RNA, 16 nt, Mycobacterium bovis subsp bovis AF2122/97
caggugucgucgaucg

SEQ ID NO: 3136418 - RNA, 23 nt, Mycobacterium bovis subsp bovis AF2122/97
cagguguugcacgagcaucauug

SEQ ID NO: 3136419 - RNA, 15 nt, Mycobacterium bovis subsp bovis AF2122/97
cagguguuggugcgg

SEQ ID NO: 3136420 - RNA, 18 nt, Mycobacterium bovis subsp bovis AF2122/97
cagguuaggcaauagccg

SEQ ID NO: 3136421 - RNA, 16 nt, Mycobacterium bovis subsp bovis AF2122/97
cagguuaggguccagg

SEQ ID NO: 3136422 - RNA, 17 nt, Mycobacterium bovis subsp bovis AF2122/97
cagguuaggguccaggu

SEQ ID NO: 3136423 - RNA, 21 nt, Mycobacterium bovis subsp bovis AF2122/97
cagguucaugcaaaagccgcg

SEQ ID NO: 3136424 - RNA, 17 nt, Mycobacterium bovis subsp bovis AF2122/97
cagguuccacgcguuga

SEQ ID NO: 3136425 - RNA, 20 nt, Mycobacterium bovis subsp bovis AF2122/97
cagguuccacgcguugacga

SEQ ID NO: 3136426 - RNA, 14 nt, Mycobacterium bovis subsp bovis AF2122/97
cagguucgucaggu

SEQ ID NO: 3136427 - RNA, 17 nt, Mycobacterium bovis subsp bovis AF2122/97
cagguucuucuccacca

SEQ ID NO: 3136428 - RNA, 19 nt, Mycobacterium bovis subsp bovis AF2122/97
cagguucuugaccagcagc

SEQ ID NO: 3136429 - RNA, 22 nt, Mycobacterium bovis subsp bovis AF2122/97
cagguugaagaaugccgucuga

SEQ ID NO: 3136430 - RNA, 17 nt, Mycobacterium bovis subsp bovis AF2122/97
cagguugauccagugcu

SEQ ID NO: 3136431 - RNA, 19 nt, Mycobacterium bovis subsp bovis AF2122/97
cagguugcguugcaggaaa

SEQ ID NO: 3136432 - RNA, 13 nt, Mycobacterium bovis subsp bovis AF2122/97
cagguuggcaagc

SEQ ID NO: 3136433 - RNA, 14 nt, Mycobacterium bovis subsp bovis AF2122/97
cagguuggcaagca

SEQ ID NO: 3136434 - RNA, 23 nt, Mycobacterium bovis subsp bovis AF2122/97
cagguuggcaagcacggcgucga

SEQ ID NO: 3136435 - RNA, 14 nt, Mycobacterium bovis subsp bovis AF2122/97
cagguuggcacgcu

SEQ ID NO: 3136436 - RNA, 22 nt, Mycobacterium bovis subsp bovis AF2122/97
cagguuggcacgcugucgaucu

SEQ ID NO: 3136437 - RNA, 15 nt, Mycobacterium bovis subsp bovis AF2122/97
cagguuggccaccgc

SEQ ID NO: 3136438 - RNA, 16 nt, Mycobacterium bovis subsp bovis AF2122/97
cagguuggccaccgcc

SEQ ID NO: 3136439 - RNA, 17 nt, Mycobacterium bovis subsp bovis AF2122/97
cagguuggucaccaccu

SEQ ID NO: 3136440 - RNA, 23 nt, Mycobacterium bovis subsp bovis AF2122/97
cagguuggugcucagcggcucgc

SEQ ID NO: 3136441 - RNA, 18 nt, Mycobacterium bovis subsp bovis AF2122/97
cagguuguaguccgcgcc

SEQ ID NO: 3136442 - RNA, 13 nt, Mycobacterium bovis subsp bovis AF2122/97
cagguugucggcg

SEQ ID NO: 3136443 - RNA, 18 nt, Mycobacterium bovis subsp bovis AF2122/97
cagguugucggcgaucaa

SEQ ID NO: 3136444 - RNA, 20 nt, Mycobacterium bovis subsp bovis AF2122/97
cagguugugauccugggugu

SEQ ID NO: 3136445 - RNA, 14 nt, Mycobacterium bovis subsp bovis AF2122/97
cagguuuccggccu

SEQ ID NO: 3136446 - RNA, 17 nt, Mycobacterium bovis subsp bovis AF2122/97
cagguuuccggccugca

SEQ ID NO: 3136447 - RNA, 21 nt, Mycobacterium bovis subsp bovis AF2122/97
cagguuugcgccgcgcagcga

SEQ ID NO: 3136448 - RNA, 19 nt, Mycobacterium bovis subsp bovis AF2122/97
cagguuuugccgcguacga

SEQ ID NO: 3136449 - RNA, 17 nt, Mycobacterium bovis subsp bovis AF2122/97
caguaacuucaccggcu

SEQ ID NO: 3136450 - RNA, 15 nt, Mycobacterium bovis subsp bovis AF2122/97
caguaauucggccau

SEQ ID NO: 3136451 - RNA, 16 nt, Mycobacterium bovis subsp bovis AF2122/97
caguacaccgcccggc

SEQ ID NO: 3136452 - RNA, 18 nt, Mycobacterium bovis subsp bovis AF2122/97
caguacaccgcccggccc

SEQ ID NO: 3136453 - RNA, 16 nt, Mycobacterium bovis subsp bovis AF2122/97
caguacaccggcgugc

SEQ ID NO: 3136454 - RNA, 13 nt, Mycobacterium bovis subsp bovis AF2122/97
caguacagcgcgu

SEQ ID NO: 3136455 - RNA, 15 nt, Mycobacterium bovis subsp bovis AF2122/97
caguaccaccggcac

SEQ ID NO: 3136456 - RNA, 24 nt, Mycobacterium bovis subsp bovis AF2122/97
caguaccaccggcaccggccgugc

SEQ ID NO: 3136457 - RNA, 23 nt, Mycobacterium bovis subsp bovis AF2122/97
caguacgaucucauccuccugcg

SEQ ID NO: 3136458 - RNA, 13 nt, Mycobacterium bovis subsp bovis AF2122/97
caguacgcgcuga

SEQ ID NO: 3136459 - RNA, 23 nt, Mycobacterium bovis subsp bovis AF2122/97
caguacgucgaucaacaggucua

SEQ ID NO: 3136460 - RNA, 15 nt, Mycobacterium bovis subsp bovis AF2122/97
caguacuaacaacac

SEQ ID NO: 3136461 - RNA, 19 nt, Mycobacterium bovis subsp bovis AF2122/97
caguacuaacaacaccacc

SEQ ID NO: 3136462 - RNA, 23 nt, Mycobacterium bovis subsp bovis AF2122/97
caguacuaacaacaccaccagca

SEQ ID NO: 3136463 - RNA, 21 nt, Mycobacterium bovis subsp bovis AF2122/97
caguagaucgccucgacgcgg

SEQ ID NO: 3136464 - RNA, 20 nt, Mycobacterium bovis subsp bovis AF2122/97
caguagcacguugacgucca

SEQ ID NO: 3136465 - RNA, 15 nt, Mycobacterium bovis subsp bovis AF2122/97
caguagccacgccca

SEQ ID NO: 3136466 - RNA, 18 nt, Mycobacterium bovis subsp bovis AF2122/97
caguagccggugccggcg

SEQ ID NO: 3136467 - RNA, 19 nt, Mycobacterium bovis subsp bovis AF2122/97
caguagccggugccggcgc

SEQ ID NO: 3136468 - RNA, 16 nt, Mycobacterium bovis subsp bovis AF2122/97
caguagcuguggcccg

SEQ ID NO: 3136469 - RNA, 16 nt, Mycobacterium bovis subsp bovis AF2122/97
caguaggccuccgcug

SEQ ID NO: 3136470 - RNA, 19 nt, Mycobacterium bovis subsp bovis AF2122/97
caguaggccuccgcugccg

SEQ ID NO: 3136471 - RNA, 20 nt, Mycobacterium bovis subsp bovis AF2122/97
caguaggugucgggcucgca

SEQ ID NO: 3136472 - RNA, 21 nt, Mycobacterium bovis subsp bovis AF2122/97
caguaggugucgggcucgcau

SEQ ID NO: 3136473 - RNA, 17 nt, Mycobacterium bovis subsp bovis AF2122/97
caguaugaggucuacuu

SEQ ID NO: 3136474 - RNA, 17 nt, Mycobacterium bovis subsp bovis AF2122/97
caguaugcggugcccgc

SEQ ID NO: 3136475 - RNA, 13 nt, Mycobacterium bovis subsp bovis AF2122/97
cagucaacagggc

SEQ ID NO: 3136476 - RNA, 19 nt, Mycobacterium bovis subsp bovis AF2122/97
cagucaacucccgaacacu

SEQ ID NO: 3136477 - RNA, 17 nt, Mycobacterium bovis subsp bovis AF2122/97
cagucaccaaccacaug

SEQ ID NO: 3136478 - RNA, 13 nt, Mycobacterium bovis subsp bovis AF2122/97
cagucacgcccac

SEQ ID NO: 3136479 - RNA, 17 nt, Mycobacterium bovis subsp bovis AF2122/97
cagucacgcccaccacu

SEQ ID NO: 3136480 - RNA, 21 nt, Mycobacterium bovis subsp bovis AF2122/97
cagucaggccuagcgcggcga

SEQ ID NO: 3136481 - RNA, 15 nt, Mycobacterium bovis subsp bovis AF2122/97
caguccaagcuguca

SEQ ID NO: 3136482 - RNA, 19 nt, Mycobacterium bovis subsp bovis AF2122/97
caguccaaucuucucgagc

SEQ ID NO: 3136483 - RNA, 15 nt, Mycobacterium bovis subsp bovis AF2122/97
caguccaccgcgcgg

SEQ ID NO: 3136484 - RNA, 17 nt, Mycobacterium bovis subsp bovis AF2122/97
caguccacgagcacggg

SEQ ID NO: 3136485 - RNA, 22 nt, Mycobacterium bovis subsp bovis AF2122/97
caguccacgcguagcggucccg

SEQ ID NO: 3136486 - RNA, 20 nt, Mycobacterium bovis subsp bovis AF2122/97
caguccacugaucaggccga

SEQ ID NO: 3136487 - RNA, 15 nt, Mycobacterium bovis subsp bovis AF2122/97
caguccagccgggug

SEQ ID NO: 3136488 - RNA, 14 nt, Mycobacterium bovis subsp bovis AF2122/97
caguccagcgggca

SEQ ID NO: 3136489 - RNA, 15 nt, Mycobacterium bovis subsp bovis AF2122/97
caguccagcgggcau

SEQ ID NO: 3136490 - RNA, 21 nt, Mycobacterium bovis subsp bovis AF2122/97
caguccaggacggucgccagg

SEQ ID NO: 3136491 - RNA, 21 nt, Mycobacterium bovis subsp bovis AF2122/97
caguccaggcacuccagcggc

SEQ ID NO: 3136492 - RNA, 15 nt, Mycobacterium bovis subsp bovis AF2122/97
caguccaucgacagg

SEQ ID NO: 3136493 - RNA, 18 nt, Mycobacterium bovis subsp bovis AF2122/97
caguccaugugcccaggu

SEQ ID NO: 3136494 - RNA, 18 nt, Mycobacterium bovis subsp bovis AF2122/97
cagucccacugggccggu

SEQ ID NO: 3136495 - RNA, 16 nt, Mycobacterium bovis subsp bovis AF2122/97
cagucccagcgccgca

SEQ ID NO: 3136496 - RNA, 23 nt, Mycobacterium bovis subsp bovis AF2122/97
cagucccagcgccgcacagaaaa

SEQ ID NO: 3136497 - RNA, 15 nt, Mycobacterium bovis subsp bovis AF2122/97
cagugcaggcggccg

SEQ ID NO: 3136498 - RNA, 19 nt, Mycobacterium bovis subsp bovis AF2122/97
cagugcauacgguugaugc

SEQ ID NO: 3136499 - RNA, 18 nt, Mycobacterium bovis subsp bovis AF2122/97
cagugcaucgaucaccgc

SEQ ID NO: 3136500 - RNA, 20 nt, Mycobacterium bovis subsp bovis AF2122/97
cagugcaucgaucaccgcuu

SEQ ID NO: 3136501 - RNA, 21 nt, Mycobacterium bovis subsp bovis AF2122/97
cagugccaauuccagcccccc

SEQ ID NO: 3136502 - RNA, 19 nt, Mycobacterium bovis subsp bovis AF2122/97
cagugccaccugggcgggc

SEQ ID NO: 3136503 - RNA, 15 nt, Mycobacterium bovis subsp bovis AF2122/97
cagugccacgccuga

SEQ ID NO: 3136504 - RNA, 14 nt, Mycobacterium bovis subsp bovis AF2122/97
cagugccaucuaca

SEQ ID NO: 3136505 - RNA, 17 nt, Mycobacterium bovis subsp bovis AF2122/97
cagugccaucuacaucg

SEQ ID NO: 3136506 - RNA, 17 nt, Mycobacterium bovis subsp bovis AF2122/97
cagugccccgcagcacu

SEQ ID NO: 3136507 - RNA, 18 nt, Mycobacterium bovis subsp bovis AF2122/97
cagugccccgcagcacuc

SEQ ID NO: 3136508 - RNA, 15 nt, Mycobacterium bovis subsp bovis AF2122/97
cagugccccgcccgg

SEQ ID NO: 3136509 - RNA, 14 nt, Mycobacterium bovis subsp bovis AF2122/97
cagugccccgccga

SEQ ID NO: 3136510 - RNA, 15 nt, Mycobacterium bovis subsp bovis AF2122/97
cagugcccgaucgcu

SEQ ID NO: 3136511 - RNA, 17 nt, Mycobacterium bovis subsp bovis AF2122/97
cagugcccgcacugccg

SEQ ID NO: 3136512 - RNA, 19 nt, Mycobacterium bovis subsp bovis AF2122/97
cagugcccgcacugccgcc

SEQ ID NO: 3136513 - RNA, 18 nt, Mycobacterium bovis subsp bovis AF2122/97
cagugccgcccaccacac

SEQ ID NO: 3136514 - RNA, 22 nt, Mycobacterium bovis subsp bovis AF2122/97
cagugccgcccaccacacagcc

SEQ ID NO: 3136515 - RNA, 14 nt, Mycobacterium bovis subsp bovis AF2122/97
cagugccgccggcc

SEQ ID NO: 3136516 - RNA, 15 nt, Mycobacterium bovis subsp bovis AF2122/97
cagugccgccggcca

SEQ ID NO: 3136517 - RNA, 17 nt, Mycobacterium bovis subsp bovis AF2122/97
cagugccgguucgaugg

SEQ ID NO: 3136518 - RNA, 14 nt, Mycobacterium bovis subsp bovis AF2122/97
cagugccucggcga

SEQ ID NO: 3136519 - RNA, 17 nt, Mycobacterium bovis subsp bovis AF2122/97
cagugccucggcgaugg

SEQ ID NO: 3136520 - RNA, 15 nt, Mycobacterium bovis subsp bovis AF2122/97
cagugccucggcggc

SEQ ID NO: 3136521 - RNA, 14 nt, Mycobacterium bovis subsp bovis AF2122/97
cagugcgacccggg

SEQ ID NO: 3136522 - RNA, 21 nt, Mycobacterium bovis subsp bovis AF2122/97
cagugcgacucugcgucugcu

SEQ ID NO: 3136523 - RNA, 13 nt, Mycobacterium bovis subsp bovis AF2122/97
cagugcgaugcgg

SEQ ID NO: 3136524 - RNA, 16 nt, Mycobacterium bovis subsp bovis AF2122/97
cagugcgaugcggugu

SEQ ID NO: 3136525 - RNA, 15 nt, Mycobacterium bovis subsp bovis AF2122/97
cagugcgcaacccag

SEQ ID NO: 3136526 - RNA, 17 nt, Mycobacterium bovis subsp bovis AF2122/97
cagugcgcaacccagcc

SEQ ID NO: 3136527 - RNA, 19 nt, Mycobacterium bovis subsp bovis AF2122/97
cagugcgcaacccagccgc

SEQ ID NO: 3136528 - RNA, 12 nt, Mycobacterium bovis subsp bovis AF2122/97
cagugcgcacgg

SEQ ID NO: 3136529 - RNA, 15 nt, Mycobacterium bovis subsp bovis AF2122/97
cagugcgcagaacac

SEQ ID NO: 3136530 - RNA, 17 nt, Mycobacterium bovis subsp bovis AF2122/97
cagugcgcagaacacca

SEQ ID NO: 3136531 - RNA, 20 nt, Mycobacterium bovis subsp bovis AF2122/97
cagugcgcagaacaccaccg

SEQ ID NO: 3136532 - RNA, 15 nt, Mycobacterium bovis subsp bovis AF2122/97
cagugcgcagcccgc

SEQ ID NO: 3136533 - RNA, 18 nt, Mycobacterium bovis subsp bovis AF2122/97
cagugcgcggaucaacag

SEQ ID NO: 3136534 - RNA, 23 nt, Mycobacterium bovis subsp bovis AF2122/97
cagugcgcggaucaacaggccgg

SEQ ID NO: 3136535 - RNA, 24 nt, Mycobacterium bovis subsp bovis AF2122/97
cagugcgcggaucaacaggccggc

SEQ ID NO: 3136536 - RNA, 16 nt, Mycobacterium bovis subsp bovis AF2122/97
cagugcgcgugcccgu

SEQ ID NO: 3136537 - RNA, 14 nt, Mycobacterium bovis subsp bovis AF2122/97
cagugcggccuugg

SEQ ID NO: 3136538 - RNA, 23 nt, Mycobacterium bovis subsp bovis AF2122/97
cagugcggccuuggcgacgucgc

SEQ ID NO: 3136539 - RNA, 13 nt, Mycobacterium bovis subsp bovis AF2122/97
cagugcgggcggc

SEQ ID NO: 3136540 - RNA, 17 nt, Mycobacterium bovis subsp bovis AF2122/97
cagugcgggcggcgucu

SEQ ID NO: 3136541 - RNA, 23 nt, Mycobacterium bovis subsp bovis AF2122/97
cagugcgggggcgaccuggugga

SEQ ID NO: 3136542 - RNA, 13 nt, Mycobacterium bovis subsp bovis AF2122/97
cagugcucaucga

SEQ ID NO: 3136543 - RNA, 15 nt, Mycobacterium bovis subsp bovis AF2122/97
cagugcugcagaccc

SEQ ID NO: 3136544 - RNA, 18 nt, Mycobacterium bovis subsp bovis AF2122/97
cagugcugcagacccguu

SEQ ID NO: 3136545 - RNA, 22 nt, Mycobacterium bovis subsp bovis AF2122/97
cagugcugccuugggaccgcgc

SEQ ID NO: 3136546 - RNA, 20 nt, Mycobacterium bovis subsp bovis AF2122/97
caguggaguauccggcagac

SEQ ID NO: 3136547 - RNA, 14 nt, Mycobacterium bovis subsp bovis AF2122/97
caguggauccggca

SEQ ID NO: 3136548 - RNA, 22 nt, Mycobacterium bovis subsp bovis AF2122/97
caguggauccggcagcagccgg

SEQ ID NO: 3136549 - RNA, 17 nt, Mycobacterium bovis subsp bovis AF2122/97
caguggcagccagcggc

SEQ ID NO: 3136550 - RNA, 18 nt, Mycobacterium bovis subsp bovis AF2122/97
caguggcagccagcggcg

SEQ ID NO: 3136551 - RNA, 13 nt, Mycobacterium bovis subsp bovis AF2122/97
caguggcagcccg

SEQ ID NO: 3136552 - RNA, 14 nt, Mycobacterium bovis subsp bovis AF2122/97
caguggccagaccc

SEQ ID NO: 3136553 - RNA, 21 nt, Mycobacterium bovis subsp bovis AF2122/97
caguggcgcccauggccacca

SEQ ID NO: 3136554 - RNA, 18 nt, Mycobacterium bovis subsp bovis AF2122/97
caguggcgcguaggccca

SEQ ID NO: 3136555 - RNA, 17 nt, Mycobacterium bovis subsp bovis AF2122/97
caguggcgcgugcagcg

SEQ ID NO: 3136556 - RNA, 22 nt, Mycobacterium bovis subsp bovis AF2122/97
caguggcuacgcgaucagcugg

SEQ ID NO: 3136557 - RNA, 22 nt, Mycobacterium bovis subsp bovis AF2122/97
caguggcucgcggaugcucguu

SEQ ID NO: 3136558 - RNA, 20 nt, Mycobacterium bovis subsp bovis AF2122/97
cagugggacaaagacgccgu

SEQ ID NO: 3136559 - RNA, 17 nt, Mycobacterium bovis subsp bovis AF2122/97
cagugggacaggucggc

SEQ ID NO: 3136560 - RNA, 18 nt, Mycobacterium bovis subsp bovis AF2122/97
cagugggacaggucggca

SEQ ID NO: 3136561 - RNA, 14 nt, Mycobacterium bovis subsp bovis AF2122/97
cagugggccgacgu

SEQ ID NO: 3136562 - RNA, 16 nt, Mycobacterium bovis subsp bovis AF2122/97
caguggggguccggcg

SEQ ID NO: 3136563 - RNA, 18 nt, Mycobacterium bovis subsp bovis AF2122/97
caguggggguccggcggc

SEQ ID NO: 3136564 - RNA, 19 nt, Mycobacterium bovis subsp bovis AF2122/97
caguggggguccggcggcc

SEQ ID NO: 3136565 - RNA, 20 nt, Mycobacterium bovis subsp bovis AF2122/97
cagugggggugguaccggcg

SEQ ID NO: 3136566 - RNA, 21 nt, Mycobacterium bovis subsp bovis AF2122/97
cagugggggugguaccggcgg

SEQ ID NO: 3136567 - RNA, 15 nt, Mycobacterium bovis subsp bovis AF2122/97
cagugguaccggcgc

SEQ ID NO: 3136568 - RNA, 16 nt, Mycobacterium bovis subsp bovis AF2122/97
cagugguaggccgccg

SEQ ID NO: 3136569 - RNA, 21 nt, Mycobacterium bovis subsp bovis AF2122/97
cagugguaggccgccggaccc

SEQ ID NO: 3136570 - RNA, 15 nt, Mycobacterium bovis subsp bovis AF2122/97
caguguacaccgcgc

SEQ ID NO: 3136571 - RNA, 20 nt, Mycobacterium bovis subsp bovis AF2122/97
caguguacaccgcgcccgcc

SEQ ID NO: 3136572 - RNA, 20 nt, Mycobacterium bovis subsp bovis AF2122/97
cagugucagcacgacgacaa

SEQ ID NO: 3136573 - RNA, 18 nt, Mycobacterium bovis subsp bovis AF2122/97
cagugucgauagcccgcc

SEQ ID NO: 3136574 - RNA, 21 nt, Mycobacterium bovis subsp bovis AF2122/97
cagugucgauagcccgccacc

SEQ ID NO: 3136575 - RNA, 22 nt, Mycobacterium bovis subsp bovis AF2122/97
cagugucgauagcccgccaccc

SEQ ID NO: 3136576 - RNA, 14 nt, Mycobacterium bovis subsp bovis AF2122/97
cagugucucacaaa

SEQ ID NO: 3136577 - RNA, 20 nt, Mycobacterium bovis subsp bovis AF2122/97
cagugugaagaccaccgccc

SEQ ID NO: 3136578 - RNA, 13 nt, Mycobacterium bovis subsp bovis AF2122/97
cagugugcgccgu

SEQ ID NO: 3136579 - RNA, 21 nt, Mycobacterium bovis subsp bovis AF2122/97
cagugugcgguuggaucggcg

SEQ ID NO: 3136580 - RNA, 23 nt, Mycobacterium bovis subsp bovis AF2122/97
cagugugcgguuggaucggcggc

SEQ ID NO: 3136581 - RNA, 14 nt, Mycobacterium bovis subsp bovis AF2122/97
caguguggcgauga

SEQ ID NO: 3136582 - RNA, 19 nt, Mycobacterium bovis subsp bovis AF2122/97
caguguggcgaugaccacg

SEQ ID NO: 3136583 - RNA, 15 nt, Mycobacterium bovis subsp bovis AF2122/97
cauacccagcucguc

SEQ ID NO: 3136584 - RNA, 23 nt, Mycobacterium bovis subsp bovis AF2122/97
cauacccaucaacaucggcccgc

SEQ ID NO: 3136585 - RNA, 16 nt, Mycobacterium bovis subsp bovis AF2122/97
cauaccccgaacauug

SEQ ID NO: 3136586 - RNA, 13 nt, Mycobacterium bovis subsp bovis AF2122/97
cauacccgcgcgc

SEQ ID NO: 3136587 - RNA, 15 nt, Mycobacterium bovis subsp bovis AF2122/97
cauacccgcgcgcac

SEQ ID NO: 3136588 - RNA, 17 nt, Mycobacterium bovis subsp bovis AF2122/97
cauacccgcgcgcacca

SEQ ID NO: 3136589 - RNA, 13 nt, Mycobacterium bovis subsp bovis AF2122/97
cauaccgccgcug

SEQ ID NO: 3136590 - RNA, 16 nt, Mycobacterium bovis subsp bovis AF2122/97
cauaccgccgcugcca

SEQ ID NO: 3136591 - RNA, 14 nt, Mycobacterium bovis subsp bovis AF2122/97
cauaccgccgggcc

SEQ ID NO: 3136592 - RNA, 18 nt, Mycobacterium bovis subsp bovis AF2122/97
cauaccggcuggccaggu

SEQ ID NO: 3136593 - RNA, 16 nt, Mycobacterium bovis subsp bovis AF2122/97
cauaccguucacccag

SEQ ID NO: 3136594 - RNA, 22 nt, Mycobacterium bovis subsp bovis AF2122/97
cauaccguucacccagcggaac

SEQ ID NO: 3136595 - RNA, 20 nt, Mycobacterium bovis subsp bovis AF2122/97
cauaccuaacgagccgucca

SEQ ID NO: 3136596 - RNA, 15 nt, Mycobacterium bovis subsp bovis AF2122/97
cauacgaaacaugcg

SEQ ID NO: 3136597 - RNA, 16 nt, Mycobacterium bovis subsp bovis AF2122/97
cauacgauuucgacga

SEQ ID NO: 3136598 - RNA, 14 nt, Mycobacterium bovis subsp bovis AF2122/97
cauacgcaccggua

SEQ ID NO: 3136599 - RNA, 18 nt, Mycobacterium bovis subsp bovis AF2122/97
cauacgcccacuccagca

SEQ ID NO: 3136600 - RNA, 20 nt, Mycobacterium bovis subsp bovis AF2122/97
cauacgcccacuccagcagc

SEQ ID NO: 3136601 - RNA, 15 nt, Mycobacterium bovis subsp bovis AF2122/97
cauacgccggccgcg

SEQ ID NO: 3136602 - RNA, 18 nt, Mycobacterium bovis subsp bovis AF2122/97
cauacgcggcuuugacgc

SEQ ID NO: 3136603 - RNA, 19 nt, Mycobacterium bovis subsp bovis AF2122/97
cauacgcgugugcgcgugc

SEQ ID NO: 3136604 - RNA, 21 nt, Mycobacterium bovis subsp bovis AF2122/97
cauacggaagggcccggugug

SEQ ID NO: 3136605 - RNA, 15 nt, Mycobacterium bovis subsp bovis AF2122/97
cauacgucgccucga

SEQ ID NO: 3136606 - RNA, 19 nt, Mycobacterium bovis subsp bovis AF2122/97
cauacgugccgccgauguc

SEQ ID NO: 3136607 - RNA, 23 nt, Mycobacterium bovis subsp bovis AF2122/97
cauacgugccgccgaugucgacg

SEQ ID NO: 3136608 - RNA, 20 nt, Mycobacterium bovis subsp bovis AF2122/97
cauacuaauggcgccaccgg

SEQ ID NO: 3136609 - RNA, 19 nt, Mycobacterium bovis subsp bovis AF2122/97
cauacucuuugugcccaau

SEQ ID NO: 3136610 - RNA, 16 nt, Mycobacterium bovis subsp bovis AF2122/97
cauagacagggccgcu

SEQ ID NO: 3136611 - RNA, 18 nt, Mycobacterium bovis subsp bovis AF2122/97
cauagaccaccggcagcg

SEQ ID NO: 3136612 - RNA, 19 nt, Mycobacterium bovis subsp bovis AF2122/97
cauagaccucgccggugac

SEQ ID NO: 3136613 - RNA, 17 nt, Mycobacterium bovis subsp bovis AF2122/97
cauagauacagucgacc

SEQ ID NO: 3136614 - RNA, 17 nt, Mycobacterium bovis subsp bovis AF2122/97
cauagcaauccgcacag

SEQ ID NO: 3136615 - RNA, 18 nt, Mycobacterium bovis subsp bovis AF2122/97
cauagcaauccgcacagc

SEQ ID NO: 3136616 - RNA, 15 nt, Mycobacterium bovis subsp bovis AF2122/97
cauagcccgagcgcu

SEQ ID NO: 3136617 - RNA, 16 nt, Mycobacterium bovis subsp bovis AF2122/97
cauagccguugcgggc

SEQ ID NO: 3136618 - RNA, 13 nt, Mycobacterium bovis subsp bovis AF2122/97
cauagccugcgcc

SEQ ID NO: 3136619 - RNA, 19 nt, Mycobacterium bovis subsp bovis AF2122/97
cauagccugcgccgacccg

SEQ ID NO: 3136620 - RNA, 20 nt, Mycobacterium bovis subsp bovis AF2122/97
cauagcgacggcgcucggcg

SEQ ID NO: 3136621 - RNA, 15 nt, Mycobacterium bovis subsp bovis AF2122/97
cauagcgcaccaccg

SEQ ID NO: 3136622 - RNA, 16 nt, Mycobacterium bovis subsp bovis AF2122/97
cauagcgccgcgccca

SEQ ID NO: 3136623 - RNA, 20 nt, Mycobacterium bovis subsp bovis AF2122/97
cauagcucaacggaaccgau

SEQ ID NO: 3136624 - RNA, 16 nt, Mycobacterium bovis subsp bovis AF2122/97
cauagcucagaccggc

SEQ ID NO: 3136625 - RNA, 11 nt, Mycobacterium bovis subsp bovis AF2122/97
cauagcugccg

SEQ ID NO: 3136626 - RNA, 18 nt, Mycobacterium bovis subsp bovis AF2122/97
cauagcugccggcccacc

SEQ ID NO: 3136627 - RNA, 18 nt, Mycobacterium bovis subsp bovis AF2122/97
cauaggacaggaacggcc

SEQ ID NO: 3136628 - RNA, 21 nt, Mycobacterium bovis subsp bovis AF2122/97
cauaggacaggaacggcccgg

SEQ ID NO: 3136629 - RNA, 18 nt, Mycobacterium bovis subsp bovis AF2122/97
cauaggccgacggguugg

SEQ ID NO: 3136630 - RNA, 16 nt, Mycobacterium bovis subsp bovis AF2122/97
cauaggccgcgucgau

SEQ ID NO: 3136631 - RNA, 14 nt, Mycobacterium bovis subsp bovis AF2122/97
cauaggcgcgguca

SEQ ID NO: 3136632 - RNA, 20 nt, Mycobacterium bovis subsp bovis AF2122/97
cauaggcguaaugcgcggcg

SEQ ID NO: 3136633 - RNA, 16 nt, Mycobacterium bovis subsp bovis AF2122/97
cauaggcuuccggcgc

SEQ ID NO: 3136634 - RNA, 17 nt, Mycobacterium bovis subsp bovis AF2122/97
cauaggcuuccggcgcg

SEQ ID NO: 3136635 - RNA, 15 nt, Mycobacterium bovis subsp bovis AF2122/97
cauagggccaccgcc

SEQ ID NO: 3136636 - RNA, 20 nt, Mycobacterium bovis subsp bovis AF2122/97
cauagggccaccgccgccug

SEQ ID NO: 3136637 - RNA, 16 nt, Mycobacterium bovis subsp bovis AF2122/97
cauagguaugcccgga

SEQ ID NO: 3136638 - RNA, 21 nt, Mycobacterium bovis subsp bovis AF2122/97
cauaggucacaaacggcaagc

SEQ ID NO: 3136639 - RNA, 16 nt, Mycobacterium bovis subsp bovis AF2122/97
cauaggugcggggccg

SEQ ID NO: 3136640 - RNA, 22 nt, Mycobacterium bovis subsp bovis AF2122/97
cauagguuugggcacggaacgc

SEQ ID NO: 3136641 - RNA, 20 nt, Mycobacterium bovis subsp bovis AF2122/97
cauagucgaauggcaacaca

SEQ ID NO: 3136642 - RNA, 21 nt, Mycobacterium bovis subsp bovis AF2122/97
cauagugcggcagcgguggcu

SEQ ID NO: 3136643 - RNA, 18 nt, Mycobacterium bovis subsp bovis AF2122/97
cauagugcggcugcaacg

SEQ ID NO: 3136644 - RNA, 23 nt, Mycobacterium bovis subsp bovis AF2122/97
cauaguuggcgcccgaagccggg

SEQ ID NO: 3136645 - RNA, 21 nt, Mycobacterium bovis subsp bovis AF2122/97
cauauagaucacugcucgucg

SEQ ID NO: 3136646 - RNA, 17 nt, Mycobacterium bovis subsp bovis AF2122/97
cauauccgccggcgaca

SEQ ID NO: 3136647 - RNA, 14 nt, Mycobacterium bovis subsp bovis AF2122/97
cauaucgcccacca

SEQ ID NO: 3136648 - RNA, 12 nt, Mycobacterium bovis subsp bovis AF2122/97
cauaucggugcc

SEQ ID NO: 3136649 - RNA, 22 nt, Mycobacterium bovis subsp bovis AF2122/97
cauaucgugaugugcccauuca

SEQ ID NO: 3136650 - RNA, 22 nt, Mycobacterium bovis subsp bovis AF2122/97
cauauucuuggucgaggucggc

SEQ ID NO: 3136651 - RNA, 23 nt, Mycobacterium bovis subsp bovis AF2122/97
cauauuggcgcggccgaaagagc

SEQ ID NO: 3136652 - RNA, 15 nt, Mycobacterium bovis subsp bovis AF2122/97
cauauugggaguccg

SEQ ID NO: 3136653 - RNA, 21 nt, Mycobacterium bovis subsp bovis AF2122/97
caucaaaaacgaacccaggca

SEQ ID NO: 3136654 - RNA, 19 nt, Mycobacterium bovis subsp bovis AF2122/97
caucaaacccccggggcgc

SEQ ID NO: 3136655 - RNA, 14 nt, Mycobacterium bovis subsp bovis AF2122/97
caucaacaucggcc

SEQ ID NO: 3136656 - RNA, 17 nt, Mycobacterium bovis subsp bovis AF2122/97
caucaacaucggcccgc

SEQ ID NO: 3136657 - RNA, 16 nt, Mycobacterium bovis subsp bovis AF2122/97
caucaacgacaccaga

SEQ ID NO: 3136658 - RNA, 21 nt, Mycobacterium bovis subsp bovis AF2122/97
caucaacgccggcgacggcgu

SEQ ID NO: 3136659 - RNA, 12 nt, Mycobacterium bovis subsp bovis AF2122/97
caucaacugcau

SEQ ID NO: 3136660 - RNA, 14 nt, Mycobacterium bovis subsp bovis AF2122/97
caucaaggccaccu

SEQ ID NO: 3136661 - RNA, 15 nt, Mycobacterium bovis subsp bovis AF2122/97
caucacacccaucac

SEQ ID NO: 3136662 - RNA, 19 nt, Mycobacterium bovis subsp bovis AF2122/97
caucacacccaucacccug

SEQ ID NO: 3136663 - RNA, 23 nt, Mycobacterium bovis subsp bovis AF2122/97
caucacacccgguaugcgcgucc

SEQ ID NO: 3136664 - RNA, 15 nt, Mycobacterium bovis subsp bovis AF2122/97
caucacauccacgca

SEQ ID NO: 3136665 - RNA, 17 nt, Mycobacterium bovis subsp bovis AF2122/97
caucaccacaccggcag

SEQ ID NO: 3136666 - RNA, 15 nt, Mycobacterium bovis subsp bovis AF2122/97
caucaccacccgacc

SEQ ID NO: 3136667 - RNA, 13 nt, Mycobacterium bovis subsp bovis AF2122/97
caucaccaccgcc

SEQ ID NO: 3136668 - RNA, 14 nt, Mycobacterium bovis subsp bovis AF2122/97
caucaccaccggca

SEQ ID NO: 3136669 - RNA, 15 nt, Mycobacterium bovis subsp bovis AF2122/97
caucaccaccggcac

SEQ ID NO: 3136670 - RNA, 19 nt, Mycobacterium bovis subsp bovis AF2122/97
cauccagaagccggccacu

SEQ ID NO: 3136671 - RNA, 20 nt, Mycobacterium bovis subsp bovis AF2122/97
cauccagaagccggccacua

SEQ ID NO: 3136672 - RNA, 22 nt, Mycobacterium bovis subsp bovis AF2122/97
cauccagaaguaggcgaccgcc

SEQ ID NO: 3136673 - RNA, 23 nt, Mycobacterium bovis subsp bovis AF2122/97
cauccagaaguaggcgaccgcca

SEQ ID NO: 3136674 - RNA, 22 nt, Mycobacterium bovis subsp bovis AF2122/97
cauccagagcuggcuacgggcc

SEQ ID NO: 3136675 - RNA, 22 nt, Mycobacterium bovis subsp bovis AF2122/97
cauccagaucggauugccuccg

SEQ ID NO: 3136676 - RNA, 18 nt, Mycobacterium bovis subsp bovis AF2122/97
cauccagaugcccagcag

SEQ ID NO: 3136677 - RNA, 12 nt, Mycobacterium bovis subsp bovis AF2122/97
cauccagcagcg

SEQ ID NO: 3136678 - RNA, 15 nt, Mycobacterium bovis subsp bovis AF2122/97
cauccagcagcgccu

SEQ ID NO: 3136679 - RNA, 20 nt, Mycobacterium bovis subsp bovis AF2122/97
cauccagcgcgcgcugagcc

SEQ ID NO: 3136680 - RNA, 21 nt, Mycobacterium bovis subsp bovis AF2122/97
cauccaggcugucgcgggcca

SEQ ID NO: 3136681 - RNA, 17 nt, Mycobacterium bovis subsp bovis AF2122/97
cauccaguaaccguccg

SEQ ID NO: 3136682 - RNA, 21 nt, Mycobacterium bovis subsp bovis AF2122/97
cauccauccgggccgcggcca

SEQ ID NO: 3136683 - RNA, 19 nt, Mycobacterium bovis subsp bovis AF2122/97
cauccauguugaccucgcg

SEQ ID NO: 3136684 - RNA, 20 nt, Mycobacterium bovis subsp bovis AF2122/97
cauccauucggcggcggcgu

SEQ ID NO: 3136685 - RNA, 15 nt, Mycobacterium bovis subsp bovis AF2122/97
caucccaacgagaug

SEQ ID NO: 3136686 - RNA, 22 nt, Mycobacterium bovis subsp bovis AF2122/97
caucccaacgagaugugagcac

SEQ ID NO: 3136687 - RNA, 13 nt, Mycobacterium bovis subsp bovis AF2122/97
caucccagcgaau

SEQ ID NO: 3136688 - RNA, 12 nt, Mycobacterium bovis subsp bovis AF2122/97
caucccagucga

SEQ ID NO: 3136689 - RNA, 19 nt, Mycobacterium bovis subsp bovis AF2122/97
cauccccagcacaaccagc

SEQ ID NO: 3136690 - RNA, 18 nt, Mycobacterium bovis subsp bovis AF2122/97
cauccccgagcugucggc

SEQ ID NO: 3136691 - RNA, 12 nt, Mycobacterium bovis subsp bovis AF2122/97
cauccccgccgg

SEQ ID NO: 3136692 - RNA, 14 nt, Mycobacterium bovis subsp bovis AF2122/97
cauccccgccggcg

SEQ ID NO: 3136693 - RNA, 15 nt, Mycobacterium bovis subsp bovis AF2122/97
cauccccgccggcgc

SEQ ID NO: 3136694 - RNA, 16 nt, Mycobacterium bovis subsp bovis AF2122/97
cauccccgccggcgcc

SEQ ID NO: 3136695 - RNA, 18 nt, Mycobacterium bovis subsp bovis AF2122/97
cauccccggagcgauccg

SEQ ID NO: 3136696 - RNA, 15 nt, Mycobacterium bovis subsp bovis AF2122/97
cauccccggccagcc

SEQ ID NO: 3136697 - RNA, 19 nt, Mycobacterium bovis subsp bovis AF2122/97
cauccccgguucugcgccc

SEQ ID NO: 3136698 - RNA, 23 nt, Mycobacterium bovis subsp bovis AF2122/97
cauccccgguucugcgcccaccc

SEQ ID NO: 3136699 - RNA, 20 nt, Mycobacterium bovis subsp bovis AF2122/97
cauccccuugguggccagcc

SEQ ID NO: 3136700 - RNA, 19 nt, Mycobacterium bovis subsp bovis AF2122/97
caucccgaaguagaagccc

SEQ ID NO: 3136701 - RNA, 19 nt, Mycobacterium bovis subsp bovis AF2122/97
caucccgaauggccgaucc

SEQ ID NO: 3136702 - RNA, 18 nt, Mycobacterium bovis subsp bovis AF2122/97
caucccgacccuucgggc

SEQ ID NO: 3136703 - RNA, 14 nt, Mycobacterium bovis subsp bovis AF2122/97
caucccgagcucua

SEQ ID NO: 3136704 - RNA, 20 nt, Mycobacterium bovis subsp bovis AF2122/97
caucccgaucccggccagcu

SEQ ID NO: 3136705 - RNA, 17 nt, Mycobacterium bovis subsp bovis AF2122/97
caucccgauccugccca

SEQ ID NO: 3136706 - RNA, 20 nt, Mycobacterium bovis subsp bovis AF2122/97
caucccgauccugcccacca

SEQ ID NO: 3136707 - RNA, 23 nt, Mycobacterium bovis subsp bovis AF2122/97
caucccgauccugcccaccaucc

SEQ ID NO: 3136708 - RNA, 13 nt, Mycobacterium bovis subsp bovis AF2122/97
caucccgccgccc

SEQ ID NO: 3136709 - RNA, 14 nt, Mycobacterium bovis subsp bovis AF2122/97
caucccgccgcccg

SEQ ID NO: 3136710 - RNA, 22 nt, Mycobacterium bovis subsp bovis AF2122/97
caucccgcucagcauucaccaa

SEQ ID NO: 3136711 - RNA, 12 nt, Mycobacterium bovis subsp bovis AF2122/97
caucccggaacg

SEQ ID NO: 3136712 - RNA, 14 nt, Mycobacterium bovis subsp bovis AF2122/97
caucccggccucca

SEQ ID NO: 3136713 - RNA, 13 nt, Mycobacterium bovis subsp bovis AF2122/97
caucccggcgccg

SEQ ID NO: 3136714 - RNA, 15 nt, Mycobacterium bovis subsp bovis AF2122/97
caucccgggcagucc

SEQ ID NO: 3136715 - RNA, 18 nt, Mycobacterium bovis subsp bovis AF2122/97
caucccgggcaguccagg

SEQ ID NO: 3136716 - RNA, 12 nt, Mycobacterium bovis subsp bovis AF2122/97
caucccgguguc

SEQ ID NO: 3136717 - RNA, 17 nt, Mycobacterium bovis subsp bovis AF2122/97
caucccggugucgaugc

SEQ ID NO: 3136718 - RNA, 22 nt, Mycobacterium bovis subsp bovis AF2122/97
caucccggugucgaugcgcagc

SEQ ID NO: 3136719 - RNA, 18 nt, Mycobacterium bovis subsp bovis AF2122/97
caucccguucagcgacca

SEQ ID NO: 3136720 - RNA, 17 nt, Mycobacterium bovis subsp bovis AF2122/97
caucccugacgaagguc

SEQ ID NO: 3136721 - RNA, 18 nt, Mycobacterium bovis subsp bovis AF2122/97
caucccuuucgcgccgcg

SEQ ID NO: 3136722 - RNA, 20 nt, Mycobacterium bovis subsp bovis AF2122/97
caucccuuucgcgccgcgag

SEQ ID NO: 3136723 - RNA, 14 nt, Mycobacterium bovis subsp bovis AF2122/97
cauccgacaagcug

SEQ ID NO: 3136724 - RNA, 17 nt, Mycobacterium bovis subsp bovis AF2122/97
cauccgacaagcugucg

SEQ ID NO: 3136725 - RNA, 14 nt, Mycobacterium bovis subsp bovis AF2122/97
cauccgacagcagc

SEQ ID NO: 3136726 - RNA, 19 nt, Mycobacterium bovis subsp bovis AF2122/97
cauccgagcgggaacgagc

SEQ ID NO: 3136727 - RNA, 20 nt, Mycobacterium bovis subsp bovis AF2122/97
cauccgagcgggaacgagcc

SEQ ID NO: 3136728 - RNA, 17 nt, Mycobacterium bovis subsp bovis AF2122/97
cauccgaucgccgcgaa

SEQ ID NO: 3136729 - RNA, 15 nt, Mycobacterium bovis subsp bovis AF2122/97
cauccgauggcccgg

SEQ ID NO: 3136730 - RNA, 16 nt, Mycobacterium bovis subsp bovis AF2122/97
cauccgccccgcccgc

SEQ ID NO: 3136731 - RNA, 23 nt, Mycobacterium bovis subsp bovis AF2122/97
cauccgccccgcccgcacccaug

SEQ ID NO: 3136732 - RNA, 12 nt, Mycobacterium bovis subsp bovis AF2122/97
cauccgccgccc

SEQ ID NO: 3136733 - RNA, 16 nt, Mycobacterium bovis subsp bovis AF2122/97
cauccgccgcccccgc

SEQ ID NO: 3136734 - RNA, 19 nt, Mycobacterium bovis subsp bovis AF2122/97
cauccgccgcccccgcccg

SEQ ID NO: 3136735 - RNA, 19 nt, Mycobacterium bovis subsp bovis AF2122/97
cauccgccgggccaggccg

SEQ ID NO: 3136736 - RNA, 16 nt, Mycobacterium bovis subsp bovis AF2122/97
cauccgcgacggcgcc

SEQ ID NO: 3136737 - RNA, 16 nt, Mycobacterium bovis subsp bovis AF2122/97
cauccgcggcaugcaa

SEQ ID NO: 3136738 - RNA, 15 nt, Mycobacterium bovis subsp bovis AF2122/97
cauccggccgucggg

SEQ ID NO: 3136739 - RNA, 12 nt, Mycobacterium bovis subsp bovis AF2122/97
cauccggcgccg

SEQ ID NO: 3136740 - RNA, 16 nt, Mycobacterium bovis subsp bovis AF2122/97
cauccggcggcggcca

SEQ ID NO: 3136741 - RNA, 19 nt, Mycobacterium bovis subsp bovis AF2122/97
cauccggcggcggccagga

SEQ ID NO: 3136742 - RNA, 15 nt, Mycobacterium bovis subsp bovis AF2122/97
cauccgggccgcggc

SEQ ID NO: 3136743 - RNA, 17 nt, Mycobacterium bovis subsp bovis AF2122/97
cauccgggccgcggcca

SEQ ID NO: 3136744 - RNA, 19 nt, Mycobacterium bovis subsp bovis AF2122/97
cauccgggccgcggccaca

SEQ ID NO: 3136745 - RNA, 23 nt, Mycobacterium bovis subsp bovis AF2122/97
cauccggucagauagugcaugua

SEQ ID NO: 3136746 - RNA, 23 nt, Mycobacterium bovis subsp bovis AF2122/97
cauccggucgaugucagccacca

SEQ ID NO: 3136747 - RNA, 19 nt, Mycobacterium bovis subsp bovis AF2122/97
cauccggucggucucggcg

SEQ ID NO: 3136748 - RNA, 20 nt, Mycobacterium bovis subsp bovis AF2122/97
cauccggucggucucggcga

SEQ ID NO: 3136749 - RNA, 16 nt, Mycobacterium bovis subsp bovis AF2122/97
cauccggucucggccg

SEQ ID NO: 3136750 - RNA, 17 nt, Mycobacterium bovis subsp bovis AF2122/97
cauccggucucggccga

SEQ ID NO: 3136751 - RNA, 18 nt, Mycobacterium bovis subsp bovis AF2122/97
cauccgguggugcucguc

SEQ ID NO: 3136752 - RNA, 21 nt, Mycobacterium bovis subsp bovis AF2122/97
cauccgguggugcucgucggu

SEQ ID NO: 3136753 - RNA, 15 nt, Mycobacterium bovis subsp bovis AF2122/97
cauccgguucgccgc

SEQ ID NO: 3136754 - RNA, 12 nt, Mycobacterium bovis subsp bovis AF2122/97
cauccgucaagu

SEQ ID NO: 3136755 - RNA, 20 nt, Mycobacterium bovis subsp bovis AF2122/97
cauccgugaaucgagcaccg

SEQ ID NO: 3136756 - RNA, 17 nt, Mycobacterium bovis subsp bovis AF2122/97
caucgccaugauggaca

SEQ ID NO: 3136757 - RNA, 16 nt, Mycobacterium bovis subsp bovis AF2122/97
caucgcccaacaacgc

SEQ ID NO: 3136758 - RNA, 16 nt, Mycobacterium bovis subsp bovis AF2122/97
caucgcccaccgcaac

SEQ ID NO: 3136759 - RNA, 14 nt, Mycobacterium bovis subsp bovis AF2122/97
caucgcccgaugcg

SEQ ID NO: 3136760 - RNA, 20 nt, Mycobacterium bovis subsp bovis AF2122/97
caucgcccgaugcgccagcg

SEQ ID NO: 3136761 - RNA, 20 nt, Mycobacterium bovis subsp bovis AF2122/97
caucgcccggaaccggcgug

SEQ ID NO: 3136762 - RNA, 20 nt, Mycobacterium bovis subsp bovis AF2122/97
caucgcccggugcgucgugg

SEQ ID NO: 3136763 - RNA, 15 nt, Mycobacterium bovis subsp bovis AF2122/97
caucgcccugggcgc

SEQ ID NO: 3136764 - RNA, 20 nt, Mycobacterium bovis subsp bovis AF2122/97
caucgcccugggcgccggcg

SEQ ID NO: 3136765 - RNA, 21 nt, Mycobacterium bovis subsp bovis AF2122/97
caucgcccugggcgccggcgu

SEQ ID NO: 3136766 - RNA, 23 nt, Mycobacterium bovis subsp bovis AF2122/97
caucgcccugggcgccggcgucc

SEQ ID NO: 3136767 - RNA, 17 nt, Mycobacterium bovis subsp bovis AF2122/97
caucgccgacacccucg

SEQ ID NO: 3136768 - RNA, 16 nt, Mycobacterium bovis subsp bovis AF2122/97
caucgccgacagcgcc

SEQ ID NO: 3136769 - RNA, 17 nt, Mycobacterium bovis subsp bovis AF2122/97
caucgccgacagcgccu

SEQ ID NO: 3136770 - RNA, 17 nt, Mycobacterium bovis subsp bovis AF2122/97
caucgccgagguggaca

SEQ ID NO: 3136771 - RNA, 21 nt, Mycobacterium bovis subsp bovis AF2122/97
caucgccgagguggacaaauc

SEQ ID NO: 3136772 - RNA, 16 nt, Mycobacterium bovis subsp bovis AF2122/97
caucgccgcagugcgc

SEQ ID NO: 3136773 - RNA, 19 nt, Mycobacterium bovis subsp bovis AF2122/97
caucgccgcccgagcaccc

SEQ ID NO: 3136774 - RNA, 13 nt, Mycobacterium bovis subsp bovis AF2122/97
caucgccgccgcg

SEQ ID NO: 3136775 - RNA, 14 nt, Mycobacterium bovis subsp bovis AF2122/97
caucgccgccguug

SEQ ID NO: 3136776 - RNA, 22 nt, Mycobacterium bovis subsp bovis AF2122/97
caucgccgccguugccgccguc

SEQ ID NO: 3136777 - RNA, 14 nt, Mycobacterium bovis subsp bovis AF2122/97
caucgccgcggcca

SEQ ID NO: 3136778 - RNA, 15 nt, Mycobacterium bovis subsp bovis AF2122/97
caucgccgcggccag

SEQ ID NO: 3136779 - RNA, 14 nt, Mycobacterium bovis subsp bovis AF2122/97
caucgccgcuggcc

SEQ ID NO: 3136780 - RNA, 18 nt, Mycobacterium bovis subsp bovis AF2122/97
caucgccgcuggccagca

SEQ ID NO: 3136781 - RNA, 15 nt, Mycobacterium bovis subsp bovis AF2122/97
caucgccggagucga

SEQ ID NO: 3136782 - RNA, 23 nt, Mycobacterium bovis subsp bovis AF2122/97
caucgccggagucgacccugccc

SEQ ID NO: 3136783 - RNA, 14 nt, Mycobacterium bovis subsp bovis AF2122/97
caucgccggcacgg

SEQ ID NO: 3136784 - RNA, 19 nt, Mycobacterium bovis subsp bovis AF2122/97
caucgccggcacggugaac

SEQ ID NO: 3136785 - RNA, 19 nt, Mycobacterium bovis subsp bovis AF2122/97
caucgccggcgcgccgaug

SEQ ID NO: 3136786 - RNA, 19 nt, Mycobacterium bovis subsp bovis AF2122/97
caucgccgguaugccgaac

SEQ ID NO: 3136787 - RNA, 20 nt, Mycobacterium bovis subsp bovis AF2122/97
caucgccuccagccggcgaa

SEQ ID NO: 3136788 - RNA, 17 nt, Mycobacterium bovis subsp bovis AF2122/97
caucgccuccaggcgcc

SEQ ID NO: 3136789 - RNA, 18 nt, Mycobacterium bovis subsp bovis AF2122/97
caucgccuccucgacguc

SEQ ID NO: 3136790 - RNA, 19 nt, Mycobacterium bovis subsp bovis AF2122/97
caucgccuccucgacgucg

SEQ ID NO: 3136791 - RNA, 20 nt, Mycobacterium bovis subsp bovis AF2122/97
caucgccuccucgacgucgg

SEQ ID NO: 3136792 - RNA, 20 nt, Mycobacterium bovis subsp bovis AF2122/97
caucgccucgaggaccacca

SEQ ID NO: 3136793 - RNA, 23 nt, Mycobacterium bovis subsp bovis AF2122/97
caucgccucggcguaggcgaugg

SEQ ID NO: 3136794 - RNA, 19 nt, Mycobacterium bovis subsp bovis AF2122/97
caucgccuggaugccgauc

SEQ ID NO: 3136795 - RNA, 22 nt, Mycobacterium bovis subsp bovis AF2122/97
caucgccuggaugccgaucggg

SEQ ID NO: 3136796 - RNA, 19 nt, Mycobacterium bovis subsp bovis AF2122/97
caucgccuugcccagcgac

SEQ ID NO: 3136797 - RNA, 23 nt, Mycobacterium bovis subsp bovis AF2122/97
caucgcgaaaccggaccugaccg

SEQ ID NO: 3136798 - RNA, 16 nt, Mycobacterium bovis subsp bovis AF2122/97
caucgcgaacucgggc

SEQ ID NO: 3136799 - RNA, 17 nt, Mycobacterium bovis subsp bovis AF2122/97
caucgcgaacucgggca

SEQ ID NO: 3136800 - RNA, 12 nt, Mycobacterium bovis subsp bovis AF2122/97
caucgcgacauc

SEQ ID NO: 3136801 - RNA, 15 nt, Mycobacterium bovis subsp bovis AF2122/97
caucgcgacgaucgu

SEQ ID NO: 3136802 - RNA, 19 nt, Mycobacterium bovis subsp bovis AF2122/97
caucgcgacuagacgccgc

SEQ ID NO: 3136803 - RNA, 20 nt, Mycobacterium bovis subsp bovis AF2122/97
caucgcgacuagacgccgcc

SEQ ID NO: 3136804 - RNA, 23 nt, Mycobacterium bovis subsp bovis AF2122/97
caucgcgacuagacgccgccgcu

SEQ ID NO: 3136805 - RNA, 21 nt, Mycobacterium bovis subsp bovis AF2122/97
caucgcgagaaggugcugcgc

SEQ ID NO: 3136806 - RNA, 22 nt, Mycobacterium bovis subsp bovis AF2122/97
caucgcgagaaggugcugcgcg

SEQ ID NO: 3136807 - RNA, 19 nt, Mycobacterium bovis subsp bovis AF2122/97
caucgcgagccagcugcuc

SEQ ID NO: 3136808 - RNA, 17 nt, Mycobacterium bovis subsp bovis AF2122/97
caucgcgagcugcgacg

SEQ ID NO: 3136809 - RNA, 14 nt, Mycobacterium bovis subsp bovis AF2122/97
caucgcgaucgggg

SEQ ID NO: 3136810 - RNA, 15 nt, Mycobacterium bovis subsp bovis AF2122/97
caucgcgaugcaacu

SEQ ID NO: 3136811 - RNA, 17 nt, Mycobacterium bovis subsp bovis AF2122/97
caucgcgcaaccgggcg

SEQ ID NO: 3136812 - RNA, 15 nt, Mycobacterium bovis subsp bovis AF2122/97
caucgcgcacgcccu

SEQ ID NO: 3136813 - RNA, 15 nt, Mycobacterium bovis subsp bovis AF2122/97
caucgcgcgccgacc

SEQ ID NO: 3136814 - RNA, 16 nt, Mycobacterium bovis subsp bovis AF2122/97
caucgcgcgccgaccg

SEQ ID NO: 3136815 - RNA, 18 nt, Mycobacterium bovis subsp bovis AF2122/97
caucgcgcgccgaccgac

SEQ ID NO: 3136816 - RNA, 14 nt, Mycobacterium bovis subsp bovis AF2122/97
caucgcgcgcggcu

SEQ ID NO: 3136817 - RNA, 17 nt, Mycobacterium bovis subsp bovis AF2122/97
caucgcgcggaccagag

SEQ ID NO: 3136818 - RNA, 17 nt, Mycobacterium bovis subsp bovis AF2122/97
caucgcgcugcggccca

SEQ ID NO: 3136819 - RNA, 20 nt, Mycobacterium bovis subsp bovis AF2122/97
caucgcgcugcggcccacac

SEQ ID NO: 3136820 - RNA, 20 nt, Mycobacterium bovis subsp bovis AF2122/97
caucgcggaagcgggcgaug

SEQ ID NO: 3136821 - RNA, 14 nt, Mycobacterium bovis subsp bovis AF2122/97
caucgcggcaucga

SEQ ID NO: 3136822 - RNA, 13 nt, Mycobacterium bovis subsp bovis AF2122/97
caucgcggccgcu

SEQ ID NO: 3136823 - RNA, 19 nt, Mycobacterium bovis subsp bovis AF2122/97
caucgcggccgcugggccc

SEQ ID NO: 3136824 - RNA, 13 nt, Mycobacterium bovis subsp bovis AF2122/97
caucgcggcggcg

SEQ ID NO: 3136825 - RNA, 23 nt, Mycobacterium bovis subsp bovis AF2122/97
caucgcggcguugugaccgccga

SEQ ID NO: 3136826 - RNA, 16 nt, Mycobacterium bovis subsp bovis AF2122/97
caucgcgggcggcgcu

SEQ ID NO: 3136827 - RNA, 20 nt, Mycobacterium bovis subsp bovis AF2122/97
caucgcgggcgugccgacca

SEQ ID NO: 3136828 - RNA, 21 nt, Mycobacterium bovis subsp bovis AF2122/97
caucgcgggcgugccgaccag

SEQ ID NO: 3136829 - RNA, 14 nt, Mycobacterium bovis subsp bovis AF2122/97
caucgcgggugauc

SEQ ID NO: 3136830 - RNA, 17 nt, Mycobacterium bovis subsp bovis AF2122/97
caucgcucaucgucacc

SEQ ID NO: 3136831 - RNA, 23 nt, Mycobacterium bovis subsp bovis AF2122/97
caucgcuuggccuaugcugcccg

SEQ ID NO: 3136832 - RNA, 16 nt, Mycobacterium bovis subsp bovis AF2122/97
caucggaacgugaccg

SEQ ID NO: 3136833 - RNA, 20 nt, Mycobacterium bovis subsp bovis AF2122/97
caucggacagcgccuggccg

SEQ ID NO: 3136834 - RNA, 11 nt, Mycobacterium bovis subsp bovis AF2122/97
caucggacagg

SEQ ID NO: 3136835 - RNA, 20 nt, Mycobacterium bovis subsp bovis AF2122/97
caucggagauacgggccacc

SEQ ID NO: 3136836 - RNA, 21 nt, Mycobacterium bovis subsp bovis AF2122/97
caucggagauacgggccaccg

SEQ ID NO: 3136837 - RNA, 22 nt, Mycobacterium bovis subsp bovis AF2122/97
caucggaggaaccccgcgcggu

SEQ ID NO: 3136838 - RNA, 15 nt, Mycobacterium bovis subsp bovis AF2122/97
caucggaucaaagcc

SEQ ID NO: 3136839 - RNA, 20 nt, Mycobacterium bovis subsp bovis AF2122/97
caucggaugaccagugauca

SEQ ID NO: 3136840 - RNA, 21 nt, Mycobacterium bovis subsp bovis AF2122/97
caucggauggcccccaagacc

SEQ ID NO: 3136841 - RNA, 13 nt, Mycobacterium bovis subsp bovis AF2122/97
caucggcaccagc

SEQ ID NO: 3136842 - RNA, 17 nt, Mycobacterium bovis subsp bovis AF2122/97
caucgguggcggccucc

SEQ ID NO: 3136843 - RNA, 20 nt, Mycobacterium bovis subsp bovis AF2122/97
caucggugguaacaccggcg

SEQ ID NO: 3136844 - RNA, 14 nt, Mycobacterium bovis subsp bovis AF2122/97
caucggugucuucc

SEQ ID NO: 3136845 - RNA, 21 nt, Mycobacterium bovis subsp bovis AF2122/97
caucggugucuuccuccucga

SEQ ID NO: 3136846 - RNA, 14 nt, Mycobacterium bovis subsp bovis AF2122/97
caucgguguggccc

SEQ ID NO: 3136847 - RNA, 19 nt, Mycobacterium bovis subsp bovis AF2122/97
caucgguguggcccaacac

SEQ ID NO: 3136848 - RNA, 20 nt, Mycobacterium bovis subsp bovis AF2122/97
caucgguguggcccaacacc

SEQ ID NO: 3136849 - RNA, 21 nt, Mycobacterium bovis subsp bovis AF2122/97
caucgguguggcccaacaccg

SEQ ID NO: 3136850 - RNA, 16 nt, Mycobacterium bovis subsp bovis AF2122/97
caucgguugacccggc

SEQ ID NO: 3136851 - RNA, 14 nt, Mycobacterium bovis subsp bovis AF2122/97
caucguaggccggc

SEQ ID NO: 3136852 - RNA, 15 nt, Mycobacterium bovis subsp bovis AF2122/97
caucguaggccggca

SEQ ID NO: 3136853 - RNA, 14 nt, Mycobacterium bovis subsp bovis AF2122/97
caucgucacugcca

SEQ ID NO: 3136854 - RNA, 16 nt, Mycobacterium bovis subsp bovis AF2122/97
caucgucacugccacc

SEQ ID NO: 3136855 - RNA, 15 nt, Mycobacterium bovis subsp bovis AF2122/97
caucgucagcgacca

SEQ ID NO: 3136856 - RNA, 17 nt, Mycobacterium bovis subsp bovis AF2122/97
caucgucaggaaccacc

SEQ ID NO: 3136857 - RNA, 19 nt, Mycobacterium bovis subsp bovis AF2122/97
caucgucaggaaccaccca

SEQ ID NO: 3136858 - RNA, 22 nt, Mycobacterium bovis subsp bovis AF2122/97
caucgucauccaggggcgcaac

SEQ ID NO: 3136859 - RNA, 15 nt, Mycobacterium bovis subsp bovis AF2122/97
caucguccgccgggc

SEQ ID NO: 3136860 - RNA, 22 nt, Mycobacterium bovis subsp bovis AF2122/97
caucguccgugguuugcgucag

SEQ ID NO: 3136861 - RNA, 16 nt, Mycobacterium bovis subsp bovis AF2122/97
caucgucgaaagccug

SEQ ID NO: 3136862 - RNA, 13 nt, Mycobacterium bovis subsp bovis AF2122/97
caucgucgaagac

SEQ ID NO: 3136863 - RNA, 14 nt, Mycobacterium bovis subsp bovis AF2122/97
caucgucgaagacc

SEQ ID NO: 3136864 - RNA, 22 nt, Mycobacterium bovis subsp bovis AF2122/97
caucgucgagccacagcgucga

SEQ ID NO: 3136865 - RNA, 21 nt, Mycobacterium bovis subsp bovis AF2122/97
caucgucgccacgaugccggc

SEQ ID NO: 3136866 - RNA, 17 nt, Mycobacterium bovis subsp bovis AF2122/97
caucgucgccagggccg

SEQ ID NO: 3136867 - RNA, 23 nt, Mycobacterium bovis subsp bovis AF2122/97
caucgucgccagggccgccgaag

SEQ ID NO: 3136868 - RNA, 14 nt, Mycobacterium bovis subsp bovis AF2122/97
caucgucgccgagc

SEQ ID NO: 3136869 - RNA, 12 nt, Mycobacterium bovis subsp bovis AF2122/97
caucgucgccgc

SEQ ID NO: 3136870 - RNA, 14 nt, Mycobacterium bovis subsp bovis AF2122/97
caucgucgcgacga

SEQ ID NO: 3136871 - RNA, 15 nt, Mycobacterium bovis subsp bovis AF2122/97
caucgucgcgccgcg

SEQ ID NO: 3136872 - RNA, 17 nt, Mycobacterium bovis subsp bovis AF2122/97
caucgucggcgggcggc

SEQ ID NO: 3136873 - RNA, 19 nt, Mycobacterium bovis subsp bovis AF2122/97
caucgucgggucaaugcug

SEQ ID NO: 3136874 - RNA, 20 nt, Mycobacterium bovis subsp bovis AF2122/97
caucgucgucgcugccgcca

SEQ ID NO: 3136875 - RNA, 14 nt, Mycobacterium bovis subsp bovis AF2122/97
caucgucguggagg

SEQ ID NO: 3136876 - RNA, 16 nt, Mycobacterium bovis subsp bovis AF2122/97
caucgucugguggcag

SEQ ID NO: 3136877 - RNA, 23 nt, Mycobacterium bovis subsp bovis AF2122/97
caucgucugguggcagcgcaccc

SEQ ID NO: 3136878 - RNA, 17 nt, Mycobacterium bovis subsp bovis AF2122/97
caucgugcccgcgucua

SEQ ID NO: 3136879 - RNA, 23 nt, Mycobacterium bovis subsp bovis AF2122/97
caucguggcgucgugcgcggccg

SEQ ID NO: 3136880 - RNA, 21 nt, Mycobacterium bovis subsp bovis AF2122/97
caucguggggaucgaccaugg

SEQ ID NO: 3136881 - RNA, 23 nt, Mycobacterium bovis subsp bovis AF2122/97
caucguggggaucgaccaugguc

SEQ ID NO: 3136882 - RNA, 18 nt, Mycobacterium bovis subsp bovis AF2122/97
caucguucugacggcuug

SEQ ID NO: 3136883 - RNA, 20 nt, Mycobacterium bovis subsp bovis AF2122/97
caucguugccggugccgccg

SEQ ID NO: 3136884 - RNA, 23 nt, Mycobacterium bovis subsp bovis AF2122/97
caucguugccggugccgccgcgg

SEQ ID NO: 3136885 - RNA, 21 nt, Mycobacterium bovis subsp bovis AF2122/97
caucguuggccgggcacgcga

SEQ ID NO: 3136886 - RNA, 19 nt, Mycobacterium bovis subsp bovis AF2122/97
caucguuguugaccaccac

SEQ ID NO: 3136887 - RNA, 21 nt, Mycobacterium bovis subsp bovis AF2122/97
caucguuucacccgggcugcu

SEQ ID NO: 3136888 - RNA, 18 nt, Mycobacterium bovis subsp bovis AF2122/97
caucguuuucgccgaucc

SEQ ID NO: 3136889 - RNA, 22 nt, Mycobacterium bovis subsp bovis AF2122/97
caucuagguucaguuccaccgc

SEQ ID NO: 3136890 - RNA, 14 nt, Mycobacterium bovis subsp bovis AF2122/97
caucucaccgggcc

SEQ ID NO: 3136891 - RNA, 15 nt, Mycobacterium bovis subsp bovis AF2122/97
caucucaccgggccc

SEQ ID NO: 3136892 - RNA, 16 nt, Mycobacterium bovis subsp bovis AF2122/97
caucucaugcaucugc

SEQ ID NO: 3136893 - RNA, 19 nt, Mycobacterium bovis subsp bovis AF2122/97
caucuccaccgucgccgcc

SEQ ID NO: 3136894 - RNA, 20 nt, Mycobacterium bovis subsp bovis AF2122/97
caucuccaccgucgccgccg

SEQ ID NO: 3136895 - RNA, 15 nt, Mycobacterium bovis subsp bovis AF2122/97
caucucccgaccgcc

SEQ ID NO: 3136896 - RNA, 18 nt, Mycobacterium bovis subsp bovis AF2122/97
caucucccgaccgccgag

SEQ ID NO: 3136897 - RNA, 20 nt, Mycobacterium bovis subsp bovis AF2122/97
caucucccgaccgccgagcg

SEQ ID NO: 3136898 - RNA, 14 nt, Mycobacterium bovis subsp bovis AF2122/97
caucuccgacucga

SEQ ID NO: 3136899 - RNA, 21 nt, Mycobacterium bovis subsp bovis AF2122/97
caucuccgccgucgccaccgg

SEQ ID NO: 3136900 - RNA, 16 nt, Mycobacterium bovis subsp bovis AF2122/97
caucuccucggcgaug

SEQ ID NO: 3136901 - RNA, 13 nt, Mycobacterium bovis subsp bovis AF2122/97
caucucgaaggug

SEQ ID NO: 3136902 - RNA, 13 nt, Mycobacterium bovis subsp bovis AF2122/97
caucucgcaccgc

SEQ ID NO: 3136903 - RNA, 14 nt, Mycobacterium bovis subsp bovis AF2122/97
caucucgcaccgcg

SEQ ID NO: 3136904 - RNA, 16 nt, Mycobacterium bovis subsp bovis AF2122/97
caucucgcaccgcgcc

SEQ ID NO: 3136905 - RNA, 14 nt, Mycobacterium bovis subsp bovis AF2122/97
caucucggaccaca

SEQ ID NO: 3136906 - RNA, 16 nt, Mycobacterium bovis subsp bovis AF2122/97
caucucgggcaggccg

SEQ ID NO: 3136907 - RNA, 15 nt, Mycobacterium bovis subsp bovis AF2122/97
caucucgucgaucuc

SEQ ID NO: 3136908 - RNA, 14 nt, Mycobacterium bovis subsp bovis AF2122/97
caucucgucgaugu

SEQ ID NO: 3136909 - RNA, 21 nt, Mycobacterium bovis subsp bovis AF2122/97
caucucgucgucgcggccgcu

SEQ ID NO: 3136910 - RNA, 18 nt, Mycobacterium bovis subsp bovis AF2122/97
caucugauccggugccgc

SEQ ID NO: 3136911 - RNA, 19 nt, Mycobacterium bovis subsp bovis AF2122/97
caucugauccggugccgcg

SEQ ID NO: 3136912 - RNA, 17 nt, Mycobacterium bovis subsp bovis AF2122/97
caucugccggucgaugu

SEQ ID NO: 3136913 - RNA, 14 nt, Mycobacterium bovis subsp bovis AF2122/97
caucugccugccug

SEQ ID NO: 3136914 - RNA, 19 nt, Mycobacterium bovis subsp bovis AF2122/97
caucugcgggacgucgucg

SEQ ID NO: 3136915 - RNA, 22 nt, Mycobacterium bovis subsp bovis AF2122/97
caucugcgggacgucgucguug

SEQ ID NO: 3136916 - RNA, 22 nt, Mycobacterium bovis subsp bovis AF2122/97
caucugcgggucggcaucggag

SEQ ID NO: 3136917 - RNA, 16 nt, Mycobacterium bovis subsp bovis AF2122/97
caucugcuguggaucg

SEQ ID NO: 3136918 - RNA, 14 nt, Mycobacterium bovis subsp bovis AF2122/97
caucuggcgcugcu

SEQ ID NO: 3136919 - RNA, 17 nt, Mycobacterium bovis subsp bovis AF2122/97
caucuggcgcugcuggc

SEQ ID NO: 3136920 - RNA, 23 nt, Mycobacterium bovis subsp bovis AF2122/97
caucuggcugagcagacugcccu

SEQ ID NO: 3136921 - RNA, 11 nt, Mycobacterium bovis subsp bovis AF2122/97
caucuggguga

SEQ ID NO: 3136922 - RNA, 22 nt, Mycobacterium bovis subsp bovis AF2122/97
caucuguuccgugccagcugcc

SEQ ID NO: 3136923 - RNA, 15 nt, Mycobacterium bovis subsp bovis AF2122/97
caucuucggacgcca

SEQ ID NO: 3136924 - RNA, 12 nt, Mycobacterium bovis subsp bovis AF2122/97
caucuugccacc

SEQ ID NO: 3136925 - RNA, 14 nt, Mycobacterium bovis subsp bovis AF2122/97
caucuugccaccgc

SEQ ID NO: 3136926 - RNA, 18 nt, Mycobacterium bovis subsp bovis AF2122/97
caucuugucgaucugccc

SEQ ID NO: 3136927 - RNA, 15 nt, Mycobacterium bovis subsp bovis AF2122/97
caugaacaucggccg

SEQ ID NO: 3136928 - RNA, 17 nt, Mycobacterium bovis subsp bovis AF2122/97
caugaacaucggccggg

SEQ ID NO: 3136929 - RNA, 12 nt, Mycobacterium bovis subsp bovis AF2122/97
caugccgcccgc

SEQ ID NO: 3136930 - RNA, 15 nt, Mycobacterium bovis subsp bovis AF2122/97
caugccgcccgcgcc

SEQ ID NO: 3136931 - RNA, 18 nt, Mycobacterium bovis subsp bovis AF2122/97
caugccgcccgcgccgcc

SEQ ID NO: 3136932 - RNA, 21 nt, Mycobacterium bovis subsp bovis AF2122/97
caugccgcccgcgccgccgga

SEQ ID NO: 3136933 - RNA, 13 nt, Mycobacterium bovis subsp bovis AF2122/97
caugccgccgaag

SEQ ID NO: 3136934 - RNA, 19 nt, Mycobacterium bovis subsp bovis AF2122/97
caugccgccgaagccgcgc

SEQ ID NO: 3136935 - RNA, 17 nt, Mycobacterium bovis subsp bovis AF2122/97
caugccgcucggcaacc

SEQ ID NO: 3136936 - RNA, 17 nt, Mycobacterium bovis subsp bovis AF2122/97
caugccggacugcgauc

SEQ ID NO: 3136937 - RNA, 15 nt, Mycobacterium bovis subsp bovis AF2122/97
caugccggcgcacca

SEQ ID NO: 3136938 - RNA, 19 nt, Mycobacterium bovis subsp bovis AF2122/97
caugccggcgcaccacacc

SEQ ID NO: 3136939 - RNA, 12 nt, Mycobacterium bovis subsp bovis AF2122/97
caugccggcgug

SEQ ID NO: 3136940 - RNA, 15 nt, Mycobacterium bovis subsp bovis AF2122/97
caugccggcgugcgg

SEQ ID NO: 3136941 - RNA, 19 nt, Mycobacterium bovis subsp bovis AF2122/97
caugccgggauugccgucg

SEQ ID NO: 3136942 - RNA, 20 nt, Mycobacterium bovis subsp bovis AF2122/97
caugccgggauugccgucgg

SEQ ID NO: 3136943 - RNA, 21 nt, Mycobacterium bovis subsp bovis AF2122/97
caugccggucauccgggcgac

SEQ ID NO: 3136944 - RNA, 13 nt, Mycobacterium bovis subsp bovis AF2122/97
caugccgguguug

SEQ ID NO: 3136945 - RNA, 16 nt, Mycobacterium bovis subsp bovis AF2122/97
caugccgguguugccg

SEQ ID NO: 3136946 - RNA, 22 nt, Mycobacterium bovis subsp bovis AF2122/97
caugccgucggguaggccgccg

SEQ ID NO: 3136947 - RNA, 14 nt, Mycobacterium bovis subsp bovis AF2122/97
caugccgucgucgg

SEQ ID NO: 3136948 - RNA, 18 nt, Mycobacterium bovis subsp bovis AF2122/97
caugccgucgucggcgua

SEQ ID NO: 3136949 - RNA, 19 nt, Mycobacterium bovis subsp bovis AF2122/97
caugccgugugugcgaucc

SEQ ID NO: 3136950 - RNA, 21 nt, Mycobacterium bovis subsp bovis AF2122/97
caugccguugauaaaaaccug

SEQ ID NO: 3136951 - RNA, 19 nt, Mycobacterium bovis subsp bovis AF2122/97
caugccugcgaaacgcugg

SEQ ID NO: 3136952 - RNA, 17 nt, Mycobacterium bovis subsp bovis AF2122/97
caugccuucggccaacc

SEQ ID NO: 3136953 - RNA, 15 nt, Mycobacterium bovis subsp bovis AF2122/97
caugcgaccggcaac

SEQ ID NO: 3136954 - RNA, 21 nt, Mycobacterium bovis subsp bovis AF2122/97
caugcgaccggcaacgcggcc

SEQ ID NO: 3136955 - RNA, 20 nt, Mycobacterium bovis subsp bovis AF2122/97
caugcgaggggcggcaaucg

SEQ ID NO: 3136956 - RNA, 18 nt, Mycobacterium bovis subsp bovis AF2122/97
caugcgauucugcguccu

SEQ ID NO: 3136957 - RNA, 19 nt, Mycobacterium bovis subsp bovis AF2122/97
caugcgauucugcguccug

SEQ ID NO: 3136958 - RNA, 20 nt, Mycobacterium bovis subsp bovis AF2122/97
caugcgauucugcguccugc

SEQ ID NO: 3136959 - RNA, 13 nt, Mycobacterium bovis subsp bovis AF2122/97
caugcgcaccagu

SEQ ID NO: 3136960 - RNA, 20 nt, Mycobacterium bovis subsp bovis AF2122/97
caugcgcaccaguccagcgg

SEQ ID NO: 3136961 - RNA, 23 nt, Mycobacterium bovis subsp bovis AF2122/97
caugcgcagaaacgccgagcgcc

SEQ ID NO: 3136962 - RNA, 15 nt, Mycobacterium bovis subsp bovis AF2122/97
caugcgccaacccgg

SEQ ID NO: 3136963 - RNA, 22 nt, Mycobacterium bovis subsp bovis AF2122/97
caugcgccauaauauugccgcc

SEQ ID NO: 3136964 - RNA, 22 nt, Mycobacterium bovis subsp bovis AF2122/97
caugcgccgagauccacgccag

SEQ ID NO: 3136965 - RNA, 13 nt, Mycobacterium bovis subsp bovis AF2122/97
caugcgcgcgccg

SEQ ID NO: 3136966 - RNA, 15 nt, Mycobacterium bovis subsp bovis AF2122/97
caugcgcguccagcu

SEQ ID NO: 3136967 - RNA, 13 nt, Mycobacterium bovis subsp bovis AF2122/97
caugcgcucagaa

SEQ ID NO: 3136968 - RNA, 19 nt, Mycobacterium bovis subsp bovis AF2122/97
caugcgcuccggcgcgacg

SEQ ID NO: 3136969 - RNA, 21 nt, Mycobacterium bovis subsp bovis AF2122/97
caugcggaauuugcuugggcc

SEQ ID NO: 3136970 - RNA, 23 nt, Mycobacterium bovis subsp bovis AF2122/97
caugcggaauuugcuugggcccc

SEQ ID NO: 3136971 - RNA, 14 nt, Mycobacterium bovis subsp bovis AF2122/97
caugcggaucggcg

SEQ ID NO: 3136972 - RNA, 20 nt, Mycobacterium bovis subsp bovis AF2122/97
caugcggauucgcgcugucc

SEQ ID NO: 3136973 - RNA, 19 nt, Mycobacterium bovis subsp bovis AF2122/97
caugcggcggcgcucgucg

SEQ ID NO: 3136974 - RNA, 19 nt, Mycobacterium bovis subsp bovis AF2122/97
caugcggguaaaccaggug

SEQ ID NO: 3136975 - RNA, 21 nt, Mycobacterium bovis subsp bovis AF2122/97
caugcggguaaaccagguggc

SEQ ID NO: 3136976 - RNA, 22 nt, Mycobacterium bovis subsp bovis AF2122/97
caugcgguuagcagccgcugau

SEQ ID NO: 3136977 - RNA, 21 nt, Mycobacterium bovis subsp bovis AF2122/97
caugcguuggggcacgacgcc

SEQ ID NO: 3136978 - RNA, 23 nt, Mycobacterium bovis subsp bovis AF2122/97
caugcguuggggcacgacgccgg

SEQ ID NO: 3136979 - RNA, 16 nt, Mycobacterium bovis subsp bovis AF2122/97
caugcuaggaccacca

SEQ ID NO: 3136980 - RNA, 17 nt, Mycobacterium bovis subsp bovis AF2122/97
caugcuaggaccaccag

SEQ ID NO: 3136981 - RNA, 13 nt, Mycobacterium bovis subsp bovis AF2122/97
caugcuaggccac

SEQ ID NO: 3136982 - RNA, 15 nt, Mycobacterium bovis subsp bovis AF2122/97
caugcuaggccaccg

SEQ ID NO: 3136983 - RNA, 16 nt, Mycobacterium bovis subsp bovis AF2122/97
caugcucagcaucguc

SEQ ID NO: 3136984 - RNA, 14 nt, Mycobacterium bovis subsp bovis AF2122/97
caugcucgacgccc

SEQ ID NO: 3136985 - RNA, 17 nt, Mycobacterium bovis subsp bovis AF2122/97
caugcucgacgcccgcc

SEQ ID NO: 3136986 - RNA, 18 nt, Mycobacterium bovis subsp bovis AF2122/97
caugcucgacgcccgcca

SEQ ID NO: 3136987 - RNA, 20 nt, Mycobacterium bovis subsp bovis AF2122/97
caugcucgacgcccgccacc

SEQ ID NO: 3136988 - RNA, 15 nt, Mycobacterium bovis subsp bovis AF2122/97
caugcugcucgagga

SEQ ID NO: 3136989 - RNA, 22 nt, Mycobacterium bovis subsp bovis AF2122/97
caugcuggagaaaccacuggau

SEQ ID NO: 3136990 - RNA, 19 nt, Mycobacterium bovis subsp bovis AF2122/97
caugcuggcgaucgcgacg

SEQ ID NO: 3136991 - RNA, 19 nt, Mycobacterium bovis subsp bovis AF2122/97
caugcuggucagcggcgcg

SEQ ID NO: 3136992 - RNA, 21 nt, Mycobacterium bovis subsp bovis AF2122/97
caugcugucggugccgucgag

SEQ ID NO: 3136993 - RNA, 20 nt, Mycobacterium bovis subsp bovis AF2122/97
cauggcaagucaacaccgcg

SEQ ID NO: 3136994 - RNA, 22 nt, Mycobacterium bovis subsp bovis AF2122/97
cauggcacgcgggaagugcacc

SEQ ID NO: 3136995 - RNA, 13 nt, Mycobacterium bovis subsp bovis AF2122/97
cauggcacugccg

SEQ ID NO: 3136996 - RNA, 15 nt, Mycobacterium bovis subsp bovis AF2122/97
cauggcacugccggc

SEQ ID NO: 3136997 - RNA, 18 nt, Mycobacterium bovis subsp bovis AF2122/97
cauggcacugccggcacg

SEQ ID NO: 3136998 - RNA, 21 nt, Mycobacterium bovis subsp bovis AF2122/97
cauggcacugccggcacgccg

SEQ ID NO: 3136999 - RNA, 22 nt, Mycobacterium bovis subsp bovis AF2122/97
cauggcacugccggcacgccga

SEQ ID NO: 3137000 - RNA, 13 nt, Mycobacterium bovis subsp bovis AF2122/97
cauggcagcggcg

SEQ ID NO: 3137001 - RNA, 20 nt, Mycobacterium bovis subsp bovis AF2122/97
cauggccagcaucagcgcca

SEQ ID NO: 3137002 - RNA, 13 nt, Mycobacterium bovis subsp bovis AF2122/97
cauggccagcgcu

SEQ ID NO: 3137003 - RNA, 16 nt, Mycobacterium bovis subsp bovis AF2122/97
cauggccagugucccg

SEQ ID NO: 3137004 - RNA, 16 nt, Mycobacterium bovis subsp bovis AF2122/97
cauggcccgaucgacc

SEQ ID NO: 3137005 - RNA, 14 nt, Mycobacterium bovis subsp bovis AF2122/97
cauggcccuggcga

SEQ ID NO: 3137006 - RNA, 15 nt, Mycobacterium bovis subsp bovis AF2122/97
cauggcccuggcgac

SEQ ID NO: 3137007 - RNA, 22 nt, Mycobacterium bovis subsp bovis AF2122/97
cauggcccuggcgaccagccga

SEQ ID NO: 3137008 - RNA, 23 nt, Mycobacterium bovis subsp bovis AF2122/97
cauggccugauuccacugggccu

SEQ ID NO: 3137009 - RNA, 19 nt, Mycobacterium bovis subsp bovis AF2122/97
cauggcgaacacgucggcc

SEQ ID NO: 3137010 - RNA, 18 nt, Mycobacterium bovis subsp bovis AF2122/97
cauggcgaaccgucagcg

SEQ ID NO: 3137011 - RNA, 20 nt, Mycobacterium bovis subsp bovis AF2122/97
cauggcgagcguuuggacgg

SEQ ID NO: 3137012 - RNA, 23 nt, Mycobacterium bovis subsp bovis AF2122/97
cauggcgagcguuuggacgggcg

SEQ ID NO: 3137013 - RNA, 22 nt, Mycobacterium bovis subsp bovis AF2122/97
cauggcgaguacggccugccgc

SEQ ID NO: 3137014 - RNA, 12 nt, Mycobacterium bovis subsp bovis AF2122/97
cauggcgccgcg

SEQ ID NO: 3137015 - RNA, 16 nt, Mycobacterium bovis subsp bovis AF2122/97
cauguggccgccgucg

SEQ ID NO: 3137016 - RNA, 15 nt, Mycobacterium bovis subsp bovis AF2122/97
caugugggugaacac

SEQ ID NO: 3137017 - RNA, 16 nt, Mycobacterium bovis subsp bovis AF2122/97
cauguggucaacggcc

SEQ ID NO: 3137018 - RNA, 16 nt, Mycobacterium bovis subsp bovis AF2122/97
caugugguggcgccgg

SEQ ID NO: 3137019 - RNA, 21 nt, Mycobacterium bovis subsp bovis AF2122/97
caugugguggcgccggccggu

SEQ ID NO: 3137020 - RNA, 13 nt, Mycobacterium bovis subsp bovis AF2122/97
cauguguggcagc

SEQ ID NO: 3137021 - RNA, 16 nt, Mycobacterium bovis subsp bovis AF2122/97
cauguguggcagcccc

SEQ ID NO: 3137022 - RNA, 18 nt, Mycobacterium bovis subsp bovis AF2122/97
cauguuccacccgguggc

SEQ ID NO: 3137023 - RNA, 14 nt, Mycobacterium bovis subsp bovis AF2122/97
cauguuccccgucg

SEQ ID NO: 3137024 - RNA, 22 nt, Mycobacterium bovis subsp bovis AF2122/97
cauguuccccgucgccagggcc

SEQ ID NO: 3137025 - RNA, 23 nt, Mycobacterium bovis subsp bovis AF2122/97
cauguuccuugcggccgcugauc

SEQ ID NO: 3137026 - RNA, 14 nt, Mycobacterium bovis subsp bovis AF2122/97
cauguucggccacc

SEQ ID NO: 3137027 - RNA, 21 nt, Mycobacterium bovis subsp bovis AF2122/97
cauguucggccaccagaacca

SEQ ID NO: 3137028 - RNA, 18 nt, Mycobacterium bovis subsp bovis AF2122/97
cauguucggggcgcacca

SEQ ID NO: 3137029 - RNA, 20 nt, Mycobacterium bovis subsp bovis AF2122/97
cauguucggggcgcaccacg

SEQ ID NO: 3137030 - RNA, 16 nt, Mycobacterium bovis subsp bovis AF2122/97
cauguucucgaccgcg

SEQ ID NO: 3137031 - RNA, 17 nt, Mycobacterium bovis subsp bovis AF2122/97
cauguucucgaccgcgu

SEQ ID NO: 3137032 - RNA, 22 nt, Mycobacterium bovis subsp bovis AF2122/97
cauguugaagcgaagccagauc

SEQ ID NO: 3137033 - RNA, 20 nt, Mycobacterium bovis subsp bovis AF2122/97
cauguugaccucgcgcaccg

SEQ ID NO: 3137034 - RNA, 23 nt, Mycobacterium bovis subsp bovis AF2122/97
cauguugcaggcgcagcugggug

SEQ ID NO: 3137035 - RNA, 14 nt, Mycobacterium bovis subsp bovis AF2122/97
cauguugcggacca

SEQ ID NO: 3137036 - RNA, 19 nt, Mycobacterium bovis subsp bovis AF2122/97
cauguugucgucgccgccg

SEQ ID NO: 3137037 - RNA, 19 nt, Mycobacterium bovis subsp bovis AF2122/97
cauguuuucgagcccaagg

SEQ ID NO: 3137038 - RNA, 20 nt, Mycobacterium bovis subsp bovis AF2122/97
cauuaaugcggccccgcgca

SEQ ID NO: 3137039 - RNA, 17 nt, Mycobacterium bovis subsp bovis AF2122/97
cauuaccaacgcgguga

SEQ ID NO: 3137040 - RNA, 14 nt, Mycobacterium bovis subsp bovis AF2122/97
cauuacucaacagu

SEQ ID NO: 3137041 - RNA, 18 nt, Mycobacterium bovis subsp bovis AF2122/97
cauuacucaacaguucac

SEQ ID NO: 3137042 - RNA, 13 nt, Mycobacterium bovis subsp bovis AF2122/97
cauuagcagcacc

SEQ ID NO: 3137043 - RNA, 12 nt, Mycobacterium bovis subsp bovis AF2122/97
cauuaggccggg

SEQ ID NO: 3137044 - RNA, 13 nt, Mycobacterium bovis subsp bovis AF2122/97
cauuaggccgggg

SEQ ID NO: 3137045 - RNA, 21 nt, Mycobacterium bovis subsp bovis AF2122/97
cauuauucgcgcaacgggucg

SEQ ID NO: 3137046 - RNA, 18 nt, Mycobacterium bovis subsp bovis AF2122/97
cauucaacagauccgacg

SEQ ID NO: 3137047 - RNA, 23 nt, Mycobacterium bovis subsp bovis AF2122/97
cauucaacagauccgacgaccgc

SEQ ID NO: 3137048 - RNA, 12 nt, Mycobacterium bovis subsp bovis AF2122/97
cauucaccgcgg

SEQ ID NO: 3137049 - RNA, 17 nt, Mycobacterium bovis subsp bovis AF2122/97
cauuccagaucaacgcg

SEQ ID NO: 3137050 - RNA, 14 nt, Mycobacterium bovis subsp bovis AF2122/97
cauucccaacacag

SEQ ID NO: 3137051 - RNA, 16 nt, Mycobacterium bovis subsp bovis AF2122/97
cauucccaacacagcc

SEQ ID NO: 3137052 - RNA, 21 nt, Mycobacterium bovis subsp bovis AF2122/97
cauucccgaguugcccucugg

SEQ ID NO: 3137053 - RNA, 18 nt, Mycobacterium bovis subsp bovis AF2122/97
cauuccgaacaacaucac

SEQ ID NO: 3137054 - RNA, 21 nt, Mycobacterium bovis subsp bovis AF2122/97
cauuccucgacgguguaacug

SEQ ID NO: 3137055 - RNA, 14 nt, Mycobacterium bovis subsp bovis AF2122/97
cauucgagcacguc

SEQ ID NO: 3137056 - RNA, 20 nt, Mycobacterium bovis subsp bovis AF2122/97
cauucgcaccaccugggcgg

SEQ ID NO: 3137057 - RNA, 14 nt, Mycobacterium bovis subsp bovis AF2122/97
cauucgccccaccc

SEQ ID NO: 3137058 - RNA, 13 nt, Mycobacterium bovis subsp bovis AF2122/97
cauucgcgggccg

SEQ ID NO: 3137059 - RNA, 14 nt, Mycobacterium bovis subsp bovis AF2122/97
cauucggcgagccg

SEQ ID NO: 3137060 - RNA, 19 nt, Mycobacterium bovis subsp bovis AF2122/97
cauucggcgagccgcgccc

SEQ ID NO: 3137061 - RNA, 13 nt, Mycobacterium bovis subsp bovis AF2122/97
cauucgggcgccc

SEQ ID NO: 3137062 - RNA, 14 nt, Mycobacterium bovis subsp bovis AF2122/97
cauucgggcgcccu

SEQ ID NO: 3137063 - RNA, 13 nt, Mycobacterium bovis subsp bovis AF2122/97
cauucgguguggc

SEQ ID NO: 3137064 - RNA, 19 nt, Mycobacterium bovis subsp bovis AF2122/97
cauucgguguggccguggg

SEQ ID NO: 3137065 - RNA, 22 nt, Mycobacterium bovis subsp bovis AF2122/97
cauucgucgguaccguccucga

SEQ ID NO: 3137066 - RNA, 14 nt, Mycobacterium bovis subsp bovis AF2122/97
cauucgugcccggg

SEQ ID NO: 3137067 - RNA, 17 nt, Mycobacterium bovis subsp bovis AF2122/97
cauucgugggaaccacc

SEQ ID NO: 3137068 - RNA, 14 nt, Mycobacterium bovis subsp bovis AF2122/97
cauucucgccgacg

SEQ ID NO: 3137069 - RNA, 19 nt, Mycobacterium bovis subsp bovis AF2122/97
cauucucggccggcggcgc

SEQ ID NO: 3137070 - RNA, 11 nt, Mycobacterium bovis subsp bovis AF2122/97
cauucugcggc

SEQ ID NO: 3137071 - RNA, 18 nt, Mycobacterium bovis subsp bovis AF2122/97
cauucuucgaucagcggc

SEQ ID NO: 3137072 - RNA, 16 nt, Mycobacterium bovis subsp bovis AF2122/97
cauugacccgacgaug

SEQ ID NO: 3137073 - RNA, 21 nt, Mycobacterium bovis subsp bovis AF2122/97
cauugacccgacgaugccggc

SEQ ID NO: 3137074 - RNA, 22 nt, Mycobacterium bovis subsp bovis AF2122/97
cauugacgaggcgagcggccag

SEQ ID NO: 3137075 - RNA, 18 nt, Mycobacterium bovis subsp bovis AF2122/97
cauugacgaugucggucg

SEQ ID NO: 3137076 - RNA, 16 nt, Mycobacterium bovis subsp bovis AF2122/97
cauugagcucccgcaa

SEQ ID NO: 3137077 - RNA, 17 nt, Mycobacterium bovis subsp bovis AF2122/97
cauugagcuggcgcccg

SEQ ID NO: 3137078 - RNA, 23 nt, Mycobacterium bovis subsp bovis AF2122/97
cauugaggaagccguuggcgacg

SEQ ID NO: 3137079 - RNA, 17 nt, Mycobacterium bovis subsp bovis AF2122/97
cauugaguucggccacc

SEQ ID NO: 3137080 - RNA, 18 nt, Mycobacterium bovis subsp bovis AF2122/97
cauugaguucggccacca

SEQ ID NO: 3137081 - RNA, 21 nt, Mycobacterium bovis subsp bovis AF2122/97
cauugaguucggccaccaacc

SEQ ID NO: 3137082 - RNA, 17 nt, Mycobacterium bovis subsp bovis AF2122/97
cauugaucgacggccag

SEQ ID NO: 3137083 - RNA, 21 nt, Mycobacterium bovis subsp bovis AF2122/97
cauugaucgacggccagccca

SEQ ID NO: 3137084 - RNA, 10 nt, Mycobacterium bovis subsp bovis AF2122/97
cauugccaua

SEQ ID NO: 3137085 - RNA, 15 nt, Mycobacterium bovis subsp bovis AF2122/97
cauugccauacagca

SEQ ID NO: 3137086 - RNA, 21 nt, Mycobacterium bovis subsp bovis AF2122/97
cauugccauacagcaccccgc

SEQ ID NO: 3137087 - RNA, 11 nt, Mycobacterium bovis subsp bovis AF2122/97
cauugcccaca

SEQ ID NO: 3137088 - RNA, 16 nt, Mycobacterium bovis subsp bovis AF2122/97
cauugcccgacgaugc

SEQ ID NO: 3137089 - RNA, 14 nt, Mycobacterium bovis subsp bovis AF2122/97
cauugcccgagccc

SEQ ID NO: 3137090 - RNA, 20 nt, Mycobacterium bovis subsp bovis AF2122/97
cauugcccgagcccagcgcc

SEQ ID NO: 3137091 - RNA, 21 nt, Mycobacterium bovis subsp bovis AF2122/97
cauugcccguguuaaagaagc

SEQ ID NO: 3137092 - RNA, 14 nt, Mycobacterium bovis subsp bovis AF2122/97
cauugccgacccgu

SEQ ID NO: 3137093 - RNA, 22 nt, Mycobacterium bovis subsp bovis AF2122/97
cauugccgacgcgcggccagcc

SEQ ID NO: 3137094 - RNA, 20 nt, Mycobacterium bovis subsp bovis AF2122/97
cauugccgccagcccagccc

SEQ ID NO: 3137095 - RNA, 13 nt, Mycobacterium bovis subsp bovis AF2122/97
cauugccgccggc

SEQ ID NO: 3137096 - RNA, 12 nt, Mycobacterium bovis subsp bovis AF2122/97
cauugccgccgu

SEQ ID NO: 3137097 - RNA, 14 nt, Mycobacterium bovis subsp bovis AF2122/97
cauugccgccgucg

SEQ ID NO: 3137098 - RNA, 21 nt, Mycobacterium bovis subsp bovis AF2122/97
cauugccgccgucgccgccgc

SEQ ID NO: 3137099 - RNA, 20 nt, Mycobacterium bovis subsp bovis AF2122/97
cauugccgccguugccgccg

SEQ ID NO: 3137100 - RNA, 15 nt, Mycobacterium bovis subsp bovis AF2122/97
cauugccggccacca

SEQ ID NO: 3137101 - RNA, 18 nt, Mycobacterium bovis subsp bovis AF2122/97
cauugccggccaccagcc

SEQ ID NO: 3137102 - RNA, 15 nt, Mycobacterium bovis subsp bovis AF2122/97
ccaacaggccggugu

SEQ ID NO: 3137103 - RNA, 21 nt, Mycobacterium bovis subsp bovis AF2122/97
ccaacaggccuaggucgacgc

SEQ ID NO: 3137104 - RNA, 16 nt, Mycobacterium bovis subsp bovis AF2122/97
ccaacagggcgccgac

SEQ ID NO: 3137105 - RNA, 18 nt, Mycobacterium bovis subsp bovis AF2122/97
ccaacagucgcagcacgg

SEQ ID NO: 3137106 - RNA, 20 nt, Mycobacterium bovis subsp bovis AF2122/97
ccaacagucgcagcacggcu

SEQ ID NO: 3137107 - RNA, 17 nt, Mycobacterium bovis subsp bovis AF2122/97
ccaacaucccggaccga

SEQ ID NO: 3137108 - RNA, 21 nt, Mycobacterium bovis subsp bovis AF2122/97
ccaacauguugucgucgccgc

SEQ ID NO: 3137109 - RNA, 22 nt, Mycobacterium bovis subsp bovis AF2122/97
ccaaccaaggacgaacgcgccg

SEQ ID NO: 3137110 - RNA, 16 nt, Mycobacterium bovis subsp bovis AF2122/97
ccaaccacgagcauca

SEQ ID NO: 3137111 - RNA, 12 nt, Mycobacterium bovis subsp bovis AF2122/97
ccaaccagcacc

SEQ ID NO: 3137112 - RNA, 13 nt, Mycobacterium bovis subsp bovis AF2122/97
ccaaccaggccgc

SEQ ID NO: 3137113 - RNA, 16 nt, Mycobacterium bovis subsp bovis AF2122/97
ccaaccaggccgcgac

SEQ ID NO: 3137114 - RNA, 15 nt, Mycobacterium bovis subsp bovis AF2122/97
ccaaccagugcagcu

SEQ ID NO: 3137115 - RNA, 17 nt, Mycobacterium bovis subsp bovis AF2122/97
ccaaccagugcagcucg

SEQ ID NO: 3137116 - RNA, 20 nt, Mycobacterium bovis subsp bovis AF2122/97
ccaaccagugcagcucgaua

SEQ ID NO: 3137117 - RNA, 22 nt, Mycobacterium bovis subsp bovis AF2122/97
ccaaccaugcgguuagcagccg

SEQ ID NO: 3137118 - RNA, 15 nt, Mycobacterium bovis subsp bovis AF2122/97
ccaacccacccccca

SEQ ID NO: 3137119 - RNA, 22 nt, Mycobacterium bovis subsp bovis AF2122/97
ccaacccauuucgucagcgacc

SEQ ID NO: 3137120 - RNA, 13 nt, Mycobacterium bovis subsp bovis AF2122/97
ccaaccccgccgg

SEQ ID NO: 3137121 - RNA, 20 nt, Mycobacterium bovis subsp bovis AF2122/97
ccaaccccgccggccggaac

SEQ ID NO: 3137122 - RNA, 13 nt, Mycobacterium bovis subsp bovis AF2122/97
ccaacccggcggc

SEQ ID NO: 3137123 - RNA, 15 nt, Mycobacterium bovis subsp bovis AF2122/97
ccaacccgggccgcc

SEQ ID NO: 3137124 - RNA, 21 nt, Mycobacterium bovis subsp bovis AF2122/97
ccaacccgucuuaucggcguc

SEQ ID NO: 3137125 - RNA, 22 nt, Mycobacterium bovis subsp bovis AF2122/97
ccaacccuaaaccagccaccac

SEQ ID NO: 3137126 - RNA, 12 nt, Mycobacterium bovis subsp bovis AF2122/97
ccaacccucgcc

SEQ ID NO: 3137127 - RNA, 15 nt, Mycobacterium bovis subsp bovis AF2122/97
ccaacccugcggcgu

SEQ ID NO: 3137128 - RNA, 17 nt, Mycobacterium bovis subsp bovis AF2122/97
ccaacccugcggcgucg

SEQ ID NO: 3137129 - RNA, 14 nt, Mycobacterium bovis subsp bovis AF2122/97
ccaaccgccggcca

SEQ ID NO: 3137130 - RNA, 13 nt, Mycobacterium bovis subsp bovis AF2122/97
ccaaccgcgccac

SEQ ID NO: 3137131 - RNA, 19 nt, Mycobacterium bovis subsp bovis AF2122/97
ccaaccgcgugcgucagcg

SEQ ID NO: 3137132 - RNA, 17 nt, Mycobacterium bovis subsp bovis AF2122/97
ccaaccgguagccaggc

SEQ ID NO: 3137133 - RNA, 18 nt, Mycobacterium bovis subsp bovis AF2122/97
ccaaccgguagccaggcg

SEQ ID NO: 3137134 - RNA, 19 nt, Mycobacterium bovis subsp bovis AF2122/97
ccaaccgguggccggucgu

SEQ ID NO: 3137135 - RNA, 15 nt, Mycobacterium bovis subsp bovis AF2122/97
ccaaccucaucgcgg

SEQ ID NO: 3137136 - RNA, 13 nt, Mycobacterium bovis subsp bovis AF2122/97
ccaaccugcgcgg

SEQ ID NO: 3137137 - RNA, 15 nt, Mycobacterium bovis subsp bovis AF2122/97
ccaaccugcgcggcg

SEQ ID NO: 3137138 - RNA, 16 nt, Mycobacterium bovis subsp bovis AF2122/97
ccaacgacagcgacgg

SEQ ID NO: 3137139 - RNA, 13 nt, Mycobacterium bovis subsp bovis AF2122/97
ccaacgacaggug

SEQ ID NO: 3137140 - RNA, 12 nt, Mycobacterium bovis subsp bovis AF2122/97
ccaacgacauga

SEQ ID NO: 3137141 - RNA, 22 nt, Mycobacterium bovis subsp bovis AF2122/97
ccaacgacucacccacccgcac

SEQ ID NO: 3137142 - RNA, 15 nt, Mycobacterium bovis subsp bovis AF2122/97
ccaacgacuguggcg

SEQ ID NO: 3137143 - RNA, 17 nt, Mycobacterium bovis subsp bovis AF2122/97
ccaacgacuguggcgcc

SEQ ID NO: 3137144 - RNA, 21 nt, Mycobacterium bovis subsp bovis AF2122/97
ccaacgacuguggcgccgccg

SEQ ID NO: 3137145 - RNA, 22 nt, Mycobacterium bovis subsp bovis AF2122/97
ccaacgacuguggcgccgccgg

SEQ ID NO: 3137146 - RNA, 14 nt, Mycobacterium bovis subsp bovis AF2122/97
ccaacgagcgcgcu

SEQ ID NO: 3137147 - RNA, 18 nt, Mycobacterium bovis subsp bovis AF2122/97
ccaacgcaacacgggcgc

SEQ ID NO: 3137148 - RNA, 16 nt, Mycobacterium bovis subsp bovis AF2122/97
ccaacgcacacaccgu

SEQ ID NO: 3137149 - RNA, 13 nt, Mycobacterium bovis subsp bovis AF2122/97
ccaacgccaccgu

SEQ ID NO: 3137150 - RNA, 14 nt, Mycobacterium bovis subsp bovis AF2122/97
ccaacgccaccguc

SEQ ID NO: 3137151 - RNA, 13 nt, Mycobacterium bovis subsp bovis AF2122/97
ccaacgccacggc

SEQ ID NO: 3137152 - RNA, 14 nt, Mycobacterium bovis subsp bovis AF2122/97
ccaacgccacggca

SEQ ID NO: 3137153 - RNA, 13 nt, Mycobacterium bovis subsp bovis AF2122/97
ccaacgccagcgg

SEQ ID NO: 3137154 - RNA, 14 nt, Mycobacterium bovis subsp bovis AF2122/97
ccaacgccagcggg

SEQ ID NO: 3137155 - RNA, 13 nt, Mycobacterium bovis subsp bovis AF2122/97
ccaacgcccgggc

SEQ ID NO: 3137156 - RNA, 18 nt, Mycobacterium bovis subsp bovis AF2122/97
ccaacgcccgggcgaauc

SEQ ID NO: 3137157 - RNA, 22 nt, Mycobacterium bovis subsp bovis AF2122/97
ccaacgccuugacugaacucaa

SEQ ID NO: 3137158 - RNA, 19 nt, Mycobacterium bovis subsp bovis AF2122/97
ccaacgcgauguccaggug

SEQ ID NO: 3137159 - RNA, 22 nt, Mycobacterium bovis subsp bovis AF2122/97
ccaacgcgauguccagguggcg

SEQ ID NO: 3137160 - RNA, 16 nt, Mycobacterium bovis subsp bovis AF2122/97
ccaacgcgcagagcgu

SEQ ID NO: 3137161 - RNA, 13 nt, Mycobacterium bovis subsp bovis AF2122/97
ccaacgcggcgcg

SEQ ID NO: 3137162 - RNA, 17 nt, Mycobacterium bovis subsp bovis AF2122/97
ccaacgcggcgcgagcc

SEQ ID NO: 3137163 - RNA, 22 nt, Mycobacterium bovis subsp bovis AF2122/97
ccaacgcgggaacgaugccgcc

SEQ ID NO: 3137164 - RNA, 23 nt, Mycobacterium bovis subsp bovis AF2122/97
ccaacgcgggaacgaugccgccg

SEQ ID NO: 3137165 - RNA, 16 nt, Mycobacterium bovis subsp bovis AF2122/97
ccaacgcgggugccgg

SEQ ID NO: 3137166 - RNA, 20 nt, Mycobacterium bovis subsp bovis AF2122/97
ccaacgcgguaaagccccgc

SEQ ID NO: 3137167 - RNA, 13 nt, Mycobacterium bovis subsp bovis AF2122/97
ccaacgcgguggg

SEQ ID NO: 3137168 - RNA, 19 nt, Mycobacterium bovis subsp bovis AF2122/97
ccaacgcggugggcacagc

SEQ ID NO: 3137169 - RNA, 21 nt, Mycobacterium bovis subsp bovis AF2122/97
ccaacgcggugggcacagcca

SEQ ID NO: 3137170 - RNA, 23 nt, Mycobacterium bovis subsp bovis AF2122/97
ccaacgcugucccuauugaucug

SEQ ID NO: 3137171 - RNA, 15 nt, Mycobacterium bovis subsp bovis AF2122/97
ccaacgcuucugccu

SEQ ID NO: 3137172 - RNA, 23 nt, Mycobacterium bovis subsp bovis AF2122/97
ccaacgcuucugccugcgcacga

SEQ ID NO: 3137173 - RNA, 24 nt, Mycobacterium bovis subsp bovis AF2122/97
ccaacgcuucugccugcgcacgac

SEQ ID NO: 3137174 - RNA, 18 nt, Mycobacterium bovis subsp bovis AF2122/97
ccaacggcuccgggcgcu

SEQ ID NO: 3137175 - RNA, 17 nt, Mycobacterium bovis subsp bovis AF2122/97
ccaacgggcugccccuc

SEQ ID NO: 3137176 - RNA, 24 nt, Mycobacterium bovis subsp bovis AF2122/97
ccaacggguaguucuuggucaggc

SEQ ID NO: 3137177 - RNA, 20 nt, Mycobacterium bovis subsp bovis AF2122/97
ccaacggugcucguguuguu

SEQ ID NO: 3137178 - RNA, 19 nt, Mycobacterium bovis subsp bovis AF2122/97
ccaacgucgacuucagcgg

SEQ ID NO: 3137179 - RNA, 22 nt, Mycobacterium bovis subsp bovis AF2122/97
ccaacgucgauguccccggcgg

SEQ ID NO: 3137180 - RNA, 18 nt, Mycobacterium bovis subsp bovis AF2122/97
ccaacgucgccaggucau

SEQ ID NO: 3137181 - RNA, 19 nt, Mycobacterium bovis subsp bovis AF2122/97
ccaacgucgccaggucauc

SEQ ID NO: 3137182 - RNA, 16 nt, Mycobacterium bovis subsp bovis AF2122/97
ccaacgugacgccggc

SEQ ID NO: 3137183 - RNA, 20 nt, Mycobacterium bovis subsp bovis AF2122/97
ccaacgugacgccggccagu

SEQ ID NO: 3137184 - RNA, 18 nt, Mycobacterium bovis subsp bovis AF2122/97
ccaacguugcgccagcgg

SEQ ID NO: 3137185 - RNA, 16 nt, Mycobacterium bovis subsp bovis AF2122/97
ccaacguugugccgcu

SEQ ID NO: 3137186 - RNA, 18 nt, Mycobacterium bovis subsp bovis AF2122/97
ccaacuccaagaugccgc

SEQ ID NO: 3137187 - RNA, 21 nt, Mycobacterium bovis subsp bovis AF2122/97
ccaacuccaagaugccgcccc

SEQ ID NO: 3137188 - RNA, 15 nt, Mycobacterium bovis subsp bovis AF2122/97
ccaagucggagcggg

SEQ ID NO: 3137189 - RNA, 13 nt, Mycobacterium bovis subsp bovis AF2122/97
ccaagugaccggc

SEQ ID NO: 3137190 - RNA, 19 nt, Mycobacterium bovis subsp bovis AF2122/97
ccaagugaccggccugcga

SEQ ID NO: 3137191 - RNA, 19 nt, Mycobacterium bovis subsp bovis AF2122/97
ccaagugagcgaucgggug

SEQ ID NO: 3137192 - RNA, 21 nt, Mycobacterium bovis subsp bovis AF2122/97
ccaaguucagcacgugggcca

SEQ ID NO: 3137193 - RNA, 17 nt, Mycobacterium bovis subsp bovis AF2122/97
ccaaguugcagcgggcc

SEQ ID NO: 3137194 - RNA, 19 nt, Mycobacterium bovis subsp bovis AF2122/97
ccaauacgugauguagcug

SEQ ID NO: 3137195 - RNA, 19 nt, Mycobacterium bovis subsp bovis AF2122/97
ccaauacucgccaucgcgg

SEQ ID NO: 3137196 - RNA, 14 nt, Mycobacterium bovis subsp bovis AF2122/97
ccaauagcacgggc

SEQ ID NO: 3137197 - RNA, 22 nt, Mycobacterium bovis subsp bovis AF2122/97
ccaauaguccuugcgccagcgg

SEQ ID NO: 3137198 - RNA, 22 nt, Mycobacterium bovis subsp bovis AF2122/97
ccaaucaccguaauuucuucac

SEQ ID NO: 3137199 - RNA, 13 nt, Mycobacterium bovis subsp bovis AF2122/97
ccaaucagcccgc

SEQ ID NO: 3137200 - RNA, 15 nt, Mycobacterium bovis subsp bovis AF2122/97
ccaaucagcccgccg

SEQ ID NO: 3137201 - RNA, 14 nt, Mycobacterium bovis subsp bovis AF2122/97
ccaauccggcggcg

SEQ ID NO: 3137202 - RNA, 20 nt, Mycobacterium bovis subsp bovis AF2122/97
ccaauccggcggcgacgugu

SEQ ID NO: 3137203 - RNA, 20 nt, Mycobacterium bovis subsp bovis AF2122/97
ccaauccggcugcgguaauc

SEQ ID NO: 3137204 - RNA, 16 nt, Mycobacterium bovis subsp bovis AF2122/97
ccaauccggggcccgg

SEQ ID NO: 3137205 - RNA, 15 nt, Mycobacterium bovis subsp bovis AF2122/97
ccaaucgaguagcug

SEQ ID NO: 3137206 - RNA, 16 nt, Mycobacterium bovis subsp bovis AF2122/97
ccaaucgcacgccagc

SEQ ID NO: 3137207 - RNA, 15 nt, Mycobacterium bovis subsp bovis AF2122/97
ccaaucgucggccag

SEQ ID NO: 3137208 - RNA, 17 nt, Mycobacterium bovis subsp bovis AF2122/97
ccaaucgucggccagca

SEQ ID NO: 3137209 - RNA, 18 nt, Mycobacterium bovis subsp bovis AF2122/97
ccaaucgucggccagcag

SEQ ID NO: 3137210 - RNA, 19 nt, Mycobacterium bovis subsp bovis AF2122/97
ccaaucuucucgagccgcc

SEQ ID NO: 3137211 - RNA, 19 nt, Mycobacterium bovis subsp bovis AF2122/97
ccaaugaaaacggaugugu

SEQ ID NO: 3137212 - RNA, 18 nt, Mycobacterium bovis subsp bovis AF2122/97
ccaaugacgucgcggauu

SEQ ID NO: 3137213 - RNA, 13 nt, Mycobacterium bovis subsp bovis AF2122/97
ccaaugacgucgg

SEQ ID NO: 3137214 - RNA, 22 nt, Mycobacterium bovis subsp bovis AF2122/97
ccaaugauucggcacgccgggc

SEQ ID NO: 3137215 - RNA, 15 nt, Mycobacterium bovis subsp bovis AF2122/97
ccaaugccaccgcgg

SEQ ID NO: 3137216 - RNA, 17 nt, Mycobacterium bovis subsp bovis AF2122/97
ccaaugccaccgcggcc

SEQ ID NO: 3137217 - RNA, 19 nt, Mycobacterium bovis subsp bovis AF2122/97
ccaaugccaccgcggccgc

SEQ ID NO: 3137218 - RNA, 18 nt, Mycobacterium bovis subsp bovis AF2122/97
ccaaugcccuuggccagc

SEQ ID NO: 3137219 - RNA, 19 nt, Mycobacterium bovis subsp bovis AF2122/97
ccaaugcccuuggccagca

SEQ ID NO: 3137220 - RNA, 20 nt, Mycobacterium bovis subsp bovis AF2122/97
ccaaugcccuuggccagcag

SEQ ID NO: 3137221 - RNA, 18 nt, Mycobacterium bovis subsp bovis AF2122/97
ccaaugcgauucugcguc

SEQ ID NO: 3137222 - RNA, 17 nt, Mycobacterium bovis subsp bovis AF2122/97
ccaauggagccgcgacc

SEQ ID NO: 3137223 - RNA, 20 nt, Mycobacterium bovis subsp bovis AF2122/97
ccaauggccgcggcacccag

SEQ ID NO: 3137224 - RNA, 16 nt, Mycobacterium bovis subsp bovis AF2122/97
ccaauggccugcagcg

SEQ ID NO: 3137225 - RNA, 15 nt, Mycobacterium bovis subsp bovis AF2122/97
ccaaugucagugccc

SEQ ID NO: 3137226 - RNA, 22 nt, Mycobacterium bovis subsp bovis AF2122/97
ccaaugucagugccccgcccgg

SEQ ID NO: 3137227 - RNA, 17 nt, Mycobacterium bovis subsp bovis AF2122/97
ccaaugucggacagcga

SEQ ID NO: 3137228 - RNA, 16 nt, Mycobacterium bovis subsp bovis AF2122/97
ccaaugugccggucac

SEQ ID NO: 3137229 - RNA, 23 nt, Mycobacterium bovis subsp bovis AF2122/97
ccaauuacagcuugcgcagccgc

SEQ ID NO: 3137230 - RNA, 15 nt, Mycobacterium bovis subsp bovis AF2122/97
ccaauucccgcgcgg

SEQ ID NO: 3137231 - RNA, 21 nt, Mycobacterium bovis subsp bovis AF2122/97
ccaauucuggcuccgacgaaa

SEQ ID NO: 3137232 - RNA, 16 nt, Mycobacterium bovis subsp bovis AF2122/97
ccaauugauaggcccc

SEQ ID NO: 3137233 - RNA, 23 nt, Mycobacterium bovis subsp bovis AF2122/97
ccaauugcccuuucccaccuuca

SEQ ID NO: 3137234 - RNA, 18 nt, Mycobacterium bovis subsp bovis AF2122/97
ccaauugcggccgcgcgc

SEQ ID NO: 3137235 - RNA, 15 nt, Mycobacterium bovis subsp bovis AF2122/97
ccaauuggcgucguc

SEQ ID NO: 3137236 - RNA, 14 nt, Mycobacterium bovis subsp bovis AF2122/97
ccaauugucaagcc

SEQ ID NO: 3137237 - RNA, 19 nt, Mycobacterium bovis subsp bovis AF2122/97
ccacaacccgcuuggcaau

SEQ ID NO: 3137238 - RNA, 18 nt, Mycobacterium bovis subsp bovis AF2122/97
ccacaaccgugagcacca

SEQ ID NO: 3137239 - RNA, 20 nt, Mycobacterium bovis subsp bovis AF2122/97
ccacaaccgugagcaccagc

SEQ ID NO: 3137240 - RNA, 13 nt, Mycobacterium bovis subsp bovis AF2122/97
ccacaacgccucg

SEQ ID NO: 3137241 - RNA, 14 nt, Mycobacterium bovis subsp bovis AF2122/97
ccacaacggcggcg

SEQ ID NO: 3137242 - RNA, 15 nt, Mycobacterium bovis subsp bovis AF2122/97
ccacaacggcggcgc

SEQ ID NO: 3137243 - RNA, 14 nt, Mycobacterium bovis subsp bovis AF2122/97
ccacaacgucggca

SEQ ID NO: 3137244 - RNA, 13 nt, Mycobacterium bovis subsp bovis AF2122/97
ccacaauccgcuc

SEQ ID NO: 3137245 - RNA, 17 nt, Mycobacterium bovis subsp bovis AF2122/97
ccacaauccgcucgguc

SEQ ID NO: 3137246 - RNA, 14 nt, Mycobacterium bovis subsp bovis AF2122/97
ccacaaucgcagau

SEQ ID NO: 3137247 - RNA, 18 nt, Mycobacterium bovis subsp bovis AF2122/97
ccacaaugacucggccgc

SEQ ID NO: 3137248 - RNA, 21 nt, Mycobacterium bovis subsp bovis AF2122/97
ccacaaugacucggccgcacc

SEQ ID NO: 3137249 - RNA, 13 nt, Mycobacterium bovis subsp bovis AF2122/97
ccacacacugccg

SEQ ID NO: 3137250 - RNA, 15 nt, Mycobacterium bovis subsp bovis AF2122/97
ccacacagccgcgcu

SEQ ID NO: 3137251 - RNA, 16 nt, Mycobacterium bovis subsp bovis AF2122/97
ccacacagccgcgcug

SEQ ID NO: 3137252 - RNA, 17 nt, Mycobacterium bovis subsp bovis AF2122/97
ccacaccacgguggccg

SEQ ID NO: 3137253 - RNA, 14 nt, Mycobacterium bovis subsp bovis AF2122/97
ccacaccagcgcag

SEQ ID NO: 3137254 - RNA, 22 nt, Mycobacterium bovis subsp bovis AF2122/97
ccacaccagcuuguagcgcucg

SEQ ID NO: 3137255 - RNA, 22 nt, Mycobacterium bovis subsp bovis AF2122/97
ccacaccaggccgagccgcccg

SEQ ID NO: 3137256 - RNA, 14 nt, Mycobacterium bovis subsp bovis AF2122/97
ccacacccaaaccg

SEQ ID NO: 3137257 - RNA, 20 nt, Mycobacterium bovis subsp bovis AF2122/97
ccacacccagcgugcccgcc

SEQ ID NO: 3137258 - RNA, 22 nt, Mycobacterium bovis subsp bovis AF2122/97
ccacacccagcgugcccgccac

SEQ ID NO: 3137259 - RNA, 14 nt, Mycobacterium bovis subsp bovis AF2122/97
ccacacccaguuga

SEQ ID NO: 3137260 - RNA, 21 nt, Mycobacterium bovis subsp bovis AF2122/97
ccacacccgcgaacgcgacag

SEQ ID NO: 3137261 - RNA, 19 nt, Mycobacterium bovis subsp bovis AF2122/97
ccacacccggcacacccuc

SEQ ID NO: 3137262 - RNA, 14 nt, Mycobacterium bovis subsp bovis AF2122/97
ccacacccgggacg

SEQ ID NO: 3137263 - RNA, 21 nt, Mycobacterium bovis subsp bovis AF2122/97
ccacaccgccgccaagcucgg

SEQ ID NO: 3137264 - RNA, 12 nt, Mycobacterium bovis subsp bovis AF2122/97
ccacaccgcggc

SEQ ID NO: 3137265 - RNA, 13 nt, Mycobacterium bovis subsp bovis AF2122/97
ccacaccgcggcg

SEQ ID NO: 3137266 - RNA, 15 nt, Mycobacterium bovis subsp bovis AF2122/97
ccacaccgcggcggc

SEQ ID NO: 3137267 - RNA, 18 nt, Mycobacterium bovis subsp bovis AF2122/97
ccacaccgcggcggcgcg

SEQ ID NO: 3137268 - RNA, 15 nt, Mycobacterium bovis subsp bovis AF2122/97
ccacaccggagccga

SEQ ID NO: 3137269 - RNA, 13 nt, Mycobacterium bovis subsp bovis AF2122/97
ccacaccggcagc

SEQ ID NO: 3137270 - RNA, 16 nt, Mycobacterium bovis subsp bovis AF2122/97
ccacaccggggcggcc

SEQ ID NO: 3137271 - RNA, 20 nt, Mycobacterium bovis subsp bovis AF2122/97
ccacaccgugggcgacggcg

SEQ ID NO: 3137272 - RNA, 22 nt, Mycobacterium bovis subsp bovis AF2122/97
ccacaccuaccguacgcagcgu

SEQ ID NO: 3137273 - RNA, 16 nt, Mycobacterium bovis subsp bovis AF2122/97
ccacaccugcggcugc

SEQ ID NO: 3137274 - RNA, 22 nt, Mycobacterium bovis subsp bovis AF2122/97
ccacaccuucgggggcgcgcgg

SEQ ID NO: 3137275 - RNA, 14 nt, Mycobacterium bovis subsp bovis AF2122/97
ccaccaccaccgcc

SEQ ID NO: 3137276 - RNA, 15 nt, Mycobacterium bovis subsp bovis AF2122/97
ccaccacccaggcca

SEQ ID NO: 3137277 - RNA, 12 nt, Mycobacterium bovis subsp bovis AF2122/97
ccaccacccugc

SEQ ID NO: 3137278 - RNA, 13 nt, Mycobacterium bovis subsp bovis AF2122/97
ccaccacccugca

SEQ ID NO: 3137279 - RNA, 15 nt, Mycobacterium bovis subsp bovis AF2122/97
ccaccacccugcacu

SEQ ID NO: 3137280 - RNA, 15 nt, Mycobacterium bovis subsp bovis AF2122/97
ccaccaccgagccgu

SEQ ID NO: 3137281 - RNA, 12 nt, Mycobacterium bovis subsp bovis AF2122/97
ccaccaccgccg

SEQ ID NO: 3137282 - RNA, 13 nt, Mycobacterium bovis subsp bovis AF2122/97
ccaccaccgccgc

SEQ ID NO: 3137283 - RNA, 15 nt, Mycobacterium bovis subsp bovis AF2122/97
ccaccaccgccgccg

SEQ ID NO: 3137284 - RNA, 17 nt, Mycobacterium bovis subsp bovis AF2122/97
ccaccaccgccgccgaa

SEQ ID NO: 3137285 - RNA, 13 nt, Mycobacterium bovis subsp bovis AF2122/97
ccaccaccgccgg

SEQ ID NO: 3137286 - RNA, 14 nt, Mycobacterium bovis subsp bovis AF2122/97
ccaccaccgccggu

SEQ ID NO: 3137287 - RNA, 19 nt, Mycobacterium bovis subsp bovis AF2122/97
ccaccaccgccggugccgc

SEQ ID NO: 3137288 - RNA, 12 nt, Mycobacterium bovis subsp bovis AF2122/97
ccaccaccgcgc

SEQ ID NO: 3137289 - RNA, 18 nt, Mycobacterium bovis subsp bovis AF2122/97
ccaccaccgcugccggcg

SEQ ID NO: 3137290 - RNA, 13 nt, Mycobacterium bovis subsp bovis AF2122/97
ccaccaccggcac

SEQ ID NO: 3137291 - RNA, 13 nt, Mycobacterium bovis subsp bovis AF2122/97
ccaccaccggcgc

SEQ ID NO: 3137292 - RNA, 19 nt, Mycobacterium bovis subsp bovis AF2122/97
ccaccaccggugaacacca

SEQ ID NO: 3137293 - RNA, 12 nt, Mycobacterium bovis subsp bovis AF2122/97
ccaccaccguga

SEQ ID NO: 3137294 - RNA, 14 nt, Mycobacterium bovis subsp bovis AF2122/97
ccaccaccuggccg

SEQ ID NO: 3137295 - RNA, 13 nt, Mycobacterium bovis subsp bovis AF2122/97
ccaccacgccguc

SEQ ID NO: 3137296 - RNA, 13 nt, Mycobacterium bovis subsp bovis AF2122/97
ccaccacgcgacg

SEQ ID NO: 3137297 - RNA, 13 nt, Mycobacterium bovis subsp bovis AF2122/97
ccaccacgcuccc

SEQ ID NO: 3137298 - RNA, 17 nt, Mycobacterium bovis subsp bovis AF2122/97
ccaccacgcuggccucg

SEQ ID NO: 3137299 - RNA, 22 nt, Mycobacterium bovis subsp bovis AF2122/97
ccaccacggccagaaacccggc

SEQ ID NO: 3137300 - RNA, 23 nt, Mycobacterium bovis subsp bovis AF2122/97
ccaccacuagcuucgcuugccga

SEQ ID NO: 3137301 - RNA, 22 nt, Mycobacterium bovis subsp bovis AF2122/97
ccaccacuaggucgccggccac

SEQ ID NO: 3137302 - RNA, 22 nt, Mycobacterium bovis subsp bovis AF2122/97
ccaccacugugacacccgaggg

SEQ ID NO: 3137303 - RNA, 18 nt, Mycobacterium bovis subsp bovis AF2122/97
ccaccacuucggcgccgc

SEQ ID NO: 3137304 - RNA, 17 nt, Mycobacterium bovis subsp bovis AF2122/97
ccaccagaaacaccgac

SEQ ID NO: 3137305 - RNA, 22 nt, Mycobacterium bovis subsp bovis AF2122/97
ccaccagaaacaccgacgacgg

SEQ ID NO: 3137306 - RNA, 23 nt, Mycobacterium bovis subsp bovis AF2122/97
ccaccagaaacaccgacgacggc

SEQ ID NO: 3137307 - RNA, 12 nt, Mycobacterium bovis subsp bovis AF2122/97
ccaccagaaucc

SEQ ID NO: 3137308 - RNA, 16 nt, Mycobacterium bovis subsp bovis AF2122/97
ccaccagcaccgccgc

SEQ ID NO: 3137309 - RNA, 11 nt, Mycobacterium bovis subsp bovis AF2122/97
ccaccagcacg

SEQ ID NO: 3137310 - RNA, 12 nt, Mycobacterium bovis subsp bovis AF2122/97
ccaccagcacgc

SEQ ID NO: 3137311 - RNA, 13 nt, Mycobacterium bovis subsp bovis AF2122/97
ccaccagccgggc

SEQ ID NO: 3137312 - RNA, 15 nt, Mycobacterium bovis subsp bovis AF2122/97
ccaccagccgguagc

SEQ ID NO: 3137313 - RNA, 21 nt, Mycobacterium bovis subsp bovis AF2122/97
ccaccagccgguccagcagcu

SEQ ID NO: 3137314 - RNA, 14 nt, Mycobacterium bovis subsp bovis AF2122/97
ccaccagcgacgac

SEQ ID NO: 3137315 - RNA, 18 nt, Mycobacterium bovis subsp bovis AF2122/97
ccaccagcgacgaccaca

SEQ ID NO: 3137316 - RNA, 22 nt, Mycobacterium bovis subsp bovis AF2122/97
ccaccagcgacgaccacaccac

SEQ ID NO: 3137317 - RNA, 14 nt, Mycobacterium bovis subsp bovis AF2122/97
ccaccagcgagccg

SEQ ID NO: 3137318 - RNA, 14 nt, Mycobacterium bovis subsp bovis AF2122/97
ccaccagcgcccgg

SEQ ID NO: 3137319 - RNA, 16 nt, Mycobacterium bovis subsp bovis AF2122/97
ccaccagcgcccggcc

SEQ ID NO: 3137320 - RNA, 17 nt, Mycobacterium bovis subsp bovis AF2122/97
ccaccagcgcccggccc

SEQ ID NO: 3137321 - RNA, 15 nt, Mycobacterium bovis subsp bovis AF2122/97
ccaccagcgcccguc

SEQ ID NO: 3137322 - RNA, 14 nt, Mycobacterium bovis subsp bovis AF2122/97
ccaccagcgccgac

SEQ ID NO: 3137323 - RNA, 15 nt, Mycobacterium bovis subsp bovis AF2122/97
ccaccagcgcuccag

SEQ ID NO: 3137324 - RNA, 14 nt, Mycobacterium bovis subsp bovis AF2122/97
ccaccagcggcggc

SEQ ID NO: 3137325 - RNA, 16 nt, Mycobacterium bovis subsp bovis AF2122/97
ccaccagcggcggccc

SEQ ID NO: 3137326 - RNA, 22 nt, Mycobacterium bovis subsp bovis AF2122/97
ccaccagcguguagcgaugccg

SEQ ID NO: 3137327 - RNA, 16 nt, Mycobacterium bovis subsp bovis AF2122/97
ccaccagcuggugagc

SEQ ID NO: 3137328 - RNA, 15 nt, Mycobacterium bovis subsp bovis AF2122/97
ccaccaggcccaucu

SEQ ID NO: 3137329 - RNA, 23 nt, Mycobacterium bovis subsp bovis AF2122/97
ccaccagggacgaugcccuccuc

SEQ ID NO: 3137330 - RNA, 23 nt, Mycobacterium bovis subsp bovis AF2122/97
ccaccagggcaacggccgcuagc

SEQ ID NO: 3137331 - RNA, 21 nt, Mycobacterium bovis subsp bovis AF2122/97
ccaccagggcacguucggcgc

SEQ ID NO: 3137332 - RNA, 18 nt, Mycobacterium bovis subsp bovis AF2122/97
ccaccagggcggccuccc

SEQ ID NO: 3137333 - RNA, 23 nt, Mycobacterium bovis subsp bovis AF2122/97
ccaccagggcggccuccccgacc

SEQ ID NO: 3137334 - RNA, 19 nt, Mycobacterium bovis subsp bovis AF2122/97
ccaccagguacgcgaucag

SEQ ID NO: 3137335 - RNA, 19 nt, Mycobacterium bovis subsp bovis AF2122/97
ccaccaguaccaccggcac

SEQ ID NO: 3137336 - RNA, 23 nt, Mycobacterium bovis subsp bovis AF2122/97
ccaccaguccgaugggaaucagu

SEQ ID NO: 3137337 - RNA, 17 nt, Mycobacterium bovis subsp bovis AF2122/97
ccaccagugagcccgcu

SEQ ID NO: 3137338 - RNA, 19 nt, Mycobacterium bovis subsp bovis AF2122/97
ccaccagugagcccgcuuc

SEQ ID NO: 3137339 - RNA, 16 nt, Mycobacterium bovis subsp bovis AF2122/97
ccaccaguuccggggu

SEQ ID NO: 3137340 - RNA, 23 nt, Mycobacterium bovis subsp bovis AF2122/97
ccaccaucaccgccuuugccgcc

SEQ ID NO: 3137341 - RNA, 21 nt, Mycobacterium bovis subsp bovis AF2122/97
ccaccaucaccucgcacgaca

SEQ ID NO: 3137342 - RNA, 13 nt, Mycobacterium bovis subsp bovis AF2122/97
ccaccaucgccgc

SEQ ID NO: 3137343 - RNA, 15 nt, Mycobacterium bovis subsp bovis AF2122/97
ccaccaucgccgccg

SEQ ID NO: 3137344 - RNA, 22 nt, Mycobacterium bovis subsp bovis AF2122/97
ccaccaucgccucggcgcugcg

SEQ ID NO: 3137345 - RNA, 15 nt, Mycobacterium bovis subsp bovis AF2122/97
ccaccaucguugccg

SEQ ID NO: 3137346 - RNA, 22 nt, Mycobacterium bovis subsp bovis AF2122/97
ccaccaucguugccggugccgc

SEQ ID NO: 3137347 - RNA, 19 nt, Mycobacterium bovis subsp bovis AF2122/97
ccaccaucuguuccgugcc

SEQ ID NO: 3137348 - RNA, 22 nt, Mycobacterium bovis subsp bovis AF2122/97
ccaccaucuguuccgugccagc

SEQ ID NO: 3137349 - RNA, 22 nt, Mycobacterium bovis subsp bovis AF2122/97
ccaccaugaucacaccgagcgc

SEQ ID NO: 3137350 - RNA, 23 nt, Mycobacterium bovis subsp bovis AF2122/97
ccaccauguauuucucccagccc

SEQ ID NO: 3137351 - RNA, 23 nt, Mycobacterium bovis subsp bovis AF2122/97
ccaccauucccggacccaccaau

SEQ ID NO: 3137352 - RNA, 22 nt, Mycobacterium bovis subsp bovis AF2122/97
ccaccauucgcgggccgaggcc

SEQ ID NO: 3137353 - RNA, 23 nt, Mycobacterium bovis subsp bovis AF2122/97
ccaccauucgcgggccgaggccg

SEQ ID NO: 3137354 - RNA, 19 nt, Mycobacterium bovis subsp bovis AF2122/97
ccacccacauggcggcccg

SEQ ID NO: 3137355 - RNA, 20 nt, Mycobacterium bovis subsp bovis AF2122/97
ccacccacauggcggcccgg

SEQ ID NO: 3137356 - RNA, 13 nt, Mycobacterium bovis subsp bovis AF2122/97
ccacccaccacag

SEQ ID NO: 3137357 - RNA, 13 nt, Mycobacterium bovis subsp bovis AF2122/97
ccacccacccgca

SEQ ID NO: 3137358 - RNA, 16 nt, Mycobacterium bovis subsp bovis AF2122/97
ccacccacccgcacca

SEQ ID NO: 3137359 - RNA, 13 nt, Mycobacterium bovis subsp bovis AF2122/97
ccacccaccggcc

SEQ ID NO: 3137360 - RNA, 15 nt, Mycobacterium bovis subsp bovis AF2122/97
ccacccaccggccac

SEQ ID NO: 3137361 - RNA, 15 nt, Mycobacterium bovis subsp bovis AF2122/97
ccacccacgccgacu

SEQ ID NO: 3137362 - RNA, 21 nt, Mycobacterium bovis subsp bovis AF2122/97
ccaccgauucggcgacgaacu

SEQ ID NO: 3137363 - RNA, 24 nt, Mycobacterium bovis subsp bovis AF2122/97
ccaccgcaaccaaagcgacgagca

SEQ ID NO: 3137364 - RNA, 15 nt, Mycobacterium bovis subsp bovis AF2122/97
ccaccgcacaucguc

SEQ ID NO: 3137365 - RNA, 15 nt, Mycobacterium bovis subsp bovis AF2122/97
ccaccgcaccugcga

SEQ ID NO: 3137366 - RNA, 17 nt, Mycobacterium bovis subsp bovis AF2122/97
ccaccgcacgcuggcgg

SEQ ID NO: 3137367 - RNA, 23 nt, Mycobacterium bovis subsp bovis AF2122/97
ccaccgcagacgugguagccggc

SEQ ID NO: 3137368 - RNA, 18 nt, Mycobacterium bovis subsp bovis AF2122/97
ccaccgcagauccccgcc

SEQ ID NO: 3137369 - RNA, 17 nt, Mycobacterium bovis subsp bovis AF2122/97
ccaccgcauugggccca

SEQ ID NO: 3137370 - RNA, 19 nt, Mycobacterium bovis subsp bovis AF2122/97
ccaccgccaccacccaggc

SEQ ID NO: 3137371 - RNA, 17 nt, Mycobacterium bovis subsp bovis AF2122/97
ccaccgcccacagcaac

SEQ ID NO: 3137372 - RNA, 15 nt, Mycobacterium bovis subsp bovis AF2122/97
ccaccgccccgcgcc

SEQ ID NO: 3137373 - RNA, 13 nt, Mycobacterium bovis subsp bovis AF2122/97
ccaccgcccgcac

SEQ ID NO: 3137374 - RNA, 21 nt, Mycobacterium bovis subsp bovis AF2122/97
ccaccgccgaacagugucgau

SEQ ID NO: 3137375 - RNA, 17 nt, Mycobacterium bovis subsp bovis AF2122/97
ccaccgccgacccuaga

SEQ ID NO: 3137376 - RNA, 13 nt, Mycobacterium bovis subsp bovis AF2122/97
ccaccgccgcacg

SEQ ID NO: 3137377 - RNA, 12 nt, Mycobacterium bovis subsp bovis AF2122/97
ccaccgccgcca

SEQ ID NO: 3137378 - RNA, 13 nt, Mycobacterium bovis subsp bovis AF2122/97
ccaccgccgccac

SEQ ID NO: 3137379 - RNA, 12 nt, Mycobacterium bovis subsp bovis AF2122/97
ccaccgccgccg

SEQ ID NO: 3137380 - RNA, 13 nt, Mycobacterium bovis subsp bovis AF2122/97
ccaccgccgccga

SEQ ID NO: 3137381 - RNA, 14 nt, Mycobacterium bovis subsp bovis AF2122/97
ccaccgccgccgaa

SEQ ID NO: 3137382 - RNA, 13 nt, Mycobacterium bovis subsp bovis AF2122/97
ccaccgccgccgc

SEQ ID NO: 3137383 - RNA, 22 nt, Mycobacterium bovis subsp bovis AF2122/97
ccaccgccgccgccgacgccgc

SEQ ID NO: 3137384 - RNA, 16 nt, Mycobacterium bovis subsp bovis AF2122/97
ccaccgccgccugccc

SEQ ID NO: 3137385 - RNA, 17 nt, Mycobacterium bovis subsp bovis AF2122/97
ccaccgccgccugcccg

SEQ ID NO: 3137386 - RNA, 22 nt, Mycobacterium bovis subsp bovis AF2122/97
ccaccgccgccugcccggcccg

SEQ ID NO: 3137387 - RNA, 12 nt, Mycobacterium bovis subsp bovis AF2122/97
ccaccgccgcgc

SEQ ID NO: 3137388 - RNA, 13 nt, Mycobacterium bovis subsp bovis AF2122/97
ccaccgccgcgcg

SEQ ID NO: 3137389 - RNA, 14 nt, Mycobacterium bovis subsp bovis AF2122/97
ccaccgccgcgcgg

SEQ ID NO: 3137390 - RNA, 12 nt, Mycobacterium bovis subsp bovis AF2122/97
ccaccgccgcug

SEQ ID NO: 3137391 - RNA, 13 nt, Mycobacterium bovis subsp bovis AF2122/97
ccaccgccgcugc

SEQ ID NO: 3137392 - RNA, 14 nt, Mycobacterium bovis subsp bovis AF2122/97
ccaccgccgcugcc

SEQ ID NO: 3137393 - RNA, 14 nt, Mycobacterium bovis subsp bovis AF2122/97
ccaccgccggcccg

SEQ ID NO: 3137394 - RNA, 11 nt, Mycobacterium bovis subsp bovis AF2122/97
ccaccgccguu

SEQ ID NO: 3137395 - RNA, 20 nt, Mycobacterium bovis subsp bovis AF2122/97
ccaccgccguugggccgcgc

SEQ ID NO: 3137396 - RNA, 20 nt, Mycobacterium bovis subsp bovis AF2122/97
ccaccgccuggaucagcgcg

SEQ ID NO: 3137397 - RNA, 18 nt, Mycobacterium bovis subsp bovis AF2122/97
ccaccgccugggcggcca

SEQ ID NO: 3137398 - RNA, 21 nt, Mycobacterium bovis subsp bovis AF2122/97
ccaccgccugggcggccagca

SEQ ID NO: 3137399 - RNA, 22 nt, Mycobacterium bovis subsp bovis AF2122/97
ccaccgccugggcggccagcac

SEQ ID NO: 3137400 - RNA, 15 nt, Mycobacterium bovis subsp bovis AF2122/97
ccaccgcgacgagcg

SEQ ID NO: 3137401 - RNA, 21 nt, Mycobacterium bovis subsp bovis AF2122/97
ccaccgcgacggcaggcucgg

SEQ ID NO: 3137402 - RNA, 13 nt, Mycobacterium bovis subsp bovis AF2122/97
ccaccgcgagacc

SEQ ID NO: 3137403 - RNA, 24 nt, Mycobacterium bovis subsp bovis AF2122/97
ccaccgcgaugccccacggugcgg

SEQ ID NO: 3137404 - RNA, 15 nt, Mycobacterium bovis subsp bovis AF2122/97
ccaccgcgcaacccg

SEQ ID NO: 3137405 - RNA, 13 nt, Mycobacterium bovis subsp bovis AF2122/97
ccaccgcgcaggu

SEQ ID NO: 3137406 - RNA, 15 nt, Mycobacterium bovis subsp bovis AF2122/97
ccaccgcgcaggugc

SEQ ID NO: 3137407 - RNA, 12 nt, Mycobacterium bovis subsp bovis AF2122/97
ccaccgcgccgg

SEQ ID NO: 3137408 - RNA, 15 nt, Mycobacterium bovis subsp bovis AF2122/97
ccaccgcgcggcgca

SEQ ID NO: 3137409 - RNA, 14 nt, Mycobacterium bovis subsp bovis AF2122/97
ccaccgcggccgcg

SEQ ID NO: 3137410 - RNA, 15 nt, Mycobacterium bovis subsp bovis AF2122/97
ccaccgcggcggcgg

SEQ ID NO: 3137411 - RNA, 20 nt, Mycobacterium bovis subsp bovis AF2122/97
ccaccgcggcggcggccaua

SEQ ID NO: 3137412 - RNA, 19 nt, Mycobacterium bovis subsp bovis AF2122/97
ccaccgcgggcggcaucgc

SEQ ID NO: 3137413 - RNA, 14 nt, Mycobacterium bovis subsp bovis AF2122/97
ccaccgcggucacc

SEQ ID NO: 3137414 - RNA, 18 nt, Mycobacterium bovis subsp bovis AF2122/97
ccaccgcggucaccgacg

SEQ ID NO: 3137415 - RNA, 21 nt, Mycobacterium bovis subsp bovis AF2122/97
ccaccgcggucaccgacgcag

SEQ ID NO: 3137416 - RNA, 18 nt, Mycobacterium bovis subsp bovis AF2122/97
ccaccgcggucagcucgg

SEQ ID NO: 3137417 - RNA, 14 nt, Mycobacterium bovis subsp bovis AF2122/97
ccaccgcgguggcg

SEQ ID NO: 3137418 - RNA, 18 nt, Mycobacterium bovis subsp bovis AF2122/97
ccaccgcgucgggccgca

SEQ ID NO: 3137419 - RNA, 23 nt, Mycobacterium bovis subsp bovis AF2122/97
ccaccgcucgucguccggccacg

SEQ ID NO: 3137420 - RNA, 14 nt, Mycobacterium bovis subsp bovis AF2122/97
ccaccgcugccggc

SEQ ID NO: 3137421 - RNA, 15 nt, Mycobacterium bovis subsp bovis AF2122/97
ccaccgcugccggca

SEQ ID NO: 3137422 - RNA, 16 nt, Mycobacterium bovis subsp bovis AF2122/97
ccaccgcugccggcgc

SEQ ID NO: 3137423 - RNA, 22 nt, Mycobacterium bovis subsp bovis AF2122/97
ccaccgcugcggcaccacccgg

SEQ ID NO: 3137424 - RNA, 13 nt, Mycobacterium bovis subsp bovis AF2122/97
ccaccgcugucga

SEQ ID NO: 3137425 - RNA, 17 nt, Mycobacterium bovis subsp bovis AF2122/97
ccaccggaauacgcgcc

SEQ ID NO: 3137426 - RNA, 21 nt, Mycobacterium bovis subsp bovis AF2122/97
ccaccggaauacgcgccgccg

SEQ ID NO: 3137427 - RNA, 22 nt, Mycobacterium bovis subsp bovis AF2122/97
ccaccggaauccuggccgccgc

SEQ ID NO: 3137428 - RNA, 16 nt, Mycobacterium bovis subsp bovis AF2122/97
ccaccggaccaccgcc

SEQ ID NO: 3137429 - RNA, 19 nt, Mycobacterium bovis subsp bovis AF2122/97
ccaccggaccaccgccgaa

SEQ ID NO: 3137430 - RNA, 20 nt, Mycobacterium bovis subsp bovis AF2122/97
ccaccggaccgaccaccgcg

SEQ ID NO: 3137431 - RNA, 21 nt, Mycobacterium bovis subsp bovis AF2122/97
ccaccggaccgaccaccgcga

SEQ ID NO: 3137432 - RNA, 17 nt, Mycobacterium bovis subsp bovis AF2122/97
ccaccggaucgcucccg

SEQ ID NO: 3137433 - RNA, 21 nt, Mycobacterium bovis subsp bovis AF2122/97
ccaccggaucgucgaacagca

SEQ ID NO: 3137434 - RNA, 15 nt, Mycobacterium bovis subsp bovis AF2122/97
ccaccggcacccccg

SEQ ID NO: 3137435 - RNA, 17 nt, Mycobacterium bovis subsp bovis AF2122/97
ccaccggcacccccguc

SEQ ID NO: 3137436 - RNA, 14 nt, Mycobacterium bovis subsp bovis AF2122/97
ccaccggcacccgc

SEQ ID NO: 3137437 - RNA, 12 nt, Mycobacterium bovis subsp bovis AF2122/97
ccaccggcaccg

SEQ ID NO: 3137438 - RNA, 15 nt, Mycobacterium bovis subsp bovis AF2122/97
ccaccggcaccgccu

SEQ ID NO: 3137439 - RNA, 17 nt, Mycobacterium bovis subsp bovis AF2122/97
ccaccggcaccgccugc

SEQ ID NO: 3137440 - RNA, 19 nt, Mycobacterium bovis subsp bovis AF2122/97
ccaccggcaccgccugcgc

SEQ ID NO: 3137441 - RNA, 21 nt, Mycobacterium bovis subsp bovis AF2122/97
ccaccggcaccgccugcgccg

SEQ ID NO: 3137442 - RNA, 14 nt, Mycobacterium bovis subsp bovis AF2122/97
ccaccggcaccgcu

SEQ ID NO: 3137443 - RNA, 15 nt, Mycobacterium bovis subsp bovis AF2122/97
ccaccggcaccgcug

SEQ ID NO: 3137444 - RNA, 16 nt, Mycobacterium bovis subsp bovis AF2122/97
ccaccggcaccgcugc

SEQ ID NO: 3137445 - RNA, 19 nt, Mycobacterium bovis subsp bovis AF2122/97
ccaccggcaccgcugccgc

SEQ ID NO: 3137446 - RNA, 15 nt, Mycobacterium bovis subsp bovis AF2122/97
ccaccggcacgguga

SEQ ID NO: 3137447 - RNA, 12 nt, Mycobacterium bovis subsp bovis AF2122/97
ccaccggccagu

SEQ ID NO: 3137448 - RNA, 14 nt, Mycobacterium bovis subsp bovis AF2122/97
ccaccggccagugg

SEQ ID NO: 3137449 - RNA, 19 nt, Mycobacterium bovis subsp bovis AF2122/97
ccaccucggugaccaggcc

SEQ ID NO: 3137450 - RNA, 20 nt, Mycobacterium bovis subsp bovis AF2122/97
ccaccucggugaccaggccg

SEQ ID NO: 3137451 - RNA, 14 nt, Mycobacterium bovis subsp bovis AF2122/97
ccaccucggugcgg

SEQ ID NO: 3137452 - RNA, 15 nt, Mycobacterium bovis subsp bovis AF2122/97
ccaccucgucacagu

SEQ ID NO: 3137453 - RNA, 18 nt, Mycobacterium bovis subsp bovis AF2122/97
ccaccucuucucggacac

SEQ ID NO: 3137454 - RNA, 15 nt, Mycobacterium bovis subsp bovis AF2122/97
ccaccugcuggccgu

SEQ ID NO: 3137455 - RNA, 21 nt, Mycobacterium bovis subsp bovis AF2122/97
ccaccuggucgcguccaccca

SEQ ID NO: 3137456 - RNA, 20 nt, Mycobacterium bovis subsp bovis AF2122/97
ccaccuggugcaaccgugcc

SEQ ID NO: 3137457 - RNA, 21 nt, Mycobacterium bovis subsp bovis AF2122/97
ccaccuggugcaaccgugccg

SEQ ID NO: 3137458 - RNA, 22 nt, Mycobacterium bovis subsp bovis AF2122/97
ccaccuggugcaaccgugccgc

SEQ ID NO: 3137459 - RNA, 20 nt, Mycobacterium bovis subsp bovis AF2122/97
ccaccuguugcccuugcgca

SEQ ID NO: 3137460 - RNA, 21 nt, Mycobacterium bovis subsp bovis AF2122/97
ccaccuguuggcaugccgccc

SEQ ID NO: 3137461 - RNA, 22 nt, Mycobacterium bovis subsp bovis AF2122/97
ccaccuguuggcaugccgcccg

SEQ ID NO: 3137462 - RNA, 23 nt, Mycobacterium bovis subsp bovis AF2122/97
ccaccuuagcgcuugccgcugag

SEQ ID NO: 3137463 - RNA, 18 nt, Mycobacterium bovis subsp bovis AF2122/97
ccaccuucaucaacgaca

SEQ ID NO: 3137464 - RNA, 20 nt, Mycobacterium bovis subsp bovis AF2122/97
ccaccuucugacgcggccgg

SEQ ID NO: 3137465 - RNA, 22 nt, Mycobacterium bovis subsp bovis AF2122/97
ccaccuucugacgcggccgggc

SEQ ID NO: 3137466 - RNA, 18 nt, Mycobacterium bovis subsp bovis AF2122/97
ccaccuucugguccagca

SEQ ID NO: 3137467 - RNA, 20 nt, Mycobacterium bovis subsp bovis AF2122/97
ccaccuuggaugcccugccc

SEQ ID NO: 3137468 - RNA, 21 nt, Mycobacterium bovis subsp bovis AF2122/97
ccaccuuggcguugaccagca

SEQ ID NO: 3137469 - RNA, 23 nt, Mycobacterium bovis subsp bovis AF2122/97
ccaccuuggcguugaccagcacg

SEQ ID NO: 3137470 - RNA, 21 nt, Mycobacterium bovis subsp bovis AF2122/97
ccaccuuggcugggcccgccg

SEQ ID NO: 3137471 - RNA, 23 nt, Mycobacterium bovis subsp bovis AF2122/97
ccacgaacccucagccgcgccgg

SEQ ID NO: 3137472 - RNA, 23 nt, Mycobacterium bovis subsp bovis AF2122/97
ccacgaacgcgcgcagccgggca

SEQ ID NO: 3137473 - RNA, 22 nt, Mycobacterium bovis subsp bovis AF2122/97
ccacgacacuaggggcggggcu

SEQ ID NO: 3137474 - RNA, 23 nt, Mycobacterium bovis subsp bovis AF2122/97
ccacgacaggucgcccggucucg

SEQ ID NO: 3137475 - RNA, 18 nt, Mycobacterium bovis subsp bovis AF2122/97
ccacgacccagcauggug

SEQ ID NO: 3137476 - RNA, 16 nt, Mycobacterium bovis subsp bovis AF2122/97
ccacgaccccggcggu

SEQ ID NO: 3137477 - RNA, 18 nt, Mycobacterium bovis subsp bovis AF2122/97
ccacgaccccggcgguac

SEQ ID NO: 3137478 - RNA, 12 nt, Mycobacterium bovis subsp bovis AF2122/97
ccacgaccgcga

SEQ ID NO: 3137479 - RNA, 20 nt, Mycobacterium bovis subsp bovis AF2122/97
ccacgaccgucucgguggug

SEQ ID NO: 3137480 - RNA, 21 nt, Mycobacterium bovis subsp bovis AF2122/97
ccacgaccgucucggugguga

SEQ ID NO: 3137481 - RNA, 16 nt, Mycobacterium bovis subsp bovis AF2122/97
ccacgaccucgggauc

SEQ ID NO: 3137482 - RNA, 19 nt, Mycobacterium bovis subsp bovis AF2122/97
ccacgacgaacaccagcgc

SEQ ID NO: 3137483 - RNA, 20 nt, Mycobacterium bovis subsp bovis AF2122/97
ccacgacgaacaccagcgcg

SEQ ID NO: 3137484 - RNA, 15 nt, Mycobacterium bovis subsp bovis AF2122/97
ccacgacgucgguga

SEQ ID NO: 3137485 - RNA, 20 nt, Mycobacterium bovis subsp bovis AF2122/97
ccacgacgucgucguccucg

SEQ ID NO: 3137486 - RNA, 21 nt, Mycobacterium bovis subsp bovis AF2122/97
ccacgacguucgacgacagca

SEQ ID NO: 3137487 - RNA, 17 nt, Mycobacterium bovis subsp bovis AF2122/97
ccacgagcaacgggcga

SEQ ID NO: 3137488 - RNA, 13 nt, Mycobacterium bovis subsp bovis AF2122/97
ccacgagcagccg

SEQ ID NO: 3137489 - RNA, 14 nt, Mycobacterium bovis subsp bovis AF2122/97
ccacgagcagccga

SEQ ID NO: 3137490 - RNA, 15 nt, Mycobacterium bovis subsp bovis AF2122/97
ccacgagcaucaacg

SEQ ID NO: 3137491 - RNA, 18 nt, Mycobacterium bovis subsp bovis AF2122/97
ccacgagcguagcgaccu

SEQ ID NO: 3137492 - RNA, 20 nt, Mycobacterium bovis subsp bovis AF2122/97
ccacgagcguagcgaccucg

SEQ ID NO: 3137493 - RNA, 18 nt, Mycobacterium bovis subsp bovis AF2122/97
ccacgaggcaucguccac

SEQ ID NO: 3137494 - RNA, 22 nt, Mycobacterium bovis subsp bovis AF2122/97
ccacgaggcaucguccacgcag

SEQ ID NO: 3137495 - RNA, 17 nt, Mycobacterium bovis subsp bovis AF2122/97
ccacgaggcuugcggca

SEQ ID NO: 3137496 - RNA, 15 nt, Mycobacterium bovis subsp bovis AF2122/97
ccacgagucgcacgu

SEQ ID NO: 3137497 - RNA, 20 nt, Mycobacterium bovis subsp bovis AF2122/97
ccacgagucgcacgugggca

SEQ ID NO: 3137498 - RNA, 14 nt, Mycobacterium bovis subsp bovis AF2122/97
ccacgaguuggcca

SEQ ID NO: 3137499 - RNA, 24 nt, Mycobacterium bovis subsp bovis AF2122/97
ccacgauaaaugcuucgaccgccg

SEQ ID NO: 3137500 - RNA, 16 nt, Mycobacterium bovis subsp bovis AF2122/97
ccacgauaaggucaca

SEQ ID NO: 3137501 - RNA, 20 nt, Mycobacterium bovis subsp bovis AF2122/97
ccacgauaucgaugcggcga

SEQ ID NO: 3137502 - RNA, 16 nt, Mycobacterium bovis subsp bovis AF2122/97
ccacgaucacccggau

SEQ ID NO: 3137503 - RNA, 19 nt, Mycobacterium bovis subsp bovis AF2122/97
ccacgaucagcagcgucgg

SEQ ID NO: 3137504 - RNA, 16 nt, Mycobacterium bovis subsp bovis AF2122/97
ccacgauccgcgguag

SEQ ID NO: 3137505 - RNA, 13 nt, Mycobacterium bovis subsp bovis AF2122/97
ccacgaucggccc

SEQ ID NO: 3137506 - RNA, 20 nt, Mycobacterium bovis subsp bovis AF2122/97
ccacgaucggcccagcccuu

SEQ ID NO: 3137507 - RNA, 23 nt, Mycobacterium bovis subsp bovis AF2122/97
ccacgaugaucagggucagcgcc

SEQ ID NO: 3137508 - RNA, 19 nt, Mycobacterium bovis subsp bovis AF2122/97
ccacgaugaucuugccgcg

SEQ ID NO: 3137509 - RNA, 13 nt, Mycobacterium bovis subsp bovis AF2122/97
ccacgauggcggc

SEQ ID NO: 3137510 - RNA, 15 nt, Mycobacterium bovis subsp bovis AF2122/97
ccacgauggcggcca

SEQ ID NO: 3137511 - RNA, 14 nt, Mycobacterium bovis subsp bovis AF2122/97
ccacgaugucgucg

SEQ ID NO: 3137512 - RNA, 17 nt, Mycobacterium bovis subsp bovis AF2122/97
ccacgauuugguagcgg

SEQ ID NO: 3137513 - RNA, 21 nt, Mycobacterium bovis subsp bovis AF2122/97
ccacgauuugguagcggaucg

SEQ ID NO: 3137514 - RNA, 13 nt, Mycobacterium bovis subsp bovis AF2122/97
ccacgcaccgccc

SEQ ID NO: 3137515 - RNA, 13 nt, Mycobacterium bovis subsp bovis AF2122/97
ccacgcaccgggu

SEQ ID NO: 3137516 - RNA, 20 nt, Mycobacterium bovis subsp bovis AF2122/97
ccacgcaccgggugcaggug

SEQ ID NO: 3137517 - RNA, 15 nt, Mycobacterium bovis subsp bovis AF2122/97
ccacgcacucacuac

SEQ ID NO: 3137518 - RNA, 19 nt, Mycobacterium bovis subsp bovis AF2122/97
ccacgcagaggcggcuggc

SEQ ID NO: 3137519 - RNA, 20 nt, Mycobacterium bovis subsp bovis AF2122/97
ccacgcagaggcggcuggcg

SEQ ID NO: 3137520 - RNA, 13 nt, Mycobacterium bovis subsp bovis AF2122/97
ccacgcagcacgg

SEQ ID NO: 3137521 - RNA, 16 nt, Mycobacterium bovis subsp bovis AF2122/97
ccacgcagcacggcac

SEQ ID NO: 3137522 - RNA, 18 nt, Mycobacterium bovis subsp bovis AF2122/97
ccacgcaugcgcgcgccg

SEQ ID NO: 3137523 - RNA, 14 nt, Mycobacterium bovis subsp bovis AF2122/97
ccacgcaugggcca

SEQ ID NO: 3137524 - RNA, 11 nt, Mycobacterium bovis subsp bovis AF2122/97
ccacgccaccg

SEQ ID NO: 3137525 - RNA, 12 nt, Mycobacterium bovis subsp bovis AF2122/97
ccacgccaccgc

SEQ ID NO: 3137526 - RNA, 15 nt, Mycobacterium bovis subsp bovis AF2122/97
ccacgccaccgcggu

SEQ ID NO: 3137527 - RNA, 17 nt, Mycobacterium bovis subsp bovis AF2122/97
ccacgccaccgcgguca

SEQ ID NO: 3137528 - RNA, 15 nt, Mycobacterium bovis subsp bovis AF2122/97
ccacgccacguccaa

SEQ ID NO: 3137529 - RNA, 14 nt, Mycobacterium bovis subsp bovis AF2122/97
ccacgccagagcgg

SEQ ID NO: 3137530 - RNA, 14 nt, Mycobacterium bovis subsp bovis AF2122/97
ccacgccagcccgu

SEQ ID NO: 3137531 - RNA, 14 nt, Mycobacterium bovis subsp bovis AF2122/97
ccacgccagcgcga

SEQ ID NO: 3137532 - RNA, 21 nt, Mycobacterium bovis subsp bovis AF2122/97
ccacgcccaauguccaggcgc

SEQ ID NO: 3137533 - RNA, 17 nt, Mycobacterium bovis subsp bovis AF2122/97
ccacgcccacaggggca

SEQ ID NO: 3137534 - RNA, 15 nt, Mycobacterium bovis subsp bovis AF2122/97
ccacgcccagcgccc

SEQ ID NO: 3137535 - RNA, 19 nt, Mycobacterium bovis subsp bovis AF2122/97
ccacggcggccaccugcug

SEQ ID NO: 3137536 - RNA, 19 nt, Mycobacterium bovis subsp bovis AF2122/97
ccacggcgggaacggugcc

SEQ ID NO: 3137537 - RNA, 13 nt, Mycobacterium bovis subsp bovis AF2122/97
ccacggcgggcga

SEQ ID NO: 3137538 - RNA, 17 nt, Mycobacterium bovis subsp bovis AF2122/97
ccacggcgggcgacccg

SEQ ID NO: 3137539 - RNA, 19 nt, Mycobacterium bovis subsp bovis AF2122/97
ccacggcggugccgugcuc

SEQ ID NO: 3137540 - RNA, 15 nt, Mycobacterium bovis subsp bovis AF2122/97
ccacggcgucggcca

SEQ ID NO: 3137541 - RNA, 16 nt, Mycobacterium bovis subsp bovis AF2122/97
ccacggcgucggccac

SEQ ID NO: 3137542 - RNA, 19 nt, Mycobacterium bovis subsp bovis AF2122/97
ccacggcgucggccacccg

SEQ ID NO: 3137543 - RNA, 20 nt, Mycobacterium bovis subsp bovis AF2122/97
ccacggcgucggccacccgg

SEQ ID NO: 3137544 - RNA, 22 nt, Mycobacterium bovis subsp bovis AF2122/97
ccacggcgucggccacccgguc

SEQ ID NO: 3137545 - RNA, 22 nt, Mycobacterium bovis subsp bovis AF2122/97
ccacggcgugaaaaacgcccgc

SEQ ID NO: 3137546 - RNA, 16 nt, Mycobacterium bovis subsp bovis AF2122/97
ccacggcguggucggc

SEQ ID NO: 3137547 - RNA, 18 nt, Mycobacterium bovis subsp bovis AF2122/97
ccacggcguuacguggug

SEQ ID NO: 3137548 - RNA, 15 nt, Mycobacterium bovis subsp bovis AF2122/97
ccacggcguugccgc

SEQ ID NO: 3137549 - RNA, 19 nt, Mycobacterium bovis subsp bovis AF2122/97
ccacggcguugccgccggc

SEQ ID NO: 3137550 - RNA, 23 nt, Mycobacterium bovis subsp bovis AF2122/97
ccacggcguugccgccggcucca

SEQ ID NO: 3137551 - RNA, 21 nt, Mycobacterium bovis subsp bovis AF2122/97
ccacggcugcccaugguggcg

SEQ ID NO: 3137552 - RNA, 12 nt, Mycobacterium bovis subsp bovis AF2122/97
ccacggcugugg

SEQ ID NO: 3137553 - RNA, 16 nt, Mycobacterium bovis subsp bovis AF2122/97
ccacggcuguggccgc

SEQ ID NO: 3137554 - RNA, 17 nt, Mycobacterium bovis subsp bovis AF2122/97
ccacggcuuugcggcgc

SEQ ID NO: 3137555 - RNA, 18 nt, Mycobacterium bovis subsp bovis AF2122/97
ccacggcuuugcggcgcg

SEQ ID NO: 3137556 - RNA, 14 nt, Mycobacterium bovis subsp bovis AF2122/97
ccacgggccggccg

SEQ ID NO: 3137557 - RNA, 13 nt, Mycobacterium bovis subsp bovis AF2122/97
ccacgggcggcca

SEQ ID NO: 3137558 - RNA, 19 nt, Mycobacterium bovis subsp bovis AF2122/97
ccacgggcggccaccgcac

SEQ ID NO: 3137559 - RNA, 20 nt, Mycobacterium bovis subsp bovis AF2122/97
ccacgggcggccaccgcacg

SEQ ID NO: 3137560 - RNA, 21 nt, Mycobacterium bovis subsp bovis AF2122/97
ccacggggauuggcgacgucg

SEQ ID NO: 3137561 - RNA, 14 nt, Mycobacterium bovis subsp bovis AF2122/97
ccacggggcugccg

SEQ ID NO: 3137562 - RNA, 16 nt, Mycobacterium bovis subsp bovis AF2122/97
ccacggucaagccggc

SEQ ID NO: 3137563 - RNA, 19 nt, Mycobacterium bovis subsp bovis AF2122/97
ccacggucaagccggcgcc

SEQ ID NO: 3137564 - RNA, 13 nt, Mycobacterium bovis subsp bovis AF2122/97
ccacggucagcca

SEQ ID NO: 3137565 - RNA, 15 nt, Mycobacterium bovis subsp bovis AF2122/97
ccacggucagccagg

SEQ ID NO: 3137566 - RNA, 16 nt, Mycobacterium bovis subsp bovis AF2122/97
ccacggucauugggug

SEQ ID NO: 3137567 - RNA, 17 nt, Mycobacterium bovis subsp bovis AF2122/97
ccacggucauugggugu

SEQ ID NO: 3137568 - RNA, 21 nt, Mycobacterium bovis subsp bovis AF2122/97
ccacggucauugggugucaau

SEQ ID NO: 3137569 - RNA, 18 nt, Mycobacterium bovis subsp bovis AF2122/97
ccacgguccggcccacca

SEQ ID NO: 3137570 - RNA, 16 nt, Mycobacterium bovis subsp bovis AF2122/97
ccacggucgaccagga

SEQ ID NO: 3137571 - RNA, 21 nt, Mycobacterium bovis subsp bovis AF2122/97
ccacggucgccgaccacucga

SEQ ID NO: 3137572 - RNA, 15 nt, Mycobacterium bovis subsp bovis AF2122/97
ccacggucugccacg

SEQ ID NO: 3137573 - RNA, 14 nt, Mycobacterium bovis subsp bovis AF2122/97
ccacggugcgguga

SEQ ID NO: 3137574 - RNA, 15 nt, Mycobacterium bovis subsp bovis AF2122/97
ccacgguggagcgcg

SEQ ID NO: 3137575 - RNA, 18 nt, Mycobacterium bovis subsp bovis AF2122/97
ccacgguggagcgcgccu

SEQ ID NO: 3137576 - RNA, 13 nt, Mycobacterium bovis subsp bovis AF2122/97
ccacgguggccgc

SEQ ID NO: 3137577 - RNA, 12 nt, Mycobacterium bovis subsp bovis AF2122/97
ccacgguggcgc

SEQ ID NO: 3137578 - RNA, 22 nt, Mycobacterium bovis subsp bovis AF2122/97
ccacgguggucccccgcagcca

SEQ ID NO: 3137579 - RNA, 24 nt, Mycobacterium bovis subsp bovis AF2122/97
ccacgguguaccagguggaccggc

SEQ ID NO: 3137580 - RNA, 20 nt, Mycobacterium bovis subsp bovis AF2122/97
ccacggugucccgcgaggca

SEQ ID NO: 3137581 - RNA, 16 nt, Mycobacterium bovis subsp bovis AF2122/97
ccacgguucgggcagc

SEQ ID NO: 3137582 - RNA, 20 nt, Mycobacterium bovis subsp bovis AF2122/97
ccacgguucgggcagcaccc

SEQ ID NO: 3137583 - RNA, 16 nt, Mycobacterium bovis subsp bovis AF2122/97
ccacgguugccggcgg

SEQ ID NO: 3137584 - RNA, 21 nt, Mycobacterium bovis subsp bovis AF2122/97
ccacgguugccggcggcgacg

SEQ ID NO: 3137585 - RNA, 22 nt, Mycobacterium bovis subsp bovis AF2122/97
ccacgguuggccaccagcuggc

SEQ ID NO: 3137586 - RNA, 18 nt, Mycobacterium bovis subsp bovis AF2122/97
ccacguaagcgguugucc

SEQ ID NO: 3137587 - RNA, 18 nt, Mycobacterium bovis subsp bovis AF2122/97
ccacguacuccaccgcgc

SEQ ID NO: 3137588 - RNA, 20 nt, Mycobacterium bovis subsp bovis AF2122/97
ccacguacuccaccgcgccg

SEQ ID NO: 3137589 - RNA, 21 nt, Mycobacterium bovis subsp bovis AF2122/97
ccacguacuccaccgcgccgu

SEQ ID NO: 3137590 - RNA, 22 nt, Mycobacterium bovis subsp bovis AF2122/97
ccacguacuccaccgcgccguc

SEQ ID NO: 3137591 - RNA, 16 nt, Mycobacterium bovis subsp bovis AF2122/97
ccacguagcagcgccg

SEQ ID NO: 3137592 - RNA, 19 nt, Mycobacterium bovis subsp bovis AF2122/97
ccacguagcagcgccggca

SEQ ID NO: 3137593 - RNA, 20 nt, Mycobacterium bovis subsp bovis AF2122/97
ccacguagcagcgccggcac

SEQ ID NO: 3137594 - RNA, 17 nt, Mycobacterium bovis subsp bovis AF2122/97
ccacgucaucuggcgcu

SEQ ID NO: 3137595 - RNA, 22 nt, Mycobacterium bovis subsp bovis AF2122/97
ccacgucaucuggcgcugcugg

SEQ ID NO: 3137596 - RNA, 16 nt, Mycobacterium bovis subsp bovis AF2122/97
ccacguccaacucggc

SEQ ID NO: 3137597 - RNA, 19 nt, Mycobacterium bovis subsp bovis AF2122/97
ccacguccaacucggcccg

SEQ ID NO: 3137598 - RNA, 20 nt, Mycobacterium bovis subsp bovis AF2122/97
ccacguccaacucggcccgg

SEQ ID NO: 3137599 - RNA, 22 nt, Mycobacterium bovis subsp bovis AF2122/97
ccacguccaacucggcccgggu

SEQ ID NO: 3137600 - RNA, 21 nt, Mycobacterium bovis subsp bovis AF2122/97
ccacguccaucaccggcggcc

SEQ ID NO: 3137601 - RNA, 18 nt, Mycobacterium bovis subsp bovis AF2122/97
ccacgucccagagaauca

SEQ ID NO: 3137602 - RNA, 23 nt, Mycobacterium bovis subsp bovis AF2122/97
ccacgucccaggacuccggccgc

SEQ ID NO: 3137603 - RNA, 21 nt, Mycobacterium bovis subsp bovis AF2122/97
ccacguccgcaaccucgccgu

SEQ ID NO: 3137604 - RNA, 14 nt, Mycobacterium bovis subsp bovis AF2122/97
ccacguccucagcc

SEQ ID NO: 3137605 - RNA, 21 nt, Mycobacterium bovis subsp bovis AF2122/97
ccacguccucagccgugccca

SEQ ID NO: 3137606 - RNA, 13 nt, Mycobacterium bovis subsp bovis AF2122/97
ccacguccugccc

SEQ ID NO: 3137607 - RNA, 17 nt, Mycobacterium bovis subsp bovis AF2122/97
ccacguccugcccgucg

SEQ ID NO: 3137608 - RNA, 21 nt, Mycobacterium bovis subsp bovis AF2122/97
ccacgucgaccgaacccgacg

SEQ ID NO: 3137609 - RNA, 14 nt, Mycobacterium bovis subsp bovis AF2122/97
ccacgucgagcagg

SEQ ID NO: 3137610 - RNA, 20 nt, Mycobacterium bovis subsp bovis AF2122/97
ccacgucgagguccaccacc

SEQ ID NO: 3137611 - RNA, 22 nt, Mycobacterium bovis subsp bovis AF2122/97
ccacgucgagguccaccacccu

SEQ ID NO: 3137612 - RNA, 22 nt, Mycobacterium bovis subsp bovis AF2122/97
ccacgucgaucagugcaagacc

SEQ ID NO: 3137613 - RNA, 23 nt, Mycobacterium bovis subsp bovis AF2122/97
ccacgucgaucagugcaagaccg

SEQ ID NO: 3137614 - RNA, 18 nt, Mycobacterium bovis subsp bovis AF2122/97
ccacgucgaugugcgccc

SEQ ID NO: 3137615 - RNA, 13 nt, Mycobacterium bovis subsp bovis AF2122/97
ccacgucgcccag

SEQ ID NO: 3137616 - RNA, 13 nt, Mycobacterium bovis subsp bovis AF2122/97
ccacgucgcggcg

SEQ ID NO: 3137617 - RNA, 20 nt, Mycobacterium bovis subsp bovis AF2122/97
ccacgucgcggcguuguugc

SEQ ID NO: 3137618 - RNA, 23 nt, Mycobacterium bovis subsp bovis AF2122/97
ccacgucggacagcuuuccgcga

SEQ ID NO: 3137619 - RNA, 15 nt, Mycobacterium bovis subsp bovis AF2122/97
ccacgucgucgccca

SEQ ID NO: 3137620 - RNA, 15 nt, Mycobacterium bovis subsp bovis AF2122/97
ccacgucuccugugg

SEQ ID NO: 3137621 - RNA, 20 nt, Mycobacterium bovis subsp bovis AF2122/97
ccagaaccuggagccgugcg

SEQ ID NO: 3137622 - RNA, 14 nt, Mycobacterium bovis subsp bovis AF2122/97
ccagaacggcgauc

SEQ ID NO: 3137623 - RNA, 19 nt, Mycobacterium bovis subsp bovis AF2122/97
ccagaacgguggcgcggug

SEQ ID NO: 3137624 - RNA, 22 nt, Mycobacterium bovis subsp bovis AF2122/97
ccagaacgguggcgcggugccg

SEQ ID NO: 3137625 - RNA, 15 nt, Mycobacterium bovis subsp bovis AF2122/97
ccagaagccggccac

SEQ ID NO: 3137626 - RNA, 17 nt, Mycobacterium bovis subsp bovis AF2122/97
ccagaaggccgcaccgc

SEQ ID NO: 3137627 - RNA, 19 nt, Mycobacterium bovis subsp bovis AF2122/97
ccagaaggccgcaccgcca

SEQ ID NO: 3137628 - RNA, 20 nt, Mycobacterium bovis subsp bovis AF2122/97
ccagaaggccgcaccgccac

SEQ ID NO: 3137629 - RNA, 22 nt, Mycobacterium bovis subsp bovis AF2122/97
ccagaaggccgcaccgccaccc

SEQ ID NO: 3137630 - RNA, 20 nt, Mycobacterium bovis subsp bovis AF2122/97
ccagaaggccggggcggaac

SEQ ID NO: 3137631 - RNA, 20 nt, Mycobacterium bovis subsp bovis AF2122/97
ccagaaguaggcgaccgcca

SEQ ID NO: 3137632 - RNA, 18 nt, Mycobacterium bovis subsp bovis AF2122/97
ccagaagucgucauauuc

SEQ ID NO: 3137633 - RNA, 15 nt, Mycobacterium bovis subsp bovis AF2122/97
ccagaauccaggugg

SEQ ID NO: 3137634 - RNA, 13 nt, Mycobacterium bovis subsp bovis AF2122/97
ccagaaucgggcc

SEQ ID NO: 3137635 - RNA, 21 nt, Mycobacterium bovis subsp bovis AF2122/97
ccagaaucucgccgggcugca

SEQ ID NO: 3137636 - RNA, 12 nt, Mycobacterium bovis subsp bovis AF2122/97
ccagaaugucgc

SEQ ID NO: 3137637 - RNA, 18 nt, Mycobacterium bovis subsp bovis AF2122/97
ccagaauuccggcggagc

SEQ ID NO: 3137638 - RNA, 16 nt, Mycobacterium bovis subsp bovis AF2122/97
ccagacaauccgccgc

SEQ ID NO: 3137639 - RNA, 22 nt, Mycobacterium bovis subsp bovis AF2122/97
ccagacacuggccgucggcgug

SEQ ID NO: 3137640 - RNA, 20 nt, Mycobacterium bovis subsp bovis AF2122/97
ccagacaucagugcgccggc

SEQ ID NO: 3137641 - RNA, 12 nt, Mycobacterium bovis subsp bovis AF2122/97
ccagacauccag

SEQ ID NO: 3137642 - RNA, 14 nt, Mycobacterium bovis subsp bovis AF2122/97
ccagacccaccacc

SEQ ID NO: 3137643 - RNA, 16 nt, Mycobacterium bovis subsp bovis AF2122/97
ccagacccaccaccgc

SEQ ID NO: 3137644 - RNA, 14 nt, Mycobacterium bovis subsp bovis AF2122/97
ccagacccagcucg

SEQ ID NO: 3137645 - RNA, 15 nt, Mycobacterium bovis subsp bovis AF2122/97
ccagacccgaaucca

SEQ ID NO: 3137646 - RNA, 20 nt, Mycobacterium bovis subsp bovis AF2122/97
ccagacccgaauccaccagc

SEQ ID NO: 3137647 - RNA, 17 nt, Mycobacterium bovis subsp bovis AF2122/97
ccagaccgccgacgccg

SEQ ID NO: 3137648 - RNA, 19 nt, Mycobacterium bovis subsp bovis AF2122/97
ccagaccgccgacgccguu

SEQ ID NO: 3137649 - RNA, 12 nt, Mycobacterium bovis subsp bovis AF2122/97
ccagaccgcgcg

SEQ ID NO: 3137650 - RNA, 17 nt, Mycobacterium bovis subsp bovis AF2122/97
ccagaccgcgcgcauac

SEQ ID NO: 3137651 - RNA, 12 nt, Mycobacterium bovis subsp bovis AF2122/97
ccagaccggcgg

SEQ ID NO: 3137652 - RNA, 14 nt, Mycobacterium bovis subsp bovis AF2122/97
ccagaccggcucgu

SEQ ID NO: 3137653 - RNA, 19 nt, Mycobacterium bovis subsp bovis AF2122/97
ccagacgauggccagguug

SEQ ID NO: 3137654 - RNA, 19 nt, Mycobacterium bovis subsp bovis AF2122/97
ccagacgccacugccagcc

SEQ ID NO: 3137655 - RNA, 16 nt, Mycobacterium bovis subsp bovis AF2122/97
ccagacgcucuugaau

SEQ ID NO: 3137656 - RNA, 17 nt, Mycobacterium bovis subsp bovis AF2122/97
ccagacggugcagcucc

SEQ ID NO: 3137657 - RNA, 20 nt, Mycobacterium bovis subsp bovis AF2122/97
ccagacucgcggucgacagc

SEQ ID NO: 3137658 - RNA, 19 nt, Mycobacterium bovis subsp bovis AF2122/97
ccagagaaaucgguggugc

SEQ ID NO: 3137659 - RNA, 21 nt, Mycobacterium bovis subsp bovis AF2122/97
ccagagacaugucgcugccgc

SEQ ID NO: 3137660 - RNA, 16 nt, Mycobacterium bovis subsp bovis AF2122/97
ccagagaucagcaccc

SEQ ID NO: 3137661 - RNA, 17 nt, Mycobacterium bovis subsp bovis AF2122/97
ccagagcacgggcucgc

SEQ ID NO: 3137662 - RNA, 13 nt, Mycobacterium bovis subsp bovis AF2122/97
ccagagcaucagg

SEQ ID NO: 3137663 - RNA, 11 nt, Mycobacterium bovis subsp bovis AF2122/97
ccagagccgcg

SEQ ID NO: 3137664 - RNA, 15 nt, Mycobacterium bovis subsp bovis AF2122/97
ccagagccgcgagca

SEQ ID NO: 3137665 - RNA, 13 nt, Mycobacterium bovis subsp bovis AF2122/97
ccagagccgcgcg

SEQ ID NO: 3137666 - RNA, 15 nt, Mycobacterium bovis subsp bovis AF2122/97
ccagagccgcugcgg

SEQ ID NO: 3137667 - RNA, 20 nt, Mycobacterium bovis subsp bovis AF2122/97
ccagagcgaacccccgccgc

SEQ ID NO: 3137668 - RNA, 23 nt, Mycobacterium bovis subsp bovis AF2122/97
ccagagcgaacccccgccgcgca

SEQ ID NO: 3137669 - RNA, 12 nt, Mycobacterium bovis subsp bovis AF2122/97
ccagaggcccga

SEQ ID NO: 3137670 - RNA, 15 nt, Mycobacterium bovis subsp bovis AF2122/97
ccagaggcccgcggu

SEQ ID NO: 3137671 - RNA, 21 nt, Mycobacterium bovis subsp bovis AF2122/97
ccagaggccggcgggcucgcc

SEQ ID NO: 3137672 - RNA, 18 nt, Mycobacterium bovis subsp bovis AF2122/97
ccagaggcgcuucgccac

SEQ ID NO: 3137673 - RNA, 21 nt, Mycobacterium bovis subsp bovis AF2122/97
ccagaggcgcuucgccacacc

SEQ ID NO: 3137674 - RNA, 13 nt, Mycobacterium bovis subsp bovis AF2122/97
ccagaggucacgc

SEQ ID NO: 3137675 - RNA, 15 nt, Mycobacterium bovis subsp bovis AF2122/97
ccagaggucgagcgc

SEQ ID NO: 3137676 - RNA, 14 nt, Mycobacterium bovis subsp bovis AF2122/97
ccagagucgcccgc

SEQ ID NO: 3137677 - RNA, 15 nt, Mycobacterium bovis subsp bovis AF2122/97
ccagagucgcccgca

SEQ ID NO: 3137678 - RNA, 13 nt, Mycobacterium bovis subsp bovis AF2122/97
ccagagucggaga

SEQ ID NO: 3137679 - RNA, 16 nt, Mycobacterium bovis subsp bovis AF2122/97
ccagaguucccgaaac

SEQ ID NO: 3137680 - RNA, 16 nt, Mycobacterium bovis subsp bovis AF2122/97
ccagaguucggccagc

SEQ ID NO: 3137681 - RNA, 15 nt, Mycobacterium bovis subsp bovis AF2122/97
ccagauaauccuggu

SEQ ID NO: 3137682 - RNA, 23 nt, Mycobacterium bovis subsp bovis AF2122/97
ccagauacaucgggaucugggcu

SEQ ID NO: 3137683 - RNA, 14 nt, Mycobacterium bovis subsp bovis AF2122/97
ccagauaccaccgc

SEQ ID NO: 3137684 - RNA, 16 nt, Mycobacterium bovis subsp bovis AF2122/97
ccagauaccaccgccg

SEQ ID NO: 3137685 - RNA, 13 nt, Mycobacterium bovis subsp bovis AF2122/97
ccagauacccgcg

SEQ ID NO: 3137686 - RNA, 14 nt, Mycobacterium bovis subsp bovis AF2122/97
ccagauacgucguc

SEQ ID NO: 3137687 - RNA, 16 nt, Mycobacterium bovis subsp bovis AF2122/97
ccagauaggcaccaag

SEQ ID NO: 3137688 - RNA, 14 nt, Mycobacterium bovis subsp bovis AF2122/97
ccagauaucgaagc

SEQ ID NO: 3137689 - RNA, 15 nt, Mycobacterium bovis subsp bovis AF2122/97
ccagaucaccgucga

SEQ ID NO: 3137690 - RNA, 13 nt, Mycobacterium bovis subsp bovis AF2122/97
ccagaucagcacc

SEQ ID NO: 3137691 - RNA, 15 nt, Mycobacterium bovis subsp bovis AF2122/97
ccagauccgcagcgu

SEQ ID NO: 3137692 - RNA, 14 nt, Mycobacterium bovis subsp bovis AF2122/97
ccagauccgucagc

SEQ ID NO: 3137693 - RNA, 22 nt, Mycobacterium bovis subsp bovis AF2122/97
ccagauccgucagcuuggaccc

SEQ ID NO: 3137694 - RNA, 18 nt, Mycobacterium bovis subsp bovis AF2122/97
ccagaucgaacgcagcca

SEQ ID NO: 3137695 - RNA, 15 nt, Mycobacterium bovis subsp bovis AF2122/97
ccagaucgacgccaa

SEQ ID NO: 3137696 - RNA, 23 nt, Mycobacterium bovis subsp bovis AF2122/97
ccagaucgcacaccaacaccgcg

SEQ ID NO: 3137697 - RNA, 20 nt, Mycobacterium bovis subsp bovis AF2122/97
ccagaucgcgguccgagcgg

SEQ ID NO: 3137698 - RNA, 21 nt, Mycobacterium bovis subsp bovis AF2122/97
ccagaucgcgguccgagcggc

SEQ ID NO: 3137699 - RNA, 13 nt, Mycobacterium bovis subsp bovis AF2122/97
ccagaucggcgac

SEQ ID NO: 3137700 - RNA, 19 nt, Mycobacterium bovis subsp bovis AF2122/97
ccagaucggcguuggcaug

SEQ ID NO: 3137701 - RNA, 17 nt, Mycobacterium bovis subsp bovis AF2122/97
ccagaucggucggccaa

SEQ ID NO: 3137702 - RNA, 21 nt, Mycobacterium bovis subsp bovis AF2122/97
ccagaucgguugaucggccac

SEQ ID NO: 3137703 - RNA, 22 nt, Mycobacterium bovis subsp bovis AF2122/97
ccagaucgguugaucggccacg

SEQ ID NO: 3137704 - RNA, 18 nt, Mycobacterium bovis subsp bovis AF2122/97
ccagaucguuccaggccg

SEQ ID NO: 3137705 - RNA, 17 nt, Mycobacterium bovis subsp bovis AF2122/97
ccagaucuugcagugcg

SEQ ID NO: 3137706 - RNA, 18 nt, Mycobacterium bovis subsp bovis AF2122/97
ccagaucuugcagugcgc

SEQ ID NO: 3137707 - RNA, 13 nt, Mycobacterium bovis subsp bovis AF2122/97
ccagaugcagcgg

SEQ ID NO: 3137708 - RNA, 15 nt, Mycobacterium bovis subsp bovis AF2122/97
ccagcagcaccaacu

SEQ ID NO: 3137709 - RNA, 14 nt, Mycobacterium bovis subsp bovis AF2122/97
ccagcagcaccgac

SEQ ID NO: 3137710 - RNA, 15 nt, Mycobacterium bovis subsp bovis AF2122/97
ccagcagcagcgccg

SEQ ID NO: 3137711 - RNA, 20 nt, Mycobacterium bovis subsp bovis AF2122/97
ccagcagcagcgccgcgugg

SEQ ID NO: 3137712 - RNA, 14 nt, Mycobacterium bovis subsp bovis AF2122/97
ccagcagcaggcca

SEQ ID NO: 3137713 - RNA, 15 nt, Mycobacterium bovis subsp bovis AF2122/97
ccagcagcagugcca

SEQ ID NO: 3137714 - RNA, 23 nt, Mycobacterium bovis subsp bovis AF2122/97
ccagcagcagugccaccgguuug

SEQ ID NO: 3137715 - RNA, 23 nt, Mycobacterium bovis subsp bovis AF2122/97
ccagcagccacccgacaacgcug

SEQ ID NO: 3137716 - RNA, 16 nt, Mycobacterium bovis subsp bovis AF2122/97
ccagcagccagcccag

SEQ ID NO: 3137717 - RNA, 18 nt, Mycobacterium bovis subsp bovis AF2122/97
ccagcagccagcccagcc

SEQ ID NO: 3137718 - RNA, 22 nt, Mycobacterium bovis subsp bovis AF2122/97
ccagcagccagcccagccgcca

SEQ ID NO: 3137719 - RNA, 14 nt, Mycobacterium bovis subsp bovis AF2122/97
ccagcagccaggag

SEQ ID NO: 3137720 - RNA, 18 nt, Mycobacterium bovis subsp bovis AF2122/97
ccagcagccaggagccga

SEQ ID NO: 3137721 - RNA, 15 nt, Mycobacterium bovis subsp bovis AF2122/97
ccagcagccgcgacg

SEQ ID NO: 3137722 - RNA, 14 nt, Mycobacterium bovis subsp bovis AF2122/97
ccagcagccugcgc

SEQ ID NO: 3137723 - RNA, 17 nt, Mycobacterium bovis subsp bovis AF2122/97
ccagcagccugcgccgc

SEQ ID NO: 3137724 - RNA, 15 nt, Mycobacterium bovis subsp bovis AF2122/97
ccagcagcgaaaacc

SEQ ID NO: 3137725 - RNA, 18 nt, Mycobacterium bovis subsp bovis AF2122/97
ccagcagcgaaaaccguc

SEQ ID NO: 3137726 - RNA, 12 nt, Mycobacterium bovis subsp bovis AF2122/97
ccagcagcgacg

SEQ ID NO: 3137727 - RNA, 19 nt, Mycobacterium bovis subsp bovis AF2122/97
ccagcagcgacgcugccgc

SEQ ID NO: 3137728 - RNA, 10 nt, Mycobacterium bovis subsp bovis AF2122/97
ccagcagcgc

SEQ ID NO: 3137729 - RNA, 12 nt, Mycobacterium bovis subsp bovis AF2122/97
ccagcagcgcgg

SEQ ID NO: 3137730 - RNA, 18 nt, Mycobacterium bovis subsp bovis AF2122/97
ccagcagcgcgggaucug

SEQ ID NO: 3137731 - RNA, 14 nt, Mycobacterium bovis subsp bovis AF2122/97
ccagcagcggcgag

SEQ ID NO: 3137732 - RNA, 13 nt, Mycobacterium bovis subsp bovis AF2122/97
ccagcagcggcuc

SEQ ID NO: 3137733 - RNA, 14 nt, Mycobacterium bovis subsp bovis AF2122/97
ccagcagcucgccg

SEQ ID NO: 3137734 - RNA, 16 nt, Mycobacterium bovis subsp bovis AF2122/97
ccagcagcucgccggc

SEQ ID NO: 3137735 - RNA, 14 nt, Mycobacterium bovis subsp bovis AF2122/97
ccagcagcucggcc

SEQ ID NO: 3137736 - RNA, 16 nt, Mycobacterium bovis subsp bovis AF2122/97
ccagcagcucggccga

SEQ ID NO: 3137737 - RNA, 24 nt, Mycobacterium bovis subsp bovis AF2122/97
ccagcagcugaaaauaggccgggc

SEQ ID NO: 3137738 - RNA, 13 nt, Mycobacterium bovis subsp bovis AF2122/97
ccagcagcugcga

SEQ ID NO: 3137739 - RNA, 21 nt, Mycobacterium bovis subsp bovis AF2122/97
ccagcaggaacgccgugccgu

SEQ ID NO: 3137740 - RNA, 13 nt, Mycobacterium bovis subsp bovis AF2122/97
ccagcaggaagua

SEQ ID NO: 3137741 - RNA, 15 nt, Mycobacterium bovis subsp bovis AF2122/97
ccagcaggccacugc

SEQ ID NO: 3137742 - RNA, 22 nt, Mycobacterium bovis subsp bovis AF2122/97
ccagcaggcccuggccacccag

SEQ ID NO: 3137743 - RNA, 19 nt, Mycobacterium bovis subsp bovis AF2122/97
ccagcaggcccuuggcgau

SEQ ID NO: 3137744 - RNA, 16 nt, Mycobacterium bovis subsp bovis AF2122/97
ccagcaggccgaagaa

SEQ ID NO: 3137745 - RNA, 14 nt, Mycobacterium bovis subsp bovis AF2122/97
ccagcaggcggcug

SEQ ID NO: 3137746 - RNA, 16 nt, Mycobacterium bovis subsp bovis AF2122/97
ccagcagggccaccac

SEQ ID NO: 3137747 - RNA, 20 nt, Mycobacterium bovis subsp bovis AF2122/97
ccagcagggccaccaccacg

SEQ ID NO: 3137748 - RNA, 18 nt, Mycobacterium bovis subsp bovis AF2122/97
ccagcaggguuccccaua

SEQ ID NO: 3137749 - RNA, 20 nt, Mycobacterium bovis subsp bovis AF2122/97
ccagcagguaguuaccauau

SEQ ID NO: 3137750 - RNA, 21 nt, Mycobacterium bovis subsp bovis AF2122/97
ccagcagguauuugccgugcu

SEQ ID NO: 3137751 - RNA, 19 nt, Mycobacterium bovis subsp bovis AF2122/97
ccagcagguccgcggccgc

SEQ ID NO: 3137752 - RNA, 18 nt, Mycobacterium bovis subsp bovis AF2122/97
ccagcaggucgucggcgu

SEQ ID NO: 3137753 - RNA, 20 nt, Mycobacterium bovis subsp bovis AF2122/97
ccagcaggucgucggcgucg

SEQ ID NO: 3137754 - RNA, 16 nt, Mycobacterium bovis subsp bovis AF2122/97
ccagcaguacaccgcc

SEQ ID NO: 3137755 - RNA, 17 nt, Mycobacterium bovis subsp bovis AF2122/97
ccagcaguacaccgccc

SEQ ID NO: 3137756 - RNA, 18 nt, Mycobacterium bovis subsp bovis AF2122/97
ccagcaguacaccgcccg

SEQ ID NO: 3137757 - RNA, 13 nt, Mycobacterium bovis subsp bovis AF2122/97
ccagcaucagccc

SEQ ID NO: 3137758 - RNA, 16 nt, Mycobacterium bovis subsp bovis AF2122/97
ccagcaucagcgccag

SEQ ID NO: 3137759 - RNA, 22 nt, Mycobacterium bovis subsp bovis AF2122/97
ccagcaucagcgccagcgagca

SEQ ID NO: 3137760 - RNA, 20 nt, Mycobacterium bovis subsp bovis AF2122/97
ccagcaucgagcaguggccg

SEQ ID NO: 3137761 - RNA, 22 nt, Mycobacterium bovis subsp bovis AF2122/97
ccagcaucgagcaguggccgcc

SEQ ID NO: 3137762 - RNA, 15 nt, Mycobacterium bovis subsp bovis AF2122/97
ccagcaucggcagca

SEQ ID NO: 3137763 - RNA, 14 nt, Mycobacterium bovis subsp bovis AF2122/97
ccagcaucucggcc

SEQ ID NO: 3137764 - RNA, 16 nt, Mycobacterium bovis subsp bovis AF2122/97
ccagcaucucggcggc

SEQ ID NO: 3137765 - RNA, 16 nt, Mycobacterium bovis subsp bovis AF2122/97
ccagcaugaagucccg

SEQ ID NO: 3137766 - RNA, 17 nt, Mycobacterium bovis subsp bovis AF2122/97
ccagcaugacaccggcc

SEQ ID NO: 3137767 - RNA, 18 nt, Mycobacterium bovis subsp bovis AF2122/97
ccagcaugacaccggcca

SEQ ID NO: 3137768 - RNA, 19 nt, Mycobacterium bovis subsp bovis AF2122/97
ccagcaugacaccggccac

SEQ ID NO: 3137769 - RNA, 21 nt, Mycobacterium bovis subsp bovis AF2122/97
ccagcaugacaccggccacca

SEQ ID NO: 3137770 - RNA, 23 nt, Mycobacterium bovis subsp bovis AF2122/97
ccagcauggcggaacagcaauuu

SEQ ID NO: 3137771 - RNA, 23 nt, Mycobacterium bovis subsp bovis AF2122/97
ccagcauggcuuuugcgccgaau

SEQ ID NO: 3137772 - RNA, 17 nt, Mycobacterium bovis subsp bovis AF2122/97
ccagcaugucgggccgc

SEQ ID NO: 3137773 - RNA, 20 nt, Mycobacterium bovis subsp bovis AF2122/97
ccagcauucucgccgacggc

SEQ ID NO: 3137774 - RNA, 17 nt, Mycobacterium bovis subsp bovis AF2122/97
ccagcauugaagaagcc

SEQ ID NO: 3137775 - RNA, 17 nt, Mycobacterium bovis subsp bovis AF2122/97
ccagccaaaucagccag

SEQ ID NO: 3137776 - RNA, 19 nt, Mycobacterium bovis subsp bovis AF2122/97
ccagccaaaucagccaggc

SEQ ID NO: 3137777 - RNA, 20 nt, Mycobacterium bovis subsp bovis AF2122/97
ccagccaaaucagccaggcg

SEQ ID NO: 3137778 - RNA, 22 nt, Mycobacterium bovis subsp bovis AF2122/97
ccagccaaccguccggggccgc

SEQ ID NO: 3137779 - RNA, 16 nt, Mycobacterium bovis subsp bovis AF2122/97
ccagccaacucaggcc

SEQ ID NO: 3137780 - RNA, 17 nt, Mycobacterium bovis subsp bovis AF2122/97
ccagccaacucaggccg

SEQ ID NO: 3137781 - RNA, 14 nt, Mycobacterium bovis subsp bovis AF2122/97
ccagccacagcccg

SEQ ID NO: 3137782 - RNA, 15 nt, Mycobacterium bovis subsp bovis AF2122/97
ccagccacagcccgg

SEQ ID NO: 3137783 - RNA, 16 nt, Mycobacterium bovis subsp bovis AF2122/97
ccagccacagcccggc

SEQ ID NO: 3137784 - RNA, 15 nt, Mycobacterium bovis subsp bovis AF2122/97
ccagccacagccgac

SEQ ID NO: 3137785 - RNA, 19 nt, Mycobacterium bovis subsp bovis AF2122/97
ccagccacagccgaccucg

SEQ ID NO: 3137786 - RNA, 15 nt, Mycobacterium bovis subsp bovis AF2122/97
ccagccaccaccagg

SEQ ID NO: 3137787 - RNA, 18 nt, Mycobacterium bovis subsp bovis AF2122/97
ccagccaccaccaggucg

SEQ ID NO: 3137788 - RNA, 11 nt, Mycobacterium bovis subsp bovis AF2122/97
ccagccaccga

SEQ ID NO: 3137789 - RNA, 20 nt, Mycobacterium bovis subsp bovis AF2122/97
ccagccaccgaucgacugca

SEQ ID NO: 3137790 - RNA, 18 nt, Mycobacterium bovis subsp bovis AF2122/97
ccagccacgaacugaucg

SEQ ID NO: 3137791 - RNA, 20 nt, Mycobacterium bovis subsp bovis AF2122/97
ccagccacgccagccaggcg

SEQ ID NO: 3137792 - RNA, 20 nt, Mycobacterium bovis subsp bovis AF2122/97
ccagccacgcugucccgcgg

SEQ ID NO: 3137793 - RNA, 20 nt, Mycobacterium bovis subsp bovis AF2122/97
ccagccacugacggcuucca

SEQ ID NO: 3137794 - RNA, 14 nt, Mycobacterium bovis subsp bovis AF2122/97
ccagccagccgccc

SEQ ID NO: 3137795 - RNA, 16 nt, Mycobacterium bovis subsp bovis AF2122/97
ccagccgugcggcggc

SEQ ID NO: 3137796 - RNA, 19 nt, Mycobacterium bovis subsp bovis AF2122/97
ccagccguggcggcgggcc

SEQ ID NO: 3137797 - RNA, 20 nt, Mycobacterium bovis subsp bovis AF2122/97
ccagccguggcggcgggccu

SEQ ID NO: 3137798 - RNA, 22 nt, Mycobacterium bovis subsp bovis AF2122/97
ccagccguucucgcccacccgc

SEQ ID NO: 3137799 - RNA, 19 nt, Mycobacterium bovis subsp bovis AF2122/97
ccagccguuuuccugaucg

SEQ ID NO: 3137800 - RNA, 14 nt, Mycobacterium bovis subsp bovis AF2122/97
ccagccuaccggcu

SEQ ID NO: 3137801 - RNA, 19 nt, Mycobacterium bovis subsp bovis AF2122/97
ccagccuaccggcuacggc

SEQ ID NO: 3137802 - RNA, 22 nt, Mycobacterium bovis subsp bovis AF2122/97
ccagccuaccggcuacggcgac

SEQ ID NO: 3137803 - RNA, 22 nt, Mycobacterium bovis subsp bovis AF2122/97
ccagccucaucugaggcuucca

SEQ ID NO: 3137804 - RNA, 13 nt, Mycobacterium bovis subsp bovis AF2122/97
ccagccuggcaac

SEQ ID NO: 3137805 - RNA, 17 nt, Mycobacterium bovis subsp bovis AF2122/97
ccagccuggcaaccacg

SEQ ID NO: 3137806 - RNA, 23 nt, Mycobacterium bovis subsp bovis AF2122/97
ccagccuggccaucgagggcauc

SEQ ID NO: 3137807 - RNA, 17 nt, Mycobacterium bovis subsp bovis AF2122/97
ccagccuuuccggccgc

SEQ ID NO: 3137808 - RNA, 18 nt, Mycobacterium bovis subsp bovis AF2122/97
ccagccuuuccggccgcc

SEQ ID NO: 3137809 - RNA, 18 nt, Mycobacterium bovis subsp bovis AF2122/97
ccagcgaaaugcccauca

SEQ ID NO: 3137810 - RNA, 15 nt, Mycobacterium bovis subsp bovis AF2122/97
ccagcgaaucacccg

SEQ ID NO: 3137811 - RNA, 23 nt, Mycobacterium bovis subsp bovis AF2122/97
ccagcgaaucacccgcgagaucg

SEQ ID NO: 3137812 - RNA, 18 nt, Mycobacterium bovis subsp bovis AF2122/97
ccagcgaauccagccgcg

SEQ ID NO: 3137813 - RNA, 20 nt, Mycobacterium bovis subsp bovis AF2122/97
ccagcgaauccagccgcgcg

SEQ ID NO: 3137814 - RNA, 17 nt, Mycobacterium bovis subsp bovis AF2122/97
ccagcgaauccaggccg

SEQ ID NO: 3137815 - RNA, 18 nt, Mycobacterium bovis subsp bovis AF2122/97
ccagcgaaucgcugguga

SEQ ID NO: 3137816 - RNA, 21 nt, Mycobacterium bovis subsp bovis AF2122/97
ccagcgacaacaccacggugc

SEQ ID NO: 3137817 - RNA, 23 nt, Mycobacterium bovis subsp bovis AF2122/97
ccagcgacaacaccacggugccg

SEQ ID NO: 3137818 - RNA, 20 nt, Mycobacterium bovis subsp bovis AF2122/97
ccagcgacaugucgaacgcc

SEQ ID NO: 3137819 - RNA, 13 nt, Mycobacterium bovis subsp bovis AF2122/97
ccagcgaccaggu

SEQ ID NO: 3137820 - RNA, 19 nt, Mycobacterium bovis subsp bovis AF2122/97
ccagcgaccaggucgccag

SEQ ID NO: 3137821 - RNA, 20 nt, Mycobacterium bovis subsp bovis AF2122/97
ccagcgaccaggucgccagc

SEQ ID NO: 3137822 - RNA, 13 nt, Mycobacterium bovis subsp bovis AF2122/97
ccagcgacccggc

SEQ ID NO: 3137823 - RNA, 17 nt, Mycobacterium bovis subsp bovis AF2122/97
ccagcgacccggccagc

SEQ ID NO: 3137824 - RNA, 18 nt, Mycobacterium bovis subsp bovis AF2122/97
ccagcgaccuagcagcgc

SEQ ID NO: 3137825 - RNA, 18 nt, Mycobacterium bovis subsp bovis AF2122/97
ccagcgacgaccacacca

SEQ ID NO: 3137826 - RNA, 20 nt, Mycobacterium bovis subsp bovis AF2122/97
ccagcgacgaccacaccacg

SEQ ID NO: 3137827 - RNA, 20 nt, Mycobacterium bovis subsp bovis AF2122/97
ccagcgacgcggccagcggc

SEQ ID NO: 3137828 - RNA, 15 nt, Mycobacterium bovis subsp bovis AF2122/97
ccagcgacgcgguca

SEQ ID NO: 3137829 - RNA, 14 nt, Mycobacterium bovis subsp bovis AF2122/97
ccagcgacucggcc

SEQ ID NO: 3137830 - RNA, 16 nt, Mycobacterium bovis subsp bovis AF2122/97
ccagcgacucggccag

SEQ ID NO: 3137831 - RNA, 14 nt, Mycobacterium bovis subsp bovis AF2122/97
ccagcgagaucagc

SEQ ID NO: 3137832 - RNA, 14 nt, Mycobacterium bovis subsp bovis AF2122/97
ccagcgagcccagc

SEQ ID NO: 3137833 - RNA, 20 nt, Mycobacterium bovis subsp bovis AF2122/97
ccagcgagcccagcugcgcc

SEQ ID NO: 3137834 - RNA, 16 nt, Mycobacterium bovis subsp bovis AF2122/97
ccagcgagcgccaggu

SEQ ID NO: 3137835 - RNA, 17 nt, Mycobacterium bovis subsp bovis AF2122/97
ccagcgagcgccagguc

SEQ ID NO: 3137836 - RNA, 22 nt, Mycobacterium bovis subsp bovis AF2122/97
ccagcgaggagcagggcucguc

SEQ ID NO: 3137837 - RNA, 14 nt, Mycobacterium bovis subsp bovis AF2122/97
ccagcgaggccagc

SEQ ID NO: 3137838 - RNA, 16 nt, Mycobacterium bovis subsp bovis AF2122/97
ccagcgaggccagcgg

SEQ ID NO: 3137839 - RNA, 16 nt, Mycobacterium bovis subsp bovis AF2122/97
ccagcgauaucggcgg

SEQ ID NO: 3137840 - RNA, 21 nt, Mycobacterium bovis subsp bovis AF2122/97
ccagcgauaucggcggcuugg

SEQ ID NO: 3137841 - RNA, 16 nt, Mycobacterium bovis subsp bovis AF2122/97
ccagcgauccaccaag

SEQ ID NO: 3137842 - RNA, 18 nt, Mycobacterium bovis subsp bovis AF2122/97
ccagcgaucccggugagg

SEQ ID NO: 3137843 - RNA, 14 nt, Mycobacterium bovis subsp bovis AF2122/97
ccagcgauucagcc

SEQ ID NO: 3137844 - RNA, 15 nt, Mycobacterium bovis subsp bovis AF2122/97
ccagcgcaagguugc

SEQ ID NO: 3137845 - RNA, 13 nt, Mycobacterium bovis subsp bovis AF2122/97
ccagcgcaccgcc

SEQ ID NO: 3137846 - RNA, 14 nt, Mycobacterium bovis subsp bovis AF2122/97
ccagcgcaccgccg

SEQ ID NO: 3137847 - RNA, 22 nt, Mycobacterium bovis subsp bovis AF2122/97
ccagcgcacgauagccaccgac

SEQ ID NO: 3137848 - RNA, 16 nt, Mycobacterium bovis subsp bovis AF2122/97
ccagcgcacgcucggc

SEQ ID NO: 3137849 - RNA, 15 nt, Mycobacterium bovis subsp bovis AF2122/97
ccagcgcacggacca

SEQ ID NO: 3137850 - RNA, 14 nt, Mycobacterium bovis subsp bovis AF2122/97
ccagcgcagcagcg

SEQ ID NO: 3137851 - RNA, 15 nt, Mycobacterium bovis subsp bovis AF2122/97
ccagcgcagcagcgg

SEQ ID NO: 3137852 - RNA, 17 nt, Mycobacterium bovis subsp bovis AF2122/97
ccagcgcagccaggcug

SEQ ID NO: 3137853 - RNA, 12 nt, Mycobacterium bovis subsp bovis AF2122/97
ccagcgcagccg

SEQ ID NO: 3137854 - RNA, 13 nt, Mycobacterium bovis subsp bovis AF2122/97
ccagcgcagccga

SEQ ID NO: 3137855 - RNA, 14 nt, Mycobacterium bovis subsp bovis AF2122/97
ccagcgcagugccu

SEQ ID NO: 3137856 - RNA, 22 nt, Mycobacterium bovis subsp bovis AF2122/97
ccagcgcagugccuccgacacc

SEQ ID NO: 3137857 - RNA, 17 nt, Mycobacterium bovis subsp bovis AF2122/97
ccagcgcaucggccagc

SEQ ID NO: 3137858 - RNA, 23 nt, Mycobacterium bovis subsp bovis AF2122/97
ccagcgcaucggccagcagcgac

SEQ ID NO: 3137859 - RNA, 19 nt, Mycobacterium bovis subsp bovis AF2122/97
ccagcgcauuuuccacauc

SEQ ID NO: 3137860 - RNA, 18 nt, Mycobacterium bovis subsp bovis AF2122/97
ccagcgccacuggaagcc

SEQ ID NO: 3137861 - RNA, 15 nt, Mycobacterium bovis subsp bovis AF2122/97
ccagcgcccccagca

SEQ ID NO: 3137862 - RNA, 19 nt, Mycobacterium bovis subsp bovis AF2122/97
ccagcgcccccagcagcug

SEQ ID NO: 3137863 - RNA, 14 nt, Mycobacterium bovis subsp bovis AF2122/97
ccagcgcccgccgg

SEQ ID NO: 3137864 - RNA, 19 nt, Mycobacterium bovis subsp bovis AF2122/97
ccagcgcccgcgcggccac

SEQ ID NO: 3137865 - RNA, 14 nt, Mycobacterium bovis subsp bovis AF2122/97
ccagcgcccggcca

SEQ ID NO: 3137866 - RNA, 17 nt, Mycobacterium bovis subsp bovis AF2122/97
ccagcgccgacccguac

SEQ ID NO: 3137867 - RNA, 16 nt, Mycobacterium bovis subsp bovis AF2122/97
ccagcgccgcacccgc

SEQ ID NO: 3137868 - RNA, 18 nt, Mycobacterium bovis subsp bovis AF2122/97
ccagcgccgcacccgcuc

SEQ ID NO: 3137869 - RNA, 13 nt, Mycobacterium bovis subsp bovis AF2122/97
ccagcgccgcagu

SEQ ID NO: 3137870 - RNA, 21 nt, Mycobacterium bovis subsp bovis AF2122/97
ccagcgccgccaccgaagccg

SEQ ID NO: 3137871 - RNA, 13 nt, Mycobacterium bovis subsp bovis AF2122/97
ccagcgccgccgc

SEQ ID NO: 3137872 - RNA, 15 nt, Mycobacterium bovis subsp bovis AF2122/97
ccagcgccgccgcgu

SEQ ID NO: 3137873 - RNA, 19 nt, Mycobacterium bovis subsp bovis AF2122/97
ccagcgccgccgcguucac

SEQ ID NO: 3137874 - RNA, 14 nt, Mycobacterium bovis subsp bovis AF2122/97
ccagcgccgccggc

SEQ ID NO: 3137875 - RNA, 14 nt, Mycobacterium bovis subsp bovis AF2122/97
ccagcgccgcggcc

SEQ ID NO: 3137876 - RNA, 15 nt, Mycobacterium bovis subsp bovis AF2122/97
ccagcgccggccagg

SEQ ID NO: 3137877 - RNA, 16 nt, Mycobacterium bovis subsp bovis AF2122/97
ccagcgccggccaggc

SEQ ID NO: 3137878 - RNA, 16 nt, Mycobacterium bovis subsp bovis AF2122/97
ccagcgccggucaggg

SEQ ID NO: 3137879 - RNA, 17 nt, Mycobacterium bovis subsp bovis AF2122/97
ccagcgccuccagcacc

SEQ ID NO: 3137880 - RNA, 17 nt, Mycobacterium bovis subsp bovis AF2122/97
ccagcgccucggcaucg

SEQ ID NO: 3137881 - RNA, 18 nt, Mycobacterium bovis subsp bovis AF2122/97
ccagcgccugcgcccagc

SEQ ID NO: 3137882 - RNA, 17 nt, Mycobacterium bovis subsp bovis AF2122/97
ccagcgucgacacaccc

SEQ ID NO: 3137883 - RNA, 18 nt, Mycobacterium bovis subsp bovis AF2122/97
ccagcgucgacacaccca

SEQ ID NO: 3137884 - RNA, 14 nt, Mycobacterium bovis subsp bovis AF2122/97
ccagcgucgcacgc

SEQ ID NO: 3137885 - RNA, 16 nt, Mycobacterium bovis subsp bovis AF2122/97
ccagcgucgcacgcgc

SEQ ID NO: 3137886 - RNA, 23 nt, Mycobacterium bovis subsp bovis AF2122/97
ccagcgucgcacgcgcgcaggcc

SEQ ID NO: 3137887 - RNA, 22 nt, Mycobacterium bovis subsp bovis AF2122/97
ccagcgucgcgauugccgcggu

SEQ ID NO: 3137888 - RNA, 16 nt, Mycobacterium bovis subsp bovis AF2122/97
ccagcgucgcggccac

SEQ ID NO: 3137889 - RNA, 17 nt, Mycobacterium bovis subsp bovis AF2122/97
ccagcgucgcggccacg

SEQ ID NO: 3137890 - RNA, 21 nt, Mycobacterium bovis subsp bovis AF2122/97
ccagcgucucgaucaccucgc

SEQ ID NO: 3137891 - RNA, 14 nt, Mycobacterium bovis subsp bovis AF2122/97
ccagcgugcccgcc

SEQ ID NO: 3137892 - RNA, 19 nt, Mycobacterium bovis subsp bovis AF2122/97
ccagcgugcccgccaccgg

SEQ ID NO: 3137893 - RNA, 22 nt, Mycobacterium bovis subsp bovis AF2122/97
ccagcgugcccgccaccggcgc

SEQ ID NO: 3137894 - RNA, 16 nt, Mycobacterium bovis subsp bovis AF2122/97
ccagcgugcugccgga

SEQ ID NO: 3137895 - RNA, 22 nt, Mycobacterium bovis subsp bovis AF2122/97
ccagcguggagaucacgugccg

SEQ ID NO: 3137896 - RNA, 23 nt, Mycobacterium bovis subsp bovis AF2122/97
ccagcguggagaucacgugccgg

SEQ ID NO: 3137897 - RNA, 23 nt, Mycobacterium bovis subsp bovis AF2122/97
ccagcguggggccgccaccagcg

SEQ ID NO: 3137898 - RNA, 21 nt, Mycobacterium bovis subsp bovis AF2122/97
ccagcguggugauccggucuc

SEQ ID NO: 3137899 - RNA, 16 nt, Mycobacterium bovis subsp bovis AF2122/97
ccagcgugucccaacg

SEQ ID NO: 3137900 - RNA, 19 nt, Mycobacterium bovis subsp bovis AF2122/97
ccagcgugucuugucgcgc

SEQ ID NO: 3137901 - RNA, 17 nt, Mycobacterium bovis subsp bovis AF2122/97
ccagcguguggagcucg

SEQ ID NO: 3137902 - RNA, 19 nt, Mycobacterium bovis subsp bovis AF2122/97
ccagcguguggagcucgcg

SEQ ID NO: 3137903 - RNA, 21 nt, Mycobacterium bovis subsp bovis AF2122/97
ccagcguguggagcucgcggc

SEQ ID NO: 3137904 - RNA, 23 nt, Mycobacterium bovis subsp bovis AF2122/97
ccagcguguggagcucgcggcgc

SEQ ID NO: 3137905 - RNA, 19 nt, Mycobacterium bovis subsp bovis AF2122/97
ccagcguuaggucgccggc

SEQ ID NO: 3137906 - RNA, 20 nt, Mycobacterium bovis subsp bovis AF2122/97
ccagcguuaggucgccggcu

SEQ ID NO: 3137907 - RNA, 14 nt, Mycobacterium bovis subsp bovis AF2122/97
ccagcguucccgcc

SEQ ID NO: 3137908 - RNA, 15 nt, Mycobacterium bovis subsp bovis AF2122/97
ccagcguucccgccg

SEQ ID NO: 3137909 - RNA, 16 nt, Mycobacterium bovis subsp bovis AF2122/97
ccagcguucccgccgg

SEQ ID NO: 3137910 - RNA, 14 nt, Mycobacterium bovis subsp bovis AF2122/97
ccagcguuggcggc

SEQ ID NO: 3137911 - RNA, 20 nt, Mycobacterium bovis subsp bovis AF2122/97
ccagcguugucggguggcug

SEQ ID NO: 3137912 - RNA, 17 nt, Mycobacterium bovis subsp bovis AF2122/97
ccagcguuugcuggcgg

SEQ ID NO: 3137913 - RNA, 16 nt, Mycobacterium bovis subsp bovis AF2122/97
ccagcucccgggcggc

SEQ ID NO: 3137914 - RNA, 13 nt, Mycobacterium bovis subsp bovis AF2122/97
ccagcuccgccug

SEQ ID NO: 3137915 - RNA, 20 nt, Mycobacterium bovis subsp bovis AF2122/97
ccagcuccgccugccgcugg

SEQ ID NO: 3137916 - RNA, 13 nt, Mycobacterium bovis subsp bovis AF2122/97
ccagcuccggcgc

SEQ ID NO: 3137917 - RNA, 22 nt, Mycobacterium bovis subsp bovis AF2122/97
ccagcuccgggucgacgacguc

SEQ ID NO: 3137918 - RNA, 14 nt, Mycobacterium bovis subsp bovis AF2122/97
ccagcuccucagcc

SEQ ID NO: 3137919 - RNA, 16 nt, Mycobacterium bovis subsp bovis AF2122/97
ccagcuccucagccac

SEQ ID NO: 3137920 - RNA, 18 nt, Mycobacterium bovis subsp bovis AF2122/97
ccagcuccucagccaccg

SEQ ID NO: 3137921 - RNA, 19 nt, Mycobacterium bovis subsp bovis AF2122/97
ccagcuccucagccaccgc

SEQ ID NO: 3137922 - RNA, 23 nt, Mycobacterium bovis subsp bovis AF2122/97
ccagcuccucgugcucggccaga

SEQ ID NO: 3137923 - RNA, 13 nt, Mycobacterium bovis subsp bovis AF2122/97
ccagcuccugcau

SEQ ID NO: 3137924 - RNA, 17 nt, Mycobacterium bovis subsp bovis AF2122/97
ccagcuccugcaugccg

SEQ ID NO: 3137925 - RNA, 21 nt, Mycobacterium bovis subsp bovis AF2122/97
ccagcucgagguccucagcga

SEQ ID NO: 3137926 - RNA, 18 nt, Mycobacterium bovis subsp bovis AF2122/97
ccagcucgcgcacccagc

SEQ ID NO: 3137927 - RNA, 22 nt, Mycobacterium bovis subsp bovis AF2122/97
ccagcucgcgcacccagcccag

SEQ ID NO: 3137928 - RNA, 16 nt, Mycobacterium bovis subsp bovis AF2122/97
ccagcucgcgggccgc

SEQ ID NO: 3137929 - RNA, 17 nt, Mycobacterium bovis subsp bovis AF2122/97
ccagcucgcgggccgcg

SEQ ID NO: 3137930 - RNA, 16 nt, Mycobacterium bovis subsp bovis AF2122/97
ccagcucgcggugggc

SEQ ID NO: 3137931 - RNA, 14 nt, Mycobacterium bovis subsp bovis AF2122/97
ccagcucgcugcgc

SEQ ID NO: 3137932 - RNA, 20 nt, Mycobacterium bovis subsp bovis AF2122/97
ccagcucgcugcgcgcccac

SEQ ID NO: 3137933 - RNA, 13 nt, Mycobacterium bovis subsp bovis AF2122/97
ccagcucggccag

SEQ ID NO: 3137934 - RNA, 16 nt, Mycobacterium bovis subsp bovis AF2122/97
ccagcucggccagcug

SEQ ID NO: 3137935 - RNA, 14 nt, Mycobacterium bovis subsp bovis AF2122/97
ccagcucggccagu

SEQ ID NO: 3137936 - RNA, 16 nt, Mycobacterium bovis subsp bovis AF2122/97
ccagcucggcggcagc

SEQ ID NO: 3137937 - RNA, 14 nt, Mycobacterium bovis subsp bovis AF2122/97
ccagcucggcgggc

SEQ ID NO: 3137938 - RNA, 23 nt, Mycobacterium bovis subsp bovis AF2122/97
ccagcucgggggcgccggcgccc

SEQ ID NO: 3137939 - RNA, 21 nt, Mycobacterium bovis subsp bovis AF2122/97
ccagcucggugaucaccauga

SEQ ID NO: 3137940 - RNA, 17 nt, Mycobacterium bovis subsp bovis AF2122/97
ccagcucgucgacgucg

SEQ ID NO: 3137941 - RNA, 12 nt, Mycobacterium bovis subsp bovis AF2122/97
ccagcucgucgc

SEQ ID NO: 3137942 - RNA, 20 nt, Mycobacterium bovis subsp bovis AF2122/97
ccagcugagccgucggcgcc

SEQ ID NO: 3137943 - RNA, 21 nt, Mycobacterium bovis subsp bovis AF2122/97
ccagcugagcggccggcaugc

SEQ ID NO: 3137944 - RNA, 16 nt, Mycobacterium bovis subsp bovis AF2122/97
ccagcugcagcagacc

SEQ ID NO: 3137945 - RNA, 22 nt, Mycobacterium bovis subsp bovis AF2122/97
ccagcugcagcagacccggugg

SEQ ID NO: 3137946 - RNA, 14 nt, Mycobacterium bovis subsp bovis AF2122/97
ccagcugcccgacg

SEQ ID NO: 3137947 - RNA, 12 nt, Mycobacterium bovis subsp bovis AF2122/97
ccagcugcgagu

SEQ ID NO: 3137948 - RNA, 18 nt, Mycobacterium bovis subsp bovis AF2122/97
ccagcugcgagucgucgc

SEQ ID NO: 3137949 - RNA, 18 nt, Mycobacterium bovis subsp bovis AF2122/97
ccagcugcgcagcgcaac

SEQ ID NO: 3137950 - RNA, 17 nt, Mycobacterium bovis subsp bovis AF2122/97
ccagcugcgcgggcgag

SEQ ID NO: 3137951 - RNA, 19 nt, Mycobacterium bovis subsp bovis AF2122/97
ccagcugcggcuccggcgg

SEQ ID NO: 3137952 - RNA, 15 nt, Mycobacterium bovis subsp bovis AF2122/97
ccagcuggacuccgg

SEQ ID NO: 3137953 - RNA, 13 nt, Mycobacterium bovis subsp bovis AF2122/97
ccagcuggccggg

SEQ ID NO: 3137954 - RNA, 22 nt, Mycobacterium bovis subsp bovis AF2122/97
ccagcuggccgggugcgugcgc

SEQ ID NO: 3137955 - RNA, 22 nt, Mycobacterium bovis subsp bovis AF2122/97
ccagcuggcgauacagcgacag

SEQ ID NO: 3137956 - RNA, 17 nt, Mycobacterium bovis subsp bovis AF2122/97
ccagcugggcagccaga

SEQ ID NO: 3137957 - RNA, 20 nt, Mycobacterium bovis subsp bovis AF2122/97
ccagcugucauccccggcca

SEQ ID NO: 3137958 - RNA, 16 nt, Mycobacterium bovis subsp bovis AF2122/97
ccagcuguccucgcgg

SEQ ID NO: 3137959 - RNA, 19 nt, Mycobacterium bovis subsp bovis AF2122/97
ccagcuguccucgcgggcu

SEQ ID NO: 3137960 - RNA, 16 nt, Mycobacterium bovis subsp bovis AF2122/97
ccagcugucgggcagc

SEQ ID NO: 3137961 - RNA, 17 nt, Mycobacterium bovis subsp bovis AF2122/97
ccagcuugagguccguc

SEQ ID NO: 3137962 - RNA, 14 nt, Mycobacterium bovis subsp bovis AF2122/97
ccagcuugcgccgc

SEQ ID NO: 3137963 - RNA, 20 nt, Mycobacterium bovis subsp bovis AF2122/97
ccagcuugcggugaucccac

SEQ ID NO: 3137964 - RNA, 20 nt, Mycobacterium bovis subsp bovis AF2122/97
ccagcuuggagaggcggugc

SEQ ID NO: 3137965 - RNA, 23 nt, Mycobacterium bovis subsp bovis AF2122/97
ccagcuuggagaggcggugcagc

SEQ ID NO: 3137966 - RNA, 17 nt, Mycobacterium bovis subsp bovis AF2122/97
ccagcuuggcgagcagg

SEQ ID NO: 3137967 - RNA, 20 nt, Mycobacterium bovis subsp bovis AF2122/97
ccagcuuggcgucgaugcgg

SEQ ID NO: 3137968 - RNA, 22 nt, Mycobacterium bovis subsp bovis AF2122/97
ccaggccgaucagcguggcgcc

SEQ ID NO: 3137969 - RNA, 14 nt, Mycobacterium bovis subsp bovis AF2122/97
ccaggccgaugccg

SEQ ID NO: 3137970 - RNA, 17 nt, Mycobacterium bovis subsp bovis AF2122/97
ccaggccgaugccgacc

SEQ ID NO: 3137971 - RNA, 22 nt, Mycobacterium bovis subsp bovis AF2122/97
ccaggccgaugugucgaugagg

SEQ ID NO: 3137972 - RNA, 13 nt, Mycobacterium bovis subsp bovis AF2122/97
ccaggccgccgcc

SEQ ID NO: 3137973 - RNA, 21 nt, Mycobacterium bovis subsp bovis AF2122/97
ccaggccgcgacaauggugcc

SEQ ID NO: 3137974 - RNA, 12 nt, Mycobacterium bovis subsp bovis AF2122/97
ccaggccgcgcg

SEQ ID NO: 3137975 - RNA, 13 nt, Mycobacterium bovis subsp bovis AF2122/97
ccaggccgcgcgc

SEQ ID NO: 3137976 - RNA, 15 nt, Mycobacterium bovis subsp bovis AF2122/97
ccaggccgcuugccc

SEQ ID NO: 3137977 - RNA, 19 nt, Mycobacterium bovis subsp bovis AF2122/97
ccaggccgcuugccccgcc

SEQ ID NO: 3137978 - RNA, 13 nt, Mycobacterium bovis subsp bovis AF2122/97
ccaggccggcacc

SEQ ID NO: 3137979 - RNA, 18 nt, Mycobacterium bovis subsp bovis AF2122/97
ccaggccggcacccacca

SEQ ID NO: 3137980 - RNA, 13 nt, Mycobacterium bovis subsp bovis AF2122/97
ccaggccggcccg

SEQ ID NO: 3137981 - RNA, 14 nt, Mycobacterium bovis subsp bovis AF2122/97
ccaggccggcccgc

SEQ ID NO: 3137982 - RNA, 15 nt, Mycobacterium bovis subsp bovis AF2122/97
ccaggccggcccgca

SEQ ID NO: 3137983 - RNA, 14 nt, Mycobacterium bovis subsp bovis AF2122/97
ccaggccggcggcg

SEQ ID NO: 3137984 - RNA, 19 nt, Mycobacterium bovis subsp bovis AF2122/97
ccaggccggcggcggcgcu

SEQ ID NO: 3137985 - RNA, 21 nt, Mycobacterium bovis subsp bovis AF2122/97
ccaggccggcggcggcgcucg

SEQ ID NO: 3137986 - RNA, 15 nt, Mycobacterium bovis subsp bovis AF2122/97
ccaggccggugacgg

SEQ ID NO: 3137987 - RNA, 16 nt, Mycobacterium bovis subsp bovis AF2122/97
ccaggccguacucgau

SEQ ID NO: 3137988 - RNA, 17 nt, Mycobacterium bovis subsp bovis AF2122/97
ccaggccguagcccacg

SEQ ID NO: 3137989 - RNA, 20 nt, Mycobacterium bovis subsp bovis AF2122/97
ccaggccguagcccacgacg

SEQ ID NO: 3137990 - RNA, 21 nt, Mycobacterium bovis subsp bovis AF2122/97
ccaggccguagcccacgacga

SEQ ID NO: 3137991 - RNA, 22 nt, Mycobacterium bovis subsp bovis AF2122/97
ccaggccguagcccacgacgaa

SEQ ID NO: 3137992 - RNA, 13 nt, Mycobacterium bovis subsp bovis AF2122/97
ccaggccgucagg

SEQ ID NO: 3137993 - RNA, 21 nt, Mycobacterium bovis subsp bovis AF2122/97
ccaggccgucaggcgugccgg

SEQ ID NO: 3137994 - RNA, 19 nt, Mycobacterium bovis subsp bovis AF2122/97
ccaggccgucguugccggc

SEQ ID NO: 3137995 - RNA, 22 nt, Mycobacterium bovis subsp bovis AF2122/97
ccaggccgucguugccggcgac

SEQ ID NO: 3137996 - RNA, 14 nt, Mycobacterium bovis subsp bovis AF2122/97
ccaggcgaacaggg

SEQ ID NO: 3137997 - RNA, 18 nt, Mycobacterium bovis subsp bovis AF2122/97
ccaggcgaaguacccggc

SEQ ID NO: 3137998 - RNA, 15 nt, Mycobacterium bovis subsp bovis AF2122/97
ccaggcgaccgcuga

SEQ ID NO: 3137999 - RNA, 12 nt, Mycobacterium bovis subsp bovis AF2122/97
ccaggcgagccg

SEQ ID NO: 3138000 - RNA, 14 nt, Mycobacterium bovis subsp bovis AF2122/97
ccaggcgagccgcc

SEQ ID NO: 3138001 - RNA, 19 nt, Mycobacterium bovis subsp bovis AF2122/97
ccaggcgagccgccaccgu

SEQ ID NO: 3138002 - RNA, 16 nt, Mycobacterium bovis subsp bovis AF2122/97
ccaggcgagccggcgc

SEQ ID NO: 3138003 - RNA, 18 nt, Mycobacterium bovis subsp bovis AF2122/97
ccaggcgagccggcgcgc

SEQ ID NO: 3138004 - RNA, 21 nt, Mycobacterium bovis subsp bovis AF2122/97
ccaggcgaucgcccggccccg

SEQ ID NO: 3138005 - RNA, 22 nt, Mycobacterium bovis subsp bovis AF2122/97
ccaggcgauugcccgcgcucgc

SEQ ID NO: 3138006 - RNA, 19 nt, Mycobacterium bovis subsp bovis AF2122/97
ccaggcgcauagggccacc

SEQ ID NO: 3138007 - RNA, 22 nt, Mycobacterium bovis subsp bovis AF2122/97
ccaggcgcauagggccaccgcc

SEQ ID NO: 3138008 - RNA, 23 nt, Mycobacterium bovis subsp bovis AF2122/97
ccaggcgcgacguagacgacguc

SEQ ID NO: 3138009 - RNA, 17 nt, Mycobacterium bovis subsp bovis AF2122/97
ccaggcgcgaucgcgcc

SEQ ID NO: 3138010 - RNA, 17 nt, Mycobacterium bovis subsp bovis AF2122/97
ccaggcgcgcaccaccg

SEQ ID NO: 3138011 - RNA, 20 nt, Mycobacterium bovis subsp bovis AF2122/97
ccaggcgcgcaccaccgcgg

SEQ ID NO: 3138012 - RNA, 19 nt, Mycobacterium bovis subsp bovis AF2122/97
ccaggcgcgccgcacccgg

SEQ ID NO: 3138013 - RNA, 14 nt, Mycobacterium bovis subsp bovis AF2122/97
ccaggcgcggccca

SEQ ID NO: 3138014 - RNA, 12 nt, Mycobacterium bovis subsp bovis AF2122/97
ccaggcgcggcg

SEQ ID NO: 3138015 - RNA, 21 nt, Mycobacterium bovis subsp bovis AF2122/97
ccaggcgcucagcgcggccac

SEQ ID NO: 3138016 - RNA, 14 nt, Mycobacterium bovis subsp bovis AF2122/97
ccaggcgcucauca

SEQ ID NO: 3138017 - RNA, 20 nt, Mycobacterium bovis subsp bovis AF2122/97
ccaggcgcucaucacccagc

SEQ ID NO: 3138018 - RNA, 14 nt, Mycobacterium bovis subsp bovis AF2122/97
ccaggcgcugcagc

SEQ ID NO: 3138019 - RNA, 14 nt, Mycobacterium bovis subsp bovis AF2122/97
ccaggcggacgccg

SEQ ID NO: 3138020 - RNA, 17 nt, Mycobacterium bovis subsp bovis AF2122/97
ccaggcggacgccgcgc

SEQ ID NO: 3138021 - RNA, 22 nt, Mycobacterium bovis subsp bovis AF2122/97
ccaggcggcaaggacggagccc

SEQ ID NO: 3138022 - RNA, 12 nt, Mycobacterium bovis subsp bovis AF2122/97
ccaggcggccgc

SEQ ID NO: 3138023 - RNA, 15 nt, Mycobacterium bovis subsp bovis AF2122/97
ccaggcggcgcgggu

SEQ ID NO: 3138024 - RNA, 15 nt, Mycobacterium bovis subsp bovis AF2122/97
ccaggcgggcggcac

SEQ ID NO: 3138025 - RNA, 16 nt, Mycobacterium bovis subsp bovis AF2122/97
ccaggcgggcggcacc

SEQ ID NO: 3138026 - RNA, 18 nt, Mycobacterium bovis subsp bovis AF2122/97
ccaggcgguacgggucgc

SEQ ID NO: 3138027 - RNA, 21 nt, Mycobacterium bovis subsp bovis AF2122/97
ccaggcgguacgggucgccgg

SEQ ID NO: 3138028 - RNA, 21 nt, Mycobacterium bovis subsp bovis AF2122/97
ccaggcguuggaucccagccc

SEQ ID NO: 3138029 - RNA, 20 nt, Mycobacterium bovis subsp bovis AF2122/97
ccaggcguuuggcgugccgu

SEQ ID NO: 3138030 - RNA, 20 nt, Mycobacterium bovis subsp bovis AF2122/97
ccaggcuaauagcucgccgg

SEQ ID NO: 3138031 - RNA, 22 nt, Mycobacterium bovis subsp bovis AF2122/97
ccaggcuaauagcucgccggcg

SEQ ID NO: 3138032 - RNA, 22 nt, Mycobacterium bovis subsp bovis AF2122/97
ccaggcuaccguuacccgggau

SEQ ID NO: 3138033 - RNA, 18 nt, Mycobacterium bovis subsp bovis AF2122/97
ccaggcuauggugccggu

SEQ ID NO: 3138034 - RNA, 17 nt, Mycobacterium bovis subsp bovis AF2122/97
ccaggcuccggccggcc

SEQ ID NO: 3138035 - RNA, 20 nt, Mycobacterium bovis subsp bovis AF2122/97
ccaggcuccggccggccagc

SEQ ID NO: 3138036 - RNA, 22 nt, Mycobacterium bovis subsp bovis AF2122/97
ccaggcucgagguguagcccuc

SEQ ID NO: 3138037 - RNA, 20 nt, Mycobacterium bovis subsp bovis AF2122/97
ccaggcugaucccgaugcug

SEQ ID NO: 3138038 - RNA, 15 nt, Mycobacterium bovis subsp bovis AF2122/97
ccaggcugcgcagug

SEQ ID NO: 3138039 - RNA, 22 nt, Mycobacterium bovis subsp bovis AF2122/97
ccaggcugcgcagugacgccuc

SEQ ID NO: 3138040 - RNA, 18 nt, Mycobacterium bovis subsp bovis AF2122/97
ccaggcuggcgucaccgc

SEQ ID NO: 3138041 - RNA, 14 nt, Mycobacterium bovis subsp bovis AF2122/97
ccaggcugguccgg

SEQ ID NO: 3138042 - RNA, 15 nt, Mycobacterium bovis subsp bovis AF2122/97
ccaggcugguccggg

SEQ ID NO: 3138043 - RNA, 22 nt, Mycobacterium bovis subsp bovis AF2122/97
ccaggcugguccgggugccggu

SEQ ID NO: 3138044 - RNA, 21 nt, Mycobacterium bovis subsp bovis AF2122/97
ccaggcugucgcgggccacca

SEQ ID NO: 3138045 - RNA, 15 nt, Mycobacterium bovis subsp bovis AF2122/97
ccaggcuguggccag

SEQ ID NO: 3138046 - RNA, 16 nt, Mycobacterium bovis subsp bovis AF2122/97
ccaggcuguggccagc

SEQ ID NO: 3138047 - RNA, 19 nt, Mycobacterium bovis subsp bovis AF2122/97
ccagggagcggcugcacgc

SEQ ID NO: 3138048 - RNA, 12 nt, Mycobacterium bovis subsp bovis AF2122/97
ccagggagugcc

SEQ ID NO: 3138049 - RNA, 17 nt, Mycobacterium bovis subsp bovis AF2122/97
ccagggcacaucgggcg

SEQ ID NO: 3138050 - RNA, 17 nt, Mycobacterium bovis subsp bovis AF2122/97
ccagggcacguggcggu

SEQ ID NO: 3138051 - RNA, 20 nt, Mycobacterium bovis subsp bovis AF2122/97
ccagggcacguggcgguaca

SEQ ID NO: 3138052 - RNA, 20 nt, Mycobacterium bovis subsp bovis AF2122/97
ccagggcacguucggcgcac

SEQ ID NO: 3138053 - RNA, 14 nt, Mycobacterium bovis subsp bovis AF2122/97
ccagggccaccgcg

SEQ ID NO: 3138054 - RNA, 15 nt, Mycobacterium bovis subsp bovis AF2122/97
ccaggucuccaucaa

SEQ ID NO: 3138055 - RNA, 20 nt, Mycobacterium bovis subsp bovis AF2122/97
ccaggucuccaucaaccgcg

SEQ ID NO: 3138056 - RNA, 21 nt, Mycobacterium bovis subsp bovis AF2122/97
ccaggucuccaucaaccgcgc

SEQ ID NO: 3138057 - RNA, 15 nt, Mycobacterium bovis subsp bovis AF2122/97
ccaggucuccuuggg

SEQ ID NO: 3138058 - RNA, 16 nt, Mycobacterium bovis subsp bovis AF2122/97
ccaggucuccuugggc

SEQ ID NO: 3138059 - RNA, 12 nt, Mycobacterium bovis subsp bovis AF2122/97
ccaggucugcgg

SEQ ID NO: 3138060 - RNA, 14 nt, Mycobacterium bovis subsp bovis AF2122/97
ccaggucugcggug

SEQ ID NO: 3138061 - RNA, 22 nt, Mycobacterium bovis subsp bovis AF2122/97
ccaggucugggcuuugcagcgu

SEQ ID NO: 3138062 - RNA, 22 nt, Mycobacterium bovis subsp bovis AF2122/97
ccaggucuucgaccacggucug

SEQ ID NO: 3138063 - RNA, 18 nt, Mycobacterium bovis subsp bovis AF2122/97
ccaggucuuucgaauccc

SEQ ID NO: 3138064 - RNA, 15 nt, Mycobacterium bovis subsp bovis AF2122/97
ccaggugacgcccgc

SEQ ID NO: 3138065 - RNA, 17 nt, Mycobacterium bovis subsp bovis AF2122/97
ccaggugaucgcgaggc

SEQ ID NO: 3138066 - RNA, 16 nt, Mycobacterium bovis subsp bovis AF2122/97
ccaggugaugccgccg

SEQ ID NO: 3138067 - RNA, 11 nt, Mycobacterium bovis subsp bovis AF2122/97
ccaggugcagg

SEQ ID NO: 3138068 - RNA, 16 nt, Mycobacterium bovis subsp bovis AF2122/97
ccaggugcccaagcag

SEQ ID NO: 3138069 - RNA, 19 nt, Mycobacterium bovis subsp bovis AF2122/97
ccaggugcccaagcagucc

SEQ ID NO: 3138070 - RNA, 13 nt, Mycobacterium bovis subsp bovis AF2122/97
ccaggugcccgcc

SEQ ID NO: 3138071 - RNA, 16 nt, Mycobacterium bovis subsp bovis AF2122/97
ccaggugcccgccccg

SEQ ID NO: 3138072 - RNA, 22 nt, Mycobacterium bovis subsp bovis AF2122/97
ccaggugcguccaggccagggc

SEQ ID NO: 3138073 - RNA, 21 nt, Mycobacterium bovis subsp bovis AF2122/97
ccaggugcugguauagccggc

SEQ ID NO: 3138074 - RNA, 15 nt, Mycobacterium bovis subsp bovis AF2122/97
ccagguggccaggcc

SEQ ID NO: 3138075 - RNA, 12 nt, Mycobacterium bovis subsp bovis AF2122/97
ccagguggccgc

SEQ ID NO: 3138076 - RNA, 13 nt, Mycobacterium bovis subsp bovis AF2122/97
ccagguggccgcu

SEQ ID NO: 3138077 - RNA, 18 nt, Mycobacterium bovis subsp bovis AF2122/97
ccaggugggcagcaggcc

SEQ ID NO: 3138078 - RNA, 21 nt, Mycobacterium bovis subsp bovis AF2122/97
ccaggugggccgagagcagcc

SEQ ID NO: 3138079 - RNA, 20 nt, Mycobacterium bovis subsp bovis AF2122/97
ccagguggucaucgccacgc

SEQ ID NO: 3138080 - RNA, 19 nt, Mycobacterium bovis subsp bovis AF2122/97
ccaggugucgucgaucgcg

SEQ ID NO: 3138081 - RNA, 20 nt, Mycobacterium bovis subsp bovis AF2122/97
ccaggugucgucgaucgcgg

SEQ ID NO: 3138082 - RNA, 21 nt, Mycobacterium bovis subsp bovis AF2122/97
ccaggugucgucgaucgcgga

SEQ ID NO: 3138083 - RNA, 13 nt, Mycobacterium bovis subsp bovis AF2122/97
ccaggugugcccc

SEQ ID NO: 3138084 - RNA, 16 nt, Mycobacterium bovis subsp bovis AF2122/97
ccagguguguggcggc

SEQ ID NO: 3138085 - RNA, 14 nt, Mycobacterium bovis subsp bovis AF2122/97
ccagguguugacga

SEQ ID NO: 3138086 - RNA, 23 nt, Mycobacterium bovis subsp bovis AF2122/97
ccagguuccgcugucgagccggu

SEQ ID NO: 3138087 - RNA, 21 nt, Mycobacterium bovis subsp bovis AF2122/97
ccagguucuucuccaccaccg

SEQ ID NO: 3138088 - RNA, 23 nt, Mycobacterium bovis subsp bovis AF2122/97
ccagguugaagaaugccgucuga

SEQ ID NO: 3138089 - RNA, 19 nt, Mycobacterium bovis subsp bovis AF2122/97
ccagguugaggugugccga

SEQ ID NO: 3138090 - RNA, 16 nt, Mycobacterium bovis subsp bovis AF2122/97
ccagguugauccagug

SEQ ID NO: 3138091 - RNA, 14 nt, Mycobacterium bovis subsp bovis AF2122/97
ccagguugccaacc

SEQ ID NO: 3138092 - RNA, 17 nt, Mycobacterium bovis subsp bovis AF2122/97
ccagguugccgucggcc

SEQ ID NO: 3138093 - RNA, 18 nt, Mycobacterium bovis subsp bovis AF2122/97
ccagguugccuuggcggc

SEQ ID NO: 3138094 - RNA, 22 nt, Mycobacterium bovis subsp bovis AF2122/97
ccagguuguagacggcaccccc

SEQ ID NO: 3138095 - RNA, 15 nt, Mycobacterium bovis subsp bovis AF2122/97
ccagguuuugccgcg

SEQ ID NO: 3138096 - RNA, 21 nt, Mycobacterium bovis subsp bovis AF2122/97
ccaguaaaaaggcaggacuga

SEQ ID NO: 3138097 - RNA, 15 nt, Mycobacterium bovis subsp bovis AF2122/97
ccaguaaugcccaug

SEQ ID NO: 3138098 - RNA, 14 nt, Mycobacterium bovis subsp bovis AF2122/97
ccaguaccaccggc

SEQ ID NO: 3138099 - RNA, 16 nt, Mycobacterium bovis subsp bovis AF2122/97
ccaguaccaccggcac

SEQ ID NO: 3138100 - RNA, 22 nt, Mycobacterium bovis subsp bovis AF2122/97
ccaguaccgucaucgcggugug

SEQ ID NO: 3138101 - RNA, 20 nt, Mycobacterium bovis subsp bovis AF2122/97
ccaguacguuggugucccac

SEQ ID NO: 3138102 - RNA, 16 nt, Mycobacterium bovis subsp bovis AF2122/97
ccaguagaucgccucg

SEQ ID NO: 3138103 - RNA, 14 nt, Mycobacterium bovis subsp bovis AF2122/97
ccaguagaucgcga

SEQ ID NO: 3138104 - RNA, 12 nt, Mycobacterium bovis subsp bovis AF2122/97
ccaguagccggu

SEQ ID NO: 3138105 - RNA, 18 nt, Mycobacterium bovis subsp bovis AF2122/97
ccaguaggcuucgaccgu

SEQ ID NO: 3138106 - RNA, 19 nt, Mycobacterium bovis subsp bovis AF2122/97
ccaguaggcuucgaccgug

SEQ ID NO: 3138107 - RNA, 21 nt, Mycobacterium bovis subsp bovis AF2122/97
ccaguaggcuucgaccguggu

SEQ ID NO: 3138108 - RNA, 12 nt, Mycobacterium bovis subsp bovis AF2122/97
ccagucacgccc

SEQ ID NO: 3138109 - RNA, 17 nt, Mycobacterium bovis subsp bovis AF2122/97
ccagucacgcccaccac

SEQ ID NO: 3138110 - RNA, 13 nt, Mycobacterium bovis subsp bovis AF2122/97
ccagucccaggug

SEQ ID NO: 3138111 - RNA, 19 nt, Mycobacterium bovis subsp bovis AF2122/97
ccaguccccgccggccucc

SEQ ID NO: 3138112 - RNA, 14 nt, Mycobacterium bovis subsp bovis AF2122/97
ccagucccggcgca

SEQ ID NO: 3138113 - RNA, 15 nt, Mycobacterium bovis subsp bovis AF2122/97
ccagucccucgccaa

SEQ ID NO: 3138114 - RNA, 23 nt, Mycobacterium bovis subsp bovis AF2122/97
ccaguccgaugguaugcccgccg

SEQ ID NO: 3138115 - RNA, 14 nt, Mycobacterium bovis subsp bovis AF2122/97
ccaguccggacggc

SEQ ID NO: 3138116 - RNA, 17 nt, Mycobacterium bovis subsp bovis AF2122/97
ccaguccggacggcagc

SEQ ID NO: 3138117 - RNA, 18 nt, Mycobacterium bovis subsp bovis AF2122/97
ccaguccggacggcagcc

SEQ ID NO: 3138118 - RNA, 19 nt, Mycobacterium bovis subsp bovis AF2122/97
ccaguccggcggacgugac

SEQ ID NO: 3138119 - RNA, 14 nt, Mycobacterium bovis subsp bovis AF2122/97
ccagucgaagaaga

SEQ ID NO: 3138120 - RNA, 15 nt, Mycobacterium bovis subsp bovis AF2122/97
ccagucgaagaagac

SEQ ID NO: 3138121 - RNA, 17 nt, Mycobacterium bovis subsp bovis AF2122/97
ccagucgaaucgucauc

SEQ ID NO: 3138122 - RNA, 23 nt, Mycobacterium bovis subsp bovis AF2122/97
ccagucgacgucucuggugcagg

SEQ ID NO: 3138123 - RNA, 18 nt, Mycobacterium bovis subsp bovis AF2122/97
ccagucgagcaccugccg

SEQ ID NO: 3138124 - RNA, 19 nt, Mycobacterium bovis subsp bovis AF2122/97
ccagucgagcaccugccga

SEQ ID NO: 3138125 - RNA, 19 nt, Mycobacterium bovis subsp bovis AF2122/97
ccagucgaucgcggcccgc

SEQ ID NO: 3138126 - RNA, 20 nt, Mycobacterium bovis subsp bovis AF2122/97
ccagucgaucgcggcccgca

SEQ ID NO: 3138127 - RNA, 18 nt, Mycobacterium bovis subsp bovis AF2122/97
ccagucgaugucaaggaa

SEQ ID NO: 3138128 - RNA, 15 nt, Mycobacterium bovis subsp bovis AF2122/97
ccagucgauucggcc

SEQ ID NO: 3138129 - RNA, 17 nt, Mycobacterium bovis subsp bovis AF2122/97
ccagucgauucggccca

SEQ ID NO: 3138130 - RNA, 20 nt, Mycobacterium bovis subsp bovis AF2122/97
ccagucgcaggaucggcgga

SEQ ID NO: 3138131 - RNA, 23 nt, Mycobacterium bovis subsp bovis AF2122/97
ccagucgccgaaagggucgacgu

SEQ ID NO: 3138132 - RNA, 14 nt, Mycobacterium bovis subsp bovis AF2122/97
ccagucgcggcgcg

SEQ ID NO: 3138133 - RNA, 18 nt, Mycobacterium bovis subsp bovis AF2122/97
ccagucgcggcgcgagga

SEQ ID NO: 3138134 - RNA, 17 nt, Mycobacterium bovis subsp bovis AF2122/97
ccagucgcggcguucgg

SEQ ID NO: 3138135 - RNA, 13 nt, Mycobacterium bovis subsp bovis AF2122/97
ccagucggccacc

SEQ ID NO: 3138136 - RNA, 14 nt, Mycobacterium bovis subsp bovis AF2122/97
ccagucggccaccu

SEQ ID NO: 3138137 - RNA, 21 nt, Mycobacterium bovis subsp bovis AF2122/97
ccagucguacucccaggccgc

SEQ ID NO: 3138138 - RNA, 17 nt, Mycobacterium bovis subsp bovis AF2122/97
ccagugaaaccaccggc

SEQ ID NO: 3138139 - RNA, 18 nt, Mycobacterium bovis subsp bovis AF2122/97
ccagugaaaccaccggcc

SEQ ID NO: 3138140 - RNA, 22 nt, Mycobacterium bovis subsp bovis AF2122/97
ccagugaacgcgcgugcagcca

SEQ ID NO: 3138141 - RNA, 13 nt, Mycobacterium bovis subsp bovis AF2122/97
ccaucaccagcgg

SEQ ID NO: 3138142 - RNA, 14 nt, Mycobacterium bovis subsp bovis AF2122/97
ccaucaccagcggc

SEQ ID NO: 3138143 - RNA, 12 nt, Mycobacterium bovis subsp bovis AF2122/97
ccaucaccgccg

SEQ ID NO: 3138144 - RNA, 23 nt, Mycobacterium bovis subsp bovis AF2122/97
ccaucaccgccuuugccgccggc

SEQ ID NO: 3138145 - RNA, 12 nt, Mycobacterium bovis subsp bovis AF2122/97
ccaucaccgcgc

SEQ ID NO: 3138146 - RNA, 16 nt, Mycobacterium bovis subsp bovis AF2122/97
ccaucaccgcgccagc

SEQ ID NO: 3138147 - RNA, 13 nt, Mycobacterium bovis subsp bovis AF2122/97
ccaucaccggcgg

SEQ ID NO: 3138148 - RNA, 16 nt, Mycobacterium bovis subsp bovis AF2122/97
ccaucacgaccagggu

SEQ ID NO: 3138149 - RNA, 19 nt, Mycobacterium bovis subsp bovis AF2122/97
ccaucacgcccuguucucc

SEQ ID NO: 3138150 - RNA, 14 nt, Mycobacterium bovis subsp bovis AF2122/97
ccaucacggucagc

SEQ ID NO: 3138151 - RNA, 15 nt, Mycobacterium bovis subsp bovis AF2122/97
ccaucacggucagcu

SEQ ID NO: 3138152 - RNA, 16 nt, Mycobacterium bovis subsp bovis AF2122/97
ccaucacggucagcuc

SEQ ID NO: 3138153 - RNA, 12 nt, Mycobacterium bovis subsp bovis AF2122/97
ccaucacggugg

SEQ ID NO: 3138154 - RNA, 16 nt, Mycobacterium bovis subsp bovis AF2122/97
ccaucacgguggccgc

SEQ ID NO: 3138155 - RNA, 19 nt, Mycobacterium bovis subsp bovis AF2122/97
ccaucagagacagcagcgu

SEQ ID NO: 3138156 - RNA, 13 nt, Mycobacterium bovis subsp bovis AF2122/97
ccaucagcgcgac

SEQ ID NO: 3138157 - RNA, 22 nt, Mycobacterium bovis subsp bovis AF2122/97
ccaucaucccguauucgaugcc

SEQ ID NO: 3138158 - RNA, 15 nt, Mycobacterium bovis subsp bovis AF2122/97
ccaucaucgccacca

SEQ ID NO: 3138159 - RNA, 22 nt, Mycobacterium bovis subsp bovis AF2122/97
ccaucaucgccaccaccccguc

SEQ ID NO: 3138160 - RNA, 23 nt, Mycobacterium bovis subsp bovis AF2122/97
ccaucaucgcccugggcgccggc

SEQ ID NO: 3138161 - RNA, 14 nt, Mycobacterium bovis subsp bovis AF2122/97
ccaucaugguccgg

SEQ ID NO: 3138162 - RNA, 20 nt, Mycobacterium bovis subsp bovis AF2122/97
ccaucauguucuuuugcguc

SEQ ID NO: 3138163 - RNA, 21 nt, Mycobacterium bovis subsp bovis AF2122/97
ccauccacaucgaugucggcu

SEQ ID NO: 3138164 - RNA, 19 nt, Mycobacterium bovis subsp bovis AF2122/97
ccauccaugauggccguca

SEQ ID NO: 3138165 - RNA, 13 nt, Mycobacterium bovis subsp bovis AF2122/97
ccauccccgccgg

SEQ ID NO: 3138166 - RNA, 16 nt, Mycobacterium bovis subsp bovis AF2122/97
ccauccccuggccagc

SEQ ID NO: 3138167 - RNA, 14 nt, Mycobacterium bovis subsp bovis AF2122/97
ccaucccgagcucc

SEQ ID NO: 3138168 - RNA, 18 nt, Mycobacterium bovis subsp bovis AF2122/97
ccaucccgaucccggcca

SEQ ID NO: 3138169 - RNA, 20 nt, Mycobacterium bovis subsp bovis AF2122/97
ccaucccgaucccggccagc

SEQ ID NO: 3138170 - RNA, 17 nt, Mycobacterium bovis subsp bovis AF2122/97
ccaucccgguuccggcg

SEQ ID NO: 3138171 - RNA, 21 nt, Mycobacterium bovis subsp bovis AF2122/97
ccaucccucgaaaaccguggu

SEQ ID NO: 3138172 - RNA, 23 nt, Mycobacterium bovis subsp bovis AF2122/97
ccaucccugaaauaccaguccgg

SEQ ID NO: 3138173 - RNA, 16 nt, Mycobacterium bovis subsp bovis AF2122/97
ccauccgauggcccgg

SEQ ID NO: 3138174 - RNA, 18 nt, Mycobacterium bovis subsp bovis AF2122/97
ccauccggccgucgggca

SEQ ID NO: 3138175 - RNA, 16 nt, Mycobacterium bovis subsp bovis AF2122/97
ccauccggcggcggcc

SEQ ID NO: 3138176 - RNA, 19 nt, Mycobacterium bovis subsp bovis AF2122/97
ccauccggcggcggccagg

SEQ ID NO: 3138177 - RNA, 16 nt, Mycobacterium bovis subsp bovis AF2122/97
ccauccgggccgcggc

SEQ ID NO: 3138178 - RNA, 22 nt, Mycobacterium bovis subsp bovis AF2122/97
ccauccggucccgccgugccgc

SEQ ID NO: 3138179 - RNA, 23 nt, Mycobacterium bovis subsp bovis AF2122/97
ccauccgugaaucgagcaccgca

SEQ ID NO: 3138180 - RNA, 16 nt, Mycobacterium bovis subsp bovis AF2122/97
ccauccucgagcugcu

SEQ ID NO: 3138181 - RNA, 20 nt, Mycobacterium bovis subsp bovis AF2122/97
ccauccucgaguuuggccag

SEQ ID NO: 3138182 - RNA, 12 nt, Mycobacterium bovis subsp bovis AF2122/97
ccauccuggacg

SEQ ID NO: 3138183 - RNA, 15 nt, Mycobacterium bovis subsp bovis AF2122/97
ccaucgaccgcccgc

SEQ ID NO: 3138184 - RNA, 16 nt, Mycobacterium bovis subsp bovis AF2122/97
ccaucgaccgcccgcc

SEQ ID NO: 3138185 - RNA, 20 nt, Mycobacterium bovis subsp bovis AF2122/97
ccaucgaccgcccgccagcg

SEQ ID NO: 3138186 - RNA, 23 nt, Mycobacterium bovis subsp bovis AF2122/97
ccaucgaccuugagcacuccguc

SEQ ID NO: 3138187 - RNA, 13 nt, Mycobacterium bovis subsp bovis AF2122/97
ccaucgacgccgc

SEQ ID NO: 3138188 - RNA, 20 nt, Mycobacterium bovis subsp bovis AF2122/97
ccaucgaggcgaucaccgcg

SEQ ID NO: 3138189 - RNA, 23 nt, Mycobacterium bovis subsp bovis AF2122/97
ccaucgaggcgaucaccgcgccg

SEQ ID NO: 3138190 - RNA, 23 nt, Mycobacterium bovis subsp bovis AF2122/97
ccaucgcauccccagcacaacca

SEQ ID NO: 3138191 - RNA, 19 nt, Mycobacterium bovis subsp bovis AF2122/97
ccaucgccaacaccaacca

SEQ ID NO: 3138192 - RNA, 13 nt, Mycobacterium bovis subsp bovis AF2122/97
ccaucgccaccgc

SEQ ID NO: 3138193 - RNA, 14 nt, Mycobacterium bovis subsp bovis AF2122/97
ccaucgccaccgcg

SEQ ID NO: 3138194 - RNA, 15 nt, Mycobacterium bovis subsp bovis AF2122/97
ccaucgccaccgcgu

SEQ ID NO: 3138195 - RNA, 16 nt, Mycobacterium bovis subsp bovis AF2122/97
ccaucgccaccgcguc

SEQ ID NO: 3138196 - RNA, 17 nt, Mycobacterium bovis subsp bovis AF2122/97
ccaucgccaccgcguca

SEQ ID NO: 3138197 - RNA, 19 nt, Mycobacterium bovis subsp bovis AF2122/97
ccaucgccaccgcgucacu

SEQ ID NO: 3138198 - RNA, 22 nt, Mycobacterium bovis subsp bovis AF2122/97
ccaucgccaccgcgucacuucc

SEQ ID NO: 3138199 - RNA, 23 nt, Mycobacterium bovis subsp bovis AF2122/97
ccaucgccacuguugaagaagcc

SEQ ID NO: 3138200 - RNA, 21 nt, Mycobacterium bovis subsp bovis AF2122/97
ccaucgccagcaucagcccgg

SEQ ID NO: 3138201 - RNA, 14 nt, Mycobacterium bovis subsp bovis AF2122/97
ccaucgccagccgg

SEQ ID NO: 3138202 - RNA, 15 nt, Mycobacterium bovis subsp bovis AF2122/97
ccaucgccagccggc

SEQ ID NO: 3138203 - RNA, 16 nt, Mycobacterium bovis subsp bovis AF2122/97
ccaucgccagccggcg

SEQ ID NO: 3138204 - RNA, 20 nt, Mycobacterium bovis subsp bovis AF2122/97
ccaucgcccgaugcgccagc

SEQ ID NO: 3138205 - RNA, 23 nt, Mycobacterium bovis subsp bovis AF2122/97
ccaucgcccgaugcgccagcgua

SEQ ID NO: 3138206 - RNA, 12 nt, Mycobacterium bovis subsp bovis AF2122/97
ccaucgcccggu

SEQ ID NO: 3138207 - RNA, 16 nt, Mycobacterium bovis subsp bovis AF2122/97
ccaucgcccggugcgu

SEQ ID NO: 3138208 - RNA, 12 nt, Mycobacterium bovis subsp bovis AF2122/97
ccaucgccgccg

SEQ ID NO: 3138209 - RNA, 12 nt, Mycobacterium bovis subsp bovis AF2122/97
ccaucgccucca

SEQ ID NO: 3138210 - RNA, 18 nt, Mycobacterium bovis subsp bovis AF2122/97
ccaucgccuccagccggc

SEQ ID NO: 3138211 - RNA, 20 nt, Mycobacterium bovis subsp bovis AF2122/97
ccaucgccuccagccggcga

SEQ ID NO: 3138212 - RNA, 18 nt, Mycobacterium bovis subsp bovis AF2122/97
ccaucgccuggaugccga

SEQ ID NO: 3138213 - RNA, 18 nt, Mycobacterium bovis subsp bovis AF2122/97
ccaucgcgacaucggugg

SEQ ID NO: 3138214 - RNA, 22 nt, Mycobacterium bovis subsp bovis AF2122/97
ccaucgcgacaucgguggcggc

SEQ ID NO: 3138215 - RNA, 19 nt, Mycobacterium bovis subsp bovis AF2122/97
ccaucgcgacggcaagcac

SEQ ID NO: 3138216 - RNA, 17 nt, Mycobacterium bovis subsp bovis AF2122/97
ccaucgcgacggcccga

SEQ ID NO: 3138217 - RNA, 20 nt, Mycobacterium bovis subsp bovis AF2122/97
ccaucgcgacuagacgccgc

SEQ ID NO: 3138218 - RNA, 23 nt, Mycobacterium bovis subsp bovis AF2122/97
ccaucgcgacuagacgccgccgc

SEQ ID NO: 3138219 - RNA, 14 nt, Mycobacterium bovis subsp bovis AF2122/97
ccaucgcgcgccga

SEQ ID NO: 3138220 - RNA, 16 nt, Mycobacterium bovis subsp bovis AF2122/97
ccaucgcgcgccgacc

SEQ ID NO: 3138221 - RNA, 19 nt, Mycobacterium bovis subsp bovis AF2122/97
ccaucgcggaaccguacgc

SEQ ID NO: 3138222 - RNA, 18 nt, Mycobacterium bovis subsp bovis AF2122/97
ccaucgcggcguugugac

SEQ ID NO: 3138223 - RNA, 16 nt, Mycobacterium bovis subsp bovis AF2122/97
ccaucggcaccagcgc

SEQ ID NO: 3138224 - RNA, 20 nt, Mycobacterium bovis subsp bovis AF2122/97
ccaucggccuggugcucaac

SEQ ID NO: 3138225 - RNA, 19 nt, Mycobacterium bovis subsp bovis AF2122/97
ccaucggcuaggccggccg

SEQ ID NO: 3138226 - RNA, 13 nt, Mycobacterium bovis subsp bovis AF2122/97
ccaucgggaccgg

SEQ ID NO: 3138227 - RNA, 20 nt, Mycobacterium bovis subsp bovis AF2122/97
ccauggcacugccggcacgc

SEQ ID NO: 3138228 - RNA, 13 nt, Mycobacterium bovis subsp bovis AF2122/97
ccauggcagcgcc

SEQ ID NO: 3138229 - RNA, 14 nt, Mycobacterium bovis subsp bovis AF2122/97
ccauggccaccagg

SEQ ID NO: 3138230 - RNA, 13 nt, Mycobacterium bovis subsp bovis AF2122/97
ccauggccaccga

SEQ ID NO: 3138231 - RNA, 16 nt, Mycobacterium bovis subsp bovis AF2122/97
ccauggccaccgaacg

SEQ ID NO: 3138232 - RNA, 14 nt, Mycobacterium bovis subsp bovis AF2122/97
ccauggccagcgcu

SEQ ID NO: 3138233 - RNA, 12 nt, Mycobacterium bovis subsp bovis AF2122/97
ccauggccgauu

SEQ ID NO: 3138234 - RNA, 19 nt, Mycobacterium bovis subsp bovis AF2122/97
ccauggccucccacucacc

SEQ ID NO: 3138235 - RNA, 14 nt, Mycobacterium bovis subsp bovis AF2122/97
ccauggcgccgcgc

SEQ ID NO: 3138236 - RNA, 15 nt, Mycobacterium bovis subsp bovis AF2122/97
ccauggcgccgcgcc

SEQ ID NO: 3138237 - RNA, 16 nt, Mycobacterium bovis subsp bovis AF2122/97
ccauggcgccgcgccg

SEQ ID NO: 3138238 - RNA, 19 nt, Mycobacterium bovis subsp bovis AF2122/97
ccauggcgccgcgccgauu

SEQ ID NO: 3138239 - RNA, 14 nt, Mycobacterium bovis subsp bovis AF2122/97
ccauggcgcgcaac

SEQ ID NO: 3138240 - RNA, 17 nt, Mycobacterium bovis subsp bovis AF2122/97
ccauggcgugccccagu

SEQ ID NO: 3138241 - RNA, 20 nt, Mycobacterium bovis subsp bovis AF2122/97
ccauggcugugcccacgcgc

SEQ ID NO: 3138242 - RNA, 20 nt, Mycobacterium bovis subsp bovis AF2122/97
ccaugggaguucaucgcacg

SEQ ID NO: 3138243 - RNA, 16 nt, Mycobacterium bovis subsp bovis AF2122/97
ccaugggauucggcca

SEQ ID NO: 3138244 - RNA, 22 nt, Mycobacterium bovis subsp bovis AF2122/97
ccaugggcaauuaggucgacca

SEQ ID NO: 3138245 - RNA, 22 nt, Mycobacterium bovis subsp bovis AF2122/97
ccaugggucuggcaggccagca

SEQ ID NO: 3138246 - RNA, 20 nt, Mycobacterium bovis subsp bovis AF2122/97
ccauggucgcgccacccgcg

SEQ ID NO: 3138247 - RNA, 24 nt, Mycobacterium bovis subsp bovis AF2122/97
ccauggucggucaagucugucugg

SEQ ID NO: 3138248 - RNA, 18 nt, Mycobacterium bovis subsp bovis AF2122/97
ccauggugguauccaugu

SEQ ID NO: 3138249 - RNA, 20 nt, Mycobacterium bovis subsp bovis AF2122/97
ccaugguguucggcagcgcg

SEQ ID NO: 3138250 - RNA, 20 nt, Mycobacterium bovis subsp bovis AF2122/97
ccaugguugaugacggcguc

SEQ ID NO: 3138251 - RNA, 22 nt, Mycobacterium bovis subsp bovis AF2122/97
ccaugguugaugugcaggacgu

SEQ ID NO: 3138252 - RNA, 21 nt, Mycobacterium bovis subsp bovis AF2122/97
ccauguagccguugccgccga

SEQ ID NO: 3138253 - RNA, 21 nt, Mycobacterium bovis subsp bovis AF2122/97
ccauguauuucucccagccca

SEQ ID NO: 3138254 - RNA, 12 nt, Mycobacterium bovis subsp bovis AF2122/97
ccaugucaagcg

SEQ ID NO: 3138255 - RNA, 21 nt, Mycobacterium bovis subsp bovis AF2122/97
ccaugucagcggccugcucgg

SEQ ID NO: 3138256 - RNA, 14 nt, Mycobacterium bovis subsp bovis AF2122/97
ccaugucggccagg

SEQ ID NO: 3138257 - RNA, 16 nt, Mycobacterium bovis subsp bovis AF2122/97
ccaugucggcgcgccg

SEQ ID NO: 3138258 - RNA, 21 nt, Mycobacterium bovis subsp bovis AF2122/97
ccaugucggcgcgccgcacac

SEQ ID NO: 3138259 - RNA, 14 nt, Mycobacterium bovis subsp bovis AF2122/97
ccaugucggugacc

SEQ ID NO: 3138260 - RNA, 20 nt, Mycobacterium bovis subsp bovis AF2122/97
ccaugucggugaccguucgg

SEQ ID NO: 3138261 - RNA, 23 nt, Mycobacterium bovis subsp bovis AF2122/97
ccaugucggugaggaagcggccg

SEQ ID NO: 3138262 - RNA, 22 nt, Mycobacterium bovis subsp bovis AF2122/97
ccauguggcgucgcucgucguc

SEQ ID NO: 3138263 - RNA, 15 nt, Mycobacterium bovis subsp bovis AF2122/97
ccaugugucccggac

SEQ ID NO: 3138264 - RNA, 12 nt, Mycobacterium bovis subsp bovis AF2122/97
ccauguguuuga

SEQ ID NO: 3138265 - RNA, 17 nt, Mycobacterium bovis subsp bovis AF2122/97
ccauguguuugaucacc

SEQ ID NO: 3138266 - RNA, 15 nt, Mycobacterium bovis subsp bovis AF2122/97
ccauguucggagcca

SEQ ID NO: 3138267 - RNA, 18 nt, Mycobacterium bovis subsp bovis AF2122/97
ccauguugaaaaggcgcu

SEQ ID NO: 3138268 - RNA, 19 nt, Mycobacterium bovis subsp bovis AF2122/97
ccauguugaagcgaagcca

SEQ ID NO: 3138269 - RNA, 15 nt, Mycobacterium bovis subsp bovis AF2122/97
ccauguuggcgaaug

SEQ ID NO: 3138270 - RNA, 15 nt, Mycobacterium bovis subsp bovis AF2122/97
ccauuagcagcaccc

SEQ ID NO: 3138271 - RNA, 17 nt, Mycobacterium bovis subsp bovis AF2122/97
ccauuagcagcacccgg

SEQ ID NO: 3138272 - RNA, 17 nt, Mycobacterium bovis subsp bovis AF2122/97
ccauucacgagccgcuc

SEQ ID NO: 3138273 - RNA, 20 nt, Mycobacterium bovis subsp bovis AF2122/97
ccauuccagccggugccgcc

SEQ ID NO: 3138274 - RNA, 14 nt, Mycobacterium bovis subsp bovis AF2122/97
ccauuccaucgcgc

SEQ ID NO: 3138275 - RNA, 20 nt, Mycobacterium bovis subsp bovis AF2122/97
ccauucccaacacagccguc

SEQ ID NO: 3138276 - RNA, 18 nt, Mycobacterium bovis subsp bovis AF2122/97
ccauucccggacccacca

SEQ ID NO: 3138277 - RNA, 19 nt, Mycobacterium bovis subsp bovis AF2122/97
ccauucccggacccaccaa

SEQ ID NO: 3138278 - RNA, 17 nt, Mycobacterium bovis subsp bovis AF2122/97
ccauucgcgggccgagg

SEQ ID NO: 3138279 - RNA, 23 nt, Mycobacterium bovis subsp bovis AF2122/97
ccauucgcgguccaucagcacgg

SEQ ID NO: 3138280 - RNA, 17 nt, Mycobacterium bovis subsp bovis AF2122/97
ccauugacauugagguc

SEQ ID NO: 3138281 - RNA, 11 nt, Mycobacterium bovis subsp bovis AF2122/97
ccauugccaua

SEQ ID NO: 3138282 - RNA, 23 nt, Mycobacterium bovis subsp bovis AF2122/97
ccauugccauacagcaccccgcc

SEQ ID NO: 3138283 - RNA, 20 nt, Mycobacterium bovis subsp bovis AF2122/97
ccauugccgccggcgccgcc

SEQ ID NO: 3138284 - RNA, 22 nt, Mycobacterium bovis subsp bovis AF2122/97
ccauugccgccggugccgccga

SEQ ID NO: 3138285 - RNA, 14 nt, Mycobacterium bovis subsp bovis AF2122/97
ccauugccgccguc

SEQ ID NO: 3138286 - RNA, 19 nt, Mycobacterium bovis subsp bovis AF2122/97
ccauugccggauuuguauu

SEQ ID NO: 3138287 - RNA, 13 nt, Mycobacterium bovis subsp bovis AF2122/97
ccauugccucccg

SEQ ID NO: 3138288 - RNA, 20 nt, Mycobacterium bovis subsp bovis AF2122/97
ccauugccucccgcgccggc

SEQ ID NO: 3138289 - RNA, 21 nt, Mycobacterium bovis subsp bovis AF2122/97
ccauugccucccgcgccggcg

SEQ ID NO: 3138290 - RNA, 22 nt, Mycobacterium bovis subsp bovis AF2122/97
ccauugcgggcucaacaccagc

SEQ ID NO: 3138291 - RNA, 14 nt, Mycobacterium bovis subsp bovis AF2122/97
ccauuggcgccgcc

SEQ ID NO: 3138292 - RNA, 22 nt, Mycobacterium bovis subsp bovis AF2122/97
ccauugucgaucaccugcagca

SEQ ID NO: 3138293 - RNA, 20 nt, Mycobacterium bovis subsp bovis AF2122/97
ccauuguuccguccccgacg

SEQ ID NO: 3138294 - RNA, 23 nt, Mycobacterium bovis subsp bovis AF2122/97
ccauuucgagcucgaagcccgga

SEQ ID NO: 3138295 - RNA, 15 nt, Mycobacterium bovis subsp bovis AF2122/97
ccauuucgucagcga

SEQ ID NO: 3138296 - RNA, 17 nt, Mycobacterium bovis subsp bovis AF2122/97
ccauuucucguacccgg

SEQ ID NO: 3138297 - RNA, 16 nt, Mycobacterium bovis subsp bovis AF2122/97
ccauuuucgccaacuu

SEQ ID NO: 3138298 - RNA, 15 nt, Mycobacterium bovis subsp bovis AF2122/97
cccaaaaacggcagc

SEQ ID NO: 3138299 - RNA, 21 nt, Mycobacterium bovis subsp bovis AF2122/97
cccaaaaugccuuggcagccc

SEQ ID NO: 3138300 - RNA, 21 nt, Mycobacterium bovis subsp bovis AF2122/97
cccaaaccggcccgcagcagc

SEQ ID NO: 3138301 - RNA, 17 nt, Mycobacterium bovis subsp bovis AF2122/97
cccaaagcgccagcagc

SEQ ID NO: 3138302 - RNA, 22 nt, Mycobacterium bovis subsp bovis AF2122/97
cccaaaggcuguaacacccggc

SEQ ID NO: 3138303 - RNA, 12 nt, Mycobacterium bovis subsp bovis AF2122/97
cccaacacagcc

SEQ ID NO: 3138304 - RNA, 14 nt, Mycobacterium bovis subsp bovis AF2122/97
cccaacaccagcag

SEQ ID NO: 3138305 - RNA, 15 nt, Mycobacterium bovis subsp bovis AF2122/97
cccaacaccagcagc

SEQ ID NO: 3138306 - RNA, 15 nt, Mycobacterium bovis subsp bovis AF2122/97
cccaacaccgccaga

SEQ ID NO: 3138307 - RNA, 19 nt, Mycobacterium bovis subsp bovis AF2122/97
cccaacagcccaccggugc

SEQ ID NO: 3138308 - RNA, 13 nt, Mycobacterium bovis subsp bovis AF2122/97
cccaacagggcgg

SEQ ID NO: 3138309 - RNA, 18 nt, Mycobacterium bovis subsp bovis AF2122/97
cccaacagggcggcaggg

SEQ ID NO: 3138310 - RNA, 15 nt, Mycobacterium bovis subsp bovis AF2122/97
cccaacccauaucga

SEQ ID NO: 3138311 - RNA, 17 nt, Mycobacterium bovis subsp bovis AF2122/97
cccaaccccgccggccg

SEQ ID NO: 3138312 - RNA, 19 nt, Mycobacterium bovis subsp bovis AF2122/97
cccaacccuaaaccagcca

SEQ ID NO: 3138313 - RNA, 20 nt, Mycobacterium bovis subsp bovis AF2122/97
cccacccgcggcgccguugc

SEQ ID NO: 3138314 - RNA, 13 nt, Mycobacterium bovis subsp bovis AF2122/97
cccacccgcugcg

SEQ ID NO: 3138315 - RNA, 13 nt, Mycobacterium bovis subsp bovis AF2122/97
cccaccgaaaccg

SEQ ID NO: 3138316 - RNA, 19 nt, Mycobacterium bovis subsp bovis AF2122/97
cccaccgaaaccggucagc

SEQ ID NO: 3138317 - RNA, 21 nt, Mycobacterium bovis subsp bovis AF2122/97
cccaccgaagcggugacccac

SEQ ID NO: 3138318 - RNA, 23 nt, Mycobacterium bovis subsp bovis AF2122/97
cccaccgacaagaauggccgccu

SEQ ID NO: 3138319 - RNA, 21 nt, Mycobacterium bovis subsp bovis AF2122/97
cccaccgacagccccaucacc

SEQ ID NO: 3138320 - RNA, 21 nt, Mycobacterium bovis subsp bovis AF2122/97
cccaccgacauguguggcagc

SEQ ID NO: 3138321 - RNA, 23 nt, Mycobacterium bovis subsp bovis AF2122/97
cccaccgacauguguggcagccc

SEQ ID NO: 3138322 - RNA, 22 nt, Mycobacterium bovis subsp bovis AF2122/97
cccaccgcaacgcuucggcagc

SEQ ID NO: 3138323 - RNA, 20 nt, Mycobacterium bovis subsp bovis AF2122/97
cccaccgccccggcggcggc

SEQ ID NO: 3138324 - RNA, 22 nt, Mycobacterium bovis subsp bovis AF2122/97
cccaccgccguugggccgcgcc

SEQ ID NO: 3138325 - RNA, 13 nt, Mycobacterium bovis subsp bovis AF2122/97
cccaccgccuggg

SEQ ID NO: 3138326 - RNA, 12 nt, Mycobacterium bovis subsp bovis AF2122/97
cccaccgcgccg

SEQ ID NO: 3138327 - RNA, 13 nt, Mycobacterium bovis subsp bovis AF2122/97
cccaccgcgccga

SEQ ID NO: 3138328 - RNA, 17 nt, Mycobacterium bovis subsp bovis AF2122/97
cccaccgcgccgagcag

SEQ ID NO: 3138329 - RNA, 12 nt, Mycobacterium bovis subsp bovis AF2122/97
cccaccgcugcg

SEQ ID NO: 3138330 - RNA, 18 nt, Mycobacterium bovis subsp bovis AF2122/97
cccaccgcugcggcacca

SEQ ID NO: 3138331 - RNA, 12 nt, Mycobacterium bovis subsp bovis AF2122/97
cccaccggccac

SEQ ID NO: 3138332 - RNA, 16 nt, Mycobacterium bovis subsp bovis AF2122/97
cccaccggccaccagg

SEQ ID NO: 3138333 - RNA, 12 nt, Mycobacterium bovis subsp bovis AF2122/97
cccaccggcccg

SEQ ID NO: 3138334 - RNA, 15 nt, Mycobacterium bovis subsp bovis AF2122/97
cccaccggccggugc

SEQ ID NO: 3138335 - RNA, 13 nt, Mycobacterium bovis subsp bovis AF2122/97
cccaccggcgccg

SEQ ID NO: 3138336 - RNA, 19 nt, Mycobacterium bovis subsp bovis AF2122/97
cccaccggcuaugcuggcg

SEQ ID NO: 3138337 - RNA, 12 nt, Mycobacterium bovis subsp bovis AF2122/97
cccaccgggcgg

SEQ ID NO: 3138338 - RNA, 13 nt, Mycobacterium bovis subsp bovis AF2122/97
cccaccgggcggc

SEQ ID NO: 3138339 - RNA, 15 nt, Mycobacterium bovis subsp bovis AF2122/97
cccaccggucgccgc

SEQ ID NO: 3138340 - RNA, 13 nt, Mycobacterium bovis subsp bovis AF2122/97
cccaccggugccg

SEQ ID NO: 3138341 - RNA, 15 nt, Mycobacterium bovis subsp bovis AF2122/97
cccaccggugccgcc

SEQ ID NO: 3138342 - RNA, 17 nt, Mycobacterium bovis subsp bovis AF2122/97
cccaccggugccgcccg

SEQ ID NO: 3138343 - RNA, 22 nt, Mycobacterium bovis subsp bovis AF2122/97
cccaccggugccgcccgcgccg

SEQ ID NO: 3138344 - RNA, 14 nt, Mycobacterium bovis subsp bovis AF2122/97
cccaccgucacccc

SEQ ID NO: 3138345 - RNA, 22 nt, Mycobacterium bovis subsp bovis AF2122/97
cccaccgucgucguuucgccag

SEQ ID NO: 3138346 - RNA, 23 nt, Mycobacterium bovis subsp bovis AF2122/97
cccaccgucgucguuucgccagc

SEQ ID NO: 3138347 - RNA, 15 nt, Mycobacterium bovis subsp bovis AF2122/97
cccaccgucugcugg

SEQ ID NO: 3138348 - RNA, 18 nt, Mycobacterium bovis subsp bovis AF2122/97
cccaccgugccgggcgac

SEQ ID NO: 3138349 - RNA, 21 nt, Mycobacterium bovis subsp bovis AF2122/97
cccaccguugcgaagaagaag

SEQ ID NO: 3138350 - RNA, 18 nt, Mycobacterium bovis subsp bovis AF2122/97
cccaccguuugggcgccg

SEQ ID NO: 3138351 - RNA, 22 nt, Mycobacterium bovis subsp bovis AF2122/97
cccaccguuugggcgccggugu

SEQ ID NO: 3138352 - RNA, 16 nt, Mycobacterium bovis subsp bovis AF2122/97
cccaccucccgcagcc

SEQ ID NO: 3138353 - RNA, 17 nt, Mycobacterium bovis subsp bovis AF2122/97
cccaccucccgcagccg

SEQ ID NO: 3138354 - RNA, 18 nt, Mycobacterium bovis subsp bovis AF2122/97
cccaccucgaucgcgccg

SEQ ID NO: 3138355 - RNA, 22 nt, Mycobacterium bovis subsp bovis AF2122/97
cccaccucgaucgcgccgucgg

SEQ ID NO: 3138356 - RNA, 14 nt, Mycobacterium bovis subsp bovis AF2122/97
cccaccuggggccg

SEQ ID NO: 3138357 - RNA, 13 nt, Mycobacterium bovis subsp bovis AF2122/97
cccacgaauccca

SEQ ID NO: 3138358 - RNA, 19 nt, Mycobacterium bovis subsp bovis AF2122/97
cccacgacgaagucguugg

SEQ ID NO: 3138359 - RNA, 14 nt, Mycobacterium bovis subsp bovis AF2122/97
cccacgagagcgcu

SEQ ID NO: 3138360 - RNA, 21 nt, Mycobacterium bovis subsp bovis AF2122/97
cccacgagagcgcugucccga

SEQ ID NO: 3138361 - RNA, 12 nt, Mycobacterium bovis subsp bovis AF2122/97
cccacgauaggu

SEQ ID NO: 3138362 - RNA, 12 nt, Mycobacterium bovis subsp bovis AF2122/97
cccacgaucagc

SEQ ID NO: 3138363 - RNA, 19 nt, Mycobacterium bovis subsp bovis AF2122/97
cccacgaucagcagcgucg

SEQ ID NO: 3138364 - RNA, 14 nt, Mycobacterium bovis subsp bovis AF2122/97
cccacgccagcgcg

SEQ ID NO: 3138365 - RNA, 15 nt, Mycobacterium bovis subsp bovis AF2122/97
cccacgcccaauguc

SEQ ID NO: 3138366 - RNA, 13 nt, Mycobacterium bovis subsp bovis AF2122/97
cccacgcccggcc

SEQ ID NO: 3138367 - RNA, 12 nt, Mycobacterium bovis subsp bovis AF2122/97
cccacgccgccg

SEQ ID NO: 3138368 - RNA, 22 nt, Mycobacterium bovis subsp bovis AF2122/97
cccacgcugcccacgggccggc

SEQ ID NO: 3138369 - RNA, 15 nt, Mycobacterium bovis subsp bovis AF2122/97
cccacggcaccacca

SEQ ID NO: 3138370 - RNA, 14 nt, Mycobacterium bovis subsp bovis AF2122/97
cccacggcagcgcc

SEQ ID NO: 3138371 - RNA, 15 nt, Mycobacterium bovis subsp bovis AF2122/97
cccacggcagcgccg

SEQ ID NO: 3138372 - RNA, 12 nt, Mycobacterium bovis subsp bovis AF2122/97
cccacggccagu

SEQ ID NO: 3138373 - RNA, 13 nt, Mycobacterium bovis subsp bovis AF2122/97
cccacggccggcc

SEQ ID NO: 3138374 - RNA, 14 nt, Mycobacterium bovis subsp bovis AF2122/97
cccacggccggccg

SEQ ID NO: 3138375 - RNA, 17 nt, Mycobacterium bovis subsp bovis AF2122/97
cccacggcgaccacgcc

SEQ ID NO: 3138376 - RNA, 18 nt, Mycobacterium bovis subsp bovis AF2122/97
cccacggcgaccacgccg

SEQ ID NO: 3138377 - RNA, 23 nt, Mycobacterium bovis subsp bovis AF2122/97
cccacggcgagaaaaugacccac

SEQ ID NO: 3138378 - RNA, 19 nt, Mycobacterium bovis subsp bovis AF2122/97
cccacggcggguuccacac

SEQ ID NO: 3138379 - RNA, 18 nt, Mycobacterium bovis subsp bovis AF2122/97
cccacgggccggccgagc

SEQ ID NO: 3138380 - RNA, 16 nt, Mycobacterium bovis subsp bovis AF2122/97
cccacggugucccgcg

SEQ ID NO: 3138381 - RNA, 18 nt, Mycobacterium bovis subsp bovis AF2122/97
cccacggugucccgcgag

SEQ ID NO: 3138382 - RNA, 22 nt, Mycobacterium bovis subsp bovis AF2122/97
cccacggugucccgcgaggcaa

SEQ ID NO: 3138383 - RNA, 14 nt, Mycobacterium bovis subsp bovis AF2122/97
cccacgucgagcag

SEQ ID NO: 3138384 - RNA, 16 nt, Mycobacterium bovis subsp bovis AF2122/97
cccacgugcugccuuu

SEQ ID NO: 3138385 - RNA, 21 nt, Mycobacterium bovis subsp bovis AF2122/97
cccacguugaugaugccggcg

SEQ ID NO: 3138386 - RNA, 16 nt, Mycobacterium bovis subsp bovis AF2122/97
cccacguugcugaugc

SEQ ID NO: 3138387 - RNA, 22 nt, Mycobacterium bovis subsp bovis AF2122/97
cccacguugcugaugcccuugc

SEQ ID NO: 3138388 - RNA, 12 nt, Mycobacterium bovis subsp bovis AF2122/97
cccacguuggcc

SEQ ID NO: 3138389 - RNA, 13 nt, Mycobacterium bovis subsp bovis AF2122/97
cccacuccagcag

SEQ ID NO: 3138390 - RNA, 13 nt, Mycobacterium bovis subsp bovis AF2122/97
cccacucccgccc

SEQ ID NO: 3138391 - RNA, 13 nt, Mycobacterium bovis subsp bovis AF2122/97
cccacuccgccga

SEQ ID NO: 3138392 - RNA, 14 nt, Mycobacterium bovis subsp bovis AF2122/97
cccacucgcagcag

SEQ ID NO: 3138393 - RNA, 16 nt, Mycobacterium bovis subsp bovis AF2122/97
cccacucggacccgca

SEQ ID NO: 3138394 - RNA, 17 nt, Mycobacterium bovis subsp bovis AF2122/97
cccacucucgccacgcc

SEQ ID NO: 3138395 - RNA, 14 nt, Mycobacterium bovis subsp bovis AF2122/97
cccacugccacucc

SEQ ID NO: 3138396 - RNA, 13 nt, Mycobacterium bovis subsp bovis AF2122/97
cccacugcccgcc

SEQ ID NO: 3138397 - RNA, 15 nt, Mycobacterium bovis subsp bovis AF2122/97
cccacugcccgccga

SEQ ID NO: 3138398 - RNA, 17 nt, Mycobacterium bovis subsp bovis AF2122/97
cccacugcccgccgacg

SEQ ID NO: 3138399 - RNA, 16 nt, Mycobacterium bovis subsp bovis AF2122/97
cccacugccggugcug

SEQ ID NO: 3138400 - RNA, 20 nt, Mycobacterium bovis subsp bovis AF2122/97
cccagcgacgcggccagcgg

SEQ ID NO: 3138401 - RNA, 18 nt, Mycobacterium bovis subsp bovis AF2122/97
cccagcgacucggccagg

SEQ ID NO: 3138402 - RNA, 19 nt, Mycobacterium bovis subsp bovis AF2122/97
cccagcgacucggccagga

SEQ ID NO: 3138403 - RNA, 22 nt, Mycobacterium bovis subsp bovis AF2122/97
cccagcgacucggccaggauga

SEQ ID NO: 3138404 - RNA, 13 nt, Mycobacterium bovis subsp bovis AF2122/97
cccagcgagcgcc

SEQ ID NO: 3138405 - RNA, 23 nt, Mycobacterium bovis subsp bovis AF2122/97
cccagcgaggugggcgucaucga

SEQ ID NO: 3138406 - RNA, 21 nt, Mycobacterium bovis subsp bovis AF2122/97
cccagcgcacggaccaucgcc

SEQ ID NO: 3138407 - RNA, 15 nt, Mycobacterium bovis subsp bovis AF2122/97
cccagcgcagcagcg

SEQ ID NO: 3138408 - RNA, 17 nt, Mycobacterium bovis subsp bovis AF2122/97
cccagcgcagcagcggc

SEQ ID NO: 3138409 - RNA, 13 nt, Mycobacterium bovis subsp bovis AF2122/97
cccagcgccaccg

SEQ ID NO: 3138410 - RNA, 14 nt, Mycobacterium bovis subsp bovis AF2122/97
cccagcgcccccag

SEQ ID NO: 3138411 - RNA, 14 nt, Mycobacterium bovis subsp bovis AF2122/97
cccagcgcccgccg

SEQ ID NO: 3138412 - RNA, 17 nt, Mycobacterium bovis subsp bovis AF2122/97
cccagcgcccgccggca

SEQ ID NO: 3138413 - RNA, 17 nt, Mycobacterium bovis subsp bovis AF2122/97
cccagcgcccgcgcggc

SEQ ID NO: 3138414 - RNA, 20 nt, Mycobacterium bovis subsp bovis AF2122/97
cccagcgcccgcgcggccac

SEQ ID NO: 3138415 - RNA, 21 nt, Mycobacterium bovis subsp bovis AF2122/97
cccagcgcccgcgcggccacu

SEQ ID NO: 3138416 - RNA, 12 nt, Mycobacterium bovis subsp bovis AF2122/97
cccagcgcccgg

SEQ ID NO: 3138417 - RNA, 14 nt, Mycobacterium bovis subsp bovis AF2122/97
cccagcgcccggcc

SEQ ID NO: 3138418 - RNA, 16 nt, Mycobacterium bovis subsp bovis AF2122/97
cccagcgcccggccac

SEQ ID NO: 3138419 - RNA, 17 nt, Mycobacterium bovis subsp bovis AF2122/97
cccagcgcccggccacu

SEQ ID NO: 3138420 - RNA, 23 nt, Mycobacterium bovis subsp bovis AF2122/97
cccagcgcccggccacuccagua

SEQ ID NO: 3138421 - RNA, 15 nt, Mycobacterium bovis subsp bovis AF2122/97
cccagcgccgaccca

SEQ ID NO: 3138422 - RNA, 15 nt, Mycobacterium bovis subsp bovis AF2122/97
cccagcgccgcacag

SEQ ID NO: 3138423 - RNA, 21 nt, Mycobacterium bovis subsp bovis AF2122/97
cccagcgccgcaguggaugca

SEQ ID NO: 3138424 - RNA, 13 nt, Mycobacterium bovis subsp bovis AF2122/97
cccagcgccucca

SEQ ID NO: 3138425 - RNA, 15 nt, Mycobacterium bovis subsp bovis AF2122/97
cccagcgccuccagc

SEQ ID NO: 3138426 - RNA, 18 nt, Mycobacterium bovis subsp bovis AF2122/97
cccagcgccuccagcacc

SEQ ID NO: 3138427 - RNA, 22 nt, Mycobacterium bovis subsp bovis AF2122/97
cccagcgccuccagcaccacgg

SEQ ID NO: 3138428 - RNA, 14 nt, Mycobacterium bovis subsp bovis AF2122/97
cccagcgcggcaac

SEQ ID NO: 3138429 - RNA, 16 nt, Mycobacterium bovis subsp bovis AF2122/97
cccagcgcggcaacuc

SEQ ID NO: 3138430 - RNA, 14 nt, Mycobacterium bovis subsp bovis AF2122/97
cccagcgcuagccg

SEQ ID NO: 3138431 - RNA, 19 nt, Mycobacterium bovis subsp bovis AF2122/97
cccagcgcuuugaugccga

SEQ ID NO: 3138432 - RNA, 20 nt, Mycobacterium bovis subsp bovis AF2122/97
cccagcgcuuugaugccgau

SEQ ID NO: 3138433 - RNA, 15 nt, Mycobacterium bovis subsp bovis AF2122/97
cccagcggaaucacc

SEQ ID NO: 3138434 - RNA, 19 nt, Mycobacterium bovis subsp bovis AF2122/97
cccagcggagccacucggc

SEQ ID NO: 3138435 - RNA, 14 nt, Mycobacterium bovis subsp bovis AF2122/97
cccagcggccgcga

SEQ ID NO: 3138436 - RNA, 21 nt, Mycobacterium bovis subsp bovis AF2122/97
cccagcgggacaaaaucagca

SEQ ID NO: 3138437 - RNA, 23 nt, Mycobacterium bovis subsp bovis AF2122/97
cccagcgggacaaaaucagcagc

SEQ ID NO: 3138438 - RNA, 18 nt, Mycobacterium bovis subsp bovis AF2122/97
cccagcgguagccgagcu

SEQ ID NO: 3138439 - RNA, 20 nt, Mycobacterium bovis subsp bovis AF2122/97
cccagcgguagccgagcucg

SEQ ID NO: 3138440 - RNA, 18 nt, Mycobacterium bovis subsp bovis AF2122/97
cccagcgguaguccggcu

SEQ ID NO: 3138441 - RNA, 18 nt, Mycobacterium bovis subsp bovis AF2122/97
cccagcgguaucccccag

SEQ ID NO: 3138442 - RNA, 15 nt, Mycobacterium bovis subsp bovis AF2122/97
cccagcgugcccgcc

SEQ ID NO: 3138443 - RNA, 16 nt, Mycobacterium bovis subsp bovis AF2122/97
cccagcgugcccgcca

SEQ ID NO: 3138444 - RNA, 21 nt, Mycobacterium bovis subsp bovis AF2122/97
cccagcgugcccgccaccggc

SEQ ID NO: 3138445 - RNA, 20 nt, Mycobacterium bovis subsp bovis AF2122/97
cccagcgugucuugucgcgc

SEQ ID NO: 3138446 - RNA, 21 nt, Mycobacterium bovis subsp bovis AF2122/97
cccagcgugucuugucgcgca

SEQ ID NO: 3138447 - RNA, 19 nt, Mycobacterium bovis subsp bovis AF2122/97
cccagcguucccgccggcu

SEQ ID NO: 3138448 - RNA, 21 nt, Mycobacterium bovis subsp bovis AF2122/97
cccagcuagguccgaacuuga

SEQ ID NO: 3138449 - RNA, 14 nt, Mycobacterium bovis subsp bovis AF2122/97
cccagcucgcgcac

SEQ ID NO: 3138450 - RNA, 21 nt, Mycobacterium bovis subsp bovis AF2122/97
cccagcucgcgcacccagccc

SEQ ID NO: 3138451 - RNA, 18 nt, Mycobacterium bovis subsp bovis AF2122/97
cccagcucgucgacgucg

SEQ ID NO: 3138452 - RNA, 14 nt, Mycobacterium bovis subsp bovis AF2122/97
cccagcugcggucg

SEQ ID NO: 3138453 - RNA, 15 nt, Mycobacterium bovis subsp bovis AF2122/97
cccagcugggucccg

SEQ ID NO: 3138454 - RNA, 17 nt, Mycobacterium bovis subsp bovis AF2122/97
cccagcugucauccccg

SEQ ID NO: 3138455 - RNA, 15 nt, Mycobacterium bovis subsp bovis AF2122/97
cccaggaacgggacg

SEQ ID NO: 3138456 - RNA, 12 nt, Mycobacterium bovis subsp bovis AF2122/97
cccaggacaccu

SEQ ID NO: 3138457 - RNA, 14 nt, Mycobacterium bovis subsp bovis AF2122/97
cccaggacaccuug

SEQ ID NO: 3138458 - RNA, 15 nt, Mycobacterium bovis subsp bovis AF2122/97
cccaggacagcagcc

SEQ ID NO: 3138459 - RNA, 14 nt, Mycobacterium bovis subsp bovis AF2122/97
cccaggacuccggc

SEQ ID NO: 3138460 - RNA, 16 nt, Mycobacterium bovis subsp bovis AF2122/97
cccaggacuccggccg

SEQ ID NO: 3138461 - RNA, 23 nt, Mycobacterium bovis subsp bovis AF2122/97
cccaggacuccggccgcacgccg

SEQ ID NO: 3138462 - RNA, 17 nt, Mycobacterium bovis subsp bovis AF2122/97
cccaggagcaccucgaa

SEQ ID NO: 3138463 - RNA, 19 nt, Mycobacterium bovis subsp bovis AF2122/97
cccaggaucagcccggacg

SEQ ID NO: 3138464 - RNA, 12 nt, Mycobacterium bovis subsp bovis AF2122/97
cccaggaucgga

SEQ ID NO: 3138465 - RNA, 22 nt, Mycobacterium bovis subsp bovis AF2122/97
cccaggcacaacaucgccgcag

SEQ ID NO: 3138466 - RNA, 15 nt, Mycobacterium bovis subsp bovis AF2122/97
cccaggccgaucagc

SEQ ID NO: 3138467 - RNA, 21 nt, Mycobacterium bovis subsp bovis AF2122/97
cccaggccgaugugucgauga

SEQ ID NO: 3138468 - RNA, 19 nt, Mycobacterium bovis subsp bovis AF2122/97
cccaggccgcuugccccgc

SEQ ID NO: 3138469 - RNA, 15 nt, Mycobacterium bovis subsp bovis AF2122/97
cccaggccgucgcgc

SEQ ID NO: 3138470 - RNA, 12 nt, Mycobacterium bovis subsp bovis AF2122/97
cccaggcgaaca

SEQ ID NO: 3138471 - RNA, 17 nt, Mycobacterium bovis subsp bovis AF2122/97
cccaggcgaacagggcu

SEQ ID NO: 3138472 - RNA, 19 nt, Mycobacterium bovis subsp bovis AF2122/97
cccaggcgaacagggcugc

SEQ ID NO: 3138473 - RNA, 17 nt, Mycobacterium bovis subsp bovis AF2122/97
cccaggcgccgaugucg

SEQ ID NO: 3138474 - RNA, 18 nt, Mycobacterium bovis subsp bovis AF2122/97
cccaggcgcucagcgcgg

SEQ ID NO: 3138475 - RNA, 21 nt, Mycobacterium bovis subsp bovis AF2122/97
cccaggcgcucagcgcggcca

SEQ ID NO: 3138476 - RNA, 21 nt, Mycobacterium bovis subsp bovis AF2122/97
cccaggcgcucaucacccagc

SEQ ID NO: 3138477 - RNA, 22 nt, Mycobacterium bovis subsp bovis AF2122/97
cccaggcgcucaucacccagcg

SEQ ID NO: 3138478 - RNA, 20 nt, Mycobacterium bovis subsp bovis AF2122/97
cccaggcgcugccgguguug

SEQ ID NO: 3138479 - RNA, 19 nt, Mycobacterium bovis subsp bovis AF2122/97
cccaggcguuuggcgugcc

SEQ ID NO: 3138480 - RNA, 13 nt, Mycobacterium bovis subsp bovis AF2122/97
cccaggcucgcac

SEQ ID NO: 3138481 - RNA, 20 nt, Mycobacterium bovis subsp bovis AF2122/97
cccaggcugguccgggugcc

SEQ ID NO: 3138482 - RNA, 15 nt, Mycobacterium bovis subsp bovis AF2122/97
cccaggcuguccgac

SEQ ID NO: 3138483 - RNA, 16 nt, Mycobacterium bovis subsp bovis AF2122/97
cccagggagugccgca

SEQ ID NO: 3138484 - RNA, 18 nt, Mycobacterium bovis subsp bovis AF2122/97
cccagggagugccgcacg

SEQ ID NO: 3138485 - RNA, 15 nt, Mycobacterium bovis subsp bovis AF2122/97
cccagggcgucggcg

SEQ ID NO: 3138486 - RNA, 17 nt, Mycobacterium bovis subsp bovis AF2122/97
cccagggcucggcggcc

SEQ ID NO: 3138487 - RNA, 23 nt, Mycobacterium bovis subsp bovis AF2122/97
cccaugcgguuuggaucacccgc

SEQ ID NO: 3138488 - RNA, 19 nt, Mycobacterium bovis subsp bovis AF2122/97
cccaugucggcgcgccgca

SEQ ID NO: 3138489 - RNA, 20 nt, Mycobacterium bovis subsp bovis AF2122/97
cccaugucggcgcgccgcac

SEQ ID NO: 3138490 - RNA, 16 nt, Mycobacterium bovis subsp bovis AF2122/97
cccauucaucuugcgg

SEQ ID NO: 3138491 - RNA, 14 nt, Mycobacterium bovis subsp bovis AF2122/97
cccauucggcggcg

SEQ ID NO: 3138492 - RNA, 20 nt, Mycobacterium bovis subsp bovis AF2122/97
cccauucucggccggcggcg

SEQ ID NO: 3138493 - RNA, 12 nt, Mycobacterium bovis subsp bovis AF2122/97
cccauugccgcc

SEQ ID NO: 3138494 - RNA, 13 nt, Mycobacterium bovis subsp bovis AF2122/97
cccauugccgccg

SEQ ID NO: 3138495 - RNA, 18 nt, Mycobacterium bovis subsp bovis AF2122/97
cccauugccgccgucgcc

SEQ ID NO: 3138496 - RNA, 12 nt, Mycobacterium bovis subsp bovis AF2122/97
cccauuggaccg

SEQ ID NO: 3138497 - RNA, 23 nt, Mycobacterium bovis subsp bovis AF2122/97
cccauuggaccgagacuugcugg

SEQ ID NO: 3138498 - RNA, 21 nt, Mycobacterium bovis subsp bovis AF2122/97
cccauuggguaaccagcgcca

SEQ ID NO: 3138499 - RNA, 22 nt, Mycobacterium bovis subsp bovis AF2122/97
cccauugucgaucaccugcagc

SEQ ID NO: 3138500 - RNA, 13 nt, Mycobacterium bovis subsp bovis AF2122/97
cccauuucggcac

SEQ ID NO: 3138501 - RNA, 15 nt, Mycobacterium bovis subsp bovis AF2122/97
cccauuucggcccga

SEQ ID NO: 3138502 - RNA, 16 nt, Mycobacterium bovis subsp bovis AF2122/97
cccauuugccuugagc

SEQ ID NO: 3138503 - RNA, 23 nt, Mycobacterium bovis subsp bovis AF2122/97
cccauuugccuugagccgccccg

SEQ ID NO: 3138504 - RNA, 21 nt, Mycobacterium bovis subsp bovis AF2122/97
cccauuuugaacgcugcccaa

SEQ ID NO: 3138505 - RNA, 15 nt, Mycobacterium bovis subsp bovis AF2122/97
ccccaacagggcggc

SEQ ID NO: 3138506 - RNA, 13 nt, Mycobacterium bovis subsp bovis AF2122/97
ccccaacaucccg

SEQ ID NO: 3138507 - RNA, 21 nt, Mycobacterium bovis subsp bovis AF2122/97
ccccaacugcgaaacgccacc

SEQ ID NO: 3138508 - RNA, 14 nt, Mycobacterium bovis subsp bovis AF2122/97
ccccaagccaugug

SEQ ID NO: 3138509 - RNA, 15 nt, Mycobacterium bovis subsp bovis AF2122/97
ccccaagcccgauuc

SEQ ID NO: 3138510 - RNA, 18 nt, Mycobacterium bovis subsp bovis AF2122/97
ccccaagcgccugagcgg

SEQ ID NO: 3138511 - RNA, 14 nt, Mycobacterium bovis subsp bovis AF2122/97
ccccaagucgacgg

SEQ ID NO: 3138512 - RNA, 22 nt, Mycobacterium bovis subsp bovis AF2122/97
ccccaaucgaccgcccgccaac

SEQ ID NO: 3138513 - RNA, 19 nt, Mycobacterium bovis subsp bovis AF2122/97
ccccaauugaacgcaccaa

SEQ ID NO: 3138514 - RNA, 20 nt, Mycobacterium bovis subsp bovis AF2122/97
ccccacacgaagugggucaa

SEQ ID NO: 3138515 - RNA, 15 nt, Mycobacterium bovis subsp bovis AF2122/97
ccccacauggcccgg

SEQ ID NO: 3138516 - RNA, 13 nt, Mycobacterium bovis subsp bovis AF2122/97
ccccacccaccac

SEQ ID NO: 3138517 - RNA, 11 nt, Mycobacterium bovis subsp bovis AF2122/97
ccccacccgcg

SEQ ID NO: 3138518 - RNA, 15 nt, Mycobacterium bovis subsp bovis AF2122/97
ccccaccgaagcggu

SEQ ID NO: 3138519 - RNA, 15 nt, Mycobacterium bovis subsp bovis AF2122/97
ccccaccggaaucga

SEQ ID NO: 3138520 - RNA, 15 nt, Mycobacterium bovis subsp bovis AF2122/97
ccccaccggcacccc

SEQ ID NO: 3138521 - RNA, 13 nt, Mycobacterium bovis subsp bovis AF2122/97
ccccaccggcccg

SEQ ID NO: 3138522 - RNA, 16 nt, Mycobacterium bovis subsp bovis AF2122/97
ccccacgccugccgaa

SEQ ID NO: 3138523 - RNA, 12 nt, Mycobacterium bovis subsp bovis AF2122/97
ccccacggcccg

SEQ ID NO: 3138524 - RNA, 19 nt, Mycobacterium bovis subsp bovis AF2122/97
ccccacuggugcagcgccg

SEQ ID NO: 3138525 - RNA, 14 nt, Mycobacterium bovis subsp bovis AF2122/97
ccccacuugccggg

SEQ ID NO: 3138526 - RNA, 21 nt, Mycobacterium bovis subsp bovis AF2122/97
ccccacuugccgggcaaucgc

SEQ ID NO: 3138527 - RNA, 23 nt, Mycobacterium bovis subsp bovis AF2122/97
ccccacuugccgggcaaucgcuc

SEQ ID NO: 3138528 - RNA, 18 nt, Mycobacterium bovis subsp bovis AF2122/97
ccccagacaauccgccgc

SEQ ID NO: 3138529 - RNA, 12 nt, Mycobacterium bovis subsp bovis AF2122/97
ccccagaccgcc

SEQ ID NO: 3138530 - RNA, 16 nt, Mycobacterium bovis subsp bovis AF2122/97
ccccagaccgccacac

SEQ ID NO: 3138531 - RNA, 19 nt, Mycobacterium bovis subsp bovis AF2122/97
ccccagaccggcggcuacg

SEQ ID NO: 3138532 - RNA, 19 nt, Mycobacterium bovis subsp bovis AF2122/97
ccccagcacaaccagcugu

SEQ ID NO: 3138533 - RNA, 19 nt, Mycobacterium bovis subsp bovis AF2122/97
ccccagcacauucugcagc

SEQ ID NO: 3138534 - RNA, 13 nt, Mycobacterium bovis subsp bovis AF2122/97
ccccagcagcugc

SEQ ID NO: 3138535 - RNA, 19 nt, Mycobacterium bovis subsp bovis AF2122/97
ccccagcaguucgccgcgc

SEQ ID NO: 3138536 - RNA, 22 nt, Mycobacterium bovis subsp bovis AF2122/97
ccccagcaucuuuggcggccgc

SEQ ID NO: 3138537 - RNA, 13 nt, Mycobacterium bovis subsp bovis AF2122/97
ccccagccaugcu

SEQ ID NO: 3138538 - RNA, 12 nt, Mycobacterium bovis subsp bovis AF2122/97
ccccagccccac

SEQ ID NO: 3138539 - RNA, 13 nt, Mycobacterium bovis subsp bovis AF2122/97
ccccagccgcggc

SEQ ID NO: 3138540 - RNA, 17 nt, Mycobacterium bovis subsp bovis AF2122/97
ccccagccggcagcagc

SEQ ID NO: 3138541 - RNA, 13 nt, Mycobacterium bovis subsp bovis AF2122/97
ccccagcgacggc

SEQ ID NO: 3138542 - RNA, 15 nt, Mycobacterium bovis subsp bovis AF2122/97
ccccagcgacggcaa

SEQ ID NO: 3138543 - RNA, 12 nt, Mycobacterium bovis subsp bovis AF2122/97
ccccagcgacgu

SEQ ID NO: 3138544 - RNA, 15 nt, Mycobacterium bovis subsp bovis AF2122/97
ccccagcgccgccgc

SEQ ID NO: 3138545 - RNA, 16 nt, Mycobacterium bovis subsp bovis AF2122/97
ccccagcggccaccga

SEQ ID NO: 3138546 - RNA, 20 nt, Mycobacterium bovis subsp bovis AF2122/97
ccccagcgguuuccgcacga

SEQ ID NO: 3138547 - RNA, 15 nt, Mycobacterium bovis subsp bovis AF2122/97
ccccagcugcagggc

SEQ ID NO: 3138548 - RNA, 17 nt, Mycobacterium bovis subsp bovis AF2122/97
ccccagcugcggucgcg

SEQ ID NO: 3138549 - RNA, 19 nt, Mycobacterium bovis subsp bovis AF2122/97
ccccagcugcggucgcggc

SEQ ID NO: 3138550 - RNA, 21 nt, Mycobacterium bovis subsp bovis AF2122/97
ccccaggccgcuugccccgcc

SEQ ID NO: 3138551 - RNA, 16 nt, Mycobacterium bovis subsp bovis AF2122/97
ccccaggcgcucagcg

SEQ ID NO: 3138552 - RNA, 22 nt, Mycobacterium bovis subsp bovis AF2122/97
ccccaggcgcucaucacccagc

SEQ ID NO: 3138553 - RNA, 15 nt, Mycobacterium bovis subsp bovis AF2122/97
ccccagggagugccg

SEQ ID NO: 3138554 - RNA, 20 nt, Mycobacterium bovis subsp bovis AF2122/97
ccccagggagugccgcacga

SEQ ID NO: 3138555 - RNA, 21 nt, Mycobacterium bovis subsp bovis AF2122/97
ccccaggugggcagcaggccc

SEQ ID NO: 3138556 - RNA, 14 nt, Mycobacterium bovis subsp bovis AF2122/97
ccccagugcacgcu

SEQ ID NO: 3138557 - RNA, 19 nt, Mycobacterium bovis subsp bovis AF2122/97
ccccagugcacgcucggcg

SEQ ID NO: 3138558 - RNA, 11 nt, Mycobacterium bovis subsp bovis AF2122/97
ccccagugcuc

SEQ ID NO: 3138559 - RNA, 18 nt, Mycobacterium bovis subsp bovis AF2122/97
ccccaguucgacggcguc

SEQ ID NO: 3138560 - RNA, 19 nt, Mycobacterium bovis subsp bovis AF2122/97
ccccaguugugcggccagg

SEQ ID NO: 3138561 - RNA, 21 nt, Mycobacterium bovis subsp bovis AF2122/97
ccccaguugugcggccaggcg

SEQ ID NO: 3138562 - RNA, 23 nt, Mycobacterium bovis subsp bovis AF2122/97
ccccauaaacucuguggugucga

SEQ ID NO: 3138563 - RNA, 20 nt, Mycobacterium bovis subsp bovis AF2122/97
ccccauacucggcggcuucg

SEQ ID NO: 3138564 - RNA, 23 nt, Mycobacterium bovis subsp bovis AF2122/97
ccccauaguuguuccuggucgag

SEQ ID NO: 3138565 - RNA, 17 nt, Mycobacterium bovis subsp bovis AF2122/97
ccccaucaccaccggca

SEQ ID NO: 3138566 - RNA, 21 nt, Mycobacterium bovis subsp bovis AF2122/97
ccccaucagaaugccuggccc

SEQ ID NO: 3138567 - RNA, 14 nt, Mycobacterium bovis subsp bovis AF2122/97
ccccaugaccggga

SEQ ID NO: 3138568 - RNA, 18 nt, Mycobacterium bovis subsp bovis AF2122/97
ccccaugaucuggugcgc

SEQ ID NO: 3138569 - RNA, 16 nt, Mycobacterium bovis subsp bovis AF2122/97
ccccaugccgaccggc

SEQ ID NO: 3138570 - RNA, 18 nt, Mycobacterium bovis subsp bovis AF2122/97
ccccaugccgaccggcac

SEQ ID NO: 3138571 - RNA, 20 nt, Mycobacterium bovis subsp bovis AF2122/97
ccccaugcgccagcgagcgc

SEQ ID NO: 3138572 - RNA, 16 nt, Mycobacterium bovis subsp bovis AF2122/97
ccccaugcgguuugga

SEQ ID NO: 3138573 - RNA, 15 nt, Mycobacterium bovis subsp bovis AF2122/97
ccccauggccaccga

SEQ ID NO: 3138574 - RNA, 12 nt, Mycobacterium bovis subsp bovis AF2122/97
ccccgccggaca

SEQ ID NO: 3138575 - RNA, 13 nt, Mycobacterium bovis subsp bovis AF2122/97
ccccgccggccgc

SEQ ID NO: 3138576 - RNA, 16 nt, Mycobacterium bovis subsp bovis AF2122/97
ccccgccggccgcgcc

SEQ ID NO: 3138577 - RNA, 12 nt, Mycobacterium bovis subsp bovis AF2122/97
ccccgccggccu

SEQ ID NO: 3138578 - RNA, 13 nt, Mycobacterium bovis subsp bovis AF2122/97
ccccgccggcgcc

SEQ ID NO: 3138579 - RNA, 22 nt, Mycobacterium bovis subsp bovis AF2122/97
ccccgccggcgccaccgucacc

SEQ ID NO: 3138580 - RNA, 13 nt, Mycobacterium bovis subsp bovis AF2122/97
ccccgccguaccg

SEQ ID NO: 3138581 - RNA, 10 nt, Mycobacterium bovis subsp bovis AF2122/97
ccccgccguc

SEQ ID NO: 3138582 - RNA, 14 nt, Mycobacterium bovis subsp bovis AF2122/97
ccccgccgucaccg

SEQ ID NO: 3138583 - RNA, 15 nt, Mycobacterium bovis subsp bovis AF2122/97
ccccgccgucgccac

SEQ ID NO: 3138584 - RNA, 10 nt, Mycobacterium bovis subsp bovis AF2122/97
ccccgccguu

SEQ ID NO: 3138585 - RNA, 14 nt, Mycobacterium bovis subsp bovis AF2122/97
ccccgccguuaccg

SEQ ID NO: 3138586 - RNA, 23 nt, Mycobacterium bovis subsp bovis AF2122/97
ccccgccguugccgccgacgccg

SEQ ID NO: 3138587 - RNA, 12 nt, Mycobacterium bovis subsp bovis AF2122/97
ccccgccuuggc

SEQ ID NO: 3138588 - RNA, 16 nt, Mycobacterium bovis subsp bovis AF2122/97
ccccgcgccggccgca

SEQ ID NO: 3138589 - RNA, 13 nt, Mycobacterium bovis subsp bovis AF2122/97
ccccgcgccugcc

SEQ ID NO: 3138590 - RNA, 12 nt, Mycobacterium bovis subsp bovis AF2122/97
ccccgcgcugag

SEQ ID NO: 3138591 - RNA, 13 nt, Mycobacterium bovis subsp bovis AF2122/97
ccccgcggccagc

SEQ ID NO: 3138592 - RNA, 12 nt, Mycobacterium bovis subsp bovis AF2122/97
ccccgcggcggu

SEQ ID NO: 3138593 - RNA, 23 nt, Mycobacterium bovis subsp bovis AF2122/97
ccccgcguguccuuugccaccuc

SEQ ID NO: 3138594 - RNA, 15 nt, Mycobacterium bovis subsp bovis AF2122/97
ccccgcuacgcgcgc

SEQ ID NO: 3138595 - RNA, 21 nt, Mycobacterium bovis subsp bovis AF2122/97
ccccgcuacgcgcgcucgcuc

SEQ ID NO: 3138596 - RNA, 19 nt, Mycobacterium bovis subsp bovis AF2122/97
ccccgcucgaccagacgcu

SEQ ID NO: 3138597 - RNA, 18 nt, Mycobacterium bovis subsp bovis AF2122/97
ccccgcuggucgaccggc

SEQ ID NO: 3138598 - RNA, 17 nt, Mycobacterium bovis subsp bovis AF2122/97
ccccggaacgaccccac

SEQ ID NO: 3138599 - RNA, 16 nt, Mycobacterium bovis subsp bovis AF2122/97
ccccggacggcaggcu

SEQ ID NO: 3138600 - RNA, 22 nt, Mycobacterium bovis subsp bovis AF2122/97
ccccggcaaccgggaucugcuc

SEQ ID NO: 3138601 - RNA, 15 nt, Mycobacterium bovis subsp bovis AF2122/97
ccccggcaccgccgg

SEQ ID NO: 3138602 - RNA, 13 nt, Mycobacterium bovis subsp bovis AF2122/97
ccccggcagcgcc

SEQ ID NO: 3138603 - RNA, 22 nt, Mycobacterium bovis subsp bovis AF2122/97
ccccggcauugcccgagcccag

SEQ ID NO: 3138604 - RNA, 12 nt, Mycobacterium bovis subsp bovis AF2122/97
ccccggccacca

SEQ ID NO: 3138605 - RNA, 12 nt, Mycobacterium bovis subsp bovis AF2122/97
ccccggccagcc

SEQ ID NO: 3138606 - RNA, 14 nt, Mycobacterium bovis subsp bovis AF2122/97
ccccggccagccuc

SEQ ID NO: 3138607 - RNA, 12 nt, Mycobacterium bovis subsp bovis AF2122/97
ccccggccagga

SEQ ID NO: 3138608 - RNA, 14 nt, Mycobacterium bovis subsp bovis AF2122/97
ccccggccccgacg

SEQ ID NO: 3138609 - RNA, 12 nt, Mycobacterium bovis subsp bovis AF2122/97
ccccggccggcu

SEQ ID NO: 3138610 - RNA, 14 nt, Mycobacterium bovis subsp bovis AF2122/97
ccccggccuugcca

SEQ ID NO: 3138611 - RNA, 16 nt, Mycobacterium bovis subsp bovis AF2122/97
ccccggccuuggcggc

SEQ ID NO: 3138612 - RNA, 17 nt, Mycobacterium bovis subsp bovis AF2122/97
ccccggcgcggccagcu

SEQ ID NO: 3138613 - RNA, 13 nt, Mycobacterium bovis subsp bovis AF2122/97
ccccggcggcagc

SEQ ID NO: 3138614 - RNA, 14 nt, Mycobacterium bovis subsp bovis AF2122/97
ccccggcggccauc

SEQ ID NO: 3138615 - RNA, 13 nt, Mycobacterium bovis subsp bovis AF2122/97
ccccggcggucag

SEQ ID NO: 3138616 - RNA, 20 nt, Mycobacterium bovis subsp bovis AF2122/97
ccccggcguccgaccgguac

SEQ ID NO: 3138617 - RNA, 18 nt, Mycobacterium bovis subsp bovis AF2122/97
ccccggcucucuucgcgc

SEQ ID NO: 3138618 - RNA, 14 nt, Mycobacterium bovis subsp bovis AF2122/97
ccccggcugccagc

SEQ ID NO: 3138619 - RNA, 17 nt, Mycobacterium bovis subsp bovis AF2122/97
ccccggcugccagcgcc

SEQ ID NO: 3138620 - RNA, 18 nt, Mycobacterium bovis subsp bovis AF2122/97
ccccggcugccagcgccg

SEQ ID NO: 3138621 - RNA, 12 nt, Mycobacterium bovis subsp bovis AF2122/97
ccccgggcgccg

SEQ ID NO: 3138622 - RNA, 11 nt, Mycobacterium bovis subsp bovis AF2122/97
ccccgggcggu

SEQ ID NO: 3138623 - RNA, 13 nt, Mycobacterium bovis subsp bovis AF2122/97
ccccgggcgguga

SEQ ID NO: 3138624 - RNA, 16 nt, Mycobacterium bovis subsp bovis AF2122/97
ccccggggccgcaacc

SEQ ID NO: 3138625 - RNA, 14 nt, Mycobacterium bovis subsp bovis AF2122/97
ccccggggguccac

SEQ ID NO: 3138626 - RNA, 13 nt, Mycobacterium bovis subsp bovis AF2122/97
ccccggguccgcc

SEQ ID NO: 3138627 - RNA, 14 nt, Mycobacterium bovis subsp bovis AF2122/97
ccccgguagccccg

SEQ ID NO: 3138628 - RNA, 20 nt, Mycobacterium bovis subsp bovis AF2122/97
ccccgguagccccgucgacc

SEQ ID NO: 3138629 - RNA, 24 nt, Mycobacterium bovis subsp bovis AF2122/97
ccccggucaggacggcacccgacu

SEQ ID NO: 3138630 - RNA, 15 nt, Mycobacterium bovis subsp bovis AF2122/97
ccccggucccgccga

SEQ ID NO: 3138631 - RNA, 18 nt, Mycobacterium bovis subsp bovis AF2122/97
ccccggucgaggucggcg

SEQ ID NO: 3138632 - RNA, 15 nt, Mycobacterium bovis subsp bovis AF2122/97
ccccggucggcccgc

SEQ ID NO: 3138633 - RNA, 16 nt, Mycobacterium bovis subsp bovis AF2122/97
ccccggucggcccgcg

SEQ ID NO: 3138634 - RNA, 15 nt, Mycobacterium bovis subsp bovis AF2122/97
ccccggucggcgacg

SEQ ID NO: 3138635 - RNA, 21 nt, Mycobacterium bovis subsp bovis AF2122/97
ccccggucggcgacguauacc

SEQ ID NO: 3138636 - RNA, 18 nt, Mycobacterium bovis subsp bovis AF2122/97
ccccggugcagaugcggc

SEQ ID NO: 3138637 - RNA, 17 nt, Mycobacterium bovis subsp bovis AF2122/97
ccccggugcccgcggug

SEQ ID NO: 3138638 - RNA, 12 nt, Mycobacterium bovis subsp bovis AF2122/97
ccccggugccgc

SEQ ID NO: 3138639 - RNA, 23 nt, Mycobacterium bovis subsp bovis AF2122/97
ccccggugccguuggagccgcca

SEQ ID NO: 3138640 - RNA, 15 nt, Mycobacterium bovis subsp bovis AF2122/97
ccccgguucugcgcc

SEQ ID NO: 3138641 - RNA, 19 nt, Mycobacterium bovis subsp bovis AF2122/97
ccccgguugacucgcuccg

SEQ ID NO: 3138642 - RNA, 22 nt, Mycobacterium bovis subsp bovis AF2122/97
ccccgguugaucuuguccuccg

SEQ ID NO: 3138643 - RNA, 21 nt, Mycobacterium bovis subsp bovis AF2122/97
ccccguaaauaucggggccac

SEQ ID NO: 3138644 - RNA, 17 nt, Mycobacterium bovis subsp bovis AF2122/97
ccccguaggcgccgaac

SEQ ID NO: 3138645 - RNA, 18 nt, Mycobacterium bovis subsp bovis AF2122/97
ccccguaggugcacaacc

SEQ ID NO: 3138646 - RNA, 23 nt, Mycobacterium bovis subsp bovis AF2122/97
ccccguaggugcacaacccgugc

SEQ ID NO: 3138647 - RNA, 17 nt, Mycobacterium bovis subsp bovis AF2122/97
ccccgucagcgggcagc

SEQ ID NO: 3138648 - RNA, 18 nt, Mycobacterium bovis subsp bovis AF2122/97
ccccgucagcgggcagca

SEQ ID NO: 3138649 - RNA, 14 nt, Mycobacterium bovis subsp bovis AF2122/97
ccccgucgaccucc

SEQ ID NO: 3138650 - RNA, 17 nt, Mycobacterium bovis subsp bovis AF2122/97
ccccgucgaccuccacc

SEQ ID NO: 3138651 - RNA, 14 nt, Mycobacterium bovis subsp bovis AF2122/97
ccccgucgaucagc

SEQ ID NO: 3138652 - RNA, 17 nt, Mycobacterium bovis subsp bovis AF2122/97
ccccgucgaucagcggc

SEQ ID NO: 3138653 - RNA, 13 nt, Mycobacterium bovis subsp bovis AF2122/97
ccccgucgccacc

SEQ ID NO: 3138654 - RNA, 14 nt, Mycobacterium bovis subsp bovis AF2122/97
ccccgucgccaccg

SEQ ID NO: 3138655 - RNA, 15 nt, Mycobacterium bovis subsp bovis AF2122/97
ccccgucgccaccga

SEQ ID NO: 3138656 - RNA, 16 nt, Mycobacterium bovis subsp bovis AF2122/97
ccccgucgccaccgau

SEQ ID NO: 3138657 - RNA, 13 nt, Mycobacterium bovis subsp bovis AF2122/97
ccccgucgccagg

SEQ ID NO: 3138658 - RNA, 13 nt, Mycobacterium bovis subsp bovis AF2122/97
ccccgucgcuggc

SEQ ID NO: 3138659 - RNA, 13 nt, Mycobacterium bovis subsp bovis AF2122/97
ccccgucugcgug

SEQ ID NO: 3138660 - RNA, 12 nt, Mycobacterium bovis subsp bovis AF2122/97
ccccguugccgc

SEQ ID NO: 3138661 - RNA, 21 nt, Mycobacterium bovis subsp bovis AF2122/97
ccccguugccgccguugccgc

SEQ ID NO: 3138662 - RNA, 15 nt, Mycobacterium bovis subsp bovis AF2122/97
cccgaccgccaccgc

SEQ ID NO: 3138663 - RNA, 16 nt, Mycobacterium bovis subsp bovis AF2122/97
cccgaccgccaccgcc

SEQ ID NO: 3138664 - RNA, 12 nt, Mycobacterium bovis subsp bovis AF2122/97
cccgaccgccau

SEQ ID NO: 3138665 - RNA, 12 nt, Mycobacterium bovis subsp bovis AF2122/97
cccgaccgccga

SEQ ID NO: 3138666 - RNA, 12 nt, Mycobacterium bovis subsp bovis AF2122/97
cccgaccgcugg

SEQ ID NO: 3138667 - RNA, 15 nt, Mycobacterium bovis subsp bovis AF2122/97
cccgaccgggaacca

SEQ ID NO: 3138668 - RNA, 22 nt, Mycobacterium bovis subsp bovis AF2122/97
cccgacgaccauucgagagccu

SEQ ID NO: 3138669 - RNA, 21 nt, Mycobacterium bovis subsp bovis AF2122/97
cccgacgacggcaccgaugca

SEQ ID NO: 3138670 - RNA, 22 nt, Mycobacterium bovis subsp bovis AF2122/97
cccgacgacguauucguugggg

SEQ ID NO: 3138671 - RNA, 20 nt, Mycobacterium bovis subsp bovis AF2122/97
cccgacgagauacggccacc

SEQ ID NO: 3138672 - RNA, 12 nt, Mycobacterium bovis subsp bovis AF2122/97
cccgacgagauu

SEQ ID NO: 3138673 - RNA, 21 nt, Mycobacterium bovis subsp bovis AF2122/97
cccgacgagauugccgggccg

SEQ ID NO: 3138674 - RNA, 16 nt, Mycobacterium bovis subsp bovis AF2122/97
cccgacgaggaugucg

SEQ ID NO: 3138675 - RNA, 13 nt, Mycobacterium bovis subsp bovis AF2122/97
cccgacgagucgc

SEQ ID NO: 3138676 - RNA, 23 nt, Mycobacterium bovis subsp bovis AF2122/97
cccgacgagucgccgcgggcagc

SEQ ID NO: 3138677 - RNA, 12 nt, Mycobacterium bovis subsp bovis AF2122/97
cccgacgcagcu

SEQ ID NO: 3138678 - RNA, 21 nt, Mycobacterium bovis subsp bovis AF2122/97
cccgacgcagcuugcccgacg

SEQ ID NO: 3138679 - RNA, 12 nt, Mycobacterium bovis subsp bovis AF2122/97
cccgacgccacg

SEQ ID NO: 3138680 - RNA, 18 nt, Mycobacterium bovis subsp bovis AF2122/97
cccgacgccagcugcccg

SEQ ID NO: 3138681 - RNA, 13 nt, Mycobacterium bovis subsp bovis AF2122/97
cccgacgccgguc

SEQ ID NO: 3138682 - RNA, 20 nt, Mycobacterium bovis subsp bovis AF2122/97
cccgacgcgaagcugagcac

SEQ ID NO: 3138683 - RNA, 21 nt, Mycobacterium bovis subsp bovis AF2122/97
cccgacggacuccggccggcc

SEQ ID NO: 3138684 - RNA, 13 nt, Mycobacterium bovis subsp bovis AF2122/97
cccgacggcgccc

SEQ ID NO: 3138685 - RNA, 18 nt, Mycobacterium bovis subsp bovis AF2122/97
cccgacggugaaccacca

SEQ ID NO: 3138686 - RNA, 22 nt, Mycobacterium bovis subsp bovis AF2122/97
cccgacguagccguacgguccg

SEQ ID NO: 3138687 - RNA, 15 nt, Mycobacterium bovis subsp bovis AF2122/97
cccgacgucgcggag

SEQ ID NO: 3138688 - RNA, 23 nt, Mycobacterium bovis subsp bovis AF2122/97
cccgacgucgcggaguagccgca

SEQ ID NO: 3138689 - RNA, 19 nt, Mycobacterium bovis subsp bovis AF2122/97
cccgacguugccgaagccg

SEQ ID NO: 3138690 - RNA, 22 nt, Mycobacterium bovis subsp bovis AF2122/97
cccgacuccggcaggcccgacg

SEQ ID NO: 3138691 - RNA, 22 nt, Mycobacterium bovis subsp bovis AF2122/97
cccgacuguagaaaacccguau

SEQ ID NO: 3138692 - RNA, 19 nt, Mycobacterium bovis subsp bovis AF2122/97
cccgacuucaagacagccg

SEQ ID NO: 3138693 - RNA, 16 nt, Mycobacterium bovis subsp bovis AF2122/97
cccgagaguggacgug

SEQ ID NO: 3138694 - RNA, 18 nt, Mycobacterium bovis subsp bovis AF2122/97
cccgagaucaccgguacg

SEQ ID NO: 3138695 - RNA, 20 nt, Mycobacterium bovis subsp bovis AF2122/97
cccgagccacaaaggcgccg

SEQ ID NO: 3138696 - RNA, 16 nt, Mycobacterium bovis subsp bovis AF2122/97
cccgagccaucaccgc

SEQ ID NO: 3138697 - RNA, 22 nt, Mycobacterium bovis subsp bovis AF2122/97
cccgagcccagccgggcacccu

SEQ ID NO: 3138698 - RNA, 23 nt, Mycobacterium bovis subsp bovis AF2122/97
cccgagcccagcgccuccagcac

SEQ ID NO: 3138699 - RNA, 18 nt, Mycobacterium bovis subsp bovis AF2122/97
cccgagccgcagcucgcc

SEQ ID NO: 3138700 - RNA, 18 nt, Mycobacterium bovis subsp bovis AF2122/97
cccgagccgguaaccgcg

SEQ ID NO: 3138701 - RNA, 15 nt, Mycobacterium bovis subsp bovis AF2122/97
cccgagccggugcca

SEQ ID NO: 3138702 - RNA, 14 nt, Mycobacterium bovis subsp bovis AF2122/97
cccgagcgcgcgcu

SEQ ID NO: 3138703 - RNA, 16 nt, Mycobacterium bovis subsp bovis AF2122/97
cccgagcgcgcgcugu

SEQ ID NO: 3138704 - RNA, 20 nt, Mycobacterium bovis subsp bovis AF2122/97
cccgagcggagccgccgacu

SEQ ID NO: 3138705 - RNA, 19 nt, Mycobacterium bovis subsp bovis AF2122/97
cccgagcggcugagccgca

SEQ ID NO: 3138706 - RNA, 17 nt, Mycobacterium bovis subsp bovis AF2122/97
cccgagcucaccgcaca

SEQ ID NO: 3138707 - RNA, 20 nt, Mycobacterium bovis subsp bovis AF2122/97
cccgagcuccgcggcgagcu

SEQ ID NO: 3138708 - RNA, 13 nt, Mycobacterium bovis subsp bovis AF2122/97
cccgagcucgccg

SEQ ID NO: 3138709 - RNA, 14 nt, Mycobacterium bovis subsp bovis AF2122/97
cccgagcucgccgc

SEQ ID NO: 3138710 - RNA, 18 nt, Mycobacterium bovis subsp bovis AF2122/97
cccgagcucgccgcagcg

SEQ ID NO: 3138711 - RNA, 15 nt, Mycobacterium bovis subsp bovis AF2122/97
cccgagcucgggugc

SEQ ID NO: 3138712 - RNA, 17 nt, Mycobacterium bovis subsp bovis AF2122/97
cccgagcugccaacgcc

SEQ ID NO: 3138713 - RNA, 17 nt, Mycobacterium bovis subsp bovis AF2122/97
cccgaggcaacaagcac

SEQ ID NO: 3138714 - RNA, 12 nt, Mycobacterium bovis subsp bovis AF2122/97
cccgaggcaacg

SEQ ID NO: 3138715 - RNA, 18 nt, Mycobacterium bovis subsp bovis AF2122/97
cccgaggcgagacgcucc

SEQ ID NO: 3138716 - RNA, 13 nt, Mycobacterium bovis subsp bovis AF2122/97
cccgaggcgccca

SEQ ID NO: 3138717 - RNA, 21 nt, Mycobacterium bovis subsp bovis AF2122/97
cccgaggcgcccaacaggcgg

SEQ ID NO: 3138718 - RNA, 16 nt, Mycobacterium bovis subsp bovis AF2122/97
cccgaggcucgggccg

SEQ ID NO: 3138719 - RNA, 15 nt, Mycobacterium bovis subsp bovis AF2122/97
cccgaggcucgugcg

SEQ ID NO: 3138720 - RNA, 15 nt, Mycobacterium bovis subsp bovis AF2122/97
cccgaggcuggcauc

SEQ ID NO: 3138721 - RNA, 20 nt, Mycobacterium bovis subsp bovis AF2122/97
cccgaggggagugucagcgc

SEQ ID NO: 3138722 - RNA, 18 nt, Mycobacterium bovis subsp bovis AF2122/97
cccgagucgaaaccgccc

SEQ ID NO: 3138723 - RNA, 17 nt, Mycobacterium bovis subsp bovis AF2122/97
cccgagucugcgagcag

SEQ ID NO: 3138724 - RNA, 22 nt, Mycobacterium bovis subsp bovis AF2122/97
cccgaguggccggugggccgcc

SEQ ID NO: 3138725 - RNA, 23 nt, Mycobacterium bovis subsp bovis AF2122/97
cccgaguggccggugggccgccc

SEQ ID NO: 3138726 - RNA, 21 nt, Mycobacterium bovis subsp bovis AF2122/97
cccgaguuauagaagccgacg

SEQ ID NO: 3138727 - RNA, 15 nt, Mycobacterium bovis subsp bovis AF2122/97
cccgaguugaagaag

SEQ ID NO: 3138728 - RNA, 21 nt, Mycobacterium bovis subsp bovis AF2122/97
cccgaguugaaggugccggcg

SEQ ID NO: 3138729 - RNA, 22 nt, Mycobacterium bovis subsp bovis AF2122/97
cccgaguugaaggugccggcgu

SEQ ID NO: 3138730 - RNA, 23 nt, Mycobacterium bovis subsp bovis AF2122/97
cccgaguugaaggugccggcguu

SEQ ID NO: 3138731 - RNA, 22 nt, Mycobacterium bovis subsp bovis AF2122/97
cccgaguuguggacgcccgagu

SEQ ID NO: 3138732 - RNA, 18 nt, Mycobacterium bovis subsp bovis AF2122/97
cccgaguuguugcugccc

SEQ ID NO: 3138733 - RNA, 19 nt, Mycobacterium bovis subsp bovis AF2122/97
cccgaguuugcgauaccca

SEQ ID NO: 3138734 - RNA, 22 nt, Mycobacterium bovis subsp bovis AF2122/97
cccgaguuugcgauacccaccg

SEQ ID NO: 3138735 - RNA, 16 nt, Mycobacterium bovis subsp bovis AF2122/97
cccgauaacaaggccg

SEQ ID NO: 3138736 - RNA, 18 nt, Mycobacterium bovis subsp bovis AF2122/97
cccgauaacaaggccgcc

SEQ ID NO: 3138737 - RNA, 19 nt, Mycobacterium bovis subsp bovis AF2122/97
cccgauaacaaggccgccg

SEQ ID NO: 3138738 - RNA, 14 nt, Mycobacterium bovis subsp bovis AF2122/97
cccgauacccggug

SEQ ID NO: 3138739 - RNA, 17 nt, Mycobacterium bovis subsp bovis AF2122/97
cccgauacgccaccggc

SEQ ID NO: 3138740 - RNA, 13 nt, Mycobacterium bovis subsp bovis AF2122/97
cccgauacggccg

SEQ ID NO: 3138741 - RNA, 15 nt, Mycobacterium bovis subsp bovis AF2122/97
cccgauacggccggc

SEQ ID NO: 3138742 - RNA, 18 nt, Mycobacterium bovis subsp bovis AF2122/97
cccgauacuugcgcuguu

SEQ ID NO: 3138743 - RNA, 14 nt, Mycobacterium bovis subsp bovis AF2122/97
cccgauagcgaccg

SEQ ID NO: 3138744 - RNA, 17 nt, Mycobacterium bovis subsp bovis AF2122/97
cccgauaguucuggccc

SEQ ID NO: 3138745 - RNA, 20 nt, Mycobacterium bovis subsp bovis AF2122/97
cccgauaguucuggcccgca

SEQ ID NO: 3138746 - RNA, 17 nt, Mycobacterium bovis subsp bovis AF2122/97
cccgauauucggccaug

SEQ ID NO: 3138747 - RNA, 14 nt, Mycobacterium bovis subsp bovis AF2122/97
cccgaucaccccgg

SEQ ID NO: 3138748 - RNA, 19 nt, Mycobacterium bovis subsp bovis AF2122/97
cccgcaucggaaucgcgag

SEQ ID NO: 3138749 - RNA, 21 nt, Mycobacterium bovis subsp bovis AF2122/97
cccgcaucggaaucgcgagcu

SEQ ID NO: 3138750 - RNA, 17 nt, Mycobacterium bovis subsp bovis AF2122/97
cccgcaugacgccggcg

SEQ ID NO: 3138751 - RNA, 22 nt, Mycobacterium bovis subsp bovis AF2122/97
cccgcaugcccuggaccagcgg

SEQ ID NO: 3138752 - RNA, 19 nt, Mycobacterium bovis subsp bovis AF2122/97
cccgcaugccggcgcacca

SEQ ID NO: 3138753 - RNA, 14 nt, Mycobacterium bovis subsp bovis AF2122/97
cccgcauggcagcg

SEQ ID NO: 3138754 - RNA, 17 nt, Mycobacterium bovis subsp bovis AF2122/97
cccgcauggcagcggcg

SEQ ID NO: 3138755 - RNA, 17 nt, Mycobacterium bovis subsp bovis AF2122/97
cccgcauugacgaaacc

SEQ ID NO: 3138756 - RNA, 17 nt, Mycobacterium bovis subsp bovis AF2122/97
cccgcauugccaacgcc

SEQ ID NO: 3138757 - RNA, 21 nt, Mycobacterium bovis subsp bovis AF2122/97
cccgcauugccaacgcccacg

SEQ ID NO: 3138758 - RNA, 22 nt, Mycobacterium bovis subsp bovis AF2122/97
cccgcauugccaacgcccacgu

SEQ ID NO: 3138759 - RNA, 14 nt, Mycobacterium bovis subsp bovis AF2122/97
cccgcauugccguc

SEQ ID NO: 3138760 - RNA, 20 nt, Mycobacterium bovis subsp bovis AF2122/97
cccgcauugccgucgggguc

SEQ ID NO: 3138761 - RNA, 21 nt, Mycobacterium bovis subsp bovis AF2122/97
cccgccaacgccaaaacgguc

SEQ ID NO: 3138762 - RNA, 15 nt, Mycobacterium bovis subsp bovis AF2122/97
cccgccacaacggcg

SEQ ID NO: 3138763 - RNA, 14 nt, Mycobacterium bovis subsp bovis AF2122/97
cccgccacaccaac

SEQ ID NO: 3138764 - RNA, 12 nt, Mycobacterium bovis subsp bovis AF2122/97
cccgccaccccg

SEQ ID NO: 3138765 - RNA, 11 nt, Mycobacterium bovis subsp bovis AF2122/97
cccgccaccga

SEQ ID NO: 3138766 - RNA, 14 nt, Mycobacterium bovis subsp bovis AF2122/97
cccgccaccgaaca

SEQ ID NO: 3138767 - RNA, 20 nt, Mycobacterium bovis subsp bovis AF2122/97
cccgccaccgcgacaccccg

SEQ ID NO: 3138768 - RNA, 18 nt, Mycobacterium bovis subsp bovis AF2122/97
cccgccaccucgccggcc

SEQ ID NO: 3138769 - RNA, 19 nt, Mycobacterium bovis subsp bovis AF2122/97
cccgccacgaugucgucga

SEQ ID NO: 3138770 - RNA, 13 nt, Mycobacterium bovis subsp bovis AF2122/97
cccgccacgccga

SEQ ID NO: 3138771 - RNA, 15 nt, Mycobacterium bovis subsp bovis AF2122/97
cccgccacgccgaag

SEQ ID NO: 3138772 - RNA, 22 nt, Mycobacterium bovis subsp bovis AF2122/97
cccgccacgguucgggcagcac

SEQ ID NO: 3138773 - RNA, 18 nt, Mycobacterium bovis subsp bovis AF2122/97
cccgccacguacuccacc

SEQ ID NO: 3138774 - RNA, 22 nt, Mycobacterium bovis subsp bovis AF2122/97
cccgccacguacuccaccgcgc

SEQ ID NO: 3138775 - RNA, 16 nt, Mycobacterium bovis subsp bovis AF2122/97
cccgccacgucgccgg

SEQ ID NO: 3138776 - RNA, 19 nt, Mycobacterium bovis subsp bovis AF2122/97
cccgccagaacggcgucga

SEQ ID NO: 3138777 - RNA, 17 nt, Mycobacterium bovis subsp bovis AF2122/97
cccgccagcagggccag

SEQ ID NO: 3138778 - RNA, 14 nt, Mycobacterium bovis subsp bovis AF2122/97
cccgccagcccagc

SEQ ID NO: 3138779 - RNA, 18 nt, Mycobacterium bovis subsp bovis AF2122/97
cccgccagcgauccacca

SEQ ID NO: 3138780 - RNA, 12 nt, Mycobacterium bovis subsp bovis AF2122/97
cccgccagcgcc

SEQ ID NO: 3138781 - RNA, 13 nt, Mycobacterium bovis subsp bovis AF2122/97
cccgccagcgccg

SEQ ID NO: 3138782 - RNA, 19 nt, Mycobacterium bovis subsp bovis AF2122/97
cccgccagcgccgccgagg

SEQ ID NO: 3138783 - RNA, 17 nt, Mycobacterium bovis subsp bovis AF2122/97
cccgccagcgccgccgg

SEQ ID NO: 3138784 - RNA, 19 nt, Mycobacterium bovis subsp bovis AF2122/97
cccgccagcgccgccggag

SEQ ID NO: 3138785 - RNA, 12 nt, Mycobacterium bovis subsp bovis AF2122/97
cccgccagcggc

SEQ ID NO: 3138786 - RNA, 13 nt, Mycobacterium bovis subsp bovis AF2122/97
cccgccaggaucu

SEQ ID NO: 3138787 - RNA, 23 nt, Mycobacterium bovis subsp bovis AF2122/97
cccgccagggcacguggcgguac

SEQ ID NO: 3138788 - RNA, 17 nt, Mycobacterium bovis subsp bovis AF2122/97
cccgccagggcggcauc

SEQ ID NO: 3138789 - RNA, 19 nt, Mycobacterium bovis subsp bovis AF2122/97
cccgccaucagcccggcgc

SEQ ID NO: 3138790 - RNA, 20 nt, Mycobacterium bovis subsp bovis AF2122/97
cccgccaucauggcggcccg

SEQ ID NO: 3138791 - RNA, 14 nt, Mycobacterium bovis subsp bovis AF2122/97
cccgccaucugccu

SEQ ID NO: 3138792 - RNA, 14 nt, Mycobacterium bovis subsp bovis AF2122/97
cccgccauugccgc

SEQ ID NO: 3138793 - RNA, 19 nt, Mycobacterium bovis subsp bovis AF2122/97
cccgccauugccgccggcg

SEQ ID NO: 3138794 - RNA, 23 nt, Mycobacterium bovis subsp bovis AF2122/97
cccgccauugccgccggcgccgc

SEQ ID NO: 3138795 - RNA, 19 nt, Mycobacterium bovis subsp bovis AF2122/97
cccgccauugccgccgucg

SEQ ID NO: 3138796 - RNA, 21 nt, Mycobacterium bovis subsp bovis AF2122/97
cccgccauugccgccgucgcc

SEQ ID NO: 3138797 - RNA, 12 nt, Mycobacterium bovis subsp bovis AF2122/97
cccgcccaccuc

SEQ ID NO: 3138798 - RNA, 18 nt, Mycobacterium bovis subsp bovis AF2122/97
cccgcccacggcaccacc

SEQ ID NO: 3138799 - RNA, 13 nt, Mycobacterium bovis subsp bovis AF2122/97
cccgcccagcagc

SEQ ID NO: 3138800 - RNA, 14 nt, Mycobacterium bovis subsp bovis AF2122/97
cccgcccagcccgg

SEQ ID NO: 3138801 - RNA, 11 nt, Mycobacterium bovis subsp bovis AF2122/97
cccgcccagcg

SEQ ID NO: 3138802 - RNA, 16 nt, Mycobacterium bovis subsp bovis AF2122/97
cccgcccaggcgucca

SEQ ID NO: 3138803 - RNA, 12 nt, Mycobacterium bovis subsp bovis AF2122/97
cccgccccgacc

SEQ ID NO: 3138804 - RNA, 14 nt, Mycobacterium bovis subsp bovis AF2122/97
cccgccccgcgccu

SEQ ID NO: 3138805 - RNA, 16 nt, Mycobacterium bovis subsp bovis AF2122/97
cccgcccgagccgcug

SEQ ID NO: 3138806 - RNA, 15 nt, Mycobacterium bovis subsp bovis AF2122/97
cccgcccgcacgacg

SEQ ID NO: 3138807 - RNA, 14 nt, Mycobacterium bovis subsp bovis AF2122/97
cccgcccgcgcggu

SEQ ID NO: 3138808 - RNA, 22 nt, Mycobacterium bovis subsp bovis AF2122/97
cccgcccgguguguucggcccg

SEQ ID NO: 3138809 - RNA, 21 nt, Mycobacterium bovis subsp bovis AF2122/97
cccgcccguagacccacaguc

SEQ ID NO: 3138810 - RNA, 14 nt, Mycobacterium bovis subsp bovis AF2122/97
cccgcccuugccgc

SEQ ID NO: 3138811 - RNA, 16 nt, Mycobacterium bovis subsp bovis AF2122/97
cccgcccuugccgcca

SEQ ID NO: 3138812 - RNA, 17 nt, Mycobacterium bovis subsp bovis AF2122/97
cccgcccuugccgccag

SEQ ID NO: 3138813 - RNA, 16 nt, Mycobacterium bovis subsp bovis AF2122/97
cccgcccuugccgccg

SEQ ID NO: 3138814 - RNA, 18 nt, Mycobacterium bovis subsp bovis AF2122/97
cccgcccuugccgccgag

SEQ ID NO: 3138815 - RNA, 19 nt, Mycobacterium bovis subsp bovis AF2122/97
cccgcccuugccgccgagg

SEQ ID NO: 3138816 - RNA, 19 nt, Mycobacterium bovis subsp bovis AF2122/97
cccgccgaacguguugacc

SEQ ID NO: 3138817 - RNA, 16 nt, Mycobacterium bovis subsp bovis AF2122/97
cccgccgaccgacacc

SEQ ID NO: 3138818 - RNA, 19 nt, Mycobacterium bovis subsp bovis AF2122/97
cccgccgaccgacaccacc

SEQ ID NO: 3138819 - RNA, 15 nt, Mycobacterium bovis subsp bovis AF2122/97
cccgccgacgccgcc

SEQ ID NO: 3138820 - RNA, 18 nt, Mycobacterium bovis subsp bovis AF2122/97
cccgccgacgccgccggc

SEQ ID NO: 3138821 - RNA, 20 nt, Mycobacterium bovis subsp bovis AF2122/97
cccgccgacgccgccggccc

SEQ ID NO: 3138822 - RNA, 21 nt, Mycobacterium bovis subsp bovis AF2122/97
cccgccgacgccgccggcccc

SEQ ID NO: 3138823 - RNA, 13 nt, Mycobacterium bovis subsp bovis AF2122/97
cccgccgagcgcg

SEQ ID NO: 3138824 - RNA, 17 nt, Mycobacterium bovis subsp bovis AF2122/97
cccgccgagcggugccg

SEQ ID NO: 3138825 - RNA, 20 nt, Mycobacterium bovis subsp bovis AF2122/97
cccgccgagcggugccggcg

SEQ ID NO: 3138826 - RNA, 22 nt, Mycobacterium bovis subsp bovis AF2122/97
cccgccgagcggugccggcgua

SEQ ID NO: 3138827 - RNA, 20 nt, Mycobacterium bovis subsp bovis AF2122/97
cccgccgagcgguugccuuc

SEQ ID NO: 3138828 - RNA, 16 nt, Mycobacterium bovis subsp bovis AF2122/97
cccgccgaucacuguc

SEQ ID NO: 3138829 - RNA, 19 nt, Mycobacterium bovis subsp bovis AF2122/97
cccgccgaugaugcggcgc

SEQ ID NO: 3138830 - RNA, 22 nt, Mycobacterium bovis subsp bovis AF2122/97
cccgccgaugaugcggcgcagc

SEQ ID NO: 3138831 - RNA, 23 nt, Mycobacterium bovis subsp bovis AF2122/97
cccgccgaugaugcggcgcagcg

SEQ ID NO: 3138832 - RNA, 17 nt, Mycobacterium bovis subsp bovis AF2122/97
cccgccgaugcugccgc

SEQ ID NO: 3138833 - RNA, 18 nt, Mycobacterium bovis subsp bovis AF2122/97
cccgccgaugcugccgcc

SEQ ID NO: 3138834 - RNA, 20 nt, Mycobacterium bovis subsp bovis AF2122/97
cccgccgaugcugccgccgc

SEQ ID NO: 3138835 - RNA, 13 nt, Mycobacterium bovis subsp bovis AF2122/97
cccgcgccgcccg

SEQ ID NO: 3138836 - RNA, 12 nt, Mycobacterium bovis subsp bovis AF2122/97
cccgcgccgccg

SEQ ID NO: 3138837 - RNA, 13 nt, Mycobacterium bovis subsp bovis AF2122/97
cccgcgccgcgca

SEQ ID NO: 3138838 - RNA, 14 nt, Mycobacterium bovis subsp bovis AF2122/97
cccgcgccgcgcau

SEQ ID NO: 3138839 - RNA, 13 nt, Mycobacterium bovis subsp bovis AF2122/97
cccgcgccggccg

SEQ ID NO: 3138840 - RNA, 14 nt, Mycobacterium bovis subsp bovis AF2122/97
cccgcgccggccgc

SEQ ID NO: 3138841 - RNA, 19 nt, Mycobacterium bovis subsp bovis AF2122/97
cccgcgccggccgcacgcc

SEQ ID NO: 3138842 - RNA, 20 nt, Mycobacterium bovis subsp bovis AF2122/97
cccgcgccuccguugccccc

SEQ ID NO: 3138843 - RNA, 21 nt, Mycobacterium bovis subsp bovis AF2122/97
cccgcgccuccguugccccca

SEQ ID NO: 3138844 - RNA, 14 nt, Mycobacterium bovis subsp bovis AF2122/97
cccgcgccugccuc

SEQ ID NO: 3138845 - RNA, 14 nt, Mycobacterium bovis subsp bovis AF2122/97
cccgcgcgacgccg

SEQ ID NO: 3138846 - RNA, 17 nt, Mycobacterium bovis subsp bovis AF2122/97
cccgcgcgagagccucc

SEQ ID NO: 3138847 - RNA, 18 nt, Mycobacterium bovis subsp bovis AF2122/97
cccgcgcgagagccucca

SEQ ID NO: 3138848 - RNA, 13 nt, Mycobacterium bovis subsp bovis AF2122/97
cccgcgcgcacca

SEQ ID NO: 3138849 - RNA, 13 nt, Mycobacterium bovis subsp bovis AF2122/97
cccgcgcgccagc

SEQ ID NO: 3138850 - RNA, 14 nt, Mycobacterium bovis subsp bovis AF2122/97
cccgcgcgccagcu

SEQ ID NO: 3138851 - RNA, 19 nt, Mycobacterium bovis subsp bovis AF2122/97
cccgcgcgccagcucggcg

SEQ ID NO: 3138852 - RNA, 16 nt, Mycobacterium bovis subsp bovis AF2122/97
cccgcgcgccggcgac

SEQ ID NO: 3138853 - RNA, 12 nt, Mycobacterium bovis subsp bovis AF2122/97
cccgcgcgcuga

SEQ ID NO: 3138854 - RNA, 17 nt, Mycobacterium bovis subsp bovis AF2122/97
cccgcgcggagaccccg

SEQ ID NO: 3138855 - RNA, 17 nt, Mycobacterium bovis subsp bovis AF2122/97
cccgcgcgggcggaucg

SEQ ID NO: 3138856 - RNA, 14 nt, Mycobacterium bovis subsp bovis AF2122/97
cccgcgcggugccc

SEQ ID NO: 3138857 - RNA, 23 nt, Mycobacterium bovis subsp bovis AF2122/97
cccgcgcggugcccugccggcag

SEQ ID NO: 3138858 - RNA, 14 nt, Mycobacterium bovis subsp bovis AF2122/97
cccgcgcgguggcg

SEQ ID NO: 3138859 - RNA, 18 nt, Mycobacterium bovis subsp bovis AF2122/97
cccgcgcgguggcggucg

SEQ ID NO: 3138860 - RNA, 17 nt, Mycobacterium bovis subsp bovis AF2122/97
cccgcgcguacccgauc

SEQ ID NO: 3138861 - RNA, 23 nt, Mycobacterium bovis subsp bovis AF2122/97
cccgcgcgucgcccagugcgcaa

SEQ ID NO: 3138862 - RNA, 15 nt, Mycobacterium bovis subsp bovis AF2122/97
cccgcgcguucggcg

SEQ ID NO: 3138863 - RNA, 14 nt, Mycobacterium bovis subsp bovis AF2122/97
cccgcgcugagcac

SEQ ID NO: 3138864 - RNA, 19 nt, Mycobacterium bovis subsp bovis AF2122/97
cccgcgcugagcacgcgga

SEQ ID NO: 3138865 - RNA, 22 nt, Mycobacterium bovis subsp bovis AF2122/97
cccgcgcuugauccacccgacg

SEQ ID NO: 3138866 - RNA, 16 nt, Mycobacterium bovis subsp bovis AF2122/97
cccgcggaccgcaacg

SEQ ID NO: 3138867 - RNA, 23 nt, Mycobacterium bovis subsp bovis AF2122/97
cccgcggcaacgcggucugcucc

SEQ ID NO: 3138868 - RNA, 13 nt, Mycobacterium bovis subsp bovis AF2122/97
cccgcggccagca

SEQ ID NO: 3138869 - RNA, 19 nt, Mycobacterium bovis subsp bovis AF2122/97
cccgcggccagcaccgggg

SEQ ID NO: 3138870 - RNA, 14 nt, Mycobacterium bovis subsp bovis AF2122/97
cccgcggccgggcc

SEQ ID NO: 3138871 - RNA, 22 nt, Mycobacterium bovis subsp bovis AF2122/97
cccgcggcgaaccgucucgccc

SEQ ID NO: 3138872 - RNA, 23 nt, Mycobacterium bovis subsp bovis AF2122/97
cccgcggcgaaccgucucgcccc

SEQ ID NO: 3138873 - RNA, 15 nt, Mycobacterium bovis subsp bovis AF2122/97
cccgcggcgccgcca

SEQ ID NO: 3138874 - RNA, 19 nt, Mycobacterium bovis subsp bovis AF2122/97
cccgcggcgccguugccac

SEQ ID NO: 3138875 - RNA, 21 nt, Mycobacterium bovis subsp bovis AF2122/97
cccgcggcgccguugccaccg

SEQ ID NO: 3138876 - RNA, 22 nt, Mycobacterium bovis subsp bovis AF2122/97
cccgcggcgcggagagccugcu

SEQ ID NO: 3138877 - RNA, 11 nt, Mycobacterium bovis subsp bovis AF2122/97
cccgcggcggu

SEQ ID NO: 3138878 - RNA, 14 nt, Mycobacterium bovis subsp bovis AF2122/97
cccgcgggaucagc

SEQ ID NO: 3138879 - RNA, 13 nt, Mycobacterium bovis subsp bovis AF2122/97
cccgcggggaauc

SEQ ID NO: 3138880 - RNA, 19 nt, Mycobacterium bovis subsp bovis AF2122/97
cccgcgggucguccggcgg

SEQ ID NO: 3138881 - RNA, 16 nt, Mycobacterium bovis subsp bovis AF2122/97
cccgcgguagccgacc

SEQ ID NO: 3138882 - RNA, 17 nt, Mycobacterium bovis subsp bovis AF2122/97
cccgcgguagccgaccg

SEQ ID NO: 3138883 - RNA, 19 nt, Mycobacterium bovis subsp bovis AF2122/97
cccgcgguccugguguagc

SEQ ID NO: 3138884 - RNA, 19 nt, Mycobacterium bovis subsp bovis AF2122/97
cccgcggucgaucaggccg

SEQ ID NO: 3138885 - RNA, 19 nt, Mycobacterium bovis subsp bovis AF2122/97
cccgcggugaccaccccgg

SEQ ID NO: 3138886 - RNA, 13 nt, Mycobacterium bovis subsp bovis AF2122/97
cccgcggugacga

SEQ ID NO: 3138887 - RNA, 21 nt, Mycobacterium bovis subsp bovis AF2122/97
cccgcggugacgagcacaugc

SEQ ID NO: 3138888 - RNA, 20 nt, Mycobacterium bovis subsp bovis AF2122/97
cccgcggugacgcaacaucg

SEQ ID NO: 3138889 - RNA, 18 nt, Mycobacterium bovis subsp bovis AF2122/97
cccgcgguggaccgggca

SEQ ID NO: 3138890 - RNA, 17 nt, Mycobacterium bovis subsp bovis AF2122/97
cccgcgguuucgggccg

SEQ ID NO: 3138891 - RNA, 19 nt, Mycobacterium bovis subsp bovis AF2122/97
cccgcguaccacggugguc

SEQ ID NO: 3138892 - RNA, 22 nt, Mycobacterium bovis subsp bovis AF2122/97
cccgcgucgagugccgccaccg

SEQ ID NO: 3138893 - RNA, 20 nt, Mycobacterium bovis subsp bovis AF2122/97
cccgcgucuacgucguccag

SEQ ID NO: 3138894 - RNA, 21 nt, Mycobacterium bovis subsp bovis AF2122/97
cccgcguugaaggcgccggug

SEQ ID NO: 3138895 - RNA, 23 nt, Mycobacterium bovis subsp bovis AF2122/97
cccgcguugaaggcgccgguguu

SEQ ID NO: 3138896 - RNA, 22 nt, Mycobacterium bovis subsp bovis AF2122/97
cccgcguuugcgaagcccacgu

SEQ ID NO: 3138897 - RNA, 18 nt, Mycobacterium bovis subsp bovis AF2122/97
cccgcuaacuggcccgga

SEQ ID NO: 3138898 - RNA, 22 nt, Mycobacterium bovis subsp bovis AF2122/97
cccgcuaacuggcccggacaug

SEQ ID NO: 3138899 - RNA, 20 nt, Mycobacterium bovis subsp bovis AF2122/97
cccgcuaccaacgcaacacg

SEQ ID NO: 3138900 - RNA, 15 nt, Mycobacterium bovis subsp bovis AF2122/97
cccgcuacgcgcgcu

SEQ ID NO: 3138901 - RNA, 20 nt, Mycobacterium bovis subsp bovis AF2122/97
cccgcuacgcgcgcucgcuc

SEQ ID NO: 3138902 - RNA, 17 nt, Mycobacterium bovis subsp bovis AF2122/97
cccgcuacggcagcccg

SEQ ID NO: 3138903 - RNA, 14 nt, Mycobacterium bovis subsp bovis AF2122/97
cccgcuagcccacc

SEQ ID NO: 3138904 - RNA, 15 nt, Mycobacterium bovis subsp bovis AF2122/97
cccgcuagcccacca

SEQ ID NO: 3138905 - RNA, 16 nt, Mycobacterium bovis subsp bovis AF2122/97
cccgcuagcccaccac

SEQ ID NO: 3138906 - RNA, 22 nt, Mycobacterium bovis subsp bovis AF2122/97
cccgcuagcgcuugcgaccccg

SEQ ID NO: 3138907 - RNA, 19 nt, Mycobacterium bovis subsp bovis AF2122/97
cccgcuauucggcggcaug

SEQ ID NO: 3138908 - RNA, 16 nt, Mycobacterium bovis subsp bovis AF2122/97
cccgcucaacgggccg

SEQ ID NO: 3138909 - RNA, 17 nt, Mycobacterium bovis subsp bovis AF2122/97
cccgcucacgcucaccc

SEQ ID NO: 3138910 - RNA, 16 nt, Mycobacterium bovis subsp bovis AF2122/97
cccgcucagccguccg

SEQ ID NO: 3138911 - RNA, 19 nt, Mycobacterium bovis subsp bovis AF2122/97
cccgcucauaccgggagga

SEQ ID NO: 3138912 - RNA, 17 nt, Mycobacterium bovis subsp bovis AF2122/97
cccgcuccaagcgcggu

SEQ ID NO: 3138913 - RNA, 15 nt, Mycobacterium bovis subsp bovis AF2122/97
cccgcuccacgguca

SEQ ID NO: 3138914 - RNA, 15 nt, Mycobacterium bovis subsp bovis AF2122/97
cccgcucccccgcca

SEQ ID NO: 3138915 - RNA, 16 nt, Mycobacterium bovis subsp bovis AF2122/97
cccgcuccgcgccgcc

SEQ ID NO: 3138916 - RNA, 17 nt, Mycobacterium bovis subsp bovis AF2122/97
cccgcuccgcgccgccc

SEQ ID NO: 3138917 - RNA, 12 nt, Mycobacterium bovis subsp bovis AF2122/97
cccgcuccgcgg

SEQ ID NO: 3138918 - RNA, 13 nt, Mycobacterium bovis subsp bovis AF2122/97
cccgcuccgggac

SEQ ID NO: 3138919 - RNA, 16 nt, Mycobacterium bovis subsp bovis AF2122/97
cccgcuccuccggcac

SEQ ID NO: 3138920 - RNA, 13 nt, Mycobacterium bovis subsp bovis AF2122/97
cccgcucgagcag

SEQ ID NO: 3138921 - RNA, 15 nt, Mycobacterium bovis subsp bovis AF2122/97
cccgcucgagcagcg

SEQ ID NO: 3138922 - RNA, 19 nt, Mycobacterium bovis subsp bovis AF2122/97
cccggcagcccggcggccg

SEQ ID NO: 3138923 - RNA, 20 nt, Mycobacterium bovis subsp bovis AF2122/97
cccggcagcccggcggccgc

SEQ ID NO: 3138924 - RNA, 23 nt, Mycobacterium bovis subsp bovis AF2122/97
cccggcagcgugcggggcgccug

SEQ ID NO: 3138925 - RNA, 20 nt, Mycobacterium bovis subsp bovis AF2122/97
cccggcaguucgcggccauc

SEQ ID NO: 3138926 - RNA, 12 nt, Mycobacterium bovis subsp bovis AF2122/97
cccggcauacaa

SEQ ID NO: 3138927 - RNA, 13 nt, Mycobacterium bovis subsp bovis AF2122/97
cccggcaucgcga

SEQ ID NO: 3138928 - RNA, 16 nt, Mycobacterium bovis subsp bovis AF2122/97
cccggcauugagccgg

SEQ ID NO: 3138929 - RNA, 17 nt, Mycobacterium bovis subsp bovis AF2122/97
cccggcauugcccgagc

SEQ ID NO: 3138930 - RNA, 21 nt, Mycobacterium bovis subsp bovis AF2122/97
cccggcauugcccgagcccag

SEQ ID NO: 3138931 - RNA, 23 nt, Mycobacterium bovis subsp bovis AF2122/97
cccggccaaaauuuugucggccg

SEQ ID NO: 3138932 - RNA, 16 nt, Mycobacterium bovis subsp bovis AF2122/97
cccggccaagccggcg

SEQ ID NO: 3138933 - RNA, 14 nt, Mycobacterium bovis subsp bovis AF2122/97
cccggccaccagca

SEQ ID NO: 3138934 - RNA, 16 nt, Mycobacterium bovis subsp bovis AF2122/97
cccggccaccagcaug

SEQ ID NO: 3138935 - RNA, 21 nt, Mycobacterium bovis subsp bovis AF2122/97
cccggccaccagcaugccugc

SEQ ID NO: 3138936 - RNA, 22 nt, Mycobacterium bovis subsp bovis AF2122/97
cccggccacugaaccguagcgc

SEQ ID NO: 3138937 - RNA, 13 nt, Mycobacterium bovis subsp bovis AF2122/97
cccggccagccgc

SEQ ID NO: 3138938 - RNA, 12 nt, Mycobacterium bovis subsp bovis AF2122/97
cccggccagccu

SEQ ID NO: 3138939 - RNA, 22 nt, Mycobacterium bovis subsp bovis AF2122/97
cccggccagcuccucagccacc

SEQ ID NO: 3138940 - RNA, 19 nt, Mycobacterium bovis subsp bovis AF2122/97
cccggccagcugcguggcg

SEQ ID NO: 3138941 - RNA, 22 nt, Mycobacterium bovis subsp bovis AF2122/97
cccggccagcugcguggcgaac

SEQ ID NO: 3138942 - RNA, 23 nt, Mycobacterium bovis subsp bovis AF2122/97
cccggccaggaguuugaccaccu

SEQ ID NO: 3138943 - RNA, 14 nt, Mycobacterium bovis subsp bovis AF2122/97
cccggccaggccga

SEQ ID NO: 3138944 - RNA, 13 nt, Mycobacterium bovis subsp bovis AF2122/97
cccggccaggggc

SEQ ID NO: 3138945 - RNA, 16 nt, Mycobacterium bovis subsp bovis AF2122/97
cccggccaggggcgca

SEQ ID NO: 3138946 - RNA, 18 nt, Mycobacterium bovis subsp bovis AF2122/97
cccggccaggucgacacc

SEQ ID NO: 3138947 - RNA, 19 nt, Mycobacterium bovis subsp bovis AF2122/97
cccggccaggucgacaccg

SEQ ID NO: 3138948 - RNA, 21 nt, Mycobacterium bovis subsp bovis AF2122/97
cccggccaggucgacaccgcg

SEQ ID NO: 3138949 - RNA, 21 nt, Mycobacterium bovis subsp bovis AF2122/97
cccggccauagcccgagcgcu

SEQ ID NO: 3138950 - RNA, 19 nt, Mycobacterium bovis subsp bovis AF2122/97
cccggcccaaggaacggcg

SEQ ID NO: 3138951 - RNA, 22 nt, Mycobacterium bovis subsp bovis AF2122/97
cccggcccauugucgaucaccu

SEQ ID NO: 3138952 - RNA, 20 nt, Mycobacterium bovis subsp bovis AF2122/97
cccggccccgacggucaacg

SEQ ID NO: 3138953 - RNA, 16 nt, Mycobacterium bovis subsp bovis AF2122/97
cccggccccgcggcca

SEQ ID NO: 3138954 - RNA, 12 nt, Mycobacterium bovis subsp bovis AF2122/97
cccggcccgcca

SEQ ID NO: 3138955 - RNA, 14 nt, Mycobacterium bovis subsp bovis AF2122/97
cccggcccgccacc

SEQ ID NO: 3138956 - RNA, 16 nt, Mycobacterium bovis subsp bovis AF2122/97
cccggcccgccacccc

SEQ ID NO: 3138957 - RNA, 17 nt, Mycobacterium bovis subsp bovis AF2122/97
cccggcccgccaccccg

SEQ ID NO: 3138958 - RNA, 21 nt, Mycobacterium bovis subsp bovis AF2122/97
cccggcccgcucagccguccg

SEQ ID NO: 3138959 - RNA, 21 nt, Mycobacterium bovis subsp bovis AF2122/97
cccggcccuccgggcccaucg

SEQ ID NO: 3138960 - RNA, 23 nt, Mycobacterium bovis subsp bovis AF2122/97
cccggcccugaacgguucggccg

SEQ ID NO: 3138961 - RNA, 18 nt, Mycobacterium bovis subsp bovis AF2122/97
cccggccgaacgccucgc

SEQ ID NO: 3138962 - RNA, 14 nt, Mycobacterium bovis subsp bovis AF2122/97
cccggccgaguacc

SEQ ID NO: 3138963 - RNA, 18 nt, Mycobacterium bovis subsp bovis AF2122/97
cccggccgcaucggucaa

SEQ ID NO: 3138964 - RNA, 15 nt, Mycobacterium bovis subsp bovis AF2122/97
cccggccgccagcgc

SEQ ID NO: 3138965 - RNA, 17 nt, Mycobacterium bovis subsp bovis AF2122/97
cccggccgccagcgcgc

SEQ ID NO: 3138966 - RNA, 18 nt, Mycobacterium bovis subsp bovis AF2122/97
cccggccgccagcgcgcc

SEQ ID NO: 3138967 - RNA, 12 nt, Mycobacterium bovis subsp bovis AF2122/97
cccggccgccga

SEQ ID NO: 3138968 - RNA, 16 nt, Mycobacterium bovis subsp bovis AF2122/97
cccggccgcgcacccg

SEQ ID NO: 3138969 - RNA, 23 nt, Mycobacterium bovis subsp bovis AF2122/97
cccggccgcgcacccguccgccg

SEQ ID NO: 3138970 - RNA, 14 nt, Mycobacterium bovis subsp bovis AF2122/97
cccggccgcgcccc

SEQ ID NO: 3138971 - RNA, 12 nt, Mycobacterium bovis subsp bovis AF2122/97
cccggccgcgcg

SEQ ID NO: 3138972 - RNA, 14 nt, Mycobacterium bovis subsp bovis AF2122/97
cccggccgcgcgca

SEQ ID NO: 3138973 - RNA, 23 nt, Mycobacterium bovis subsp bovis AF2122/97
cccggccgcgucacggaccugga

SEQ ID NO: 3138974 - RNA, 14 nt, Mycobacterium bovis subsp bovis AF2122/97
cccggccggcccgg

SEQ ID NO: 3138975 - RNA, 14 nt, Mycobacterium bovis subsp bovis AF2122/97
cccggccggcuagc

SEQ ID NO: 3138976 - RNA, 19 nt, Mycobacterium bovis subsp bovis AF2122/97
cccggccgggucgagugcg

SEQ ID NO: 3138977 - RNA, 15 nt, Mycobacterium bovis subsp bovis AF2122/97
cccggccggucgaga

SEQ ID NO: 3138978 - RNA, 19 nt, Mycobacterium bovis subsp bovis AF2122/97
cccggccggucgagacgcu

SEQ ID NO: 3138979 - RNA, 16 nt, Mycobacterium bovis subsp bovis AF2122/97
cccggccguugggcca

SEQ ID NO: 3138980 - RNA, 23 nt, Mycobacterium bovis subsp bovis AF2122/97
cccggccguugggccaccggcgc

SEQ ID NO: 3138981 - RNA, 21 nt, Mycobacterium bovis subsp bovis AF2122/97
cccggccucaacacccggccg

SEQ ID NO: 3138982 - RNA, 21 nt, Mycobacterium bovis subsp bovis AF2122/97
cccggccugcuggucaccauc

SEQ ID NO: 3138983 - RNA, 24 nt, Mycobacterium bovis subsp bovis AF2122/97
cccggccugcuggucaccaucacc

SEQ ID NO: 3138984 - RNA, 18 nt, Mycobacterium bovis subsp bovis AF2122/97
cccggccuggagcagcca

SEQ ID NO: 3138985 - RNA, 17 nt, Mycobacterium bovis subsp bovis AF2122/97
cccggccuucuccaucg

SEQ ID NO: 3138986 - RNA, 15 nt, Mycobacterium bovis subsp bovis AF2122/97
cccggccuugccacc

SEQ ID NO: 3138987 - RNA, 16 nt, Mycobacterium bovis subsp bovis AF2122/97
cccggccuugccaccg

SEQ ID NO: 3138988 - RNA, 14 nt, Mycobacterium bovis subsp bovis AF2122/97
cccggccuugccgc

SEQ ID NO: 3138989 - RNA, 15 nt, Mycobacterium bovis subsp bovis AF2122/97
cccggccuugccgcc

SEQ ID NO: 3138990 - RNA, 21 nt, Mycobacterium bovis subsp bovis AF2122/97
cccggccuugccgccggcccc

SEQ ID NO: 3138991 - RNA, 20 nt, Mycobacterium bovis subsp bovis AF2122/97
cccggccuugccgccggcgc

SEQ ID NO: 3138992 - RNA, 22 nt, Mycobacterium bovis subsp bovis AF2122/97
cccggccuugccgccggcgccg

SEQ ID NO: 3138993 - RNA, 15 nt, Mycobacterium bovis subsp bovis AF2122/97
cccggccuuggcggc

SEQ ID NO: 3138994 - RNA, 18 nt, Mycobacterium bovis subsp bovis AF2122/97
cccggccuuggcggcggc

SEQ ID NO: 3138995 - RNA, 14 nt, Mycobacterium bovis subsp bovis AF2122/97
cccggcgaacaggc

SEQ ID NO: 3138996 - RNA, 13 nt, Mycobacterium bovis subsp bovis AF2122/97
cccggcgacgacc

SEQ ID NO: 3138997 - RNA, 15 nt, Mycobacterium bovis subsp bovis AF2122/97
cccggcgacgacccg

SEQ ID NO: 3138998 - RNA, 15 nt, Mycobacterium bovis subsp bovis AF2122/97
cccggcgacguuccg

SEQ ID NO: 3138999 - RNA, 17 nt, Mycobacterium bovis subsp bovis AF2122/97
cccggcgagcacccgcu

SEQ ID NO: 3139000 - RNA, 15 nt, Mycobacterium bovis subsp bovis AF2122/97
cccggcgagggcaac

SEQ ID NO: 3139001 - RNA, 16 nt, Mycobacterium bovis subsp bovis AF2122/97
cccggcgaugcagccg

SEQ ID NO: 3139002 - RNA, 17 nt, Mycobacterium bovis subsp bovis AF2122/97
cccggcgaugcagccgg

SEQ ID NO: 3139003 - RNA, 18 nt, Mycobacterium bovis subsp bovis AF2122/97
cccggcgauuggaccgcc

SEQ ID NO: 3139004 - RNA, 21 nt, Mycobacterium bovis subsp bovis AF2122/97
cccggcgcaccaucgcggccg

SEQ ID NO: 3139005 - RNA, 12 nt, Mycobacterium bovis subsp bovis AF2122/97
cccggcgccgcg

SEQ ID NO: 3139006 - RNA, 16 nt, Mycobacterium bovis subsp bovis AF2122/97
cccggcgccgcgggug

SEQ ID NO: 3139007 - RNA, 22 nt, Mycobacterium bovis subsp bovis AF2122/97
cccggcgccguagugcgcaucg

SEQ ID NO: 3139008 - RNA, 16 nt, Mycobacterium bovis subsp bovis AF2122/97
cccgggccgccagggc

SEQ ID NO: 3139009 - RNA, 13 nt, Mycobacterium bovis subsp bovis AF2122/97
cccgggccgccgc

SEQ ID NO: 3139010 - RNA, 14 nt, Mycobacterium bovis subsp bovis AF2122/97
cccgggccgccgcg

SEQ ID NO: 3139011 - RNA, 21 nt, Mycobacterium bovis subsp bovis AF2122/97
cccgggccgccgcgauggccc

SEQ ID NO: 3139012 - RNA, 22 nt, Mycobacterium bovis subsp bovis AF2122/97
cccgggccgcggcggccagcgc

SEQ ID NO: 3139013 - RNA, 19 nt, Mycobacterium bovis subsp bovis AF2122/97
cccgggccugaaccacgcg

SEQ ID NO: 3139014 - RNA, 20 nt, Mycobacterium bovis subsp bovis AF2122/97
cccgggcggaacgccggcac

SEQ ID NO: 3139015 - RNA, 22 nt, Mycobacterium bovis subsp bovis AF2122/97
cccgggcggcgucggugagcgc

SEQ ID NO: 3139016 - RNA, 21 nt, Mycobacterium bovis subsp bovis AF2122/97
cccgggcgggagucgucgagc

SEQ ID NO: 3139017 - RNA, 18 nt, Mycobacterium bovis subsp bovis AF2122/97
cccgggcgggauccaccc

SEQ ID NO: 3139018 - RNA, 20 nt, Mycobacterium bovis subsp bovis AF2122/97
cccgggcggucgagaugucg

SEQ ID NO: 3139019 - RNA, 12 nt, Mycobacterium bovis subsp bovis AF2122/97
cccgggcguggg

SEQ ID NO: 3139020 - RNA, 18 nt, Mycobacterium bovis subsp bovis AF2122/97
cccgggcgugggugucgg

SEQ ID NO: 3139021 - RNA, 19 nt, Mycobacterium bovis subsp bovis AF2122/97
cccgggcgugguaucgccg

SEQ ID NO: 3139022 - RNA, 19 nt, Mycobacterium bovis subsp bovis AF2122/97
cccgggcucugcugccagc

SEQ ID NO: 3139023 - RNA, 22 nt, Mycobacterium bovis subsp bovis AF2122/97
cccgggcucugcugccagccga

SEQ ID NO: 3139024 - RNA, 13 nt, Mycobacterium bovis subsp bovis AF2122/97
cccgggcugccgc

SEQ ID NO: 3139025 - RNA, 14 nt, Mycobacterium bovis subsp bovis AF2122/97
cccgggcugccgcc

SEQ ID NO: 3139026 - RNA, 16 nt, Mycobacterium bovis subsp bovis AF2122/97
cccgggcugccgccca

SEQ ID NO: 3139027 - RNA, 19 nt, Mycobacterium bovis subsp bovis AF2122/97
cccggggacgggucggcag

SEQ ID NO: 3139028 - RNA, 13 nt, Mycobacterium bovis subsp bovis AF2122/97
cccggggagacga

SEQ ID NO: 3139029 - RNA, 15 nt, Mycobacterium bovis subsp bovis AF2122/97
cccggggccgcaacc

SEQ ID NO: 3139030 - RNA, 19 nt, Mycobacterium bovis subsp bovis AF2122/97
cccggggcgcucgcgcgcu

SEQ ID NO: 3139031 - RNA, 20 nt, Mycobacterium bovis subsp bovis AF2122/97
cccgggggaagcgccaaacc

SEQ ID NO: 3139032 - RNA, 13 nt, Mycobacterium bovis subsp bovis AF2122/97
cccggggugccga

SEQ ID NO: 3139033 - RNA, 16 nt, Mycobacterium bovis subsp bovis AF2122/97
cccgggguguucgucg

SEQ ID NO: 3139034 - RNA, 15 nt, Mycobacterium bovis subsp bovis AF2122/97
cccggguaucgccag

SEQ ID NO: 3139035 - RNA, 15 nt, Mycobacterium bovis subsp bovis AF2122/97
cccgggucagcgacc

SEQ ID NO: 3139036 - RNA, 16 nt, Mycobacterium bovis subsp bovis AF2122/97
cccgggucggcacgac

SEQ ID NO: 3139037 - RNA, 15 nt, Mycobacterium bovis subsp bovis AF2122/97
cccgggucuccggcg

SEQ ID NO: 3139038 - RNA, 18 nt, Mycobacterium bovis subsp bovis AF2122/97
cccgggugaaacgauggc

SEQ ID NO: 3139039 - RNA, 17 nt, Mycobacterium bovis subsp bovis AF2122/97
cccgggugcgacgcgac

SEQ ID NO: 3139040 - RNA, 17 nt, Mycobacterium bovis subsp bovis AF2122/97
cccgggugcgcucuucu

SEQ ID NO: 3139041 - RNA, 13 nt, Mycobacterium bovis subsp bovis AF2122/97
cccgggugcugug

SEQ ID NO: 3139042 - RNA, 12 nt, Mycobacterium bovis subsp bovis AF2122/97
cccggguggcac

SEQ ID NO: 3139043 - RNA, 12 nt, Mycobacterium bovis subsp bovis AF2122/97
cccggguggccc

SEQ ID NO: 3139044 - RNA, 15 nt, Mycobacterium bovis subsp bovis AF2122/97
cccggguggcccgga

SEQ ID NO: 3139045 - RNA, 19 nt, Mycobacterium bovis subsp bovis AF2122/97
cccgguaacgccaucgucg

SEQ ID NO: 3139046 - RNA, 14 nt, Mycobacterium bovis subsp bovis AF2122/97
cccgguaccucaac

SEQ ID NO: 3139047 - RNA, 15 nt, Mycobacterium bovis subsp bovis AF2122/97
cccgguacgccgcgc

SEQ ID NO: 3139048 - RNA, 17 nt, Mycobacterium bovis subsp bovis AF2122/97
cccgguacgccgcgccg

SEQ ID NO: 3139049 - RNA, 16 nt, Mycobacterium bovis subsp bovis AF2122/97
cccgguagccccgucg

SEQ ID NO: 3139050 - RNA, 16 nt, Mycobacterium bovis subsp bovis AF2122/97
cccgguagcggcggca

SEQ ID NO: 3139051 - RNA, 17 nt, Mycobacterium bovis subsp bovis AF2122/97
cccgguagcguucggcg

SEQ ID NO: 3139052 - RNA, 21 nt, Mycobacterium bovis subsp bovis AF2122/97
cccgguagcguucggcgagca

SEQ ID NO: 3139053 - RNA, 23 nt, Mycobacterium bovis subsp bovis AF2122/97
cccgguagcguucggcgagcauc

SEQ ID NO: 3139054 - RNA, 15 nt, Mycobacterium bovis subsp bovis AF2122/97
cccgguaguccgcgc

SEQ ID NO: 3139055 - RNA, 18 nt, Mycobacterium bovis subsp bovis AF2122/97
cccgguaucgucccggcg

SEQ ID NO: 3139056 - RNA, 20 nt, Mycobacterium bovis subsp bovis AF2122/97
cccgguaucgucccggcgac

SEQ ID NO: 3139057 - RNA, 13 nt, Mycobacterium bovis subsp bovis AF2122/97
cccgguccagccg

SEQ ID NO: 3139058 - RNA, 15 nt, Mycobacterium bovis subsp bovis AF2122/97
cccgguccauucguc

SEQ ID NO: 3139059 - RNA, 13 nt, Mycobacterium bovis subsp bovis AF2122/97
cccggucccgccg

SEQ ID NO: 3139060 - RNA, 17 nt, Mycobacterium bovis subsp bovis AF2122/97
cccggucccgccgaccg

SEQ ID NO: 3139061 - RNA, 20 nt, Mycobacterium bovis subsp bovis AF2122/97
cccggucccgccgaccgaca

SEQ ID NO: 3139062 - RNA, 22 nt, Mycobacterium bovis subsp bovis AF2122/97
cccgguccggcccggggacgcc

SEQ ID NO: 3139063 - RNA, 19 nt, Mycobacterium bovis subsp bovis AF2122/97
cccgguccugcucgcacag

SEQ ID NO: 3139064 - RNA, 22 nt, Mycobacterium bovis subsp bovis AF2122/97
cccgguccugcucgcacagcac

SEQ ID NO: 3139065 - RNA, 19 nt, Mycobacterium bovis subsp bovis AF2122/97
cccggucgacgggucggcg

SEQ ID NO: 3139066 - RNA, 21 nt, Mycobacterium bovis subsp bovis AF2122/97
cccggucgacgggucggcgcc

SEQ ID NO: 3139067 - RNA, 22 nt, Mycobacterium bovis subsp bovis AF2122/97
cccggucgacgggucggcgccg

SEQ ID NO: 3139068 - RNA, 18 nt, Mycobacterium bovis subsp bovis AF2122/97
cccggucgagccagcgga

SEQ ID NO: 3139069 - RNA, 21 nt, Mycobacterium bovis subsp bovis AF2122/97
cccggucgagccagcggagca

SEQ ID NO: 3139070 - RNA, 14 nt, Mycobacterium bovis subsp bovis AF2122/97
cccggucgagcucg

SEQ ID NO: 3139071 - RNA, 15 nt, Mycobacterium bovis subsp bovis AF2122/97
cccggucgauucggc

SEQ ID NO: 3139072 - RNA, 23 nt, Mycobacterium bovis subsp bovis AF2122/97
cccggucgauucggcucaucccg

SEQ ID NO: 3139073 - RNA, 18 nt, Mycobacterium bovis subsp bovis AF2122/97
cccggucgcacuuggccc

SEQ ID NO: 3139074 - RNA, 13 nt, Mycobacterium bovis subsp bovis AF2122/97
cccggucgccgcg

SEQ ID NO: 3139075 - RNA, 21 nt, Mycobacterium bovis subsp bovis AF2122/97
cccggucgccggucaucgccg

SEQ ID NO: 3139076 - RNA, 20 nt, Mycobacterium bovis subsp bovis AF2122/97
cccggucggagcggugccga

SEQ ID NO: 3139077 - RNA, 15 nt, Mycobacterium bovis subsp bovis AF2122/97
cccggucggcccgcg

SEQ ID NO: 3139078 - RNA, 14 nt, Mycobacterium bovis subsp bovis AF2122/97
cccggucggcggca

SEQ ID NO: 3139079 - RNA, 22 nt, Mycobacterium bovis subsp bovis AF2122/97
cccggucgggcgcggggcggcc

SEQ ID NO: 3139080 - RNA, 17 nt, Mycobacterium bovis subsp bovis AF2122/97
cccggucuacgacgucg

SEQ ID NO: 3139081 - RNA, 22 nt, Mycobacterium bovis subsp bovis AF2122/97
cccggucuacgacgucgcugua

SEQ ID NO: 3139082 - RNA, 21 nt, Mycobacterium bovis subsp bovis AF2122/97
cccggucuacgccaccgagau

SEQ ID NO: 3139083 - RNA, 21 nt, Mycobacterium bovis subsp bovis AF2122/97
cccggucuauuugccugccgc

SEQ ID NO: 3139084 - RNA, 11 nt, Mycobacterium bovis subsp bovis AF2122/97
cccggucucga

SEQ ID NO: 3139085 - RNA, 19 nt, Mycobacterium bovis subsp bovis AF2122/97
cccggucucgacggcggcc

SEQ ID NO: 3139086 - RNA, 16 nt, Mycobacterium bovis subsp bovis AF2122/97
cccggucuuacggucg

SEQ ID NO: 3139087 - RNA, 12 nt, Mycobacterium bovis subsp bovis AF2122/97
cccggugacaag

SEQ ID NO: 3139088 - RNA, 13 nt, Mycobacterium bovis subsp bovis AF2122/97
cccggugaccacu

SEQ ID NO: 3139089 - RNA, 17 nt, Mycobacterium bovis subsp bovis AF2122/97
cccggugaccagcaacc

SEQ ID NO: 3139090 - RNA, 20 nt, Mycobacterium bovis subsp bovis AF2122/97
cccggugacccgcugggccg

SEQ ID NO: 3139091 - RNA, 13 nt, Mycobacterium bovis subsp bovis AF2122/97
cccggugacgccg

SEQ ID NO: 3139092 - RNA, 16 nt, Mycobacterium bovis subsp bovis AF2122/97
cccggugacgccgucg

SEQ ID NO: 3139093 - RNA, 15 nt, Mycobacterium bovis subsp bovis AF2122/97
cccggugagaagaag

SEQ ID NO: 3139094 - RNA, 19 nt, Mycobacterium bovis subsp bovis AF2122/97
cccggugauccacgcucgg

SEQ ID NO: 3139095 - RNA, 19 nt, Mycobacterium bovis subsp bovis AF2122/97
cccucgaauucggccggcg

SEQ ID NO: 3139096 - RNA, 17 nt, Mycobacterium bovis subsp bovis AF2122/97
cccucgacgcgcucggg

SEQ ID NO: 3139097 - RNA, 18 nt, Mycobacterium bovis subsp bovis AF2122/97
cccucgaucacggcggcc

SEQ ID NO: 3139098 - RNA, 20 nt, Mycobacterium bovis subsp bovis AF2122/97
cccucgaucacggcggcccc

SEQ ID NO: 3139099 - RNA, 21 nt, Mycobacterium bovis subsp bovis AF2122/97
cccucgauggccaggcuggcg

SEQ ID NO: 3139100 - RNA, 14 nt, Mycobacterium bovis subsp bovis AF2122/97
cccucgcaaccggc

SEQ ID NO: 3139101 - RNA, 22 nt, Mycobacterium bovis subsp bovis AF2122/97
cccucgccgaaguagacggugg

SEQ ID NO: 3139102 - RNA, 12 nt, Mycobacterium bovis subsp bovis AF2122/97
cccucggccgca

SEQ ID NO: 3139103 - RNA, 12 nt, Mycobacterium bovis subsp bovis AF2122/97
cccucggccgcc

SEQ ID NO: 3139104 - RNA, 14 nt, Mycobacterium bovis subsp bovis AF2122/97
cccucggccgcccg

SEQ ID NO: 3139105 - RNA, 15 nt, Mycobacterium bovis subsp bovis AF2122/97
cccucggccgcccgu

SEQ ID NO: 3139106 - RNA, 15 nt, Mycobacterium bovis subsp bovis AF2122/97
cccucggcgaccugg

SEQ ID NO: 3139107 - RNA, 18 nt, Mycobacterium bovis subsp bovis AF2122/97
cccucggcgugaucaccg

SEQ ID NO: 3139108 - RNA, 19 nt, Mycobacterium bovis subsp bovis AF2122/97
cccucgggacugcgcggcu

SEQ ID NO: 3139109 - RNA, 15 nt, Mycobacterium bovis subsp bovis AF2122/97
cccucgggaucaccg

SEQ ID NO: 3139110 - RNA, 22 nt, Mycobacterium bovis subsp bovis AF2122/97
cccucggugagaaucgacuccg

SEQ ID NO: 3139111 - RNA, 17 nt, Mycobacterium bovis subsp bovis AF2122/97
cccucguaauccacgcc

SEQ ID NO: 3139112 - RNA, 19 nt, Mycobacterium bovis subsp bovis AF2122/97
cccucguaauccacgccga

SEQ ID NO: 3139113 - RNA, 18 nt, Mycobacterium bovis subsp bovis AF2122/97
cccucgucgaucgccgcg

SEQ ID NO: 3139114 - RNA, 18 nt, Mycobacterium bovis subsp bovis AF2122/97
cccucguuaucgaccgcc

SEQ ID NO: 3139115 - RNA, 19 nt, Mycobacterium bovis subsp bovis AF2122/97
cccucguuaucgaccgccg

SEQ ID NO: 3139116 - RNA, 16 nt, Mycobacterium bovis subsp bovis AF2122/97
cccucuacacccggac

SEQ ID NO: 3139117 - RNA, 20 nt, Mycobacterium bovis subsp bovis AF2122/97
cccucuagcgccucgccggc

SEQ ID NO: 3139118 - RNA, 20 nt, Mycobacterium bovis subsp bovis AF2122/97
cccugaaaagggcuggucua

SEQ ID NO: 3139119 - RNA, 15 nt, Mycobacterium bovis subsp bovis AF2122/97
cccugaacgguucgg

SEQ ID NO: 3139120 - RNA, 16 nt, Mycobacterium bovis subsp bovis AF2122/97
cccugaagggccgccu

SEQ ID NO: 3139121 - RNA, 20 nt, Mycobacterium bovis subsp bovis AF2122/97
cccugaagggccgccucgcg

SEQ ID NO: 3139122 - RNA, 13 nt, Mycobacterium bovis subsp bovis AF2122/97
cccugacacccau

SEQ ID NO: 3139123 - RNA, 21 nt, Mycobacterium bovis subsp bovis AF2122/97
cccugacacccaucgaccgcc

SEQ ID NO: 3139124 - RNA, 13 nt, Mycobacterium bovis subsp bovis AF2122/97
cccugacagcgag

SEQ ID NO: 3139125 - RNA, 17 nt, Mycobacterium bovis subsp bovis AF2122/97
cccugacccggagccgc

SEQ ID NO: 3139126 - RNA, 15 nt, Mycobacterium bovis subsp bovis AF2122/97
cccugacgccccgcc

SEQ ID NO: 3139127 - RNA, 23 nt, Mycobacterium bovis subsp bovis AF2122/97
cccugacgguggugaccgcgggc

SEQ ID NO: 3139128 - RNA, 22 nt, Mycobacterium bovis subsp bovis AF2122/97
cccugacgucacguucggcgca

SEQ ID NO: 3139129 - RNA, 20 nt, Mycobacterium bovis subsp bovis AF2122/97
cccugagaacacguucggcg

SEQ ID NO: 3139130 - RNA, 13 nt, Mycobacterium bovis subsp bovis AF2122/97
cccugagccaccc

SEQ ID NO: 3139131 - RNA, 19 nt, Mycobacterium bovis subsp bovis AF2122/97
cccugagcgaagugucgcu

SEQ ID NO: 3139132 - RNA, 13 nt, Mycobacterium bovis subsp bovis AF2122/97
cccugagcucccg

SEQ ID NO: 3139133 - RNA, 23 nt, Mycobacterium bovis subsp bovis AF2122/97
cccugaucaaggaccgcucugcg

SEQ ID NO: 3139134 - RNA, 23 nt, Mycobacterium bovis subsp bovis AF2122/97
cccugaucgugaacacgucgcgg

SEQ ID NO: 3139135 - RNA, 16 nt, Mycobacterium bovis subsp bovis AF2122/97
cccugauggggccuug

SEQ ID NO: 3139136 - RNA, 21 nt, Mycobacterium bovis subsp bovis AF2122/97
cccugaugugaguccagccgg

SEQ ID NO: 3139137 - RNA, 16 nt, Mycobacterium bovis subsp bovis AF2122/97
cccugauugaagcccc

SEQ ID NO: 3139138 - RNA, 12 nt, Mycobacterium bovis subsp bovis AF2122/97
cccugcacagca

SEQ ID NO: 3139139 - RNA, 20 nt, Mycobacterium bovis subsp bovis AF2122/97
cccugcacccagccgugccc

SEQ ID NO: 3139140 - RNA, 21 nt, Mycobacterium bovis subsp bovis AF2122/97
cccugcacccagccgugccca

SEQ ID NO: 3139141 - RNA, 18 nt, Mycobacterium bovis subsp bovis AF2122/97
cccugcaccgucacgucg

SEQ ID NO: 3139142 - RNA, 17 nt, Mycobacterium bovis subsp bovis AF2122/97
cccugcacggugcccag

SEQ ID NO: 3139143 - RNA, 23 nt, Mycobacterium bovis subsp bovis AF2122/97
cccugcacugcgcgugcucgacg

SEQ ID NO: 3139144 - RNA, 22 nt, Mycobacterium bovis subsp bovis AF2122/97
cccugcagacggguggcccgac

SEQ ID NO: 3139145 - RNA, 15 nt, Mycobacterium bovis subsp bovis AF2122/97
cccugcauaggcgcg

SEQ ID NO: 3139146 - RNA, 16 nt, Mycobacterium bovis subsp bovis AF2122/97
cccugcauaggcgcgg

SEQ ID NO: 3139147 - RNA, 20 nt, Mycobacterium bovis subsp bovis AF2122/97
cccugcccagcacccccugc

SEQ ID NO: 3139148 - RNA, 15 nt, Mycobacterium bovis subsp bovis AF2122/97
cccugcccggcccgc

SEQ ID NO: 3139149 - RNA, 16 nt, Mycobacterium bovis subsp bovis AF2122/97
cccugcccggcccgcc

SEQ ID NO: 3139150 - RNA, 19 nt, Mycobacterium bovis subsp bovis AF2122/97
cccugccgaucccguggug

SEQ ID NO: 3139151 - RNA, 18 nt, Mycobacterium bovis subsp bovis AF2122/97
cccugccgccggccccgc

SEQ ID NO: 3139152 - RNA, 21 nt, Mycobacterium bovis subsp bovis AF2122/97
cccugccgcgaugagcggcgc

SEQ ID NO: 3139153 - RNA, 12 nt, Mycobacterium bovis subsp bovis AF2122/97
cccugccggcag

SEQ ID NO: 3139154 - RNA, 13 nt, Mycobacterium bovis subsp bovis AF2122/97
cccugccggcagc

SEQ ID NO: 3139155 - RNA, 14 nt, Mycobacterium bovis subsp bovis AF2122/97
cccugccggcagcg

SEQ ID NO: 3139156 - RNA, 13 nt, Mycobacterium bovis subsp bovis AF2122/97
cccugcgcagccg

SEQ ID NO: 3139157 - RNA, 15 nt, Mycobacterium bovis subsp bovis AF2122/97
cccugcgcagccgcc

SEQ ID NO: 3139158 - RNA, 19 nt, Mycobacterium bovis subsp bovis AF2122/97
cccugcgccacacccggca

SEQ ID NO: 3139159 - RNA, 13 nt, Mycobacterium bovis subsp bovis AF2122/97
cccugcgccucgg

SEQ ID NO: 3139160 - RNA, 19 nt, Mycobacterium bovis subsp bovis AF2122/97
cccugcgccucggcggcca

SEQ ID NO: 3139161 - RNA, 15 nt, Mycobacterium bovis subsp bovis AF2122/97
cccugcgcggccacc

SEQ ID NO: 3139162 - RNA, 13 nt, Mycobacterium bovis subsp bovis AF2122/97
cccugcgggccga

SEQ ID NO: 3139163 - RNA, 14 nt, Mycobacterium bovis subsp bovis AF2122/97
cccugcgguccgcu

SEQ ID NO: 3139164 - RNA, 20 nt, Mycobacterium bovis subsp bovis AF2122/97
cccugcgguccgcugccauc

SEQ ID NO: 3139165 - RNA, 13 nt, Mycobacterium bovis subsp bovis AF2122/97
cccugcgugcggc

SEQ ID NO: 3139166 - RNA, 17 nt, Mycobacterium bovis subsp bovis AF2122/97
cccugcucgaacgcuga

SEQ ID NO: 3139167 - RNA, 15 nt, Mycobacterium bovis subsp bovis AF2122/97
cccugcucggccaac

SEQ ID NO: 3139168 - RNA, 21 nt, Mycobacterium bovis subsp bovis AF2122/97
cccugcugcagggccuggcca

SEQ ID NO: 3139169 - RNA, 20 nt, Mycobacterium bovis subsp bovis AF2122/97
cccugcuggcccaacaucaa

SEQ ID NO: 3139170 - RNA, 17 nt, Mycobacterium bovis subsp bovis AF2122/97
cccugcuggugucggcu

SEQ ID NO: 3139171 - RNA, 20 nt, Mycobacterium bovis subsp bovis AF2122/97
cccugcuggugucggcucga

SEQ ID NO: 3139172 - RNA, 20 nt, Mycobacterium bovis subsp bovis AF2122/97
cccuggaccagcgggcggcc

SEQ ID NO: 3139173 - RNA, 13 nt, Mycobacterium bovis subsp bovis AF2122/97
cccuggacuucgg

SEQ ID NO: 3139174 - RNA, 17 nt, Mycobacterium bovis subsp bovis AF2122/97
cccuggacuucgggggc

SEQ ID NO: 3139175 - RNA, 16 nt, Mycobacterium bovis subsp bovis AF2122/97
cccuggaucgcgcccu

SEQ ID NO: 3139176 - RNA, 20 nt, Mycobacterium bovis subsp bovis AF2122/97
cccuggauggcgcccugcgc

SEQ ID NO: 3139177 - RNA, 14 nt, Mycobacterium bovis subsp bovis AF2122/97
cccuggccgcccag

SEQ ID NO: 3139178 - RNA, 12 nt, Mycobacterium bovis subsp bovis AF2122/97
cccuggccgccg

SEQ ID NO: 3139179 - RNA, 13 nt, Mycobacterium bovis subsp bovis AF2122/97
cccuggccgccgc

SEQ ID NO: 3139180 - RNA, 14 nt, Mycobacterium bovis subsp bovis AF2122/97
cccuggccgccggc

SEQ ID NO: 3139181 - RNA, 16 nt, Mycobacterium bovis subsp bovis AF2122/97
cccuggccgccggccc

SEQ ID NO: 3139182 - RNA, 18 nt, Mycobacterium bovis subsp bovis AF2122/97
ccgaacagcuggacggcc

SEQ ID NO: 3139183 - RNA, 15 nt, Mycobacterium bovis subsp bovis AF2122/97
ccgaacagucgcagc

SEQ ID NO: 3139184 - RNA, 16 nt, Mycobacterium bovis subsp bovis AF2122/97
ccgaacauucccaugc

SEQ ID NO: 3139185 - RNA, 19 nt, Mycobacterium bovis subsp bovis AF2122/97
ccgaacauugcgcccagcg

SEQ ID NO: 3139186 - RNA, 13 nt, Mycobacterium bovis subsp bovis AF2122/97
ccgaaccaccgcg

SEQ ID NO: 3139187 - RNA, 14 nt, Mycobacterium bovis subsp bovis AF2122/97
ccgaaccaccgcgu

SEQ ID NO: 3139188 - RNA, 15 nt, Mycobacterium bovis subsp bovis AF2122/97
ccgaacccaccacga

SEQ ID NO: 3139189 - RNA, 17 nt, Mycobacterium bovis subsp bovis AF2122/97
ccgaaccgacguucccc

SEQ ID NO: 3139190 - RNA, 23 nt, Mycobacterium bovis subsp bovis AF2122/97
ccgaaccgagggauggccguuga

SEQ ID NO: 3139191 - RNA, 15 nt, Mycobacterium bovis subsp bovis AF2122/97
ccgaaccgccgcugc

SEQ ID NO: 3139192 - RNA, 18 nt, Mycobacterium bovis subsp bovis AF2122/97
ccgaaccgccgcugccgc

SEQ ID NO: 3139193 - RNA, 19 nt, Mycobacterium bovis subsp bovis AF2122/97
ccgaaccgcguuaugccag

SEQ ID NO: 3139194 - RNA, 23 nt, Mycobacterium bovis subsp bovis AF2122/97
ccgaaccgcguuaugccaggcgc

SEQ ID NO: 3139195 - RNA, 17 nt, Mycobacterium bovis subsp bovis AF2122/97
ccgaaccggcaccagcg

SEQ ID NO: 3139196 - RNA, 19 nt, Mycobacterium bovis subsp bovis AF2122/97
ccgaaccggcaccagcggc

SEQ ID NO: 3139197 - RNA, 16 nt, Mycobacterium bovis subsp bovis AF2122/97
ccgaaccgucagcggc

SEQ ID NO: 3139198 - RNA, 19 nt, Mycobacterium bovis subsp bovis AF2122/97
ccgaaccgucagcggcaac

SEQ ID NO: 3139199 - RNA, 22 nt, Mycobacterium bovis subsp bovis AF2122/97
ccgaaccguucgcucagggugu

SEQ ID NO: 3139200 - RNA, 15 nt, Mycobacterium bovis subsp bovis AF2122/97
ccgaaccugcggcag

SEQ ID NO: 3139201 - RNA, 18 nt, Mycobacterium bovis subsp bovis AF2122/97
ccgaaccuggucuugacu

SEQ ID NO: 3139202 - RNA, 20 nt, Mycobacterium bovis subsp bovis AF2122/97
ccgaacgaggcgcccagcga

SEQ ID NO: 3139203 - RNA, 15 nt, Mycobacterium bovis subsp bovis AF2122/97
ccgaacgcaacagcc

SEQ ID NO: 3139204 - RNA, 16 nt, Mycobacterium bovis subsp bovis AF2122/97
ccgaacgcaacgccga

SEQ ID NO: 3139205 - RNA, 13 nt, Mycobacterium bovis subsp bovis AF2122/97
ccgaacgcaccga

SEQ ID NO: 3139206 - RNA, 22 nt, Mycobacterium bovis subsp bovis AF2122/97
ccgaacgcacgucgaggcggca

SEQ ID NO: 3139207 - RNA, 23 nt, Mycobacterium bovis subsp bovis AF2122/97
ccgaacgcacgucgaggcggcag

SEQ ID NO: 3139208 - RNA, 14 nt, Mycobacterium bovis subsp bovis AF2122/97
ccgaacgccaccac

SEQ ID NO: 3139209 - RNA, 17 nt, Mycobacterium bovis subsp bovis AF2122/97
ccgaacgccaccaccuc

SEQ ID NO: 3139210 - RNA, 15 nt, Mycobacterium bovis subsp bovis AF2122/97
ccgaacgccagaccg

SEQ ID NO: 3139211 - RNA, 22 nt, Mycobacterium bovis subsp bovis AF2122/97
ccgaacgcgagguuccaguugg

SEQ ID NO: 3139212 - RNA, 13 nt, Mycobacterium bovis subsp bovis AF2122/97
ccgaacgcggcca

SEQ ID NO: 3139213 - RNA, 21 nt, Mycobacterium bovis subsp bovis AF2122/97
ccgaacggcaauucgggauag

SEQ ID NO: 3139214 - RNA, 18 nt, Mycobacterium bovis subsp bovis AF2122/97
ccgaacggguagacccac

SEQ ID NO: 3139215 - RNA, 21 nt, Mycobacterium bovis subsp bovis AF2122/97
ccgaacggguagacccacauc

SEQ ID NO: 3139216 - RNA, 18 nt, Mycobacterium bovis subsp bovis AF2122/97
ccgaacgugaacucacgg

SEQ ID NO: 3139217 - RNA, 23 nt, Mycobacterium bovis subsp bovis AF2122/97
ccgaacgugaacucacggcggua

SEQ ID NO: 3139218 - RNA, 23 nt, Mycobacterium bovis subsp bovis AF2122/97
ccgaacgugcaaccacggcggca

SEQ ID NO: 3139219 - RNA, 18 nt, Mycobacterium bovis subsp bovis AF2122/97
ccgaacuaucguugugcg

SEQ ID NO: 3139220 - RNA, 16 nt, Mycobacterium bovis subsp bovis AF2122/97
ccgaacucaacgacac

SEQ ID NO: 3139221 - RNA, 20 nt, Mycobacterium bovis subsp bovis AF2122/97
ccgaacuccgcggaacccag

SEQ ID NO: 3139222 - RNA, 19 nt, Mycobacterium bovis subsp bovis AF2122/97
ccgaacuccuuaucgucga

SEQ ID NO: 3139223 - RNA, 19 nt, Mycobacterium bovis subsp bovis AF2122/97
ccgaacucgcgggcgacca

SEQ ID NO: 3139224 - RNA, 15 nt, Mycobacterium bovis subsp bovis AF2122/97
ccgaacucguuggcg

SEQ ID NO: 3139225 - RNA, 22 nt, Mycobacterium bovis subsp bovis AF2122/97
ccgaacuucugguaggcggcca

SEQ ID NO: 3139226 - RNA, 21 nt, Mycobacterium bovis subsp bovis AF2122/97
ccgaagaacaguugcccgacg

SEQ ID NO: 3139227 - RNA, 13 nt, Mycobacterium bovis subsp bovis AF2122/97
ccgaagaagcccg

SEQ ID NO: 3139228 - RNA, 18 nt, Mycobacterium bovis subsp bovis AF2122/97
ccgaagaagcccgacugg

SEQ ID NO: 3139229 - RNA, 21 nt, Mycobacterium bovis subsp bovis AF2122/97
ccgaagaaugggauggcacca

SEQ ID NO: 3139230 - RNA, 18 nt, Mycobacterium bovis subsp bovis AF2122/97
ccgaagacgggguggugg

SEQ ID NO: 3139231 - RNA, 16 nt, Mycobacterium bovis subsp bovis AF2122/97
ccgaagacgugccggc

SEQ ID NO: 3139232 - RNA, 19 nt, Mycobacterium bovis subsp bovis AF2122/97
ccgaagacucgucaacgga

SEQ ID NO: 3139233 - RNA, 12 nt, Mycobacterium bovis subsp bovis AF2122/97
ccgaagaggaga

SEQ ID NO: 3139234 - RNA, 16 nt, Mycobacterium bovis subsp bovis AF2122/97
ccgaagaugccuggaa

SEQ ID NO: 3139235 - RNA, 15 nt, Mycobacterium bovis subsp bovis AF2122/97
ccgaagauggccagc

SEQ ID NO: 3139236 - RNA, 18 nt, Mycobacterium bovis subsp bovis AF2122/97
ccgaagauggccagcgcg

SEQ ID NO: 3139237 - RNA, 14 nt, Mycobacterium bovis subsp bovis AF2122/97
ccgaagcagaacag

SEQ ID NO: 3139238 - RNA, 11 nt, Mycobacterium bovis subsp bovis AF2122/97
ccgaagccccc

SEQ ID NO: 3139239 - RNA, 11 nt, Mycobacterium bovis subsp bovis AF2122/97
ccgaagcccga

SEQ ID NO: 3139240 - RNA, 13 nt, Mycobacterium bovis subsp bovis AF2122/97
ccgaagcccgggg

SEQ ID NO: 3139241 - RNA, 15 nt, Mycobacterium bovis subsp bovis AF2122/97
ccgaagccgccgggu

SEQ ID NO: 3139242 - RNA, 13 nt, Mycobacterium bovis subsp bovis AF2122/97
ccgaagccggcgc

SEQ ID NO: 3139243 - RNA, 13 nt, Mycobacterium bovis subsp bovis AF2122/97
ccgaagccgggcc

SEQ ID NO: 3139244 - RNA, 15 nt, Mycobacterium bovis subsp bovis AF2122/97
ccgaagccgggcccc

SEQ ID NO: 3139245 - RNA, 15 nt, Mycobacterium bovis subsp bovis AF2122/97
ccgaagccggugccg

SEQ ID NO: 3139246 - RNA, 17 nt, Mycobacterium bovis subsp bovis AF2122/97
ccgaagccucggcaugc

SEQ ID NO: 3139247 - RNA, 17 nt, Mycobacterium bovis subsp bovis AF2122/97
ccgaagccuugcagcgc

SEQ ID NO: 3139248 - RNA, 16 nt, Mycobacterium bovis subsp bovis AF2122/97
ccgaagcgcccguugg

SEQ ID NO: 3139249 - RNA, 17 nt, Mycobacterium bovis subsp bovis AF2122/97
ccgaagcggaucuggcc

SEQ ID NO: 3139250 - RNA, 12 nt, Mycobacterium bovis subsp bovis AF2122/97
ccgaagcggcca

SEQ ID NO: 3139251 - RNA, 17 nt, Mycobacterium bovis subsp bovis AF2122/97
ccgaagcggccaccgcc

SEQ ID NO: 3139252 - RNA, 18 nt, Mycobacterium bovis subsp bovis AF2122/97
ccgaagcggccaccgccg

SEQ ID NO: 3139253 - RNA, 14 nt, Mycobacterium bovis subsp bovis AF2122/97
ccgaagcggugacc

SEQ ID NO: 3139254 - RNA, 20 nt, Mycobacterium bovis subsp bovis AF2122/97
ccgaagcuacgucggcucgu

SEQ ID NO: 3139255 - RNA, 17 nt, Mycobacterium bovis subsp bovis AF2122/97
ccgaagcucaucgccgc

SEQ ID NO: 3139256 - RNA, 12 nt, Mycobacterium bovis subsp bovis AF2122/97
ccgaagcugccc

SEQ ID NO: 3139257 - RNA, 22 nt, Mycobacterium bovis subsp bovis AF2122/97
ccgaagcugcgggucagcgccg

SEQ ID NO: 3139258 - RNA, 13 nt, Mycobacterium bovis subsp bovis AF2122/97
ccgaaggccgcca

SEQ ID NO: 3139259 - RNA, 23 nt, Mycobacterium bovis subsp bovis AF2122/97
ccgaaggccgccaguccgaucgc

SEQ ID NO: 3139260 - RNA, 20 nt, Mycobacterium bovis subsp bovis AF2122/97
ccgaaggcggcuccaccggg

SEQ ID NO: 3139261 - RNA, 19 nt, Mycobacterium bovis subsp bovis AF2122/97
ccgaaggugggauugaagc

SEQ ID NO: 3139262 - RNA, 14 nt, Mycobacterium bovis subsp bovis AF2122/97
ccgaaguacuggcc

SEQ ID NO: 3139263 - RNA, 17 nt, Mycobacterium bovis subsp bovis AF2122/97
ccgaaguacuggccgcc

SEQ ID NO: 3139264 - RNA, 19 nt, Mycobacterium bovis subsp bovis AF2122/97
ccgaaguacuggccgccgc

SEQ ID NO: 3139265 - RNA, 22 nt, Mycobacterium bovis subsp bovis AF2122/97
ccgaaguacuggccgccgcgca

SEQ ID NO: 3139266 - RNA, 16 nt, Mycobacterium bovis subsp bovis AF2122/97
ccgaaguagaagccca

SEQ ID NO: 3139267 - RNA, 17 nt, Mycobacterium bovis subsp bovis AF2122/97
ccgaaguagaagcccag

SEQ ID NO: 3139268 - RNA, 18 nt, Mycobacterium bovis subsp bovis AF2122/97
ccgaaguagaagcccagg

SEQ ID NO: 3139269 - RNA, 18 nt, Mycobacterium bovis subsp bovis AF2122/97
ccgacaguccgcgccggc

SEQ ID NO: 3139270 - RNA, 19 nt, Mycobacterium bovis subsp bovis AF2122/97
ccgacaguccgcgccggcg

SEQ ID NO: 3139271 - RNA, 21 nt, Mycobacterium bovis subsp bovis AF2122/97
ccgacaguccgcgccggcggg

SEQ ID NO: 3139272 - RNA, 15 nt, Mycobacterium bovis subsp bovis AF2122/97
ccgacaguggcucac

SEQ ID NO: 3139273 - RNA, 17 nt, Mycobacterium bovis subsp bovis AF2122/97
ccgacaguggucccggu

SEQ ID NO: 3139274 - RNA, 19 nt, Mycobacterium bovis subsp bovis AF2122/97
ccgacaguggucccgguga

SEQ ID NO: 3139275 - RNA, 18 nt, Mycobacterium bovis subsp bovis AF2122/97
ccgacaguuuaccgugcc

SEQ ID NO: 3139276 - RNA, 19 nt, Mycobacterium bovis subsp bovis AF2122/97
ccgacaguuuaccgugccg

SEQ ID NO: 3139277 - RNA, 20 nt, Mycobacterium bovis subsp bovis AF2122/97
ccgacaguuuaccgugccgc

SEQ ID NO: 3139278 - RNA, 21 nt, Mycobacterium bovis subsp bovis AF2122/97
ccgacaguuuaccgugccgcc

SEQ ID NO: 3139279 - RNA, 19 nt, Mycobacterium bovis subsp bovis AF2122/97
ccgacauacgucggggccg

SEQ ID NO: 3139280 - RNA, 23 nt, Mycobacterium bovis subsp bovis AF2122/97
ccgacaucgcugcgacuggccgu

SEQ ID NO: 3139281 - RNA, 16 nt, Mycobacterium bovis subsp bovis AF2122/97
ccgacaucggcggccc

SEQ ID NO: 3139282 - RNA, 12 nt, Mycobacterium bovis subsp bovis AF2122/97
ccgacaucguca

SEQ ID NO: 3139283 - RNA, 16 nt, Mycobacterium bovis subsp bovis AF2122/97
ccgacaucgucaucca

SEQ ID NO: 3139284 - RNA, 12 nt, Mycobacterium bovis subsp bovis AF2122/97
ccgacaucguga

SEQ ID NO: 3139285 - RNA, 18 nt, Mycobacterium bovis subsp bovis AF2122/97
ccgacaugaaccggucga

SEQ ID NO: 3139286 - RNA, 15 nt, Mycobacterium bovis subsp bovis AF2122/97
ccgacaugcgccgag

SEQ ID NO: 3139287 - RNA, 16 nt, Mycobacterium bovis subsp bovis AF2122/97
ccgacauggcggugcg

SEQ ID NO: 3139288 - RNA, 18 nt, Mycobacterium bovis subsp bovis AF2122/97
ccgacauggcggugcgca

SEQ ID NO: 3139289 - RNA, 21 nt, Mycobacterium bovis subsp bovis AF2122/97
ccgacauggcggugcgcagcu

SEQ ID NO: 3139290 - RNA, 13 nt, Mycobacterium bovis subsp bovis AF2122/97
ccgacaugguccg

SEQ ID NO: 3139291 - RNA, 19 nt, Mycobacterium bovis subsp bovis AF2122/97
ccgacaugguccgaccagc

SEQ ID NO: 3139292 - RNA, 21 nt, Mycobacterium bovis subsp bovis AF2122/97
ccgacaugguccgaccagcgg

SEQ ID NO: 3139293 - RNA, 17 nt, Mycobacterium bovis subsp bovis AF2122/97
ccgaccaacgcggugug

SEQ ID NO: 3139294 - RNA, 20 nt, Mycobacterium bovis subsp bovis AF2122/97
ccgaccaauucgcaaucggc

SEQ ID NO: 3139295 - RNA, 16 nt, Mycobacterium bovis subsp bovis AF2122/97
ccgaccacaccgggau

SEQ ID NO: 3139296 - RNA, 12 nt, Mycobacterium bovis subsp bovis AF2122/97
ccgaccacccgg

SEQ ID NO: 3139297 - RNA, 16 nt, Mycobacterium bovis subsp bovis AF2122/97
ccgaccacccggaugg

SEQ ID NO: 3139298 - RNA, 14 nt, Mycobacterium bovis subsp bovis AF2122/97
ccgaccaccgccgg

SEQ ID NO: 3139299 - RNA, 13 nt, Mycobacterium bovis subsp bovis AF2122/97
ccgaccaccgcga

SEQ ID NO: 3139300 - RNA, 16 nt, Mycobacterium bovis subsp bovis AF2122/97
ccgaccaccucagcug

SEQ ID NO: 3139301 - RNA, 18 nt, Mycobacterium bovis subsp bovis AF2122/97
ccgaccaccucagcugcg

SEQ ID NO: 3139302 - RNA, 14 nt, Mycobacterium bovis subsp bovis AF2122/97
ccgaccacuccacg

SEQ ID NO: 3139303 - RNA, 19 nt, Mycobacterium bovis subsp bovis AF2122/97
ccgaccagaacgacgccgc

SEQ ID NO: 3139304 - RNA, 21 nt, Mycobacterium bovis subsp bovis AF2122/97
ccgaccagaacgacgccgcgg

SEQ ID NO: 3139305 - RNA, 15 nt, Mycobacterium bovis subsp bovis AF2122/97
ccgaccagcacaccg

SEQ ID NO: 3139306 - RNA, 14 nt, Mycobacterium bovis subsp bovis AF2122/97
ccgaccagcacccg

SEQ ID NO: 3139307 - RNA, 16 nt, Mycobacterium bovis subsp bovis AF2122/97
ccgaccagcaucucgg

SEQ ID NO: 3139308 - RNA, 22 nt, Mycobacterium bovis subsp bovis AF2122/97
ccgaccagcgcgcugcgcgacu

SEQ ID NO: 3139309 - RNA, 19 nt, Mycobacterium bovis subsp bovis AF2122/97
ccgaccagcggccgaccgc

SEQ ID NO: 3139310 - RNA, 22 nt, Mycobacterium bovis subsp bovis AF2122/97
ccgaccagcggccgaccgcgac

SEQ ID NO: 3139311 - RNA, 13 nt, Mycobacterium bovis subsp bovis AF2122/97
ccgaccagcuuga

SEQ ID NO: 3139312 - RNA, 14 nt, Mycobacterium bovis subsp bovis AF2122/97
ccgaccagcuugac

SEQ ID NO: 3139313 - RNA, 16 nt, Mycobacterium bovis subsp bovis AF2122/97
ccgaccagggccgccg

SEQ ID NO: 3139314 - RNA, 17 nt, Mycobacterium bovis subsp bovis AF2122/97
ccgaccagggccgccgc

SEQ ID NO: 3139315 - RNA, 16 nt, Mycobacterium bovis subsp bovis AF2122/97
ccgaccagucgacguc

SEQ ID NO: 3139316 - RNA, 19 nt, Mycobacterium bovis subsp bovis AF2122/97
ccgaccagucgacgucucu

SEQ ID NO: 3139317 - RNA, 16 nt, Mycobacterium bovis subsp bovis AF2122/97
ccgaccaucgggacgc

SEQ ID NO: 3139318 - RNA, 20 nt, Mycobacterium bovis subsp bovis AF2122/97
ccgaccaucucaccgggccc

SEQ ID NO: 3139319 - RNA, 23 nt, Mycobacterium bovis subsp bovis AF2122/97
ccgaccaugcaagugggcgcgaa

SEQ ID NO: 3139320 - RNA, 17 nt, Mycobacterium bovis subsp bovis AF2122/97
ccgacccaucaccagcg

SEQ ID NO: 3139321 - RNA, 18 nt, Mycobacterium bovis subsp bovis AF2122/97
ccgacccaucaccagcgg

SEQ ID NO: 3139322 - RNA, 23 nt, Mycobacterium bovis subsp bovis AF2122/97
ccgacccaucaccagcggcugca

SEQ ID NO: 3139323 - RNA, 24 nt, Mycobacterium bovis subsp bovis AF2122/97
ccgacccaucaccagcggcugcag

SEQ ID NO: 3139324 - RNA, 15 nt, Mycobacterium bovis subsp bovis AF2122/97
ccgaccccgccgagc

SEQ ID NO: 3139325 - RNA, 19 nt, Mycobacterium bovis subsp bovis AF2122/97
ccgaccccgccgagcgcgc

SEQ ID NO: 3139326 - RNA, 21 nt, Mycobacterium bovis subsp bovis AF2122/97
ccgaccccgccgagcgcgccg

SEQ ID NO: 3139327 - RNA, 14 nt, Mycobacterium bovis subsp bovis AF2122/97
ccgaccccgcgccg

SEQ ID NO: 3139328 - RNA, 15 nt, Mycobacterium bovis subsp bovis AF2122/97
ccgaccccgcgccga

SEQ ID NO: 3139329 - RNA, 22 nt, Mycobacterium bovis subsp bovis AF2122/97
ccgacccgaugcgucucgcgcg

SEQ ID NO: 3139330 - RNA, 16 nt, Mycobacterium bovis subsp bovis AF2122/97
ccgacccgcccgaaga

SEQ ID NO: 3139331 - RNA, 20 nt, Mycobacterium bovis subsp bovis AF2122/97
ccgacccgccgacgccgccg

SEQ ID NO: 3139332 - RNA, 13 nt, Mycobacterium bovis subsp bovis AF2122/97
ccgacccgccgcg

SEQ ID NO: 3139333 - RNA, 14 nt, Mycobacterium bovis subsp bovis AF2122/97
ccgacccgccgcgc

SEQ ID NO: 3139334 - RNA, 16 nt, Mycobacterium bovis subsp bovis AF2122/97
ccgacccgccgcgccc

SEQ ID NO: 3139335 - RNA, 17 nt, Mycobacterium bovis subsp bovis AF2122/97
ccgacccgccgcgcccg

SEQ ID NO: 3139336 - RNA, 22 nt, Mycobacterium bovis subsp bovis AF2122/97
ccgacccgccgcgcccggcgca

SEQ ID NO: 3139337 - RNA, 12 nt, Mycobacterium bovis subsp bovis AF2122/97
ccgacccgcgcg

SEQ ID NO: 3139338 - RNA, 14 nt, Mycobacterium bovis subsp bovis AF2122/97
ccgacccgcugcca

SEQ ID NO: 3139339 - RNA, 18 nt, Mycobacterium bovis subsp bovis AF2122/97
ccgacccgcugccaccca

SEQ ID NO: 3139340 - RNA, 22 nt, Mycobacterium bovis subsp bovis AF2122/97
ccgacccgggcgagcgcggccu

SEQ ID NO: 3139341 - RNA, 17 nt, Mycobacterium bovis subsp bovis AF2122/97
ccgacccgggggcgccc

SEQ ID NO: 3139342 - RNA, 19 nt, Mycobacterium bovis subsp bovis AF2122/97
ccgacccgggggcgcccgg

SEQ ID NO: 3139343 - RNA, 20 nt, Mycobacterium bovis subsp bovis AF2122/97
ccgacccuacuuccucgacg

SEQ ID NO: 3139344 - RNA, 15 nt, Mycobacterium bovis subsp bovis AF2122/97
ccgacccugcugcag

SEQ ID NO: 3139345 - RNA, 18 nt, Mycobacterium bovis subsp bovis AF2122/97
ccgacccugcugcagggc

SEQ ID NO: 3139346 - RNA, 17 nt, Mycobacterium bovis subsp bovis AF2122/97
ccgaccgaaagccgcac

SEQ ID NO: 3139347 - RNA, 17 nt, Mycobacterium bovis subsp bovis AF2122/97
ccgaccgaaccgucagc

SEQ ID NO: 3139348 - RNA, 16 nt, Mycobacterium bovis subsp bovis AF2122/97
ccgaccgaaucagcac

SEQ ID NO: 3139349 - RNA, 18 nt, Mycobacterium bovis subsp bovis AF2122/97
ccgaccgaaucagcacgg

SEQ ID NO: 3139350 - RNA, 19 nt, Mycobacterium bovis subsp bovis AF2122/97
ccgaccgaaucagcacggu

SEQ ID NO: 3139351 - RNA, 16 nt, Mycobacterium bovis subsp bovis AF2122/97
ccgaccgacaccacca

SEQ ID NO: 3139352 - RNA, 15 nt, Mycobacterium bovis subsp bovis AF2122/97
ccgaccgaccgcacg

SEQ ID NO: 3139353 - RNA, 17 nt, Mycobacterium bovis subsp bovis AF2122/97
ccgaccgauacaccgac

SEQ ID NO: 3139354 - RNA, 23 nt, Mycobacterium bovis subsp bovis AF2122/97
ccgaccgauacaccgacgggaua

SEQ ID NO: 3139355 - RNA, 21 nt, Mycobacterium bovis subsp bovis AF2122/97
ccgacgccaacgccagcgggu

SEQ ID NO: 3139356 - RNA, 13 nt, Mycobacterium bovis subsp bovis AF2122/97
ccgacgccaccgc

SEQ ID NO: 3139357 - RNA, 21 nt, Mycobacterium bovis subsp bovis AF2122/97
ccgacgccagaacguggccau

SEQ ID NO: 3139358 - RNA, 21 nt, Mycobacterium bovis subsp bovis AF2122/97
ccgacgccagcugcccgacgu

SEQ ID NO: 3139359 - RNA, 14 nt, Mycobacterium bovis subsp bovis AF2122/97
ccgacgccccgauc

SEQ ID NO: 3139360 - RNA, 13 nt, Mycobacterium bovis subsp bovis AF2122/97
ccgacgcccgacg

SEQ ID NO: 3139361 - RNA, 14 nt, Mycobacterium bovis subsp bovis AF2122/97
ccgacgccgccagg

SEQ ID NO: 3139362 - RNA, 18 nt, Mycobacterium bovis subsp bovis AF2122/97
ccgacgccgccagguccg

SEQ ID NO: 3139363 - RNA, 23 nt, Mycobacterium bovis subsp bovis AF2122/97
ccgacgccgccagguccgccggu

SEQ ID NO: 3139364 - RNA, 16 nt, Mycobacterium bovis subsp bovis AF2122/97
ccgacgccgccggccc

SEQ ID NO: 3139365 - RNA, 18 nt, Mycobacterium bovis subsp bovis AF2122/97
ccgacgccgccggccccg

SEQ ID NO: 3139366 - RNA, 19 nt, Mycobacterium bovis subsp bovis AF2122/97
ccgacgccgccggccccgc

SEQ ID NO: 3139367 - RNA, 16 nt, Mycobacterium bovis subsp bovis AF2122/97
ccgacgccgccggcgc

SEQ ID NO: 3139368 - RNA, 18 nt, Mycobacterium bovis subsp bovis AF2122/97
ccgacgccgccggcgcca

SEQ ID NO: 3139369 - RNA, 14 nt, Mycobacterium bovis subsp bovis AF2122/97
ccgacgccggugcc

SEQ ID NO: 3139370 - RNA, 17 nt, Mycobacterium bovis subsp bovis AF2122/97
ccgacgccggugccggc

SEQ ID NO: 3139371 - RNA, 16 nt, Mycobacterium bovis subsp bovis AF2122/97
ccgacgccgguggcag

SEQ ID NO: 3139372 - RNA, 14 nt, Mycobacterium bovis subsp bovis AF2122/97
ccgacgccgguggg

SEQ ID NO: 3139373 - RNA, 16 nt, Mycobacterium bovis subsp bovis AF2122/97
ccgacgccggugucgg

SEQ ID NO: 3139374 - RNA, 17 nt, Mycobacterium bovis subsp bovis AF2122/97
ccgacgccggugucggc

SEQ ID NO: 3139375 - RNA, 16 nt, Mycobacterium bovis subsp bovis AF2122/97
ccgacgccgucgagca

SEQ ID NO: 3139376 - RNA, 21 nt, Mycobacterium bovis subsp bovis AF2122/97
ccgacgccugggcacggccgu

SEQ ID NO: 3139377 - RNA, 22 nt, Mycobacterium bovis subsp bovis AF2122/97
ccgacgccugggcacggccguc

SEQ ID NO: 3139378 - RNA, 17 nt, Mycobacterium bovis subsp bovis AF2122/97
ccgacgccuuccagccc

SEQ ID NO: 3139379 - RNA, 14 nt, Mycobacterium bovis subsp bovis AF2122/97
ccgacgcgaaccca

SEQ ID NO: 3139380 - RNA, 19 nt, Mycobacterium bovis subsp bovis AF2122/97
ccgacgcgaacgcggccac

SEQ ID NO: 3139381 - RNA, 18 nt, Mycobacterium bovis subsp bovis AF2122/97
ccgacgcgaucuguccgc

SEQ ID NO: 3139382 - RNA, 16 nt, Mycobacterium bovis subsp bovis AF2122/97
ccgacgcgcggccagc

SEQ ID NO: 3139383 - RNA, 20 nt, Mycobacterium bovis subsp bovis AF2122/97
ccgacgcgcucggcgaucug

SEQ ID NO: 3139384 - RNA, 14 nt, Mycobacterium bovis subsp bovis AF2122/97
ccgacgcggacagg

SEQ ID NO: 3139385 - RNA, 14 nt, Mycobacterium bovis subsp bovis AF2122/97
ccgacgcggcgggu

SEQ ID NO: 3139386 - RNA, 14 nt, Mycobacterium bovis subsp bovis AF2122/97
ccgacgcgggccgc

SEQ ID NO: 3139387 - RNA, 17 nt, Mycobacterium bovis subsp bovis AF2122/97
ccgacgcgggccgcgaa

SEQ ID NO: 3139388 - RNA, 14 nt, Mycobacterium bovis subsp bovis AF2122/97
ccgacgcguccggu

SEQ ID NO: 3139389 - RNA, 15 nt, Mycobacterium bovis subsp bovis AF2122/97
ccgacgcgucggcga

SEQ ID NO: 3139390 - RNA, 18 nt, Mycobacterium bovis subsp bovis AF2122/97
ccgacgcuaaguccccgc

SEQ ID NO: 3139391 - RNA, 13 nt, Mycobacterium bovis subsp bovis AF2122/97
ccgacgcuccagg

SEQ ID NO: 3139392 - RNA, 15 nt, Mycobacterium bovis subsp bovis AF2122/97
ccgacgcuggucggc

SEQ ID NO: 3139393 - RNA, 17 nt, Mycobacterium bovis subsp bovis AF2122/97
ccgacggaaugucagcc

SEQ ID NO: 3139394 - RNA, 19 nt, Mycobacterium bovis subsp bovis AF2122/97
ccgacggaaugucagccgg

SEQ ID NO: 3139395 - RNA, 15 nt, Mycobacterium bovis subsp bovis AF2122/97
ccgacggacuccggc

SEQ ID NO: 3139396 - RNA, 17 nt, Mycobacterium bovis subsp bovis AF2122/97
ccgacggacuccggccg

SEQ ID NO: 3139397 - RNA, 18 nt, Mycobacterium bovis subsp bovis AF2122/97
ccgacggacuccggccgg

SEQ ID NO: 3139398 - RNA, 19 nt, Mycobacterium bovis subsp bovis AF2122/97
ccgacggacuccggccggc

SEQ ID NO: 3139399 - RNA, 22 nt, Mycobacterium bovis subsp bovis AF2122/97
ccgacggacuccggccggccua

SEQ ID NO: 3139400 - RNA, 19 nt, Mycobacterium bovis subsp bovis AF2122/97
ccgacggacuucccgcgcg

SEQ ID NO: 3139401 - RNA, 20 nt, Mycobacterium bovis subsp bovis AF2122/97
ccgacggacuucccgcgcga

SEQ ID NO: 3139402 - RNA, 15 nt, Mycobacterium bovis subsp bovis AF2122/97
ccgacggcaagggca

SEQ ID NO: 3139403 - RNA, 19 nt, Mycobacterium bovis subsp bovis AF2122/97
ccgacggcaaugcggggca

SEQ ID NO: 3139404 - RNA, 13 nt, Mycobacterium bovis subsp bovis AF2122/97
ccgacggccagca

SEQ ID NO: 3139405 - RNA, 17 nt, Mycobacterium bovis subsp bovis AF2122/97
ccgacggccagcaggau

SEQ ID NO: 3139406 - RNA, 19 nt, Mycobacterium bovis subsp bovis AF2122/97
ccgacggccagcaggauga

SEQ ID NO: 3139407 - RNA, 15 nt, Mycobacterium bovis subsp bovis AF2122/97
ccgacggcccgguga

SEQ ID NO: 3139408 - RNA, 16 nt, Mycobacterium bovis subsp bovis AF2122/97
ccgacggcgaccaccg

SEQ ID NO: 3139409 - RNA, 19 nt, Mycobacterium bovis subsp bovis AF2122/97
ccgacggcgaccaccgcgg

SEQ ID NO: 3139410 - RNA, 15 nt, Mycobacterium bovis subsp bovis AF2122/97
ccgacggcgcccagc

SEQ ID NO: 3139411 - RNA, 16 nt, Mycobacterium bovis subsp bovis AF2122/97
ccgacggcgcccagcg

SEQ ID NO: 3139412 - RNA, 23 nt, Mycobacterium bovis subsp bovis AF2122/97
ccgacggcgcccagcgcuagccg

SEQ ID NO: 3139413 - RNA, 17 nt, Mycobacterium bovis subsp bovis AF2122/97
ccgacggcgccccgcgc

SEQ ID NO: 3139414 - RNA, 14 nt, Mycobacterium bovis subsp bovis AF2122/97
ccgacggcgcccgc

SEQ ID NO: 3139415 - RNA, 21 nt, Mycobacterium bovis subsp bovis AF2122/97
ccgacggcgcccgcccgagcc

SEQ ID NO: 3139416 - RNA, 15 nt, Mycobacterium bovis subsp bovis AF2122/97
ccgacggcgccgaac

SEQ ID NO: 3139417 - RNA, 15 nt, Mycobacterium bovis subsp bovis AF2122/97
ccgacgggacaaccc

SEQ ID NO: 3139418 - RNA, 17 nt, Mycobacterium bovis subsp bovis AF2122/97
ccgacgggacaacccgu

SEQ ID NO: 3139419 - RNA, 17 nt, Mycobacterium bovis subsp bovis AF2122/97
ccgacgggauagacgac

SEQ ID NO: 3139420 - RNA, 21 nt, Mycobacterium bovis subsp bovis AF2122/97
ccgacgggauagacgaccccg

SEQ ID NO: 3139421 - RNA, 20 nt, Mycobacterium bovis subsp bovis AF2122/97
ccgacgggauauccggucgc

SEQ ID NO: 3139422 - RNA, 12 nt, Mycobacterium bovis subsp bovis AF2122/97
ccgacgggccgu

SEQ ID NO: 3139423 - RNA, 15 nt, Mycobacterium bovis subsp bovis AF2122/97
ccgacgggccgucgc

SEQ ID NO: 3139424 - RNA, 17 nt, Mycobacterium bovis subsp bovis AF2122/97
ccgacgggccgucgccg

SEQ ID NO: 3139425 - RNA, 23 nt, Mycobacterium bovis subsp bovis AF2122/97
ccgacgggcgaaauuccgggccu

SEQ ID NO: 3139426 - RNA, 19 nt, Mycobacterium bovis subsp bovis AF2122/97
ccgacggggauggagccgg

SEQ ID NO: 3139427 - RNA, 22 nt, Mycobacterium bovis subsp bovis AF2122/97
ccgacggggauggagccgguga

SEQ ID NO: 3139428 - RNA, 22 nt, Mycobacterium bovis subsp bovis AF2122/97
ccgacggggaugggggagccgg

SEQ ID NO: 3139429 - RNA, 16 nt, Mycobacterium bovis subsp bovis AF2122/97
ccgacgggggucgggc

SEQ ID NO: 3139430 - RNA, 19 nt, Mycobacterium bovis subsp bovis AF2122/97
ccgacgggggucgggcgug

SEQ ID NO: 3139431 - RNA, 12 nt, Mycobacterium bovis subsp bovis AF2122/97
ccgacgggugcg

SEQ ID NO: 3139432 - RNA, 13 nt, Mycobacterium bovis subsp bovis AF2122/97
ccgacgggugcgc

SEQ ID NO: 3139433 - RNA, 14 nt, Mycobacterium bovis subsp bovis AF2122/97
ccgacggucaacga

SEQ ID NO: 3139434 - RNA, 16 nt, Mycobacterium bovis subsp bovis AF2122/97
ccgacgguguagccgc

SEQ ID NO: 3139435 - RNA, 18 nt, Mycobacterium bovis subsp bovis AF2122/97
ccgacgguguagccgccg

SEQ ID NO: 3139436 - RNA, 19 nt, Mycobacterium bovis subsp bovis AF2122/97
ccgacgguguagccgccgg

SEQ ID NO: 3139437 - RNA, 22 nt, Mycobacterium bovis subsp bovis AF2122/97
ccgacgguguagccgccggcag

SEQ ID NO: 3139438 - RNA, 18 nt, Mycobacterium bovis subsp bovis AF2122/97
ccgacgguuacccagccg

SEQ ID NO: 3139439 - RNA, 20 nt, Mycobacterium bovis subsp bovis AF2122/97
ccgacguacaggacgguuga

SEQ ID NO: 3139440 - RNA, 17 nt, Mycobacterium bovis subsp bovis AF2122/97
ccgacguauagaccagg

SEQ ID NO: 3139441 - RNA, 13 nt, Mycobacterium bovis subsp bovis AF2122/97
ccgacgucaggca

SEQ ID NO: 3139442 - RNA, 17 nt, Mycobacterium bovis subsp bovis AF2122/97
ccgagacgucggcguag

SEQ ID NO: 3139443 - RNA, 15 nt, Mycobacterium bovis subsp bovis AF2122/97
ccgagagcaccgcuc

SEQ ID NO: 3139444 - RNA, 22 nt, Mycobacterium bovis subsp bovis AF2122/97
ccgagauagcaacgaagccggc

SEQ ID NO: 3139445 - RNA, 18 nt, Mycobacterium bovis subsp bovis AF2122/97
ccgagauagggccgcguc

SEQ ID NO: 3139446 - RNA, 16 nt, Mycobacterium bovis subsp bovis AF2122/97
ccgagaucaccgccac

SEQ ID NO: 3139447 - RNA, 19 nt, Mycobacterium bovis subsp bovis AF2122/97
ccgagaucaccgccaccac

SEQ ID NO: 3139448 - RNA, 14 nt, Mycobacterium bovis subsp bovis AF2122/97
ccgagaucaccggu

SEQ ID NO: 3139449 - RNA, 18 nt, Mycobacterium bovis subsp bovis AF2122/97
ccgagaucaugccggcga

SEQ ID NO: 3139450 - RNA, 15 nt, Mycobacterium bovis subsp bovis AF2122/97
ccgagauccacgcca

SEQ ID NO: 3139451 - RNA, 20 nt, Mycobacterium bovis subsp bovis AF2122/97
ccgagauccacgccagagcg

SEQ ID NO: 3139452 - RNA, 15 nt, Mycobacterium bovis subsp bovis AF2122/97
ccgagaucccagcgg

SEQ ID NO: 3139453 - RNA, 18 nt, Mycobacterium bovis subsp bovis AF2122/97
ccgagaucccagcgggac

SEQ ID NO: 3139454 - RNA, 18 nt, Mycobacterium bovis subsp bovis AF2122/97
ccgagauccguccgcugg

SEQ ID NO: 3139455 - RNA, 14 nt, Mycobacterium bovis subsp bovis AF2122/97
ccgagaucgacauc

SEQ ID NO: 3139456 - RNA, 17 nt, Mycobacterium bovis subsp bovis AF2122/97
ccgagaucgcgugcgac

SEQ ID NO: 3139457 - RNA, 19 nt, Mycobacterium bovis subsp bovis AF2122/97
ccgagaugaugcugccggc

SEQ ID NO: 3139458 - RNA, 14 nt, Mycobacterium bovis subsp bovis AF2122/97
ccgagaugccggcg

SEQ ID NO: 3139459 - RNA, 20 nt, Mycobacterium bovis subsp bovis AF2122/97
ccgagaugcugcacccggag

SEQ ID NO: 3139460 - RNA, 17 nt, Mycobacterium bovis subsp bovis AF2122/97
ccgagaugcuggucggc

SEQ ID NO: 3139461 - RNA, 19 nt, Mycobacterium bovis subsp bovis AF2122/97
ccgagaugcuggucggcga

SEQ ID NO: 3139462 - RNA, 20 nt, Mycobacterium bovis subsp bovis AF2122/97
ccgagaugcuggucggcgau

SEQ ID NO: 3139463 - RNA, 15 nt, Mycobacterium bovis subsp bovis AF2122/97
ccgagauggcgauca

SEQ ID NO: 3139464 - RNA, 17 nt, Mycobacterium bovis subsp bovis AF2122/97
ccgagcaaacacgccuc

SEQ ID NO: 3139465 - RNA, 20 nt, Mycobacterium bovis subsp bovis AF2122/97
ccgagcaaacauccacccgc

SEQ ID NO: 3139466 - RNA, 15 nt, Mycobacterium bovis subsp bovis AF2122/97
ccgagcaacaccguc

SEQ ID NO: 3139467 - RNA, 17 nt, Mycobacterium bovis subsp bovis AF2122/97
ccgagcaacaccgucgg

SEQ ID NO: 3139468 - RNA, 21 nt, Mycobacterium bovis subsp bovis AF2122/97
ccgagcaacaccgucggcagc

SEQ ID NO: 3139469 - RNA, 16 nt, Mycobacterium bovis subsp bovis AF2122/97
ccgagcaacggcggca

SEQ ID NO: 3139470 - RNA, 22 nt, Mycobacterium bovis subsp bovis AF2122/97
ccgagcaacggcggcaggccgg

SEQ ID NO: 3139471 - RNA, 20 nt, Mycobacterium bovis subsp bovis AF2122/97
ccgagcacaggaucacccac

SEQ ID NO: 3139472 - RNA, 16 nt, Mycobacterium bovis subsp bovis AF2122/97
ccgagcaccccagggg

SEQ ID NO: 3139473 - RNA, 19 nt, Mycobacterium bovis subsp bovis AF2122/97
ccgagcaccugaccguuga

SEQ ID NO: 3139474 - RNA, 19 nt, Mycobacterium bovis subsp bovis AF2122/97
ccgagcacgacgacgucgg

SEQ ID NO: 3139475 - RNA, 16 nt, Mycobacterium bovis subsp bovis AF2122/97
ccgagcacuccggagc

SEQ ID NO: 3139476 - RNA, 14 nt, Mycobacterium bovis subsp bovis AF2122/97
ccgagcacucggcc

SEQ ID NO: 3139477 - RNA, 19 nt, Mycobacterium bovis subsp bovis AF2122/97
ccgagcacugacgggccgu

SEQ ID NO: 3139478 - RNA, 17 nt, Mycobacterium bovis subsp bovis AF2122/97
ccgagcagacacagaau

SEQ ID NO: 3139479 - RNA, 19 nt, Mycobacterium bovis subsp bovis AF2122/97
ccgagcagacacagaaucg

SEQ ID NO: 3139480 - RNA, 17 nt, Mycobacterium bovis subsp bovis AF2122/97
ccgagcagacgcaaaau

SEQ ID NO: 3139481 - RNA, 19 nt, Mycobacterium bovis subsp bovis AF2122/97
ccgagcagacgcaaaaucg

SEQ ID NO: 3139482 - RNA, 14 nt, Mycobacterium bovis subsp bovis AF2122/97
ccgagcagacgcag

SEQ ID NO: 3139483 - RNA, 14 nt, Mycobacterium bovis subsp bovis AF2122/97
ccgagcagacgcgg

SEQ ID NO: 3139484 - RNA, 19 nt, Mycobacterium bovis subsp bovis AF2122/97
ccgagcagacgcggaaucg

SEQ ID NO: 3139485 - RNA, 22 nt, Mycobacterium bovis subsp bovis AF2122/97
ccgagcagauacuccgcgguug

SEQ ID NO: 3139486 - RNA, 21 nt, Mycobacterium bovis subsp bovis AF2122/97
ccgagcagcagaaacggcgac

SEQ ID NO: 3139487 - RNA, 15 nt, Mycobacterium bovis subsp bovis AF2122/97
ccgagcagcccgcgg

SEQ ID NO: 3139488 - RNA, 17 nt, Mycobacterium bovis subsp bovis AF2122/97
ccgagcagcccgcggau

SEQ ID NO: 3139489 - RNA, 13 nt, Mycobacterium bovis subsp bovis AF2122/97
ccgagcagggccg

SEQ ID NO: 3139490 - RNA, 16 nt, Mycobacterium bovis subsp bovis AF2122/97
ccgagcagggccggca

SEQ ID NO: 3139491 - RNA, 23 nt, Mycobacterium bovis subsp bovis AF2122/97
ccgagcagggccggcaccgcagc

SEQ ID NO: 3139492 - RNA, 21 nt, Mycobacterium bovis subsp bovis AF2122/97
ccgagcaguggaguauccggc

SEQ ID NO: 3139493 - RNA, 16 nt, Mycobacterium bovis subsp bovis AF2122/97
ccgagcaucagauucg

SEQ ID NO: 3139494 - RNA, 24 nt, Mycobacterium bovis subsp bovis AF2122/97
ccgagcaucagauucgcgcuggcc

SEQ ID NO: 3139495 - RNA, 19 nt, Mycobacterium bovis subsp bovis AF2122/97
ccgagccacaaaggcgccg

SEQ ID NO: 3139496 - RNA, 14 nt, Mycobacterium bovis subsp bovis AF2122/97
ccgagccacgaccc

SEQ ID NO: 3139497 - RNA, 14 nt, Mycobacterium bovis subsp bovis AF2122/97
ccgagccagcuccg

SEQ ID NO: 3139498 - RNA, 16 nt, Mycobacterium bovis subsp bovis AF2122/97
ccgagccagcuccggc

SEQ ID NO: 3139499 - RNA, 16 nt, Mycobacterium bovis subsp bovis AF2122/97
ccgagccaucaccgca

SEQ ID NO: 3139500 - RNA, 14 nt, Mycobacterium bovis subsp bovis AF2122/97
ccgagcccagccgg

SEQ ID NO: 3139501 - RNA, 15 nt, Mycobacterium bovis subsp bovis AF2122/97
ccgagcccagccggg

SEQ ID NO: 3139502 - RNA, 14 nt, Mycobacterium bovis subsp bovis AF2122/97
ccgagcccagcgcc

SEQ ID NO: 3139503 - RNA, 15 nt, Mycobacterium bovis subsp bovis AF2122/97
ccgagcccagcgccu

SEQ ID NO: 3139504 - RNA, 16 nt, Mycobacterium bovis subsp bovis AF2122/97
ccgagcccagcgccuc

SEQ ID NO: 3139505 - RNA, 20 nt, Mycobacterium bovis subsp bovis AF2122/97
ccgagcccagcgccuccagc

SEQ ID NO: 3139506 - RNA, 14 nt, Mycobacterium bovis subsp bovis AF2122/97
ccgagcccaggugg

SEQ ID NO: 3139507 - RNA, 15 nt, Mycobacterium bovis subsp bovis AF2122/97
ccgagcccgggccgu

SEQ ID NO: 3139508 - RNA, 17 nt, Mycobacterium bovis subsp bovis AF2122/97
ccgagcccgggccguac

SEQ ID NO: 3139509 - RNA, 19 nt, Mycobacterium bovis subsp bovis AF2122/97
ccgagcccgggccguacgg

SEQ ID NO: 3139510 - RNA, 13 nt, Mycobacterium bovis subsp bovis AF2122/97
ccgagcccggugc

SEQ ID NO: 3139511 - RNA, 19 nt, Mycobacterium bovis subsp bovis AF2122/97
ccgagcccggugcuaccgg

SEQ ID NO: 3139512 - RNA, 16 nt, Mycobacterium bovis subsp bovis AF2122/97
ccgagcccgucagcuc

SEQ ID NO: 3139513 - RNA, 16 nt, Mycobacterium bovis subsp bovis AF2122/97
ccgagcccgucgauca

SEQ ID NO: 3139514 - RNA, 17 nt, Mycobacterium bovis subsp bovis AF2122/97
ccgagcccuccagggcc

SEQ ID NO: 3139515 - RNA, 16 nt, Mycobacterium bovis subsp bovis AF2122/97
ccgagccgacaucgau

SEQ ID NO: 3139516 - RNA, 21 nt, Mycobacterium bovis subsp bovis AF2122/97
ccgagccgauauaccagggca

SEQ ID NO: 3139517 - RNA, 22 nt, Mycobacterium bovis subsp bovis AF2122/97
ccgagccgauauaccagggcau

SEQ ID NO: 3139518 - RNA, 13 nt, Mycobacterium bovis subsp bovis AF2122/97
ccgagccgcacag

SEQ ID NO: 3139519 - RNA, 16 nt, Mycobacterium bovis subsp bovis AF2122/97
ccgagccgcagcucgc

SEQ ID NO: 3139520 - RNA, 17 nt, Mycobacterium bovis subsp bovis AF2122/97
ccgagccgcccgcccgg

SEQ ID NO: 3139521 - RNA, 12 nt, Mycobacterium bovis subsp bovis AF2122/97
ccgagccgccgu

SEQ ID NO: 3139522 - RNA, 13 nt, Mycobacterium bovis subsp bovis AF2122/97
ccgagccgcgaug

SEQ ID NO: 3139523 - RNA, 20 nt, Mycobacterium bovis subsp bovis AF2122/97
ccgagccgcggucaccccgg

SEQ ID NO: 3139524 - RNA, 14 nt, Mycobacterium bovis subsp bovis AF2122/97
ccgagccgcguggg

SEQ ID NO: 3139525 - RNA, 14 nt, Mycobacterium bovis subsp bovis AF2122/97
ccgagccgguaacc

SEQ ID NO: 3139526 - RNA, 20 nt, Mycobacterium bovis subsp bovis AF2122/97
ccgagccgguaaccgcgucg

SEQ ID NO: 3139527 - RNA, 22 nt, Mycobacterium bovis subsp bovis AF2122/97
ccgagccgguauacccggcccc

SEQ ID NO: 3139528 - RNA, 16 nt, Mycobacterium bovis subsp bovis AF2122/97
ccgagccggugccacu

SEQ ID NO: 3139529 - RNA, 14 nt, Mycobacterium bovis subsp bovis AF2122/97
ccgaggaugccgaa

SEQ ID NO: 3139530 - RNA, 22 nt, Mycobacterium bovis subsp bovis AF2122/97
ccgaggaugccgaaccgcgcgu

SEQ ID NO: 3139531 - RNA, 22 nt, Mycobacterium bovis subsp bovis AF2122/97
ccgaggauguugugccgaucgg

SEQ ID NO: 3139532 - RNA, 19 nt, Mycobacterium bovis subsp bovis AF2122/97
ccgaggccaugcucgccaa

SEQ ID NO: 3139533 - RNA, 16 nt, Mycobacterium bovis subsp bovis AF2122/97
ccgaggccgaccucgu

SEQ ID NO: 3139534 - RNA, 17 nt, Mycobacterium bovis subsp bovis AF2122/97
ccgaggccgccaucgcc

SEQ ID NO: 3139535 - RNA, 13 nt, Mycobacterium bovis subsp bovis AF2122/97
ccgaggccgccga

SEQ ID NO: 3139536 - RNA, 14 nt, Mycobacterium bovis subsp bovis AF2122/97
ccgaggccgccguu

SEQ ID NO: 3139537 - RNA, 16 nt, Mycobacterium bovis subsp bovis AF2122/97
ccgaggccugacugaa

SEQ ID NO: 3139538 - RNA, 15 nt, Mycobacterium bovis subsp bovis AF2122/97
ccgaggcgagacgcu

SEQ ID NO: 3139539 - RNA, 22 nt, Mycobacterium bovis subsp bovis AF2122/97
ccgaggcgagacgcuccagugg

SEQ ID NO: 3139540 - RNA, 14 nt, Mycobacterium bovis subsp bovis AF2122/97
ccgaggcgcccaac

SEQ ID NO: 3139541 - RNA, 20 nt, Mycobacterium bovis subsp bovis AF2122/97
ccgaggcggguacaccacgg

SEQ ID NO: 3139542 - RNA, 21 nt, Mycobacterium bovis subsp bovis AF2122/97
ccgaggcggucuuguccagga

SEQ ID NO: 3139543 - RNA, 24 nt, Mycobacterium bovis subsp bovis AF2122/97
ccgaggcggucuuguccaggaacu

SEQ ID NO: 3139544 - RNA, 13 nt, Mycobacterium bovis subsp bovis AF2122/97
ccgaggcucgggc

SEQ ID NO: 3139545 - RNA, 15 nt, Mycobacterium bovis subsp bovis AF2122/97
ccgaggcucgggccg

SEQ ID NO: 3139546 - RNA, 18 nt, Mycobacterium bovis subsp bovis AF2122/97
ccgaggcucgggccgcac

SEQ ID NO: 3139547 - RNA, 16 nt, Mycobacterium bovis subsp bovis AF2122/97
ccgaggcuggcauccc

SEQ ID NO: 3139548 - RNA, 23 nt, Mycobacterium bovis subsp bovis AF2122/97
ccgaggcuggcaucccgggcagu

SEQ ID NO: 3139549 - RNA, 14 nt, Mycobacterium bovis subsp bovis AF2122/97
ccgagggauggccg

SEQ ID NO: 3139550 - RNA, 23 nt, Mycobacterium bovis subsp bovis AF2122/97
ccgagggauugccgugcucgucg

SEQ ID NO: 3139551 - RNA, 22 nt, Mycobacterium bovis subsp bovis AF2122/97
ccgagggccugacgcgucagcg

SEQ ID NO: 3139552 - RNA, 20 nt, Mycobacterium bovis subsp bovis AF2122/97
ccgagggcgccgggggcgcc

SEQ ID NO: 3139553 - RNA, 15 nt, Mycobacterium bovis subsp bovis AF2122/97
ccgagggcggcagcu

SEQ ID NO: 3139554 - RNA, 16 nt, Mycobacterium bovis subsp bovis AF2122/97
ccgagggcgucgccgc

SEQ ID NO: 3139555 - RNA, 17 nt, Mycobacterium bovis subsp bovis AF2122/97
ccgagggcgucgccgcc

SEQ ID NO: 3139556 - RNA, 14 nt, Mycobacterium bovis subsp bovis AF2122/97
ccgagggcugcgug

SEQ ID NO: 3139557 - RNA, 17 nt, Mycobacterium bovis subsp bovis AF2122/97
ccgagggcugcguggcg

SEQ ID NO: 3139558 - RNA, 19 nt, Mycobacterium bovis subsp bovis AF2122/97
ccgagggcuugcaccugca

SEQ ID NO: 3139559 - RNA, 19 nt, Mycobacterium bovis subsp bovis AF2122/97
ccgaggggagugucagcgc

SEQ ID NO: 3139560 - RNA, 22 nt, Mycobacterium bovis subsp bovis AF2122/97
ccgaggguagacggggcgagca

SEQ ID NO: 3139561 - RNA, 13 nt, Mycobacterium bovis subsp bovis AF2122/97
ccgagggucgggc

SEQ ID NO: 3139562 - RNA, 16 nt, Mycobacterium bovis subsp bovis AF2122/97
ccgagguaacgcagcg

SEQ ID NO: 3139563 - RNA, 12 nt, Mycobacterium bovis subsp bovis AF2122/97
ccgaggucggcc

SEQ ID NO: 3139564 - RNA, 19 nt, Mycobacterium bovis subsp bovis AF2122/97
ccgaggucgguucggccgg

SEQ ID NO: 3139565 - RNA, 20 nt, Mycobacterium bovis subsp bovis AF2122/97
ccgaggucgguucggccgga

SEQ ID NO: 3139566 - RNA, 19 nt, Mycobacterium bovis subsp bovis AF2122/97
ccgaggucuccggugcgca

SEQ ID NO: 3139567 - RNA, 23 nt, Mycobacterium bovis subsp bovis AF2122/97
ccgaggucuccggugcgcagcca

SEQ ID NO: 3139568 - RNA, 14 nt, Mycobacterium bovis subsp bovis AF2122/97
ccgaggugccgcgc

SEQ ID NO: 3139569 - RNA, 15 nt, Mycobacterium bovis subsp bovis AF2122/97
ccgaggugccgcgca

SEQ ID NO: 3139570 - RNA, 19 nt, Mycobacterium bovis subsp bovis AF2122/97
ccgaggugccgcgcagcug

SEQ ID NO: 3139571 - RNA, 22 nt, Mycobacterium bovis subsp bovis AF2122/97
ccgaggugccgcgcagcugccg

SEQ ID NO: 3139572 - RNA, 22 nt, Mycobacterium bovis subsp bovis AF2122/97
ccgaguaccagcccaccggcgc

SEQ ID NO: 3139573 - RNA, 21 nt, Mycobacterium bovis subsp bovis AF2122/97
ccgaguaccggccagccgcgg

SEQ ID NO: 3139574 - RNA, 22 nt, Mycobacterium bovis subsp bovis AF2122/97
ccgaguagaagauggcaccgcc

SEQ ID NO: 3139575 - RNA, 20 nt, Mycobacterium bovis subsp bovis AF2122/97
ccgaguauuggucggugggg

SEQ ID NO: 3139576 - RNA, 16 nt, Mycobacterium bovis subsp bovis AF2122/97
ccgagucgacggccag

SEQ ID NO: 3139577 - RNA, 17 nt, Mycobacterium bovis subsp bovis AF2122/97
ccgagucgacggccagu

SEQ ID NO: 3139578 - RNA, 12 nt, Mycobacterium bovis subsp bovis AF2122/97
ccgagucgauca

SEQ ID NO: 3139579 - RNA, 14 nt, Mycobacterium bovis subsp bovis AF2122/97
ccgagucgaucacg

SEQ ID NO: 3139580 - RNA, 19 nt, Mycobacterium bovis subsp bovis AF2122/97
ccgagucgaucacguggug

SEQ ID NO: 3139581 - RNA, 22 nt, Mycobacterium bovis subsp bovis AF2122/97
ccgagucgaucacguggugcgg

SEQ ID NO: 3139582 - RNA, 14 nt, Mycobacterium bovis subsp bovis AF2122/97
ccgagucggcaaac

SEQ ID NO: 3139583 - RNA, 14 nt, Mycobacterium bovis subsp bovis AF2122/97
ccgagugaccaggg

SEQ ID NO: 3139584 - RNA, 22 nt, Mycobacterium bovis subsp bovis AF2122/97
ccgagugcccagcgaugcgcuc

SEQ ID NO: 3139585 - RNA, 16 nt, Mycobacterium bovis subsp bovis AF2122/97
ccgagugcggugugug

SEQ ID NO: 3139586 - RNA, 19 nt, Mycobacterium bovis subsp bovis AF2122/97
ccgagugugaaucgcacga

SEQ ID NO: 3139587 - RNA, 22 nt, Mycobacterium bovis subsp bovis AF2122/97
ccgaguuaaacgcagcggugag

SEQ ID NO: 3139588 - RNA, 15 nt, Mycobacterium bovis subsp bovis AF2122/97
ccgaguuaccgguga

SEQ ID NO: 3139589 - RNA, 16 nt, Mycobacterium bovis subsp bovis AF2122/97
ccgaguuaccggugac

SEQ ID NO: 3139590 - RNA, 16 nt, Mycobacterium bovis subsp bovis AF2122/97
ccgaguucgucagcgg

SEQ ID NO: 3139591 - RNA, 18 nt, Mycobacterium bovis subsp bovis AF2122/97
ccgaguucgucagcggcc

SEQ ID NO: 3139592 - RNA, 22 nt, Mycobacterium bovis subsp bovis AF2122/97
ccgaguugaacaauccgguguu

SEQ ID NO: 3139593 - RNA, 18 nt, Mycobacterium bovis subsp bovis AF2122/97
ccgaguugaacguucccu

SEQ ID NO: 3139594 - RNA, 22 nt, Mycobacterium bovis subsp bovis AF2122/97
ccgaguugaagaagccgguguu

SEQ ID NO: 3139595 - RNA, 19 nt, Mycobacterium bovis subsp bovis AF2122/97
ccgaguugaaggugccggc

SEQ ID NO: 3139596 - RNA, 21 nt, Mycobacterium bovis subsp bovis AF2122/97
ccgaguugaaggugccggcgu

SEQ ID NO: 3139597 - RNA, 15 nt, Mycobacterium bovis subsp bovis AF2122/97
ccgaguugaccgccg

SEQ ID NO: 3139598 - RNA, 20 nt, Mycobacterium bovis subsp bovis AF2122/97
ccgaguugaccgccgugggu

SEQ ID NO: 3139599 - RNA, 14 nt, Mycobacterium bovis subsp bovis AF2122/97
ccgaguugcccggg

SEQ ID NO: 3139600 - RNA, 13 nt, Mycobacterium bovis subsp bovis AF2122/97
ccgaguugucgcc

SEQ ID NO: 3139601 - RNA, 23 nt, Mycobacterium bovis subsp bovis AF2122/97
ccgaguuugguguagacgugcgu

SEQ ID NO: 3139602 - RNA, 17 nt, Mycobacterium bovis subsp bovis AF2122/97
ccgauaaaaaccacccc

SEQ ID NO: 3139603 - RNA, 20 nt, Mycobacterium bovis subsp bovis AF2122/97
ccgauaaaugccgcgugggc

SEQ ID NO: 3139604 - RNA, 23 nt, Mycobacterium bovis subsp bovis AF2122/97
ccgauaacaaggccgccgccguc

SEQ ID NO: 3139605 - RNA, 14 nt, Mycobacterium bovis subsp bovis AF2122/97
ccgauacaccgacg

SEQ ID NO: 3139606 - RNA, 15 nt, Mycobacterium bovis subsp bovis AF2122/97
ccgauacccagcggg

SEQ ID NO: 3139607 - RNA, 14 nt, Mycobacterium bovis subsp bovis AF2122/97
ccgauacccgguga

SEQ ID NO: 3139608 - RNA, 23 nt, Mycobacterium bovis subsp bovis AF2122/97
ccgauacccggugaugguggcgg

SEQ ID NO: 3139609 - RNA, 15 nt, Mycobacterium bovis subsp bovis AF2122/97
ccgauaccgccggcc

SEQ ID NO: 3139610 - RNA, 17 nt, Mycobacterium bovis subsp bovis AF2122/97
ccgauaccggcggcgag

SEQ ID NO: 3139611 - RNA, 18 nt, Mycobacterium bovis subsp bovis AF2122/97
ccgauaccgucagcgccg

SEQ ID NO: 3139612 - RNA, 14 nt, Mycobacterium bovis subsp bovis AF2122/97
ccgauacgccaccg

SEQ ID NO: 3139613 - RNA, 16 nt, Mycobacterium bovis subsp bovis AF2122/97
ccgauacggccggccg

SEQ ID NO: 3139614 - RNA, 18 nt, Mycobacterium bovis subsp bovis AF2122/97
ccgauacuucaucggcac

SEQ ID NO: 3139615 - RNA, 23 nt, Mycobacterium bovis subsp bovis AF2122/97
ccgaucgggcucacucgccgaau

SEQ ID NO: 3139616 - RNA, 15 nt, Mycobacterium bovis subsp bovis AF2122/97
ccgaucgggcuucgg

SEQ ID NO: 3139617 - RNA, 17 nt, Mycobacterium bovis subsp bovis AF2122/97
ccgaucgggcuucggcc

SEQ ID NO: 3139618 - RNA, 22 nt, Mycobacterium bovis subsp bovis AF2122/97
ccgaucgggguggucgcaccgc

SEQ ID NO: 3139619 - RNA, 14 nt, Mycobacterium bovis subsp bovis AF2122/97
ccgaucggucgauc

SEQ ID NO: 3139620 - RNA, 16 nt, Mycobacterium bovis subsp bovis AF2122/97
ccgaucggucguccgg

SEQ ID NO: 3139621 - RNA, 20 nt, Mycobacterium bovis subsp bovis AF2122/97
ccgaucggucguccggaucg

SEQ ID NO: 3139622 - RNA, 13 nt, Mycobacterium bovis subsp bovis AF2122/97
ccgaucggugacg

SEQ ID NO: 3139623 - RNA, 24 nt, Mycobacterium bovis subsp bovis AF2122/97
ccgaucggugucgggcugaguggc

SEQ ID NO: 3139624 - RNA, 20 nt, Mycobacterium bovis subsp bovis AF2122/97
ccgaucguaggacucggcgg

SEQ ID NO: 3139625 - RNA, 15 nt, Mycobacterium bovis subsp bovis AF2122/97
ccgaucgucucggcc

SEQ ID NO: 3139626 - RNA, 20 nt, Mycobacterium bovis subsp bovis AF2122/97
ccgaucucugcggcggucuc

SEQ ID NO: 3139627 - RNA, 15 nt, Mycobacterium bovis subsp bovis AF2122/97
ccgaucucugguguc

SEQ ID NO: 3139628 - RNA, 14 nt, Mycobacterium bovis subsp bovis AF2122/97
ccgaucugcuccuc

SEQ ID NO: 3139629 - RNA, 17 nt, Mycobacterium bovis subsp bovis AF2122/97
ccgaucugcuccucggu

SEQ ID NO: 3139630 - RNA, 22 nt, Mycobacterium bovis subsp bovis AF2122/97
ccgaucugcucgccgagcucgg

SEQ ID NO: 3139631 - RNA, 23 nt, Mycobacterium bovis subsp bovis AF2122/97
ccgaucuggaugucccaugcacg

SEQ ID NO: 3139632 - RNA, 23 nt, Mycobacterium bovis subsp bovis AF2122/97
ccgaucugguaagucagcucgau

SEQ ID NO: 3139633 - RNA, 19 nt, Mycobacterium bovis subsp bovis AF2122/97
ccgaucuucgcgcgcucaa

SEQ ID NO: 3139634 - RNA, 13 nt, Mycobacterium bovis subsp bovis AF2122/97
ccgaucuuggcca

SEQ ID NO: 3139635 - RNA, 17 nt, Mycobacterium bovis subsp bovis AF2122/97
ccgaucuuggccaccgc

SEQ ID NO: 3139636 - RNA, 14 nt, Mycobacterium bovis subsp bovis AF2122/97
ccgaugaaccaggc

SEQ ID NO: 3139637 - RNA, 23 nt, Mycobacterium bovis subsp bovis AF2122/97
ccgaugaaccaggcggccgcguc

SEQ ID NO: 3139638 - RNA, 16 nt, Mycobacterium bovis subsp bovis AF2122/97
ccgaugaagccaagaa

SEQ ID NO: 3139639 - RNA, 20 nt, Mycobacterium bovis subsp bovis AF2122/97
ccgaugaccagggucugcuc

SEQ ID NO: 3139640 - RNA, 15 nt, Mycobacterium bovis subsp bovis AF2122/97
ccgaugacccacugc

SEQ ID NO: 3139641 - RNA, 13 nt, Mycobacterium bovis subsp bovis AF2122/97
ccgaugaccgaag

SEQ ID NO: 3139642 - RNA, 15 nt, Mycobacterium bovis subsp bovis AF2122/97
ccgaugacgaucggc

SEQ ID NO: 3139643 - RNA, 16 nt, Mycobacterium bovis subsp bovis AF2122/97
ccgaugacgaucggcg

SEQ ID NO: 3139644 - RNA, 21 nt, Mycobacterium bovis subsp bovis AF2122/97
ccgaugacgaucggcggcgcg

SEQ ID NO: 3139645 - RNA, 21 nt, Mycobacterium bovis subsp bovis AF2122/97
ccgaugacgaugccgccgaag

SEQ ID NO: 3139646 - RNA, 19 nt, Mycobacterium bovis subsp bovis AF2122/97
ccgaugacgauggccgccg

SEQ ID NO: 3139647 - RNA, 21 nt, Mycobacterium bovis subsp bovis AF2122/97
ccgaugacgauggccgccgcg

SEQ ID NO: 3139648 - RNA, 14 nt, Mycobacterium bovis subsp bovis AF2122/97
ccgaugacgcguuc

SEQ ID NO: 3139649 - RNA, 21 nt, Mycobacterium bovis subsp bovis AF2122/97
ccgaugacgguccccaggucg

SEQ ID NO: 3139650 - RNA, 16 nt, Mycobacterium bovis subsp bovis AF2122/97
ccgaugagcccagccg

SEQ ID NO: 3139651 - RNA, 22 nt, Mycobacterium bovis subsp bovis AF2122/97
ccgaugaggacauccggcgccg

SEQ ID NO: 3139652 - RNA, 20 nt, Mycobacterium bovis subsp bovis AF2122/97
ccgaugaucgguaccgacgg

SEQ ID NO: 3139653 - RNA, 17 nt, Mycobacterium bovis subsp bovis AF2122/97
ccgaugaucucacccag

SEQ ID NO: 3139654 - RNA, 16 nt, Mycobacterium bovis subsp bovis AF2122/97
ccgaugaugcggcgca

SEQ ID NO: 3139655 - RNA, 22 nt, Mycobacterium bovis subsp bovis AF2122/97
ccgaugauggacaccagccaga

SEQ ID NO: 3139656 - RNA, 13 nt, Mycobacterium bovis subsp bovis AF2122/97
ccgaugccacauc

SEQ ID NO: 3139657 - RNA, 20 nt, Mycobacterium bovis subsp bovis AF2122/97
ccgaugcccucgauggccag

SEQ ID NO: 3139658 - RNA, 14 nt, Mycobacterium bovis subsp bovis AF2122/97
ccgaugccgacggc

SEQ ID NO: 3139659 - RNA, 17 nt, Mycobacterium bovis subsp bovis AF2122/97
ccgaugccgacggcgcc

SEQ ID NO: 3139660 - RNA, 18 nt, Mycobacterium bovis subsp bovis AF2122/97
ccgaugccgacggcgccc

SEQ ID NO: 3139661 - RNA, 15 nt, Mycobacterium bovis subsp bovis AF2122/97
ccgaugccgccggcc

SEQ ID NO: 3139662 - RNA, 21 nt, Mycobacterium bovis subsp bovis AF2122/97
ccgaugccggcgagggccacg

SEQ ID NO: 3139663 - RNA, 19 nt, Mycobacterium bovis subsp bovis AF2122/97
ccgaugccgugcccggugc

SEQ ID NO: 3139664 - RNA, 16 nt, Mycobacterium bovis subsp bovis AF2122/97
ccgaugccuugaccgc

SEQ ID NO: 3139665 - RNA, 22 nt, Mycobacterium bovis subsp bovis AF2122/97
ccgaugcgaaacaucucggcgc

SEQ ID NO: 3139666 - RNA, 14 nt, Mycobacterium bovis subsp bovis AF2122/97
ccgaugcgacgcag

SEQ ID NO: 3139667 - RNA, 19 nt, Mycobacterium bovis subsp bovis AF2122/97
ccgaugcgauaacccgcau

SEQ ID NO: 3139668 - RNA, 14 nt, Mycobacterium bovis subsp bovis AF2122/97
ccgaugcgccaccg

SEQ ID NO: 3139669 - RNA, 16 nt, Mycobacterium bovis subsp bovis AF2122/97
ccgaugcgccaccggc

SEQ ID NO: 3139670 - RNA, 20 nt, Mycobacterium bovis subsp bovis AF2122/97
ccgaugcgccaccggcgccg

SEQ ID NO: 3139671 - RNA, 21 nt, Mycobacterium bovis subsp bovis AF2122/97
ccgaugcgccggaccagcucc

SEQ ID NO: 3139672 - RNA, 17 nt, Mycobacterium bovis subsp bovis AF2122/97
ccgaugcgcgcggcgcg

SEQ ID NO: 3139673 - RNA, 16 nt, Mycobacterium bovis subsp bovis AF2122/97
ccgaugcgggucucga

SEQ ID NO: 3139674 - RNA, 12 nt, Mycobacterium bovis subsp bovis AF2122/97
ccgaugcucguc

SEQ ID NO: 3139675 - RNA, 16 nt, Mycobacterium bovis subsp bovis AF2122/97
ccgaugcugacgaugc

SEQ ID NO: 3139676 - RNA, 14 nt, Mycobacterium bovis subsp bovis AF2122/97
ccgaugcugccgcc

SEQ ID NO: 3139677 - RNA, 18 nt, Mycobacterium bovis subsp bovis AF2122/97
ccgaugcugccgccgccg

SEQ ID NO: 3139678 - RNA, 23 nt, Mycobacterium bovis subsp bovis AF2122/97
ccgaugcugccgccgccgccggc

SEQ ID NO: 3139679 - RNA, 23 nt, Mycobacterium bovis subsp bovis AF2122/97
ccgauggauuggcgucagcagca

SEQ ID NO: 3139680 - RNA, 13 nt, Mycobacterium bovis subsp bovis AF2122/97
ccgauggcgcacc

SEQ ID NO: 3139681 - RNA, 15 nt, Mycobacterium bovis subsp bovis AF2122/97
ccgauggcgcaccgg

SEQ ID NO: 3139682 - RNA, 21 nt, Mycobacterium bovis subsp bovis AF2122/97
ccgauggcgcaccggcgucgg

SEQ ID NO: 3139683 - RNA, 14 nt, Mycobacterium bovis subsp bovis AF2122/97
ccgauggcgguggc

SEQ ID NO: 3139684 - RNA, 21 nt, Mycobacterium bovis subsp bovis AF2122/97
ccgauggcgguggugccgcgg

SEQ ID NO: 3139685 - RNA, 20 nt, Mycobacterium bovis subsp bovis AF2122/97
ccgauggcgucgccggcccc

SEQ ID NO: 3139686 - RNA, 21 nt, Mycobacterium bovis subsp bovis AF2122/97
ccgauggcgucgccggccccg

SEQ ID NO: 3139687 - RNA, 16 nt, Mycobacterium bovis subsp bovis AF2122/97
ccgauggcuaccuugg

SEQ ID NO: 3139688 - RNA, 20 nt, Mycobacterium bovis subsp bovis AF2122/97
ccgauggcucacaugcccgc

SEQ ID NO: 3139689 - RNA, 21 nt, Mycobacterium bovis subsp bovis AF2122/97
ccgauggcucacaugcccgca

SEQ ID NO: 3139690 - RNA, 19 nt, Mycobacterium bovis subsp bovis AF2122/97
ccgauggcucaccagcucc

SEQ ID NO: 3139691 - RNA, 18 nt, Mycobacterium bovis subsp bovis AF2122/97
ccgauggcuuggugccca

SEQ ID NO: 3139692 - RNA, 19 nt, Mycobacterium bovis subsp bovis AF2122/97
ccgaugguacccgcgccgc

SEQ ID NO: 3139693 - RNA, 14 nt, Mycobacterium bovis subsp bovis AF2122/97
ccgauggugccgac

SEQ ID NO: 3139694 - RNA, 15 nt, Mycobacterium bovis subsp bovis AF2122/97
ccgauggugccgacc

SEQ ID NO: 3139695 - RNA, 23 nt, Mycobacterium bovis subsp bovis AF2122/97
ccgauggugccgacccgccgcgc

SEQ ID NO: 3139696 - RNA, 14 nt, Mycobacterium bovis subsp bovis AF2122/97
ccgaugguggccgc

SEQ ID NO: 3139697 - RNA, 21 nt, Mycobacterium bovis subsp bovis AF2122/97
ccgauguccgacgccaccgcc

SEQ ID NO: 3139698 - RNA, 13 nt, Mycobacterium bovis subsp bovis AF2122/97
ccgaugucgaugc

SEQ ID NO: 3139699 - RNA, 21 nt, Mycobacterium bovis subsp bovis AF2122/97
ccgaugucgaugccgcgcagc

SEQ ID NO: 3139700 - RNA, 14 nt, Mycobacterium bovis subsp bovis AF2122/97
ccgaugucgucgac

SEQ ID NO: 3139701 - RNA, 14 nt, Mycobacterium bovis subsp bovis AF2122/97
ccgaugugcucggu

SEQ ID NO: 3139702 - RNA, 14 nt, Mycobacterium bovis subsp bovis AF2122/97
ccgauguggccggc

SEQ ID NO: 3139703 - RNA, 16 nt, Mycobacterium bovis subsp bovis AF2122/97
ccgauguggccggcga

SEQ ID NO: 3139704 - RNA, 23 nt, Mycobacterium bovis subsp bovis AF2122/97
ccgauguggcgcuguuguugucg

SEQ ID NO: 3139705 - RNA, 15 nt, Mycobacterium bovis subsp bovis AF2122/97
ccgaugugggcgccg

SEQ ID NO: 3139706 - RNA, 18 nt, Mycobacterium bovis subsp bovis AF2122/97
ccgaugugggcgccgucg

SEQ ID NO: 3139707 - RNA, 20 nt, Mycobacterium bovis subsp bovis AF2122/97
ccgaugugggcgccgucgcc

SEQ ID NO: 3139708 - RNA, 20 nt, Mycobacterium bovis subsp bovis AF2122/97
ccgaugugucgaugaggauc

SEQ ID NO: 3139709 - RNA, 22 nt, Mycobacterium bovis subsp bovis AF2122/97
ccgauguguggaacauccgcac

SEQ ID NO: 3139710 - RNA, 16 nt, Mycobacterium bovis subsp bovis AF2122/97
ccgauguuggcagggc

SEQ ID NO: 3139711 - RNA, 23 nt, Mycobacterium bovis subsp bovis AF2122/97
ccgauguuggcagggccagcggc

SEQ ID NO: 3139712 - RNA, 22 nt, Mycobacterium bovis subsp bovis AF2122/97
ccgauuacggugaucgccggcu

SEQ ID NO: 3139713 - RNA, 23 nt, Mycobacterium bovis subsp bovis AF2122/97
ccgauucagcgccccaugcaaca

SEQ ID NO: 3139714 - RNA, 15 nt, Mycobacterium bovis subsp bovis AF2122/97
ccgauuccaccgccg

SEQ ID NO: 3139715 - RNA, 14 nt, Mycobacterium bovis subsp bovis AF2122/97
ccgauuccgcgcgu

SEQ ID NO: 3139716 - RNA, 15 nt, Mycobacterium bovis subsp bovis AF2122/97
ccgauucggccagcg

SEQ ID NO: 3139717 - RNA, 21 nt, Mycobacterium bovis subsp bovis AF2122/97
ccgauucggccagcgcccgca

SEQ ID NO: 3139718 - RNA, 15 nt, Mycobacterium bovis subsp bovis AF2122/97
ccgauugaguucggc

SEQ ID NO: 3139719 - RNA, 17 nt, Mycobacterium bovis subsp bovis AF2122/97
ccgauugaguucggcgg

SEQ ID NO: 3139720 - RNA, 20 nt, Mycobacterium bovis subsp bovis AF2122/97
ccgauugaguucggcggcca

SEQ ID NO: 3139721 - RNA, 18 nt, Mycobacterium bovis subsp bovis AF2122/97
ccgauugcguucaucauc

SEQ ID NO: 3139722 - RNA, 12 nt, Mycobacterium bovis subsp bovis AF2122/97
ccgauuggccaa

SEQ ID NO: 3139723 - RNA, 15 nt, Mycobacterium bovis subsp bovis AF2122/97
ccgauugucggcaac

SEQ ID NO: 3139724 - RNA, 21 nt, Mycobacterium bovis subsp bovis AF2122/97
ccgauuuauccggaucggccu

SEQ ID NO: 3139725 - RNA, 13 nt, Mycobacterium bovis subsp bovis AF2122/97
ccgauuucccagc

SEQ ID NO: 3139726 - RNA, 17 nt, Mycobacterium bovis subsp bovis AF2122/97
ccgauuuggccgucauc

SEQ ID NO: 3139727 - RNA, 21 nt, Mycobacterium bovis subsp bovis AF2122/97
ccgcaaaacgagcuuccacgc

SEQ ID NO: 3139728 - RNA, 18 nt, Mycobacterium bovis subsp bovis AF2122/97
ccgcaaaaucgucagcgc

SEQ ID NO: 3139729 - RNA, 16 nt, Mycobacterium bovis subsp bovis AF2122/97
ccgcaaacgcggcguc

SEQ ID NO: 3139730 - RNA, 19 nt, Mycobacterium bovis subsp bovis AF2122/97
ccgcaaaguagacgugcca

SEQ ID NO: 3139731 - RNA, 20 nt, Mycobacterium bovis subsp bovis AF2122/97
ccgcaacaacgccgcgacgu

SEQ ID NO: 3139732 - RNA, 18 nt, Mycobacterium bovis subsp bovis AF2122/97
ccgcaacaccccccgucc

SEQ ID NO: 3139733 - RNA, 18 nt, Mycobacterium bovis subsp bovis AF2122/97
ccgcaacagcucggccag

SEQ ID NO: 3139734 - RNA, 19 nt, Mycobacterium bovis subsp bovis AF2122/97
ccgcaacagcucggccagg

SEQ ID NO: 3139735 - RNA, 17 nt, Mycobacterium bovis subsp bovis AF2122/97
ccgcaacaucgggucgc

SEQ ID NO: 3139736 - RNA, 22 nt, Mycobacterium bovis subsp bovis AF2122/97
ccgcaacaucgggucgcugccg

SEQ ID NO: 3139737 - RNA, 19 nt, Mycobacterium bovis subsp bovis AF2122/97
ccgcaacauuuucgcccgc

SEQ ID NO: 3139738 - RNA, 17 nt, Mycobacterium bovis subsp bovis AF2122/97
ccgcaacccguauggcg

SEQ ID NO: 3139739 - RNA, 12 nt, Mycobacterium bovis subsp bovis AF2122/97
ccgcaaccgcga

SEQ ID NO: 3139740 - RNA, 23 nt, Mycobacterium bovis subsp bovis AF2122/97
ccgcaaccgguaucgccgcuacg

SEQ ID NO: 3139741 - RNA, 20 nt, Mycobacterium bovis subsp bovis AF2122/97
ccgcaacgacggccgucgcc

SEQ ID NO: 3139742 - RNA, 14 nt, Mycobacterium bovis subsp bovis AF2122/97
ccgcaacgacugau

SEQ ID NO: 3139743 - RNA, 24 nt, Mycobacterium bovis subsp bovis AF2122/97
ccgcaacgccaacacgcguuggug

SEQ ID NO: 3139744 - RNA, 20 nt, Mycobacterium bovis subsp bovis AF2122/97
ccgcaacgcgucggucgcgg

SEQ ID NO: 3139745 - RNA, 21 nt, Mycobacterium bovis subsp bovis AF2122/97
ccgcaacgcuucggcagcucc

SEQ ID NO: 3139746 - RNA, 21 nt, Mycobacterium bovis subsp bovis AF2122/97
ccgcaacggauguggugucga

SEQ ID NO: 3139747 - RNA, 14 nt, Mycobacterium bovis subsp bovis AF2122/97
ccgcaagaaucagc

SEQ ID NO: 3139748 - RNA, 13 nt, Mycobacterium bovis subsp bovis AF2122/97
ccgcaaggaccug

SEQ ID NO: 3139749 - RNA, 23 nt, Mycobacterium bovis subsp bovis AF2122/97
ccgcaaggcgccgauaccggcgg

SEQ ID NO: 3139750 - RNA, 22 nt, Mycobacterium bovis subsp bovis AF2122/97
ccgcaaggcguguagccugcgg

SEQ ID NO: 3139751 - RNA, 23 nt, Mycobacterium bovis subsp bovis AF2122/97
ccgcaaggcguguagccugcggc

SEQ ID NO: 3139752 - RNA, 16 nt, Mycobacterium bovis subsp bovis AF2122/97
ccgcaauacccgagcg

SEQ ID NO: 3139753 - RNA, 15 nt, Mycobacterium bovis subsp bovis AF2122/97
ccgcaaucagacggc

SEQ ID NO: 3139754 - RNA, 14 nt, Mycobacterium bovis subsp bovis AF2122/97
ccgcaaucgcgacg

SEQ ID NO: 3139755 - RNA, 14 nt, Mycobacterium bovis subsp bovis AF2122/97
ccgcaaucugcuug

SEQ ID NO: 3139756 - RNA, 15 nt, Mycobacterium bovis subsp bovis AF2122/97
ccgcaaugaccgcgg

SEQ ID NO: 3139757 - RNA, 18 nt, Mycobacterium bovis subsp bovis AF2122/97
ccgcaaugaccuggccgc

SEQ ID NO: 3139758 - RNA, 20 nt, Mycobacterium bovis subsp bovis AF2122/97
ccgcaaugaccuggccgccc

SEQ ID NO: 3139759 - RNA, 21 nt, Mycobacterium bovis subsp bovis AF2122/97
ccgcaaugaccuggccgcccg

SEQ ID NO: 3139760 - RNA, 21 nt, Mycobacterium bovis subsp bovis AF2122/97
ccgcaaugacgucgucggcca

SEQ ID NO: 3139761 - RNA, 16 nt, Mycobacterium bovis subsp bovis AF2122/97
ccgcaaugcgagcgcg

SEQ ID NO: 3139762 - RNA, 20 nt, Mycobacterium bovis subsp bovis AF2122/97
ccgcaaugcgagcgcgccgg

SEQ ID NO: 3139763 - RNA, 15 nt, Mycobacterium bovis subsp bovis AF2122/97
ccgcaauggcggccu

SEQ ID NO: 3139764 - RNA, 17 nt, Mycobacterium bovis subsp bovis AF2122/97
ccgcaauggcggccuug

SEQ ID NO: 3139765 - RNA, 17 nt, Mycobacterium bovis subsp bovis AF2122/97
ccgcaauggggcgcaau

SEQ ID NO: 3139766 - RNA, 18 nt, Mycobacterium bovis subsp bovis AF2122/97
ccgcaauucccaucggcc

SEQ ID NO: 3139767 - RNA, 19 nt, Mycobacterium bovis subsp bovis AF2122/97
ccgcaauucccaucggccu

SEQ ID NO: 3139768 - RNA, 14 nt, Mycobacterium bovis subsp bovis AF2122/97
ccgcaauucgcggu

SEQ ID NO: 3139769 - RNA, 23 nt, Mycobacterium bovis subsp bovis AF2122/97
ccgcaauuggcguagcaacccag

SEQ ID NO: 3139770 - RNA, 14 nt, Mycobacterium bovis subsp bovis AF2122/97
ccgcacaaacgggc

SEQ ID NO: 3139771 - RNA, 23 nt, Mycobacterium bovis subsp bovis AF2122/97
ccgcacaaacgggcgugggccgc

SEQ ID NO: 3139772 - RNA, 13 nt, Mycobacterium bovis subsp bovis AF2122/97
ccgcacaacgaua

SEQ ID NO: 3139773 - RNA, 20 nt, Mycobacterium bovis subsp bovis AF2122/97
ccgcacaacgauaguucggc

SEQ ID NO: 3139774 - RNA, 19 nt, Mycobacterium bovis subsp bovis AF2122/97
ccgcacacagaccgugacg

SEQ ID NO: 3139775 - RNA, 18 nt, Mycobacterium bovis subsp bovis AF2122/97
ccgcacacgcgugcacca

SEQ ID NO: 3139776 - RNA, 19 nt, Mycobacterium bovis subsp bovis AF2122/97
ccgcacagaaaacgauggu

SEQ ID NO: 3139777 - RNA, 15 nt, Mycobacterium bovis subsp bovis AF2122/97
ccgcaccaagcagcg

SEQ ID NO: 3139778 - RNA, 17 nt, Mycobacterium bovis subsp bovis AF2122/97
ccgcaccacaccguggg

SEQ ID NO: 3139779 - RNA, 19 nt, Mycobacterium bovis subsp bovis AF2122/97
ccgcaccacaccgugggcg

SEQ ID NO: 3139780 - RNA, 11 nt, Mycobacterium bovis subsp bovis AF2122/97
ccgcaccaccg

SEQ ID NO: 3139781 - RNA, 16 nt, Mycobacterium bovis subsp bovis AF2122/97
ccgcaccaccggcccc

SEQ ID NO: 3139782 - RNA, 23 nt, Mycobacterium bovis subsp bovis AF2122/97
ccgcaccaccggccccaccgaca

SEQ ID NO: 3139783 - RNA, 17 nt, Mycobacterium bovis subsp bovis AF2122/97
ccgcaccacgcccgacg

SEQ ID NO: 3139784 - RNA, 16 nt, Mycobacterium bovis subsp bovis AF2122/97
ccgcaccagcugucgg

SEQ ID NO: 3139785 - RNA, 18 nt, Mycobacterium bovis subsp bovis AF2122/97
ccgcaccagcugucgggc

SEQ ID NO: 3139786 - RNA, 20 nt, Mycobacterium bovis subsp bovis AF2122/97
ccgcaccagcugucgggcag

SEQ ID NO: 3139787 - RNA, 16 nt, Mycobacterium bovis subsp bovis AF2122/97
ccgcagaccgccaccg

SEQ ID NO: 3139788 - RNA, 23 nt, Mycobacterium bovis subsp bovis AF2122/97
ccgcagaccgguuucuucggcca

SEQ ID NO: 3139789 - RNA, 15 nt, Mycobacterium bovis subsp bovis AF2122/97
ccgcagacgccgacu

SEQ ID NO: 3139790 - RNA, 17 nt, Mycobacterium bovis subsp bovis AF2122/97
ccgcagacgcggcaggu

SEQ ID NO: 3139791 - RNA, 20 nt, Mycobacterium bovis subsp bovis AF2122/97
ccgcagacgugguagccggc

SEQ ID NO: 3139792 - RNA, 23 nt, Mycobacterium bovis subsp bovis AF2122/97
ccgcagagaccaagguccgcacg

SEQ ID NO: 3139793 - RNA, 21 nt, Mycobacterium bovis subsp bovis AF2122/97
ccgcagagcaccgcgaacagc

SEQ ID NO: 3139794 - RNA, 15 nt, Mycobacterium bovis subsp bovis AF2122/97
ccgcagaucaccgcc

SEQ ID NO: 3139795 - RNA, 18 nt, Mycobacterium bovis subsp bovis AF2122/97
ccgcagaucaccgccagc

SEQ ID NO: 3139796 - RNA, 15 nt, Mycobacterium bovis subsp bovis AF2122/97
ccgcagauccccgcc

SEQ ID NO: 3139797 - RNA, 17 nt, Mycobacterium bovis subsp bovis AF2122/97
ccgcagauccccgccac

SEQ ID NO: 3139798 - RNA, 18 nt, Mycobacterium bovis subsp bovis AF2122/97
ccgcagaugcaccugcga

SEQ ID NO: 3139799 - RNA, 22 nt, Mycobacterium bovis subsp bovis AF2122/97
ccgcagaugcaguuccuugaga

SEQ ID NO: 3139800 - RNA, 13 nt, Mycobacterium bovis subsp bovis AF2122/97
ccgcagaugggcc

SEQ ID NO: 3139801 - RNA, 15 nt, Mycobacterium bovis subsp bovis AF2122/97
ccgcagcaccgucgg

SEQ ID NO: 3139802 - RNA, 11 nt, Mycobacterium bovis subsp bovis AF2122/97
ccgcagcagca

SEQ ID NO: 3139803 - RNA, 20 nt, Mycobacterium bovis subsp bovis AF2122/97
ccgcagcaggggacgaccau

SEQ ID NO: 3139804 - RNA, 21 nt, Mycobacterium bovis subsp bovis AF2122/97
ccgcagcaggugcaucgccac

SEQ ID NO: 3139805 - RNA, 19 nt, Mycobacterium bovis subsp bovis AF2122/97
ccgcagccagaucuccccg

SEQ ID NO: 3139806 - RNA, 12 nt, Mycobacterium bovis subsp bovis AF2122/97
ccgcagccagca

SEQ ID NO: 3139807 - RNA, 13 nt, Mycobacterium bovis subsp bovis AF2122/97
ccgcagccagcgg

SEQ ID NO: 3139808 - RNA, 16 nt, Mycobacterium bovis subsp bovis AF2122/97
ccgcagcccgugacug

SEQ ID NO: 3139809 - RNA, 20 nt, Mycobacterium bovis subsp bovis AF2122/97
ccgcagcccgugacugguga

SEQ ID NO: 3139810 - RNA, 13 nt, Mycobacterium bovis subsp bovis AF2122/97
ccgcagccgguua

SEQ ID NO: 3139811 - RNA, 11 nt, Mycobacterium bovis subsp bovis AF2122/97
ccgcagccugc

SEQ ID NO: 3139812 - RNA, 19 nt, Mycobacterium bovis subsp bovis AF2122/97
ccgcagcgaaaacccgguc

SEQ ID NO: 3139813 - RNA, 20 nt, Mycobacterium bovis subsp bovis AF2122/97
ccgcagcgaagaccagcggc

SEQ ID NO: 3139814 - RNA, 19 nt, Mycobacterium bovis subsp bovis AF2122/97
ccgcagcgaccaccgucac

SEQ ID NO: 3139815 - RNA, 13 nt, Mycobacterium bovis subsp bovis AF2122/97
ccgcagcgccacc

SEQ ID NO: 3139816 - RNA, 17 nt, Mycobacterium bovis subsp bovis AF2122/97
ccgcagcgccacccgau

SEQ ID NO: 3139817 - RNA, 12 nt, Mycobacterium bovis subsp bovis AF2122/97
ccgcagcgccua

SEQ ID NO: 3139818 - RNA, 21 nt, Mycobacterium bovis subsp bovis AF2122/97
ccgcagcgcgaaggucagcga

SEQ ID NO: 3139819 - RNA, 23 nt, Mycobacterium bovis subsp bovis AF2122/97
ccgcagcgcgaaggucagcgacu

SEQ ID NO: 3139820 - RNA, 19 nt, Mycobacterium bovis subsp bovis AF2122/97
ccgcagcggaacugggccc

SEQ ID NO: 3139821 - RNA, 20 nt, Mycobacterium bovis subsp bovis AF2122/97
ccgcagcggccugaccggcu

SEQ ID NO: 3139822 - RNA, 14 nt, Mycobacterium bovis subsp bovis AF2122/97
ccgcagcggcggca

SEQ ID NO: 3139823 - RNA, 22 nt, Mycobacterium bovis subsp bovis AF2122/97
ccgcagcggcggcaacccugcc

SEQ ID NO: 3139824 - RNA, 15 nt, Mycobacterium bovis subsp bovis AF2122/97
ccgcagcgugaucug

SEQ ID NO: 3139825 - RNA, 18 nt, Mycobacterium bovis subsp bovis AF2122/97
ccgcagcgugaucuggcc

SEQ ID NO: 3139826 - RNA, 21 nt, Mycobacterium bovis subsp bovis AF2122/97
ccgcagcgugaucuggccacg

SEQ ID NO: 3139827 - RNA, 19 nt, Mycobacterium bovis subsp bovis AF2122/97
ccgcagcuauuucgcgacg

SEQ ID NO: 3139828 - RNA, 21 nt, Mycobacterium bovis subsp bovis AF2122/97
ccgcagcuauuucgcgacgcg

SEQ ID NO: 3139829 - RNA, 13 nt, Mycobacterium bovis subsp bovis AF2122/97
ccgcagcucagca

SEQ ID NO: 3139830 - RNA, 16 nt, Mycobacterium bovis subsp bovis AF2122/97
ccgcagcucgaccagg

SEQ ID NO: 3139831 - RNA, 13 nt, Mycobacterium bovis subsp bovis AF2122/97
ccgcagcugcgga

SEQ ID NO: 3139832 - RNA, 14 nt, Mycobacterium bovis subsp bovis AF2122/97
ccgcagcugcggau

SEQ ID NO: 3139833 - RNA, 23 nt, Mycobacterium bovis subsp bovis AF2122/97
ccgcagcugcggauccaccacgc

SEQ ID NO: 3139834 - RNA, 16 nt, Mycobacterium bovis subsp bovis AF2122/97
ccgcagcuuggccuca

SEQ ID NO: 3139835 - RNA, 19 nt, Mycobacterium bovis subsp bovis AF2122/97
ccgcagcuuggccucagcc

SEQ ID NO: 3139836 - RNA, 20 nt, Mycobacterium bovis subsp bovis AF2122/97
ccgcagcuuggccucagcca

SEQ ID NO: 3139837 - RNA, 23 nt, Mycobacterium bovis subsp bovis AF2122/97
ccgcagcuuuaaucguggcacug

SEQ ID NO: 3139838 - RNA, 15 nt, Mycobacterium bovis subsp bovis AF2122/97
ccgcaggacgcugcc

SEQ ID NO: 3139839 - RNA, 16 nt, Mycobacterium bovis subsp bovis AF2122/97
ccgcaggacgcugccg

SEQ ID NO: 3139840 - RNA, 12 nt, Mycobacterium bovis subsp bovis AF2122/97
ccgcaggccugu

SEQ ID NO: 3139841 - RNA, 17 nt, Mycobacterium bovis subsp bovis AF2122/97
ccgcaggcgaacaccag

SEQ ID NO: 3139842 - RNA, 21 nt, Mycobacterium bovis subsp bovis AF2122/97
ccgcaggcgaacaccagaugg

SEQ ID NO: 3139843 - RNA, 17 nt, Mycobacterium bovis subsp bovis AF2122/97
ccgcaggcucaccgagc

SEQ ID NO: 3139844 - RNA, 19 nt, Mycobacterium bovis subsp bovis AF2122/97
ccgcaggcucaccgagccg

SEQ ID NO: 3139845 - RNA, 22 nt, Mycobacterium bovis subsp bovis AF2122/97
ccgcaggcucucuuugagcagg

SEQ ID NO: 3139846 - RNA, 16 nt, Mycobacterium bovis subsp bovis AF2122/97
ccgcagggccgcgcgc

SEQ ID NO: 3139847 - RNA, 15 nt, Mycobacterium bovis subsp bovis AF2122/97
ccgcaggguccacac

SEQ ID NO: 3139848 - RNA, 15 nt, Mycobacterium bovis subsp bovis AF2122/97
ccgcaggucgcacca

SEQ ID NO: 3139849 - RNA, 16 nt, Mycobacterium bovis subsp bovis AF2122/97
ccgcaggucgcuggcc

SEQ ID NO: 3139850 - RNA, 17 nt, Mycobacterium bovis subsp bovis AF2122/97
ccgcaggucgcuggccg

SEQ ID NO: 3139851 - RNA, 21 nt, Mycobacterium bovis subsp bovis AF2122/97
ccgcaggucggccaccugcuc

SEQ ID NO: 3139852 - RNA, 19 nt, Mycobacterium bovis subsp bovis AF2122/97
ccgcaggugggcguuggcg

SEQ ID NO: 3139853 - RNA, 22 nt, Mycobacterium bovis subsp bovis AF2122/97
ccgcaggugggcguuggcgacg

SEQ ID NO: 3139854 - RNA, 23 nt, Mycobacterium bovis subsp bovis AF2122/97
ccgcaguccggggcgcaggucgu

SEQ ID NO: 3139855 - RNA, 19 nt, Mycobacterium bovis subsp bovis AF2122/97
ccgcagucgcuggguggcg

SEQ ID NO: 3139856 - RNA, 23 nt, Mycobacterium bovis subsp bovis AF2122/97
ccgcaguggcaagcugucgucgc

SEQ ID NO: 3139857 - RNA, 14 nt, Mycobacterium bovis subsp bovis AF2122/97
ccgcaguggucggc

SEQ ID NO: 3139858 - RNA, 15 nt, Mycobacterium bovis subsp bovis AF2122/97
ccgcaguggucggcu

SEQ ID NO: 3139859 - RNA, 15 nt, Mycobacterium bovis subsp bovis AF2122/97
ccgcaguucuugauu

SEQ ID NO: 3139860 - RNA, 14 nt, Mycobacterium bovis subsp bovis AF2122/97
ccgcauaacgccag

SEQ ID NO: 3139861 - RNA, 22 nt, Mycobacterium bovis subsp bovis AF2122/97
ccgcauaacgcgaacccgcgag

SEQ ID NO: 3139862 - RNA, 21 nt, Mycobacterium bovis subsp bovis AF2122/97
ccgcauaccaguaccgucauc

SEQ ID NO: 3139863 - RNA, 19 nt, Mycobacterium bovis subsp bovis AF2122/97
ccgcauaccuuccagaucg

SEQ ID NO: 3139864 - RNA, 23 nt, Mycobacterium bovis subsp bovis AF2122/97
ccgcauacgcggcuuugacgccc

SEQ ID NO: 3139865 - RNA, 21 nt, Mycobacterium bovis subsp bovis AF2122/97
ccgcauaggccccgccagcgc

SEQ ID NO: 3139866 - RNA, 23 nt, Mycobacterium bovis subsp bovis AF2122/97
ccgcauaggccccgccagcgccg

SEQ ID NO: 3139867 - RNA, 16 nt, Mycobacterium bovis subsp bovis AF2122/97
ccgcauauugcggcgc

SEQ ID NO: 3139868 - RNA, 17 nt, Mycobacterium bovis subsp bovis AF2122/97
ccgcauauugcggcgcc

SEQ ID NO: 3139869 - RNA, 18 nt, Mycobacterium bovis subsp bovis AF2122/97
ccgcauauugcggcgccg

SEQ ID NO: 3139870 - RNA, 19 nt, Mycobacterium bovis subsp bovis AF2122/97
ccgcauauugcggcgccgu

SEQ ID NO: 3139871 - RNA, 13 nt, Mycobacterium bovis subsp bovis AF2122/97
ccgcaucacccgg

SEQ ID NO: 3139872 - RNA, 20 nt, Mycobacterium bovis subsp bovis AF2122/97
ccgcaucauagacagggccg

SEQ ID NO: 3139873 - RNA, 12 nt, Mycobacterium bovis subsp bovis AF2122/97
ccgccaccgcug

SEQ ID NO: 3139874 - RNA, 15 nt, Mycobacterium bovis subsp bovis AF2122/97
ccgccaccggcgccg

SEQ ID NO: 3139875 - RNA, 16 nt, Mycobacterium bovis subsp bovis AF2122/97
ccgccaccggcgccgc

SEQ ID NO: 3139876 - RNA, 18 nt, Mycobacterium bovis subsp bovis AF2122/97
ccgccaccggcgccgccg

SEQ ID NO: 3139877 - RNA, 14 nt, Mycobacterium bovis subsp bovis AF2122/97
ccgccaccggcuga

SEQ ID NO: 3139878 - RNA, 18 nt, Mycobacterium bovis subsp bovis AF2122/97
ccgccaccguacgacagu

SEQ ID NO: 3139879 - RNA, 18 nt, Mycobacterium bovis subsp bovis AF2122/97
ccgccaccgucauggcgg

SEQ ID NO: 3139880 - RNA, 19 nt, Mycobacterium bovis subsp bovis AF2122/97
ccgccaccgucauggcggg

SEQ ID NO: 3139881 - RNA, 17 nt, Mycobacterium bovis subsp bovis AF2122/97
ccgccaccuuggcguug

SEQ ID NO: 3139882 - RNA, 17 nt, Mycobacterium bovis subsp bovis AF2122/97
ccgccaccuuggcuggg

SEQ ID NO: 3139883 - RNA, 14 nt, Mycobacterium bovis subsp bovis AF2122/97
ccgccacgaugucg

SEQ ID NO: 3139884 - RNA, 14 nt, Mycobacterium bovis subsp bovis AF2122/97
ccgccacgccgaag

SEQ ID NO: 3139885 - RNA, 19 nt, Mycobacterium bovis subsp bovis AF2122/97
ccgccacggaucgcggcgg

SEQ ID NO: 3139886 - RNA, 13 nt, Mycobacterium bovis subsp bovis AF2122/97
ccgccacggcggc

SEQ ID NO: 3139887 - RNA, 21 nt, Mycobacterium bovis subsp bovis AF2122/97
ccgccacgggcggccaccgca

SEQ ID NO: 3139888 - RNA, 19 nt, Mycobacterium bovis subsp bovis AF2122/97
ccgccacgguacauccaga

SEQ ID NO: 3139889 - RNA, 19 nt, Mycobacterium bovis subsp bovis AF2122/97
ccgccacgguucgggcagc

SEQ ID NO: 3139890 - RNA, 15 nt, Mycobacterium bovis subsp bovis AF2122/97
ccgccacgucgccgg

SEQ ID NO: 3139891 - RNA, 22 nt, Mycobacterium bovis subsp bovis AF2122/97
ccgccacgucgccggcuaccgc

SEQ ID NO: 3139892 - RNA, 20 nt, Mycobacterium bovis subsp bovis AF2122/97
ccgccacucgcccgcugccg

SEQ ID NO: 3139893 - RNA, 14 nt, Mycobacterium bovis subsp bovis AF2122/97
ccgccacugcuggg

SEQ ID NO: 3139894 - RNA, 22 nt, Mycobacterium bovis subsp bovis AF2122/97
ccgccacuggcgccggugccgc

SEQ ID NO: 3139895 - RNA, 23 nt, Mycobacterium bovis subsp bovis AF2122/97
ccgccacuggcgcugaucgccuc

SEQ ID NO: 3139896 - RNA, 16 nt, Mycobacterium bovis subsp bovis AF2122/97
ccgccacuucccccgg

SEQ ID NO: 3139897 - RNA, 23 nt, Mycobacterium bovis subsp bovis AF2122/97
ccgccacuucccccggguccgcc

SEQ ID NO: 3139898 - RNA, 18 nt, Mycobacterium bovis subsp bovis AF2122/97
ccgccagaauugccggcg

SEQ ID NO: 3139899 - RNA, 19 nt, Mycobacterium bovis subsp bovis AF2122/97
ccgccagaauugccggcga

SEQ ID NO: 3139900 - RNA, 17 nt, Mycobacterium bovis subsp bovis AF2122/97
ccgccagaccgcggcgg

SEQ ID NO: 3139901 - RNA, 18 nt, Mycobacterium bovis subsp bovis AF2122/97
ccgccagaccgcggcggc

SEQ ID NO: 3139902 - RNA, 19 nt, Mycobacterium bovis subsp bovis AF2122/97
ccgccagaccgcggcggcc

SEQ ID NO: 3139903 - RNA, 17 nt, Mycobacterium bovis subsp bovis AF2122/97
ccgccagaucucgcgcg

SEQ ID NO: 3139904 - RNA, 18 nt, Mycobacterium bovis subsp bovis AF2122/97
ccgccagaucucgcgcgc

SEQ ID NO: 3139905 - RNA, 21 nt, Mycobacterium bovis subsp bovis AF2122/97
ccgccagaugaugccacccuc

SEQ ID NO: 3139906 - RNA, 20 nt, Mycobacterium bovis subsp bovis AF2122/97
ccgccagauuggcgcugccc

SEQ ID NO: 3139907 - RNA, 22 nt, Mycobacterium bovis subsp bovis AF2122/97
ccgccagcaccaccggcucccg

SEQ ID NO: 3139908 - RNA, 17 nt, Mycobacterium bovis subsp bovis AF2122/97
ccgccagcaccucggcc

SEQ ID NO: 3139909 - RNA, 13 nt, Mycobacterium bovis subsp bovis AF2122/97
ccgccagcagcuu

SEQ ID NO: 3139910 - RNA, 13 nt, Mycobacterium bovis subsp bovis AF2122/97
ccgccagcagggc

SEQ ID NO: 3139911 - RNA, 15 nt, Mycobacterium bovis subsp bovis AF2122/97
ccgccagcagggcca

SEQ ID NO: 3139912 - RNA, 16 nt, Mycobacterium bovis subsp bovis AF2122/97
ccgccagcagggccag

SEQ ID NO: 3139913 - RNA, 16 nt, Mycobacterium bovis subsp bovis AF2122/97
ccgccagcaugacacc

SEQ ID NO: 3139914 - RNA, 18 nt, Mycobacterium bovis subsp bovis AF2122/97
ccgccagcaugacaccgg

SEQ ID NO: 3139915 - RNA, 20 nt, Mycobacterium bovis subsp bovis AF2122/97
ccgccagcaugacaccggcc

SEQ ID NO: 3139916 - RNA, 18 nt, Mycobacterium bovis subsp bovis AF2122/97
ccgccagcauugaagaag

SEQ ID NO: 3139917 - RNA, 20 nt, Mycobacterium bovis subsp bovis AF2122/97
ccgccagcauugaagaagcc

SEQ ID NO: 3139918 - RNA, 13 nt, Mycobacterium bovis subsp bovis AF2122/97
ccgccagcccagc

SEQ ID NO: 3139919 - RNA, 15 nt, Mycobacterium bovis subsp bovis AF2122/97
ccgccagcccagcac

SEQ ID NO: 3139920 - RNA, 17 nt, Mycobacterium bovis subsp bovis AF2122/97
ccgccagcccagcacgc

SEQ ID NO: 3139921 - RNA, 18 nt, Mycobacterium bovis subsp bovis AF2122/97
ccgccagcccagcacgcu

SEQ ID NO: 3139922 - RNA, 11 nt, Mycobacterium bovis subsp bovis AF2122/97
ccgccagcccc

SEQ ID NO: 3139923 - RNA, 14 nt, Mycobacterium bovis subsp bovis AF2122/97
ccgccagccccacc

SEQ ID NO: 3139924 - RNA, 13 nt, Mycobacterium bovis subsp bovis AF2122/97
ccgccagccccag

SEQ ID NO: 3139925 - RNA, 15 nt, Mycobacterium bovis subsp bovis AF2122/97
ccgccagccccagcg

SEQ ID NO: 3139926 - RNA, 16 nt, Mycobacterium bovis subsp bovis AF2122/97
ccgccagccccagcgu

SEQ ID NO: 3139927 - RNA, 14 nt, Mycobacterium bovis subsp bovis AF2122/97
ccgccagcccggug

SEQ ID NO: 3139928 - RNA, 22 nt, Mycobacterium bovis subsp bovis AF2122/97
ccgccagcccggugauggugcc

SEQ ID NO: 3139929 - RNA, 21 nt, Mycobacterium bovis subsp bovis AF2122/97
ccgccagcccgucaucgcgua

SEQ ID NO: 3139930 - RNA, 19 nt, Mycobacterium bovis subsp bovis AF2122/97
ccgccagccgcgagccggu

SEQ ID NO: 3139931 - RNA, 14 nt, Mycobacterium bovis subsp bovis AF2122/97
ccgccagccggcgc

SEQ ID NO: 3139932 - RNA, 15 nt, Mycobacterium bovis subsp bovis AF2122/97
ccgccagccggcgca

SEQ ID NO: 3139933 - RNA, 23 nt, Mycobacterium bovis subsp bovis AF2122/97
ccgccagcgcacgauagccaccg

SEQ ID NO: 3139934 - RNA, 15 nt, Mycobacterium bovis subsp bovis AF2122/97
ccgccagcgccaccg

SEQ ID NO: 3139935 - RNA, 20 nt, Mycobacterium bovis subsp bovis AF2122/97
ccgccagcgccaccguuacc

SEQ ID NO: 3139936 - RNA, 15 nt, Mycobacterium bovis subsp bovis AF2122/97
ccgccagcgccgccg

SEQ ID NO: 3139937 - RNA, 16 nt, Mycobacterium bovis subsp bovis AF2122/97
ccgccagcgccgccgc

SEQ ID NO: 3139938 - RNA, 13 nt, Mycobacterium bovis subsp bovis AF2122/97
ccgccagcgccgg

SEQ ID NO: 3139939 - RNA, 22 nt, Mycobacterium bovis subsp bovis AF2122/97
ccgccagcgccggucagggacg

SEQ ID NO: 3139940 - RNA, 12 nt, Mycobacterium bovis subsp bovis AF2122/97
ccgccagcgcga

SEQ ID NO: 3139941 - RNA, 14 nt, Mycobacterium bovis subsp bovis AF2122/97
ccgccagcgcggug

SEQ ID NO: 3139942 - RNA, 21 nt, Mycobacterium bovis subsp bovis AF2122/97
ccgccagcgcggugucggggc

SEQ ID NO: 3139943 - RNA, 15 nt, Mycobacterium bovis subsp bovis AF2122/97
ccgccagcgcucaca

SEQ ID NO: 3139944 - RNA, 21 nt, Mycobacterium bovis subsp bovis AF2122/97
ccgccagcggcaauggccagc

SEQ ID NO: 3139945 - RNA, 15 nt, Mycobacterium bovis subsp bovis AF2122/97
ccgccagcggccgcu

SEQ ID NO: 3139946 - RNA, 12 nt, Mycobacterium bovis subsp bovis AF2122/97
ccgccagcucac

SEQ ID NO: 3139947 - RNA, 16 nt, Mycobacterium bovis subsp bovis AF2122/97
ccgccagcugcgcagc

SEQ ID NO: 3139948 - RNA, 16 nt, Mycobacterium bovis subsp bovis AF2122/97
ccgccagcugggcagc

SEQ ID NO: 3139949 - RNA, 18 nt, Mycobacterium bovis subsp bovis AF2122/97
ccgccagcugggcagcca

SEQ ID NO: 3139950 - RNA, 22 nt, Mycobacterium bovis subsp bovis AF2122/97
ccgccagcugggcagccagauc

SEQ ID NO: 3139951 - RNA, 24 nt, Mycobacterium bovis subsp bovis AF2122/97
ccgccaggaaucccucggccgcag

SEQ ID NO: 3139952 - RNA, 12 nt, Mycobacterium bovis subsp bovis AF2122/97
ccgccaggccga

SEQ ID NO: 3139953 - RNA, 15 nt, Mycobacterium bovis subsp bovis AF2122/97
ccgccaggccgcgcg

SEQ ID NO: 3139954 - RNA, 20 nt, Mycobacterium bovis subsp bovis AF2122/97
ccgccaggccgcgcgacaac

SEQ ID NO: 3139955 - RNA, 14 nt, Mycobacterium bovis subsp bovis AF2122/97
ccgccaggcucgag

SEQ ID NO: 3139956 - RNA, 18 nt, Mycobacterium bovis subsp bovis AF2122/97
ccgccagggcacguggcg

SEQ ID NO: 3139957 - RNA, 22 nt, Mycobacterium bovis subsp bovis AF2122/97
ccgccagggcccuagccggcgc

SEQ ID NO: 3139958 - RNA, 21 nt, Mycobacterium bovis subsp bovis AF2122/97
ccgccagguccgccggugccg

SEQ ID NO: 3139959 - RNA, 19 nt, Mycobacterium bovis subsp bovis AF2122/97
ccgccaggucgaggcaggc

SEQ ID NO: 3139960 - RNA, 19 nt, Mycobacterium bovis subsp bovis AF2122/97
ccgcccgcagggccgccgc

SEQ ID NO: 3139961 - RNA, 13 nt, Mycobacterium bovis subsp bovis AF2122/97
ccgcccgccaacu

SEQ ID NO: 3139962 - RNA, 15 nt, Mycobacterium bovis subsp bovis AF2122/97
ccgcccgccagcgau

SEQ ID NO: 3139963 - RNA, 17 nt, Mycobacterium bovis subsp bovis AF2122/97
ccgcccgccagcgaucc

SEQ ID NO: 3139964 - RNA, 15 nt, Mycobacterium bovis subsp bovis AF2122/97
ccgcccgcccggacg

SEQ ID NO: 3139965 - RNA, 14 nt, Mycobacterium bovis subsp bovis AF2122/97
ccgcccgccgguga

SEQ ID NO: 3139966 - RNA, 15 nt, Mycobacterium bovis subsp bovis AF2122/97
ccgcccgcgccacca

SEQ ID NO: 3139967 - RNA, 15 nt, Mycobacterium bovis subsp bovis AF2122/97
ccgcccgcgccaccg

SEQ ID NO: 3139968 - RNA, 16 nt, Mycobacterium bovis subsp bovis AF2122/97
ccgcccgcgccaccga

SEQ ID NO: 3139969 - RNA, 21 nt, Mycobacterium bovis subsp bovis AF2122/97
ccgcccgcgcccccggugccg

SEQ ID NO: 3139970 - RNA, 13 nt, Mycobacterium bovis subsp bovis AF2122/97
ccgcccgcgccgc

SEQ ID NO: 3139971 - RNA, 15 nt, Mycobacterium bovis subsp bovis AF2122/97
ccgcccgcgccgccg

SEQ ID NO: 3139972 - RNA, 19 nt, Mycobacterium bovis subsp bovis AF2122/97
ccgcccgcgccgccgcuac

SEQ ID NO: 3139973 - RNA, 16 nt, Mycobacterium bovis subsp bovis AF2122/97
ccgcccgcgccgccgg

SEQ ID NO: 3139974 - RNA, 12 nt, Mycobacterium bovis subsp bovis AF2122/97
ccgcccgcgccu

SEQ ID NO: 3139975 - RNA, 14 nt, Mycobacterium bovis subsp bovis AF2122/97
ccgcccgcgccucc

SEQ ID NO: 3139976 - RNA, 16 nt, Mycobacterium bovis subsp bovis AF2122/97
ccgcccgcgccuccgu

SEQ ID NO: 3139977 - RNA, 14 nt, Mycobacterium bovis subsp bovis AF2122/97
ccgcccgcgcggug

SEQ ID NO: 3139978 - RNA, 15 nt, Mycobacterium bovis subsp bovis AF2122/97
ccgcccgcuccgccg

SEQ ID NO: 3139979 - RNA, 20 nt, Mycobacterium bovis subsp bovis AF2122/97
ccgcccgcuccuccggcacc

SEQ ID NO: 3139980 - RNA, 17 nt, Mycobacterium bovis subsp bovis AF2122/97
ccgcccgcugggcucgc

SEQ ID NO: 3139981 - RNA, 21 nt, Mycobacterium bovis subsp bovis AF2122/97
ccgcccggaacggguuggcga

SEQ ID NO: 3139982 - RNA, 23 nt, Mycobacterium bovis subsp bovis AF2122/97
ccgcccggacgcaacacccgggc

SEQ ID NO: 3139983 - RNA, 21 nt, Mycobacterium bovis subsp bovis AF2122/97
ccgcccggcaguucgcggcca

SEQ ID NO: 3139984 - RNA, 12 nt, Mycobacterium bovis subsp bovis AF2122/97
ccgcccggcccg

SEQ ID NO: 3139985 - RNA, 13 nt, Mycobacterium bovis subsp bovis AF2122/97
ccgcccggcccgg

SEQ ID NO: 3139986 - RNA, 14 nt, Mycobacterium bovis subsp bovis AF2122/97
ccgcccggcccggc

SEQ ID NO: 3139987 - RNA, 15 nt, Mycobacterium bovis subsp bovis AF2122/97
ccgcccggcccggcu

SEQ ID NO: 3139988 - RNA, 16 nt, Mycobacterium bovis subsp bovis AF2122/97
ccgcccggguugaccg

SEQ ID NO: 3139989 - RNA, 14 nt, Mycobacterium bovis subsp bovis AF2122/97
ccgcccggucgggc

SEQ ID NO: 3139990 - RNA, 23 nt, Mycobacterium bovis subsp bovis AF2122/97
ccgcccggucgggcgcggggcgg

SEQ ID NO: 3139991 - RNA, 19 nt, Mycobacterium bovis subsp bovis AF2122/97
ccgcccggugcuaaccgac

SEQ ID NO: 3139992 - RNA, 21 nt, Mycobacterium bovis subsp bovis AF2122/97
ccgcccguagacccacagucg

SEQ ID NO: 3139993 - RNA, 18 nt, Mycobacterium bovis subsp bovis AF2122/97
ccgcccguaucggcuucg

SEQ ID NO: 3139994 - RNA, 13 nt, Mycobacterium bovis subsp bovis AF2122/97
ccgcccgugauca

SEQ ID NO: 3139995 - RNA, 18 nt, Mycobacterium bovis subsp bovis AF2122/97
ccgcccgugaucaccacg

SEQ ID NO: 3139996 - RNA, 20 nt, Mycobacterium bovis subsp bovis AF2122/97
ccgcccgugccgcccucacc

SEQ ID NO: 3139997 - RNA, 16 nt, Mycobacterium bovis subsp bovis AF2122/97
ccgcccguugcaggug

SEQ ID NO: 3139998 - RNA, 13 nt, Mycobacterium bovis subsp bovis AF2122/97
ccgcccucaccgc

SEQ ID NO: 3139999 - RNA, 21 nt, Mycobacterium bovis subsp bovis AF2122/97
ccgcccucaccgccugugccg

SEQ ID NO: 3140000 - RNA, 20 nt, Mycobacterium bovis subsp bovis AF2122/97
ccgcccucccuggggccguc

SEQ ID NO: 3140001 - RNA, 22 nt, Mycobacterium bovis subsp bovis AF2122/97
ccgcccucccuggggccguccg

SEQ ID NO: 3140002 - RNA, 18 nt, Mycobacterium bovis subsp bovis AF2122/97
ccgcccuggcaacgacac

SEQ ID NO: 3140003 - RNA, 23 nt, Mycobacterium bovis subsp bovis AF2122/97
ccgcccuggcaacgacacgccgc

SEQ ID NO: 3140004 - RNA, 13 nt, Mycobacterium bovis subsp bovis AF2122/97
ccgcccuggccgc

SEQ ID NO: 3140005 - RNA, 15 nt, Mycobacterium bovis subsp bovis AF2122/97
ccgcccuggccgccc

SEQ ID NO: 3140006 - RNA, 16 nt, Mycobacterium bovis subsp bovis AF2122/97
ccgcccuggccgccgg

SEQ ID NO: 3140007 - RNA, 19 nt, Mycobacterium bovis subsp bovis AF2122/97
ccgcccuggccgccggccc

SEQ ID NO: 3140008 - RNA, 21 nt, Mycobacterium bovis subsp bovis AF2122/97
ccgcccuggccgccggccccg

SEQ ID NO: 3140009 - RNA, 17 nt, Mycobacterium bovis subsp bovis AF2122/97
ccgcccugguccaggcc

SEQ ID NO: 3140010 - RNA, 24 nt, Mycobacterium bovis subsp bovis AF2122/97
ccgcccugguccaggcccuggcca

SEQ ID NO: 3140011 - RNA, 16 nt, Mycobacterium bovis subsp bovis AF2122/97
ccgcccuucaucuugc

SEQ ID NO: 3140012 - RNA, 14 nt, Mycobacterium bovis subsp bovis AF2122/97
ccgcccuugccgcc

SEQ ID NO: 3140013 - RNA, 18 nt, Mycobacterium bovis subsp bovis AF2122/97
ccgcccuugccgccagcc

SEQ ID NO: 3140014 - RNA, 19 nt, Mycobacterium bovis subsp bovis AF2122/97
ccgcccuugccgccagccc

SEQ ID NO: 3140015 - RNA, 21 nt, Mycobacterium bovis subsp bovis AF2122/97
ccgcccuugccgccagcccca

SEQ ID NO: 3140016 - RNA, 16 nt, Mycobacterium bovis subsp bovis AF2122/97
ccgcccuugccgcccg

SEQ ID NO: 3140017 - RNA, 16 nt, Mycobacterium bovis subsp bovis AF2122/97
ccgcccuugccgccgg

SEQ ID NO: 3140018 - RNA, 17 nt, Mycobacterium bovis subsp bovis AF2122/97
ccgcccuugccgccggc

SEQ ID NO: 3140019 - RNA, 18 nt, Mycobacterium bovis subsp bovis AF2122/97
ccgcccuugccgccggcc

SEQ ID NO: 3140020 - RNA, 21 nt, Mycobacterium bovis subsp bovis AF2122/97
ccgcccuugccgccggccccg

SEQ ID NO: 3140021 - RNA, 13 nt, Mycobacterium bovis subsp bovis AF2122/97
ccgcccuugcggc

SEQ ID NO: 3140022 - RNA, 16 nt, Mycobacterium bovis subsp bovis AF2122/97
ccgcccuugcggcgug

SEQ ID NO: 3140023 - RNA, 19 nt, Mycobacterium bovis subsp bovis AF2122/97
ccgcccuugcggcgugaug

SEQ ID NO: 3140024 - RNA, 14 nt, Mycobacterium bovis subsp bovis AF2122/97
ccgccgaaaaccuc

SEQ ID NO: 3140025 - RNA, 22 nt, Mycobacterium bovis subsp bovis AF2122/97
ccgccgaaaaccucgaaaccgu

SEQ ID NO: 3140026 - RNA, 18 nt, Mycobacterium bovis subsp bovis AF2122/97
ccgccgaaacucaccagc

SEQ ID NO: 3140027 - RNA, 21 nt, Mycobacterium bovis subsp bovis AF2122/97
ccgccgaaacucaccagcacc

SEQ ID NO: 3140028 - RNA, 16 nt, Mycobacterium bovis subsp bovis AF2122/97
ccgccgaacagcugga

SEQ ID NO: 3140029 - RNA, 20 nt, Mycobacterium bovis subsp bovis AF2122/97
ccgccgaacagcuggacggc

SEQ ID NO: 3140030 - RNA, 16 nt, Mycobacterium bovis subsp bovis AF2122/97
ccgccgaacagugucg

SEQ ID NO: 3140031 - RNA, 15 nt, Mycobacterium bovis subsp bovis AF2122/97
ccgccgaacggcaau

SEQ ID NO: 3140032 - RNA, 23 nt, Mycobacterium bovis subsp bovis AF2122/97
ccgccgaacgugaacucacggcg

SEQ ID NO: 3140033 - RNA, 14 nt, Mycobacterium bovis subsp bovis AF2122/97
ccgccgaagccgac

SEQ ID NO: 3140034 - RNA, 18 nt, Mycobacterium bovis subsp bovis AF2122/97
ccgccgaagccgcgcauc

SEQ ID NO: 3140035 - RNA, 19 nt, Mycobacterium bovis subsp bovis AF2122/97
ccgccgaagccgcgcaucu

SEQ ID NO: 3140036 - RNA, 22 nt, Mycobacterium bovis subsp bovis AF2122/97
ccgccgaagcgaugccgugcug

SEQ ID NO: 3140037 - RNA, 22 nt, Mycobacterium bovis subsp bovis AF2122/97
ccgccgaaggcgggggagccca

SEQ ID NO: 3140038 - RNA, 21 nt, Mycobacterium bovis subsp bovis AF2122/97
ccgccgaauccgacgucgacg

SEQ ID NO: 3140039 - RNA, 13 nt, Mycobacterium bovis subsp bovis AF2122/97
ccgccgacaaccc

SEQ ID NO: 3140040 - RNA, 16 nt, Mycobacterium bovis subsp bovis AF2122/97
ccgccgacaaccccgc

SEQ ID NO: 3140041 - RNA, 18 nt, Mycobacterium bovis subsp bovis AF2122/97
ccgccgacaaucaccaac

SEQ ID NO: 3140042 - RNA, 16 nt, Mycobacterium bovis subsp bovis AF2122/97
ccgccgacaccaccgg

SEQ ID NO: 3140043 - RNA, 19 nt, Mycobacterium bovis subsp bovis AF2122/97
ccgccgacaccaccggcgc

SEQ ID NO: 3140044 - RNA, 15 nt, Mycobacterium bovis subsp bovis AF2122/97
ccgccgacaggccgg

SEQ ID NO: 3140045 - RNA, 21 nt, Mycobacterium bovis subsp bovis AF2122/97
ccgccgacaggccggccacca

SEQ ID NO: 3140046 - RNA, 13 nt, Mycobacterium bovis subsp bovis AF2122/97
ccgccgaccgaca

SEQ ID NO: 3140047 - RNA, 14 nt, Mycobacterium bovis subsp bovis AF2122/97
ccgccgcgaccacg

SEQ ID NO: 3140048 - RNA, 17 nt, Mycobacterium bovis subsp bovis AF2122/97
ccgccgcgaccacgcac

SEQ ID NO: 3140049 - RNA, 20 nt, Mycobacterium bovis subsp bovis AF2122/97
ccgccgcgaccgccucgccg

SEQ ID NO: 3140050 - RNA, 21 nt, Mycobacterium bovis subsp bovis AF2122/97
ccgccgcgacgcacugccccg

SEQ ID NO: 3140051 - RNA, 23 nt, Mycobacterium bovis subsp bovis AF2122/97
ccgccgcgacgcacugccccgca

SEQ ID NO: 3140052 - RNA, 14 nt, Mycobacterium bovis subsp bovis AF2122/97
ccgccgcgagcaga

SEQ ID NO: 3140053 - RNA, 15 nt, Mycobacterium bovis subsp bovis AF2122/97
ccgccgcgagcagaa

SEQ ID NO: 3140054 - RNA, 20 nt, Mycobacterium bovis subsp bovis AF2122/97
ccgccgcgagcgccggccgc

SEQ ID NO: 3140055 - RNA, 20 nt, Mycobacterium bovis subsp bovis AF2122/97
ccgccgcgaugacggugccg

SEQ ID NO: 3140056 - RNA, 23 nt, Mycobacterium bovis subsp bovis AF2122/97
ccgccgcgaugacggugccgacc

SEQ ID NO: 3140057 - RNA, 23 nt, Mycobacterium bovis subsp bovis AF2122/97
ccgccgcgaugccacccaacagc

SEQ ID NO: 3140058 - RNA, 12 nt, Mycobacterium bovis subsp bovis AF2122/97
ccgccgcgcagc

SEQ ID NO: 3140059 - RNA, 14 nt, Mycobacterium bovis subsp bovis AF2122/97
ccgccgcgcagccg

SEQ ID NO: 3140060 - RNA, 15 nt, Mycobacterium bovis subsp bovis AF2122/97
ccgccgcgcagccgc

SEQ ID NO: 3140061 - RNA, 15 nt, Mycobacterium bovis subsp bovis AF2122/97
ccgccgcgcauccgc

SEQ ID NO: 3140062 - RNA, 13 nt, Mycobacterium bovis subsp bovis AF2122/97
ccgccgcgcccgg

SEQ ID NO: 3140063 - RNA, 14 nt, Mycobacterium bovis subsp bovis AF2122/97
ccgccgcgcccggc

SEQ ID NO: 3140064 - RNA, 16 nt, Mycobacterium bovis subsp bovis AF2122/97
ccgccgcgcccggcgc

SEQ ID NO: 3140065 - RNA, 12 nt, Mycobacterium bovis subsp bovis AF2122/97
ccgccgcgccgg

SEQ ID NO: 3140066 - RNA, 13 nt, Mycobacterium bovis subsp bovis AF2122/97
ccgccgcgccggc

SEQ ID NO: 3140067 - RNA, 15 nt, Mycobacterium bovis subsp bovis AF2122/97
ccgccgcgccggcac

SEQ ID NO: 3140068 - RNA, 16 nt, Mycobacterium bovis subsp bovis AF2122/97
ccgccgcgccggcacg

SEQ ID NO: 3140069 - RNA, 20 nt, Mycobacterium bovis subsp bovis AF2122/97
ccgccgcgccggcacgggcg

SEQ ID NO: 3140070 - RNA, 14 nt, Mycobacterium bovis subsp bovis AF2122/97
ccgccgcgcgacag

SEQ ID NO: 3140071 - RNA, 13 nt, Mycobacterium bovis subsp bovis AF2122/97
ccgccgcgcguuc

SEQ ID NO: 3140072 - RNA, 24 nt, Mycobacterium bovis subsp bovis AF2122/97
ccgccgcgcguucggcgcugaucg

SEQ ID NO: 3140073 - RNA, 14 nt, Mycobacterium bovis subsp bovis AF2122/97
ccgccgcggcaggg

SEQ ID NO: 3140074 - RNA, 13 nt, Mycobacterium bovis subsp bovis AF2122/97
ccgccgcggccac

SEQ ID NO: 3140075 - RNA, 19 nt, Mycobacterium bovis subsp bovis AF2122/97
ccgccgcggccacaaccuc

SEQ ID NO: 3140076 - RNA, 14 nt, Mycobacterium bovis subsp bovis AF2122/97
ccgccgcggccacc

SEQ ID NO: 3140077 - RNA, 16 nt, Mycobacterium bovis subsp bovis AF2122/97
ccgccgcggccaccac

SEQ ID NO: 3140078 - RNA, 18 nt, Mycobacterium bovis subsp bovis AF2122/97
ccgccgcggccaccaccg

SEQ ID NO: 3140079 - RNA, 12 nt, Mycobacterium bovis subsp bovis AF2122/97
ccgccgcggccg

SEQ ID NO: 3140080 - RNA, 14 nt, Mycobacterium bovis subsp bovis AF2122/97
ccgccgcggccgcc

SEQ ID NO: 3140081 - RNA, 15 nt, Mycobacterium bovis subsp bovis AF2122/97
ccgccgcggccgccg

SEQ ID NO: 3140082 - RNA, 19 nt, Mycobacterium bovis subsp bovis AF2122/97
ccgccgcggccgccguccc

SEQ ID NO: 3140083 - RNA, 17 nt, Mycobacterium bovis subsp bovis AF2122/97
ccgccgcggccggcgcu

SEQ ID NO: 3140084 - RNA, 12 nt, Mycobacterium bovis subsp bovis AF2122/97
ccgccgcggcgc

SEQ ID NO: 3140085 - RNA, 20 nt, Mycobacterium bovis subsp bovis AF2122/97
ccgccgcgggacaccaccgc

SEQ ID NO: 3140086 - RNA, 13 nt, Mycobacterium bovis subsp bovis AF2122/97
ccgccgcgggcgc

SEQ ID NO: 3140087 - RNA, 17 nt, Mycobacterium bovis subsp bovis AF2122/97
ccgccgcgggcuccccg

SEQ ID NO: 3140088 - RNA, 14 nt, Mycobacterium bovis subsp bovis AF2122/97
ccgccgcgggucgc

SEQ ID NO: 3140089 - RNA, 19 nt, Mycobacterium bovis subsp bovis AF2122/97
ccgccgcgggucgcgcgaa

SEQ ID NO: 3140090 - RNA, 24 nt, Mycobacterium bovis subsp bovis AF2122/97
ccgccgcgucauucaccgcguuga

SEQ ID NO: 3140091 - RNA, 14 nt, Mycobacterium bovis subsp bovis AF2122/97
ccgccgcuacccca

SEQ ID NO: 3140092 - RNA, 18 nt, Mycobacterium bovis subsp bovis AF2122/97
ccgccgcuaccccagccg

SEQ ID NO: 3140093 - RNA, 16 nt, Mycobacterium bovis subsp bovis AF2122/97
ccgccgcuaccgaaca

SEQ ID NO: 3140094 - RNA, 17 nt, Mycobacterium bovis subsp bovis AF2122/97
ccgccgcuaccgcccgc

SEQ ID NO: 3140095 - RNA, 15 nt, Mycobacterium bovis subsp bovis AF2122/97
ccgccgcuaccgccg

SEQ ID NO: 3140096 - RNA, 18 nt, Mycobacterium bovis subsp bovis AF2122/97
ccgccgcuccaggucgac

SEQ ID NO: 3140097 - RNA, 17 nt, Mycobacterium bovis subsp bovis AF2122/97
ccgccgcugccaugcgg

SEQ ID NO: 3140098 - RNA, 14 nt, Mycobacterium bovis subsp bovis AF2122/97
ccgccgcugccgcc

SEQ ID NO: 3140099 - RNA, 15 nt, Mycobacterium bovis subsp bovis AF2122/97
ccgccgcugccgccc

SEQ ID NO: 3140100 - RNA, 21 nt, Mycobacterium bovis subsp bovis AF2122/97
ccgccgcugccgccgagcugg

SEQ ID NO: 3140101 - RNA, 21 nt, Mycobacterium bovis subsp bovis AF2122/97
ccgccgcugccgccggugccg

SEQ ID NO: 3140102 - RNA, 13 nt, Mycobacterium bovis subsp bovis AF2122/97
ccgccgcugccgg

SEQ ID NO: 3140103 - RNA, 22 nt, Mycobacterium bovis subsp bovis AF2122/97
ccgccgcugccgguagcacagc

SEQ ID NO: 3140104 - RNA, 15 nt, Mycobacterium bovis subsp bovis AF2122/97
ccgccgcugccggug

SEQ ID NO: 3140105 - RNA, 13 nt, Mycobacterium bovis subsp bovis AF2122/97
ccgccgcuggucu

SEQ ID NO: 3140106 - RNA, 21 nt, Mycobacterium bovis subsp bovis AF2122/97
ccgccgcuggucuuucacgua

SEQ ID NO: 3140107 - RNA, 15 nt, Mycobacterium bovis subsp bovis AF2122/97
ccgccggaacugcgc

SEQ ID NO: 3140108 - RNA, 15 nt, Mycobacterium bovis subsp bovis AF2122/97
ccgccggaaucgaga

SEQ ID NO: 3140109 - RNA, 15 nt, Mycobacterium bovis subsp bovis AF2122/97
ccgccggacccgccg

SEQ ID NO: 3140110 - RNA, 16 nt, Mycobacterium bovis subsp bovis AF2122/97
ccgccggacccgccgg

SEQ ID NO: 3140111 - RNA, 22 nt, Mycobacterium bovis subsp bovis AF2122/97
ccgccggacccgucgagcagca

SEQ ID NO: 3140112 - RNA, 14 nt, Mycobacterium bovis subsp bovis AF2122/97
ccgccggaguuggu

SEQ ID NO: 3140113 - RNA, 20 nt, Mycobacterium bovis subsp bovis AF2122/97
ccgccggaucaggaucgaca

SEQ ID NO: 3140114 - RNA, 20 nt, Mycobacterium bovis subsp bovis AF2122/97
ccgccggaucgccacggugg

SEQ ID NO: 3140115 - RNA, 21 nt, Mycobacterium bovis subsp bovis AF2122/97
ccgccggauucgcccgggcgu

SEQ ID NO: 3140116 - RNA, 12 nt, Mycobacterium bovis subsp bovis AF2122/97
ccgccggcaacc

SEQ ID NO: 3140117 - RNA, 13 nt, Mycobacterium bovis subsp bovis AF2122/97
ccgccggcaacgc

SEQ ID NO: 3140118 - RNA, 21 nt, Mycobacterium bovis subsp bovis AF2122/97
ccgccggcaauaccgccagcg

SEQ ID NO: 3140119 - RNA, 14 nt, Mycobacterium bovis subsp bovis AF2122/97
ccgccggcacccgc

SEQ ID NO: 3140120 - RNA, 16 nt, Mycobacterium bovis subsp bovis AF2122/97
ccgccggcacccgccg

SEQ ID NO: 3140121 - RNA, 19 nt, Mycobacterium bovis subsp bovis AF2122/97
ccgccggcacccgccgugc

SEQ ID NO: 3140122 - RNA, 23 nt, Mycobacterium bovis subsp bovis AF2122/97
ccgccggcaccgccagugcccgc

SEQ ID NO: 3140123 - RNA, 18 nt, Mycobacterium bovis subsp bovis AF2122/97
ccgccggcaccgccgccc

SEQ ID NO: 3140124 - RNA, 16 nt, Mycobacterium bovis subsp bovis AF2122/97
ccgccggcaccgccgg

SEQ ID NO: 3140125 - RNA, 14 nt, Mycobacterium bovis subsp bovis AF2122/97
ccgccggcaccggg

SEQ ID NO: 3140126 - RNA, 16 nt, Mycobacterium bovis subsp bovis AF2122/97
ccgccggcagcaucgg

SEQ ID NO: 3140127 - RNA, 12 nt, Mycobacterium bovis subsp bovis AF2122/97
ccgccggccagc

SEQ ID NO: 3140128 - RNA, 17 nt, Mycobacterium bovis subsp bovis AF2122/97
ccgccggccagcgucgc

SEQ ID NO: 3140129 - RNA, 12 nt, Mycobacterium bovis subsp bovis AF2122/97
ccgccggccagu

SEQ ID NO: 3140130 - RNA, 15 nt, Mycobacterium bovis subsp bovis AF2122/97
ccgccggccccgcca

SEQ ID NO: 3140131 - RNA, 15 nt, Mycobacterium bovis subsp bovis AF2122/97
ccgccggccccgccg

SEQ ID NO: 3140132 - RNA, 22 nt, Mycobacterium bovis subsp bovis AF2122/97
ccgccggccccgccggcgccgc

SEQ ID NO: 3140133 - RNA, 20 nt, Mycobacterium bovis subsp bovis AF2122/97
ccgccggccccgccgucacc

SEQ ID NO: 3140134 - RNA, 21 nt, Mycobacterium bovis subsp bovis AF2122/97
ccgccgguguuagccccgaag

SEQ ID NO: 3140135 - RNA, 20 nt, Mycobacterium bovis subsp bovis AF2122/97
ccgccgguguugccguuacc

SEQ ID NO: 3140136 - RNA, 17 nt, Mycobacterium bovis subsp bovis AF2122/97
ccgccgguuccgccggc

SEQ ID NO: 3140137 - RNA, 19 nt, Mycobacterium bovis subsp bovis AF2122/97
ccgccgguuccgccggccc

SEQ ID NO: 3140138 - RNA, 20 nt, Mycobacterium bovis subsp bovis AF2122/97
ccgccgguuccgccggcccc

SEQ ID NO: 3140139 - RNA, 16 nt, Mycobacterium bovis subsp bovis AF2122/97
ccgccguagaccagcc

SEQ ID NO: 3140140 - RNA, 17 nt, Mycobacterium bovis subsp bovis AF2122/97
ccgccguagaccagccg

SEQ ID NO: 3140141 - RNA, 18 nt, Mycobacterium bovis subsp bovis AF2122/97
ccgccguagaccagccgu

SEQ ID NO: 3140142 - RNA, 20 nt, Mycobacterium bovis subsp bovis AF2122/97
ccgccgucacccccgauagc

SEQ ID NO: 3140143 - RNA, 20 nt, Mycobacterium bovis subsp bovis AF2122/97
ccgccgucaccgcccuugcc

SEQ ID NO: 3140144 - RNA, 15 nt, Mycobacterium bovis subsp bovis AF2122/97
ccgccgucaccgccg

SEQ ID NO: 3140145 - RNA, 19 nt, Mycobacterium bovis subsp bovis AF2122/97
ccgccgucaccgccguugc

SEQ ID NO: 3140146 - RNA, 20 nt, Mycobacterium bovis subsp bovis AF2122/97
ccgccgucaccgccguugcc

SEQ ID NO: 3140147 - RNA, 22 nt, Mycobacterium bovis subsp bovis AF2122/97
ccgccgucaccgccguugccga

SEQ ID NO: 3140148 - RNA, 19 nt, Mycobacterium bovis subsp bovis AF2122/97
ccgccguccccgccgacgc

SEQ ID NO: 3140149 - RNA, 20 nt, Mycobacterium bovis subsp bovis AF2122/97
ccgccguccccgccgucgcc

SEQ ID NO: 3140150 - RNA, 15 nt, Mycobacterium bovis subsp bovis AF2122/97
ccgccgucgaccacg

SEQ ID NO: 3140151 - RNA, 15 nt, Mycobacterium bovis subsp bovis AF2122/97
ccgccgucgccacca

SEQ ID NO: 3140152 - RNA, 23 nt, Mycobacterium bovis subsp bovis AF2122/97
ccgccgucgccaccaucguugcc

SEQ ID NO: 3140153 - RNA, 16 nt, Mycobacterium bovis subsp bovis AF2122/97
ccgccgucgccaccgg

SEQ ID NO: 3140154 - RNA, 19 nt, Mycobacterium bovis subsp bovis AF2122/97
ccgccgucgccaccgguac

SEQ ID NO: 3140155 - RNA, 13 nt, Mycobacterium bovis subsp bovis AF2122/97
ccgccgucgccga

SEQ ID NO: 3140156 - RNA, 19 nt, Mycobacterium bovis subsp bovis AF2122/97
ccgccgucgccgccgcuac

SEQ ID NO: 3140157 - RNA, 22 nt, Mycobacterium bovis subsp bovis AF2122/97
ccgccgucgccgccggcgccgc

SEQ ID NO: 3140158 - RNA, 13 nt, Mycobacterium bovis subsp bovis AF2122/97
ccgccgucgccgg

SEQ ID NO: 3140159 - RNA, 17 nt, Mycobacterium bovis subsp bovis AF2122/97
ccgccgucgccggugcc

SEQ ID NO: 3140160 - RNA, 21 nt, Mycobacterium bovis subsp bovis AF2122/97
ccgccgucggguugcgacgaa

SEQ ID NO: 3140161 - RNA, 22 nt, Mycobacterium bovis subsp bovis AF2122/97
ccgccgucggguugcgacgaac

SEQ ID NO: 3140162 - RNA, 22 nt, Mycobacterium bovis subsp bovis AF2122/97
ccgccgucuuggcccgguccgc

SEQ ID NO: 3140163 - RNA, 16 nt, Mycobacterium bovis subsp bovis AF2122/97
ccgccgugcccccggc

SEQ ID NO: 3140164 - RNA, 23 nt, Mycobacterium bovis subsp bovis AF2122/97
ccgccgugccgcggcgacgguga

SEQ ID NO: 3140165 - RNA, 22 nt, Mycobacterium bovis subsp bovis AF2122/97
ccgccgugcggguucacugccg

SEQ ID NO: 3140166 - RNA, 23 nt, Mycobacterium bovis subsp bovis AF2122/97
ccgccgugguugcacguucggcg

SEQ ID NO: 3140167 - RNA, 18 nt, Mycobacterium bovis subsp bovis AF2122/97
ccgccguuaccgacgccg

SEQ ID NO: 3140168 - RNA, 20 nt, Mycobacterium bovis subsp bovis AF2122/97
ccgccguuaccgacgccggu

SEQ ID NO: 3140169 - RNA, 22 nt, Mycobacterium bovis subsp bovis AF2122/97
ccgccguuaccgacgccggugg

SEQ ID NO: 3140170 - RNA, 21 nt, Mycobacterium bovis subsp bovis AF2122/97
ccgccguuaccgagcccgaag

SEQ ID NO: 3140171 - RNA, 15 nt, Mycobacterium bovis subsp bovis AF2122/97
ccgccguuaccgccg

SEQ ID NO: 3140172 - RNA, 22 nt, Mycobacterium bovis subsp bovis AF2122/97
ccgccguuaccgccgcugccga

SEQ ID NO: 3140173 - RNA, 20 nt, Mycobacterium bovis subsp bovis AF2122/97
ccgccguuaccgccguuacc

SEQ ID NO: 3140174 - RNA, 20 nt, Mycobacterium bovis subsp bovis AF2122/97
ccgccguuaccgccguugcc

SEQ ID NO: 3140175 - RNA, 22 nt, Mycobacterium bovis subsp bovis AF2122/97
ccgccguuaccgccguugccga

SEQ ID NO: 3140176 - RNA, 24 nt, Mycobacterium bovis subsp bovis AF2122/97
ccgccguucccaccaccaccgccg

SEQ ID NO: 3140177 - RNA, 13 nt, Mycobacterium bovis subsp bovis AF2122/97
ccgccguucccgc

SEQ ID NO: 3140178 - RNA, 15 nt, Mycobacterium bovis subsp bovis AF2122/97
ccgccguucccgccg

SEQ ID NO: 3140179 - RNA, 21 nt, Mycobacterium bovis subsp bovis AF2122/97
ccgccguucgggaugcaagga

SEQ ID NO: 3140180 - RNA, 15 nt, Mycobacterium bovis subsp bovis AF2122/97
ccgccguugacgccg

SEQ ID NO: 3140181 - RNA, 15 nt, Mycobacterium bovis subsp bovis AF2122/97
ccgccguugccaccg

SEQ ID NO: 3140182 - RNA, 23 nt, Mycobacterium bovis subsp bovis AF2122/97
ccgccguugccauugccucccgc

SEQ ID NO: 3140183 - RNA, 15 nt, Mycobacterium bovis subsp bovis AF2122/97
ccgccguugccgauc

SEQ ID NO: 3140184 - RNA, 16 nt, Mycobacterium bovis subsp bovis AF2122/97
ccgccguugccgauca

SEQ ID NO: 3140185 - RNA, 18 nt, Mycobacterium bovis subsp bovis AF2122/97
ccgccguugccgaucaac

SEQ ID NO: 3140186 - RNA, 17 nt, Mycobacterium bovis subsp bovis AF2122/97
ccgccguugccgaucac

SEQ ID NO: 3140187 - RNA, 21 nt, Mycobacterium bovis subsp bovis AF2122/97
ccgccguugccgaucagcccg

SEQ ID NO: 3140188 - RNA, 22 nt, Mycobacterium bovis subsp bovis AF2122/97
ccgccguugccgaucagcccgg

SEQ ID NO: 3140189 - RNA, 17 nt, Mycobacterium bovis subsp bovis AF2122/97
ccgccguugccgauccc

SEQ ID NO: 3140190 - RNA, 18 nt, Mycobacterium bovis subsp bovis AF2122/97
ccgccguugccgaucgcu

SEQ ID NO: 3140191 - RNA, 13 nt, Mycobacterium bovis subsp bovis AF2122/97
ccgccguugccgc

SEQ ID NO: 3140192 - RNA, 15 nt, Mycobacterium bovis subsp bovis AF2122/97
ccgccguugccgcca

SEQ ID NO: 3140193 - RNA, 15 nt, Mycobacterium bovis subsp bovis AF2122/97
ccgccguugccgccg

SEQ ID NO: 3140194 - RNA, 18 nt, Mycobacterium bovis subsp bovis AF2122/97
ccgccguugccgccgacg

SEQ ID NO: 3140195 - RNA, 19 nt, Mycobacterium bovis subsp bovis AF2122/97
ccgccguugccgccgacgc

SEQ ID NO: 3140196 - RNA, 20 nt, Mycobacterium bovis subsp bovis AF2122/97
ccgccguugccgccgacgcc

SEQ ID NO: 3140197 - RNA, 22 nt, Mycobacterium bovis subsp bovis AF2122/97
ccgccguugccgccgacgccgc

SEQ ID NO: 3140198 - RNA, 16 nt, Mycobacterium bovis subsp bovis AF2122/97
ccgccguugccgccgc

SEQ ID NO: 3140199 - RNA, 21 nt, Mycobacterium bovis subsp bovis AF2122/97
ccgccguugccgccgccuccg

SEQ ID NO: 3140200 - RNA, 17 nt, Mycobacterium bovis subsp bovis AF2122/97
ccgccguugccgccggc

SEQ ID NO: 3140201 - RNA, 19 nt, Mycobacterium bovis subsp bovis AF2122/97
ccgccguugccgccggcgc

SEQ ID NO: 3140202 - RNA, 17 nt, Mycobacterium bovis subsp bovis AF2122/97
ccgccguugccgccguc

SEQ ID NO: 3140203 - RNA, 18 nt, Mycobacterium bovis subsp bovis AF2122/97
ccgccguugccgccguca

SEQ ID NO: 3140204 - RNA, 20 nt, Mycobacterium bovis subsp bovis AF2122/97
ccgccguugccgccgucacc

SEQ ID NO: 3140205 - RNA, 20 nt, Mycobacterium bovis subsp bovis AF2122/97
ccgccguugccgccguuacc

SEQ ID NO: 3140206 - RNA, 22 nt, Mycobacterium bovis subsp bovis AF2122/97
ccgccguugccgccguugccga

SEQ ID NO: 3140207 - RNA, 15 nt, Mycobacterium bovis subsp bovis AF2122/97
ccgccguugccgccu

SEQ ID NO: 3140208 - RNA, 14 nt, Mycobacterium bovis subsp bovis AF2122/97
ccgccguugccggc

SEQ ID NO: 3140209 - RNA, 15 nt, Mycobacterium bovis subsp bovis AF2122/97
ccgccguugccguac

SEQ ID NO: 3140210 - RNA, 22 nt, Mycobacterium bovis subsp bovis AF2122/97
ccgccguugccguacagcccgg

SEQ ID NO: 3140211 - RNA, 19 nt, Mycobacterium bovis subsp bovis AF2122/97
ccgccguugccgucgucgc

SEQ ID NO: 3140212 - RNA, 21 nt, Mycobacterium bovis subsp bovis AF2122/97
ccgccguugccgucgucgccg

SEQ ID NO: 3140213 - RNA, 16 nt, Mycobacterium bovis subsp bovis AF2122/97
ccgccguugccguugg

SEQ ID NO: 3140214 - RNA, 19 nt, Mycobacterium bovis subsp bovis AF2122/97
ccgccguuggcucgagccg

SEQ ID NO: 3140215 - RNA, 20 nt, Mycobacterium bovis subsp bovis AF2122/97
ccgccguuggcucgagccgc

SEQ ID NO: 3140216 - RNA, 23 nt, Mycobacterium bovis subsp bovis AF2122/97
ccgccguuggcucgagccgcccg

SEQ ID NO: 3140217 - RNA, 15 nt, Mycobacterium bovis subsp bovis AF2122/97
ccgccguugggccgc

SEQ ID NO: 3140218 - RNA, 16 nt, Mycobacterium bovis subsp bovis AF2122/97
ccgccguugggccgcg

SEQ ID NO: 3140219 - RNA, 18 nt, Mycobacterium bovis subsp bovis AF2122/97
ccgccuuggcccccgggu

SEQ ID NO: 3140220 - RNA, 21 nt, Mycobacterium bovis subsp bovis AF2122/97
ccgccuuggcuucgacgcuuc

SEQ ID NO: 3140221 - RNA, 16 nt, Mycobacterium bovis subsp bovis AF2122/97
ccgccuuggucaccuu

SEQ ID NO: 3140222 - RNA, 23 nt, Mycobacterium bovis subsp bovis AF2122/97
ccgccuuggucgcgucggcugcc

SEQ ID NO: 3140223 - RNA, 14 nt, Mycobacterium bovis subsp bovis AF2122/97
ccgccuuugccccc

SEQ ID NO: 3140224 - RNA, 20 nt, Mycobacterium bovis subsp bovis AF2122/97
ccgccuuugcccgccgcguc

SEQ ID NO: 3140225 - RNA, 15 nt, Mycobacterium bovis subsp bovis AF2122/97
ccgccuuugccgccg

SEQ ID NO: 3140226 - RNA, 18 nt, Mycobacterium bovis subsp bovis AF2122/97
ccgcgaaauagcgagcgu

SEQ ID NO: 3140227 - RNA, 20 nt, Mycobacterium bovis subsp bovis AF2122/97
ccgcgaaauuacuucggcca

SEQ ID NO: 3140228 - RNA, 17 nt, Mycobacterium bovis subsp bovis AF2122/97
ccgcgaacaaccugccg

SEQ ID NO: 3140229 - RNA, 13 nt, Mycobacterium bovis subsp bovis AF2122/97
ccgcgaacauggu

SEQ ID NO: 3140230 - RNA, 16 nt, Mycobacterium bovis subsp bovis AF2122/97
ccgcgaaccgcggauc

SEQ ID NO: 3140231 - RNA, 16 nt, Mycobacterium bovis subsp bovis AF2122/97
ccgcgaaccucacagc

SEQ ID NO: 3140232 - RNA, 18 nt, Mycobacterium bovis subsp bovis AF2122/97
ccgcgaacgaucccgccg

SEQ ID NO: 3140233 - RNA, 20 nt, Mycobacterium bovis subsp bovis AF2122/97
ccgcgaacgauuucggccca

SEQ ID NO: 3140234 - RNA, 21 nt, Mycobacterium bovis subsp bovis AF2122/97
ccgcgaacgauuucggcccac

SEQ ID NO: 3140235 - RNA, 16 nt, Mycobacterium bovis subsp bovis AF2122/97
ccgcgaacgcgacagc

SEQ ID NO: 3140236 - RNA, 18 nt, Mycobacterium bovis subsp bovis AF2122/97
ccgcgaacgcgacagcca

SEQ ID NO: 3140237 - RNA, 21 nt, Mycobacterium bovis subsp bovis AF2122/97
ccgcgaacgggucgggacgcu

SEQ ID NO: 3140238 - RNA, 21 nt, Mycobacterium bovis subsp bovis AF2122/97
ccgcgaagcgcucggcagccg

SEQ ID NO: 3140239 - RNA, 20 nt, Mycobacterium bovis subsp bovis AF2122/97
ccgcgaaggggugcccggcg

SEQ ID NO: 3140240 - RNA, 19 nt, Mycobacterium bovis subsp bovis AF2122/97
ccgcgaaguugcgggugau

SEQ ID NO: 3140241 - RNA, 18 nt, Mycobacterium bovis subsp bovis AF2122/97
ccgcgaaucaacaggacc

SEQ ID NO: 3140242 - RNA, 21 nt, Mycobacterium bovis subsp bovis AF2122/97
ccgcgaaucaacaggaccggg

SEQ ID NO: 3140243 - RNA, 21 nt, Mycobacterium bovis subsp bovis AF2122/97
ccgcgaaugaagcccucgucg

SEQ ID NO: 3140244 - RNA, 17 nt, Mycobacterium bovis subsp bovis AF2122/97
ccgcgaaugcugugccg

SEQ ID NO: 3140245 - RNA, 20 nt, Mycobacterium bovis subsp bovis AF2122/97
ccgcgaaugucgccgccugg

SEQ ID NO: 3140246 - RNA, 16 nt, Mycobacterium bovis subsp bovis AF2122/97
ccgcgaauucccagga

SEQ ID NO: 3140247 - RNA, 20 nt, Mycobacterium bovis subsp bovis AF2122/97
ccgcgacaacaacucuucgg

SEQ ID NO: 3140248 - RNA, 18 nt, Mycobacterium bovis subsp bovis AF2122/97
ccgcgacauccgcggcau

SEQ ID NO: 3140249 - RNA, 21 nt, Mycobacterium bovis subsp bovis AF2122/97
ccgcgaccacgcaccgccccg

SEQ ID NO: 3140250 - RNA, 17 nt, Mycobacterium bovis subsp bovis AF2122/97
ccgcgaccagaggcgug

SEQ ID NO: 3140251 - RNA, 15 nt, Mycobacterium bovis subsp bovis AF2122/97
ccgcgaccagcgccg

SEQ ID NO: 3140252 - RNA, 16 nt, Mycobacterium bovis subsp bovis AF2122/97
ccgcgaccagcgccgc

SEQ ID NO: 3140253 - RNA, 18 nt, Mycobacterium bovis subsp bovis AF2122/97
ccgcgaccagcgccgcac

SEQ ID NO: 3140254 - RNA, 21 nt, Mycobacterium bovis subsp bovis AF2122/97
ccgcgaccagcgccgcacccg

SEQ ID NO: 3140255 - RNA, 14 nt, Mycobacterium bovis subsp bovis AF2122/97
ccgcgaccagcugg

SEQ ID NO: 3140256 - RNA, 15 nt, Mycobacterium bovis subsp bovis AF2122/97
ccgcgaccagcuggc

SEQ ID NO: 3140257 - RNA, 23 nt, Mycobacterium bovis subsp bovis AF2122/97
ccgcgaccaucgcgacggcaagc

SEQ ID NO: 3140258 - RNA, 16 nt, Mycobacterium bovis subsp bovis AF2122/97
ccgcgaccccugguag

SEQ ID NO: 3140259 - RNA, 21 nt, Mycobacterium bovis subsp bovis AF2122/97
ccgcgaccccugguagcaccc

SEQ ID NO: 3140260 - RNA, 14 nt, Mycobacterium bovis subsp bovis AF2122/97
ccgcgaccgccucg

SEQ ID NO: 3140261 - RNA, 12 nt, Mycobacterium bovis subsp bovis AF2122/97
ccgcgaccgcga

SEQ ID NO: 3140262 - RNA, 20 nt, Mycobacterium bovis subsp bovis AF2122/97
ccgcgaccgcgcacggcugg

SEQ ID NO: 3140263 - RNA, 22 nt, Mycobacterium bovis subsp bovis AF2122/97
ccgcgaccgcgcacggcuggcg

SEQ ID NO: 3140264 - RNA, 16 nt, Mycobacterium bovis subsp bovis AF2122/97
ccgcgaccggcguaac

SEQ ID NO: 3140265 - RNA, 19 nt, Mycobacterium bovis subsp bovis AF2122/97
ccgcgaccggcguaaccgg

SEQ ID NO: 3140266 - RNA, 14 nt, Mycobacterium bovis subsp bovis AF2122/97
ccgcgaccucgcgg

SEQ ID NO: 3140267 - RNA, 15 nt, Mycobacterium bovis subsp bovis AF2122/97
ccgcgaccucgcggc

SEQ ID NO: 3140268 - RNA, 16 nt, Mycobacterium bovis subsp bovis AF2122/97
ccgcgaccucgcggcg

SEQ ID NO: 3140269 - RNA, 15 nt, Mycobacterium bovis subsp bovis AF2122/97
ccgcgacgagcggcc

SEQ ID NO: 3140270 - RNA, 23 nt, Mycobacterium bovis subsp bovis AF2122/97
ccgcgacgaugccucggcggccu

SEQ ID NO: 3140271 - RNA, 15 nt, Mycobacterium bovis subsp bovis AF2122/97
ccgcgacgcggcguc

SEQ ID NO: 3140272 - RNA, 15 nt, Mycobacterium bovis subsp bovis AF2122/97
ccgcgacgcucgcug

SEQ ID NO: 3140273 - RNA, 19 nt, Mycobacterium bovis subsp bovis AF2122/97
ccgcgacgcucgcugcagc

SEQ ID NO: 3140274 - RNA, 17 nt, Mycobacterium bovis subsp bovis AF2122/97
ccgcgacggcacgauca

SEQ ID NO: 3140275 - RNA, 14 nt, Mycobacterium bovis subsp bovis AF2122/97
ccgcgacggcaggc

SEQ ID NO: 3140276 - RNA, 14 nt, Mycobacterium bovis subsp bovis AF2122/97
ccgcgacggccuug

SEQ ID NO: 3140277 - RNA, 21 nt, Mycobacterium bovis subsp bovis AF2122/97
ccgcgacggccuuggcgacgu

SEQ ID NO: 3140278 - RNA, 16 nt, Mycobacterium bovis subsp bovis AF2122/97
ccgcgacggcgccggc

SEQ ID NO: 3140279 - RNA, 20 nt, Mycobacterium bovis subsp bovis AF2122/97
ccgcgacggcgccggcaucg

SEQ ID NO: 3140280 - RNA, 12 nt, Mycobacterium bovis subsp bovis AF2122/97
ccgcgacggcgg

SEQ ID NO: 3140281 - RNA, 17 nt, Mycobacterium bovis subsp bovis AF2122/97
ccgcgacugcaccuggc

SEQ ID NO: 3140282 - RNA, 21 nt, Mycobacterium bovis subsp bovis AF2122/97
ccgcgacugcaccuggccgcc

SEQ ID NO: 3140283 - RNA, 20 nt, Mycobacterium bovis subsp bovis AF2122/97
ccgcgagacgcaugucgggc

SEQ ID NO: 3140284 - RNA, 16 nt, Mycobacterium bovis subsp bovis AF2122/97
ccgcgagauagcacca

SEQ ID NO: 3140285 - RNA, 15 nt, Mycobacterium bovis subsp bovis AF2122/97
ccgcgagaucgggcc

SEQ ID NO: 3140286 - RNA, 16 nt, Mycobacterium bovis subsp bovis AF2122/97
ccgcgagaucgggccg

SEQ ID NO: 3140287 - RNA, 20 nt, Mycobacterium bovis subsp bovis AF2122/97
ccgcgagaucgggccggccg

SEQ ID NO: 3140288 - RNA, 21 nt, Mycobacterium bovis subsp bovis AF2122/97
ccgcgagaucgggccggccgc

SEQ ID NO: 3140289 - RNA, 18 nt, Mycobacterium bovis subsp bovis AF2122/97
ccgcgagcagacgugggc

SEQ ID NO: 3140290 - RNA, 12 nt, Mycobacterium bovis subsp bovis AF2122/97
ccgcgagcagca

SEQ ID NO: 3140291 - RNA, 13 nt, Mycobacterium bovis subsp bovis AF2122/97
ccgcgagcagcac

SEQ ID NO: 3140292 - RNA, 15 nt, Mycobacterium bovis subsp bovis AF2122/97
ccgcgagcccggccu

SEQ ID NO: 3140293 - RNA, 19 nt, Mycobacterium bovis subsp bovis AF2122/97
ccgcgagcccggccucggc

SEQ ID NO: 3140294 - RNA, 16 nt, Mycobacterium bovis subsp bovis AF2122/97
ccgcgagcgccggccg

SEQ ID NO: 3140295 - RNA, 17 nt, Mycobacterium bovis subsp bovis AF2122/97
ccgcgagcgccggccgc

SEQ ID NO: 3140296 - RNA, 18 nt, Mycobacterium bovis subsp bovis AF2122/97
ccgcgagcgccggccgcg

SEQ ID NO: 3140297 - RNA, 23 nt, Mycobacterium bovis subsp bovis AF2122/97
ccgcgagcguaacguggcugcga

SEQ ID NO: 3140298 - RNA, 22 nt, Mycobacterium bovis subsp bovis AF2122/97
ccgcgagcuguaggucagcgcg

SEQ ID NO: 3140299 - RNA, 23 nt, Mycobacterium bovis subsp bovis AF2122/97
ccgcgagcuuggccagcagcagc

SEQ ID NO: 3140300 - RNA, 20 nt, Mycobacterium bovis subsp bovis AF2122/97
ccgcgaggcaagaacccgau

SEQ ID NO: 3140301 - RNA, 22 nt, Mycobacterium bovis subsp bovis AF2122/97
ccgcgaggcacuuaccgagccg

SEQ ID NO: 3140302 - RNA, 14 nt, Mycobacterium bovis subsp bovis AF2122/97
ccgcgagggcgcgu

SEQ ID NO: 3140303 - RNA, 19 nt, Mycobacterium bovis subsp bovis AF2122/97
ccgcgagguacccaucguc

SEQ ID NO: 3140304 - RNA, 23 nt, Mycobacterium bovis subsp bovis AF2122/97
ccgcgagguacccaucgucgagc

SEQ ID NO: 3140305 - RNA, 13 nt, Mycobacterium bovis subsp bovis AF2122/97
ccgcgccgacggc

SEQ ID NO: 3140306 - RNA, 14 nt, Mycobacterium bovis subsp bovis AF2122/97
ccgcgccgagcccg

SEQ ID NO: 3140307 - RNA, 21 nt, Mycobacterium bovis subsp bovis AF2122/97
ccgcgccgaucaccaccggca

SEQ ID NO: 3140308 - RNA, 19 nt, Mycobacterium bovis subsp bovis AF2122/97
ccgcgccgauuccaccgcc

SEQ ID NO: 3140309 - RNA, 12 nt, Mycobacterium bovis subsp bovis AF2122/97
ccgcgccgcacc

SEQ ID NO: 3140310 - RNA, 15 nt, Mycobacterium bovis subsp bovis AF2122/97
ccgcgccgccgccac

SEQ ID NO: 3140311 - RNA, 19 nt, Mycobacterium bovis subsp bovis AF2122/97
ccgcgccgccggacccacc

SEQ ID NO: 3140312 - RNA, 11 nt, Mycobacterium bovis subsp bovis AF2122/97
ccgcgccgccu

SEQ ID NO: 3140313 - RNA, 15 nt, Mycobacterium bovis subsp bovis AF2122/97
ccgcgccgcgcaucg

SEQ ID NO: 3140314 - RNA, 16 nt, Mycobacterium bovis subsp bovis AF2122/97
ccgcgccgcggcccgc

SEQ ID NO: 3140315 - RNA, 19 nt, Mycobacterium bovis subsp bovis AF2122/97
ccgcgccggacagcgcauc

SEQ ID NO: 3140316 - RNA, 13 nt, Mycobacterium bovis subsp bovis AF2122/97
ccgcgccggcccc

SEQ ID NO: 3140317 - RNA, 12 nt, Mycobacterium bovis subsp bovis AF2122/97
ccgcgccggccg

SEQ ID NO: 3140318 - RNA, 24 nt, Mycobacterium bovis subsp bovis AF2122/97
ccgcgccggccgcacgccggccag

SEQ ID NO: 3140319 - RNA, 16 nt, Mycobacterium bovis subsp bovis AF2122/97
ccgcgccggccgcugc

SEQ ID NO: 3140320 - RNA, 13 nt, Mycobacterium bovis subsp bovis AF2122/97
ccgcgccggcggc

SEQ ID NO: 3140321 - RNA, 14 nt, Mycobacterium bovis subsp bovis AF2122/97
ccgcgccggcggcc

SEQ ID NO: 3140322 - RNA, 16 nt, Mycobacterium bovis subsp bovis AF2122/97
ccgcgccggcggccac

SEQ ID NO: 3140323 - RNA, 16 nt, Mycobacterium bovis subsp bovis AF2122/97
ccgcgccggcgggcga

SEQ ID NO: 3140324 - RNA, 11 nt, Mycobacterium bovis subsp bovis AF2122/97
ccgcgccgggu

SEQ ID NO: 3140325 - RNA, 15 nt, Mycobacterium bovis subsp bovis AF2122/97
ccgcgccggguccgc

SEQ ID NO: 3140326 - RNA, 23 nt, Mycobacterium bovis subsp bovis AF2122/97
ccgcgccgucgucgagcaccacc

SEQ ID NO: 3140327 - RNA, 15 nt, Mycobacterium bovis subsp bovis AF2122/97
ccgcgccgucgucgc

SEQ ID NO: 3140328 - RNA, 19 nt, Mycobacterium bovis subsp bovis AF2122/97
ccgcgccgucgucgcgcag

SEQ ID NO: 3140329 - RNA, 12 nt, Mycobacterium bovis subsp bovis AF2122/97
ccgcgccguucc

SEQ ID NO: 3140330 - RNA, 13 nt, Mycobacterium bovis subsp bovis AF2122/97
ccgcgccuccguu

SEQ ID NO: 3140331 - RNA, 15 nt, Mycobacterium bovis subsp bovis AF2122/97
ccgcgccuccguugc

SEQ ID NO: 3140332 - RNA, 15 nt, Mycobacterium bovis subsp bovis AF2122/97
ccgcgccugccucac

SEQ ID NO: 3140333 - RNA, 17 nt, Mycobacterium bovis subsp bovis AF2122/97
ccgcgccugccucaccg

SEQ ID NO: 3140334 - RNA, 21 nt, Mycobacterium bovis subsp bovis AF2122/97
ccgcgccugccucaccgccgc

SEQ ID NO: 3140335 - RNA, 17 nt, Mycobacterium bovis subsp bovis AF2122/97
ccgcgccuuggcacccu

SEQ ID NO: 3140336 - RNA, 13 nt, Mycobacterium bovis subsp bovis AF2122/97
ccgcgcgaaccgc

SEQ ID NO: 3140337 - RNA, 16 nt, Mycobacterium bovis subsp bovis AF2122/97
ccgcgcgacaacccgg

SEQ ID NO: 3140338 - RNA, 17 nt, Mycobacterium bovis subsp bovis AF2122/97
ccgcgcgacaacccggc

SEQ ID NO: 3140339 - RNA, 21 nt, Mycobacterium bovis subsp bovis AF2122/97
ccgcgcgacgccguccucgcu

SEQ ID NO: 3140340 - RNA, 23 nt, Mycobacterium bovis subsp bovis AF2122/97
ccgcgcgagagccuccauggccu

SEQ ID NO: 3140341 - RNA, 13 nt, Mycobacterium bovis subsp bovis AF2122/97
ccgcgcgagccgc

SEQ ID NO: 3140342 - RNA, 15 nt, Mycobacterium bovis subsp bovis AF2122/97
ccgcgcgagccgcuc

SEQ ID NO: 3140343 - RNA, 14 nt, Mycobacterium bovis subsp bovis AF2122/97
ccgcgcgagccucg

SEQ ID NO: 3140344 - RNA, 12 nt, Mycobacterium bovis subsp bovis AF2122/97
ccgcgcgcacca

SEQ ID NO: 3140345 - RNA, 11 nt, Mycobacterium bovis subsp bovis AF2122/97
ccgcgcgcaga

SEQ ID NO: 3140346 - RNA, 19 nt, Mycobacterium bovis subsp bovis AF2122/97
ccgcgcgcagaugagcgcg

SEQ ID NO: 3140347 - RNA, 14 nt, Mycobacterium bovis subsp bovis AF2122/97
ccgcgcgcagggcg

SEQ ID NO: 3140348 - RNA, 15 nt, Mycobacterium bovis subsp bovis AF2122/97
ccgcgcgcaucgcgc

SEQ ID NO: 3140349 - RNA, 23 nt, Mycobacterium bovis subsp bovis AF2122/97
ccgcgcgccaucgccuccagccg

SEQ ID NO: 3140350 - RNA, 15 nt, Mycobacterium bovis subsp bovis AF2122/97
ccgcgcgccggcgac

SEQ ID NO: 3140351 - RNA, 15 nt, Mycobacterium bovis subsp bovis AF2122/97
ccgcgcgccggcggu

SEQ ID NO: 3140352 - RNA, 17 nt, Mycobacterium bovis subsp bovis AF2122/97
ccgcgcgcucgagcagg

SEQ ID NO: 3140353 - RNA, 17 nt, Mycobacterium bovis subsp bovis AF2122/97
ccgcgcgcucgcccagg

SEQ ID NO: 3140354 - RNA, 17 nt, Mycobacterium bovis subsp bovis AF2122/97
ccgcgcggagaccccgc

SEQ ID NO: 3140355 - RNA, 21 nt, Mycobacterium bovis subsp bovis AF2122/97
ccgcgcggagaccccgcgcgc

SEQ ID NO: 3140356 - RNA, 12 nt, Mycobacterium bovis subsp bovis AF2122/97
ccgcgcggcacu

SEQ ID NO: 3140357 - RNA, 13 nt, Mycobacterium bovis subsp bovis AF2122/97
ccgcgcggcaggu

SEQ ID NO: 3140358 - RNA, 11 nt, Mycobacterium bovis subsp bovis AF2122/97
ccgcgcggcga

SEQ ID NO: 3140359 - RNA, 12 nt, Mycobacterium bovis subsp bovis AF2122/97
ccgcgcggcgac

SEQ ID NO: 3140360 - RNA, 19 nt, Mycobacterium bovis subsp bovis AF2122/97
ccgcgcggcgacagcuugg

SEQ ID NO: 3140361 - RNA, 17 nt, Mycobacterium bovis subsp bovis AF2122/97
ccgcgcggcgagagccu

SEQ ID NO: 3140362 - RNA, 12 nt, Mycobacterium bovis subsp bovis AF2122/97
ccgcgcggcgca

SEQ ID NO: 3140363 - RNA, 13 nt, Mycobacterium bovis subsp bovis AF2122/97
ccgcgcggcgcag

SEQ ID NO: 3140364 - RNA, 15 nt, Mycobacterium bovis subsp bovis AF2122/97
ccgcgcggcggcgcc

SEQ ID NO: 3140365 - RNA, 16 nt, Mycobacterium bovis subsp bovis AF2122/97
ccgcgcggcggcgccg

SEQ ID NO: 3140366 - RNA, 20 nt, Mycobacterium bovis subsp bovis AF2122/97
ccgcgcggcggcgccggcgc

SEQ ID NO: 3140367 - RNA, 23 nt, Mycobacterium bovis subsp bovis AF2122/97
ccgcgcggcggugucacgaccca

SEQ ID NO: 3140368 - RNA, 14 nt, Mycobacterium bovis subsp bovis AF2122/97
ccgcgcggcgugcu

SEQ ID NO: 3140369 - RNA, 17 nt, Mycobacterium bovis subsp bovis AF2122/97
ccgcgcgggaaacguuc

SEQ ID NO: 3140370 - RNA, 20 nt, Mycobacterium bovis subsp bovis AF2122/97
ccgcgcgggaaacguuccag

SEQ ID NO: 3140371 - RNA, 14 nt, Mycobacterium bovis subsp bovis AF2122/97
ccgcgcgggccgcc

SEQ ID NO: 3140372 - RNA, 15 nt, Mycobacterium bovis subsp bovis AF2122/97
ccgcgcgggccgccg

SEQ ID NO: 3140373 - RNA, 13 nt, Mycobacterium bovis subsp bovis AF2122/97
ccgcgcgggcgga

SEQ ID NO: 3140374 - RNA, 22 nt, Mycobacterium bovis subsp bovis AF2122/97
ccgcgcggggugcgcgcgacca

SEQ ID NO: 3140375 - RNA, 18 nt, Mycobacterium bovis subsp bovis AF2122/97
ccgcgcgggucacgaccu

SEQ ID NO: 3140376 - RNA, 20 nt, Mycobacterium bovis subsp bovis AF2122/97
ccgcgcgguacugcgcagcg

SEQ ID NO: 3140377 - RNA, 23 nt, Mycobacterium bovis subsp bovis AF2122/97
ccgcgcggugauggucaccgucu

SEQ ID NO: 3140378 - RNA, 21 nt, Mycobacterium bovis subsp bovis AF2122/97
ccgcgcggugcccugccggca

SEQ ID NO: 3140379 - RNA, 17 nt, Mycobacterium bovis subsp bovis AF2122/97
ccgcgcgguggcggucg

SEQ ID NO: 3140380 - RNA, 21 nt, Mycobacterium bovis subsp bovis AF2122/97
ccgcgcgguggcggucgccac

SEQ ID NO: 3140381 - RNA, 20 nt, Mycobacterium bovis subsp bovis AF2122/97
ccgcgcguaauccgagcgcg

SEQ ID NO: 3140382 - RNA, 24 nt, Mycobacterium bovis subsp bovis AF2122/97
ccgcgcguacccgaucagcgacgc

SEQ ID NO: 3140383 - RNA, 15 nt, Mycobacterium bovis subsp bovis AF2122/97
ccgcgcguccgggca

SEQ ID NO: 3140384 - RNA, 20 nt, Mycobacterium bovis subsp bovis AF2122/97
ccgcgcguccgggcagccgc

SEQ ID NO: 3140385 - RNA, 18 nt, Mycobacterium bovis subsp bovis AF2122/97
ccgcgcguccgucggcga

SEQ ID NO: 3140386 - RNA, 13 nt, Mycobacterium bovis subsp bovis AF2122/97
ccgcgcguucggc

SEQ ID NO: 3140387 - RNA, 20 nt, Mycobacterium bovis subsp bovis AF2122/97
ccgcgcguucggcgagcagc

SEQ ID NO: 3140388 - RNA, 22 nt, Mycobacterium bovis subsp bovis AF2122/97
ccgcgcguucggcgagcagcgc

SEQ ID NO: 3140389 - RNA, 23 nt, Mycobacterium bovis subsp bovis AF2122/97
ccgcgcguucggcgagcagcgca

SEQ ID NO: 3140390 - RNA, 15 nt, Mycobacterium bovis subsp bovis AF2122/97
ccgcgcguucggcgc

SEQ ID NO: 3140391 - RNA, 16 nt, Mycobacterium bovis subsp bovis AF2122/97
ccgcgcguucggcgcu

SEQ ID NO: 3140392 - RNA, 12 nt, Mycobacterium bovis subsp bovis AF2122/97
ccgcggccagca

SEQ ID NO: 3140393 - RNA, 21 nt, Mycobacterium bovis subsp bovis AF2122/97
ccgcggccagcaccggggaca

SEQ ID NO: 3140394 - RNA, 21 nt, Mycobacterium bovis subsp bovis AF2122/97
ccgcggccaguacgucgauca

SEQ ID NO: 3140395 - RNA, 24 nt, Mycobacterium bovis subsp bovis AF2122/97
ccgcggcccacucucgccacgccg

SEQ ID NO: 3140396 - RNA, 13 nt, Mycobacterium bovis subsp bovis AF2122/97
ccgcggccccgac

SEQ ID NO: 3140397 - RNA, 12 nt, Mycobacterium bovis subsp bovis AF2122/97
ccgcggccccgc

SEQ ID NO: 3140398 - RNA, 13 nt, Mycobacterium bovis subsp bovis AF2122/97
ccgcggccccgcc

SEQ ID NO: 3140399 - RNA, 14 nt, Mycobacterium bovis subsp bovis AF2122/97
ccgcggccccgccg

SEQ ID NO: 3140400 - RNA, 24 nt, Mycobacterium bovis subsp bovis AF2122/97
ccgcggcccgcuccacggucaggc

SEQ ID NO: 3140401 - RNA, 23 nt, Mycobacterium bovis subsp bovis AF2122/97
ccgcggcccgcucgaucggcagc

SEQ ID NO: 3140402 - RNA, 18 nt, Mycobacterium bovis subsp bovis AF2122/97
ccgcggcccggacgucgg

SEQ ID NO: 3140403 - RNA, 18 nt, Mycobacterium bovis subsp bovis AF2122/97
ccgcggccgaaacgccau

SEQ ID NO: 3140404 - RNA, 13 nt, Mycobacterium bovis subsp bovis AF2122/97
ccgcggccgccag

SEQ ID NO: 3140405 - RNA, 14 nt, Mycobacterium bovis subsp bovis AF2122/97
ccgcggccgccguc

SEQ ID NO: 3140406 - RNA, 21 nt, Mycobacterium bovis subsp bovis AF2122/97
ccgcggccgccguccccgccg

SEQ ID NO: 3140407 - RNA, 13 nt, Mycobacterium bovis subsp bovis AF2122/97
ccgcggccgcgga

SEQ ID NO: 3140408 - RNA, 13 nt, Mycobacterium bovis subsp bovis AF2122/97
ccgcggccgcggu

SEQ ID NO: 3140409 - RNA, 18 nt, Mycobacterium bovis subsp bovis AF2122/97
ccgcggccgcggugacgg

SEQ ID NO: 3140410 - RNA, 23 nt, Mycobacterium bovis subsp bovis AF2122/97
ccgcggccggcgcucgcggcggc

SEQ ID NO: 3140411 - RNA, 15 nt, Mycobacterium bovis subsp bovis AF2122/97
ccgcggccgggccgc

SEQ ID NO: 3140412 - RNA, 16 nt, Mycobacterium bovis subsp bovis AF2122/97
ccgcggccgggccgcu

SEQ ID NO: 3140413 - RNA, 19 nt, Mycobacterium bovis subsp bovis AF2122/97
ccgcggccggguggcccgg

SEQ ID NO: 3140414 - RNA, 20 nt, Mycobacterium bovis subsp bovis AF2122/97
ccgcggccggguggcccggc

SEQ ID NO: 3140415 - RNA, 23 nt, Mycobacterium bovis subsp bovis AF2122/97
ccgcggccucguagucccacugc

SEQ ID NO: 3140416 - RNA, 16 nt, Mycobacterium bovis subsp bovis AF2122/97
ccgcggccuuggcggc

SEQ ID NO: 3140417 - RNA, 21 nt, Mycobacterium bovis subsp bovis AF2122/97
ccgcggcgaaccagcgcgucu

SEQ ID NO: 3140418 - RNA, 15 nt, Mycobacterium bovis subsp bovis AF2122/97
ccgcggcgaagcaag

SEQ ID NO: 3140419 - RNA, 21 nt, Mycobacterium bovis subsp bovis AF2122/97
ccgcggcgagcuccgaugccg

SEQ ID NO: 3140420 - RNA, 13 nt, Mycobacterium bovis subsp bovis AF2122/97
ccgcggcgcagca

SEQ ID NO: 3140421 - RNA, 15 nt, Mycobacterium bovis subsp bovis AF2122/97
ccgcggcgcagcacg

SEQ ID NO: 3140422 - RNA, 14 nt, Mycobacterium bovis subsp bovis AF2122/97
ccgcggcgcccggc

SEQ ID NO: 3140423 - RNA, 13 nt, Mycobacterium bovis subsp bovis AF2122/97
ccgcggcgccgcc

SEQ ID NO: 3140424 - RNA, 15 nt, Mycobacterium bovis subsp bovis AF2122/97
ccgcggcgccgccac

SEQ ID NO: 3140425 - RNA, 20 nt, Mycobacterium bovis subsp bovis AF2122/97
ccgcggcgccguugccaccg

SEQ ID NO: 3140426 - RNA, 15 nt, Mycobacterium bovis subsp bovis AF2122/97
ccgcggcgccuccgc

SEQ ID NO: 3140427 - RNA, 12 nt, Mycobacterium bovis subsp bovis AF2122/97
ccgcggcgcgga

SEQ ID NO: 3140428 - RNA, 19 nt, Mycobacterium bovis subsp bovis AF2122/97
ccgcggcgcugaugccguc

SEQ ID NO: 3140429 - RNA, 20 nt, Mycobacterium bovis subsp bovis AF2122/97
ccgcggcgcugaugccgucu

SEQ ID NO: 3140430 - RNA, 14 nt, Mycobacterium bovis subsp bovis AF2122/97
ccgcggcggaaggc

SEQ ID NO: 3140431 - RNA, 14 nt, Mycobacterium bovis subsp bovis AF2122/97
ccgcggcggcagca

SEQ ID NO: 3140432 - RNA, 16 nt, Mycobacterium bovis subsp bovis AF2122/97
ccgcggcggcagcacc

SEQ ID NO: 3140433 - RNA, 14 nt, Mycobacterium bovis subsp bovis AF2122/97
ccgcggcggcagcg

SEQ ID NO: 3140434 - RNA, 17 nt, Mycobacterium bovis subsp bovis AF2122/97
ccgcggcggcagcggcg

SEQ ID NO: 3140435 - RNA, 18 nt, Mycobacterium bovis subsp bovis AF2122/97
ccgcggcggcagcggcga

SEQ ID NO: 3140436 - RNA, 15 nt, Mycobacterium bovis subsp bovis AF2122/97
ccgcggcggccagcg

SEQ ID NO: 3140437 - RNA, 20 nt, Mycobacterium bovis subsp bovis AF2122/97
ccgcggcggccccgcgccac

SEQ ID NO: 3140438 - RNA, 18 nt, Mycobacterium bovis subsp bovis AF2122/97
ccgcggcggcgcguggug

SEQ ID NO: 3140439 - RNA, 15 nt, Mycobacterium bovis subsp bovis AF2122/97
ccgcggcggcggcca

SEQ ID NO: 3140440 - RNA, 23 nt, Mycobacterium bovis subsp bovis AF2122/97
ccgcggcuaggccaagccgcggc

SEQ ID NO: 3140441 - RNA, 18 nt, Mycobacterium bovis subsp bovis AF2122/97
ccgcggcuaggccagcac

SEQ ID NO: 3140442 - RNA, 22 nt, Mycobacterium bovis subsp bovis AF2122/97
ccgcggcugucacgccugccac

SEQ ID NO: 3140443 - RNA, 17 nt, Mycobacterium bovis subsp bovis AF2122/97
ccgcggcuuccccggua

SEQ ID NO: 3140444 - RNA, 23 nt, Mycobacterium bovis subsp bovis AF2122/97
ccgcggcuuggccuagccgcggc

SEQ ID NO: 3140445 - RNA, 16 nt, Mycobacterium bovis subsp bovis AF2122/97
ccgcgggacaccaccg

SEQ ID NO: 3140446 - RNA, 21 nt, Mycobacterium bovis subsp bovis AF2122/97
ccgcgggaccuucgagccgca

SEQ ID NO: 3140447 - RNA, 19 nt, Mycobacterium bovis subsp bovis AF2122/97
ccgcgggaucgguggcggc

SEQ ID NO: 3140448 - RNA, 23 nt, Mycobacterium bovis subsp bovis AF2122/97
ccgcgggaucgguggcggcacgc

SEQ ID NO: 3140449 - RNA, 14 nt, Mycobacterium bovis subsp bovis AF2122/97
ccgcgggcaagccg

SEQ ID NO: 3140450 - RNA, 21 nt, Mycobacterium bovis subsp bovis AF2122/97
ccgcgggcaguggcagcccgu

SEQ ID NO: 3140451 - RNA, 17 nt, Mycobacterium bovis subsp bovis AF2122/97
ccgcgggccagcaccuc

SEQ ID NO: 3140452 - RNA, 11 nt, Mycobacterium bovis subsp bovis AF2122/97
ccgcgggccgc

SEQ ID NO: 3140453 - RNA, 12 nt, Mycobacterium bovis subsp bovis AF2122/97
ccgcgggccgcc

SEQ ID NO: 3140454 - RNA, 13 nt, Mycobacterium bovis subsp bovis AF2122/97
ccgcgggccgcca

SEQ ID NO: 3140455 - RNA, 14 nt, Mycobacterium bovis subsp bovis AF2122/97
ccgcgggccgcguc

SEQ ID NO: 3140456 - RNA, 16 nt, Mycobacterium bovis subsp bovis AF2122/97
ccgcgggccgcgucca

SEQ ID NO: 3140457 - RNA, 20 nt, Mycobacterium bovis subsp bovis AF2122/97
ccgcgggccgcguccagacc

SEQ ID NO: 3140458 - RNA, 17 nt, Mycobacterium bovis subsp bovis AF2122/97
ccgcgggcggcaucgcc

SEQ ID NO: 3140459 - RNA, 20 nt, Mycobacterium bovis subsp bovis AF2122/97
ccgcgggcggcaucgccgag

SEQ ID NO: 3140460 - RNA, 14 nt, Mycobacterium bovis subsp bovis AF2122/97
ccgcgggcguugcu

SEQ ID NO: 3140461 - RNA, 16 nt, Mycobacterium bovis subsp bovis AF2122/97
ccgcggggaaucaccc

SEQ ID NO: 3140462 - RNA, 18 nt, Mycobacterium bovis subsp bovis AF2122/97
ccgcggggcagcgggccg

SEQ ID NO: 3140463 - RNA, 19 nt, Mycobacterium bovis subsp bovis AF2122/97
ccgcggggcagcgggccgc

SEQ ID NO: 3140464 - RNA, 15 nt, Mycobacterium bovis subsp bovis AF2122/97
ccgcgggggaccgcc

SEQ ID NO: 3140465 - RNA, 16 nt, Mycobacterium bovis subsp bovis AF2122/97
ccgcgggggaccgccc

SEQ ID NO: 3140466 - RNA, 17 nt, Mycobacterium bovis subsp bovis AF2122/97
ccgcgggggcggccggc

SEQ ID NO: 3140467 - RNA, 16 nt, Mycobacterium bovis subsp bovis AF2122/97
ccgcgggucccggccg

SEQ ID NO: 3140468 - RNA, 13 nt, Mycobacterium bovis subsp bovis AF2122/97
ccgcgggucgcgc

SEQ ID NO: 3140469 - RNA, 20 nt, Mycobacterium bovis subsp bovis AF2122/97
ccgcgggucgcugcgacugg

SEQ ID NO: 3140470 - RNA, 17 nt, Mycobacterium bovis subsp bovis AF2122/97
ccgcgggucguccggcg

SEQ ID NO: 3140471 - RNA, 19 nt, Mycobacterium bovis subsp bovis AF2122/97
ccgcgggucguccggcggc

SEQ ID NO: 3140472 - RNA, 22 nt, Mycobacterium bovis subsp bovis AF2122/97
ccgcgggucguccggcggcagg

SEQ ID NO: 3140473 - RNA, 14 nt, Mycobacterium bovis subsp bovis AF2122/97
ccgcgggucgugcc

SEQ ID NO: 3140474 - RNA, 18 nt, Mycobacterium bovis subsp bovis AF2122/97
ccgcgggugaucugggcg

SEQ ID NO: 3140475 - RNA, 14 nt, Mycobacterium bovis subsp bovis AF2122/97
ccgcgggugauguu

SEQ ID NO: 3140476 - RNA, 12 nt, Mycobacterium bovis subsp bovis AF2122/97
ccgcgggugcgg

SEQ ID NO: 3140477 - RNA, 16 nt, Mycobacterium bovis subsp bovis AF2122/97
ccgcgggugcggcaug

SEQ ID NO: 3140478 - RNA, 15 nt, Mycobacterium bovis subsp bovis AF2122/97
ccgcgguacccaccu

SEQ ID NO: 3140479 - RNA, 17 nt, Mycobacterium bovis subsp bovis AF2122/97
ccgcgucugcucggcgg

SEQ ID NO: 3140480 - RNA, 20 nt, Mycobacterium bovis subsp bovis AF2122/97
ccgcgugacguaccacggcg

SEQ ID NO: 3140481 - RNA, 15 nt, Mycobacterium bovis subsp bovis AF2122/97
ccgcgugccacucga

SEQ ID NO: 3140482 - RNA, 13 nt, Mycobacterium bovis subsp bovis AF2122/97
ccgcgugccgccc

SEQ ID NO: 3140483 - RNA, 11 nt, Mycobacterium bovis subsp bovis AF2122/97
ccgcgugcguc

SEQ ID NO: 3140484 - RNA, 16 nt, Mycobacterium bovis subsp bovis AF2122/97
ccgcgugcgucagcgc

SEQ ID NO: 3140485 - RNA, 17 nt, Mycobacterium bovis subsp bovis AF2122/97
ccgcgugcucgagcacc

SEQ ID NO: 3140486 - RNA, 20 nt, Mycobacterium bovis subsp bovis AF2122/97
ccgcgugcucgagcaccucg

SEQ ID NO: 3140487 - RNA, 16 nt, Mycobacterium bovis subsp bovis AF2122/97
ccgcgugcucgccgua

SEQ ID NO: 3140488 - RNA, 13 nt, Mycobacterium bovis subsp bovis AF2122/97
ccgcguggccggu

SEQ ID NO: 3140489 - RNA, 13 nt, Mycobacterium bovis subsp bovis AF2122/97
ccgcguggcuggc

SEQ ID NO: 3140490 - RNA, 17 nt, Mycobacterium bovis subsp bovis AF2122/97
ccgcguggcuggcggcg

SEQ ID NO: 3140491 - RNA, 18 nt, Mycobacterium bovis subsp bovis AF2122/97
ccgcguggcuggcggcga

SEQ ID NO: 3140492 - RNA, 19 nt, Mycobacterium bovis subsp bovis AF2122/97
ccgcgugggcaugcggauu

SEQ ID NO: 3140493 - RNA, 20 nt, Mycobacterium bovis subsp bovis AF2122/97
ccgcguggugcugaccgcgc

SEQ ID NO: 3140494 - RNA, 23 nt, Mycobacterium bovis subsp bovis AF2122/97
ccgcguggugcugaccgcgccgg

SEQ ID NO: 3140495 - RNA, 23 nt, Mycobacterium bovis subsp bovis AF2122/97
ccgcgugguuccggcgugcagca

SEQ ID NO: 3140496 - RNA, 15 nt, Mycobacterium bovis subsp bovis AF2122/97
ccgcguguaccgcga

SEQ ID NO: 3140497 - RNA, 17 nt, Mycobacterium bovis subsp bovis AF2122/97
ccgcguguccuuugcca

SEQ ID NO: 3140498 - RNA, 17 nt, Mycobacterium bovis subsp bovis AF2122/97
ccgcguuaugccaggcg

SEQ ID NO: 3140499 - RNA, 18 nt, Mycobacterium bovis subsp bovis AF2122/97
ccgcguuaugccaggcgc

SEQ ID NO: 3140500 - RNA, 14 nt, Mycobacterium bovis subsp bovis AF2122/97
ccgcguucagggca

SEQ ID NO: 3140501 - RNA, 20 nt, Mycobacterium bovis subsp bovis AF2122/97
ccgcguucgagagccccgac

SEQ ID NO: 3140502 - RNA, 17 nt, Mycobacterium bovis subsp bovis AF2122/97
ccgcguugaaggcgccg

SEQ ID NO: 3140503 - RNA, 18 nt, Mycobacterium bovis subsp bovis AF2122/97
ccgcguugaugaccaggu

SEQ ID NO: 3140504 - RNA, 19 nt, Mycobacterium bovis subsp bovis AF2122/97
ccgcguugaugaccgccgc

SEQ ID NO: 3140505 - RNA, 22 nt, Mycobacterium bovis subsp bovis AF2122/97
ccgcguugaugaccgccgccgg

SEQ ID NO: 3140506 - RNA, 13 nt, Mycobacterium bovis subsp bovis AF2122/97
ccgcguugccaaa

SEQ ID NO: 3140507 - RNA, 21 nt, Mycobacterium bovis subsp bovis AF2122/97
ccgcguuuauaccucgccgcc

SEQ ID NO: 3140508 - RNA, 22 nt, Mycobacterium bovis subsp bovis AF2122/97
ccgcguuuauaccucgccgccc

SEQ ID NO: 3140509 - RNA, 23 nt, Mycobacterium bovis subsp bovis AF2122/97
ccgcguuuauaccucgccgcccu

SEQ ID NO: 3140510 - RNA, 16 nt, Mycobacterium bovis subsp bovis AF2122/97
ccgcguuucggucguu

SEQ ID NO: 3140511 - RNA, 23 nt, Mycobacterium bovis subsp bovis AF2122/97
ccgcuaacgcaccugcgcgcggc

SEQ ID NO: 3140512 - RNA, 14 nt, Mycobacterium bovis subsp bovis AF2122/97
ccgcuaauggaucc

SEQ ID NO: 3140513 - RNA, 14 nt, Mycobacterium bovis subsp bovis AF2122/97
ccgcuaccagcugg

SEQ ID NO: 3140514 - RNA, 16 nt, Mycobacterium bovis subsp bovis AF2122/97
ccgcuaccagcugggc

SEQ ID NO: 3140515 - RNA, 16 nt, Mycobacterium bovis subsp bovis AF2122/97
ccgcuaccccagccgg

SEQ ID NO: 3140516 - RNA, 12 nt, Mycobacterium bovis subsp bovis AF2122/97
ccgcuacccccg

SEQ ID NO: 3140517 - RNA, 18 nt, Mycobacterium bovis subsp bovis AF2122/97
ccgcuacccccgauggcg

SEQ ID NO: 3140518 - RNA, 21 nt, Mycobacterium bovis subsp bovis AF2122/97
ccgcuacccggacagggcggc

SEQ ID NO: 3140519 - RNA, 12 nt, Mycobacterium bovis subsp bovis AF2122/97
ccgcuaccgcac

SEQ ID NO: 3140520 - RNA, 13 nt, Mycobacterium bovis subsp bovis AF2122/97
ccgcuaccgcaca

SEQ ID NO: 3140521 - RNA, 17 nt, Mycobacterium bovis subsp bovis AF2122/97
ccgcuaccgcccgcgcc

SEQ ID NO: 3140522 - RNA, 19 nt, Mycobacterium bovis subsp bovis AF2122/97
ccgcuaccgcccgcgccac

SEQ ID NO: 3140523 - RNA, 22 nt, Mycobacterium bovis subsp bovis AF2122/97
ccgcuaccgucaguagccacgc

SEQ ID NO: 3140524 - RNA, 21 nt, Mycobacterium bovis subsp bovis AF2122/97
ccgcuaccguuguugaggaug

SEQ ID NO: 3140525 - RNA, 13 nt, Mycobacterium bovis subsp bovis AF2122/97
ccgcuacgcgcgc

SEQ ID NO: 3140526 - RNA, 14 nt, Mycobacterium bovis subsp bovis AF2122/97
ccgcuacgcgcgcu

SEQ ID NO: 3140527 - RNA, 17 nt, Mycobacterium bovis subsp bovis AF2122/97
ccgcuacgcgcgcucgc

SEQ ID NO: 3140528 - RNA, 20 nt, Mycobacterium bovis subsp bovis AF2122/97
ccgcuacgcgcgcucgcuca

SEQ ID NO: 3140529 - RNA, 22 nt, Mycobacterium bovis subsp bovis AF2122/97
ccgcuacucgugaagugcuuug

SEQ ID NO: 3140530 - RNA, 14 nt, Mycobacterium bovis subsp bovis AF2122/97
ccgcuagcccacca

SEQ ID NO: 3140531 - RNA, 20 nt, Mycobacterium bovis subsp bovis AF2122/97
ccgcuagcgcuugcgacccc

SEQ ID NO: 3140532 - RNA, 16 nt, Mycobacterium bovis subsp bovis AF2122/97
ccgcuaggucagguga

SEQ ID NO: 3140533 - RNA, 20 nt, Mycobacterium bovis subsp bovis AF2122/97
ccgcuaggugacgccgccag

SEQ ID NO: 3140534 - RNA, 17 nt, Mycobacterium bovis subsp bovis AF2122/97
ccgcuagucgucggcgc

SEQ ID NO: 3140535 - RNA, 15 nt, Mycobacterium bovis subsp bovis AF2122/97
ccgcuaugaggcagu

SEQ ID NO: 3140536 - RNA, 23 nt, Mycobacterium bovis subsp bovis AF2122/97
ccgcuaugaugccgccggugccg

SEQ ID NO: 3140537 - RNA, 16 nt, Mycobacterium bovis subsp bovis AF2122/97
ccgcuauucggcggca

SEQ ID NO: 3140538 - RNA, 21 nt, Mycobacterium bovis subsp bovis AF2122/97
ccgcucaacgggccgcaucgu

SEQ ID NO: 3140539 - RNA, 19 nt, Mycobacterium bovis subsp bovis AF2122/97
ccgcucacaagccgugcag

SEQ ID NO: 3140540 - RNA, 14 nt, Mycobacterium bovis subsp bovis AF2122/97
ccgcucacccgccc

SEQ ID NO: 3140541 - RNA, 16 nt, Mycobacterium bovis subsp bovis AF2122/97
ccgcucacccgcccgg

SEQ ID NO: 3140542 - RNA, 22 nt, Mycobacterium bovis subsp bovis AF2122/97
ccgcucacccgcccggaacggg

SEQ ID NO: 3140543 - RNA, 16 nt, Mycobacterium bovis subsp bovis AF2122/97
ccgcucacccggucgc

SEQ ID NO: 3140544 - RNA, 17 nt, Mycobacterium bovis subsp bovis AF2122/97
ccgcucacgaagaccgc

SEQ ID NO: 3140545 - RNA, 14 nt, Mycobacterium bovis subsp bovis AF2122/97
ccgcucacgcucac

SEQ ID NO: 3140546 - RNA, 18 nt, Mycobacterium bovis subsp bovis AF2122/97
ccgcucacgcucacccgg

SEQ ID NO: 3140547 - RNA, 16 nt, Mycobacterium bovis subsp bovis AF2122/97
ccgcucagcgcagcau

SEQ ID NO: 3140548 - RNA, 20 nt, Mycobacterium bovis subsp bovis AF2122/97
ccgcucagggugcgccgcag

SEQ ID NO: 3140549 - RNA, 22 nt, Mycobacterium bovis subsp bovis AF2122/97
ccgcucagggugcgccgcagca

SEQ ID NO: 3140550 - RNA, 14 nt, Mycobacterium bovis subsp bovis AF2122/97
ccgcucauccagcg

SEQ ID NO: 3140551 - RNA, 16 nt, Mycobacterium bovis subsp bovis AF2122/97
ccgcucauccagcgcg

SEQ ID NO: 3140552 - RNA, 17 nt, Mycobacterium bovis subsp bovis AF2122/97
ccgcucauccagcgcgu

SEQ ID NO: 3140553 - RNA, 14 nt, Mycobacterium bovis subsp bovis AF2122/97
ccgcucaucgauca

SEQ ID NO: 3140554 - RNA, 20 nt, Mycobacterium bovis subsp bovis AF2122/97
ccgcucaucgaucacacguc

SEQ ID NO: 3140555 - RNA, 17 nt, Mycobacterium bovis subsp bovis AF2122/97
ccgcucauuagcccccg

SEQ ID NO: 3140556 - RNA, 22 nt, Mycobacterium bovis subsp bovis AF2122/97
ccgcucauuagcccccgcgggg

SEQ ID NO: 3140557 - RNA, 13 nt, Mycobacterium bovis subsp bovis AF2122/97
ccgcuccaagcgc

SEQ ID NO: 3140558 - RNA, 12 nt, Mycobacterium bovis subsp bovis AF2122/97
ccgcucccccgc

SEQ ID NO: 3140559 - RNA, 19 nt, Mycobacterium bovis subsp bovis AF2122/97
ccgcucccccgccaacccc

SEQ ID NO: 3140560 - RNA, 21 nt, Mycobacterium bovis subsp bovis AF2122/97
ccgcucccucuacacccggac

SEQ ID NO: 3140561 - RNA, 13 nt, Mycobacterium bovis subsp bovis AF2122/97
ccgcuccgccguc

SEQ ID NO: 3140562 - RNA, 14 nt, Mycobacterium bovis subsp bovis AF2122/97
ccgcuccgccgucg

SEQ ID NO: 3140563 - RNA, 14 nt, Mycobacterium bovis subsp bovis AF2122/97
ccgcuccgcgccgc

SEQ ID NO: 3140564 - RNA, 20 nt, Mycobacterium bovis subsp bovis AF2122/97
ccgcucgaaagcgucgauca

SEQ ID NO: 3140565 - RNA, 17 nt, Mycobacterium bovis subsp bovis AF2122/97
ccgcucgacggcccgcc

SEQ ID NO: 3140566 - RNA, 13 nt, Mycobacterium bovis subsp bovis AF2122/97
ccgcugccggcac

SEQ ID NO: 3140567 - RNA, 15 nt, Mycobacterium bovis subsp bovis AF2122/97
ccgcugccggcacgc

SEQ ID NO: 3140568 - RNA, 16 nt, Mycobacterium bovis subsp bovis AF2122/97
ccgcugccggcacgca

SEQ ID NO: 3140569 - RNA, 15 nt, Mycobacterium bovis subsp bovis AF2122/97
ccgcugccggcgccg

SEQ ID NO: 3140570 - RNA, 16 nt, Mycobacterium bovis subsp bovis AF2122/97
ccgcugccggcgccgc

SEQ ID NO: 3140571 - RNA, 12 nt, Mycobacterium bovis subsp bovis AF2122/97
ccgcugccgucg

SEQ ID NO: 3140572 - RNA, 14 nt, Mycobacterium bovis subsp bovis AF2122/97
ccgcugccuggccg

SEQ ID NO: 3140573 - RNA, 22 nt, Mycobacterium bovis subsp bovis AF2122/97
ccgcugccuucuuugccggcgc

SEQ ID NO: 3140574 - RNA, 18 nt, Mycobacterium bovis subsp bovis AF2122/97
ccgcugccuuggcgcggc

SEQ ID NO: 3140575 - RNA, 20 nt, Mycobacterium bovis subsp bovis AF2122/97
ccgcugccuuggcgcggcac

SEQ ID NO: 3140576 - RNA, 23 nt, Mycobacterium bovis subsp bovis AF2122/97
ccgcugcgaaagcacgugcacgg

SEQ ID NO: 3140577 - RNA, 16 nt, Mycobacterium bovis subsp bovis AF2122/97
ccgcugcgccagguca

SEQ ID NO: 3140578 - RNA, 21 nt, Mycobacterium bovis subsp bovis AF2122/97
ccgcugcgccaggucagcucc

SEQ ID NO: 3140579 - RNA, 21 nt, Mycobacterium bovis subsp bovis AF2122/97
ccgcugcgccgucgcagccag

SEQ ID NO: 3140580 - RNA, 14 nt, Mycobacterium bovis subsp bovis AF2122/97
ccgcugcggcaccg

SEQ ID NO: 3140581 - RNA, 17 nt, Mycobacterium bovis subsp bovis AF2122/97
ccgcugcggcaccgagc

SEQ ID NO: 3140582 - RNA, 22 nt, Mycobacterium bovis subsp bovis AF2122/97
ccgcugcggguagccgucgauc

SEQ ID NO: 3140583 - RNA, 14 nt, Mycobacterium bovis subsp bovis AF2122/97
ccgcugcggugccg

SEQ ID NO: 3140584 - RNA, 19 nt, Mycobacterium bovis subsp bovis AF2122/97
ccgcugcggugccggcccu

SEQ ID NO: 3140585 - RNA, 18 nt, Mycobacterium bovis subsp bovis AF2122/97
ccgcugcguaguguucug

SEQ ID NO: 3140586 - RNA, 23 nt, Mycobacterium bovis subsp bovis AF2122/97
ccgcugcuagugcgggccgugac

SEQ ID NO: 3140587 - RNA, 19 nt, Mycobacterium bovis subsp bovis AF2122/97
ccgcugcugcugcccccca

SEQ ID NO: 3140588 - RNA, 20 nt, Mycobacterium bovis subsp bovis AF2122/97
ccgcuggagaucacgccgac

SEQ ID NO: 3140589 - RNA, 14 nt, Mycobacterium bovis subsp bovis AF2122/97
ccgcuggaggcggc

SEQ ID NO: 3140590 - RNA, 16 nt, Mycobacterium bovis subsp bovis AF2122/97
ccgcuggaggcggcgc

SEQ ID NO: 3140591 - RNA, 15 nt, Mycobacterium bovis subsp bovis AF2122/97
ccgcuggaucgacuu

SEQ ID NO: 3140592 - RNA, 23 nt, Mycobacterium bovis subsp bovis AF2122/97
ccgcuggcauaucccuugccguc

SEQ ID NO: 3140593 - RNA, 12 nt, Mycobacterium bovis subsp bovis AF2122/97
ccgcuggccagc

SEQ ID NO: 3140594 - RNA, 18 nt, Mycobacterium bovis subsp bovis AF2122/97
ccgcuggcucaucgaagc

SEQ ID NO: 3140595 - RNA, 20 nt, Mycobacterium bovis subsp bovis AF2122/97
ccgcuggcucaucgaagcuu

SEQ ID NO: 3140596 - RNA, 18 nt, Mycobacterium bovis subsp bovis AF2122/97
ccgcugggauucugggcg

SEQ ID NO: 3140597 - RNA, 12 nt, Mycobacterium bovis subsp bovis AF2122/97
ccgcugggccgg

SEQ ID NO: 3140598 - RNA, 18 nt, Mycobacterium bovis subsp bovis AF2122/97
ccgcugggcuuggggccg

SEQ ID NO: 3140599 - RNA, 14 nt, Mycobacterium bovis subsp bovis AF2122/97
ccgcugggugacca

SEQ ID NO: 3140600 - RNA, 14 nt, Mycobacterium bovis subsp bovis AF2122/97
ccgcuggguggccg

SEQ ID NO: 3140601 - RNA, 16 nt, Mycobacterium bovis subsp bovis AF2122/97
ccgcuggucgaccggc

SEQ ID NO: 3140602 - RNA, 20 nt, Mycobacterium bovis subsp bovis AF2122/97
ccgcugguggcgccaucccc

SEQ ID NO: 3140603 - RNA, 21 nt, Mycobacterium bovis subsp bovis AF2122/97
ccgcugguggugauugggauu

SEQ ID NO: 3140604 - RNA, 19 nt, Mycobacterium bovis subsp bovis AF2122/97
ccgcugucaccccugggcg

SEQ ID NO: 3140605 - RNA, 15 nt, Mycobacterium bovis subsp bovis AF2122/97
ccgcugucagccgac

SEQ ID NO: 3140606 - RNA, 24 nt, Mycobacterium bovis subsp bovis AF2122/97
ccgcugucguaccgcucggcggca

SEQ ID NO: 3140607 - RNA, 23 nt, Mycobacterium bovis subsp bovis AF2122/97
ccgcugugauagcgccguacagc

SEQ ID NO: 3140608 - RNA, 21 nt, Mycobacterium bovis subsp bovis AF2122/97
ccgcuguggucuucaucgccg

SEQ ID NO: 3140609 - RNA, 17 nt, Mycobacterium bovis subsp bovis AF2122/97
ccgcuguguucagcgca

SEQ ID NO: 3140610 - RNA, 20 nt, Mycobacterium bovis subsp bovis AF2122/97
ccgcuuagcaaucggcagga

SEQ ID NO: 3140611 - RNA, 13 nt, Mycobacterium bovis subsp bovis AF2122/97
ccgcuucccccgg

SEQ ID NO: 3140612 - RNA, 19 nt, Mycobacterium bovis subsp bovis AF2122/97
ccgcuugaccccuggccgc

SEQ ID NO: 3140613 - RNA, 21 nt, Mycobacterium bovis subsp bovis AF2122/97
ccgcuugaccccuggccgccg

SEQ ID NO: 3140614 - RNA, 19 nt, Mycobacterium bovis subsp bovis AF2122/97
ccgcuugcccgcgcagcac

SEQ ID NO: 3140615 - RNA, 20 nt, Mycobacterium bovis subsp bovis AF2122/97
ccgcuugccggacaacugga

SEQ ID NO: 3140616 - RNA, 13 nt, Mycobacterium bovis subsp bovis AF2122/97
ccgcuugcggggc

SEQ ID NO: 3140617 - RNA, 14 nt, Mycobacterium bovis subsp bovis AF2122/97
ccgcuuggcccggc

SEQ ID NO: 3140618 - RNA, 14 nt, Mycobacterium bovis subsp bovis AF2122/97
ccgcuuggcgcggc

SEQ ID NO: 3140619 - RNA, 14 nt, Mycobacterium bovis subsp bovis AF2122/97
ccgcuuggcgugac

SEQ ID NO: 3140620 - RNA, 15 nt, Mycobacterium bovis subsp bovis AF2122/97
ccgcuuguccaccgu

SEQ ID NO: 3140621 - RNA, 15 nt, Mycobacterium bovis subsp bovis AF2122/97
ccgcuugugacacca

SEQ ID NO: 3140622 - RNA, 13 nt, Mycobacterium bovis subsp bovis AF2122/97
ccgcuuucuuggc

SEQ ID NO: 3140623 - RNA, 20 nt, Mycobacterium bovis subsp bovis AF2122/97
ccgcuuucuuggcgggcgcc

SEQ ID NO: 3140624 - RNA, 16 nt, Mycobacterium bovis subsp bovis AF2122/97
ccgcuuugcgcgguca

SEQ ID NO: 3140625 - RNA, 14 nt, Mycobacterium bovis subsp bovis AF2122/97
ccggaaaccacagc

SEQ ID NO: 3140626 - RNA, 15 nt, Mycobacterium bovis subsp bovis AF2122/97
ccggaaacgccaggg

SEQ ID NO: 3140627 - RNA, 16 nt, Mycobacterium bovis subsp bovis AF2122/97
ccggaaacgccagggg

SEQ ID NO: 3140628 - RNA, 17 nt, Mycobacterium bovis subsp bovis AF2122/97
ccggaaagaucucgguc

SEQ ID NO: 3140629 - RNA, 13 nt, Mycobacterium bovis subsp bovis AF2122/97
ccggaaagcucuc

SEQ ID NO: 3140630 - RNA, 22 nt, Mycobacterium bovis subsp bovis AF2122/97
ccggaaagcucucggcacccgg

SEQ ID NO: 3140631 - RNA, 17 nt, Mycobacterium bovis subsp bovis AF2122/97
ccggaaagcucuugcac

SEQ ID NO: 3140632 - RNA, 22 nt, Mycobacterium bovis subsp bovis AF2122/97
ccggaaagcucuugcacucggc

SEQ ID NO: 3140633 - RNA, 20 nt, Mycobacterium bovis subsp bovis AF2122/97
ccggaaauuccggcgcggcc

SEQ ID NO: 3140634 - RNA, 22 nt, Mycobacterium bovis subsp bovis AF2122/97
ccggaaauuccggcgcggccgg

SEQ ID NO: 3140635 - RNA, 14 nt, Mycobacterium bovis subsp bovis AF2122/97
ccggaaccaccagu

SEQ ID NO: 3140636 - RNA, 23 nt, Mycobacterium bovis subsp bovis AF2122/97
ccggaaccaccaguaccaccggc

SEQ ID NO: 3140637 - RNA, 17 nt, Mycobacterium bovis subsp bovis AF2122/97
ccggaaccagccgcgga

SEQ ID NO: 3140638 - RNA, 21 nt, Mycobacterium bovis subsp bovis AF2122/97
ccggaaccagcguaucggccg

SEQ ID NO: 3140639 - RNA, 14 nt, Mycobacterium bovis subsp bovis AF2122/97
ccggaacccccagc

SEQ ID NO: 3140640 - RNA, 14 nt, Mycobacterium bovis subsp bovis AF2122/97
ccggaacccgagcc

SEQ ID NO: 3140641 - RNA, 19 nt, Mycobacterium bovis subsp bovis AF2122/97
ccggaacccgagccgguaa

SEQ ID NO: 3140642 - RNA, 22 nt, Mycobacterium bovis subsp bovis AF2122/97
ccggaacccgagccgguaaccg

SEQ ID NO: 3140643 - RNA, 13 nt, Mycobacterium bovis subsp bovis AF2122/97
ccggaaccggcgu

SEQ ID NO: 3140644 - RNA, 14 nt, Mycobacterium bovis subsp bovis AF2122/97
ccggaaccggcgug

SEQ ID NO: 3140645 - RNA, 22 nt, Mycobacterium bovis subsp bovis AF2122/97
ccggaaccggcgugcagcacuu

SEQ ID NO: 3140646 - RNA, 18 nt, Mycobacterium bovis subsp bovis AF2122/97
ccggaacgagcggccgcg

SEQ ID NO: 3140647 - RNA, 14 nt, Mycobacterium bovis subsp bovis AF2122/97
ccggaacgcccggc

SEQ ID NO: 3140648 - RNA, 14 nt, Mycobacterium bovis subsp bovis AF2122/97
ccggaacgccgcca

SEQ ID NO: 3140649 - RNA, 23 nt, Mycobacterium bovis subsp bovis AF2122/97
ccggaacugcgcaacaccgugca

SEQ ID NO: 3140650 - RNA, 14 nt, Mycobacterium bovis subsp bovis AF2122/97
ccggaagauccggg

SEQ ID NO: 3140651 - RNA, 12 nt, Mycobacterium bovis subsp bovis AF2122/97
ccggaagcgccg

SEQ ID NO: 3140652 - RNA, 21 nt, Mycobacterium bovis subsp bovis AF2122/97
ccggaagcgccggccgaucgg

SEQ ID NO: 3140653 - RNA, 20 nt, Mycobacterium bovis subsp bovis AF2122/97
ccggacuaccgccggcggcg

SEQ ID NO: 3140654 - RNA, 21 nt, Mycobacterium bovis subsp bovis AF2122/97
ccggacuaccgccggcggcgg

SEQ ID NO: 3140655 - RNA, 18 nt, Mycobacterium bovis subsp bovis AF2122/97
ccggacucuccccuggcc

SEQ ID NO: 3140656 - RNA, 19 nt, Mycobacterium bovis subsp bovis AF2122/97
ccggacucuccccuggccc

SEQ ID NO: 3140657 - RNA, 15 nt, Mycobacterium bovis subsp bovis AF2122/97
ccggacugcgccggg

SEQ ID NO: 3140658 - RNA, 13 nt, Mycobacterium bovis subsp bovis AF2122/97
ccggacuugacca

SEQ ID NO: 3140659 - RNA, 18 nt, Mycobacterium bovis subsp bovis AF2122/97
ccggacuugaccagagca

SEQ ID NO: 3140660 - RNA, 17 nt, Mycobacterium bovis subsp bovis AF2122/97
ccggacuuggccugcgg

SEQ ID NO: 3140661 - RNA, 18 nt, Mycobacterium bovis subsp bovis AF2122/97
ccggacuuggccugcggu

SEQ ID NO: 3140662 - RNA, 22 nt, Mycobacterium bovis subsp bovis AF2122/97
ccggagaauagaucagggcucg

SEQ ID NO: 3140663 - RNA, 21 nt, Mycobacterium bovis subsp bovis AF2122/97
ccggagacacccgccaggccg

SEQ ID NO: 3140664 - RNA, 17 nt, Mycobacterium bovis subsp bovis AF2122/97
ccggagacaccgcaacg

SEQ ID NO: 3140665 - RNA, 18 nt, Mycobacterium bovis subsp bovis AF2122/97
ccggagaucccgguccca

SEQ ID NO: 3140666 - RNA, 21 nt, Mycobacterium bovis subsp bovis AF2122/97
ccggagaugacaaucucggcg

SEQ ID NO: 3140667 - RNA, 21 nt, Mycobacterium bovis subsp bovis AF2122/97
ccggagauguaguccucggug

SEQ ID NO: 3140668 - RNA, 14 nt, Mycobacterium bovis subsp bovis AF2122/97
ccggagcacccggg

SEQ ID NO: 3140669 - RNA, 16 nt, Mycobacterium bovis subsp bovis AF2122/97
ccggagcccacacgcu

SEQ ID NO: 3140670 - RNA, 21 nt, Mycobacterium bovis subsp bovis AF2122/97
ccggagccccugucaacgccg

SEQ ID NO: 3140671 - RNA, 22 nt, Mycobacterium bovis subsp bovis AF2122/97
ccggagccccugucaacgccgc

SEQ ID NO: 3140672 - RNA, 12 nt, Mycobacterium bovis subsp bovis AF2122/97
ccggagccgcca

SEQ ID NO: 3140673 - RNA, 13 nt, Mycobacterium bovis subsp bovis AF2122/97
ccggagccgccca

SEQ ID NO: 3140674 - RNA, 12 nt, Mycobacterium bovis subsp bovis AF2122/97
ccggagccgccg

SEQ ID NO: 3140675 - RNA, 13 nt, Mycobacterium bovis subsp bovis AF2122/97
ccggagccgccgg

SEQ ID NO: 3140676 - RNA, 14 nt, Mycobacterium bovis subsp bovis AF2122/97
ccggagccgccggc

SEQ ID NO: 3140677 - RNA, 16 nt, Mycobacterium bovis subsp bovis AF2122/97
ccggagccgccggccc

SEQ ID NO: 3140678 - RNA, 19 nt, Mycobacterium bovis subsp bovis AF2122/97
ccggagccgcuacguuacg

SEQ ID NO: 3140679 - RNA, 15 nt, Mycobacterium bovis subsp bovis AF2122/97
ccggagccggugccg

SEQ ID NO: 3140680 - RNA, 17 nt, Mycobacterium bovis subsp bovis AF2122/97
ccggagccggugccgac

SEQ ID NO: 3140681 - RNA, 22 nt, Mycobacterium bovis subsp bovis AF2122/97
ccggagccggugccgacggcgc

SEQ ID NO: 3140682 - RNA, 19 nt, Mycobacterium bovis subsp bovis AF2122/97
ccggagcgccgagcucggc

SEQ ID NO: 3140683 - RNA, 21 nt, Mycobacterium bovis subsp bovis AF2122/97
ccggagcgccgagcucggcgc

SEQ ID NO: 3140684 - RNA, 15 nt, Mycobacterium bovis subsp bovis AF2122/97
ccggagcggucagcg

SEQ ID NO: 3140685 - RNA, 14 nt, Mycobacterium bovis subsp bovis AF2122/97
ccggaggcaagcaa

SEQ ID NO: 3140686 - RNA, 19 nt, Mycobacterium bovis subsp bovis AF2122/97
ccggaggcaagcaaccggu

SEQ ID NO: 3140687 - RNA, 17 nt, Mycobacterium bovis subsp bovis AF2122/97
ccggaggcaauccgauc

SEQ ID NO: 3140688 - RNA, 21 nt, Mycobacterium bovis subsp bovis AF2122/97
ccggaggcaauccgaucugga

SEQ ID NO: 3140689 - RNA, 21 nt, Mycobacterium bovis subsp bovis AF2122/97
ccggaggcuugcaacaccccg

SEQ ID NO: 3140690 - RNA, 18 nt, Mycobacterium bovis subsp bovis AF2122/97
ccggagggguuagguugu

SEQ ID NO: 3140691 - RNA, 18 nt, Mycobacterium bovis subsp bovis AF2122/97
ccggaggugacaaauggg

SEQ ID NO: 3140692 - RNA, 15 nt, Mycobacterium bovis subsp bovis AF2122/97
ccggaggugcgccgc

SEQ ID NO: 3140693 - RNA, 17 nt, Mycobacterium bovis subsp bovis AF2122/97
ccggaggugcgccgcgg

SEQ ID NO: 3140694 - RNA, 14 nt, Mycobacterium bovis subsp bovis AF2122/97
ccggagucgacgac

SEQ ID NO: 3140695 - RNA, 15 nt, Mycobacterium bovis subsp bovis AF2122/97
ccggagucgcccggu

SEQ ID NO: 3140696 - RNA, 22 nt, Mycobacterium bovis subsp bovis AF2122/97
ccggagucgcccgguccgccgc

SEQ ID NO: 3140697 - RNA, 15 nt, Mycobacterium bovis subsp bovis AF2122/97
ccggaguucucgcug

SEQ ID NO: 3140698 - RNA, 11 nt, Mycobacterium bovis subsp bovis AF2122/97
ccggaguugaa

SEQ ID NO: 3140699 - RNA, 15 nt, Mycobacterium bovis subsp bovis AF2122/97
ccggaguugaagaag

SEQ ID NO: 3140700 - RNA, 21 nt, Mycobacterium bovis subsp bovis AF2122/97
ccggaguugguguuauugaug

SEQ ID NO: 3140701 - RNA, 19 nt, Mycobacterium bovis subsp bovis AF2122/97
ccggauaacccagcggcgc

SEQ ID NO: 3140702 - RNA, 20 nt, Mycobacterium bovis subsp bovis AF2122/97
ccggauaaucauccgagcgg

SEQ ID NO: 3140703 - RNA, 15 nt, Mycobacterium bovis subsp bovis AF2122/97
ccggauacagccacg

SEQ ID NO: 3140704 - RNA, 23 nt, Mycobacterium bovis subsp bovis AF2122/97
ccggauacgucagcccgauacgg

SEQ ID NO: 3140705 - RNA, 16 nt, Mycobacterium bovis subsp bovis AF2122/97
ccggauagacggcgac

SEQ ID NO: 3140706 - RNA, 17 nt, Mycobacterium bovis subsp bovis AF2122/97
ccggauagcaccggcac

SEQ ID NO: 3140707 - RNA, 20 nt, Mycobacterium bovis subsp bovis AF2122/97
ccggauagcgcagcucgcug

SEQ ID NO: 3140708 - RNA, 20 nt, Mycobacterium bovis subsp bovis AF2122/97
ccggauagcgucgucccagc

SEQ ID NO: 3140709 - RNA, 15 nt, Mycobacterium bovis subsp bovis AF2122/97
ccggauaggucgggc

SEQ ID NO: 3140710 - RNA, 23 nt, Mycobacterium bovis subsp bovis AF2122/97
ccggaucaccgcgcccgccgcgg

SEQ ID NO: 3140711 - RNA, 14 nt, Mycobacterium bovis subsp bovis AF2122/97
ccggaucaggaucg

SEQ ID NO: 3140712 - RNA, 16 nt, Mycobacterium bovis subsp bovis AF2122/97
ccggaucaucgccgcg

SEQ ID NO: 3140713 - RNA, 17 nt, Mycobacterium bovis subsp bovis AF2122/97
ccggaucaucgccgcgg

SEQ ID NO: 3140714 - RNA, 18 nt, Mycobacterium bovis subsp bovis AF2122/97
ccggaucaucgccgcggc

SEQ ID NO: 3140715 - RNA, 15 nt, Mycobacterium bovis subsp bovis AF2122/97
ccggaucccaccacc

SEQ ID NO: 3140716 - RNA, 18 nt, Mycobacterium bovis subsp bovis AF2122/97
ccggaucccaccaccgcu

SEQ ID NO: 3140717 - RNA, 19 nt, Mycobacterium bovis subsp bovis AF2122/97
ccggaucccaccaccgcuc

SEQ ID NO: 3140718 - RNA, 21 nt, Mycobacterium bovis subsp bovis AF2122/97
ccggaucccaccaccgcucgu

SEQ ID NO: 3140719 - RNA, 22 nt, Mycobacterium bovis subsp bovis AF2122/97
ccggaucccaccaccgcucguc

SEQ ID NO: 3140720 - RNA, 15 nt, Mycobacterium bovis subsp bovis AF2122/97
ccggauccgauccgc

SEQ ID NO: 3140721 - RNA, 17 nt, Mycobacterium bovis subsp bovis AF2122/97
ccggauccgccagaccg

SEQ ID NO: 3140722 - RNA, 14 nt, Mycobacterium bovis subsp bovis AF2122/97
ccggaucgccacgg

SEQ ID NO: 3140723 - RNA, 14 nt, Mycobacterium bovis subsp bovis AF2122/97
ccggaucgccgaau

SEQ ID NO: 3140724 - RNA, 20 nt, Mycobacterium bovis subsp bovis AF2122/97
ccggaucgccgaaucggcag

SEQ ID NO: 3140725 - RNA, 15 nt, Mycobacterium bovis subsp bovis AF2122/97
ccggaucgccgucgg

SEQ ID NO: 3140726 - RNA, 18 nt, Mycobacterium bovis subsp bovis AF2122/97
ccggaucgccgucggcgg

SEQ ID NO: 3140727 - RNA, 14 nt, Mycobacterium bovis subsp bovis AF2122/97
ccggaucgcucccg

SEQ ID NO: 3140728 - RNA, 17 nt, Mycobacterium bovis subsp bovis AF2122/97
ccggaucgcucccgucu

SEQ ID NO: 3140729 - RNA, 18 nt, Mycobacterium bovis subsp bovis AF2122/97
ccggaucgcucccgucuc

SEQ ID NO: 3140730 - RNA, 17 nt, Mycobacterium bovis subsp bovis AF2122/97
ccggaucggcuaccuaa

SEQ ID NO: 3140731 - RNA, 21 nt, Mycobacterium bovis subsp bovis AF2122/97
ccggaucggcuaccuaacccg

SEQ ID NO: 3140732 - RNA, 22 nt, Mycobacterium bovis subsp bovis AF2122/97
ccggaucggcuaccuaacccgc

SEQ ID NO: 3140733 - RNA, 14 nt, Mycobacterium bovis subsp bovis AF2122/97
ccggaucggucggc

SEQ ID NO: 3140734 - RNA, 18 nt, Mycobacterium bovis subsp bovis AF2122/97
ccggaucggucggcacca

SEQ ID NO: 3140735 - RNA, 21 nt, Mycobacterium bovis subsp bovis AF2122/97
ccggaucggucggcaccaggu

SEQ ID NO: 3140736 - RNA, 23 nt, Mycobacterium bovis subsp bovis AF2122/97
ccggaucggucggcaccagguug

SEQ ID NO: 3140737 - RNA, 19 nt, Mycobacterium bovis subsp bovis AF2122/97
ccggaucgucgaacagcac

SEQ ID NO: 3140738 - RNA, 23 nt, Mycobacterium bovis subsp bovis AF2122/97
ccggaucgucgaacagcaccgcc

SEQ ID NO: 3140739 - RNA, 23 nt, Mycobacterium bovis subsp bovis AF2122/97
ccggcacccgcggcgaaccgucu

SEQ ID NO: 3140740 - RNA, 16 nt, Mycobacterium bovis subsp bovis AF2122/97
ccggcacccgcuggcg

SEQ ID NO: 3140741 - RNA, 16 nt, Mycobacterium bovis subsp bovis AF2122/97
ccggcacccggugaga

SEQ ID NO: 3140742 - RNA, 12 nt, Mycobacterium bovis subsp bovis AF2122/97
ccggcacccguc

SEQ ID NO: 3140743 - RNA, 22 nt, Mycobacterium bovis subsp bovis AF2122/97
ccggcacccgucgggugcugau

SEQ ID NO: 3140744 - RNA, 13 nt, Mycobacterium bovis subsp bovis AF2122/97
ccggcaccgacgg

SEQ ID NO: 3140745 - RNA, 15 nt, Mycobacterium bovis subsp bovis AF2122/97
ccggcaccgcagcgg

SEQ ID NO: 3140746 - RNA, 16 nt, Mycobacterium bovis subsp bovis AF2122/97
ccggcaccgccagugc

SEQ ID NO: 3140747 - RNA, 13 nt, Mycobacterium bovis subsp bovis AF2122/97
ccggcaccgccgc

SEQ ID NO: 3140748 - RNA, 16 nt, Mycobacterium bovis subsp bovis AF2122/97
ccggcaccgccgcccc

SEQ ID NO: 3140749 - RNA, 17 nt, Mycobacterium bovis subsp bovis AF2122/97
ccggcaccgccgccccc

SEQ ID NO: 3140750 - RNA, 23 nt, Mycobacterium bovis subsp bovis AF2122/97
ccggcaccgccgcccccgccggc

SEQ ID NO: 3140751 - RNA, 16 nt, Mycobacterium bovis subsp bovis AF2122/97
ccggcaccgccggcac

SEQ ID NO: 3140752 - RNA, 21 nt, Mycobacterium bovis subsp bovis AF2122/97
ccggcaccgccggcaccgccg

SEQ ID NO: 3140753 - RNA, 16 nt, Mycobacterium bovis subsp bovis AF2122/97
ccggcaccgccggcgc

SEQ ID NO: 3140754 - RNA, 21 nt, Mycobacterium bovis subsp bovis AF2122/97
ccggcaccgccggcgcccagg

SEQ ID NO: 3140755 - RNA, 21 nt, Mycobacterium bovis subsp bovis AF2122/97
ccggcaccgccggcuccgccg

SEQ ID NO: 3140756 - RNA, 19 nt, Mycobacterium bovis subsp bovis AF2122/97
ccggcaccgccgguggcgc

SEQ ID NO: 3140757 - RNA, 12 nt, Mycobacterium bovis subsp bovis AF2122/97
ccggcaccgccu

SEQ ID NO: 3140758 - RNA, 13 nt, Mycobacterium bovis subsp bovis AF2122/97
ccggcaccgccug

SEQ ID NO: 3140759 - RNA, 19 nt, Mycobacterium bovis subsp bovis AF2122/97
ccggcaccgccugcgccgc

SEQ ID NO: 3140760 - RNA, 21 nt, Mycobacterium bovis subsp bovis AF2122/97
ccggcaccgccugcgccgccc

SEQ ID NO: 3140761 - RNA, 22 nt, Mycobacterium bovis subsp bovis AF2122/97
ccggcaccgccugcgccgcccg

SEQ ID NO: 3140762 - RNA, 16 nt, Mycobacterium bovis subsp bovis AF2122/97
ccggcaccgcugccgc

SEQ ID NO: 3140763 - RNA, 14 nt, Mycobacterium bovis subsp bovis AF2122/97
ccggcaccggccgu

SEQ ID NO: 3140764 - RNA, 17 nt, Mycobacterium bovis subsp bovis AF2122/97
ccggcaccggccgugcc

SEQ ID NO: 3140765 - RNA, 20 nt, Mycobacterium bovis subsp bovis AF2122/97
ccggcaccggggcugcccgc

SEQ ID NO: 3140766 - RNA, 22 nt, Mycobacterium bovis subsp bovis AF2122/97
ccggcaccggggcugcccgcgg

SEQ ID NO: 3140767 - RNA, 22 nt, Mycobacterium bovis subsp bovis AF2122/97
ccggcaccguagagcaugccgc

SEQ ID NO: 3140768 - RNA, 16 nt, Mycobacterium bovis subsp bovis AF2122/97
ccggcaccuccagcac

SEQ ID NO: 3140769 - RNA, 21 nt, Mycobacterium bovis subsp bovis AF2122/97
ccggcaccuccagcaccaccg

SEQ ID NO: 3140770 - RNA, 22 nt, Mycobacterium bovis subsp bovis AF2122/97
ccggcaccuccagcaccaccgg

SEQ ID NO: 3140771 - RNA, 20 nt, Mycobacterium bovis subsp bovis AF2122/97
ccggcacgaccgcucccggu

SEQ ID NO: 3140772 - RNA, 16 nt, Mycobacterium bovis subsp bovis AF2122/97
ccggcacgccgaccgg

SEQ ID NO: 3140773 - RNA, 17 nt, Mycobacterium bovis subsp bovis AF2122/97
ccggcacgccgaccggu

SEQ ID NO: 3140774 - RNA, 14 nt, Mycobacterium bovis subsp bovis AF2122/97
ccggcacgccggcg

SEQ ID NO: 3140775 - RNA, 16 nt, Mycobacterium bovis subsp bovis AF2122/97
ccggcacgccggcggc

SEQ ID NO: 3140776 - RNA, 18 nt, Mycobacterium bovis subsp bovis AF2122/97
ccggcacgccggcggcgg

SEQ ID NO: 3140777 - RNA, 13 nt, Mycobacterium bovis subsp bovis AF2122/97
ccggcacgcgcgc

SEQ ID NO: 3140778 - RNA, 12 nt, Mycobacterium bovis subsp bovis AF2122/97
ccggcacgcguc

SEQ ID NO: 3140779 - RNA, 16 nt, Mycobacterium bovis subsp bovis AF2122/97
ccggcacgggcgggga

SEQ ID NO: 3140780 - RNA, 23 nt, Mycobacterium bovis subsp bovis AF2122/97
ccggcacgggcggggacggcggc

SEQ ID NO: 3140781 - RNA, 19 nt, Mycobacterium bovis subsp bovis AF2122/97
ccggcacggugaacaaucc

SEQ ID NO: 3140782 - RNA, 14 nt, Mycobacterium bovis subsp bovis AF2122/97
ccggcacgucgacc

SEQ ID NO: 3140783 - RNA, 12 nt, Mycobacterium bovis subsp bovis AF2122/97
ccggcacugccg

SEQ ID NO: 3140784 - RNA, 13 nt, Mycobacterium bovis subsp bovis AF2122/97
ccggcacugccga

SEQ ID NO: 3140785 - RNA, 14 nt, Mycobacterium bovis subsp bovis AF2122/97
ccggcacugcggcc

SEQ ID NO: 3140786 - RNA, 17 nt, Mycobacterium bovis subsp bovis AF2122/97
ccggcacugcggccagu

SEQ ID NO: 3140787 - RNA, 18 nt, Mycobacterium bovis subsp bovis AF2122/97
ccggcacugcggccaguc

SEQ ID NO: 3140788 - RNA, 19 nt, Mycobacterium bovis subsp bovis AF2122/97
ccggcacugcggccaguca

SEQ ID NO: 3140789 - RNA, 18 nt, Mycobacterium bovis subsp bovis AF2122/97
ccggcagagcacgcgcgg

SEQ ID NO: 3140790 - RNA, 20 nt, Mycobacterium bovis subsp bovis AF2122/97
ccggcagagcacgcgcggcg

SEQ ID NO: 3140791 - RNA, 24 nt, Mycobacterium bovis subsp bovis AF2122/97
ccggcagagcacgcgcggcgucgu

SEQ ID NO: 3140792 - RNA, 16 nt, Mycobacterium bovis subsp bovis AF2122/97
ccggcagaugcagcgg

SEQ ID NO: 3140793 - RNA, 19 nt, Mycobacterium bovis subsp bovis AF2122/97
ccggcagauguguccggca

SEQ ID NO: 3140794 - RNA, 20 nt, Mycobacterium bovis subsp bovis AF2122/97
ccggcagcacguggaccggc

SEQ ID NO: 3140795 - RNA, 22 nt, Mycobacterium bovis subsp bovis AF2122/97
ccggcagcacguggaccggcac

SEQ ID NO: 3140796 - RNA, 14 nt, Mycobacterium bovis subsp bovis AF2122/97
ccggcagcaucggc

SEQ ID NO: 3140797 - RNA, 19 nt, Mycobacterium bovis subsp bovis AF2122/97
ccggcagcaucggcacccc

SEQ ID NO: 3140798 - RNA, 22 nt, Mycobacterium bovis subsp bovis AF2122/97
ccggcagcaucggcaccccggc

SEQ ID NO: 3140799 - RNA, 13 nt, Mycobacterium bovis subsp bovis AF2122/97
ccggcagcccggc

SEQ ID NO: 3140800 - RNA, 14 nt, Mycobacterium bovis subsp bovis AF2122/97
ccggcagcccggcg

SEQ ID NO: 3140801 - RNA, 16 nt, Mycobacterium bovis subsp bovis AF2122/97
ccggcagcccggcggc

SEQ ID NO: 3140802 - RNA, 19 nt, Mycobacterium bovis subsp bovis AF2122/97
ccggcagcgaugcgguguc

SEQ ID NO: 3140803 - RNA, 19 nt, Mycobacterium bovis subsp bovis AF2122/97
ccggcagcgcccccggacu

SEQ ID NO: 3140804 - RNA, 12 nt, Mycobacterium bovis subsp bovis AF2122/97
ccggcagcggcg

SEQ ID NO: 3140805 - RNA, 14 nt, Mycobacterium bovis subsp bovis AF2122/97
ccggcagcggcgag

SEQ ID NO: 3140806 - RNA, 13 nt, Mycobacterium bovis subsp bovis AF2122/97
ccggcagcggcgc

SEQ ID NO: 3140807 - RNA, 14 nt, Mycobacterium bovis subsp bovis AF2122/97
ccggcagcggcgcg

SEQ ID NO: 3140808 - RNA, 16 nt, Mycobacterium bovis subsp bovis AF2122/97
ccggcagcggcgcgcu

SEQ ID NO: 3140809 - RNA, 18 nt, Mycobacterium bovis subsp bovis AF2122/97
ccggcagcggcgcgcugc

SEQ ID NO: 3140810 - RNA, 21 nt, Mycobacterium bovis subsp bovis AF2122/97
ccggcagcggcgcgcugcacg

SEQ ID NO: 3140811 - RNA, 20 nt, Mycobacterium bovis subsp bovis AF2122/97
ccggcagcggcgcucggcgc

SEQ ID NO: 3140812 - RNA, 14 nt, Mycobacterium bovis subsp bovis AF2122/97
ccggcagcgguggc

SEQ ID NO: 3140813 - RNA, 20 nt, Mycobacterium bovis subsp bovis AF2122/97
ccggcagcgguggcaagccu

SEQ ID NO: 3140814 - RNA, 21 nt, Mycobacterium bovis subsp bovis AF2122/97
ccggcagcguccgaaccaccu

SEQ ID NO: 3140815 - RNA, 22 nt, Mycobacterium bovis subsp bovis AF2122/97
ccggcagcguccgaaccaccug

SEQ ID NO: 3140816 - RNA, 18 nt, Mycobacterium bovis subsp bovis AF2122/97
ccggcagcuuugacgccc

SEQ ID NO: 3140817 - RNA, 20 nt, Mycobacterium bovis subsp bovis AF2122/97
ccggcagcuuugacgcccuc

SEQ ID NO: 3140818 - RNA, 12 nt, Mycobacterium bovis subsp bovis AF2122/97
ccggcaggcccg

SEQ ID NO: 3140819 - RNA, 16 nt, Mycobacterium bovis subsp bovis AF2122/97
ccggcaggcccgacgg

SEQ ID NO: 3140820 - RNA, 19 nt, Mycobacterium bovis subsp bovis AF2122/97
ccggcaggcccgacggcgc

SEQ ID NO: 3140821 - RNA, 13 nt, Mycobacterium bovis subsp bovis AF2122/97
ccggcaggccggc

SEQ ID NO: 3140822 - RNA, 19 nt, Mycobacterium bovis subsp bovis AF2122/97
ccggcaggcuaaucagcca

SEQ ID NO: 3140823 - RNA, 22 nt, Mycobacterium bovis subsp bovis AF2122/97
ccggcaggcuaaucagccaggc

SEQ ID NO: 3140824 - RNA, 17 nt, Mycobacterium bovis subsp bovis AF2122/97
ccggcagguccaucugg

SEQ ID NO: 3140825 - RNA, 17 nt, Mycobacterium bovis subsp bovis AF2122/97
ccggcaguucgcggcca

SEQ ID NO: 3140826 - RNA, 14 nt, Mycobacterium bovis subsp bovis AF2122/97
ccggccagcggccc

SEQ ID NO: 3140827 - RNA, 18 nt, Mycobacterium bovis subsp bovis AF2122/97
ccggccagcuccucagcc

SEQ ID NO: 3140828 - RNA, 19 nt, Mycobacterium bovis subsp bovis AF2122/97
ccggccagcugcguggcga

SEQ ID NO: 3140829 - RNA, 19 nt, Mycobacterium bovis subsp bovis AF2122/97
ccggccaggaguuugacca

SEQ ID NO: 3140830 - RNA, 23 nt, Mycobacterium bovis subsp bovis AF2122/97
ccggccaggaguuugaccaccug

SEQ ID NO: 3140831 - RNA, 12 nt, Mycobacterium bovis subsp bovis AF2122/97
ccggccaggccg

SEQ ID NO: 3140832 - RNA, 16 nt, Mycobacterium bovis subsp bovis AF2122/97
ccggccaggccggcgg

SEQ ID NO: 3140833 - RNA, 22 nt, Mycobacterium bovis subsp bovis AF2122/97
ccggccaggccggcggcggcgc

SEQ ID NO: 3140834 - RNA, 20 nt, Mycobacterium bovis subsp bovis AF2122/97
ccggccaggcuauggugccg

SEQ ID NO: 3140835 - RNA, 18 nt, Mycobacterium bovis subsp bovis AF2122/97
ccggccaggggcgcagcg

SEQ ID NO: 3140836 - RNA, 21 nt, Mycobacterium bovis subsp bovis AF2122/97
ccggccaggggcgcagcgcgg

SEQ ID NO: 3140837 - RNA, 22 nt, Mycobacterium bovis subsp bovis AF2122/97
ccggccaggggcgcagcgcggc

SEQ ID NO: 3140838 - RNA, 17 nt, Mycobacterium bovis subsp bovis AF2122/97
ccggccagguauguccg

SEQ ID NO: 3140839 - RNA, 19 nt, Mycobacterium bovis subsp bovis AF2122/97
ccggccagguauguccgcc

SEQ ID NO: 3140840 - RNA, 20 nt, Mycobacterium bovis subsp bovis AF2122/97
ccggccagguauguccgcca

SEQ ID NO: 3140841 - RNA, 19 nt, Mycobacterium bovis subsp bovis AF2122/97
ccggccaggucgacaccgc

SEQ ID NO: 3140842 - RNA, 15 nt, Mycobacterium bovis subsp bovis AF2122/97
ccggccaggugacgu

SEQ ID NO: 3140843 - RNA, 14 nt, Mycobacterium bovis subsp bovis AF2122/97
ccggccagguguug

SEQ ID NO: 3140844 - RNA, 17 nt, Mycobacterium bovis subsp bovis AF2122/97
ccggccaguccgcgcgc

SEQ ID NO: 3140845 - RNA, 20 nt, Mycobacterium bovis subsp bovis AF2122/97
ccggccagugacaacgcgau

SEQ ID NO: 3140846 - RNA, 19 nt, Mycobacterium bovis subsp bovis AF2122/97
ccggccaucgaccguccgg

SEQ ID NO: 3140847 - RNA, 16 nt, Mycobacterium bovis subsp bovis AF2122/97
ccggccaucgcccgau

SEQ ID NO: 3140848 - RNA, 21 nt, Mycobacterium bovis subsp bovis AF2122/97
ccggccaugccuucggugccg

SEQ ID NO: 3140849 - RNA, 21 nt, Mycobacterium bovis subsp bovis AF2122/97
ccggccauggcgcgcaaccgc

SEQ ID NO: 3140850 - RNA, 17 nt, Mycobacterium bovis subsp bovis AF2122/97
ccggccaugugcacggc

SEQ ID NO: 3140851 - RNA, 14 nt, Mycobacterium bovis subsp bovis AF2122/97
ccggcccaccaggc

SEQ ID NO: 3140852 - RNA, 14 nt, Mycobacterium bovis subsp bovis AF2122/97
ccggcccaccgacg

SEQ ID NO: 3140853 - RNA, 13 nt, Mycobacterium bovis subsp bovis AF2122/97
ccggcccagaucg

SEQ ID NO: 3140854 - RNA, 15 nt, Mycobacterium bovis subsp bovis AF2122/97
ccggcccagcgcccc

SEQ ID NO: 3140855 - RNA, 20 nt, Mycobacterium bovis subsp bovis AF2122/97
ccggcccaucuucggacgcc

SEQ ID NO: 3140856 - RNA, 22 nt, Mycobacterium bovis subsp bovis AF2122/97
ccggcccaucuucggacgccag

SEQ ID NO: 3140857 - RNA, 14 nt, Mycobacterium bovis subsp bovis AF2122/97
ccggccccaccgac

SEQ ID NO: 3140858 - RNA, 16 nt, Mycobacterium bovis subsp bovis AF2122/97
ccggccccaccggcac

SEQ ID NO: 3140859 - RNA, 14 nt, Mycobacterium bovis subsp bovis AF2122/97
ccggccccaccggu

SEQ ID NO: 3140860 - RNA, 22 nt, Mycobacterium bovis subsp bovis AF2122/97
ccggccccaccgguaccgccac

SEQ ID NO: 3140861 - RNA, 16 nt, Mycobacterium bovis subsp bovis AF2122/97
ccggccccaccggugc

SEQ ID NO: 3140862 - RNA, 16 nt, Mycobacterium bovis subsp bovis AF2122/97
ccggcccccgacuccg

SEQ ID NO: 3140863 - RNA, 24 nt, Mycobacterium bovis subsp bovis AF2122/97
ccggcccccgacuccggcaggccc

SEQ ID NO: 3140864 - RNA, 22 nt, Mycobacterium bovis subsp bovis AF2122/97
ccggcccccgaggcuggcaucc

SEQ ID NO: 3140865 - RNA, 15 nt, Mycobacterium bovis subsp bovis AF2122/97
ccggcccccggucga

SEQ ID NO: 3140866 - RNA, 14 nt, Mycobacterium bovis subsp bovis AF2122/97
ccggccccgccagc

SEQ ID NO: 3140867 - RNA, 22 nt, Mycobacterium bovis subsp bovis AF2122/97
ccggccccgccagcgccgccgg

SEQ ID NO: 3140868 - RNA, 18 nt, Mycobacterium bovis subsp bovis AF2122/97
ccggccccgcccgcgcgg

SEQ ID NO: 3140869 - RNA, 16 nt, Mycobacterium bovis subsp bovis AF2122/97
ccggccccgccgaugg

SEQ ID NO: 3140870 - RNA, 14 nt, Mycobacterium bovis subsp bovis AF2122/97
ccggccccgccggc

SEQ ID NO: 3140871 - RNA, 15 nt, Mycobacterium bovis subsp bovis AF2122/97
ccggccccgccguca

SEQ ID NO: 3140872 - RNA, 16 nt, Mycobacterium bovis subsp bovis AF2122/97
ccggccccgccgucac

SEQ ID NO: 3140873 - RNA, 20 nt, Mycobacterium bovis subsp bovis AF2122/97
ccggccccgccgucaccgcc

SEQ ID NO: 3140874 - RNA, 19 nt, Mycobacterium bovis subsp bovis AF2122/97
ccggccccgccgucgccgc

SEQ ID NO: 3140875 - RNA, 17 nt, Mycobacterium bovis subsp bovis AF2122/97
ccggccccgcggccagc

SEQ ID NO: 3140876 - RNA, 19 nt, Mycobacterium bovis subsp bovis AF2122/97
ccggccccgcggccagcac

SEQ ID NO: 3140877 - RNA, 14 nt, Mycobacterium bovis subsp bovis AF2122/97
ccggccccguccga

SEQ ID NO: 3140878 - RNA, 20 nt, Mycobacterium bovis subsp bovis AF2122/97
ccggccccgucgucuagcgg

SEQ ID NO: 3140879 - RNA, 14 nt, Mycobacterium bovis subsp bovis AF2122/97
ccggcccgaggcgg

SEQ ID NO: 3140880 - RNA, 17 nt, Mycobacterium bovis subsp bovis AF2122/97
ccggcccgaucggcaac

SEQ ID NO: 3140881 - RNA, 23 nt, Mycobacterium bovis subsp bovis AF2122/97
ccggcccgaugccgaggaucgcg

SEQ ID NO: 3140882 - RNA, 17 nt, Mycobacterium bovis subsp bovis AF2122/97
ccggcccgcaacgcguc

SEQ ID NO: 3140883 - RNA, 19 nt, Mycobacterium bovis subsp bovis AF2122/97
ccggcccgcaacgcgucgg

SEQ ID NO: 3140884 - RNA, 16 nt, Mycobacterium bovis subsp bovis AF2122/97
ccggcccgcagcagca

SEQ ID NO: 3140885 - RNA, 15 nt, Mycobacterium bovis subsp bovis AF2122/97
ccggcccgcauccgc

SEQ ID NO: 3140886 - RNA, 15 nt, Mycobacterium bovis subsp bovis AF2122/97
ccggcccgccacccc

SEQ ID NO: 3140887 - RNA, 13 nt, Mycobacterium bovis subsp bovis AF2122/97
ccggcccgcgggc

SEQ ID NO: 3140888 - RNA, 21 nt, Mycobacterium bovis subsp bovis AF2122/97
ccggcccgcucagccguccgg

SEQ ID NO: 3140889 - RNA, 19 nt, Mycobacterium bovis subsp bovis AF2122/97
ccggcccggggacgcccuc

SEQ ID NO: 3140890 - RNA, 20 nt, Mycobacterium bovis subsp bovis AF2122/97
ccggcccggggacgcccucg

SEQ ID NO: 3140891 - RNA, 17 nt, Mycobacterium bovis subsp bovis AF2122/97
ccggcccgggucagcga

SEQ ID NO: 3140892 - RNA, 16 nt, Mycobacterium bovis subsp bovis AF2122/97
ccggcccggugaugaa

SEQ ID NO: 3140893 - RNA, 19 nt, Mycobacterium bovis subsp bovis AF2122/97
ccggcccguagcugcgcag

SEQ ID NO: 3140894 - RNA, 19 nt, Mycobacterium bovis subsp bovis AF2122/97
ccggcccuacgcagcgcgg

SEQ ID NO: 3140895 - RNA, 20 nt, Mycobacterium bovis subsp bovis AF2122/97
ccggcccuacgcagcgcggc

SEQ ID NO: 3140896 - RNA, 13 nt, Mycobacterium bovis subsp bovis AF2122/97
ccggcccugccgc

SEQ ID NO: 3140897 - RNA, 14 nt, Mycobacterium bovis subsp bovis AF2122/97
ccggcccugccgcc

SEQ ID NO: 3140898 - RNA, 16 nt, Mycobacterium bovis subsp bovis AF2122/97
ccggcccugccgccgg

SEQ ID NO: 3140899 - RNA, 21 nt, Mycobacterium bovis subsp bovis AF2122/97
ccggcccugccgccggccccg

SEQ ID NO: 3140900 - RNA, 12 nt, Mycobacterium bovis subsp bovis AF2122/97
ccggcccugcuc

SEQ ID NO: 3140901 - RNA, 16 nt, Mycobacterium bovis subsp bovis AF2122/97
ccggcccugcucggcc

SEQ ID NO: 3140902 - RNA, 14 nt, Mycobacterium bovis subsp bovis AF2122/97
ccggccgaacgccu

SEQ ID NO: 3140903 - RNA, 15 nt, Mycobacterium bovis subsp bovis AF2122/97
ccggccgaacgccuc

SEQ ID NO: 3140904 - RNA, 22 nt, Mycobacterium bovis subsp bovis AF2122/97
ccggccgaacgccucgccggcc

SEQ ID NO: 3140905 - RNA, 15 nt, Mycobacterium bovis subsp bovis AF2122/97
ccggccgaaggcgcu

SEQ ID NO: 3140906 - RNA, 16 nt, Mycobacterium bovis subsp bovis AF2122/97
ccggccgacacgccga

SEQ ID NO: 3140907 - RNA, 22 nt, Mycobacterium bovis subsp bovis AF2122/97
ccggccgacacgccgaugccga

SEQ ID NO: 3140908 - RNA, 13 nt, Mycobacterium bovis subsp bovis AF2122/97
ccggccgacccgg

SEQ ID NO: 3140909 - RNA, 15 nt, Mycobacterium bovis subsp bovis AF2122/97
ccggccgacccggau

SEQ ID NO: 3140910 - RNA, 19 nt, Mycobacterium bovis subsp bovis AF2122/97
ccggccgacgaacagcggu

SEQ ID NO: 3140911 - RNA, 13 nt, Mycobacterium bovis subsp bovis AF2122/97
ccggccgacgcug

SEQ ID NO: 3140912 - RNA, 14 nt, Mycobacterium bovis subsp bovis AF2122/97
ccggccgagccguu

SEQ ID NO: 3140913 - RNA, 14 nt, Mycobacterium bovis subsp bovis AF2122/97
ccggccuuggcggc

SEQ ID NO: 3140914 - RNA, 15 nt, Mycobacterium bovis subsp bovis AF2122/97
ccggccuuggcggcg

SEQ ID NO: 3140915 - RNA, 16 nt, Mycobacterium bovis subsp bovis AF2122/97
ccggccuuuacccggg

SEQ ID NO: 3140916 - RNA, 17 nt, Mycobacterium bovis subsp bovis AF2122/97
ccggccuuuacccgggc

SEQ ID NO: 3140917 - RNA, 23 nt, Mycobacterium bovis subsp bovis AF2122/97
ccggccuuuacccgggcggcggc

SEQ ID NO: 3140918 - RNA, 20 nt, Mycobacterium bovis subsp bovis AF2122/97
ccggccuuuccagcaccccg

SEQ ID NO: 3140919 - RNA, 20 nt, Mycobacterium bovis subsp bovis AF2122/97
ccggcgaaaagacugcgccg

SEQ ID NO: 3140920 - RNA, 21 nt, Mycobacterium bovis subsp bovis AF2122/97
ccggcgaaaagacugcgccgc

SEQ ID NO: 3140921 - RNA, 20 nt, Mycobacterium bovis subsp bovis AF2122/97
ccggcgaacaggcgaccggg

SEQ ID NO: 3140922 - RNA, 21 nt, Mycobacterium bovis subsp bovis AF2122/97
ccggcgaacccagcggagcca

SEQ ID NO: 3140923 - RNA, 20 nt, Mycobacterium bovis subsp bovis AF2122/97
ccggcgaaccccagcgcauc

SEQ ID NO: 3140924 - RNA, 18 nt, Mycobacterium bovis subsp bovis AF2122/97
ccggcgaacucgcgccga

SEQ ID NO: 3140925 - RNA, 22 nt, Mycobacterium bovis subsp bovis AF2122/97
ccggcgaacucgcgccgagcca

SEQ ID NO: 3140926 - RNA, 22 nt, Mycobacterium bovis subsp bovis AF2122/97
ccggcgaacugcgaucggccgc

SEQ ID NO: 3140927 - RNA, 16 nt, Mycobacterium bovis subsp bovis AF2122/97
ccggcgaagaccgccg

SEQ ID NO: 3140928 - RNA, 16 nt, Mycobacterium bovis subsp bovis AF2122/97
ccggcgaagccggccg

SEQ ID NO: 3140929 - RNA, 19 nt, Mycobacterium bovis subsp bovis AF2122/97
ccggcgaagccggccggga

SEQ ID NO: 3140930 - RNA, 18 nt, Mycobacterium bovis subsp bovis AF2122/97
ccggcgaaguuggugaca

SEQ ID NO: 3140931 - RNA, 18 nt, Mycobacterium bovis subsp bovis AF2122/97
ccggcgaauacgaccguc

SEQ ID NO: 3140932 - RNA, 21 nt, Mycobacterium bovis subsp bovis AF2122/97
ccggcgacaccgcaggugccg

SEQ ID NO: 3140933 - RNA, 13 nt, Mycobacterium bovis subsp bovis AF2122/97
ccggcgaccagga

SEQ ID NO: 3140934 - RNA, 15 nt, Mycobacterium bovis subsp bovis AF2122/97
ccggcgacccgggua

SEQ ID NO: 3140935 - RNA, 20 nt, Mycobacterium bovis subsp bovis AF2122/97
ccggcgaccggcgagcccgc

SEQ ID NO: 3140936 - RNA, 21 nt, Mycobacterium bovis subsp bovis AF2122/97
ccggcgaccggcgagcccgca

SEQ ID NO: 3140937 - RNA, 12 nt, Mycobacterium bovis subsp bovis AF2122/97
ccggcgaccggg

SEQ ID NO: 3140938 - RNA, 18 nt, Mycobacterium bovis subsp bovis AF2122/97
ccggcgaccgggccccca

SEQ ID NO: 3140939 - RNA, 17 nt, Mycobacterium bovis subsp bovis AF2122/97
ccggcgacgacccgggu

SEQ ID NO: 3140940 - RNA, 23 nt, Mycobacterium bovis subsp bovis AF2122/97
ccggcgacgacccgggucggcac

SEQ ID NO: 3140941 - RNA, 23 nt, Mycobacterium bovis subsp bovis AF2122/97
ccggcgacgaucucgccgccagc

SEQ ID NO: 3140942 - RNA, 13 nt, Mycobacterium bovis subsp bovis AF2122/97
ccggcgacgccgg

SEQ ID NO: 3140943 - RNA, 23 nt, Mycobacterium bovis subsp bovis AF2122/97
ccggcgacgccggccuuggcgau

SEQ ID NO: 3140944 - RNA, 18 nt, Mycobacterium bovis subsp bovis AF2122/97
ccggcgacgcuaccgccg

SEQ ID NO: 3140945 - RNA, 17 nt, Mycobacterium bovis subsp bovis AF2122/97
ccggcgacggcguagcc

SEQ ID NO: 3140946 - RNA, 16 nt, Mycobacterium bovis subsp bovis AF2122/97
ccggcgacgggucggg

SEQ ID NO: 3140947 - RNA, 22 nt, Mycobacterium bovis subsp bovis AF2122/97
ccggcgacgggucgggcaaccu

SEQ ID NO: 3140948 - RNA, 15 nt, Mycobacterium bovis subsp bovis AF2122/97
ccggcgacugcagcg

SEQ ID NO: 3140949 - RNA, 23 nt, Mycobacterium bovis subsp bovis AF2122/97
ccggcgagagcgucaaccacggc

SEQ ID NO: 3140950 - RNA, 15 nt, Mycobacterium bovis subsp bovis AF2122/97
ccggcgagcacccgc

SEQ ID NO: 3140951 - RNA, 18 nt, Mycobacterium bovis subsp bovis AF2122/97
ccggcgagcacccgcugg

SEQ ID NO: 3140952 - RNA, 18 nt, Mycobacterium bovis subsp bovis AF2122/97
ccggcgagcagacgcaua

SEQ ID NO: 3140953 - RNA, 14 nt, Mycobacterium bovis subsp bovis AF2122/97
ccggcgagcaggcc

SEQ ID NO: 3140954 - RNA, 15 nt, Mycobacterium bovis subsp bovis AF2122/97
ccggcgagcagggcg

SEQ ID NO: 3140955 - RNA, 15 nt, Mycobacterium bovis subsp bovis AF2122/97
ccggcgagcccgcau

SEQ ID NO: 3140956 - RNA, 20 nt, Mycobacterium bovis subsp bovis AF2122/97
ccggcgagggcgcggauacg

SEQ ID NO: 3140957 - RNA, 23 nt, Mycobacterium bovis subsp bovis AF2122/97
ccggcgagggugagcauggcuag

SEQ ID NO: 3140958 - RNA, 19 nt, Mycobacterium bovis subsp bovis AF2122/97
ccggcgagugcugucgucu

SEQ ID NO: 3140959 - RNA, 22 nt, Mycobacterium bovis subsp bovis AF2122/97
ccggcgagugguccagccagau

SEQ ID NO: 3140960 - RNA, 21 nt, Mycobacterium bovis subsp bovis AF2122/97
ccggcgaucgggcgggugaac

SEQ ID NO: 3140961 - RNA, 13 nt, Mycobacterium bovis subsp bovis AF2122/97
ccggcgaugagca

SEQ ID NO: 3140962 - RNA, 21 nt, Mycobacterium bovis subsp bovis AF2122/97
ccggcgaugagcaugcccagc

SEQ ID NO: 3140963 - RNA, 21 nt, Mycobacterium bovis subsp bovis AF2122/97
ccggcgauuaccggcacgccg

SEQ ID NO: 3140964 - RNA, 16 nt, Mycobacterium bovis subsp bovis AF2122/97
ccggcgcaagcgccgc

SEQ ID NO: 3140965 - RNA, 22 nt, Mycobacterium bovis subsp bovis AF2122/97
ccggcgcacaaacauacgccac

SEQ ID NO: 3140966 - RNA, 22 nt, Mycobacterium bovis subsp bovis AF2122/97
ccggcgcaccggagucgcccgg

SEQ ID NO: 3140967 - RNA, 14 nt, Mycobacterium bovis subsp bovis AF2122/97
ccggcgcaccuggg

SEQ ID NO: 3140968 - RNA, 17 nt, Mycobacterium bovis subsp bovis AF2122/97
ccggcgcaccugggcug

SEQ ID NO: 3140969 - RNA, 22 nt, Mycobacterium bovis subsp bovis AF2122/97
ccggcgcaccugggcugccggc

SEQ ID NO: 3140970 - RNA, 15 nt, Mycobacterium bovis subsp bovis AF2122/97
ccggcgcagcgaccg

SEQ ID NO: 3140971 - RNA, 11 nt, Mycobacterium bovis subsp bovis AF2122/97
ccggcgcagcu

SEQ ID NO: 3140972 - RNA, 16 nt, Mycobacterium bovis subsp bovis AF2122/97
ccggcgcagcugccga

SEQ ID NO: 3140973 - RNA, 16 nt, Mycobacterium bovis subsp bovis AF2122/97
ccggcgcagguucucg

SEQ ID NO: 3140974 - RNA, 19 nt, Mycobacterium bovis subsp bovis AF2122/97
ccggcgcaguagccgacca

SEQ ID NO: 3140975 - RNA, 21 nt, Mycobacterium bovis subsp bovis AF2122/97
ccggcgcaguagccgaccagg

SEQ ID NO: 3140976 - RNA, 22 nt, Mycobacterium bovis subsp bovis AF2122/97
ccggcgcaguagccgaccagga

SEQ ID NO: 3140977 - RNA, 23 nt, Mycobacterium bovis subsp bovis AF2122/97
ccggcgcaguagccgaccaggac

SEQ ID NO: 3140978 - RNA, 18 nt, Mycobacterium bovis subsp bovis AF2122/97
ccggcgcagugcagguca

SEQ ID NO: 3140979 - RNA, 24 nt, Mycobacterium bovis subsp bovis AF2122/97
ccggcgcauucccuugucggucga

SEQ ID NO: 3140980 - RNA, 13 nt, Mycobacterium bovis subsp bovis AF2122/97
ccggcgccacccc

SEQ ID NO: 3140981 - RNA, 20 nt, Mycobacterium bovis subsp bovis AF2122/97
ccggcgccacccgcgccgcc

SEQ ID NO: 3140982 - RNA, 13 nt, Mycobacterium bovis subsp bovis AF2122/97
ccggcgccaccgc

SEQ ID NO: 3140983 - RNA, 16 nt, Mycobacterium bovis subsp bovis AF2122/97
ccggcgccaccgccgc

SEQ ID NO: 3140984 - RNA, 17 nt, Mycobacterium bovis subsp bovis AF2122/97
ccggcgccaccgccgcu

SEQ ID NO: 3140985 - RNA, 20 nt, Mycobacterium bovis subsp bovis AF2122/97
ccggcgccaccgccgcugcc

SEQ ID NO: 3140986 - RNA, 21 nt, Mycobacterium bovis subsp bovis AF2122/97
ccggcgccaccgccgcugccg

SEQ ID NO: 3140987 - RNA, 14 nt, Mycobacterium bovis subsp bovis AF2122/97
ccggcgccaccggc

SEQ ID NO: 3140988 - RNA, 15 nt, Mycobacterium bovis subsp bovis AF2122/97
ccggcgccaccggcg

SEQ ID NO: 3140989 - RNA, 18 nt, Mycobacterium bovis subsp bovis AF2122/97
ccggcgccaccggcgccg

SEQ ID NO: 3140990 - RNA, 19 nt, Mycobacterium bovis subsp bovis AF2122/97
ccggcgccaccggcgccgc

SEQ ID NO: 3140991 - RNA, 22 nt, Mycobacterium bovis subsp bovis AF2122/97
ccggcgccaccggcgccgcccg

SEQ ID NO: 3140992 - RNA, 13 nt, Mycobacterium bovis subsp bovis AF2122/97
ccggcgccaccgu

SEQ ID NO: 3140993 - RNA, 17 nt, Mycobacterium bovis subsp bovis AF2122/97
ccggcgccaccgucacc

SEQ ID NO: 3140994 - RNA, 20 nt, Mycobacterium bovis subsp bovis AF2122/97
ccggcgccaccgucaccgcc

SEQ ID NO: 3140995 - RNA, 21 nt, Mycobacterium bovis subsp bovis AF2122/97
ccggcgccaccgucaccgccg

SEQ ID NO: 3140996 - RNA, 16 nt, Mycobacterium bovis subsp bovis AF2122/97
ccggcgccaccgucgc

SEQ ID NO: 3140997 - RNA, 17 nt, Mycobacterium bovis subsp bovis AF2122/97
ccggcgccaccgucgcc

SEQ ID NO: 3140998 - RNA, 18 nt, Mycobacterium bovis subsp bovis AF2122/97
ccggcgccaccgucgccg

SEQ ID NO: 3140999 - RNA, 15 nt, Mycobacterium bovis subsp bovis AF2122/97
ccggcgcggucucgg

SEQ ID NO: 3141000 - RNA, 13 nt, Mycobacterium bovis subsp bovis AF2122/97
ccggcgcgguggc

SEQ ID NO: 3141001 - RNA, 21 nt, Mycobacterium bovis subsp bovis AF2122/97
ccggcgcgguggccccgaugg

SEQ ID NO: 3141002 - RNA, 19 nt, Mycobacterium bovis subsp bovis AF2122/97
ccggcgcguuccaucaggg

SEQ ID NO: 3141003 - RNA, 22 nt, Mycobacterium bovis subsp bovis AF2122/97
ccggcgcguuccaucagggccu

SEQ ID NO: 3141004 - RNA, 16 nt, Mycobacterium bovis subsp bovis AF2122/97
ccggcgcuagcgccgc

SEQ ID NO: 3141005 - RNA, 18 nt, Mycobacterium bovis subsp bovis AF2122/97
ccggcgcuccacugacca

SEQ ID NO: 3141006 - RNA, 20 nt, Mycobacterium bovis subsp bovis AF2122/97
ccggcgcuccacugaccagg

SEQ ID NO: 3141007 - RNA, 22 nt, Mycobacterium bovis subsp bovis AF2122/97
ccggcgcuccacugaccagguc

SEQ ID NO: 3141008 - RNA, 23 nt, Mycobacterium bovis subsp bovis AF2122/97
ccggcgcuccacugaccaggucu

SEQ ID NO: 3141009 - RNA, 13 nt, Mycobacterium bovis subsp bovis AF2122/97
ccggcgcuccgcc

SEQ ID NO: 3141010 - RNA, 20 nt, Mycobacterium bovis subsp bovis AF2122/97
ccggcgcucgcggcggcgcu

SEQ ID NO: 3141011 - RNA, 16 nt, Mycobacterium bovis subsp bovis AF2122/97
ccggcgcugcccgggc

SEQ ID NO: 3141012 - RNA, 16 nt, Mycobacterium bovis subsp bovis AF2122/97
ccggcgcugcugccau

SEQ ID NO: 3141013 - RNA, 20 nt, Mycobacterium bovis subsp bovis AF2122/97
ccggcgcugcugccauugcc

SEQ ID NO: 3141014 - RNA, 18 nt, Mycobacterium bovis subsp bovis AF2122/97
ccggcgcuggcguggcca

SEQ ID NO: 3141015 - RNA, 16 nt, Mycobacterium bovis subsp bovis AF2122/97
ccggcgcuuccgcugg

SEQ ID NO: 3141016 - RNA, 23 nt, Mycobacterium bovis subsp bovis AF2122/97
ccggcggaaauggcgucgccggc

SEQ ID NO: 3141017 - RNA, 21 nt, Mycobacterium bovis subsp bovis AF2122/97
ccggcggacaccucgggcgcc

SEQ ID NO: 3141018 - RNA, 17 nt, Mycobacterium bovis subsp bovis AF2122/97
ccggcggacgacgucgg

SEQ ID NO: 3141019 - RNA, 16 nt, Mycobacterium bovis subsp bovis AF2122/97
ccggcggacgcccggc

SEQ ID NO: 3141020 - RNA, 18 nt, Mycobacterium bovis subsp bovis AF2122/97
ccggcggacgcccggcgc

SEQ ID NO: 3141021 - RNA, 22 nt, Mycobacterium bovis subsp bovis AF2122/97
ccggcggacgcccggcgcacca

SEQ ID NO: 3141022 - RNA, 16 nt, Mycobacterium bovis subsp bovis AF2122/97
ccggcggagcgggcca

SEQ ID NO: 3141023 - RNA, 19 nt, Mycobacterium bovis subsp bovis AF2122/97
ccggcggagcgggccagca

SEQ ID NO: 3141024 - RNA, 23 nt, Mycobacterium bovis subsp bovis AF2122/97
ccggcggagcgggccagcacccg

SEQ ID NO: 3141025 - RNA, 17 nt, Mycobacterium bovis subsp bovis AF2122/97
ccggcggaucugaucgg

SEQ ID NO: 3141026 - RNA, 15 nt, Mycobacterium bovis subsp bovis AF2122/97
ccggcggauucggcg

SEQ ID NO: 3141027 - RNA, 21 nt, Mycobacterium bovis subsp bovis AF2122/97
ccggcggcaaacacugcggcc

SEQ ID NO: 3141028 - RNA, 22 nt, Mycobacterium bovis subsp bovis AF2122/97
ccggcggcaaagaacagccggc

SEQ ID NO: 3141029 - RNA, 12 nt, Mycobacterium bovis subsp bovis AF2122/97
ccggcggcagcg

SEQ ID NO: 3141030 - RNA, 17 nt, Mycobacterium bovis subsp bovis AF2122/97
ccggcggcagcggcgcc

SEQ ID NO: 3141031 - RNA, 23 nt, Mycobacterium bovis subsp bovis AF2122/97
ccggcggcagcggcgccgccugg

SEQ ID NO: 3141032 - RNA, 12 nt, Mycobacterium bovis subsp bovis AF2122/97
ccggcggcaggu

SEQ ID NO: 3141033 - RNA, 14 nt, Mycobacterium bovis subsp bovis AF2122/97
ccggcggcagguag

SEQ ID NO: 3141034 - RNA, 21 nt, Mycobacterium bovis subsp bovis AF2122/97
ccggcggcaucgaguucggcc

SEQ ID NO: 3141035 - RNA, 14 nt, Mycobacterium bovis subsp bovis AF2122/97
ccggcggccacgcc

SEQ ID NO: 3141036 - RNA, 15 nt, Mycobacterium bovis subsp bovis AF2122/97
ccggcggccacgccg

SEQ ID NO: 3141037 - RNA, 17 nt, Mycobacterium bovis subsp bovis AF2122/97
ccggcggccacgccggc

SEQ ID NO: 3141038 - RNA, 13 nt, Mycobacterium bovis subsp bovis AF2122/97
ccggcggccaucc

SEQ ID NO: 3141039 - RNA, 17 nt, Mycobacterium bovis subsp bovis AF2122/97
ccggcggccaucccgcg

SEQ ID NO: 3141040 - RNA, 18 nt, Mycobacterium bovis subsp bovis AF2122/97
ccggcggccauggugagu

SEQ ID NO: 3141041 - RNA, 15 nt, Mycobacterium bovis subsp bovis AF2122/97
ccggcggccccaggg

SEQ ID NO: 3141042 - RNA, 13 nt, Mycobacterium bovis subsp bovis AF2122/97
ccggcggcccgau

SEQ ID NO: 3141043 - RNA, 13 nt, Mycobacterium bovis subsp bovis AF2122/97
ccggcggcccgcu

SEQ ID NO: 3141044 - RNA, 14 nt, Mycobacterium bovis subsp bovis AF2122/97
ccggcggcccgcuc

SEQ ID NO: 3141045 - RNA, 15 nt, Mycobacterium bovis subsp bovis AF2122/97
ccggcggcccgcucg

SEQ ID NO: 3141046 - RNA, 12 nt, Mycobacterium bovis subsp bovis AF2122/97
ccggcggccgcc

SEQ ID NO: 3141047 - RNA, 13 nt, Mycobacterium bovis subsp bovis AF2122/97
ccggcggccgcca

SEQ ID NO: 3141048 - RNA, 14 nt, Mycobacterium bovis subsp bovis AF2122/97
ccggcggccgccau

SEQ ID NO: 3141049 - RNA, 18 nt, Mycobacterium bovis subsp bovis AF2122/97
ccggcggccgccaucagc

SEQ ID NO: 3141050 - RNA, 20 nt, Mycobacterium bovis subsp bovis AF2122/97
ccggcggccgccaucagccg

SEQ ID NO: 3141051 - RNA, 18 nt, Mycobacterium bovis subsp bovis AF2122/97
ccggcggccgcggugccc

SEQ ID NO: 3141052 - RNA, 21 nt, Mycobacterium bovis subsp bovis AF2122/97
ccggcggcgaagaagccggca

SEQ ID NO: 3141053 - RNA, 15 nt, Mycobacterium bovis subsp bovis AF2122/97
ccggcggcgaccaga

SEQ ID NO: 3141054 - RNA, 16 nt, Mycobacterium bovis subsp bovis AF2122/97
ccggcggcgacggcgg

SEQ ID NO: 3141055 - RNA, 17 nt, Mycobacterium bovis subsp bovis AF2122/97
ccggcggcgacggcggc

SEQ ID NO: 3141056 - RNA, 19 nt, Mycobacterium bovis subsp bovis AF2122/97
ccggcggcgacggcggcac

SEQ ID NO: 3141057 - RNA, 15 nt, Mycobacterium bovis subsp bovis AF2122/97
ccggcggcgacggug

SEQ ID NO: 3141058 - RNA, 16 nt, Mycobacterium bovis subsp bovis AF2122/97
ccggcggcgacggugc

SEQ ID NO: 3141059 - RNA, 19 nt, Mycobacterium bovis subsp bovis AF2122/97
ccggcggcgacggugccac

SEQ ID NO: 3141060 - RNA, 22 nt, Mycobacterium bovis subsp bovis AF2122/97
ccggcggcgacggugccaccgc

SEQ ID NO: 3141061 - RNA, 14 nt, Mycobacterium bovis subsp bovis AF2122/97
ccggcggcgagcgg

SEQ ID NO: 3141062 - RNA, 18 nt, Mycobacterium bovis subsp bovis AF2122/97
ccggcggcgagcggccuc

SEQ ID NO: 3141063 - RNA, 23 nt, Mycobacterium bovis subsp bovis AF2122/97
ccggcggcgagcggccuccagca

SEQ ID NO: 3141064 - RNA, 15 nt, Mycobacterium bovis subsp bovis AF2122/97
ccggcggcgcaucac

SEQ ID NO: 3141065 - RNA, 20 nt, Mycobacterium bovis subsp bovis AF2122/97
ccggcggcgcaucaccuccg

SEQ ID NO: 3141066 - RNA, 11 nt, Mycobacterium bovis subsp bovis AF2122/97
ccggcggcgcc

SEQ ID NO: 3141067 - RNA, 21 nt, Mycobacterium bovis subsp bovis AF2122/97
ccggcggcgcccaucgcgacg

SEQ ID NO: 3141068 - RNA, 23 nt, Mycobacterium bovis subsp bovis AF2122/97
ccggcggcgcccaucgcgacggc

SEQ ID NO: 3141069 - RNA, 19 nt, Mycobacterium bovis subsp bovis AF2122/97
ccggcggcgccggaggcgg

SEQ ID NO: 3141070 - RNA, 15 nt, Mycobacterium bovis subsp bovis AF2122/97
ccggcggcgccgggg

SEQ ID NO: 3141071 - RNA, 14 nt, Mycobacterium bovis subsp bovis AF2122/97
ccggcggcgcgccc

SEQ ID NO: 3141072 - RNA, 19 nt, Mycobacterium bovis subsp bovis AF2122/97
ccggcggcggaggcuucga

SEQ ID NO: 3141073 - RNA, 13 nt, Mycobacterium bovis subsp bovis AF2122/97
ccggcggcggcca

SEQ ID NO: 3141074 - RNA, 14 nt, Mycobacterium bovis subsp bovis AF2122/97
ccggcggcggccgc

SEQ ID NO: 3141075 - RNA, 15 nt, Mycobacterium bovis subsp bovis AF2122/97
ccggcggcggccgca

SEQ ID NO: 3141076 - RNA, 22 nt, Mycobacterium bovis subsp bovis AF2122/97
ccggcggcggccgcagcggcca

SEQ ID NO: 3141077 - RNA, 12 nt, Mycobacterium bovis subsp bovis AF2122/97
ccggcggcggcg

SEQ ID NO: 3141078 - RNA, 14 nt, Mycobacterium bovis subsp bovis AF2122/97
ccggcggcggcgcu

SEQ ID NO: 3141079 - RNA, 14 nt, Mycobacterium bovis subsp bovis AF2122/97
ccggcggcggugcg

SEQ ID NO: 3141080 - RNA, 15 nt, Mycobacterium bovis subsp bovis AF2122/97
ccggcggcggugcgc

SEQ ID NO: 3141081 - RNA, 20 nt, Mycobacterium bovis subsp bovis AF2122/97
ccggcggcggugcgccccgc

SEQ ID NO: 3141082 - RNA, 22 nt, Mycobacterium bovis subsp bovis AF2122/97
ccggcggcggugguaccggcgc

SEQ ID NO: 3141083 - RNA, 21 nt, Mycobacterium bovis subsp bovis AF2122/97
ccggcggcucgggugcgcccg

SEQ ID NO: 3141084 - RNA, 18 nt, Mycobacterium bovis subsp bovis AF2122/97
ccggcgggaccgagaacu

SEQ ID NO: 3141085 - RNA, 22 nt, Mycobacterium bovis subsp bovis AF2122/97
ccggcgggaccgagaacugcuc

SEQ ID NO: 3141086 - RNA, 20 nt, Mycobacterium bovis subsp bovis AF2122/97
ccggcguucccgccauugcc

SEQ ID NO: 3141087 - RNA, 16 nt, Mycobacterium bovis subsp bovis AF2122/97
ccggcguugccgaaac

SEQ ID NO: 3141088 - RNA, 14 nt, Mycobacterium bovis subsp bovis AF2122/97
ccggcguugccgcc

SEQ ID NO: 3141089 - RNA, 19 nt, Mycobacterium bovis subsp bovis AF2122/97
ccggcguugccgccguccc

SEQ ID NO: 3141090 - RNA, 21 nt, Mycobacterium bovis subsp bovis AF2122/97
ccggcguugccgccguccccg

SEQ ID NO: 3141091 - RNA, 19 nt, Mycobacterium bovis subsp bovis AF2122/97
ccggcguugccgccguucc

SEQ ID NO: 3141092 - RNA, 20 nt, Mycobacterium bovis subsp bovis AF2122/97
ccggcguugccgccguuccc

SEQ ID NO: 3141093 - RNA, 14 nt, Mycobacterium bovis subsp bovis AF2122/97
ccggcguuggccau

SEQ ID NO: 3141094 - RNA, 22 nt, Mycobacterium bovis subsp bovis AF2122/97
ccggcguuguaguugcccacgu

SEQ ID NO: 3141095 - RNA, 16 nt, Mycobacterium bovis subsp bovis AF2122/97
ccggcguuugggcauc

SEQ ID NO: 3141096 - RNA, 20 nt, Mycobacterium bovis subsp bovis AF2122/97
ccggcuaccgccuugucggc

SEQ ID NO: 3141097 - RNA, 12 nt, Mycobacterium bovis subsp bovis AF2122/97
ccggcuaccgcg

SEQ ID NO: 3141098 - RNA, 14 nt, Mycobacterium bovis subsp bovis AF2122/97
ccggcuaccggcgu

SEQ ID NO: 3141099 - RNA, 14 nt, Mycobacterium bovis subsp bovis AF2122/97
ccggcuacgacggc

SEQ ID NO: 3141100 - RNA, 17 nt, Mycobacterium bovis subsp bovis AF2122/97
ccggcuacgacggcgcc

SEQ ID NO: 3141101 - RNA, 19 nt, Mycobacterium bovis subsp bovis AF2122/97
ccggcuacgacggcgccau

SEQ ID NO: 3141102 - RNA, 23 nt, Mycobacterium bovis subsp bovis AF2122/97
ccggcuacggcgacacgccagcc

SEQ ID NO: 3141103 - RNA, 22 nt, Mycobacterium bovis subsp bovis AF2122/97
ccggcuagauaacccaaccgcg

SEQ ID NO: 3141104 - RNA, 14 nt, Mycobacterium bovis subsp bovis AF2122/97
ccggcuagcucggc

SEQ ID NO: 3141105 - RNA, 18 nt, Mycobacterium bovis subsp bovis AF2122/97
ccggcuagcucggcggcu

SEQ ID NO: 3141106 - RNA, 21 nt, Mycobacterium bovis subsp bovis AF2122/97
ccggcuagggcagcagcccgg

SEQ ID NO: 3141107 - RNA, 23 nt, Mycobacterium bovis subsp bovis AF2122/97
ccggcuagggcagcagcccgggc

SEQ ID NO: 3141108 - RNA, 17 nt, Mycobacterium bovis subsp bovis AF2122/97
ccggcuauaucccgccc

SEQ ID NO: 3141109 - RNA, 18 nt, Mycobacterium bovis subsp bovis AF2122/97
ccggcuauaucccgcccc

SEQ ID NO: 3141110 - RNA, 17 nt, Mycobacterium bovis subsp bovis AF2122/97
ccggcuaugcuggcgca

SEQ ID NO: 3141111 - RNA, 19 nt, Mycobacterium bovis subsp bovis AF2122/97
ccggcuaugcuggcgcagc

SEQ ID NO: 3141112 - RNA, 14 nt, Mycobacterium bovis subsp bovis AF2122/97
ccggcucaacaccg

SEQ ID NO: 3141113 - RNA, 18 nt, Mycobacterium bovis subsp bovis AF2122/97
ccggcucaaggacgcacc

SEQ ID NO: 3141114 - RNA, 23 nt, Mycobacterium bovis subsp bovis AF2122/97
ccggcucaaggacgcaccgccag

SEQ ID NO: 3141115 - RNA, 21 nt, Mycobacterium bovis subsp bovis AF2122/97
ccggcucaccacgccggucga

SEQ ID NO: 3141116 - RNA, 23 nt, Mycobacterium bovis subsp bovis AF2122/97
ccggcucaggggcuacuaggccc

SEQ ID NO: 3141117 - RNA, 18 nt, Mycobacterium bovis subsp bovis AF2122/97
ccggcucagucacgcacu

SEQ ID NO: 3141118 - RNA, 16 nt, Mycobacterium bovis subsp bovis AF2122/97
ccggcucauccgacgg

SEQ ID NO: 3141119 - RNA, 18 nt, Mycobacterium bovis subsp bovis AF2122/97
ccggcuccagcaugggcg

SEQ ID NO: 3141120 - RNA, 20 nt, Mycobacterium bovis subsp bovis AF2122/97
ccggcucccgggggcacucc

SEQ ID NO: 3141121 - RNA, 17 nt, Mycobacterium bovis subsp bovis AF2122/97
ccggcuccgccacuggc

SEQ ID NO: 3141122 - RNA, 12 nt, Mycobacterium bovis subsp bovis AF2122/97
ccggcuccgccg

SEQ ID NO: 3141123 - RNA, 16 nt, Mycobacterium bovis subsp bovis AF2122/97
ccggcuccgccguuga

SEQ ID NO: 3141124 - RNA, 17 nt, Mycobacterium bovis subsp bovis AF2122/97
ccggcuccgccguugac

SEQ ID NO: 3141125 - RNA, 23 nt, Mycobacterium bovis subsp bovis AF2122/97
ccggcuccgccguugccgccgcc

SEQ ID NO: 3141126 - RNA, 20 nt, Mycobacterium bovis subsp bovis AF2122/97
ccggcuccuccccggcccgc

SEQ ID NO: 3141127 - RNA, 21 nt, Mycobacterium bovis subsp bovis AF2122/97
ccggcuccuccccggcccgcu

SEQ ID NO: 3141128 - RNA, 21 nt, Mycobacterium bovis subsp bovis AF2122/97
ccggcucgacgcgucgccggc

SEQ ID NO: 3141129 - RNA, 16 nt, Mycobacterium bovis subsp bovis AF2122/97
ccggcucgagcucggc

SEQ ID NO: 3141130 - RNA, 14 nt, Mycobacterium bovis subsp bovis AF2122/97
ccggcucgccgacc

SEQ ID NO: 3141131 - RNA, 20 nt, Mycobacterium bovis subsp bovis AF2122/97
ccggcucgccgacccgccgc

SEQ ID NO: 3141132 - RNA, 12 nt, Mycobacterium bovis subsp bovis AF2122/97
ccggcucgccgg

SEQ ID NO: 3141133 - RNA, 13 nt, Mycobacterium bovis subsp bovis AF2122/97
ccggcucgccggc

SEQ ID NO: 3141134 - RNA, 16 nt, Mycobacterium bovis subsp bovis AF2122/97
ccggcucggaaaccgc

SEQ ID NO: 3141135 - RNA, 19 nt, Mycobacterium bovis subsp bovis AF2122/97
ccggcucggaaaccgcccc

SEQ ID NO: 3141136 - RNA, 20 nt, Mycobacterium bovis subsp bovis AF2122/97
ccggcucggaaaccgccccg

SEQ ID NO: 3141137 - RNA, 13 nt, Mycobacterium bovis subsp bovis AF2122/97
ccggcucggccag

SEQ ID NO: 3141138 - RNA, 14 nt, Mycobacterium bovis subsp bovis AF2122/97
ccggcucggccagc

SEQ ID NO: 3141139 - RNA, 15 nt, Mycobacterium bovis subsp bovis AF2122/97
ccggcucggccagcc

SEQ ID NO: 3141140 - RNA, 21 nt, Mycobacterium bovis subsp bovis AF2122/97
ccggcucggccagccagcggg

SEQ ID NO: 3141141 - RNA, 14 nt, Mycobacterium bovis subsp bovis AF2122/97
ccggcucggugcgc

SEQ ID NO: 3141142 - RNA, 13 nt, Mycobacterium bovis subsp bovis AF2122/97
ccggcucguccgg

SEQ ID NO: 3141143 - RNA, 16 nt, Mycobacterium bovis subsp bovis AF2122/97
ccggcucguccgggca

SEQ ID NO: 3141144 - RNA, 15 nt, Mycobacterium bovis subsp bovis AF2122/97
ccggcucuccgguga

SEQ ID NO: 3141145 - RNA, 18 nt, Mycobacterium bovis subsp bovis AF2122/97
ccggcucucuucgcgcgc

SEQ ID NO: 3141146 - RNA, 20 nt, Mycobacterium bovis subsp bovis AF2122/97
ccggcucuuuuucgaucgcu

SEQ ID NO: 3141147 - RNA, 17 nt, Mycobacterium bovis subsp bovis AF2122/97
ccggcugaccgacccgg

SEQ ID NO: 3141148 - RNA, 19 nt, Mycobacterium bovis subsp bovis AF2122/97
ccggcugaccgacccggac

SEQ ID NO: 3141149 - RNA, 12 nt, Mycobacterium bovis subsp bovis AF2122/97
ccggcugaccgg

SEQ ID NO: 3141150 - RNA, 20 nt, Mycobacterium bovis subsp bovis AF2122/97
ccggcugaccggggcgcccg

SEQ ID NO: 3141151 - RNA, 21 nt, Mycobacterium bovis subsp bovis AF2122/97
ccggcugacgaccaaccaccg

SEQ ID NO: 3141152 - RNA, 18 nt, Mycobacterium bovis subsp bovis AF2122/97
ccggcugcaaccagcggc

SEQ ID NO: 3141153 - RNA, 20 nt, Mycobacterium bovis subsp bovis AF2122/97
ccggcugcaaccagcggcac

SEQ ID NO: 3141154 - RNA, 15 nt, Mycobacterium bovis subsp bovis AF2122/97
ccggcugccacacag

SEQ ID NO: 3141155 - RNA, 18 nt, Mycobacterium bovis subsp bovis AF2122/97
ccggcugccagcgccgcc

SEQ ID NO: 3141156 - RNA, 19 nt, Mycobacterium bovis subsp bovis AF2122/97
ccggcugccagcgccgccg

SEQ ID NO: 3141157 - RNA, 20 nt, Mycobacterium bovis subsp bovis AF2122/97
ccggcugccagcgccgccgc

SEQ ID NO: 3141158 - RNA, 22 nt, Mycobacterium bovis subsp bovis AF2122/97
ccggcugccagcgccgccgccg

SEQ ID NO: 3141159 - RNA, 19 nt, Mycobacterium bovis subsp bovis AF2122/97
ccggcugccgucagcugac

SEQ ID NO: 3141160 - RNA, 19 nt, Mycobacterium bovis subsp bovis AF2122/97
ccggcugcggaucacagug

SEQ ID NO: 3141161 - RNA, 21 nt, Mycobacterium bovis subsp bovis AF2122/97
ccggcugcgggaagacgucgg

SEQ ID NO: 3141162 - RNA, 23 nt, Mycobacterium bovis subsp bovis AF2122/97
ccggcugcuuuaaccgcgucauc

SEQ ID NO: 3141163 - RNA, 17 nt, Mycobacterium bovis subsp bovis AF2122/97
ccggcuggaagcggcga

SEQ ID NO: 3141164 - RNA, 14 nt, Mycobacterium bovis subsp bovis AF2122/97
ccggcuggcccacc

SEQ ID NO: 3141165 - RNA, 22 nt, Mycobacterium bovis subsp bovis AF2122/97
ccggcuggcccaccuccucgcc

SEQ ID NO: 3141166 - RNA, 20 nt, Mycobacterium bovis subsp bovis AF2122/97
ccggcuggcggcguggcgcc

SEQ ID NO: 3141167 - RNA, 19 nt, Mycobacterium bovis subsp bovis AF2122/97
ccggcugggcgccaccauc

SEQ ID NO: 3141168 - RNA, 20 nt, Mycobacterium bovis subsp bovis AF2122/97
ccggcuggugccaacugcgc

SEQ ID NO: 3141169 - RNA, 19 nt, Mycobacterium bovis subsp bovis AF2122/97
ccggcuggugggacgcggc

SEQ ID NO: 3141170 - RNA, 21 nt, Mycobacterium bovis subsp bovis AF2122/97
ccggcuggugggacgcggccg

SEQ ID NO: 3141171 - RNA, 22 nt, Mycobacterium bovis subsp bovis AF2122/97
ccggcugguugaccgaguugaa

SEQ ID NO: 3141172 - RNA, 19 nt, Mycobacterium bovis subsp bovis AF2122/97
ccgggauggcucacccagg

SEQ ID NO: 3141173 - RNA, 21 nt, Mycobacterium bovis subsp bovis AF2122/97
ccgggauggcucacccaggcg

SEQ ID NO: 3141174 - RNA, 23 nt, Mycobacterium bovis subsp bovis AF2122/97
ccgggaugggagccacugcggca

SEQ ID NO: 3141175 - RNA, 18 nt, Mycobacterium bovis subsp bovis AF2122/97
ccgggaugugcggcugca

SEQ ID NO: 3141176 - RNA, 17 nt, Mycobacterium bovis subsp bovis AF2122/97
ccgggauuaugccggca

SEQ ID NO: 3141177 - RNA, 15 nt, Mycobacterium bovis subsp bovis AF2122/97
ccgggauugccgcca

SEQ ID NO: 3141178 - RNA, 17 nt, Mycobacterium bovis subsp bovis AF2122/97
ccgggauugccgccacc

SEQ ID NO: 3141179 - RNA, 16 nt, Mycobacterium bovis subsp bovis AF2122/97
ccgggauugccgucgg

SEQ ID NO: 3141180 - RNA, 21 nt, Mycobacterium bovis subsp bovis AF2122/97
ccgggcaaaucaagcacagcc

SEQ ID NO: 3141181 - RNA, 22 nt, Mycobacterium bovis subsp bovis AF2122/97
ccgggcaaaucaagcacagccc

SEQ ID NO: 3141182 - RNA, 14 nt, Mycobacterium bovis subsp bovis AF2122/97
ccgggcaaccagca

SEQ ID NO: 3141183 - RNA, 20 nt, Mycobacterium bovis subsp bovis AF2122/97
ccgggcaaccagcagcaggu

SEQ ID NO: 3141184 - RNA, 24 nt, Mycobacterium bovis subsp bovis AF2122/97
ccgggcaacgcgaaccggccaucg

SEQ ID NO: 3141185 - RNA, 14 nt, Mycobacterium bovis subsp bovis AF2122/97
ccgggcaacggcgg

SEQ ID NO: 3141186 - RNA, 19 nt, Mycobacterium bovis subsp bovis AF2122/97
ccgggcaacggcggggccg

SEQ ID NO: 3141187 - RNA, 21 nt, Mycobacterium bovis subsp bovis AF2122/97
ccgggcaacggcggggccggc

SEQ ID NO: 3141188 - RNA, 14 nt, Mycobacterium bovis subsp bovis AF2122/97
ccgggcaaggccac

SEQ ID NO: 3141189 - RNA, 20 nt, Mycobacterium bovis subsp bovis AF2122/97
ccgggcaaggccaccgucgc

SEQ ID NO: 3141190 - RNA, 15 nt, Mycobacterium bovis subsp bovis AF2122/97
ccgggcaaggcccgg

SEQ ID NO: 3141191 - RNA, 22 nt, Mycobacterium bovis subsp bovis AF2122/97
ccgggcaauacguagucgccga

SEQ ID NO: 3141192 - RNA, 14 nt, Mycobacterium bovis subsp bovis AF2122/97
ccgggcaaucgcuc

SEQ ID NO: 3141193 - RNA, 23 nt, Mycobacterium bovis subsp bovis AF2122/97
ccgggcaccaauaccgcacccgc

SEQ ID NO: 3141194 - RNA, 13 nt, Mycobacterium bovis subsp bovis AF2122/97
ccgggcaccacca

SEQ ID NO: 3141195 - RNA, 19 nt, Mycobacterium bovis subsp bovis AF2122/97
ccgggcaccaccacaccgg

SEQ ID NO: 3141196 - RNA, 23 nt, Mycobacterium bovis subsp bovis AF2122/97
ccgggcaccacuuggguggcgcc

SEQ ID NO: 3141197 - RNA, 18 nt, Mycobacterium bovis subsp bovis AF2122/97
ccgggcaccggccggugg

SEQ ID NO: 3141198 - RNA, 14 nt, Mycobacterium bovis subsp bovis AF2122/97
ccgggcaccgucgg

SEQ ID NO: 3141199 - RNA, 17 nt, Mycobacterium bovis subsp bovis AF2122/97
ccgggcagaugaugccg

SEQ ID NO: 3141200 - RNA, 17 nt, Mycobacterium bovis subsp bovis AF2122/97
ccgggcagcaccagcgc

SEQ ID NO: 3141201 - RNA, 21 nt, Mycobacterium bovis subsp bovis AF2122/97
ccgggcagcaucaacaccggc

SEQ ID NO: 3141202 - RNA, 14 nt, Mycobacterium bovis subsp bovis AF2122/97
ccgggcagccccuc

SEQ ID NO: 3141203 - RNA, 14 nt, Mycobacterium bovis subsp bovis AF2122/97
ccgggcagccgcac

SEQ ID NO: 3141204 - RNA, 14 nt, Mycobacterium bovis subsp bovis AF2122/97
ccgggcagccgcgc

SEQ ID NO: 3141205 - RNA, 16 nt, Mycobacterium bovis subsp bovis AF2122/97
ccgggcagccgcgccg

SEQ ID NO: 3141206 - RNA, 19 nt, Mycobacterium bovis subsp bovis AF2122/97
ccgggcagccgcgccgcgg

SEQ ID NO: 3141207 - RNA, 15 nt, Mycobacterium bovis subsp bovis AF2122/97
ccgggcagcugggca

SEQ ID NO: 3141208 - RNA, 18 nt, Mycobacterium bovis subsp bovis AF2122/97
ccgggcagcugggcagga

SEQ ID NO: 3141209 - RNA, 17 nt, Mycobacterium bovis subsp bovis AF2122/97
ccgggcagucaggccua

SEQ ID NO: 3141210 - RNA, 22 nt, Mycobacterium bovis subsp bovis AF2122/97
ccgggcagucaggccuagcgcg

SEQ ID NO: 3141211 - RNA, 17 nt, Mycobacterium bovis subsp bovis AF2122/97
ccgggcagucgagugcg

SEQ ID NO: 3141212 - RNA, 17 nt, Mycobacterium bovis subsp bovis AF2122/97
ccgggcaguuuggcggc

SEQ ID NO: 3141213 - RNA, 20 nt, Mycobacterium bovis subsp bovis AF2122/97
ccgggcaguuuggcggcagg

SEQ ID NO: 3141214 - RNA, 19 nt, Mycobacterium bovis subsp bovis AF2122/97
ccgggcauccuucaccagc

SEQ ID NO: 3141215 - RNA, 21 nt, Mycobacterium bovis subsp bovis AF2122/97
ccgggcaugaucacacugccc

SEQ ID NO: 3141216 - RNA, 12 nt, Mycobacterium bovis subsp bovis AF2122/97
ccgggccaaugc

SEQ ID NO: 3141217 - RNA, 15 nt, Mycobacterium bovis subsp bovis AF2122/97
ccgggccaaugccgu

SEQ ID NO: 3141218 - RNA, 21 nt, Mycobacterium bovis subsp bovis AF2122/97
ccgggccaaugccguugaucg

SEQ ID NO: 3141219 - RNA, 21 nt, Mycobacterium bovis subsp bovis AF2122/97
ccgggccaccaguuguccggc

SEQ ID NO: 3141220 - RNA, 18 nt, Mycobacterium bovis subsp bovis AF2122/97
ccgggccacguccugccc

SEQ ID NO: 3141221 - RNA, 22 nt, Mycobacterium bovis subsp bovis AF2122/97
ccgggccacgucgagcacccgc

SEQ ID NO: 3141222 - RNA, 19 nt, Mycobacterium bovis subsp bovis AF2122/97
ccgggccaggccgaugccg

SEQ ID NO: 3141223 - RNA, 17 nt, Mycobacterium bovis subsp bovis AF2122/97
ccgggccaggcugcgca

SEQ ID NO: 3141224 - RNA, 22 nt, Mycobacterium bovis subsp bovis AF2122/97
ccgggccauuaaaaagcccagc

SEQ ID NO: 3141225 - RNA, 15 nt, Mycobacterium bovis subsp bovis AF2122/97
ccgggccccacggcg

SEQ ID NO: 3141226 - RNA, 21 nt, Mycobacterium bovis subsp bovis AF2122/97
ccgggcccgacgacgacguuc

SEQ ID NO: 3141227 - RNA, 19 nt, Mycobacterium bovis subsp bovis AF2122/97
ccgggcccgccggccccgc

SEQ ID NO: 3141228 - RNA, 14 nt, Mycobacterium bovis subsp bovis AF2122/97
ccgggcccgccguc

SEQ ID NO: 3141229 - RNA, 15 nt, Mycobacterium bovis subsp bovis AF2122/97
ccgggcccgccgucu

SEQ ID NO: 3141230 - RNA, 14 nt, Mycobacterium bovis subsp bovis AF2122/97
ccgggcccgcguuc

SEQ ID NO: 3141231 - RNA, 14 nt, Mycobacterium bovis subsp bovis AF2122/97
ccgggcccgucgga

SEQ ID NO: 3141232 - RNA, 16 nt, Mycobacterium bovis subsp bovis AF2122/97
ccgggcccgucggaca

SEQ ID NO: 3141233 - RNA, 17 nt, Mycobacterium bovis subsp bovis AF2122/97
ccgggcccgucggacau

SEQ ID NO: 3141234 - RNA, 20 nt, Mycobacterium bovis subsp bovis AF2122/97
ccgggcccuccacugcgagc

SEQ ID NO: 3141235 - RNA, 15 nt, Mycobacterium bovis subsp bovis AF2122/97
ccgggccgaagcgcg

SEQ ID NO: 3141236 - RNA, 14 nt, Mycobacterium bovis subsp bovis AF2122/97
ccgggccgagcgca

SEQ ID NO: 3141237 - RNA, 16 nt, Mycobacterium bovis subsp bovis AF2122/97
ccgggccgagcgcacc

SEQ ID NO: 3141238 - RNA, 21 nt, Mycobacterium bovis subsp bovis AF2122/97
ccgggccgccagggcccuagc

SEQ ID NO: 3141239 - RNA, 12 nt, Mycobacterium bovis subsp bovis AF2122/97
ccgggccgccgc

SEQ ID NO: 3141240 - RNA, 14 nt, Mycobacterium bovis subsp bovis AF2122/97
ccgggccgccgcga

SEQ ID NO: 3141241 - RNA, 12 nt, Mycobacterium bovis subsp bovis AF2122/97
ccgggccgcgcg

SEQ ID NO: 3141242 - RNA, 15 nt, Mycobacterium bovis subsp bovis AF2122/97
ccgggccgcggccac

SEQ ID NO: 3141243 - RNA, 17 nt, Mycobacterium bovis subsp bovis AF2122/97
ccgggccgcggccacau

SEQ ID NO: 3141244 - RNA, 13 nt, Mycobacterium bovis subsp bovis AF2122/97
ccgggccggucgg

SEQ ID NO: 3141245 - RNA, 19 nt, Mycobacterium bovis subsp bovis AF2122/97
ccgggccggucggugagcc

SEQ ID NO: 3141246 - RNA, 17 nt, Mycobacterium bovis subsp bovis AF2122/97
ccgggccguacggcgcg

SEQ ID NO: 3141247 - RNA, 17 nt, Mycobacterium bovis subsp bovis AF2122/97
ccgggccguguccgccg

SEQ ID NO: 3141248 - RNA, 18 nt, Mycobacterium bovis subsp bovis AF2122/97
ccgggccguguccgccgg

SEQ ID NO: 3141249 - RNA, 21 nt, Mycobacterium bovis subsp bovis AF2122/97
ccgggccucggcgccgucgga

SEQ ID NO: 3141250 - RNA, 20 nt, Mycobacterium bovis subsp bovis AF2122/97
ccgggccugcaccacggcgg

SEQ ID NO: 3141251 - RNA, 13 nt, Mycobacterium bovis subsp bovis AF2122/97
ccgggccuggccu

SEQ ID NO: 3141252 - RNA, 15 nt, Mycobacterium bovis subsp bovis AF2122/97
ccgggccuggccugc

SEQ ID NO: 3141253 - RNA, 16 nt, Mycobacterium bovis subsp bovis AF2122/97
ccgggccugggacggc

SEQ ID NO: 3141254 - RNA, 20 nt, Mycobacterium bovis subsp bovis AF2122/97
ccgggccugggacggcggca

SEQ ID NO: 3141255 - RNA, 22 nt, Mycobacterium bovis subsp bovis AF2122/97
ccgggccugggacggcggcagu

SEQ ID NO: 3141256 - RNA, 18 nt, Mycobacterium bovis subsp bovis AF2122/97
ccgggccuugcgcgcgca

SEQ ID NO: 3141257 - RNA, 19 nt, Mycobacterium bovis subsp bovis AF2122/97
ccgggcgaauccggcgggu

SEQ ID NO: 3141258 - RNA, 19 nt, Mycobacterium bovis subsp bovis AF2122/97
ccggggccuucggcccggu

SEQ ID NO: 3141259 - RNA, 21 nt, Mycobacterium bovis subsp bovis AF2122/97
ccggggcgaacggcaccgcgc

SEQ ID NO: 3141260 - RNA, 17 nt, Mycobacterium bovis subsp bovis AF2122/97
ccggggcgaugucggcu

SEQ ID NO: 3141261 - RNA, 21 nt, Mycobacterium bovis subsp bovis AF2122/97
ccggggcgaugucggcuggug

SEQ ID NO: 3141262 - RNA, 10 nt, Mycobacterium bovis subsp bovis AF2122/97
ccggggcgca

SEQ ID NO: 3141263 - RNA, 13 nt, Mycobacterium bovis subsp bovis AF2122/97
ccggggcgcccgg

SEQ ID NO: 3141264 - RNA, 14 nt, Mycobacterium bovis subsp bovis AF2122/97
ccggggcgcccggc

SEQ ID NO: 3141265 - RNA, 18 nt, Mycobacterium bovis subsp bovis AF2122/97
ccggggcgcccggccagg

SEQ ID NO: 3141266 - RNA, 19 nt, Mycobacterium bovis subsp bovis AF2122/97
ccggggcgcccggccaggu

SEQ ID NO: 3141267 - RNA, 12 nt, Mycobacterium bovis subsp bovis AF2122/97
ccggggcggccg

SEQ ID NO: 3141268 - RNA, 13 nt, Mycobacterium bovis subsp bovis AF2122/97
ccggggcggccga

SEQ ID NO: 3141269 - RNA, 15 nt, Mycobacterium bovis subsp bovis AF2122/97
ccggggcggugggcg

SEQ ID NO: 3141270 - RNA, 15 nt, Mycobacterium bovis subsp bovis AF2122/97
ccggggcucucggau

SEQ ID NO: 3141271 - RNA, 14 nt, Mycobacterium bovis subsp bovis AF2122/97
ccggggcugcccgc

SEQ ID NO: 3141272 - RNA, 21 nt, Mycobacterium bovis subsp bovis AF2122/97
ccggggcugcccgcggacgug

SEQ ID NO: 3141273 - RNA, 15 nt, Mycobacterium bovis subsp bovis AF2122/97
ccggggcugccgaac

SEQ ID NO: 3141274 - RNA, 12 nt, Mycobacterium bovis subsp bovis AF2122/97
ccgggggaacgg

SEQ ID NO: 3141275 - RNA, 17 nt, Mycobacterium bovis subsp bovis AF2122/97
ccgggggaagcgcgucc

SEQ ID NO: 3141276 - RNA, 24 nt, Mycobacterium bovis subsp bovis AF2122/97
ccgggggacgauuccgcccacaug

SEQ ID NO: 3141277 - RNA, 17 nt, Mycobacterium bovis subsp bovis AF2122/97
ccgggggcaccguuacc

SEQ ID NO: 3141278 - RNA, 21 nt, Mycobacterium bovis subsp bovis AF2122/97
ccgggggcaccguuaccgccg

SEQ ID NO: 3141279 - RNA, 13 nt, Mycobacterium bovis subsp bovis AF2122/97
ccgggggcgccgc

SEQ ID NO: 3141280 - RNA, 15 nt, Mycobacterium bovis subsp bovis AF2122/97
ccgggggcgccgccg

SEQ ID NO: 3141281 - RNA, 17 nt, Mycobacterium bovis subsp bovis AF2122/97
ccgggggcgccgccguu

SEQ ID NO: 3141282 - RNA, 19 nt, Mycobacterium bovis subsp bovis AF2122/97
ccgggggcgccgccguugc

SEQ ID NO: 3141283 - RNA, 13 nt, Mycobacterium bovis subsp bovis AF2122/97
ccggggggcugcu

SEQ ID NO: 3141284 - RNA, 22 nt, Mycobacterium bovis subsp bovis AF2122/97
ccggggggcugcugcucggccu

SEQ ID NO: 3141285 - RNA, 15 nt, Mycobacterium bovis subsp bovis AF2122/97
ccgggguaucgaccc

SEQ ID NO: 3141286 - RNA, 12 nt, Mycobacterium bovis subsp bovis AF2122/97
ccggggucaccu

SEQ ID NO: 3141287 - RNA, 19 nt, Mycobacterium bovis subsp bovis AF2122/97
ccgggguccaucggggccg

SEQ ID NO: 3141288 - RNA, 12 nt, Mycobacterium bovis subsp bovis AF2122/97
ccggggucggcc

SEQ ID NO: 3141289 - RNA, 22 nt, Mycobacterium bovis subsp bovis AF2122/97
ccggggugaaaaucgccaucgg

SEQ ID NO: 3141290 - RNA, 18 nt, Mycobacterium bovis subsp bovis AF2122/97
ccggggugcccccggugc

SEQ ID NO: 3141291 - RNA, 14 nt, Mycobacterium bovis subsp bovis AF2122/97
ccggggugcccggc

SEQ ID NO: 3141292 - RNA, 17 nt, Mycobacterium bovis subsp bovis AF2122/97
ccggggugcccggccgc

SEQ ID NO: 3141293 - RNA, 18 nt, Mycobacterium bovis subsp bovis AF2122/97
ccggggugcccggccgcc

SEQ ID NO: 3141294 - RNA, 18 nt, Mycobacterium bovis subsp bovis AF2122/97
ccggggugccggcgaugu

SEQ ID NO: 3141295 - RNA, 19 nt, Mycobacterium bovis subsp bovis AF2122/97
ccggggugcugacauaggu

SEQ ID NO: 3141296 - RNA, 12 nt, Mycobacterium bovis subsp bovis AF2122/97
ccgggguggcgc

SEQ ID NO: 3141297 - RNA, 20 nt, Mycobacterium bovis subsp bovis AF2122/97
ccgggguggugaguaccaau

SEQ ID NO: 3141298 - RNA, 21 nt, Mycobacterium bovis subsp bovis AF2122/97
ccggggugugcgggcggugca

SEQ ID NO: 3141299 - RNA, 21 nt, Mycobacterium bovis subsp bovis AF2122/97
ccgggguuacucgcagcgccg

SEQ ID NO: 3141300 - RNA, 16 nt, Mycobacterium bovis subsp bovis AF2122/97
ccgggguucaccgucg

SEQ ID NO: 3141301 - RNA, 17 nt, Mycobacterium bovis subsp bovis AF2122/97
ccgggguuggucgucgc

SEQ ID NO: 3141302 - RNA, 23 nt, Mycobacterium bovis subsp bovis AF2122/97
ccggguaaagcgaugggaacggg

SEQ ID NO: 3141303 - RNA, 12 nt, Mycobacterium bovis subsp bovis AF2122/97
ccggguaccgag

SEQ ID NO: 3141304 - RNA, 14 nt, Mycobacterium bovis subsp bovis AF2122/97
ccggguacgccggg

SEQ ID NO: 3141305 - RNA, 16 nt, Mycobacterium bovis subsp bovis AF2122/97
ccggguagacaccgcg

SEQ ID NO: 3141306 - RNA, 19 nt, Mycobacterium bovis subsp bovis AF2122/97
ccggguagacaugggugaa

SEQ ID NO: 3141307 - RNA, 21 nt, Mycobacterium bovis subsp bovis AF2122/97
ccggguagacaugggugaauc

SEQ ID NO: 3141308 - RNA, 16 nt, Mycobacterium bovis subsp bovis AF2122/97
ccggguagccggcgug

SEQ ID NO: 3141309 - RNA, 16 nt, Mycobacterium bovis subsp bovis AF2122/97
ccggguagcggcgccg

SEQ ID NO: 3141310 - RNA, 17 nt, Mycobacterium bovis subsp bovis AF2122/97
ccggguagcggcgccgc

SEQ ID NO: 3141311 - RNA, 18 nt, Mycobacterium bovis subsp bovis AF2122/97
ccggguagcggcgccgcc

SEQ ID NO: 3141312 - RNA, 15 nt, Mycobacterium bovis subsp bovis AF2122/97
ccggguagcucccug

SEQ ID NO: 3141313 - RNA, 23 nt, Mycobacterium bovis subsp bovis AF2122/97
ccggguaucgccaguggugcacc

SEQ ID NO: 3141314 - RNA, 16 nt, Mycobacterium bovis subsp bovis AF2122/97
ccggguauggcggcga

SEQ ID NO: 3141315 - RNA, 14 nt, Mycobacterium bovis subsp bovis AF2122/97
ccggguauuaccgc

SEQ ID NO: 3141316 - RNA, 19 nt, Mycobacterium bovis subsp bovis AF2122/97
ccgggucaacgccaucacc

SEQ ID NO: 3141317 - RNA, 22 nt, Mycobacterium bovis subsp bovis AF2122/97
ccgggucaacgccaucaccccg

SEQ ID NO: 3141318 - RNA, 13 nt, Mycobacterium bovis subsp bovis AF2122/97
ccgggucaccagc

SEQ ID NO: 3141319 - RNA, 15 nt, Mycobacterium bovis subsp bovis AF2122/97
ccgggucaccagcgc

SEQ ID NO: 3141320 - RNA, 16 nt, Mycobacterium bovis subsp bovis AF2122/97
ccgggucaccagcgca

SEQ ID NO: 3141321 - RNA, 18 nt, Mycobacterium bovis subsp bovis AF2122/97
ccgggucaccagcgcauc

SEQ ID NO: 3141322 - RNA, 13 nt, Mycobacterium bovis subsp bovis AF2122/97
ccgggucaccgau

SEQ ID NO: 3141323 - RNA, 19 nt, Mycobacterium bovis subsp bovis AF2122/97
ccgggucacgugggccaug

SEQ ID NO: 3141324 - RNA, 19 nt, Mycobacterium bovis subsp bovis AF2122/97
ccgggucacuccggcggcu

SEQ ID NO: 3141325 - RNA, 21 nt, Mycobacterium bovis subsp bovis AF2122/97
ccgggucacuccggcggcuuc

SEQ ID NO: 3141326 - RNA, 19 nt, Mycobacterium bovis subsp bovis AF2122/97
ccgggucagcccggcgcga

SEQ ID NO: 3141327 - RNA, 20 nt, Mycobacterium bovis subsp bovis AF2122/97
ccgggucagcccggcgcgau

SEQ ID NO: 3141328 - RNA, 22 nt, Mycobacterium bovis subsp bovis AF2122/97
ccgggucagcgaccucacugcg

SEQ ID NO: 3141329 - RNA, 23 nt, Mycobacterium bovis subsp bovis AF2122/97
ccggguccaagaaccacgacguu

SEQ ID NO: 3141330 - RNA, 13 nt, Mycobacterium bovis subsp bovis AF2122/97
ccggguccaccgc

SEQ ID NO: 3141331 - RNA, 17 nt, Mycobacterium bovis subsp bovis AF2122/97
ccggguccaccgcacgg

SEQ ID NO: 3141332 - RNA, 22 nt, Mycobacterium bovis subsp bovis AF2122/97
ccgggucccauuugccuugagc

SEQ ID NO: 3141333 - RNA, 21 nt, Mycobacterium bovis subsp bovis AF2122/97
ccggguccgccgggccccggg

SEQ ID NO: 3141334 - RNA, 17 nt, Mycobacterium bovis subsp bovis AF2122/97
ccggguccgccguugcc

SEQ ID NO: 3141335 - RNA, 23 nt, Mycobacterium bovis subsp bovis AF2122/97
ccggguccgccguugccgauccc

SEQ ID NO: 3141336 - RNA, 19 nt, Mycobacterium bovis subsp bovis AF2122/97
ccggguccggugaacccga

SEQ ID NO: 3141337 - RNA, 20 nt, Mycobacterium bovis subsp bovis AF2122/97
ccgggucgaaucgugucgcc

SEQ ID NO: 3141338 - RNA, 18 nt, Mycobacterium bovis subsp bovis AF2122/97
ccgggucgacgacgucgc

SEQ ID NO: 3141339 - RNA, 21 nt, Mycobacterium bovis subsp bovis AF2122/97
ccgggucgacgacgucgcgca

SEQ ID NO: 3141340 - RNA, 15 nt, Mycobacterium bovis subsp bovis AF2122/97
ccgggucgaucaccg

SEQ ID NO: 3141341 - RNA, 17 nt, Mycobacterium bovis subsp bovis AF2122/97
ccgggucgaucaccgac

SEQ ID NO: 3141342 - RNA, 19 nt, Mycobacterium bovis subsp bovis AF2122/97
ccgggucgaucaccgacac

SEQ ID NO: 3141343 - RNA, 20 nt, Mycobacterium bovis subsp bovis AF2122/97
ccgggucgauggguaccgcg

SEQ ID NO: 3141344 - RNA, 19 nt, Mycobacterium bovis subsp bovis AF2122/97
ccgggucgaugucggggcc

SEQ ID NO: 3141345 - RNA, 22 nt, Mycobacterium bovis subsp bovis AF2122/97
ccgguaucgccaaauccggugc

SEQ ID NO: 3141346 - RNA, 13 nt, Mycobacterium bovis subsp bovis AF2122/97
ccgguaucggcga

SEQ ID NO: 3141347 - RNA, 14 nt, Mycobacterium bovis subsp bovis AF2122/97
ccgguaucggcgac

SEQ ID NO: 3141348 - RNA, 19 nt, Mycobacterium bovis subsp bovis AF2122/97
ccgguaucgucccggcgac

SEQ ID NO: 3141349 - RNA, 22 nt, Mycobacterium bovis subsp bovis AF2122/97
ccgguaucgucccggcgaccgg

SEQ ID NO: 3141350 - RNA, 16 nt, Mycobacterium bovis subsp bovis AF2122/97
ccgguaugcgccaucu

SEQ ID NO: 3141351 - RNA, 20 nt, Mycobacterium bovis subsp bovis AF2122/97
ccgguaugcgccaucucgac

SEQ ID NO: 3141352 - RNA, 18 nt, Mycobacterium bovis subsp bovis AF2122/97
ccgguauuaccgccgugg

SEQ ID NO: 3141353 - RNA, 19 nt, Mycobacterium bovis subsp bovis AF2122/97
ccggucaaacgcgcgcgcc

SEQ ID NO: 3141354 - RNA, 21 nt, Mycobacterium bovis subsp bovis AF2122/97
ccggucaacacccgcccgggc

SEQ ID NO: 3141355 - RNA, 23 nt, Mycobacterium bovis subsp bovis AF2122/97
ccggucaacacccgcccgggcgu

SEQ ID NO: 3141356 - RNA, 16 nt, Mycobacterium bovis subsp bovis AF2122/97
ccggucaccgcgcagc

SEQ ID NO: 3141357 - RNA, 13 nt, Mycobacterium bovis subsp bovis AF2122/97
ccggucaccucgc

SEQ ID NO: 3141358 - RNA, 17 nt, Mycobacterium bovis subsp bovis AF2122/97
ccggucaccucgccggc

SEQ ID NO: 3141359 - RNA, 14 nt, Mycobacterium bovis subsp bovis AF2122/97
ccggucacgacguc

SEQ ID NO: 3141360 - RNA, 17 nt, Mycobacterium bovis subsp bovis AF2122/97
ccggucacgcugugcgg

SEQ ID NO: 3141361 - RNA, 13 nt, Mycobacterium bovis subsp bovis AF2122/97
ccggucacgucga

SEQ ID NO: 3141362 - RNA, 17 nt, Mycobacterium bovis subsp bovis AF2122/97
ccggucagcaccuccac

SEQ ID NO: 3141363 - RNA, 21 nt, Mycobacterium bovis subsp bovis AF2122/97
ccggucagcaccuccaccgcg

SEQ ID NO: 3141364 - RNA, 22 nt, Mycobacterium bovis subsp bovis AF2122/97
ccggucagcaccuccaccgcgc

SEQ ID NO: 3141365 - RNA, 11 nt, Mycobacterium bovis subsp bovis AF2122/97
ccggucagcga

SEQ ID NO: 3141366 - RNA, 18 nt, Mycobacterium bovis subsp bovis AF2122/97
ccggucagcgacgcacgc

SEQ ID NO: 3141367 - RNA, 23 nt, Mycobacterium bovis subsp bovis AF2122/97
ccggucagcgacgcacgcaguuc

SEQ ID NO: 3141368 - RNA, 13 nt, Mycobacterium bovis subsp bovis AF2122/97
ccggucagcgcgg

SEQ ID NO: 3141369 - RNA, 16 nt, Mycobacterium bovis subsp bovis AF2122/97
ccggucagcgcggcga

SEQ ID NO: 3141370 - RNA, 17 nt, Mycobacterium bovis subsp bovis AF2122/97
ccggucagcgcggcgac

SEQ ID NO: 3141371 - RNA, 16 nt, Mycobacterium bovis subsp bovis AF2122/97
ccggucagcgcggcgc

SEQ ID NO: 3141372 - RNA, 18 nt, Mycobacterium bovis subsp bovis AF2122/97
ccggucaggcaguccacc

SEQ ID NO: 3141373 - RNA, 22 nt, Mycobacterium bovis subsp bovis AF2122/97
ccggucaggcaguccaccgcgc

SEQ ID NO: 3141374 - RNA, 15 nt, Mycobacterium bovis subsp bovis AF2122/97
ccggucaggccgccg

SEQ ID NO: 3141375 - RNA, 18 nt, Mycobacterium bovis subsp bovis AF2122/97
ccggucaggccgccgcgg

SEQ ID NO: 3141376 - RNA, 16 nt, Mycobacterium bovis subsp bovis AF2122/97
ccggucauaccaagcg

SEQ ID NO: 3141377 - RNA, 17 nt, Mycobacterium bovis subsp bovis AF2122/97
ccggucauaccaagcgc

SEQ ID NO: 3141378 - RNA, 18 nt, Mycobacterium bovis subsp bovis AF2122/97
ccggucauaccaagcgcg

SEQ ID NO: 3141379 - RNA, 16 nt, Mycobacterium bovis subsp bovis AF2122/97
ccggucaucccaagcg

SEQ ID NO: 3141380 - RNA, 17 nt, Mycobacterium bovis subsp bovis AF2122/97
ccggucaucccaagcgu

SEQ ID NO: 3141381 - RNA, 20 nt, Mycobacterium bovis subsp bovis AF2122/97
ccggucaucccaagcguccg

SEQ ID NO: 3141382 - RNA, 17 nt, Mycobacterium bovis subsp bovis AF2122/97
ccggucaucgccgaaac

SEQ ID NO: 3141383 - RNA, 18 nt, Mycobacterium bovis subsp bovis AF2122/97
ccggucauggucagcaga

SEQ ID NO: 3141384 - RNA, 19 nt, Mycobacterium bovis subsp bovis AF2122/97
ccgguccagcccagcgcgc

SEQ ID NO: 3141385 - RNA, 23 nt, Mycobacterium bovis subsp bovis AF2122/97
ccgguccagcgccggaagcuucg

SEQ ID NO: 3141386 - RNA, 14 nt, Mycobacterium bovis subsp bovis AF2122/97
ccgguccagcggcc

SEQ ID NO: 3141387 - RNA, 15 nt, Mycobacterium bovis subsp bovis AF2122/97
ccgguccagcggccg

SEQ ID NO: 3141388 - RNA, 16 nt, Mycobacterium bovis subsp bovis AF2122/97
ccgguccagcggccgc

SEQ ID NO: 3141389 - RNA, 21 nt, Mycobacterium bovis subsp bovis AF2122/97
ccgguccagcggccgccgcgg

SEQ ID NO: 3141390 - RNA, 17 nt, Mycobacterium bovis subsp bovis AF2122/97
ccggucccaaggcguug

SEQ ID NO: 3141391 - RNA, 14 nt, Mycobacterium bovis subsp bovis AF2122/97
ccggucccccgccc

SEQ ID NO: 3141392 - RNA, 13 nt, Mycobacterium bovis subsp bovis AF2122/97
ccgguccccgccg

SEQ ID NO: 3141393 - RNA, 15 nt, Mycobacterium bovis subsp bovis AF2122/97
ccgguccccgccggc

SEQ ID NO: 3141394 - RNA, 17 nt, Mycobacterium bovis subsp bovis AF2122/97
ccgguccccgccggcgg

SEQ ID NO: 3141395 - RNA, 16 nt, Mycobacterium bovis subsp bovis AF2122/97
ccgguccccgguuucg

SEQ ID NO: 3141396 - RNA, 20 nt, Mycobacterium bovis subsp bovis AF2122/97
ccgguccccgguuucgauca

SEQ ID NO: 3141397 - RNA, 17 nt, Mycobacterium bovis subsp bovis AF2122/97
ccgguccccucggugcc

SEQ ID NO: 3141398 - RNA, 14 nt, Mycobacterium bovis subsp bovis AF2122/97
ccggucccgccgac

SEQ ID NO: 3141399 - RNA, 20 nt, Mycobacterium bovis subsp bovis AF2122/97
ccggucccgccgaccgacac

SEQ ID NO: 3141400 - RNA, 19 nt, Mycobacterium bovis subsp bovis AF2122/97
ccggucccgccgugccgcg

SEQ ID NO: 3141401 - RNA, 20 nt, Mycobacterium bovis subsp bovis AF2122/97
ccggucccgccgugccgcgg

SEQ ID NO: 3141402 - RNA, 21 nt, Mycobacterium bovis subsp bovis AF2122/97
ccggucccgccgugccgcggc

SEQ ID NO: 3141403 - RNA, 23 nt, Mycobacterium bovis subsp bovis AF2122/97
ccggucccgccgugccgcggcga

SEQ ID NO: 3141404 - RNA, 15 nt, Mycobacterium bovis subsp bovis AF2122/97
ccgguccgccagcgc

SEQ ID NO: 3141405 - RNA, 16 nt, Mycobacterium bovis subsp bovis AF2122/97
ccgguccggcgucgug

SEQ ID NO: 3141406 - RNA, 13 nt, Mycobacterium bovis subsp bovis AF2122/97
ccgguccgggucg

SEQ ID NO: 3141407 - RNA, 16 nt, Mycobacterium bovis subsp bovis AF2122/97
ccgguccggucggcgg

SEQ ID NO: 3141408 - RNA, 18 nt, Mycobacterium bovis subsp bovis AF2122/97
ccgguccgucaccaccgc

SEQ ID NO: 3141409 - RNA, 23 nt, Mycobacterium bovis subsp bovis AF2122/97
ccgguccgucaccaccgccgcca

SEQ ID NO: 3141410 - RNA, 17 nt, Mycobacterium bovis subsp bovis AF2122/97
ccgguccugggauccgg

SEQ ID NO: 3141411 - RNA, 21 nt, Mycobacterium bovis subsp bovis AF2122/97
ccgguccugggauccggcggc

SEQ ID NO: 3141412 - RNA, 22 nt, Mycobacterium bovis subsp bovis AF2122/97
ccggucgacagcgaaggcgccg

SEQ ID NO: 3141413 - RNA, 12 nt, Mycobacterium bovis subsp bovis AF2122/97
ccggucgacggg

SEQ ID NO: 3141414 - RNA, 17 nt, Mycobacterium bovis subsp bovis AF2122/97
ccggucgaugccgaugc

SEQ ID NO: 3141415 - RNA, 16 nt, Mycobacterium bovis subsp bovis AF2122/97
ccggucgaugucagcc

SEQ ID NO: 3141416 - RNA, 20 nt, Mycobacterium bovis subsp bovis AF2122/97
ccggucgaugucagccacca

SEQ ID NO: 3141417 - RNA, 15 nt, Mycobacterium bovis subsp bovis AF2122/97
ccggucgaugucggc

SEQ ID NO: 3141418 - RNA, 18 nt, Mycobacterium bovis subsp bovis AF2122/97
ccggucgcacuuggcccc

SEQ ID NO: 3141419 - RNA, 22 nt, Mycobacterium bovis subsp bovis AF2122/97
ccggucgcacuuggcccccgac

SEQ ID NO: 3141420 - RNA, 23 nt, Mycobacterium bovis subsp bovis AF2122/97
ccggucgcacuuggcccccgacg

SEQ ID NO: 3141421 - RNA, 14 nt, Mycobacterium bovis subsp bovis AF2122/97
ccggucgccgacgg

SEQ ID NO: 3141422 - RNA, 12 nt, Mycobacterium bovis subsp bovis AF2122/97
ccggucgccgcg

SEQ ID NO: 3141423 - RNA, 15 nt, Mycobacterium bovis subsp bovis AF2122/97
ccggucgccgcgaag

SEQ ID NO: 3141424 - RNA, 16 nt, Mycobacterium bovis subsp bovis AF2122/97
ccggucgccgcgucua

SEQ ID NO: 3141425 - RNA, 13 nt, Mycobacterium bovis subsp bovis AF2122/97
ccggucgccggga

SEQ ID NO: 3141426 - RNA, 18 nt, Mycobacterium bovis subsp bovis AF2122/97
ccggucgccucaccggcg

SEQ ID NO: 3141427 - RNA, 13 nt, Mycobacterium bovis subsp bovis AF2122/97
ccggucgcggaac

SEQ ID NO: 3141428 - RNA, 20 nt, Mycobacterium bovis subsp bovis AF2122/97
ccggucgcuccggguagcgg

SEQ ID NO: 3141429 - RNA, 21 nt, Mycobacterium bovis subsp bovis AF2122/97
ccggucgcuguccacugccac

SEQ ID NO: 3141430 - RNA, 14 nt, Mycobacterium bovis subsp bovis AF2122/97
ccggucggagcggu

SEQ ID NO: 3141431 - RNA, 13 nt, Mycobacterium bovis subsp bovis AF2122/97
ccggucggaucgg

SEQ ID NO: 3141432 - RNA, 22 nt, Mycobacterium bovis subsp bovis AF2122/97
ccggugccgccggugccgccug

SEQ ID NO: 3141433 - RNA, 13 nt, Mycobacterium bovis subsp bovis AF2122/97
ccggugccgccgu

SEQ ID NO: 3141434 - RNA, 14 nt, Mycobacterium bovis subsp bovis AF2122/97
ccggugccgccguc

SEQ ID NO: 3141435 - RNA, 15 nt, Mycobacterium bovis subsp bovis AF2122/97
ccggugccgccgucg

SEQ ID NO: 3141436 - RNA, 19 nt, Mycobacterium bovis subsp bovis AF2122/97
ccggugccgccgucgccgc

SEQ ID NO: 3141437 - RNA, 21 nt, Mycobacterium bovis subsp bovis AF2122/97
ccggugccgccgucgccgcca

SEQ ID NO: 3141438 - RNA, 22 nt, Mycobacterium bovis subsp bovis AF2122/97
ccggugccgccguucccaccac

SEQ ID NO: 3141439 - RNA, 17 nt, Mycobacterium bovis subsp bovis AF2122/97
ccggugccgccguugcc

SEQ ID NO: 3141440 - RNA, 15 nt, Mycobacterium bovis subsp bovis AF2122/97
ccggugccgccuccg

SEQ ID NO: 3141441 - RNA, 19 nt, Mycobacterium bovis subsp bovis AF2122/97
ccggugccgccugcgccgc

SEQ ID NO: 3141442 - RNA, 20 nt, Mycobacterium bovis subsp bovis AF2122/97
ccggugccgccugcgccgcc

SEQ ID NO: 3141443 - RNA, 21 nt, Mycobacterium bovis subsp bovis AF2122/97
ccggugccgccugcgccgcca

SEQ ID NO: 3141444 - RNA, 13 nt, Mycobacterium bovis subsp bovis AF2122/97
ccggugccgcgau

SEQ ID NO: 3141445 - RNA, 12 nt, Mycobacterium bovis subsp bovis AF2122/97
ccggugccgcgg

SEQ ID NO: 3141446 - RNA, 15 nt, Mycobacterium bovis subsp bovis AF2122/97
ccggugccgcgguag

SEQ ID NO: 3141447 - RNA, 22 nt, Mycobacterium bovis subsp bovis AF2122/97
ccggugccgcgguaggugcaug

SEQ ID NO: 3141448 - RNA, 15 nt, Mycobacterium bovis subsp bovis AF2122/97
ccggugccggccaga

SEQ ID NO: 3141449 - RNA, 22 nt, Mycobacterium bovis subsp bovis AF2122/97
ccggugccggccaucgcccgga

SEQ ID NO: 3141450 - RNA, 12 nt, Mycobacterium bovis subsp bovis AF2122/97
ccggugccggcg

SEQ ID NO: 3141451 - RNA, 19 nt, Mycobacterium bovis subsp bovis AF2122/97
ccggugccguuggagccgc

SEQ ID NO: 3141452 - RNA, 20 nt, Mycobacterium bovis subsp bovis AF2122/97
ccggugccguuggagccgcc

SEQ ID NO: 3141453 - RNA, 22 nt, Mycobacterium bovis subsp bovis AF2122/97
ccggugccguuggagccgccac

SEQ ID NO: 3141454 - RNA, 15 nt, Mycobacterium bovis subsp bovis AF2122/97
ccggugccugcaacg

SEQ ID NO: 3141455 - RNA, 16 nt, Mycobacterium bovis subsp bovis AF2122/97
ccggugcgaucccacc

SEQ ID NO: 3141456 - RNA, 15 nt, Mycobacterium bovis subsp bovis AF2122/97
ccggugcgcaccagc

SEQ ID NO: 3141457 - RNA, 17 nt, Mycobacterium bovis subsp bovis AF2122/97
ccggugcgcaccagcac

SEQ ID NO: 3141458 - RNA, 16 nt, Mycobacterium bovis subsp bovis AF2122/97
ccggugcgcagccagg

SEQ ID NO: 3141459 - RNA, 16 nt, Mycobacterium bovis subsp bovis AF2122/97
ccggugcgcagguacg

SEQ ID NO: 3141460 - RNA, 16 nt, Mycobacterium bovis subsp bovis AF2122/97
ccggugcgcauccguc

SEQ ID NO: 3141461 - RNA, 22 nt, Mycobacterium bovis subsp bovis AF2122/97
ccggugcgcauggacaacagcu

SEQ ID NO: 3141462 - RNA, 17 nt, Mycobacterium bovis subsp bovis AF2122/97
ccggugcgcgcggucga

SEQ ID NO: 3141463 - RNA, 14 nt, Mycobacterium bovis subsp bovis AF2122/97
ccggugcggcgggc

SEQ ID NO: 3141464 - RNA, 13 nt, Mycobacterium bovis subsp bovis AF2122/97
ccggugcgguggu

SEQ ID NO: 3141465 - RNA, 18 nt, Mycobacterium bovis subsp bovis AF2122/97
ccggugcgguggugcgca

SEQ ID NO: 3141466 - RNA, 18 nt, Mycobacterium bovis subsp bovis AF2122/97
ccggugcuaaccgacgcu

SEQ ID NO: 3141467 - RNA, 19 nt, Mycobacterium bovis subsp bovis AF2122/97
ccggugcuaaccgacgcug

SEQ ID NO: 3141468 - RNA, 22 nt, Mycobacterium bovis subsp bovis AF2122/97
ccggugcuaaccgacgcugaag

SEQ ID NO: 3141469 - RNA, 18 nt, Mycobacterium bovis subsp bovis AF2122/97
ccggugcucaagcgcguc

SEQ ID NO: 3141470 - RNA, 19 nt, Mycobacterium bovis subsp bovis AF2122/97
ccggugcucaagcgcgucg

SEQ ID NO: 3141471 - RNA, 20 nt, Mycobacterium bovis subsp bovis AF2122/97
ccggugcucaagcgcgucgu

SEQ ID NO: 3141472 - RNA, 17 nt, Mycobacterium bovis subsp bovis AF2122/97
ccggugcuccucggcag

SEQ ID NO: 3141473 - RNA, 19 nt, Mycobacterium bovis subsp bovis AF2122/97
ccggugcuccucggcaggc

SEQ ID NO: 3141474 - RNA, 22 nt, Mycobacterium bovis subsp bovis AF2122/97
ccggugcugcgggaauccggug

SEQ ID NO: 3141475 - RNA, 19 nt, Mycobacterium bovis subsp bovis AF2122/97
ccggugcugguccagccgg

SEQ ID NO: 3141476 - RNA, 19 nt, Mycobacterium bovis subsp bovis AF2122/97
ccggugcugucgacgucgg

SEQ ID NO: 3141477 - RNA, 16 nt, Mycobacterium bovis subsp bovis AF2122/97
ccgguggaauccacca

SEQ ID NO: 3141478 - RNA, 20 nt, Mycobacterium bovis subsp bovis AF2122/97
ccgguggaauccaccagccg

SEQ ID NO: 3141479 - RNA, 21 nt, Mycobacterium bovis subsp bovis AF2122/97
ccgguggaauccaccagccgg

SEQ ID NO: 3141480 - RNA, 23 nt, Mycobacterium bovis subsp bovis AF2122/97
ccgguggacagaaucgaccgccg

SEQ ID NO: 3141481 - RNA, 22 nt, Mycobacterium bovis subsp bovis AF2122/97
ccgguggacagaugcauccagc

SEQ ID NO: 3141482 - RNA, 23 nt, Mycobacterium bovis subsp bovis AF2122/97
ccgguggacagaugcauccagcu

SEQ ID NO: 3141483 - RNA, 19 nt, Mycobacterium bovis subsp bovis AF2122/97
ccgguggacccggcggugc

SEQ ID NO: 3141484 - RNA, 21 nt, Mycobacterium bovis subsp bovis AF2122/97
ccgguggacgaucuggcagcc

SEQ ID NO: 3141485 - RNA, 17 nt, Mycobacterium bovis subsp bovis AF2122/97
ccgguggacgugcacga

SEQ ID NO: 3141486 - RNA, 15 nt, Mycobacterium bovis subsp bovis AF2122/97
ccgguggcaccggcg

SEQ ID NO: 3141487 - RNA, 19 nt, Mycobacterium bovis subsp bovis AF2122/97
ccgguggcaccggcggcga

SEQ ID NO: 3141488 - RNA, 20 nt, Mycobacterium bovis subsp bovis AF2122/97
ccgguggcaccggcggcgac

SEQ ID NO: 3141489 - RNA, 18 nt, Mycobacterium bovis subsp bovis AF2122/97
ccgguggcacggccccug

SEQ ID NO: 3141490 - RNA, 20 nt, Mycobacterium bovis subsp bovis AF2122/97
ccgguggcacggccccugcc

SEQ ID NO: 3141491 - RNA, 17 nt, Mycobacterium bovis subsp bovis AF2122/97
ccgguggcagagccgcc

SEQ ID NO: 3141492 - RNA, 18 nt, Mycobacterium bovis subsp bovis AF2122/97
ccgguggcagagccgccg

SEQ ID NO: 3141493 - RNA, 15 nt, Mycobacterium bovis subsp bovis AF2122/97
ccgguggcagccugc

SEQ ID NO: 3141494 - RNA, 22 nt, Mycobacterium bovis subsp bovis AF2122/97
ccgguggcagggaaccauugcc

SEQ ID NO: 3141495 - RNA, 18 nt, Mycobacterium bovis subsp bovis AF2122/97
ccgguggccaacaccgcc

SEQ ID NO: 3141496 - RNA, 20 nt, Mycobacterium bovis subsp bovis AF2122/97
ccgguggcccgccggcagug

SEQ ID NO: 3141497 - RNA, 12 nt, Mycobacterium bovis subsp bovis AF2122/97
ccgguggccggu

SEQ ID NO: 3141498 - RNA, 15 nt, Mycobacterium bovis subsp bovis AF2122/97
ccgguggcgccgggg

SEQ ID NO: 3141499 - RNA, 21 nt, Mycobacterium bovis subsp bovis AF2122/97
ccgguggcgccggggccgccg

SEQ ID NO: 3141500 - RNA, 23 nt, Mycobacterium bovis subsp bovis AF2122/97
ccgguggcggcggcggcaacggc

SEQ ID NO: 3141501 - RNA, 20 nt, Mycobacterium bovis subsp bovis AF2122/97
ccgguggcggcucacgaccg

SEQ ID NO: 3141502 - RNA, 15 nt, Mycobacterium bovis subsp bovis AF2122/97
ccgguggcgugggca

SEQ ID NO: 3141503 - RNA, 22 nt, Mycobacterium bovis subsp bovis AF2122/97
ccgguggcguggucucggucag

SEQ ID NO: 3141504 - RNA, 13 nt, Mycobacterium bovis subsp bovis AF2122/97
ccggugggccgcc

SEQ ID NO: 3141505 - RNA, 13 nt, Mycobacterium bovis subsp bovis AF2122/97
ccggugggcggcu

SEQ ID NO: 3141506 - RNA, 16 nt, Mycobacterium bovis subsp bovis AF2122/97
ccggugggcggcucgu

SEQ ID NO: 3141507 - RNA, 19 nt, Mycobacterium bovis subsp bovis AF2122/97
ccggugggcggcucgucga

SEQ ID NO: 3141508 - RNA, 22 nt, Mycobacterium bovis subsp bovis AF2122/97
ccgguggggauagccgcgucgc

SEQ ID NO: 3141509 - RNA, 22 nt, Mycobacterium bovis subsp bovis AF2122/97
ccgguggggucggucuggcugg

SEQ ID NO: 3141510 - RNA, 19 nt, Mycobacterium bovis subsp bovis AF2122/97
ccggugguaacggcggcca

SEQ ID NO: 3141511 - RNA, 16 nt, Mycobacterium bovis subsp bovis AF2122/97
ccggugguaccggcgg

SEQ ID NO: 3141512 - RNA, 21 nt, Mycobacterium bovis subsp bovis AF2122/97
ccggugguaccggcggcgccg

SEQ ID NO: 3141513 - RNA, 22 nt, Mycobacterium bovis subsp bovis AF2122/97
ccggugguagcggacagcucgc

SEQ ID NO: 3141514 - RNA, 17 nt, Mycobacterium bovis subsp bovis AF2122/97
ccggugguagcggcggu

SEQ ID NO: 3141515 - RNA, 21 nt, Mycobacterium bovis subsp bovis AF2122/97
ccggugguagcggcgguuucg

SEQ ID NO: 3141516 - RNA, 17 nt, Mycobacterium bovis subsp bovis AF2122/97
ccgguggucaggaacac

SEQ ID NO: 3141517 - RNA, 22 nt, Mycobacterium bovis subsp bovis AF2122/97
ccgguggucagguuggcacgcu

SEQ ID NO: 3141518 - RNA, 15 nt, Mycobacterium bovis subsp bovis AF2122/97
ccguacaucagcgcg

SEQ ID NO: 3141519 - RNA, 16 nt, Mycobacterium bovis subsp bovis AF2122/97
ccguacaucagcgcga

SEQ ID NO: 3141520 - RNA, 15 nt, Mycobacterium bovis subsp bovis AF2122/97
ccguaccagcccguc

SEQ ID NO: 3141521 - RNA, 13 nt, Mycobacterium bovis subsp bovis AF2122/97
ccguaccggugau

SEQ ID NO: 3141522 - RNA, 14 nt, Mycobacterium bovis subsp bovis AF2122/97
ccguacgccggcgg

SEQ ID NO: 3141523 - RNA, 15 nt, Mycobacterium bovis subsp bovis AF2122/97
ccguacgccggcggu

SEQ ID NO: 3141524 - RNA, 13 nt, Mycobacterium bovis subsp bovis AF2122/97
ccguagaccagcc

SEQ ID NO: 3141525 - RNA, 19 nt, Mycobacterium bovis subsp bovis AF2122/97
ccguagacgccgagcaagg

SEQ ID NO: 3141526 - RNA, 18 nt, Mycobacterium bovis subsp bovis AF2122/97
ccguagagcaugccgccc

SEQ ID NO: 3141527 - RNA, 19 nt, Mycobacterium bovis subsp bovis AF2122/97
ccguagagcaugccgcccg

SEQ ID NO: 3141528 - RNA, 20 nt, Mycobacterium bovis subsp bovis AF2122/97
ccguagagcaugccgcccgc

SEQ ID NO: 3141529 - RNA, 22 nt, Mycobacterium bovis subsp bovis AF2122/97
ccguagagcaugccgcccgcgc

SEQ ID NO: 3141530 - RNA, 18 nt, Mycobacterium bovis subsp bovis AF2122/97
ccguagcacaccggugga

SEQ ID NO: 3141531 - RNA, 22 nt, Mycobacterium bovis subsp bovis AF2122/97
ccguagcacaccgguggacccg

SEQ ID NO: 3141532 - RNA, 15 nt, Mycobacterium bovis subsp bovis AF2122/97
ccguagcaccacauc

SEQ ID NO: 3141533 - RNA, 19 nt, Mycobacterium bovis subsp bovis AF2122/97
ccguagccagcaggaacgc

SEQ ID NO: 3141534 - RNA, 22 nt, Mycobacterium bovis subsp bovis AF2122/97
ccguagccagcaggaacgccgu

SEQ ID NO: 3141535 - RNA, 17 nt, Mycobacterium bovis subsp bovis AF2122/97
ccguagccggccggccc

SEQ ID NO: 3141536 - RNA, 13 nt, Mycobacterium bovis subsp bovis AF2122/97
ccguagccggcgg

SEQ ID NO: 3141537 - RNA, 18 nt, Mycobacterium bovis subsp bovis AF2122/97
ccguagcgcaggagcgcg

SEQ ID NO: 3141538 - RNA, 22 nt, Mycobacterium bovis subsp bovis AF2122/97
ccguagcggucuccccagagcu

SEQ ID NO: 3141539 - RNA, 16 nt, Mycobacterium bovis subsp bovis AF2122/97
ccguagcguccgcgcc

SEQ ID NO: 3141540 - RNA, 23 nt, Mycobacterium bovis subsp bovis AF2122/97
ccguagcucuuugagugccgcgu

SEQ ID NO: 3141541 - RNA, 23 nt, Mycobacterium bovis subsp bovis AF2122/97
ccguaggaacccgaacaacgccg

SEQ ID NO: 3141542 - RNA, 20 nt, Mycobacterium bovis subsp bovis AF2122/97
ccguaggccacagcccggcg

SEQ ID NO: 3141543 - RNA, 15 nt, Mycobacterium bovis subsp bovis AF2122/97
ccguaggcgccgaac

SEQ ID NO: 3141544 - RNA, 14 nt, Mycobacterium bovis subsp bovis AF2122/97
ccguaggcggcgac

SEQ ID NO: 3141545 - RNA, 18 nt, Mycobacterium bovis subsp bovis AF2122/97
ccguaggcggcgacccgc

SEQ ID NO: 3141546 - RNA, 22 nt, Mycobacterium bovis subsp bovis AF2122/97
ccguaguaaggagccgggccgu

SEQ ID NO: 3141547 - RNA, 23 nt, Mycobacterium bovis subsp bovis AF2122/97
ccguaguaaggagccgggccguc

SEQ ID NO: 3141548 - RNA, 18 nt, Mycobacterium bovis subsp bovis AF2122/97
ccguaguaguggccgcca

SEQ ID NO: 3141549 - RNA, 23 nt, Mycobacterium bovis subsp bovis AF2122/97
ccguaguaguggccgccacccgc

SEQ ID NO: 3141550 - RNA, 19 nt, Mycobacterium bovis subsp bovis AF2122/97
ccguaguaguucagccagg

SEQ ID NO: 3141551 - RNA, 22 nt, Mycobacterium bovis subsp bovis AF2122/97
ccguaguaguucagccaggccg

SEQ ID NO: 3141552 - RNA, 23 nt, Mycobacterium bovis subsp bovis AF2122/97
ccguaguaguucagccaggccgc

SEQ ID NO: 3141553 - RNA, 23 nt, Mycobacterium bovis subsp bovis AF2122/97
ccguagucgucaaacacucugau

SEQ ID NO: 3141554 - RNA, 14 nt, Mycobacterium bovis subsp bovis AF2122/97
ccguaguggccggc

SEQ ID NO: 3141555 - RNA, 15 nt, Mycobacterium bovis subsp bovis AF2122/97
ccguagugucggcgu

SEQ ID NO: 3141556 - RNA, 21 nt, Mycobacterium bovis subsp bovis AF2122/97
ccguauaggcccgggcggcca

SEQ ID NO: 3141557 - RNA, 16 nt, Mycobacterium bovis subsp bovis AF2122/97
ccguaucggcuucguc

SEQ ID NO: 3141558 - RNA, 18 nt, Mycobacterium bovis subsp bovis AF2122/97
ccguauggcaucggccug

SEQ ID NO: 3141559 - RNA, 19 nt, Mycobacterium bovis subsp bovis AF2122/97
ccguauggcggcuccaacg

SEQ ID NO: 3141560 - RNA, 17 nt, Mycobacterium bovis subsp bovis AF2122/97
ccguauugaccagcggg

SEQ ID NO: 3141561 - RNA, 17 nt, Mycobacterium bovis subsp bovis AF2122/97
ccguauugccaaagccc

SEQ ID NO: 3141562 - RNA, 12 nt, Mycobacterium bovis subsp bovis AF2122/97
ccgucaacgaug

SEQ ID NO: 3141563 - RNA, 15 nt, Mycobacterium bovis subsp bovis AF2122/97
ccgucaaguggcaac

SEQ ID NO: 3141564 - RNA, 22 nt, Mycobacterium bovis subsp bovis AF2122/97
ccgucaaguggcaaccgcaccg

SEQ ID NO: 3141565 - RNA, 15 nt, Mycobacterium bovis subsp bovis AF2122/97
ccgucacaagucgac

SEQ ID NO: 3141566 - RNA, 19 nt, Mycobacterium bovis subsp bovis AF2122/97
ccgucacaaugcccaggcu

SEQ ID NO: 3141567 - RNA, 23 nt, Mycobacterium bovis subsp bovis AF2122/97
ccgucaccgaucgaacagugccu

SEQ ID NO: 3141568 - RNA, 12 nt, Mycobacterium bovis subsp bovis AF2122/97
ccgucaccgccg

SEQ ID NO: 3141569 - RNA, 13 nt, Mycobacterium bovis subsp bovis AF2122/97
ccgucaccgccga

SEQ ID NO: 3141570 - RNA, 13 nt, Mycobacterium bovis subsp bovis AF2122/97
ccgucaccgccgg

SEQ ID NO: 3141571 - RNA, 14 nt, Mycobacterium bovis subsp bovis AF2122/97
ccgucaccgccggc

SEQ ID NO: 3141572 - RNA, 19 nt, Mycobacterium bovis subsp bovis AF2122/97
ccgucaccgccggcaccgc

SEQ ID NO: 3141573 - RNA, 19 nt, Mycobacterium bovis subsp bovis AF2122/97
ccgucaccgccgucaccgu

SEQ ID NO: 3141574 - RNA, 12 nt, Mycobacterium bovis subsp bovis AF2122/97
ccgucaccgcga

SEQ ID NO: 3141575 - RNA, 13 nt, Mycobacterium bovis subsp bovis AF2122/97
ccgucaccgcggg

SEQ ID NO: 3141576 - RNA, 22 nt, Mycobacterium bovis subsp bovis AF2122/97
ccgucaccggaauccccccugu

SEQ ID NO: 3141577 - RNA, 14 nt, Mycobacterium bovis subsp bovis AF2122/97
ccgucaccggucgg

SEQ ID NO: 3141578 - RNA, 18 nt, Mycobacterium bovis subsp bovis AF2122/97
ccgucaccggucggccau

SEQ ID NO: 3141579 - RNA, 15 nt, Mycobacterium bovis subsp bovis AF2122/97
ccgucacgccggaug

SEQ ID NO: 3141580 - RNA, 13 nt, Mycobacterium bovis subsp bovis AF2122/97
ccgucacggucgc

SEQ ID NO: 3141581 - RNA, 19 nt, Mycobacterium bovis subsp bovis AF2122/97
ccgucagaacaccggccag

SEQ ID NO: 3141582 - RNA, 20 nt, Mycobacterium bovis subsp bovis AF2122/97
ccgucagaacaccggccagg

SEQ ID NO: 3141583 - RNA, 21 nt, Mycobacterium bovis subsp bovis AF2122/97
ccgucagaacaccggccaggc

SEQ ID NO: 3141584 - RNA, 23 nt, Mycobacterium bovis subsp bovis AF2122/97
ccgucagaacaccggccaggccg

SEQ ID NO: 3141585 - RNA, 19 nt, Mycobacterium bovis subsp bovis AF2122/97
ccgucagcaccgcuacgac

SEQ ID NO: 3141586 - RNA, 14 nt, Mycobacterium bovis subsp bovis AF2122/97
ccgucagccaggug

SEQ ID NO: 3141587 - RNA, 15 nt, Mycobacterium bovis subsp bovis AF2122/97
ccgucagccaggugc

SEQ ID NO: 3141588 - RNA, 15 nt, Mycobacterium bovis subsp bovis AF2122/97
ccgucagccguucgg

SEQ ID NO: 3141589 - RNA, 17 nt, Mycobacterium bovis subsp bovis AF2122/97
ccgucagccguucggcu

SEQ ID NO: 3141590 - RNA, 12 nt, Mycobacterium bovis subsp bovis AF2122/97
ccgucagcgccg

SEQ ID NO: 3141591 - RNA, 17 nt, Mycobacterium bovis subsp bovis AF2122/97
ccgucagcgccgcgcgc

SEQ ID NO: 3141592 - RNA, 14 nt, Mycobacterium bovis subsp bovis AF2122/97
ccgucagcgccgcu

SEQ ID NO: 3141593 - RNA, 18 nt, Mycobacterium bovis subsp bovis AF2122/97
ccgucagcgccgcugacu

SEQ ID NO: 3141594 - RNA, 21 nt, Mycobacterium bovis subsp bovis AF2122/97
ccgucagcgccgcugacuccu

SEQ ID NO: 3141595 - RNA, 17 nt, Mycobacterium bovis subsp bovis AF2122/97
ccgucagcgcgaccguc

SEQ ID NO: 3141596 - RNA, 15 nt, Mycobacterium bovis subsp bovis AF2122/97
ccgucagcggacagu

SEQ ID NO: 3141597 - RNA, 12 nt, Mycobacterium bovis subsp bovis AF2122/97
ccgucagcggca

SEQ ID NO: 3141598 - RNA, 23 nt, Mycobacterium bovis subsp bovis AF2122/97
ccgucagcggcaacaugucaccu

SEQ ID NO: 3141599 - RNA, 13 nt, Mycobacterium bovis subsp bovis AF2122/97
ccgucagcggcca

SEQ ID NO: 3141600 - RNA, 16 nt, Mycobacterium bovis subsp bovis AF2122/97
ccgucagcggcggcca

SEQ ID NO: 3141601 - RNA, 14 nt, Mycobacterium bovis subsp bovis AF2122/97
ccgucagcgggcag

SEQ ID NO: 3141602 - RNA, 16 nt, Mycobacterium bovis subsp bovis AF2122/97
ccgucagcgggcagca

SEQ ID NO: 3141603 - RNA, 16 nt, Mycobacterium bovis subsp bovis AF2122/97
ccgucagcgucggcgc

SEQ ID NO: 3141604 - RNA, 15 nt, Mycobacterium bovis subsp bovis AF2122/97
ccgucaggcgugccg

SEQ ID NO: 3141605 - RNA, 15 nt, Mycobacterium bovis subsp bovis AF2122/97
ccgucgaucccgguc

SEQ ID NO: 3141606 - RNA, 17 nt, Mycobacterium bovis subsp bovis AF2122/97
ccgucgauccgucggcg

SEQ ID NO: 3141607 - RNA, 18 nt, Mycobacterium bovis subsp bovis AF2122/97
ccgucgauccgucggcgg

SEQ ID NO: 3141608 - RNA, 16 nt, Mycobacterium bovis subsp bovis AF2122/97
ccgucgauggucagca

SEQ ID NO: 3141609 - RNA, 19 nt, Mycobacterium bovis subsp bovis AF2122/97
ccgucgauguggcgcuccg

SEQ ID NO: 3141610 - RNA, 22 nt, Mycobacterium bovis subsp bovis AF2122/97
ccgucgauguggcgcuccggcg

SEQ ID NO: 3141611 - RNA, 19 nt, Mycobacterium bovis subsp bovis AF2122/97
ccgucgauguugcccagca

SEQ ID NO: 3141612 - RNA, 20 nt, Mycobacterium bovis subsp bovis AF2122/97
ccgucgauugcaggucggcc

SEQ ID NO: 3141613 - RNA, 12 nt, Mycobacterium bovis subsp bovis AF2122/97
ccgucgauuucg

SEQ ID NO: 3141614 - RNA, 11 nt, Mycobacterium bovis subsp bovis AF2122/97
ccgucgcagaa

SEQ ID NO: 3141615 - RNA, 20 nt, Mycobacterium bovis subsp bovis AF2122/97
ccgucgcagccagcugaaca

SEQ ID NO: 3141616 - RNA, 22 nt, Mycobacterium bovis subsp bovis AF2122/97
ccgucgcagccagcugaacacg

SEQ ID NO: 3141617 - RNA, 18 nt, Mycobacterium bovis subsp bovis AF2122/97
ccgucgccaaucugcgcg

SEQ ID NO: 3141618 - RNA, 23 nt, Mycobacterium bovis subsp bovis AF2122/97
ccgucgcccggguggcgucgauc

SEQ ID NO: 3141619 - RNA, 12 nt, Mycobacterium bovis subsp bovis AF2122/97
ccgucgccgcca

SEQ ID NO: 3141620 - RNA, 20 nt, Mycobacterium bovis subsp bovis AF2122/97
ccgucgccgcccgugccgcc

SEQ ID NO: 3141621 - RNA, 22 nt, Mycobacterium bovis subsp bovis AF2122/97
ccgucgccgcccgugccgcccu

SEQ ID NO: 3141622 - RNA, 13 nt, Mycobacterium bovis subsp bovis AF2122/97
ccgucgccgcccu

SEQ ID NO: 3141623 - RNA, 16 nt, Mycobacterium bovis subsp bovis AF2122/97
ccgucgccgcccuggc

SEQ ID NO: 3141624 - RNA, 17 nt, Mycobacterium bovis subsp bovis AF2122/97
ccgucgccgcccuggcc

SEQ ID NO: 3141625 - RNA, 19 nt, Mycobacterium bovis subsp bovis AF2122/97
ccgucgccgcccuggccgc

SEQ ID NO: 3141626 - RNA, 12 nt, Mycobacterium bovis subsp bovis AF2122/97
ccgucgccgccg

SEQ ID NO: 3141627 - RNA, 14 nt, Mycobacterium bovis subsp bovis AF2122/97
ccgucgccgccggc

SEQ ID NO: 3141628 - RNA, 15 nt, Mycobacterium bovis subsp bovis AF2122/97
ccgucgccgccggcg

SEQ ID NO: 3141629 - RNA, 16 nt, Mycobacterium bovis subsp bovis AF2122/97
ccgucgccgccggcgc

SEQ ID NO: 3141630 - RNA, 15 nt, Mycobacterium bovis subsp bovis AF2122/97
ccgucgccgccggcu

SEQ ID NO: 3141631 - RNA, 23 nt, Mycobacterium bovis subsp bovis AF2122/97
ccgucgccgccggcuccggcggu

SEQ ID NO: 3141632 - RNA, 14 nt, Mycobacterium bovis subsp bovis AF2122/97
ccgucgccgccggu

SEQ ID NO: 3141633 - RNA, 14 nt, Mycobacterium bovis subsp bovis AF2122/97
ccgucgccgccguc

SEQ ID NO: 3141634 - RNA, 17 nt, Mycobacterium bovis subsp bovis AF2122/97
ccgucgccgccgucacc

SEQ ID NO: 3141635 - RNA, 20 nt, Mycobacterium bovis subsp bovis AF2122/97
ccgucgccggauagcgcagc

SEQ ID NO: 3141636 - RNA, 12 nt, Mycobacterium bovis subsp bovis AF2122/97
ccgucgccgguc

SEQ ID NO: 3141637 - RNA, 22 nt, Mycobacterium bovis subsp bovis AF2122/97
ccgucgccuccagcagguccgc

SEQ ID NO: 3141638 - RNA, 15 nt, Mycobacterium bovis subsp bovis AF2122/97
ccgucgccugccgac

SEQ ID NO: 3141639 - RNA, 19 nt, Mycobacterium bovis subsp bovis AF2122/97
ccgucgccugccgacgagg

SEQ ID NO: 3141640 - RNA, 18 nt, Mycobacterium bovis subsp bovis AF2122/97
ccgucgcgacgucggccg

SEQ ID NO: 3141641 - RNA, 15 nt, Mycobacterium bovis subsp bovis AF2122/97
ccgucgcgcacggcc

SEQ ID NO: 3141642 - RNA, 18 nt, Mycobacterium bovis subsp bovis AF2122/97
ccgucgcgcgggcgagcg

SEQ ID NO: 3141643 - RNA, 20 nt, Mycobacterium bovis subsp bovis AF2122/97
ccgucgcgcgggcgagcgca

SEQ ID NO: 3141644 - RNA, 17 nt, Mycobacterium bovis subsp bovis AF2122/97
ccgucgcgcucgcacca

SEQ ID NO: 3141645 - RNA, 15 nt, Mycobacterium bovis subsp bovis AF2122/97
ccgucgcgcugccgg

SEQ ID NO: 3141646 - RNA, 16 nt, Mycobacterium bovis subsp bovis AF2122/97
ccgucgcgcugccggc

SEQ ID NO: 3141647 - RNA, 18 nt, Mycobacterium bovis subsp bovis AF2122/97
ccgucgcgcugccggccg

SEQ ID NO: 3141648 - RNA, 13 nt, Mycobacterium bovis subsp bovis AF2122/97
ccgucgcggccgg

SEQ ID NO: 3141649 - RNA, 15 nt, Mycobacterium bovis subsp bovis AF2122/97
ccgucgcggccggcg

SEQ ID NO: 3141650 - RNA, 20 nt, Mycobacterium bovis subsp bovis AF2122/97
ccgucgcggccggcggccgc

SEQ ID NO: 3141651 - RNA, 18 nt, Mycobacterium bovis subsp bovis AF2122/97
ccgucgcggcggcacuac

SEQ ID NO: 3141652 - RNA, 18 nt, Mycobacterium bovis subsp bovis AF2122/97
ccgucgcgggacaacagc

SEQ ID NO: 3141653 - RNA, 16 nt, Mycobacterium bovis subsp bovis AF2122/97
ccgucgcgucgaccgg

SEQ ID NO: 3141654 - RNA, 19 nt, Mycobacterium bovis subsp bovis AF2122/97
ccgucgcguugagcgcagc

SEQ ID NO: 3141655 - RNA, 17 nt, Mycobacterium bovis subsp bovis AF2122/97
ccgucgcuaugcgccgc

SEQ ID NO: 3141656 - RNA, 18 nt, Mycobacterium bovis subsp bovis AF2122/97
ccgucgcuaugcgccgca

SEQ ID NO: 3141657 - RNA, 21 nt, Mycobacterium bovis subsp bovis AF2122/97
ccgucgcugacgcccuccugg

SEQ ID NO: 3141658 - RNA, 17 nt, Mycobacterium bovis subsp bovis AF2122/97
ccgucgcugcccgcgcg

SEQ ID NO: 3141659 - RNA, 15 nt, Mycobacterium bovis subsp bovis AF2122/97
ccgucgcuggccggc

SEQ ID NO: 3141660 - RNA, 16 nt, Mycobacterium bovis subsp bovis AF2122/97
ccgucgcuggccggca

SEQ ID NO: 3141661 - RNA, 18 nt, Mycobacterium bovis subsp bovis AF2122/97
ccgucgcuggccggcacc

SEQ ID NO: 3141662 - RNA, 21 nt, Mycobacterium bovis subsp bovis AF2122/97
ccgucgcuggccggcaccgug

SEQ ID NO: 3141663 - RNA, 15 nt, Mycobacterium bovis subsp bovis AF2122/97
ccgucgcugggaggc

SEQ ID NO: 3141664 - RNA, 15 nt, Mycobacterium bovis subsp bovis AF2122/97
ccgucgcugguggcg

SEQ ID NO: 3141665 - RNA, 21 nt, Mycobacterium bovis subsp bovis AF2122/97
ccgucggaacugaccacgucg

SEQ ID NO: 3141666 - RNA, 15 nt, Mycobacterium bovis subsp bovis AF2122/97
ccgucggagaccagc

SEQ ID NO: 3141667 - RNA, 17 nt, Mycobacterium bovis subsp bovis AF2122/97
ccgucggagaccagcuc

SEQ ID NO: 3141668 - RNA, 18 nt, Mycobacterium bovis subsp bovis AF2122/97
ccgucggagccggccacc

SEQ ID NO: 3141669 - RNA, 20 nt, Mycobacterium bovis subsp bovis AF2122/97
ccgucggagucgacggucac

SEQ ID NO: 3141670 - RNA, 16 nt, Mycobacterium bovis subsp bovis AF2122/97
ccgucggauggaaggc

SEQ ID NO: 3141671 - RNA, 23 nt, Mycobacterium bovis subsp bovis AF2122/97
ccgucggauggaaggcggccagg

SEQ ID NO: 3141672 - RNA, 15 nt, Mycobacterium bovis subsp bovis AF2122/97
ccgucggcaccagca

SEQ ID NO: 3141673 - RNA, 18 nt, Mycobacterium bovis subsp bovis AF2122/97
ccgucggcaccagcagcc

SEQ ID NO: 3141674 - RNA, 23 nt, Mycobacterium bovis subsp bovis AF2122/97
ccgucggcaccagcagccagccc

SEQ ID NO: 3141675 - RNA, 15 nt, Mycobacterium bovis subsp bovis AF2122/97
ccgucggcagcagcg

SEQ ID NO: 3141676 - RNA, 17 nt, Mycobacterium bovis subsp bovis AF2122/97
ccgucggcagcagcggu

SEQ ID NO: 3141677 - RNA, 15 nt, Mycobacterium bovis subsp bovis AF2122/97
ccgucggccaggcca

SEQ ID NO: 3141678 - RNA, 14 nt, Mycobacterium bovis subsp bovis AF2122/97
ccgucggcccgcuc

SEQ ID NO: 3141679 - RNA, 16 nt, Mycobacterium bovis subsp bovis AF2122/97
ccgucggccgagucga

SEQ ID NO: 3141680 - RNA, 13 nt, Mycobacterium bovis subsp bovis AF2122/97
ccgucggcgagca

SEQ ID NO: 3141681 - RNA, 13 nt, Mycobacterium bovis subsp bovis AF2122/97
ccgucggcgcccg

SEQ ID NO: 3141682 - RNA, 12 nt, Mycobacterium bovis subsp bovis AF2122/97
ccgucggcgccg

SEQ ID NO: 3141683 - RNA, 21 nt, Mycobacterium bovis subsp bovis AF2122/97
ccgucggcgcgcaccucggcg

SEQ ID NO: 3141684 - RNA, 16 nt, Mycobacterium bovis subsp bovis AF2122/97
ccgucggcgcucgucg

SEQ ID NO: 3141685 - RNA, 19 nt, Mycobacterium bovis subsp bovis AF2122/97
ccgucggcgugacgucguc

SEQ ID NO: 3141686 - RNA, 19 nt, Mycobacterium bovis subsp bovis AF2122/97
ccgucggcgugcagcagcu

SEQ ID NO: 3141687 - RNA, 12 nt, Mycobacterium bovis subsp bovis AF2122/97
ccgucggcgugg

SEQ ID NO: 3141688 - RNA, 18 nt, Mycobacterium bovis subsp bovis AF2122/97
ccgucgggcacaccgacg

SEQ ID NO: 3141689 - RNA, 13 nt, Mycobacterium bovis subsp bovis AF2122/97
ccgucgggcagca

SEQ ID NO: 3141690 - RNA, 15 nt, Mycobacterium bovis subsp bovis AF2122/97
ccgucgggcccagcc

SEQ ID NO: 3141691 - RNA, 18 nt, Mycobacterium bovis subsp bovis AF2122/97
ccgucgggccgucgggug

SEQ ID NO: 3141692 - RNA, 19 nt, Mycobacterium bovis subsp bovis AF2122/97
ccgugcaccagcgaccagg

SEQ ID NO: 3141693 - RNA, 23 nt, Mycobacterium bovis subsp bovis AF2122/97
ccgugcaccagcgaccaggucgc

SEQ ID NO: 3141694 - RNA, 20 nt, Mycobacterium bovis subsp bovis AF2122/97
ccgugcaccagcucacccgg

SEQ ID NO: 3141695 - RNA, 20 nt, Mycobacterium bovis subsp bovis AF2122/97
ccgugcacgaucgcggugac

SEQ ID NO: 3141696 - RNA, 16 nt, Mycobacterium bovis subsp bovis AF2122/97
ccgugcagcucgguca

SEQ ID NO: 3141697 - RNA, 17 nt, Mycobacterium bovis subsp bovis AF2122/97
ccgugcagcucggucag

SEQ ID NO: 3141698 - RNA, 13 nt, Mycobacterium bovis subsp bovis AF2122/97
ccgugccagccca

SEQ ID NO: 3141699 - RNA, 17 nt, Mycobacterium bovis subsp bovis AF2122/97
ccgugccagcccaggcc

SEQ ID NO: 3141700 - RNA, 18 nt, Mycobacterium bovis subsp bovis AF2122/97
ccgugcccaggccaccgg

SEQ ID NO: 3141701 - RNA, 14 nt, Mycobacterium bovis subsp bovis AF2122/97
ccgugcccggugcg

SEQ ID NO: 3141702 - RNA, 21 nt, Mycobacterium bovis subsp bovis AF2122/97
ccgugccgaaaaucgcagcca

SEQ ID NO: 3141703 - RNA, 12 nt, Mycobacterium bovis subsp bovis AF2122/97
ccgugccgagcg

SEQ ID NO: 3141704 - RNA, 15 nt, Mycobacterium bovis subsp bovis AF2122/97
ccgugccgagcgugc

SEQ ID NO: 3141705 - RNA, 20 nt, Mycobacterium bovis subsp bovis AF2122/97
ccgugccgagcuucagcgcg

SEQ ID NO: 3141706 - RNA, 22 nt, Mycobacterium bovis subsp bovis AF2122/97
ccgugccgagcuucagcgcgcu

SEQ ID NO: 3141707 - RNA, 18 nt, Mycobacterium bovis subsp bovis AF2122/97
ccgugccgaugccggcga

SEQ ID NO: 3141708 - RNA, 19 nt, Mycobacterium bovis subsp bovis AF2122/97
ccgugccgcaucacccggg

SEQ ID NO: 3141709 - RNA, 12 nt, Mycobacterium bovis subsp bovis AF2122/97
ccgugccgccag

SEQ ID NO: 3141710 - RNA, 12 nt, Mycobacterium bovis subsp bovis AF2122/97
ccgugccgcccg

SEQ ID NO: 3141711 - RNA, 18 nt, Mycobacterium bovis subsp bovis AF2122/97
ccgugccgcccgcgccgc

SEQ ID NO: 3141712 - RNA, 19 nt, Mycobacterium bovis subsp bovis AF2122/97
ccgugccgcccgcgccgcc

SEQ ID NO: 3141713 - RNA, 13 nt, Mycobacterium bovis subsp bovis AF2122/97
ccgugccgcccgg

SEQ ID NO: 3141714 - RNA, 19 nt, Mycobacterium bovis subsp bovis AF2122/97
ccgugccgccgacaccacc

SEQ ID NO: 3141715 - RNA, 14 nt, Mycobacterium bovis subsp bovis AF2122/97
ccgugccggugugu

SEQ ID NO: 3141716 - RNA, 21 nt, Mycobacterium bovis subsp bovis AF2122/97
ccgugccgguguguccagcgg

SEQ ID NO: 3141717 - RNA, 22 nt, Mycobacterium bovis subsp bovis AF2122/97
ccgugccgguguguccagcgga

SEQ ID NO: 3141718 - RNA, 12 nt, Mycobacterium bovis subsp bovis AF2122/97
ccgugccgucgg

SEQ ID NO: 3141719 - RNA, 18 nt, Mycobacterium bovis subsp bovis AF2122/97
ccgugccuggccggugcg

SEQ ID NO: 3141720 - RNA, 22 nt, Mycobacterium bovis subsp bovis AF2122/97
ccgugcgaucaccuccgcgacg

SEQ ID NO: 3141721 - RNA, 16 nt, Mycobacterium bovis subsp bovis AF2122/97
ccgugcgaucgucaac

SEQ ID NO: 3141722 - RNA, 23 nt, Mycobacterium bovis subsp bovis AF2122/97
ccgugcgaucgucaacgacgacg

SEQ ID NO: 3141723 - RNA, 18 nt, Mycobacterium bovis subsp bovis AF2122/97
ccgugcgaugcacaaccg

SEQ ID NO: 3141724 - RNA, 21 nt, Mycobacterium bovis subsp bovis AF2122/97
ccgugcgccacggcuguggcc

SEQ ID NO: 3141725 - RNA, 16 nt, Mycobacterium bovis subsp bovis AF2122/97
ccgugcgcgcgcagcu

SEQ ID NO: 3141726 - RNA, 17 nt, Mycobacterium bovis subsp bovis AF2122/97
ccgugcgcgcgcagcug

SEQ ID NO: 3141727 - RNA, 19 nt, Mycobacterium bovis subsp bovis AF2122/97
ccgugcgcgcgcagcugac

SEQ ID NO: 3141728 - RNA, 20 nt, Mycobacterium bovis subsp bovis AF2122/97
ccgugcgcgcgcagcugacg

SEQ ID NO: 3141729 - RNA, 17 nt, Mycobacterium bovis subsp bovis AF2122/97
ccgugcggcggcugccg

SEQ ID NO: 3141730 - RNA, 20 nt, Mycobacterium bovis subsp bovis AF2122/97
ccgugcggcggcugccgguu

SEQ ID NO: 3141731 - RNA, 17 nt, Mycobacterium bovis subsp bovis AF2122/97
ccgugcggcucgccggc

SEQ ID NO: 3141732 - RNA, 17 nt, Mycobacterium bovis subsp bovis AF2122/97
ccgugcgggccggucgu

SEQ ID NO: 3141733 - RNA, 15 nt, Mycobacterium bovis subsp bovis AF2122/97
ccgugcgggucgucc

SEQ ID NO: 3141734 - RNA, 14 nt, Mycobacterium bovis subsp bovis AF2122/97
ccgugcggucgcgc

SEQ ID NO: 3141735 - RNA, 16 nt, Mycobacterium bovis subsp bovis AF2122/97
ccgugcgucgauggcg

SEQ ID NO: 3141736 - RNA, 13 nt, Mycobacterium bovis subsp bovis AF2122/97
ccgugcgugcggg

SEQ ID NO: 3141737 - RNA, 16 nt, Mycobacterium bovis subsp bovis AF2122/97
ccgugcucaccggcgc

SEQ ID NO: 3141738 - RNA, 12 nt, Mycobacterium bovis subsp bovis AF2122/97
ccgugcucacgg

SEQ ID NO: 3141739 - RNA, 18 nt, Mycobacterium bovis subsp bovis AF2122/97
ccgugcucacggcaggcg

SEQ ID NO: 3141740 - RNA, 13 nt, Mycobacterium bovis subsp bovis AF2122/97
ccgugcucgucgu

SEQ ID NO: 3141741 - RNA, 23 nt, Mycobacterium bovis subsp bovis AF2122/97
ccgugcucgucguacaugggcag

SEQ ID NO: 3141742 - RNA, 19 nt, Mycobacterium bovis subsp bovis AF2122/97
ccgugcugaacuccgccgc

SEQ ID NO: 3141743 - RNA, 16 nt, Mycobacterium bovis subsp bovis AF2122/97
ccgugcugcccauccc

SEQ ID NO: 3141744 - RNA, 21 nt, Mycobacterium bovis subsp bovis AF2122/97
ccgugcugcccaucccggccg

SEQ ID NO: 3141745 - RNA, 12 nt, Mycobacterium bovis subsp bovis AF2122/97
ccgugcuggcgc

SEQ ID NO: 3141746 - RNA, 13 nt, Mycobacterium bovis subsp bovis AF2122/97
ccgugcuggcgcc

SEQ ID NO: 3141747 - RNA, 21 nt, Mycobacterium bovis subsp bovis AF2122/97
ccgugcugggcaucaccgacg

SEQ ID NO: 3141748 - RNA, 22 nt, Mycobacterium bovis subsp bovis AF2122/97
ccgugcugggcaucaccgacgc

SEQ ID NO: 3141749 - RNA, 17 nt, Mycobacterium bovis subsp bovis AF2122/97
ccguggaaagccggcgu

SEQ ID NO: 3141750 - RNA, 19 nt, Mycobacterium bovis subsp bovis AF2122/97
ccguggaagacgucgaggu

SEQ ID NO: 3141751 - RNA, 21 nt, Mycobacterium bovis subsp bovis AF2122/97
ccguggaagauguugccgccg

SEQ ID NO: 3141752 - RNA, 23 nt, Mycobacterium bovis subsp bovis AF2122/97
ccguggaagauguugccgccggu

SEQ ID NO: 3141753 - RNA, 21 nt, Mycobacterium bovis subsp bovis AF2122/97
ccguggacgaucaacccgguc

SEQ ID NO: 3141754 - RNA, 21 nt, Mycobacterium bovis subsp bovis AF2122/97
ccguggauaacgacugacaac

SEQ ID NO: 3141755 - RNA, 21 nt, Mycobacterium bovis subsp bovis AF2122/97
ccguggaucaucccgaccagc

SEQ ID NO: 3141756 - RNA, 13 nt, Mycobacterium bovis subsp bovis AF2122/97
ccguggcacccgc

SEQ ID NO: 3141757 - RNA, 15 nt, Mycobacterium bovis subsp bovis AF2122/97
ccguggcaucgccuc

SEQ ID NO: 3141758 - RNA, 11 nt, Mycobacterium bovis subsp bovis AF2122/97
ccguggcccaa

SEQ ID NO: 3141759 - RNA, 22 nt, Mycobacterium bovis subsp bovis AF2122/97
ccguggccgcgaucccggccgu

SEQ ID NO: 3141760 - RNA, 21 nt, Mycobacterium bovis subsp bovis AF2122/97
ccguggccggacccauuggac

SEQ ID NO: 3141761 - RNA, 13 nt, Mycobacterium bovis subsp bovis AF2122/97
ccguggccucgaa

SEQ ID NO: 3141762 - RNA, 20 nt, Mycobacterium bovis subsp bovis AF2122/97
ccguggcgaaugacggccag

SEQ ID NO: 3141763 - RNA, 13 nt, Mycobacterium bovis subsp bovis AF2122/97
ccguggcgcccgc

SEQ ID NO: 3141764 - RNA, 16 nt, Mycobacterium bovis subsp bovis AF2122/97
ccguggcgccggucgc

SEQ ID NO: 3141765 - RNA, 18 nt, Mycobacterium bovis subsp bovis AF2122/97
ccguggcgccggucgccg

SEQ ID NO: 3141766 - RNA, 19 nt, Mycobacterium bovis subsp bovis AF2122/97
ccguggcgccggucgccgg

SEQ ID NO: 3141767 - RNA, 20 nt, Mycobacterium bovis subsp bovis AF2122/97
ccguggcgccggucgccggc

SEQ ID NO: 3141768 - RNA, 13 nt, Mycobacterium bovis subsp bovis AF2122/97
ccguggcgcgacg

SEQ ID NO: 3141769 - RNA, 18 nt, Mycobacterium bovis subsp bovis AF2122/97
ccguggcggccuccuccc

SEQ ID NO: 3141770 - RNA, 20 nt, Mycobacterium bovis subsp bovis AF2122/97
ccguggcggcgggccucggc

SEQ ID NO: 3141771 - RNA, 22 nt, Mycobacterium bovis subsp bovis AF2122/97
ccguggcggcgggccucggcga

SEQ ID NO: 3141772 - RNA, 23 nt, Mycobacterium bovis subsp bovis AF2122/97
ccguggcugcgcucgcccgcggc

SEQ ID NO: 3141773 - RNA, 14 nt, Mycobacterium bovis subsp bovis AF2122/97
ccgugggccugccc

SEQ ID NO: 3141774 - RNA, 16 nt, Mycobacterium bovis subsp bovis AF2122/97
ccgugggccugcccgg

SEQ ID NO: 3141775 - RNA, 18 nt, Mycobacterium bovis subsp bovis AF2122/97
ccgugggccugcccggcg

SEQ ID NO: 3141776 - RNA, 14 nt, Mycobacterium bovis subsp bovis AF2122/97
ccgugggcgacggc

SEQ ID NO: 3141777 - RNA, 20 nt, Mycobacterium bovis subsp bovis AF2122/97
ccgugggcgacggcggcguc

SEQ ID NO: 3141778 - RNA, 13 nt, Mycobacterium bovis subsp bovis AF2122/97
ccguugccaacaa

SEQ ID NO: 3141779 - RNA, 17 nt, Mycobacterium bovis subsp bovis AF2122/97
ccguugccaagcagcug

SEQ ID NO: 3141780 - RNA, 18 nt, Mycobacterium bovis subsp bovis AF2122/97
ccguugcccccauugccg

SEQ ID NO: 3141781 - RNA, 12 nt, Mycobacterium bovis subsp bovis AF2122/97
ccguugcccccg

SEQ ID NO: 3141782 - RNA, 24 nt, Mycobacterium bovis subsp bovis AF2122/97
ccguugccgaaccacgcgcccgca

SEQ ID NO: 3141783 - RNA, 13 nt, Mycobacterium bovis subsp bovis AF2122/97
ccguugccgauca

SEQ ID NO: 3141784 - RNA, 17 nt, Mycobacterium bovis subsp bovis AF2122/97
ccguugccgaucagccc

SEQ ID NO: 3141785 - RNA, 21 nt, Mycobacterium bovis subsp bovis AF2122/97
ccguugccgaucagcccggcc

SEQ ID NO: 3141786 - RNA, 20 nt, Mycobacterium bovis subsp bovis AF2122/97
ccguugccgauccccaggcc

SEQ ID NO: 3141787 - RNA, 21 nt, Mycobacterium bovis subsp bovis AF2122/97
ccguugccgccauuggcaggc

SEQ ID NO: 3141788 - RNA, 15 nt, Mycobacterium bovis subsp bovis AF2122/97
ccguugccgcccacg

SEQ ID NO: 3141789 - RNA, 19 nt, Mycobacterium bovis subsp bovis AF2122/97
ccguugccgccgacgccgc

SEQ ID NO: 3141790 - RNA, 21 nt, Mycobacterium bovis subsp bovis AF2122/97
ccguugccgccgacgccgccg

SEQ ID NO: 3141791 - RNA, 16 nt, Mycobacterium bovis subsp bovis AF2122/97
ccguugccgccggcgc

SEQ ID NO: 3141792 - RNA, 18 nt, Mycobacterium bovis subsp bovis AF2122/97
ccguugccgccggcgccg

SEQ ID NO: 3141793 - RNA, 20 nt, Mycobacterium bovis subsp bovis AF2122/97
ccguugccgccgucaccgcc

SEQ ID NO: 3141794 - RNA, 15 nt, Mycobacterium bovis subsp bovis AF2122/97
ccguugccgccgucg

SEQ ID NO: 3141795 - RNA, 23 nt, Mycobacterium bovis subsp bovis AF2122/97
ccguugccgccguuaccgagccc

SEQ ID NO: 3141796 - RNA, 21 nt, Mycobacterium bovis subsp bovis AF2122/97
ccguugccgccguugccgauc

SEQ ID NO: 3141797 - RNA, 21 nt, Mycobacterium bovis subsp bovis AF2122/97
ccguugccgccguugccgccg

SEQ ID NO: 3141798 - RNA, 23 nt, Mycobacterium bovis subsp bovis AF2122/97
ccguugccgccuuugcccccggu

SEQ ID NO: 3141799 - RNA, 13 nt, Mycobacterium bovis subsp bovis AF2122/97
ccguugccggcgu

SEQ ID NO: 3141800 - RNA, 17 nt, Mycobacterium bovis subsp bovis AF2122/97
ccguugccguacagccc

SEQ ID NO: 3141801 - RNA, 18 nt, Mycobacterium bovis subsp bovis AF2122/97
ccguugccguacagcccg

SEQ ID NO: 3141802 - RNA, 20 nt, Mycobacterium bovis subsp bovis AF2122/97
ccguugccgucgucgccguc

SEQ ID NO: 3141803 - RNA, 21 nt, Mycobacterium bovis subsp bovis AF2122/97
ccguugccgucgucgccgucg

SEQ ID NO: 3141804 - RNA, 22 nt, Mycobacterium bovis subsp bovis AF2122/97
ccguugcgacaccuccgucagc

SEQ ID NO: 3141805 - RNA, 14 nt, Mycobacterium bovis subsp bovis AF2122/97
ccguugcgcaagcu

SEQ ID NO: 3141806 - RNA, 19 nt, Mycobacterium bovis subsp bovis AF2122/97
ccguugcgucugcucggcg

SEQ ID NO: 3141807 - RNA, 23 nt, Mycobacterium bovis subsp bovis AF2122/97
ccguugcuauucgccagcgccgg

SEQ ID NO: 3141808 - RNA, 20 nt, Mycobacterium bovis subsp bovis AF2122/97
ccguugcucccacggcaccc

SEQ ID NO: 3141809 - RNA, 13 nt, Mycobacterium bovis subsp bovis AF2122/97
ccguuggagccgc

SEQ ID NO: 3141810 - RNA, 15 nt, Mycobacterium bovis subsp bovis AF2122/97
ccguuggcaaugacc

SEQ ID NO: 3141811 - RNA, 16 nt, Mycobacterium bovis subsp bovis AF2122/97
ccguuggcucgagccg

SEQ ID NO: 3141812 - RNA, 16 nt, Mycobacterium bovis subsp bovis AF2122/97
ccguugggccaccggc

SEQ ID NO: 3141813 - RNA, 14 nt, Mycobacterium bovis subsp bovis AF2122/97
ccguugggccgacu

SEQ ID NO: 3141814 - RNA, 16 nt, Mycobacterium bovis subsp bovis AF2122/97
ccguugggccgacugg

SEQ ID NO: 3141815 - RNA, 15 nt, Mycobacterium bovis subsp bovis AF2122/97
ccguugggccgcgcc

SEQ ID NO: 3141816 - RNA, 16 nt, Mycobacterium bovis subsp bovis AF2122/97
ccguugggccgcgccc

SEQ ID NO: 3141817 - RNA, 17 nt, Mycobacterium bovis subsp bovis AF2122/97
ccguuggggccguucaa

SEQ ID NO: 3141818 - RNA, 14 nt, Mycobacterium bovis subsp bovis AF2122/97
ccguuggugccgcc

SEQ ID NO: 3141819 - RNA, 20 nt, Mycobacterium bovis subsp bovis AF2122/97
ccguuggugccgccugugcc

SEQ ID NO: 3141820 - RNA, 15 nt, Mycobacterium bovis subsp bovis AF2122/97
ccguuguccagcgcg

SEQ ID NO: 3141821 - RNA, 18 nt, Mycobacterium bovis subsp bovis AF2122/97
ccguuguccagcgcgacg

SEQ ID NO: 3141822 - RNA, 17 nt, Mycobacterium bovis subsp bovis AF2122/97
ccguugucgaccuccuc

SEQ ID NO: 3141823 - RNA, 19 nt, Mycobacterium bovis subsp bovis AF2122/97
ccguugucgaccuccucga

SEQ ID NO: 3141824 - RNA, 12 nt, Mycobacterium bovis subsp bovis AF2122/97
ccguugucggcg

SEQ ID NO: 3141825 - RNA, 18 nt, Mycobacterium bovis subsp bovis AF2122/97
ccguuguggaccaucuuc

SEQ ID NO: 3141826 - RNA, 19 nt, Mycobacterium bovis subsp bovis AF2122/97
ccguuguucuugucggagc

SEQ ID NO: 3141827 - RNA, 22 nt, Mycobacterium bovis subsp bovis AF2122/97
ccguuuacggcccggcacccgg

SEQ ID NO: 3141828 - RNA, 15 nt, Mycobacterium bovis subsp bovis AF2122/97
ccguuuccgccgccg

SEQ ID NO: 3141829 - RNA, 21 nt, Mycobacterium bovis subsp bovis AF2122/97
ccguuuccggcgcuccgccag

SEQ ID NO: 3141830 - RNA, 20 nt, Mycobacterium bovis subsp bovis AF2122/97
ccguuucgaucucgagcagg

SEQ ID NO: 3141831 - RNA, 20 nt, Mycobacterium bovis subsp bovis AF2122/97
ccguuucgccggcgcgccgg

SEQ ID NO: 3141832 - RNA, 13 nt, Mycobacterium bovis subsp bovis AF2122/97
ccguuucggcgcc

SEQ ID NO: 3141833 - RNA, 14 nt, Mycobacterium bovis subsp bovis AF2122/97
ccguuucggcgccg

SEQ ID NO: 3141834 - RNA, 18 nt, Mycobacterium bovis subsp bovis AF2122/97
ccguuugagcggccaccg

SEQ ID NO: 3141835 - RNA, 21 nt, Mycobacterium bovis subsp bovis AF2122/97
ccguuuggccucacccgguca

SEQ ID NO: 3141836 - RNA, 19 nt, Mycobacterium bovis subsp bovis AF2122/97
ccguuuugggugaucgcac

SEQ ID NO: 3141837 - RNA, 17 nt, Mycobacterium bovis subsp bovis AF2122/97
ccuaaaaccccgagccg

SEQ ID NO: 3141838 - RNA, 14 nt, Mycobacterium bovis subsp bovis AF2122/97
ccuaaacaccgcga

SEQ ID NO: 3141839 - RNA, 15 nt, Mycobacterium bovis subsp bovis AF2122/97
ccuaaacccgugcgg

SEQ ID NO: 3141840 - RNA, 19 nt, Mycobacterium bovis subsp bovis AF2122/97
ccuaaauugccgggcccag

SEQ ID NO: 3141841 - RNA, 14 nt, Mycobacterium bovis subsp bovis AF2122/97
ccuaacccgcaccg

SEQ ID NO: 3141842 - RNA, 19 nt, Mycobacterium bovis subsp bovis AF2122/97
ccuaacgaaccagcccgcc

SEQ ID NO: 3141843 - RNA, 15 nt, Mycobacterium bovis subsp bovis AF2122/97
ccuaaggcucaccag

SEQ ID NO: 3141844 - RNA, 19 nt, Mycobacterium bovis subsp bovis AF2122/97
ccuaaggcucaccaggcga

SEQ ID NO: 3141845 - RNA, 14 nt, Mycobacterium bovis subsp bovis AF2122/97
ccuaaguucgccac

SEQ ID NO: 3141846 - RNA, 18 nt, Mycobacterium bovis subsp bovis AF2122/97
ccuacaccggcgcucaau

SEQ ID NO: 3141847 - RNA, 21 nt, Mycobacterium bovis subsp bovis AF2122/97
ccuacccgagaacgcccgagu

SEQ ID NO: 3141848 - RNA, 18 nt, Mycobacterium bovis subsp bovis AF2122/97
ccuaccguacgcagcgug

SEQ ID NO: 3141849 - RNA, 15 nt, Mycobacterium bovis subsp bovis AF2122/97
ccuaccgucgaccac

SEQ ID NO: 3141850 - RNA, 15 nt, Mycobacterium bovis subsp bovis AF2122/97
ccuaccgugcuggca

SEQ ID NO: 3141851 - RNA, 21 nt, Mycobacterium bovis subsp bovis AF2122/97
ccuaccgugcuggcaccagca

SEQ ID NO: 3141852 - RNA, 14 nt, Mycobacterium bovis subsp bovis AF2122/97
ccuacgccgccagc

SEQ ID NO: 3141853 - RNA, 14 nt, Mycobacterium bovis subsp bovis AF2122/97
ccuacugcggucgc

SEQ ID NO: 3141854 - RNA, 19 nt, Mycobacterium bovis subsp bovis AF2122/97
ccuacugcggucgcccagg

SEQ ID NO: 3141855 - RNA, 22 nt, Mycobacterium bovis subsp bovis AF2122/97
ccuagauccaaacacccuugcc

SEQ ID NO: 3141856 - RNA, 13 nt, Mycobacterium bovis subsp bovis AF2122/97
ccuagcaccgcgc

SEQ ID NO: 3141857 - RNA, 15 nt, Mycobacterium bovis subsp bovis AF2122/97
ccuagcaccgcgccg

SEQ ID NO: 3141858 - RNA, 17 nt, Mycobacterium bovis subsp bovis AF2122/97
ccuagcagggugccggc

SEQ ID NO: 3141859 - RNA, 18 nt, Mycobacterium bovis subsp bovis AF2122/97
ccuagcagggugccggcg

SEQ ID NO: 3141860 - RNA, 20 nt, Mycobacterium bovis subsp bovis AF2122/97
ccuagcagggugccggcgcc

SEQ ID NO: 3141861 - RNA, 18 nt, Mycobacterium bovis subsp bovis AF2122/97
ccuagccaacgagcgcgc

SEQ ID NO: 3141862 - RNA, 22 nt, Mycobacterium bovis subsp bovis AF2122/97
ccuagcccgauucugauaucgu

SEQ ID NO: 3141863 - RNA, 18 nt, Mycobacterium bovis subsp bovis AF2122/97
ccuagccgaagcgcccgg

SEQ ID NO: 3141864 - RNA, 20 nt, Mycobacterium bovis subsp bovis AF2122/97
ccuccacuuuuccgccggcc

SEQ ID NO: 3141865 - RNA, 22 nt, Mycobacterium bovis subsp bovis AF2122/97
ccuccagauacaggaacaacgc

SEQ ID NO: 3141866 - RNA, 21 nt, Mycobacterium bovis subsp bovis AF2122/97
ccuccagauaccaccgccgcu

SEQ ID NO: 3141867 - RNA, 11 nt, Mycobacterium bovis subsp bovis AF2122/97
ccuccagcacc

SEQ ID NO: 3141868 - RNA, 16 nt, Mycobacterium bovis subsp bovis AF2122/97
ccuccagcaccacggc

SEQ ID NO: 3141869 - RNA, 15 nt, Mycobacterium bovis subsp bovis AF2122/97
ccuccagcacccggu

SEQ ID NO: 3141870 - RNA, 19 nt, Mycobacterium bovis subsp bovis AF2122/97
ccuccagcacgccguccag

SEQ ID NO: 3141871 - RNA, 16 nt, Mycobacterium bovis subsp bovis AF2122/97
ccuccagcagcgacgg

SEQ ID NO: 3141872 - RNA, 15 nt, Mycobacterium bovis subsp bovis AF2122/97
ccuccagcagguccg

SEQ ID NO: 3141873 - RNA, 18 nt, Mycobacterium bovis subsp bovis AF2122/97
ccuccagcagguccgcgg

SEQ ID NO: 3141874 - RNA, 16 nt, Mycobacterium bovis subsp bovis AF2122/97
ccuccagcgcaccggu

SEQ ID NO: 3141875 - RNA, 18 nt, Mycobacterium bovis subsp bovis AF2122/97
ccuccagcugcgcgggcg

SEQ ID NO: 3141876 - RNA, 20 nt, Mycobacterium bovis subsp bovis AF2122/97
ccuccagggcccugcuggcc

SEQ ID NO: 3141877 - RNA, 23 nt, Mycobacterium bovis subsp bovis AF2122/97
ccuccauuucgucggagaacgcc

SEQ ID NO: 3141878 - RNA, 23 nt, Mycobacterium bovis subsp bovis AF2122/97
ccucccacagguagaccgucucc

SEQ ID NO: 3141879 - RNA, 15 nt, Mycobacterium bovis subsp bovis AF2122/97
ccucccaccagcggc

SEQ ID NO: 3141880 - RNA, 19 nt, Mycobacterium bovis subsp bovis AF2122/97
ccucccaccagcggcggcc

SEQ ID NO: 3141881 - RNA, 22 nt, Mycobacterium bovis subsp bovis AF2122/97
ccucccaccagcggcggcccuu

SEQ ID NO: 3141882 - RNA, 13 nt, Mycobacterium bovis subsp bovis AF2122/97
ccucccacccccg

SEQ ID NO: 3141883 - RNA, 14 nt, Mycobacterium bovis subsp bovis AF2122/97
ccucccacgccgcc

SEQ ID NO: 3141884 - RNA, 15 nt, Mycobacterium bovis subsp bovis AF2122/97
ccucccacgccgccg

SEQ ID NO: 3141885 - RNA, 17 nt, Mycobacterium bovis subsp bovis AF2122/97
ccucccacucacccagc

SEQ ID NO: 3141886 - RNA, 20 nt, Mycobacterium bovis subsp bovis AF2122/97
ccucccagggcucggcggcc

SEQ ID NO: 3141887 - RNA, 23 nt, Mycobacterium bovis subsp bovis AF2122/97
ccucccgcaaugcgagcgcgccg

SEQ ID NO: 3141888 - RNA, 16 nt, Mycobacterium bovis subsp bovis AF2122/97
ccucccgcagccgggc

SEQ ID NO: 3141889 - RNA, 15 nt, Mycobacterium bovis subsp bovis AF2122/97
ccucccgcggcaccu

SEQ ID NO: 3141890 - RNA, 13 nt, Mycobacterium bovis subsp bovis AF2122/97
ccucccgggcccg

SEQ ID NO: 3141891 - RNA, 19 nt, Mycobacterium bovis subsp bovis AF2122/97
ccucccgggcccgcugggc

SEQ ID NO: 3141892 - RNA, 21 nt, Mycobacterium bovis subsp bovis AF2122/97
ccucccgggcccgcugggcuu

SEQ ID NO: 3141893 - RNA, 13 nt, Mycobacterium bovis subsp bovis AF2122/97
ccucccgggccgc

SEQ ID NO: 3141894 - RNA, 18 nt, Mycobacterium bovis subsp bovis AF2122/97
ccuccgacuaacggugcg

SEQ ID NO: 3141895 - RNA, 17 nt, Mycobacterium bovis subsp bovis AF2122/97
ccuccgcaaucgcgacg

SEQ ID NO: 3141896 - RNA, 14 nt, Mycobacterium bovis subsp bovis AF2122/97
ccuccgccaaggag

SEQ ID NO: 3141897 - RNA, 14 nt, Mycobacterium bovis subsp bovis AF2122/97
ccuccgccugcccc

SEQ ID NO: 3141898 - RNA, 17 nt, Mycobacterium bovis subsp bovis AF2122/97
ccuccgccugccccacc

SEQ ID NO: 3141899 - RNA, 17 nt, Mycobacterium bovis subsp bovis AF2122/97
ccuccgcgacggcggcu

SEQ ID NO: 3141900 - RNA, 17 nt, Mycobacterium bovis subsp bovis AF2122/97
ccuccgcgccgaucagc

SEQ ID NO: 3141901 - RNA, 18 nt, Mycobacterium bovis subsp bovis AF2122/97
ccuccgcguagagcagca

SEQ ID NO: 3141902 - RNA, 13 nt, Mycobacterium bovis subsp bovis AF2122/97
ccuccgcguccaa

SEQ ID NO: 3141903 - RNA, 15 nt, Mycobacterium bovis subsp bovis AF2122/97
ccuccgcuagaacag

SEQ ID NO: 3141904 - RNA, 15 nt, Mycobacterium bovis subsp bovis AF2122/97
ccuccgcugccgccc

SEQ ID NO: 3141905 - RNA, 17 nt, Mycobacterium bovis subsp bovis AF2122/97
ccuccggaaggcucgcc

SEQ ID NO: 3141906 - RNA, 21 nt, Mycobacterium bovis subsp bovis AF2122/97
ccuccggaaucgcccgggcgg

SEQ ID NO: 3141907 - RNA, 14 nt, Mycobacterium bovis subsp bovis AF2122/97
ccuccggacccacc

SEQ ID NO: 3141908 - RNA, 16 nt, Mycobacterium bovis subsp bovis AF2122/97
ccuccggacccacccg

SEQ ID NO: 3141909 - RNA, 17 nt, Mycobacterium bovis subsp bovis AF2122/97
ccuccggcaccaacgcc

SEQ ID NO: 3141910 - RNA, 20 nt, Mycobacterium bovis subsp bovis AF2122/97
ccuccggcaccuccagcacc

SEQ ID NO: 3141911 - RNA, 15 nt, Mycobacterium bovis subsp bovis AF2122/97
ccuccggcagcagca

SEQ ID NO: 3141912 - RNA, 22 nt, Mycobacterium bovis subsp bovis AF2122/97
ccuccggcgcagcgaccgguaa

SEQ ID NO: 3141913 - RNA, 13 nt, Mycobacterium bovis subsp bovis AF2122/97
ccuccggcguggc

SEQ ID NO: 3141914 - RNA, 11 nt, Mycobacterium bovis subsp bovis AF2122/97
ccuccgggcca

SEQ ID NO: 3141915 - RNA, 21 nt, Mycobacterium bovis subsp bovis AF2122/97
ccuccggguauggcggcgacg

SEQ ID NO: 3141916 - RNA, 15 nt, Mycobacterium bovis subsp bovis AF2122/97
ccuccggguuggcga

SEQ ID NO: 3141917 - RNA, 20 nt, Mycobacterium bovis subsp bovis AF2122/97
ccuccggguuggcgacgauc

SEQ ID NO: 3141918 - RNA, 16 nt, Mycobacterium bovis subsp bovis AF2122/97
ccuccgguaucggcga

SEQ ID NO: 3141919 - RNA, 18 nt, Mycobacterium bovis subsp bovis AF2122/97
ccuccgguaucggcgacc

SEQ ID NO: 3141920 - RNA, 20 nt, Mycobacterium bovis subsp bovis AF2122/97
ccuccgguaucggcgaccag

SEQ ID NO: 3141921 - RNA, 17 nt, Mycobacterium bovis subsp bovis AF2122/97
ccuccguaacgccaagc

SEQ ID NO: 3141922 - RNA, 20 nt, Mycobacterium bovis subsp bovis AF2122/97
ccuccguaacgccaagcucg

SEQ ID NO: 3141923 - RNA, 24 nt, Mycobacterium bovis subsp bovis AF2122/97
ccuccguaacgccaagcucggccc

SEQ ID NO: 3141924 - RNA, 18 nt, Mycobacterium bovis subsp bovis AF2122/97
ccuccgugggcagcgcgc

SEQ ID NO: 3141925 - RNA, 16 nt, Mycobacterium bovis subsp bovis AF2122/97
ccuccguugcccccau

SEQ ID NO: 3141926 - RNA, 14 nt, Mycobacterium bovis subsp bovis AF2122/97
ccuccuccccgacc

SEQ ID NO: 3141927 - RNA, 20 nt, Mycobacterium bovis subsp bovis AF2122/97
ccuccuccguuuggcugccg

SEQ ID NO: 3141928 - RNA, 23 nt, Mycobacterium bovis subsp bovis AF2122/97
ccuccucgaccguggcggccucc

SEQ ID NO: 3141929 - RNA, 13 nt, Mycobacterium bovis subsp bovis AF2122/97
ccuccucgacguc

SEQ ID NO: 3141930 - RNA, 15 nt, Mycobacterium bovis subsp bovis AF2122/97
ccuccucgacgucgg

SEQ ID NO: 3141931 - RNA, 14 nt, Mycobacterium bovis subsp bovis AF2122/97
ccuccucgagcagg

SEQ ID NO: 3141932 - RNA, 17 nt, Mycobacterium bovis subsp bovis AF2122/97
ccuccucgagcaggaug

SEQ ID NO: 3141933 - RNA, 20 nt, Mycobacterium bovis subsp bovis AF2122/97
ccuccucgaugaggcgcagc

SEQ ID NO: 3141934 - RNA, 23 nt, Mycobacterium bovis subsp bovis AF2122/97
ccuccucgcccauuggccaggug

SEQ ID NO: 3141935 - RNA, 18 nt, Mycobacterium bovis subsp bovis AF2122/97
ccuccucggcaggaagga

SEQ ID NO: 3141936 - RNA, 21 nt, Mycobacterium bovis subsp bovis AF2122/97
ccuccucgucgacgucggcau

SEQ ID NO: 3141937 - RNA, 12 nt, Mycobacterium bovis subsp bovis AF2122/97
ccuccugccgcc

SEQ ID NO: 3141938 - RNA, 13 nt, Mycobacterium bovis subsp bovis AF2122/97
ccuccugccgccg

SEQ ID NO: 3141939 - RNA, 19 nt, Mycobacterium bovis subsp bovis AF2122/97
ccuccugccgccgcuccau

SEQ ID NO: 3141940 - RNA, 14 nt, Mycobacterium bovis subsp bovis AF2122/97
ccuccugcgccgca

SEQ ID NO: 3141941 - RNA, 13 nt, Mycobacterium bovis subsp bovis AF2122/97
ccuccugcuggcc

SEQ ID NO: 3141942 - RNA, 17 nt, Mycobacterium bovis subsp bovis AF2122/97
ccuccuugagccgggca

SEQ ID NO: 3141943 - RNA, 18 nt, Mycobacterium bovis subsp bovis AF2122/97
ccucgaaaccguggccau

SEQ ID NO: 3141944 - RNA, 14 nt, Mycobacterium bovis subsp bovis AF2122/97
ccucgaacgccgcc

SEQ ID NO: 3141945 - RNA, 23 nt, Mycobacterium bovis subsp bovis AF2122/97
ccucgaacgggaaggcauugccc

SEQ ID NO: 3141946 - RNA, 17 nt, Mycobacterium bovis subsp bovis AF2122/97
ccucgaagcccagcacc

SEQ ID NO: 3141947 - RNA, 22 nt, Mycobacterium bovis subsp bovis AF2122/97
ccucgaagcccagcaccaccac

SEQ ID NO: 3141948 - RNA, 17 nt, Mycobacterium bovis subsp bovis AF2122/97
ccucgaaggcacugcga

SEQ ID NO: 3141949 - RNA, 15 nt, Mycobacterium bovis subsp bovis AF2122/97
ccucgaauucggccg

SEQ ID NO: 3141950 - RNA, 21 nt, Mycobacterium bovis subsp bovis AF2122/97
ccucgaauucggccggcgcgg

SEQ ID NO: 3141951 - RNA, 22 nt, Mycobacterium bovis subsp bovis AF2122/97
ccucggagaucgagaucaccuu

SEQ ID NO: 3141952 - RNA, 19 nt, Mycobacterium bovis subsp bovis AF2122/97
ccucggaggugccggugcu

SEQ ID NO: 3141953 - RNA, 20 nt, Mycobacterium bovis subsp bovis AF2122/97
ccucggcaaaccaagcgcgc

SEQ ID NO: 3141954 - RNA, 23 nt, Mycobacterium bovis subsp bovis AF2122/97
ccucggcaaaccaagcgcgccag

SEQ ID NO: 3141955 - RNA, 19 nt, Mycobacterium bovis subsp bovis AF2122/97
ccucggcaagucgacgccg

SEQ ID NO: 3141956 - RNA, 23 nt, Mycobacterium bovis subsp bovis AF2122/97
ccucggcaagucgacgccgcagc

SEQ ID NO: 3141957 - RNA, 23 nt, Mycobacterium bovis subsp bovis AF2122/97
ccucggcacggaccgcgucgcgg

SEQ ID NO: 3141958 - RNA, 14 nt, Mycobacterium bovis subsp bovis AF2122/97
ccucggcacggucg

SEQ ID NO: 3141959 - RNA, 16 nt, Mycobacterium bovis subsp bovis AF2122/97
ccucggcacggucgcc

SEQ ID NO: 3141960 - RNA, 23 nt, Mycobacterium bovis subsp bovis AF2122/97
ccucggcaggaaggacaucgcgc

SEQ ID NO: 3141961 - RNA, 12 nt, Mycobacterium bovis subsp bovis AF2122/97
ccucggcaucgc

SEQ ID NO: 3141962 - RNA, 15 nt, Mycobacterium bovis subsp bovis AF2122/97
ccucggcaucgccgc

SEQ ID NO: 3141963 - RNA, 15 nt, Mycobacterium bovis subsp bovis AF2122/97
ccucggcaugcagcc

SEQ ID NO: 3141964 - RNA, 14 nt, Mycobacterium bovis subsp bovis AF2122/97
ccucggccacccgc

SEQ ID NO: 3141965 - RNA, 21 nt, Mycobacterium bovis subsp bovis AF2122/97
ccucggccagcgucagcuguu

SEQ ID NO: 3141966 - RNA, 23 nt, Mycobacterium bovis subsp bovis AF2122/97
ccucggccagcuccgccugccgc

SEQ ID NO: 3141967 - RNA, 16 nt, Mycobacterium bovis subsp bovis AF2122/97
ccucggccgccagccc

SEQ ID NO: 3141968 - RNA, 13 nt, Mycobacterium bovis subsp bovis AF2122/97
ccucggccgccug

SEQ ID NO: 3141969 - RNA, 18 nt, Mycobacterium bovis subsp bovis AF2122/97
ccucggccucgucgugca

SEQ ID NO: 3141970 - RNA, 12 nt, Mycobacterium bovis subsp bovis AF2122/97
ccucggcgacca

SEQ ID NO: 3141971 - RNA, 22 nt, Mycobacterium bovis subsp bovis AF2122/97
ccucggcgaccaucugaucggg

SEQ ID NO: 3141972 - RNA, 19 nt, Mycobacterium bovis subsp bovis AF2122/97
ccucggcgaccgcgucguc

SEQ ID NO: 3141973 - RNA, 21 nt, Mycobacterium bovis subsp bovis AF2122/97
ccucggcgaccugcucgcugg

SEQ ID NO: 3141974 - RNA, 15 nt, Mycobacterium bovis subsp bovis AF2122/97
ccucggcgaccuggc

SEQ ID NO: 3141975 - RNA, 14 nt, Mycobacterium bovis subsp bovis AF2122/97
ccucggcgacgucg

SEQ ID NO: 3141976 - RNA, 18 nt, Mycobacterium bovis subsp bovis AF2122/97
ccucggcgagcacgucac

SEQ ID NO: 3141977 - RNA, 22 nt, Mycobacterium bovis subsp bovis AF2122/97
ccucggcgaucaauugcccggc

SEQ ID NO: 3141978 - RNA, 18 nt, Mycobacterium bovis subsp bovis AF2122/97
ccucggcgaugggccggu

SEQ ID NO: 3141979 - RNA, 12 nt, Mycobacterium bovis subsp bovis AF2122/97
ccucggcgaugu

SEQ ID NO: 3141980 - RNA, 13 nt, Mycobacterium bovis subsp bovis AF2122/97
ccucggcgccgcc

SEQ ID NO: 3141981 - RNA, 16 nt, Mycobacterium bovis subsp bovis AF2122/97
ccucggcgccgcccag

SEQ ID NO: 3141982 - RNA, 12 nt, Mycobacterium bovis subsp bovis AF2122/97
ccucggcgccgu

SEQ ID NO: 3141983 - RNA, 23 nt, Mycobacterium bovis subsp bovis AF2122/97
ccucggcgccgucggagccggcc

SEQ ID NO: 3141984 - RNA, 15 nt, Mycobacterium bovis subsp bovis AF2122/97
ccucggcggccagcu

SEQ ID NO: 3141985 - RNA, 20 nt, Mycobacterium bovis subsp bovis AF2122/97
ccucggcggccagcucggcc

SEQ ID NO: 3141986 - RNA, 12 nt, Mycobacterium bovis subsp bovis AF2122/97
ccucggcggccg

SEQ ID NO: 3141987 - RNA, 15 nt, Mycobacterium bovis subsp bovis AF2122/97
ccucggcggcggcac

SEQ ID NO: 3141988 - RNA, 14 nt, Mycobacterium bovis subsp bovis AF2122/97
ccucggcgggaucc

SEQ ID NO: 3141989 - RNA, 22 nt, Mycobacterium bovis subsp bovis AF2122/97
ccucggcguaggcgauggcggc

SEQ ID NO: 3141990 - RNA, 13 nt, Mycobacterium bovis subsp bovis AF2122/97
ccucggcguggca

SEQ ID NO: 3141991 - RNA, 16 nt, Mycobacterium bovis subsp bovis AF2122/97
ccucgggaggcagcgc

SEQ ID NO: 3141992 - RNA, 17 nt, Mycobacterium bovis subsp bovis AF2122/97
ccucgggaggcagcgcg

SEQ ID NO: 3141993 - RNA, 18 nt, Mycobacterium bovis subsp bovis AF2122/97
ccucgggaggcagcgcga

SEQ ID NO: 3141994 - RNA, 21 nt, Mycobacterium bovis subsp bovis AF2122/97
ccucgggaggcagcgcgaggc

SEQ ID NO: 3141995 - RNA, 14 nt, Mycobacterium bovis subsp bovis AF2122/97
ccucgggaucaccg

SEQ ID NO: 3141996 - RNA, 14 nt, Mycobacterium bovis subsp bovis AF2122/97
ccucgggaucggcg

SEQ ID NO: 3141997 - RNA, 15 nt, Mycobacterium bovis subsp bovis AF2122/97
ccucgggaucggcgg

SEQ ID NO: 3141998 - RNA, 17 nt, Mycobacterium bovis subsp bovis AF2122/97
ccucgggcaccuggucg

SEQ ID NO: 3141999 - RNA, 17 nt, Mycobacterium bovis subsp bovis AF2122/97
ccucgggcaggcggcca

SEQ ID NO: 3142000 - RNA, 13 nt, Mycobacterium bovis subsp bovis AF2122/97
ccucgggccggcg

SEQ ID NO: 3142001 - RNA, 19 nt, Mycobacterium bovis subsp bovis AF2122/97
ccucggggaacaccgcggu

SEQ ID NO: 3142002 - RNA, 16 nt, Mycobacterium bovis subsp bovis AF2122/97
ccucgggguagccaac

SEQ ID NO: 3142003 - RNA, 17 nt, Mycobacterium bovis subsp bovis AF2122/97
ccucgggguuacguugu

SEQ ID NO: 3142004 - RNA, 23 nt, Mycobacterium bovis subsp bovis AF2122/97
ccucgggguucuuccacagcgcg

SEQ ID NO: 3142005 - RNA, 22 nt, Mycobacterium bovis subsp bovis AF2122/97
ccucgggugucacagugguggg

SEQ ID NO: 3142006 - RNA, 21 nt, Mycobacterium bovis subsp bovis AF2122/97
ccucgguagcauccagcgcgc

SEQ ID NO: 3142007 - RNA, 14 nt, Mycobacterium bovis subsp bovis AF2122/97
ccucggucaccgag

SEQ ID NO: 3142008 - RNA, 15 nt, Mycobacterium bovis subsp bovis AF2122/97
ccucggucaccgagg

SEQ ID NO: 3142009 - RNA, 16 nt, Mycobacterium bovis subsp bovis AF2122/97
ccucggucaccgaggg

SEQ ID NO: 3142010 - RNA, 17 nt, Mycobacterium bovis subsp bovis AF2122/97
ccucggucagcucgucg

SEQ ID NO: 3142011 - RNA, 20 nt, Mycobacterium bovis subsp bovis AF2122/97
ccucggucccguugccgccc

SEQ ID NO: 3142012 - RNA, 14 nt, Mycobacterium bovis subsp bovis AF2122/97
ccucggucugcucc

SEQ ID NO: 3142013 - RNA, 17 nt, Mycobacterium bovis subsp bovis AF2122/97
ccucggugaccaggccg

SEQ ID NO: 3142014 - RNA, 19 nt, Mycobacterium bovis subsp bovis AF2122/97
ccucggugaccaggccggc

SEQ ID NO: 3142015 - RNA, 20 nt, Mycobacterium bovis subsp bovis AF2122/97
ccucggugaccaggccggcc

SEQ ID NO: 3142016 - RNA, 23 nt, Mycobacterium bovis subsp bovis AF2122/97
ccucggugaccaggccggcccgc

SEQ ID NO: 3142017 - RNA, 22 nt, Mycobacterium bovis subsp bovis AF2122/97
ccucggugacuucacucguuga

SEQ ID NO: 3142018 - RNA, 17 nt, Mycobacterium bovis subsp bovis AF2122/97
ccucggugccacugccg

SEQ ID NO: 3142019 - RNA, 21 nt, Mycobacterium bovis subsp bovis AF2122/97
ccucggugcggaacaccgccc

SEQ ID NO: 3142020 - RNA, 22 nt, Mycobacterium bovis subsp bovis AF2122/97
ccucggugcggaacaccgcccg

SEQ ID NO: 3142021 - RNA, 23 nt, Mycobacterium bovis subsp bovis AF2122/97
ccucggugcggaacaccgcccgg

SEQ ID NO: 3142022 - RNA, 22 nt, Mycobacterium bovis subsp bovis AF2122/97
ccucgguggucuuggcccggcg

SEQ ID NO: 3142023 - RNA, 22 nt, Mycobacterium bovis subsp bovis AF2122/97
ccucggugugcucgccgaccag

SEQ ID NO: 3142024 - RNA, 17 nt, Mycobacterium bovis subsp bovis AF2122/97
ccucguaauccacgccg

SEQ ID NO: 3142025 - RNA, 23 nt, Mycobacterium bovis subsp bovis AF2122/97
ccucguacucaucgacguuccag

SEQ ID NO: 3142026 - RNA, 22 nt, Mycobacterium bovis subsp bovis AF2122/97
ccucguagaacgcuagcgccaa

SEQ ID NO: 3142027 - RNA, 22 nt, Mycobacterium bovis subsp bovis AF2122/97
ccucguauacccgggcggucga

SEQ ID NO: 3142028 - RNA, 20 nt, Mycobacterium bovis subsp bovis AF2122/97
ccucguaugccguggccgcc

SEQ ID NO: 3142029 - RNA, 21 nt, Mycobacterium bovis subsp bovis AF2122/97
ccucgucaaucaccaccgcca

SEQ ID NO: 3142030 - RNA, 13 nt, Mycobacterium bovis subsp bovis AF2122/97
ccucgucacccgg

SEQ ID NO: 3142031 - RNA, 23 nt, Mycobacterium bovis subsp bovis AF2122/97
ccucguccugcgagaggugcugc

SEQ ID NO: 3142032 - RNA, 14 nt, Mycobacterium bovis subsp bovis AF2122/97
ccucgucgaccggg

SEQ ID NO: 3142033 - RNA, 22 nt, Mycobacterium bovis subsp bovis AF2122/97
ccucgucgagagguucgccguc

SEQ ID NO: 3142034 - RNA, 17 nt, Mycobacterium bovis subsp bovis AF2122/97
ccucgucgagcgugcgc

SEQ ID NO: 3142035 - RNA, 19 nt, Mycobacterium bovis subsp bovis AF2122/97
ccucgucgagcgugcgcac

SEQ ID NO: 3142036 - RNA, 11 nt, Mycobacterium bovis subsp bovis AF2122/97
ccucgucgagg

SEQ ID NO: 3142037 - RNA, 16 nt, Mycobacterium bovis subsp bovis AF2122/97
ccugaguccggcacgc

SEQ ID NO: 3142038 - RNA, 23 nt, Mycobacterium bovis subsp bovis AF2122/97
ccugagucggcauugcugguugc

SEQ ID NO: 3142039 - RNA, 17 nt, Mycobacterium bovis subsp bovis AF2122/97
ccugaguugcggugugc

SEQ ID NO: 3142040 - RNA, 18 nt, Mycobacterium bovis subsp bovis AF2122/97
ccugauaaagcccggcgg

SEQ ID NO: 3142041 - RNA, 21 nt, Mycobacterium bovis subsp bovis AF2122/97
ccugauaccaauccggcugcg

SEQ ID NO: 3142042 - RNA, 19 nt, Mycobacterium bovis subsp bovis AF2122/97
ccugauaugacuugcgcgc

SEQ ID NO: 3142043 - RNA, 21 nt, Mycobacterium bovis subsp bovis AF2122/97
ccugauaugacuugcgcgcgg

SEQ ID NO: 3142044 - RNA, 22 nt, Mycobacterium bovis subsp bovis AF2122/97
ccugaucaaggaccgcucugcg

SEQ ID NO: 3142045 - RNA, 18 nt, Mycobacterium bovis subsp bovis AF2122/97
ccugauccgccugccgac

SEQ ID NO: 3142046 - RNA, 15 nt, Mycobacterium bovis subsp bovis AF2122/97
ccugauccggccggu

SEQ ID NO: 3142047 - RNA, 20 nt, Mycobacterium bovis subsp bovis AF2122/97
ccugaucgagcgccagcgcc

SEQ ID NO: 3142048 - RNA, 22 nt, Mycobacterium bovis subsp bovis AF2122/97
ccugaucgaguuccgcaucggc

SEQ ID NO: 3142049 - RNA, 13 nt, Mycobacterium bovis subsp bovis AF2122/97
ccugaucgcgcag

SEQ ID NO: 3142050 - RNA, 22 nt, Mycobacterium bovis subsp bovis AF2122/97
ccugaugaugugggcgauggca

SEQ ID NO: 3142051 - RNA, 22 nt, Mycobacterium bovis subsp bovis AF2122/97
ccugaugugaguccagccggcg

SEQ ID NO: 3142052 - RNA, 13 nt, Mycobacterium bovis subsp bovis AF2122/97
ccugcaacgccgc

SEQ ID NO: 3142053 - RNA, 19 nt, Mycobacterium bovis subsp bovis AF2122/97
ccugcaacgccgcggacca

SEQ ID NO: 3142054 - RNA, 21 nt, Mycobacterium bovis subsp bovis AF2122/97
ccugcaacgucacucccuggc

SEQ ID NO: 3142055 - RNA, 18 nt, Mycobacterium bovis subsp bovis AF2122/97
ccugcaagaaccacugca

SEQ ID NO: 3142056 - RNA, 19 nt, Mycobacterium bovis subsp bovis AF2122/97
ccugcaagaaccacugcau

SEQ ID NO: 3142057 - RNA, 21 nt, Mycobacterium bovis subsp bovis AF2122/97
ccugcaagacgccgauccggu

SEQ ID NO: 3142058 - RNA, 19 nt, Mycobacterium bovis subsp bovis AF2122/97
ccugcaagcuaagcgccug

SEQ ID NO: 3142059 - RNA, 12 nt, Mycobacterium bovis subsp bovis AF2122/97
ccugcacagcag

SEQ ID NO: 3142060 - RNA, 13 nt, Mycobacterium bovis subsp bovis AF2122/97
ccugcacagcagc

SEQ ID NO: 3142061 - RNA, 14 nt, Mycobacterium bovis subsp bovis AF2122/97
ccugcacagcagcg

SEQ ID NO: 3142062 - RNA, 13 nt, Mycobacterium bovis subsp bovis AF2122/97
ccugcaccacggc

SEQ ID NO: 3142063 - RNA, 18 nt, Mycobacterium bovis subsp bovis AF2122/97
ccugcaccacggcggcca

SEQ ID NO: 3142064 - RNA, 19 nt, Mycobacterium bovis subsp bovis AF2122/97
ccugcaccacggcggccac

SEQ ID NO: 3142065 - RNA, 22 nt, Mycobacterium bovis subsp bovis AF2122/97
ccugcaccacggcggccaccug

SEQ ID NO: 3142066 - RNA, 23 nt, Mycobacterium bovis subsp bovis AF2122/97
ccugcaccacggcggccaccugc

SEQ ID NO: 3142067 - RNA, 13 nt, Mycobacterium bovis subsp bovis AF2122/97
ccugcaccagcga

SEQ ID NO: 3142068 - RNA, 19 nt, Mycobacterium bovis subsp bovis AF2122/97
ccugcacccagccgugccc

SEQ ID NO: 3142069 - RNA, 15 nt, Mycobacterium bovis subsp bovis AF2122/97
ccugcacccgacccg

SEQ ID NO: 3142070 - RNA, 12 nt, Mycobacterium bovis subsp bovis AF2122/97
ccugcacccggc

SEQ ID NO: 3142071 - RNA, 14 nt, Mycobacterium bovis subsp bovis AF2122/97
ccugcaccgccgcc

SEQ ID NO: 3142072 - RNA, 21 nt, Mycobacterium bovis subsp bovis AF2122/97
ccugcaccgccgccgcccgua

SEQ ID NO: 3142073 - RNA, 22 nt, Mycobacterium bovis subsp bovis AF2122/97
ccugcaccgucacgucguuugg

SEQ ID NO: 3142074 - RNA, 19 nt, Mycobacterium bovis subsp bovis AF2122/97
ccugcacgacccgcugguc

SEQ ID NO: 3142075 - RNA, 15 nt, Mycobacterium bovis subsp bovis AF2122/97
ccugcacgccggcgc

SEQ ID NO: 3142076 - RNA, 16 nt, Mycobacterium bovis subsp bovis AF2122/97
ccugcacgccggcgcu

SEQ ID NO: 3142077 - RNA, 19 nt, Mycobacterium bovis subsp bovis AF2122/97
ccugcacgugacccugggg

SEQ ID NO: 3142078 - RNA, 17 nt, Mycobacterium bovis subsp bovis AF2122/97
ccugcagcccgggcagc

SEQ ID NO: 3142079 - RNA, 23 nt, Mycobacterium bovis subsp bovis AF2122/97
ccugcagcgaaacaccggccagc

SEQ ID NO: 3142080 - RNA, 15 nt, Mycobacterium bovis subsp bovis AF2122/97
ccugcaggccgccgg

SEQ ID NO: 3142081 - RNA, 20 nt, Mycobacterium bovis subsp bovis AF2122/97
ccugcaggccgccggccagc

SEQ ID NO: 3142082 - RNA, 19 nt, Mycobacterium bovis subsp bovis AF2122/97
ccugcagguuuccggccug

SEQ ID NO: 3142083 - RNA, 23 nt, Mycobacterium bovis subsp bovis AF2122/97
ccugcauaggcgcggucaccgcg

SEQ ID NO: 3142084 - RNA, 18 nt, Mycobacterium bovis subsp bovis AF2122/97
ccugccaaugcugcaggu

SEQ ID NO: 3142085 - RNA, 14 nt, Mycobacterium bovis subsp bovis AF2122/97
ccugccacagcgac

SEQ ID NO: 3142086 - RNA, 12 nt, Mycobacterium bovis subsp bovis AF2122/97
ccugccacccgg

SEQ ID NO: 3142087 - RNA, 14 nt, Mycobacterium bovis subsp bovis AF2122/97
ccugccacccggcc

SEQ ID NO: 3142088 - RNA, 14 nt, Mycobacterium bovis subsp bovis AF2122/97
ccugccaccggcgc

SEQ ID NO: 3142089 - RNA, 18 nt, Mycobacterium bovis subsp bovis AF2122/97
ccugccacgacgaacacc

SEQ ID NO: 3142090 - RNA, 14 nt, Mycobacterium bovis subsp bovis AF2122/97
ccugccaguccgca

SEQ ID NO: 3142091 - RNA, 16 nt, Mycobacterium bovis subsp bovis AF2122/97
ccugccaguccgcagc

SEQ ID NO: 3142092 - RNA, 13 nt, Mycobacterium bovis subsp bovis AF2122/97
ccugccaguccug

SEQ ID NO: 3142093 - RNA, 18 nt, Mycobacterium bovis subsp bovis AF2122/97
ccugccaguccugaugac

SEQ ID NO: 3142094 - RNA, 13 nt, Mycobacterium bovis subsp bovis AF2122/97
ccugccagugggc

SEQ ID NO: 3142095 - RNA, 17 nt, Mycobacterium bovis subsp bovis AF2122/97
ccugccagugggccgac

SEQ ID NO: 3142096 - RNA, 22 nt, Mycobacterium bovis subsp bovis AF2122/97
ccugccauaggcccacggcagc

SEQ ID NO: 3142097 - RNA, 14 nt, Mycobacterium bovis subsp bovis AF2122/97
ccugccaucacgcg

SEQ ID NO: 3142098 - RNA, 15 nt, Mycobacterium bovis subsp bovis AF2122/97
ccugccaucacgcgc

SEQ ID NO: 3142099 - RNA, 16 nt, Mycobacterium bovis subsp bovis AF2122/97
ccugcccaacccauau

SEQ ID NO: 3142100 - RNA, 12 nt, Mycobacterium bovis subsp bovis AF2122/97
ccugcccaccau

SEQ ID NO: 3142101 - RNA, 15 nt, Mycobacterium bovis subsp bovis AF2122/97
ccugcccaccauccc

SEQ ID NO: 3142102 - RNA, 14 nt, Mycobacterium bovis subsp bovis AF2122/97
ccugcccaccuucg

SEQ ID NO: 3142103 - RNA, 14 nt, Mycobacterium bovis subsp bovis AF2122/97
ccugcccacgcgga

SEQ ID NO: 3142104 - RNA, 13 nt, Mycobacterium bovis subsp bovis AF2122/97
ccugcccagcacc

SEQ ID NO: 3142105 - RNA, 19 nt, Mycobacterium bovis subsp bovis AF2122/97
ccugcccccgcgcgcacgg

SEQ ID NO: 3142106 - RNA, 19 nt, Mycobacterium bovis subsp bovis AF2122/97
ccugcccccggcgcggcgg

SEQ ID NO: 3142107 - RNA, 12 nt, Mycobacterium bovis subsp bovis AF2122/97
ccugcccggccc

SEQ ID NO: 3142108 - RNA, 13 nt, Mycobacterium bovis subsp bovis AF2122/97
ccugcccggcccg

SEQ ID NO: 3142109 - RNA, 15 nt, Mycobacterium bovis subsp bovis AF2122/97
ccugcccggcccgcc

SEQ ID NO: 3142110 - RNA, 17 nt, Mycobacterium bovis subsp bovis AF2122/97
ccugcccggcccgcccg

SEQ ID NO: 3142111 - RNA, 19 nt, Mycobacterium bovis subsp bovis AF2122/97
ccugcccggcccgcccgua

SEQ ID NO: 3142112 - RNA, 20 nt, Mycobacterium bovis subsp bovis AF2122/97
ccugcccggcccgcucagcc

SEQ ID NO: 3142113 - RNA, 13 nt, Mycobacterium bovis subsp bovis AF2122/97
ccugcccggcgcc

SEQ ID NO: 3142114 - RNA, 20 nt, Mycobacterium bovis subsp bovis AF2122/97
ccugcccguaauugcaggug

SEQ ID NO: 3142115 - RNA, 20 nt, Mycobacterium bovis subsp bovis AF2122/97
ccugcccgucgucggcaacc

SEQ ID NO: 3142116 - RNA, 13 nt, Mycobacterium bovis subsp bovis AF2122/97
ccugcccuagccc

SEQ ID NO: 3142117 - RNA, 13 nt, Mycobacterium bovis subsp bovis AF2122/97
ccugcccuccgug

SEQ ID NO: 3142118 - RNA, 22 nt, Mycobacterium bovis subsp bovis AF2122/97
ccugccgaaacgccgaccgcgc

SEQ ID NO: 3142119 - RNA, 17 nt, Mycobacterium bovis subsp bovis AF2122/97
ccugccgaacccggcgg

SEQ ID NO: 3142120 - RNA, 22 nt, Mycobacterium bovis subsp bovis AF2122/97
ccugccgacaguuuaccgugcc

SEQ ID NO: 3142121 - RNA, 12 nt, Mycobacterium bovis subsp bovis AF2122/97
ccugccgacgcu

SEQ ID NO: 3142122 - RNA, 13 nt, Mycobacterium bovis subsp bovis AF2122/97
ccugccgacggca

SEQ ID NO: 3142123 - RNA, 14 nt, Mycobacterium bovis subsp bovis AF2122/97
ccugccgaucccgu

SEQ ID NO: 3142124 - RNA, 12 nt, Mycobacterium bovis subsp bovis AF2122/97
ccugggcgcgcu

SEQ ID NO: 3142125 - RNA, 15 nt, Mycobacterium bovis subsp bovis AF2122/97
ccugggcgcgcuggc

SEQ ID NO: 3142126 - RNA, 19 nt, Mycobacterium bovis subsp bovis AF2122/97
ccugggcgcgcuggcgggc

SEQ ID NO: 3142127 - RNA, 15 nt, Mycobacterium bovis subsp bovis AF2122/97
ccugggcggccagca

SEQ ID NO: 3142128 - RNA, 16 nt, Mycobacterium bovis subsp bovis AF2122/97
ccugggcggccgggcu

SEQ ID NO: 3142129 - RNA, 23 nt, Mycobacterium bovis subsp bovis AF2122/97
ccugggcggcgcgaagucuugac

SEQ ID NO: 3142130 - RNA, 17 nt, Mycobacterium bovis subsp bovis AF2122/97
ccugggcgggcuuggcg

SEQ ID NO: 3142131 - RNA, 13 nt, Mycobacterium bovis subsp bovis AF2122/97
ccugggcgucgac

SEQ ID NO: 3142132 - RNA, 16 nt, Mycobacterium bovis subsp bovis AF2122/97
ccugggcgucgaccac

SEQ ID NO: 3142133 - RNA, 14 nt, Mycobacterium bovis subsp bovis AF2122/97
ccugggcugccggc

SEQ ID NO: 3142134 - RNA, 17 nt, Mycobacterium bovis subsp bovis AF2122/97
ccugggcugccggccag

SEQ ID NO: 3142135 - RNA, 13 nt, Mycobacterium bovis subsp bovis AF2122/97
ccugggcuuggcg

SEQ ID NO: 3142136 - RNA, 13 nt, Mycobacterium bovis subsp bovis AF2122/97
ccuggggcagccg

SEQ ID NO: 3142137 - RNA, 19 nt, Mycobacterium bovis subsp bovis AF2122/97
ccuggggccaccagaacca

SEQ ID NO: 3142138 - RNA, 12 nt, Mycobacterium bovis subsp bovis AF2122/97
ccuggggccgca

SEQ ID NO: 3142139 - RNA, 14 nt, Mycobacterium bovis subsp bovis AF2122/97
ccuggggccguccg

SEQ ID NO: 3142140 - RNA, 16 nt, Mycobacterium bovis subsp bovis AF2122/97
ccuggggccguccggc

SEQ ID NO: 3142141 - RNA, 18 nt, Mycobacterium bovis subsp bovis AF2122/97
ccuggggguggcagcgcg

SEQ ID NO: 3142142 - RNA, 20 nt, Mycobacterium bovis subsp bovis AF2122/97
ccuggggguggcagcgcggc

SEQ ID NO: 3142143 - RNA, 15 nt, Mycobacterium bovis subsp bovis AF2122/97
ccuggggugcucggg

SEQ ID NO: 3142144 - RNA, 17 nt, Mycobacterium bovis subsp bovis AF2122/97
ccuggguauccaccgcg

SEQ ID NO: 3142145 - RNA, 18 nt, Mycobacterium bovis subsp bovis AF2122/97
ccuggguauccaccgcga

SEQ ID NO: 3142146 - RNA, 16 nt, Mycobacterium bovis subsp bovis AF2122/97
ccugggugccggcagc

SEQ ID NO: 3142147 - RNA, 14 nt, Mycobacterium bovis subsp bovis AF2122/97
ccuggguggcgucg

SEQ ID NO: 3142148 - RNA, 17 nt, Mycobacterium bovis subsp bovis AF2122/97
ccugggugucgcggguu

SEQ ID NO: 3142149 - RNA, 17 nt, Mycobacterium bovis subsp bovis AF2122/97
ccuggguugaccgccac

SEQ ID NO: 3142150 - RNA, 21 nt, Mycobacterium bovis subsp bovis AF2122/97
ccuggguuggugauugcggcc

SEQ ID NO: 3142151 - RNA, 22 nt, Mycobacterium bovis subsp bovis AF2122/97
ccuggguuggugauugcggccg

SEQ ID NO: 3142152 - RNA, 16 nt, Mycobacterium bovis subsp bovis AF2122/97
ccugguaaggccggcc

SEQ ID NO: 3142153 - RNA, 14 nt, Mycobacterium bovis subsp bovis AF2122/97
ccugguacucccgc

SEQ ID NO: 3142154 - RNA, 15 nt, Mycobacterium bovis subsp bovis AF2122/97
ccugguacucccgcg

SEQ ID NO: 3142155 - RNA, 20 nt, Mycobacterium bovis subsp bovis AF2122/97
ccugguccaggcccuggcca

SEQ ID NO: 3142156 - RNA, 16 nt, Mycobacterium bovis subsp bovis AF2122/97
ccuggucgagcacgcu

SEQ ID NO: 3142157 - RNA, 14 nt, Mycobacterium bovis subsp bovis AF2122/97
ccuggucgcgcagc

SEQ ID NO: 3142158 - RNA, 20 nt, Mycobacterium bovis subsp bovis AF2122/97
ccuggucgcuggugcacggc

SEQ ID NO: 3142159 - RNA, 16 nt, Mycobacterium bovis subsp bovis AF2122/97
ccuggucggccagguc

SEQ ID NO: 3142160 - RNA, 13 nt, Mycobacterium bovis subsp bovis AF2122/97
ccuggucggccgc

SEQ ID NO: 3142161 - RNA, 17 nt, Mycobacterium bovis subsp bovis AF2122/97
ccuggugcaaccgugcc

SEQ ID NO: 3142162 - RNA, 18 nt, Mycobacterium bovis subsp bovis AF2122/97
ccugguggacucgggcgc

SEQ ID NO: 3142163 - RNA, 13 nt, Mycobacterium bovis subsp bovis AF2122/97
ccugguggcagac

SEQ ID NO: 3142164 - RNA, 19 nt, Mycobacterium bovis subsp bovis AF2122/97
ccugguguacacacccgcc

SEQ ID NO: 3142165 - RNA, 21 nt, Mycobacterium bovis subsp bovis AF2122/97
ccugguguacacacccgccuc

SEQ ID NO: 3142166 - RNA, 22 nt, Mycobacterium bovis subsp bovis AF2122/97
ccugguguucgggcagcuggcg

SEQ ID NO: 3142167 - RNA, 14 nt, Mycobacterium bovis subsp bovis AF2122/97
ccugguuauucgac

SEQ ID NO: 3142168 - RNA, 15 nt, Mycobacterium bovis subsp bovis AF2122/97
ccugguuccagaggc

SEQ ID NO: 3142169 - RNA, 19 nt, Mycobacterium bovis subsp bovis AF2122/97
ccugguucgacucaugccg

SEQ ID NO: 3142170 - RNA, 20 nt, Mycobacterium bovis subsp bovis AF2122/97
ccugguucgacucaugccga

SEQ ID NO: 3142171 - RNA, 21 nt, Mycobacterium bovis subsp bovis AF2122/97
ccugguugaccucggugaaga

SEQ ID NO: 3142172 - RNA, 17 nt, Mycobacterium bovis subsp bovis AF2122/97
ccugguugaggucaccc

SEQ ID NO: 3142173 - RNA, 18 nt, Mycobacterium bovis subsp bovis AF2122/97
ccugguugaggucacccg

SEQ ID NO: 3142174 - RNA, 20 nt, Mycobacterium bovis subsp bovis AF2122/97
ccugguugaggucacccggu

SEQ ID NO: 3142175 - RNA, 23 nt, Mycobacterium bovis subsp bovis AF2122/97
ccugguugaggucacccgguaac

SEQ ID NO: 3142176 - RNA, 15 nt, Mycobacterium bovis subsp bovis AF2122/97
ccugguugcugacga

SEQ ID NO: 3142177 - RNA, 15 nt, Mycobacterium bovis subsp bovis AF2122/97
ccugguuggugacgu

SEQ ID NO: 3142178 - RNA, 18 nt, Mycobacterium bovis subsp bovis AF2122/97
ccugguuggugacguaga

SEQ ID NO: 3142179 - RNA, 20 nt, Mycobacterium bovis subsp bovis AF2122/97
ccugguuguccguaucgggc

SEQ ID NO: 3142180 - RNA, 18 nt, Mycobacterium bovis subsp bovis AF2122/97
ccuguaccgccacggcgg

SEQ ID NO: 3142181 - RNA, 17 nt, Mycobacterium bovis subsp bovis AF2122/97
ccuguacggcggcuagg

SEQ ID NO: 3142182 - RNA, 24 nt, Mycobacterium bovis subsp bovis AF2122/97
ccuguagaucagcagcggcgaccg

SEQ ID NO: 3142183 - RNA, 14 nt, Mycobacterium bovis subsp bovis AF2122/97
ccuguaugccgcgg

SEQ ID NO: 3142184 - RNA, 19 nt, Mycobacterium bovis subsp bovis AF2122/97
ccugucauguccugggccg

SEQ ID NO: 3142185 - RNA, 15 nt, Mycobacterium bovis subsp bovis AF2122/97
ccugucccgccggcc

SEQ ID NO: 3142186 - RNA, 16 nt, Mycobacterium bovis subsp bovis AF2122/97
ccugucccgccggccc

SEQ ID NO: 3142187 - RNA, 13 nt, Mycobacterium bovis subsp bovis AF2122/97
ccuguccggcgcc

SEQ ID NO: 3142188 - RNA, 20 nt, Mycobacterium bovis subsp bovis AF2122/97
ccuguccggguagcggcgcc

SEQ ID NO: 3142189 - RNA, 13 nt, Mycobacterium bovis subsp bovis AF2122/97
ccugucgccgaug

SEQ ID NO: 3142190 - RNA, 15 nt, Mycobacterium bovis subsp bovis AF2122/97
ccugucgcgcaccgg

SEQ ID NO: 3142191 - RNA, 23 nt, Mycobacterium bovis subsp bovis AF2122/97
ccugucgggucgaguccgacggg

SEQ ID NO: 3142192 - RNA, 19 nt, Mycobacterium bovis subsp bovis AF2122/97
ccugugccagcagcagcgc

SEQ ID NO: 3142193 - RNA, 14 nt, Mycobacterium bovis subsp bovis AF2122/97
ccugugccgccggc

SEQ ID NO: 3142194 - RNA, 15 nt, Mycobacterium bovis subsp bovis AF2122/97
ccugugccgccggcg

SEQ ID NO: 3142195 - RNA, 17 nt, Mycobacterium bovis subsp bovis AF2122/97
ccugugcgcggugacga

SEQ ID NO: 3142196 - RNA, 18 nt, Mycobacterium bovis subsp bovis AF2122/97
ccugugcggagccgccau

SEQ ID NO: 3142197 - RNA, 16 nt, Mycobacterium bovis subsp bovis AF2122/97
ccugugcugccaacgg

SEQ ID NO: 3142198 - RNA, 23 nt, Mycobacterium bovis subsp bovis AF2122/97
ccuguggggauuccgcacccccg

SEQ ID NO: 3142199 - RNA, 16 nt, Mycobacterium bovis subsp bovis AF2122/97
ccugugucgccgucgc

SEQ ID NO: 3142200 - RNA, 20 nt, Mycobacterium bovis subsp bovis AF2122/97
ccuguucaacuccggcaccg

SEQ ID NO: 3142201 - RNA, 18 nt, Mycobacterium bovis subsp bovis AF2122/97
ccuguuccagcgugccug

SEQ ID NO: 3142202 - RNA, 17 nt, Mycobacterium bovis subsp bovis AF2122/97
ccuguucggcccgaggu

SEQ ID NO: 3142203 - RNA, 20 nt, Mycobacterium bovis subsp bovis AF2122/97
ccuguugcagaaaacccucg

SEQ ID NO: 3142204 - RNA, 20 nt, Mycobacterium bovis subsp bovis AF2122/97
ccuguuguugccccggucgg

SEQ ID NO: 3142205 - RNA, 14 nt, Mycobacterium bovis subsp bovis AF2122/97
ccuguuguugucgg

SEQ ID NO: 3142206 - RNA, 23 nt, Mycobacterium bovis subsp bovis AF2122/97
ccuguuguugucggugucgguga

SEQ ID NO: 3142207 - RNA, 19 nt, Mycobacterium bovis subsp bovis AF2122/97
ccuuaccccgcagcucacc

SEQ ID NO: 3142208 - RNA, 18 nt, Mycobacterium bovis subsp bovis AF2122/97
ccuuagcccggccgcgcc

SEQ ID NO: 3142209 - RNA, 22 nt, Mycobacterium bovis subsp bovis AF2122/97
ccuuaucgagauauugcgcgcc

SEQ ID NO: 3142210 - RNA, 19 nt, Mycobacterium bovis subsp bovis AF2122/97
ccuuaucgcucucggucag

SEQ ID NO: 3142211 - RNA, 15 nt, Mycobacterium bovis subsp bovis AF2122/97
ccuugccgccggcgc

SEQ ID NO: 3142212 - RNA, 16 nt, Mycobacterium bovis subsp bovis AF2122/97
ccuugccgccggcgcc

SEQ ID NO: 3142213 - RNA, 17 nt, Mycobacterium bovis subsp bovis AF2122/97
ccuugccgccggcgccg

SEQ ID NO: 3142214 - RNA, 22 nt, Mycobacterium bovis subsp bovis AF2122/97
ccuugccgccgguggugccggc

SEQ ID NO: 3142215 - RNA, 14 nt, Mycobacterium bovis subsp bovis AF2122/97
ccuugccgcuggug

SEQ ID NO: 3142216 - RNA, 18 nt, Mycobacterium bovis subsp bovis AF2122/97
ccuugccgggccgcgcgg

SEQ ID NO: 3142217 - RNA, 16 nt, Mycobacterium bovis subsp bovis AF2122/97
ccuugccuagccgcag

SEQ ID NO: 3142218 - RNA, 17 nt, Mycobacterium bovis subsp bovis AF2122/97
ccuugccuagccgcagc

SEQ ID NO: 3142219 - RNA, 22 nt, Mycobacterium bovis subsp bovis AF2122/97
ccuugcgauugcgcacacccug

SEQ ID NO: 3142220 - RNA, 16 nt, Mycobacterium bovis subsp bovis AF2122/97
ccuugcgcacaggcgc

SEQ ID NO: 3142221 - RNA, 18 nt, Mycobacterium bovis subsp bovis AF2122/97
ccuugcgcagcaccaggg

SEQ ID NO: 3142222 - RNA, 12 nt, Mycobacterium bovis subsp bovis AF2122/97
ccuugcgccagc

SEQ ID NO: 3142223 - RNA, 23 nt, Mycobacterium bovis subsp bovis AF2122/97
ccuugcgcgccauuggcgccgcc

SEQ ID NO: 3142224 - RNA, 14 nt, Mycobacterium bovis subsp bovis AF2122/97
ccuugcgcgcgcag

SEQ ID NO: 3142225 - RNA, 14 nt, Mycobacterium bovis subsp bovis AF2122/97
ccuugcggcagacc

SEQ ID NO: 3142226 - RNA, 13 nt, Mycobacterium bovis subsp bovis AF2122/97
ccuugcggccgcu

SEQ ID NO: 3142227 - RNA, 21 nt, Mycobacterium bovis subsp bovis AF2122/97
ccuugcgguccaggccggcac

SEQ ID NO: 3142228 - RNA, 15 nt, Mycobacterium bovis subsp bovis AF2122/97
ccuugcucagcacgc

SEQ ID NO: 3142229 - RNA, 16 nt, Mycobacterium bovis subsp bovis AF2122/97
ccuugcucagccggcc

SEQ ID NO: 3142230 - RNA, 13 nt, Mycobacterium bovis subsp bovis AF2122/97
ccuugcugcgcga

SEQ ID NO: 3142231 - RNA, 12 nt, Mycobacterium bovis subsp bovis AF2122/97
ccuuggacucgg

SEQ ID NO: 3142232 - RNA, 17 nt, Mycobacterium bovis subsp bovis AF2122/97
ccuuggacugucccacc

SEQ ID NO: 3142233 - RNA, 19 nt, Mycobacterium bovis subsp bovis AF2122/97
ccuuggcaagcacgcgacg

SEQ ID NO: 3142234 - RNA, 14 nt, Mycobacterium bovis subsp bovis AF2122/97
ccuuggcacccucc

SEQ ID NO: 3142235 - RNA, 16 nt, Mycobacterium bovis subsp bovis AF2122/97
ccuuggcacccuccgc

SEQ ID NO: 3142236 - RNA, 18 nt, Mycobacterium bovis subsp bovis AF2122/97
ccuuggcaguccagccgg

SEQ ID NO: 3142237 - RNA, 21 nt, Mycobacterium bovis subsp bovis AF2122/97
ccuuggccaccaucgccgccg

SEQ ID NO: 3142238 - RNA, 20 nt, Mycobacterium bovis subsp bovis AF2122/97
ccuuggccagacccaccacc

SEQ ID NO: 3142239 - RNA, 15 nt, Mycobacterium bovis subsp bovis AF2122/97
ccuuggccagcaggg

SEQ ID NO: 3142240 - RNA, 19 nt, Mycobacterium bovis subsp bovis AF2122/97
ccuuggccaggaagucccg

SEQ ID NO: 3142241 - RNA, 15 nt, Mycobacterium bovis subsp bovis AF2122/97
ccuuggcccagcggu

SEQ ID NO: 3142242 - RNA, 13 nt, Mycobacterium bovis subsp bovis AF2122/97
ccuuggccgccgg

SEQ ID NO: 3142243 - RNA, 17 nt, Mycobacterium bovis subsp bovis AF2122/97
ccuuggccgccggccgc

SEQ ID NO: 3142244 - RNA, 22 nt, Mycobacterium bovis subsp bovis AF2122/97
ccuuggccguucggcgcccgcu

SEQ ID NO: 3142245 - RNA, 12 nt, Mycobacterium bovis subsp bovis AF2122/97
ccuuggcgacca

SEQ ID NO: 3142246 - RNA, 15 nt, Mycobacterium bovis subsp bovis AF2122/97
ccuuggcgccaccgg

SEQ ID NO: 3142247 - RNA, 16 nt, Mycobacterium bovis subsp bovis AF2122/97
ccuuggcgccaccggc

SEQ ID NO: 3142248 - RNA, 16 nt, Mycobacterium bovis subsp bovis AF2122/97
ccuuggcgcccgcgaa

SEQ ID NO: 3142249 - RNA, 16 nt, Mycobacterium bovis subsp bovis AF2122/97
ccuuggcgcggcaccc

SEQ ID NO: 3142250 - RNA, 23 nt, Mycobacterium bovis subsp bovis AF2122/97
ccuuggcgcggcacccggucggc

SEQ ID NO: 3142251 - RNA, 13 nt, Mycobacterium bovis subsp bovis AF2122/97
ccuuggcggccgc

SEQ ID NO: 3142252 - RNA, 17 nt, Mycobacterium bovis subsp bovis AF2122/97
ccuuggcgggaucgaga

SEQ ID NO: 3142253 - RNA, 16 nt, Mycobacterium bovis subsp bovis AF2122/97
ccuuggcggucggcag

SEQ ID NO: 3142254 - RNA, 17 nt, Mycobacterium bovis subsp bovis AF2122/97
ccuuggcugggcccgcc

SEQ ID NO: 3142255 - RNA, 20 nt, Mycobacterium bovis subsp bovis AF2122/97
ccuuggcuucgacgcuuccu

SEQ ID NO: 3142256 - RNA, 14 nt, Mycobacterium bovis subsp bovis AF2122/97
ccuugggaccaccg

SEQ ID NO: 3142257 - RNA, 16 nt, Mycobacterium bovis subsp bovis AF2122/97
ccuugggcaccacccg

SEQ ID NO: 3142258 - RNA, 13 nt, Mycobacterium bovis subsp bovis AF2122/97
ccuugggcagcuu

SEQ ID NO: 3142259 - RNA, 18 nt, Mycobacterium bovis subsp bovis AF2122/97
ccuugggcgacgcggcgc

SEQ ID NO: 3142260 - RNA, 14 nt, Mycobacterium bovis subsp bovis AF2122/97
ccuugguagccggc

SEQ ID NO: 3142261 - RNA, 12 nt, Mycobacterium bovis subsp bovis AF2122/97
ccuuggucaccu

SEQ ID NO: 3142262 - RNA, 23 nt, Mycobacterium bovis subsp bovis AF2122/97
ccuuggucaccuucuuggcgggu

SEQ ID NO: 3142263 - RNA, 15 nt, Mycobacterium bovis subsp bovis AF2122/97
ccuuggucgccgccu

SEQ ID NO: 3142264 - RNA, 14 nt, Mycobacterium bovis subsp bovis AF2122/97
ccuuggucgccggc

SEQ ID NO: 3142265 - RNA, 20 nt, Mycobacterium bovis subsp bovis AF2122/97
ccuuggucgcgucggcugcc

SEQ ID NO: 3142266 - RNA, 18 nt, Mycobacterium bovis subsp bovis AF2122/97
ccuuggucuucgccgucg

SEQ ID NO: 3142267 - RNA, 16 nt, Mycobacterium bovis subsp bovis AF2122/97
ccuuggugcccagcag

SEQ ID NO: 3142268 - RNA, 20 nt, Mycobacterium bovis subsp bovis AF2122/97
ccuugguuagccgcggcccg

SEQ ID NO: 3142269 - RNA, 23 nt, Mycobacterium bovis subsp bovis AF2122/97
ccuugguugccaacgaaccgcuc

SEQ ID NO: 3142270 - RNA, 19 nt, Mycobacterium bovis subsp bovis AF2122/97
ccuugucaaaggugcacug

SEQ ID NO: 3142271 - RNA, 13 nt, Mycobacterium bovis subsp bovis AF2122/97
ccuugucggcccc

SEQ ID NO: 3142272 - RNA, 13 nt, Mycobacterium bovis subsp bovis AF2122/97
ccuuguggacccg

SEQ ID NO: 3142273 - RNA, 17 nt, Mycobacterium bovis subsp bovis AF2122/97
ccuuguggcacacccgc

SEQ ID NO: 3142274 - RNA, 21 nt, Mycobacterium bovis subsp bovis AF2122/97
ccuuguguggcgaaucuuugg

SEQ ID NO: 3142275 - RNA, 14 nt, Mycobacterium bovis subsp bovis AF2122/97
ccuuguucgcccac

SEQ ID NO: 3142276 - RNA, 18 nt, Mycobacterium bovis subsp bovis AF2122/97
ccuuguugaacguucugc

SEQ ID NO: 3142277 - RNA, 13 nt, Mycobacterium bovis subsp bovis AF2122/97
ccuuguugccgcg

SEQ ID NO: 3142278 - RNA, 24 nt, Mycobacterium bovis subsp bovis AF2122/97
ccuuguuggcgaagucgucgaggu

SEQ ID NO: 3142279 - RNA, 21 nt, Mycobacterium bovis subsp bovis AF2122/97
ccuuguuggcgcccgggccca

SEQ ID NO: 3142280 - RNA, 20 nt, Mycobacterium bovis subsp bovis AF2122/97
ccuuguuguccuucagccag

SEQ ID NO: 3142281 - RNA, 22 nt, Mycobacterium bovis subsp bovis AF2122/97
ccuuguugugguggagcggcgc

SEQ ID NO: 3142282 - RNA, 15 nt, Mycobacterium bovis subsp bovis AF2122/97
ccuuuacccgggcgg

SEQ ID NO: 3142283 - RNA, 14 nt, Mycobacterium bovis subsp bovis AF2122/97
ccuuuccggccgcc

SEQ ID NO: 3142284 - RNA, 15 nt, Mycobacterium bovis subsp bovis AF2122/97
ccuuuccggccgccu

SEQ ID NO: 3142285 - RNA, 19 nt, Mycobacterium bovis subsp bovis AF2122/97
ccuuucgcgccgcgaggca

SEQ ID NO: 3142286 - RNA, 17 nt, Mycobacterium bovis subsp bovis AF2122/97
ccuuucugaagcugagc

SEQ ID NO: 3142287 - RNA, 16 nt, Mycobacterium bovis subsp bovis AF2122/97
ccuuugagcccgcgau

SEQ ID NO: 3142288 - RNA, 16 nt, Mycobacterium bovis subsp bovis AF2122/97
ccuuugcacgguggca

SEQ ID NO: 3142289 - RNA, 13 nt, Mycobacterium bovis subsp bovis AF2122/97
ccuuugccgccga

SEQ ID NO: 3142290 - RNA, 16 nt, Mycobacterium bovis subsp bovis AF2122/97
ccuuugccgccgaacg

SEQ ID NO: 3142291 - RNA, 23 nt, Mycobacterium bovis subsp bovis AF2122/97
ccuuuggcggugaugguggcaac

SEQ ID NO: 3142292 - RNA, 20 nt, Mycobacterium bovis subsp bovis AF2122/97
ccuuugucgccuucuuggca

SEQ ID NO: 3142293 - RNA, 12 nt, Mycobacterium bovis subsp bovis AF2122/97
cgaaaaaaucgu

SEQ ID NO: 3142294 - RNA, 18 nt, Mycobacterium bovis subsp bovis AF2122/97
cgaaaaaaucgugcgggu

SEQ ID NO: 3142295 - RNA, 15 nt, Mycobacterium bovis subsp bovis AF2122/97
cgaaaaacaccagcg

SEQ ID NO: 3142296 - RNA, 23 nt, Mycobacterium bovis subsp bovis AF2122/97
cgaaaaacaccagcgaggccagc

SEQ ID NO: 3142297 - RNA, 13 nt, Mycobacterium bovis subsp bovis AF2122/97
cgaaaaaccucga

SEQ ID NO: 3142298 - RNA, 22 nt, Mycobacterium bovis subsp bovis AF2122/97
cgaacacaccggugucuucugc

SEQ ID NO: 3142299 - RNA, 17 nt, Mycobacterium bovis subsp bovis AF2122/97
cgaacaccagauggcuc

SEQ ID NO: 3142300 - RNA, 12 nt, Mycobacterium bovis subsp bovis AF2122/97
cgaacaccagcg

SEQ ID NO: 3142301 - RNA, 13 nt, Mycobacterium bovis subsp bovis AF2122/97
cgaacaccagcgc

SEQ ID NO: 3142302 - RNA, 17 nt, Mycobacterium bovis subsp bovis AF2122/97
cgaacaccagcgcgccg

SEQ ID NO: 3142303 - RNA, 19 nt, Mycobacterium bovis subsp bovis AF2122/97
cgaacaccagcgcgccgua

SEQ ID NO: 3142304 - RNA, 20 nt, Mycobacterium bovis subsp bovis AF2122/97
cgaacaccagcgcgccguag

SEQ ID NO: 3142305 - RNA, 23 nt, Mycobacterium bovis subsp bovis AF2122/97
cgaacaccagcgcgccguagacc

SEQ ID NO: 3142306 - RNA, 17 nt, Mycobacterium bovis subsp bovis AF2122/97
cgaacaccccgggcgcc

SEQ ID NO: 3142307 - RNA, 14 nt, Mycobacterium bovis subsp bovis AF2122/97
cgaacaccucggca

SEQ ID NO: 3142308 - RNA, 18 nt, Mycobacterium bovis subsp bovis AF2122/97
cgaacacgagcucaccug

SEQ ID NO: 3142309 - RNA, 16 nt, Mycobacterium bovis subsp bovis AF2122/97
cgaacacgucggccag

SEQ ID NO: 3142310 - RNA, 20 nt, Mycobacterium bovis subsp bovis AF2122/97
cgaacacgucuaucuggucg

SEQ ID NO: 3142311 - RNA, 15 nt, Mycobacterium bovis subsp bovis AF2122/97
cgaacacguucgggu

SEQ ID NO: 3142312 - RNA, 16 nt, Mycobacterium bovis subsp bovis AF2122/97
cgaacacuuugcgcac

SEQ ID NO: 3142313 - RNA, 14 nt, Mycobacterium bovis subsp bovis AF2122/97
cgaacagacaugcg

SEQ ID NO: 3142314 - RNA, 12 nt, Mycobacterium bovis subsp bovis AF2122/97
cgaacagcaccg

SEQ ID NO: 3142315 - RNA, 13 nt, Mycobacterium bovis subsp bovis AF2122/97
cgaacagcaccgc

SEQ ID NO: 3142316 - RNA, 15 nt, Mycobacterium bovis subsp bovis AF2122/97
cgaacagcaccgccg

SEQ ID NO: 3142317 - RNA, 16 nt, Mycobacterium bovis subsp bovis AF2122/97
cgaacagcaccgccgg

SEQ ID NO: 3142318 - RNA, 22 nt, Mycobacterium bovis subsp bovis AF2122/97
cgaacagcaccgccggcgacgg

SEQ ID NO: 3142319 - RNA, 21 nt, Mycobacterium bovis subsp bovis AF2122/97
cgaacagcaugauccgcuggg

SEQ ID NO: 3142320 - RNA, 15 nt, Mycobacterium bovis subsp bovis AF2122/97
cgaacagccgagcca

SEQ ID NO: 3142321 - RNA, 18 nt, Mycobacterium bovis subsp bovis AF2122/97
cgaacagcgaagcaacgg

SEQ ID NO: 3142322 - RNA, 22 nt, Mycobacterium bovis subsp bovis AF2122/97
cgaacagcggcacgaucggcag

SEQ ID NO: 3142323 - RNA, 19 nt, Mycobacterium bovis subsp bovis AF2122/97
cgaacagcgggggcagcgc

SEQ ID NO: 3142324 - RNA, 20 nt, Mycobacterium bovis subsp bovis AF2122/97
cgaacagcgggggcagcgcg

SEQ ID NO: 3142325 - RNA, 21 nt, Mycobacterium bovis subsp bovis AF2122/97
cgaacagcgggggcagcgcga

SEQ ID NO: 3142326 - RNA, 14 nt, Mycobacterium bovis subsp bovis AF2122/97
cgaacagcucgaac

SEQ ID NO: 3142327 - RNA, 22 nt, Mycobacterium bovis subsp bovis AF2122/97
cgaacagcugcccgccagcgcc

SEQ ID NO: 3142328 - RNA, 16 nt, Mycobacterium bovis subsp bovis AF2122/97
cgaacagcuggacggc

SEQ ID NO: 3142329 - RNA, 20 nt, Mycobacterium bovis subsp bovis AF2122/97
cgaacagcuggacggccucc

SEQ ID NO: 3142330 - RNA, 15 nt, Mycobacterium bovis subsp bovis AF2122/97
cgaacaggaugaugu

SEQ ID NO: 3142331 - RNA, 16 nt, Mycobacterium bovis subsp bovis AF2122/97
cgaacaggccggccgc

SEQ ID NO: 3142332 - RNA, 19 nt, Mycobacterium bovis subsp bovis AF2122/97
cgaacagggaggucgccgc

SEQ ID NO: 3142333 - RNA, 15 nt, Mycobacterium bovis subsp bovis AF2122/97
cgaacagucgaguga

SEQ ID NO: 3142334 - RNA, 22 nt, Mycobacterium bovis subsp bovis AF2122/97
cgaacagucgagugaagccgac

SEQ ID NO: 3142335 - RNA, 13 nt, Mycobacterium bovis subsp bovis AF2122/97
cgaacagucgcag

SEQ ID NO: 3142336 - RNA, 14 nt, Mycobacterium bovis subsp bovis AF2122/97
cgaacagucgcagc

SEQ ID NO: 3142337 - RNA, 15 nt, Mycobacterium bovis subsp bovis AF2122/97
cgaacagugacgcca

SEQ ID NO: 3142338 - RNA, 23 nt, Mycobacterium bovis subsp bovis AF2122/97
cgaacagugacgccacgaccgcc

SEQ ID NO: 3142339 - RNA, 20 nt, Mycobacterium bovis subsp bovis AF2122/97
cgaacagugccucgcguucg

SEQ ID NO: 3142340 - RNA, 22 nt, Mycobacterium bovis subsp bovis AF2122/97
cgaacaguggggguccggcggc

SEQ ID NO: 3142341 - RNA, 23 nt, Mycobacterium bovis subsp bovis AF2122/97
cgaacaguggggguccggcggcc

SEQ ID NO: 3142342 - RNA, 20 nt, Mycobacterium bovis subsp bovis AF2122/97
cgaacaucaccgucgcccgg

SEQ ID NO: 3142343 - RNA, 17 nt, Mycobacterium bovis subsp bovis AF2122/97
cgaacaucaucgggucc

SEQ ID NO: 3142344 - RNA, 13 nt, Mycobacterium bovis subsp bovis AF2122/97
cgaacaucgccag

SEQ ID NO: 3142345 - RNA, 15 nt, Mycobacterium bovis subsp bovis AF2122/97
cgaacaucgccagcg

SEQ ID NO: 3142346 - RNA, 16 nt, Mycobacterium bovis subsp bovis AF2122/97
cgaacauggcacgcgg

SEQ ID NO: 3142347 - RNA, 19 nt, Mycobacterium bovis subsp bovis AF2122/97
cgaacauggcacgcgggaa

SEQ ID NO: 3142348 - RNA, 23 nt, Mycobacterium bovis subsp bovis AF2122/97
cgaacauggccagcaucagcgcc

SEQ ID NO: 3142349 - RNA, 14 nt, Mycobacterium bovis subsp bovis AF2122/97
cgaacauggugcgg

SEQ ID NO: 3142350 - RNA, 14 nt, Mycobacterium bovis subsp bovis AF2122/97
cgaaccaccgcguu

SEQ ID NO: 3142351 - RNA, 15 nt, Mycobacterium bovis subsp bovis AF2122/97
cgaaccaccgcguug

SEQ ID NO: 3142352 - RNA, 22 nt, Mycobacterium bovis subsp bovis AF2122/97
cgaaccacgcgcccgcaccacc

SEQ ID NO: 3142353 - RNA, 12 nt, Mycobacterium bovis subsp bovis AF2122/97
cgaaccagcgcg

SEQ ID NO: 3142354 - RNA, 13 nt, Mycobacterium bovis subsp bovis AF2122/97
cgaaccagcgcgu

SEQ ID NO: 3142355 - RNA, 17 nt, Mycobacterium bovis subsp bovis AF2122/97
cgaaccagcuugcgccg

SEQ ID NO: 3142356 - RNA, 18 nt, Mycobacterium bovis subsp bovis AF2122/97
cgaaccagcuugcgccgc

SEQ ID NO: 3142357 - RNA, 19 nt, Mycobacterium bovis subsp bovis AF2122/97
cgaaccagcuugcgccgca

SEQ ID NO: 3142358 - RNA, 21 nt, Mycobacterium bovis subsp bovis AF2122/97
cgaaccagcuugcgccgcagc

SEQ ID NO: 3142359 - RNA, 17 nt, Mycobacterium bovis subsp bovis AF2122/97
cgaaccaguccucgggc

SEQ ID NO: 3142360 - RNA, 23 nt, Mycobacterium bovis subsp bovis AF2122/97
cgaaccagucgaagaagacccgu

SEQ ID NO: 3142361 - RNA, 23 nt, Mycobacterium bovis subsp bovis AF2122/97
cgaaccaugguugaugacggcgu

SEQ ID NO: 3142362 - RNA, 15 nt, Mycobacterium bovis subsp bovis AF2122/97
cgaacccaccgugcc

SEQ ID NO: 3142363 - RNA, 19 nt, Mycobacterium bovis subsp bovis AF2122/97
cgaacccacugcccgccga

SEQ ID NO: 3142364 - RNA, 13 nt, Mycobacterium bovis subsp bovis AF2122/97
cgaacccaggcac

SEQ ID NO: 3142365 - RNA, 14 nt, Mycobacterium bovis subsp bovis AF2122/97
cgaacccaggcaca

SEQ ID NO: 3142366 - RNA, 15 nt, Mycobacterium bovis subsp bovis AF2122/97
cgaacccaggcacaa

SEQ ID NO: 3142367 - RNA, 20 nt, Mycobacterium bovis subsp bovis AF2122/97
cgaacccccccgugcggugu

SEQ ID NO: 3142368 - RNA, 11 nt, Mycobacterium bovis subsp bovis AF2122/97
cgaaccccgac

SEQ ID NO: 3142369 - RNA, 15 nt, Mycobacterium bovis subsp bovis AF2122/97
cgaacccgagccgcc

SEQ ID NO: 3142370 - RNA, 20 nt, Mycobacterium bovis subsp bovis AF2122/97
cgaacccgagccgccgugga

SEQ ID NO: 3142371 - RNA, 14 nt, Mycobacterium bovis subsp bovis AF2122/97
cgaacccgaucguc

SEQ ID NO: 3142372 - RNA, 15 nt, Mycobacterium bovis subsp bovis AF2122/97
cgaacccgcagucgg

SEQ ID NO: 3142373 - RNA, 19 nt, Mycobacterium bovis subsp bovis AF2122/97
cgaacccgcagucggucac

SEQ ID NO: 3142374 - RNA, 21 nt, Mycobacterium bovis subsp bovis AF2122/97
cgaacccgcagucggucacgc

SEQ ID NO: 3142375 - RNA, 15 nt, Mycobacterium bovis subsp bovis AF2122/97
cgaacccgccgaugc

SEQ ID NO: 3142376 - RNA, 20 nt, Mycobacterium bovis subsp bovis AF2122/97
cgaacccgccgaugcugccg

SEQ ID NO: 3142377 - RNA, 22 nt, Mycobacterium bovis subsp bovis AF2122/97
cgaacccgccgaugcugccgcc

SEQ ID NO: 3142378 - RNA, 23 nt, Mycobacterium bovis subsp bovis AF2122/97
cgaacccgcgagguugaccacca

SEQ ID NO: 3142379 - RNA, 13 nt, Mycobacterium bovis subsp bovis AF2122/97
cgaacccgcguug

SEQ ID NO: 3142380 - RNA, 14 nt, Mycobacterium bovis subsp bovis AF2122/97
cgaacccgguguug

SEQ ID NO: 3142381 - RNA, 23 nt, Mycobacterium bovis subsp bovis AF2122/97
cgaacccgguguugagcgaaccc

SEQ ID NO: 3142382 - RNA, 20 nt, Mycobacterium bovis subsp bovis AF2122/97
cgaacccucagccgcgccgg

SEQ ID NO: 3142383 - RNA, 14 nt, Mycobacterium bovis subsp bovis AF2122/97
cgaacccuccgcag

SEQ ID NO: 3142384 - RNA, 20 nt, Mycobacterium bovis subsp bovis AF2122/97
cgaacgucaccaucgggucg

SEQ ID NO: 3142385 - RNA, 13 nt, Mycobacterium bovis subsp bovis AF2122/97
cgaacgucgcggc

SEQ ID NO: 3142386 - RNA, 17 nt, Mycobacterium bovis subsp bovis AF2122/97
cgaacgucgcggccagc

SEQ ID NO: 3142387 - RNA, 20 nt, Mycobacterium bovis subsp bovis AF2122/97
cgaacgugaacucacggcgg

SEQ ID NO: 3142388 - RNA, 15 nt, Mycobacterium bovis subsp bovis AF2122/97
cgaacgugcgguggc

SEQ ID NO: 3142389 - RNA, 17 nt, Mycobacterium bovis subsp bovis AF2122/97
cgaacucaugcccgacg

SEQ ID NO: 3142390 - RNA, 18 nt, Mycobacterium bovis subsp bovis AF2122/97
cgaacucaugcccgacga

SEQ ID NO: 3142391 - RNA, 19 nt, Mycobacterium bovis subsp bovis AF2122/97
cgaacuccagcagcccggu

SEQ ID NO: 3142392 - RNA, 17 nt, Mycobacterium bovis subsp bovis AF2122/97
cgaacuccaucaccaca

SEQ ID NO: 3142393 - RNA, 17 nt, Mycobacterium bovis subsp bovis AF2122/97
cgaacuccccggucgcc

SEQ ID NO: 3142394 - RNA, 21 nt, Mycobacterium bovis subsp bovis AF2122/97
cgaacuccccggucgccgcgu

SEQ ID NO: 3142395 - RNA, 21 nt, Mycobacterium bovis subsp bovis AF2122/97
cgaacuccgcggaacccagca

SEQ ID NO: 3142396 - RNA, 14 nt, Mycobacterium bovis subsp bovis AF2122/97
cgaacuccgcguug

SEQ ID NO: 3142397 - RNA, 21 nt, Mycobacterium bovis subsp bovis AF2122/97
cgaacuccuuaucgucgacgc

SEQ ID NO: 3142398 - RNA, 20 nt, Mycobacterium bovis subsp bovis AF2122/97
cgaacucgcccagggugggg

SEQ ID NO: 3142399 - RNA, 14 nt, Mycobacterium bovis subsp bovis AF2122/97
cgaacucgccccgc

SEQ ID NO: 3142400 - RNA, 16 nt, Mycobacterium bovis subsp bovis AF2122/97
cgaacucgccgucaua

SEQ ID NO: 3142401 - RNA, 22 nt, Mycobacterium bovis subsp bovis AF2122/97
cgaacucgcgcaggaagcccac

SEQ ID NO: 3142402 - RNA, 14 nt, Mycobacterium bovis subsp bovis AF2122/97
cgaacucgcgccga

SEQ ID NO: 3142403 - RNA, 17 nt, Mycobacterium bovis subsp bovis AF2122/97
cgaacucgcgccgagcc

SEQ ID NO: 3142404 - RNA, 18 nt, Mycobacterium bovis subsp bovis AF2122/97
cgaacucgcgggcgacca

SEQ ID NO: 3142405 - RNA, 16 nt, Mycobacterium bovis subsp bovis AF2122/97
cgaacucggccgggcg

SEQ ID NO: 3142406 - RNA, 21 nt, Mycobacterium bovis subsp bovis AF2122/97
cgaacucuggauucuucagcg

SEQ ID NO: 3142407 - RNA, 17 nt, Mycobacterium bovis subsp bovis AF2122/97
cgaacugaucgaccgcc

SEQ ID NO: 3142408 - RNA, 19 nt, Mycobacterium bovis subsp bovis AF2122/97
cgaacugcagccauucuuc

SEQ ID NO: 3142409 - RNA, 20 nt, Mycobacterium bovis subsp bovis AF2122/97
cgaacugcagccauucuucg

SEQ ID NO: 3142410 - RNA, 20 nt, Mycobacterium bovis subsp bovis AF2122/97
cgaacugccggacuaccgcc

SEQ ID NO: 3142411 - RNA, 17 nt, Mycobacterium bovis subsp bovis AF2122/97
cgaacuggcugguggcg

SEQ ID NO: 3142412 - RNA, 18 nt, Mycobacterium bovis subsp bovis AF2122/97
cgaacuggcugguggcgu

SEQ ID NO: 3142413 - RNA, 16 nt, Mycobacterium bovis subsp bovis AF2122/97
cgaacugggggccggc

SEQ ID NO: 3142414 - RNA, 17 nt, Mycobacterium bovis subsp bovis AF2122/97
cgaacugggugcggucu

SEQ ID NO: 3142415 - RNA, 17 nt, Mycobacterium bovis subsp bovis AF2122/97
cgaacugguagcccgga

SEQ ID NO: 3142416 - RNA, 19 nt, Mycobacterium bovis subsp bovis AF2122/97
cgaacuggucgacgccgag

SEQ ID NO: 3142417 - RNA, 20 nt, Mycobacterium bovis subsp bovis AF2122/97
cgaacuggucgacgccgaga

SEQ ID NO: 3142418 - RNA, 14 nt, Mycobacterium bovis subsp bovis AF2122/97
cgaacugguuucgc

SEQ ID NO: 3142419 - RNA, 19 nt, Mycobacterium bovis subsp bovis AF2122/97
cgaacuuaacuacggugcc

SEQ ID NO: 3142420 - RNA, 18 nt, Mycobacterium bovis subsp bovis AF2122/97
cgaacuucgaugccgggu

SEQ ID NO: 3142421 - RNA, 21 nt, Mycobacterium bovis subsp bovis AF2122/97
cgaacuucugguaggcggcca

SEQ ID NO: 3142422 - RNA, 19 nt, Mycobacterium bovis subsp bovis AF2122/97
cgaacuugaucaccgcgua

SEQ ID NO: 3142423 - RNA, 14 nt, Mycobacterium bovis subsp bovis AF2122/97
cgaacuuugucgcg

SEQ ID NO: 3142424 - RNA, 19 nt, Mycobacterium bovis subsp bovis AF2122/97
cgaacuuugucgcgcugcu

SEQ ID NO: 3142425 - RNA, 20 nt, Mycobacterium bovis subsp bovis AF2122/97
cgaagaacaacaucgccaua

SEQ ID NO: 3142426 - RNA, 23 nt, Mycobacterium bovis subsp bovis AF2122/97
cgaagaacaccuugggcagcuug

SEQ ID NO: 3142427 - RNA, 24 nt, Mycobacterium bovis subsp bovis AF2122/97
cgaagaacaguugcccgacgccgg

SEQ ID NO: 3142428 - RNA, 16 nt, Mycobacterium bovis subsp bovis AF2122/97
cgaagaaccggccgac

SEQ ID NO: 3142429 - RNA, 20 nt, Mycobacterium bovis subsp bovis AF2122/97
cgaagaaccggccgacgaac

SEQ ID NO: 3142430 - RNA, 23 nt, Mycobacterium bovis subsp bovis AF2122/97
cgaagaaccugagcaccaagacc

SEQ ID NO: 3142431 - RNA, 20 nt, Mycobacterium bovis subsp bovis AF2122/97
cgaagaagaacucggcgucg

SEQ ID NO: 3142432 - RNA, 22 nt, Mycobacterium bovis subsp bovis AF2122/97
cgaagaccaagagcgcgcagca

SEQ ID NO: 3142433 - RNA, 16 nt, Mycobacterium bovis subsp bovis AF2122/97
cgaagaccagcggcgg

SEQ ID NO: 3142434 - RNA, 17 nt, Mycobacterium bovis subsp bovis AF2122/97
cgaagaccagcggcggc

SEQ ID NO: 3142435 - RNA, 14 nt, Mycobacterium bovis subsp bovis AF2122/97
cgaagaccaggccg

SEQ ID NO: 3142436 - RNA, 15 nt, Mycobacterium bovis subsp bovis AF2122/97
cgaagaccaggccgg

SEQ ID NO: 3142437 - RNA, 18 nt, Mycobacterium bovis subsp bovis AF2122/97
cgaagaccaggccgguga

SEQ ID NO: 3142438 - RNA, 21 nt, Mycobacterium bovis subsp bovis AF2122/97
cgaagaccaggccggugacgg

SEQ ID NO: 3142439 - RNA, 15 nt, Mycobacterium bovis subsp bovis AF2122/97
cgaagaccgccggga

SEQ ID NO: 3142440 - RNA, 17 nt, Mycobacterium bovis subsp bovis AF2122/97
cgaagaccgccuccacc

SEQ ID NO: 3142441 - RNA, 22 nt, Mycobacterium bovis subsp bovis AF2122/97
cgaagaccgccuccaccgccgc

SEQ ID NO: 3142442 - RNA, 17 nt, Mycobacterium bovis subsp bovis AF2122/97
cgaagaccgcgucggcg

SEQ ID NO: 3142443 - RNA, 18 nt, Mycobacterium bovis subsp bovis AF2122/97
cgaagaccgcgucggcgg

SEQ ID NO: 3142444 - RNA, 19 nt, Mycobacterium bovis subsp bovis AF2122/97
cgaagaccgcgucggcggc

SEQ ID NO: 3142445 - RNA, 20 nt, Mycobacterium bovis subsp bovis AF2122/97
cgaagaccgcgucggcggcc

SEQ ID NO: 3142446 - RNA, 17 nt, Mycobacterium bovis subsp bovis AF2122/97
cgaagaccucgucgcgu

SEQ ID NO: 3142447 - RNA, 15 nt, Mycobacterium bovis subsp bovis AF2122/97
cgaagacgugccggc

SEQ ID NO: 3142448 - RNA, 16 nt, Mycobacterium bovis subsp bovis AF2122/97
cgaagagcaccgcgcc

SEQ ID NO: 3142449 - RNA, 14 nt, Mycobacterium bovis subsp bovis AF2122/97
cgaagagccagcaa

SEQ ID NO: 3142450 - RNA, 18 nt, Mycobacterium bovis subsp bovis AF2122/97
cgaagagcuccgucgcgg

SEQ ID NO: 3142451 - RNA, 21 nt, Mycobacterium bovis subsp bovis AF2122/97
cgaagagcuccgucgcggccg

SEQ ID NO: 3142452 - RNA, 19 nt, Mycobacterium bovis subsp bovis AF2122/97
cgaagagugugacggcggc

SEQ ID NO: 3142453 - RNA, 14 nt, Mycobacterium bovis subsp bovis AF2122/97
cgaagauccagcgc

SEQ ID NO: 3142454 - RNA, 15 nt, Mycobacterium bovis subsp bovis AF2122/97
cgaagauccagcgca

SEQ ID NO: 3142455 - RNA, 22 nt, Mycobacterium bovis subsp bovis AF2122/97
cgaagaucgagccgacccgacg

SEQ ID NO: 3142456 - RNA, 20 nt, Mycobacterium bovis subsp bovis AF2122/97
cgaagaucgcgugccacagc

SEQ ID NO: 3142457 - RNA, 22 nt, Mycobacterium bovis subsp bovis AF2122/97
cgaagaucggcgcuagccaggg

SEQ ID NO: 3142458 - RNA, 19 nt, Mycobacterium bovis subsp bovis AF2122/97
cgaagaucuucaccggccg

SEQ ID NO: 3142459 - RNA, 18 nt, Mycobacterium bovis subsp bovis AF2122/97
cgaagaugaccgcucgug

SEQ ID NO: 3142460 - RNA, 15 nt, Mycobacterium bovis subsp bovis AF2122/97
cgaagaugaccucgg

SEQ ID NO: 3142461 - RNA, 17 nt, Mycobacterium bovis subsp bovis AF2122/97
cgaagaugaccucggcg

SEQ ID NO: 3142462 - RNA, 17 nt, Mycobacterium bovis subsp bovis AF2122/97
cgaagauggccagcgcg

SEQ ID NO: 3142463 - RNA, 20 nt, Mycobacterium bovis subsp bovis AF2122/97
cgaagauggccagcgcggcg

SEQ ID NO: 3142464 - RNA, 13 nt, Mycobacterium bovis subsp bovis AF2122/97
cgaagcacaccgu

SEQ ID NO: 3142465 - RNA, 14 nt, Mycobacterium bovis subsp bovis AF2122/97
cgaagcacaccguc

SEQ ID NO: 3142466 - RNA, 23 nt, Mycobacterium bovis subsp bovis AF2122/97
cgaagcacaccguccgucggcgc

SEQ ID NO: 3142467 - RNA, 15 nt, Mycobacterium bovis subsp bovis AF2122/97
cgaagcaucgcguug

SEQ ID NO: 3142468 - RNA, 19 nt, Mycobacterium bovis subsp bovis AF2122/97
cgaagcaucgcguuguagg

SEQ ID NO: 3142469 - RNA, 18 nt, Mycobacterium bovis subsp bovis AF2122/97
cgaagccagaucagccgc

SEQ ID NO: 3142470 - RNA, 18 nt, Mycobacterium bovis subsp bovis AF2122/97
cgaagguguccuccagcu

SEQ ID NO: 3142471 - RNA, 20 nt, Mycobacterium bovis subsp bovis AF2122/97
cgaagguguccuccagcugc

SEQ ID NO: 3142472 - RNA, 23 nt, Mycobacterium bovis subsp bovis AF2122/97
cgaaguaauagcuguuggccagc

SEQ ID NO: 3142473 - RNA, 17 nt, Mycobacterium bovis subsp bovis AF2122/97
cgaaguacgacgacccg

SEQ ID NO: 3142474 - RNA, 16 nt, Mycobacterium bovis subsp bovis AF2122/97
cgaaguacuggccgcc

SEQ ID NO: 3142475 - RNA, 17 nt, Mycobacterium bovis subsp bovis AF2122/97
cgaaguacuggccgccg

SEQ ID NO: 3142476 - RNA, 18 nt, Mycobacterium bovis subsp bovis AF2122/97
cgaaguacuggccgccgc

SEQ ID NO: 3142477 - RNA, 20 nt, Mycobacterium bovis subsp bovis AF2122/97
cgaaguacuggccgccgcgc

SEQ ID NO: 3142478 - RNA, 20 nt, Mycobacterium bovis subsp bovis AF2122/97
cgaaguagaagcccaggacg

SEQ ID NO: 3142479 - RNA, 14 nt, Mycobacterium bovis subsp bovis AF2122/97
cgaaguagccgacc

SEQ ID NO: 3142480 - RNA, 22 nt, Mycobacterium bovis subsp bovis AF2122/97
cgaaguagccgaccggcagcga

SEQ ID NO: 3142481 - RNA, 17 nt, Mycobacterium bovis subsp bovis AF2122/97
cgaagucacgcacccgg

SEQ ID NO: 3142482 - RNA, 18 nt, Mycobacterium bovis subsp bovis AF2122/97
cgaagucacgcacccggc

SEQ ID NO: 3142483 - RNA, 21 nt, Mycobacterium bovis subsp bovis AF2122/97
cgaaguccaccacgacgucgg

SEQ ID NO: 3142484 - RNA, 18 nt, Mycobacterium bovis subsp bovis AF2122/97
cgaaguccacgcaccacg

SEQ ID NO: 3142485 - RNA, 18 nt, Mycobacterium bovis subsp bovis AF2122/97
cgaaguccgcuugggcgg

SEQ ID NO: 3142486 - RNA, 21 nt, Mycobacterium bovis subsp bovis AF2122/97
cgaagucgacgaacucgccca

SEQ ID NO: 3142487 - RNA, 20 nt, Mycobacterium bovis subsp bovis AF2122/97
cgaagucgaugaugcccauc

SEQ ID NO: 3142488 - RNA, 15 nt, Mycobacterium bovis subsp bovis AF2122/97
cgaagucgcauggcg

SEQ ID NO: 3142489 - RNA, 17 nt, Mycobacterium bovis subsp bovis AF2122/97
cgaagucgucgagguca

SEQ ID NO: 3142490 - RNA, 20 nt, Mycobacterium bovis subsp bovis AF2122/97
cgaagucgucgaggucacgc

SEQ ID NO: 3142491 - RNA, 22 nt, Mycobacterium bovis subsp bovis AF2122/97
cgaagugcaggugcgggccggu

SEQ ID NO: 3142492 - RNA, 22 nt, Mycobacterium bovis subsp bovis AF2122/97
cgaagugggucaagaucggugc

SEQ ID NO: 3142493 - RNA, 22 nt, Mycobacterium bovis subsp bovis AF2122/97
cgaagugucgcugcaaccgccg

SEQ ID NO: 3142494 - RNA, 18 nt, Mycobacterium bovis subsp bovis AF2122/97
cgaaguucuccagcucga

SEQ ID NO: 3142495 - RNA, 17 nt, Mycobacterium bovis subsp bovis AF2122/97
cgaaguugaugucgcgu

SEQ ID NO: 3142496 - RNA, 20 nt, Mycobacterium bovis subsp bovis AF2122/97
cgaaguuggcgaagcccgac

SEQ ID NO: 3142497 - RNA, 15 nt, Mycobacterium bovis subsp bovis AF2122/97
cgaaguuggcuuucg

SEQ ID NO: 3142498 - RNA, 17 nt, Mycobacterium bovis subsp bovis AF2122/97
cgaaguuugcgacgacg

SEQ ID NO: 3142499 - RNA, 20 nt, Mycobacterium bovis subsp bovis AF2122/97
cgaauaacgcggucggcagc

SEQ ID NO: 3142500 - RNA, 20 nt, Mycobacterium bovis subsp bovis AF2122/97
cgaauaccagaccggccgac

SEQ ID NO: 3142501 - RNA, 15 nt, Mycobacterium bovis subsp bovis AF2122/97
cgaauacccgcgggg

SEQ ID NO: 3142502 - RNA, 18 nt, Mycobacterium bovis subsp bovis AF2122/97
cgaauaccgccgcgcagc

SEQ ID NO: 3142503 - RNA, 21 nt, Mycobacterium bovis subsp bovis AF2122/97
cgaauaccgguggcagccugc

SEQ ID NO: 3142504 - RNA, 16 nt, Mycobacterium bovis subsp bovis AF2122/97
cgaauacgaccgucgc

SEQ ID NO: 3142505 - RNA, 17 nt, Mycobacterium bovis subsp bovis AF2122/97
cgaauacgaccgucgcg

SEQ ID NO: 3142506 - RNA, 18 nt, Mycobacterium bovis subsp bovis AF2122/97
cgaauacgaggacgacga

SEQ ID NO: 3142507 - RNA, 19 nt, Mycobacterium bovis subsp bovis AF2122/97
cgaauacggcugccuccau

SEQ ID NO: 3142508 - RNA, 19 nt, Mycobacterium bovis subsp bovis AF2122/97
cgaauagccaccaagcaca

SEQ ID NO: 3142509 - RNA, 20 nt, Mycobacterium bovis subsp bovis AF2122/97
cgaauagguguguggcgccg

SEQ ID NO: 3142510 - RNA, 20 nt, Mycobacterium bovis subsp bovis AF2122/97
cgaauagucggcaucgcgag

SEQ ID NO: 3142511 - RNA, 16 nt, Mycobacterium bovis subsp bovis AF2122/97
cgaauauagcggcguu

SEQ ID NO: 3142512 - RNA, 16 nt, Mycobacterium bovis subsp bovis AF2122/97
cgaaucaacaggaccg

SEQ ID NO: 3142513 - RNA, 17 nt, Mycobacterium bovis subsp bovis AF2122/97
cgaauccagccgcgcgc

SEQ ID NO: 3142514 - RNA, 17 nt, Mycobacterium bovis subsp bovis AF2122/97
cgaaucccacagcagga

SEQ ID NO: 3142515 - RNA, 17 nt, Mycobacterium bovis subsp bovis AF2122/97
cgaaucccccggacggc

SEQ ID NO: 3142516 - RNA, 21 nt, Mycobacterium bovis subsp bovis AF2122/97
cgaaucccgcgcccggccggu

SEQ ID NO: 3142517 - RNA, 18 nt, Mycobacterium bovis subsp bovis AF2122/97
cgaauccgacgucgacga

SEQ ID NO: 3142518 - RNA, 20 nt, Mycobacterium bovis subsp bovis AF2122/97
cgaauccgaucaccucggcg

SEQ ID NO: 3142519 - RNA, 14 nt, Mycobacterium bovis subsp bovis AF2122/97
cgaauccggcgggu

SEQ ID NO: 3142520 - RNA, 17 nt, Mycobacterium bovis subsp bovis AF2122/97
cgaaucgagacggccac

SEQ ID NO: 3142521 - RNA, 17 nt, Mycobacterium bovis subsp bovis AF2122/97
cgaaucgcgacgcgacg

SEQ ID NO: 3142522 - RNA, 21 nt, Mycobacterium bovis subsp bovis AF2122/97
cgaaucgcgucgagcgccggc

SEQ ID NO: 3142523 - RNA, 16 nt, Mycobacterium bovis subsp bovis AF2122/97
cgaaucgcugccgccg

SEQ ID NO: 3142524 - RNA, 23 nt, Mycobacterium bovis subsp bovis AF2122/97
cgaaucggcaguugaacucgacc

SEQ ID NO: 3142525 - RNA, 19 nt, Mycobacterium bovis subsp bovis AF2122/97
cgaaucggcccgugccaca

SEQ ID NO: 3142526 - RNA, 18 nt, Mycobacterium bovis subsp bovis AF2122/97
cgaaucgggucggccgcu

SEQ ID NO: 3142527 - RNA, 18 nt, Mycobacterium bovis subsp bovis AF2122/97
cgaaucgugcggcgaccg

SEQ ID NO: 3142528 - RNA, 14 nt, Mycobacterium bovis subsp bovis AF2122/97
cgaaucgugucgcc

SEQ ID NO: 3142529 - RNA, 14 nt, Mycobacterium bovis subsp bovis AF2122/97
cgaaucuccgcgcg

SEQ ID NO: 3142530 - RNA, 19 nt, Mycobacterium bovis subsp bovis AF2122/97
cgaaucugaaaaagcauca

SEQ ID NO: 3142531 - RNA, 16 nt, Mycobacterium bovis subsp bovis AF2122/97
cgaaucugccggccgg

SEQ ID NO: 3142532 - RNA, 19 nt, Mycobacterium bovis subsp bovis AF2122/97
cgaaucuucugagacugcc

SEQ ID NO: 3142533 - RNA, 19 nt, Mycobacterium bovis subsp bovis AF2122/97
cgaaugaagcccucgucgg

SEQ ID NO: 3142534 - RNA, 19 nt, Mycobacterium bovis subsp bovis AF2122/97
cgaaugacgauccagccca

SEQ ID NO: 3142535 - RNA, 19 nt, Mycobacterium bovis subsp bovis AF2122/97
cgaaugaucgucccgcggc

SEQ ID NO: 3142536 - RNA, 22 nt, Mycobacterium bovis subsp bovis AF2122/97
cgaaugaucgucccgcggcgcg

SEQ ID NO: 3142537 - RNA, 13 nt, Mycobacterium bovis subsp bovis AF2122/97
cgaaugcacgacg

SEQ ID NO: 3142538 - RNA, 22 nt, Mycobacterium bovis subsp bovis AF2122/97
cgaaugccauaaccggugggga

SEQ ID NO: 3142539 - RNA, 15 nt, Mycobacterium bovis subsp bovis AF2122/97
cgaaugcggccccga

SEQ ID NO: 3142540 - RNA, 20 nt, Mycobacterium bovis subsp bovis AF2122/97
cgaaugcugggcccgccagc

SEQ ID NO: 3142541 - RNA, 18 nt, Mycobacterium bovis subsp bovis AF2122/97
cgaauggccgaaccguuc

SEQ ID NO: 3142542 - RNA, 23 nt, Mycobacterium bovis subsp bovis AF2122/97
cgaauggccgaaccguucggcga

SEQ ID NO: 3142543 - RNA, 19 nt, Mycobacterium bovis subsp bovis AF2122/97
cgaauggcggacagggcgg

SEQ ID NO: 3142544 - RNA, 16 nt, Mycobacterium bovis subsp bovis AF2122/97
cgaaugggggcugguc

SEQ ID NO: 3142545 - RNA, 21 nt, Mycobacterium bovis subsp bovis AF2122/97
cgaaugggucuuugcccgcca

SEQ ID NO: 3142546 - RNA, 15 nt, Mycobacterium bovis subsp bovis AF2122/97
cgaaugucaccccgc

SEQ ID NO: 3142547 - RNA, 20 nt, Mycobacterium bovis subsp bovis AF2122/97
cgaaugucaccccgcccagc

SEQ ID NO: 3142548 - RNA, 17 nt, Mycobacterium bovis subsp bovis AF2122/97
cgaauguugcgaucugc

SEQ ID NO: 3142549 - RNA, 20 nt, Mycobacterium bovis subsp bovis AF2122/97
cgaauguugcgaucugcggc

SEQ ID NO: 3142550 - RNA, 19 nt, Mycobacterium bovis subsp bovis AF2122/97
cgaauuaccuugcgguucg

SEQ ID NO: 3142551 - RNA, 14 nt, Mycobacterium bovis subsp bovis AF2122/97
cgaauuccggcuca

SEQ ID NO: 3142552 - RNA, 15 nt, Mycobacterium bovis subsp bovis AF2122/97
cgaauucggccggcg

SEQ ID NO: 3142553 - RNA, 17 nt, Mycobacterium bovis subsp bovis AF2122/97
cgaauucggccggcgcg

SEQ ID NO: 3142554 - RNA, 22 nt, Mycobacterium bovis subsp bovis AF2122/97
cgaauucguagggaugcggccg

SEQ ID NO: 3142555 - RNA, 15 nt, Mycobacterium bovis subsp bovis AF2122/97
cgaauugcaggacgc

SEQ ID NO: 3142556 - RNA, 15 nt, Mycobacterium bovis subsp bovis AF2122/97
cgacacggugcugcc

SEQ ID NO: 3142557 - RNA, 19 nt, Mycobacterium bovis subsp bovis AF2122/97
cgacacggugcugccguug

SEQ ID NO: 3142558 - RNA, 18 nt, Mycobacterium bovis subsp bovis AF2122/97
cgacacgugcaucuguga

SEQ ID NO: 3142559 - RNA, 17 nt, Mycobacterium bovis subsp bovis AF2122/97
cgacacguuggcggaug

SEQ ID NO: 3142560 - RNA, 20 nt, Mycobacterium bovis subsp bovis AF2122/97
cgacacguuucacguggucg

SEQ ID NO: 3142561 - RNA, 18 nt, Mycobacterium bovis subsp bovis AF2122/97
cgacacuaggggcggggc

SEQ ID NO: 3142562 - RNA, 20 nt, Mycobacterium bovis subsp bovis AF2122/97
cgacacucacgggugcuggc

SEQ ID NO: 3142563 - RNA, 19 nt, Mycobacterium bovis subsp bovis AF2122/97
cgacacugggaucccgacg

SEQ ID NO: 3142564 - RNA, 21 nt, Mycobacterium bovis subsp bovis AF2122/97
cgacacugggaucccgacgaa

SEQ ID NO: 3142565 - RNA, 16 nt, Mycobacterium bovis subsp bovis AF2122/97
cgacagacagcaccgc

SEQ ID NO: 3142566 - RNA, 21 nt, Mycobacterium bovis subsp bovis AF2122/97
cgacagcacccaaugccaccg

SEQ ID NO: 3142567 - RNA, 22 nt, Mycobacterium bovis subsp bovis AF2122/97
cgacagcacccaaugccaccgc

SEQ ID NO: 3142568 - RNA, 18 nt, Mycobacterium bovis subsp bovis AF2122/97
cgacagcacccggccacc

SEQ ID NO: 3142569 - RNA, 23 nt, Mycobacterium bovis subsp bovis AF2122/97
cgacagcagccggugccggucga

SEQ ID NO: 3142570 - RNA, 13 nt, Mycobacterium bovis subsp bovis AF2122/97
cgacagcagcgcc

SEQ ID NO: 3142571 - RNA, 18 nt, Mycobacterium bovis subsp bovis AF2122/97
cgacagcagcgccacccg

SEQ ID NO: 3142572 - RNA, 19 nt, Mycobacterium bovis subsp bovis AF2122/97
cgacagcagcgccacccgg

SEQ ID NO: 3142573 - RNA, 17 nt, Mycobacterium bovis subsp bovis AF2122/97
cgacagcagguugccga

SEQ ID NO: 3142574 - RNA, 14 nt, Mycobacterium bovis subsp bovis AF2122/97
cgacagcaucacgc

SEQ ID NO: 3142575 - RNA, 12 nt, Mycobacterium bovis subsp bovis AF2122/97
cgacagccaccu

SEQ ID NO: 3142576 - RNA, 17 nt, Mycobacterium bovis subsp bovis AF2122/97
cgacagccccaucacca

SEQ ID NO: 3142577 - RNA, 19 nt, Mycobacterium bovis subsp bovis AF2122/97
cgacagccccaucaccacc

SEQ ID NO: 3142578 - RNA, 21 nt, Mycobacterium bovis subsp bovis AF2122/97
cgacagccccaucaccaccgg

SEQ ID NO: 3142579 - RNA, 22 nt, Mycobacterium bovis subsp bovis AF2122/97
cgacagccccaucaccaccggc

SEQ ID NO: 3142580 - RNA, 12 nt, Mycobacterium bovis subsp bovis AF2122/97
cgacagcccgcc

SEQ ID NO: 3142581 - RNA, 14 nt, Mycobacterium bovis subsp bovis AF2122/97
cgacagcccgccgg

SEQ ID NO: 3142582 - RNA, 16 nt, Mycobacterium bovis subsp bovis AF2122/97
cgacagcccgccggcg

SEQ ID NO: 3142583 - RNA, 19 nt, Mycobacterium bovis subsp bovis AF2122/97
cgacagcccuaucagccga

SEQ ID NO: 3142584 - RNA, 21 nt, Mycobacterium bovis subsp bovis AF2122/97
cgacagcccuaucagccgaga

SEQ ID NO: 3142585 - RNA, 20 nt, Mycobacterium bovis subsp bovis AF2122/97
cgacagccgauccgaucgca

SEQ ID NO: 3142586 - RNA, 17 nt, Mycobacterium bovis subsp bovis AF2122/97
cgacagccgcugcggug

SEQ ID NO: 3142587 - RNA, 14 nt, Mycobacterium bovis subsp bovis AF2122/97
cgacagccguggcg

SEQ ID NO: 3142588 - RNA, 15 nt, Mycobacterium bovis subsp bovis AF2122/97
cgacagccguggcgc

SEQ ID NO: 3142589 - RNA, 12 nt, Mycobacterium bovis subsp bovis AF2122/97
cgacagcgacgg

SEQ ID NO: 3142590 - RNA, 14 nt, Mycobacterium bovis subsp bovis AF2122/97
cgacagcgcggcgc

SEQ ID NO: 3142591 - RNA, 15 nt, Mycobacterium bovis subsp bovis AF2122/97
cgacagcgcggcgcg

SEQ ID NO: 3142592 - RNA, 17 nt, Mycobacterium bovis subsp bovis AF2122/97
cgacagcgcugggccca

SEQ ID NO: 3142593 - RNA, 20 nt, Mycobacterium bovis subsp bovis AF2122/97
cgacagcgcugggcccagga

SEQ ID NO: 3142594 - RNA, 13 nt, Mycobacterium bovis subsp bovis AF2122/97
cgacagcggcacc

SEQ ID NO: 3142595 - RNA, 16 nt, Mycobacterium bovis subsp bovis AF2122/97
cgacagcuuggccggu

SEQ ID NO: 3142596 - RNA, 14 nt, Mycobacterium bovis subsp bovis AF2122/97
cgacaggacgucgg

SEQ ID NO: 3142597 - RNA, 17 nt, Mycobacterium bovis subsp bovis AF2122/97
cgacaggacgucggcga

SEQ ID NO: 3142598 - RNA, 19 nt, Mycobacterium bovis subsp bovis AF2122/97
cgacaggacgucggcgaau

SEQ ID NO: 3142599 - RNA, 14 nt, Mycobacterium bovis subsp bovis AF2122/97
cgacaggccaccgc

SEQ ID NO: 3142600 - RNA, 15 nt, Mycobacterium bovis subsp bovis AF2122/97
cgacaggccaccgca

SEQ ID NO: 3142601 - RNA, 16 nt, Mycobacterium bovis subsp bovis AF2122/97
cgacaggccgagcaga

SEQ ID NO: 3142602 - RNA, 14 nt, Mycobacterium bovis subsp bovis AF2122/97
cgacaggccggcca

SEQ ID NO: 3142603 - RNA, 17 nt, Mycobacterium bovis subsp bovis AF2122/97
cgacaggccggccacca

SEQ ID NO: 3142604 - RNA, 19 nt, Mycobacterium bovis subsp bovis AF2122/97
cgacaggccggccaccagu

SEQ ID NO: 3142605 - RNA, 19 nt, Mycobacterium bovis subsp bovis AF2122/97
cgacagggacccgagauca

SEQ ID NO: 3142606 - RNA, 15 nt, Mycobacterium bovis subsp bovis AF2122/97
cgacaggugaaggug

SEQ ID NO: 3142607 - RNA, 18 nt, Mycobacterium bovis subsp bovis AF2122/97
cgacaggugccagaccag

SEQ ID NO: 3142608 - RNA, 23 nt, Mycobacterium bovis subsp bovis AF2122/97
cgacaggugccagaccagggcag

SEQ ID NO: 3142609 - RNA, 19 nt, Mycobacterium bovis subsp bovis AF2122/97
cgacaguagggucguacgu

SEQ ID NO: 3142610 - RNA, 15 nt, Mycobacterium bovis subsp bovis AF2122/97
cgacagucaacaggg

SEQ ID NO: 3142611 - RNA, 18 nt, Mycobacterium bovis subsp bovis AF2122/97
cgacagucaacagggcca

SEQ ID NO: 3142612 - RNA, 21 nt, Mycobacterium bovis subsp bovis AF2122/97
cgacagucaacagggccagga

SEQ ID NO: 3142613 - RNA, 17 nt, Mycobacterium bovis subsp bovis AF2122/97
cgacaguggucccggug

SEQ ID NO: 3142614 - RNA, 17 nt, Mycobacterium bovis subsp bovis AF2122/97
cgacaguugcgccagcg

SEQ ID NO: 3142615 - RNA, 22 nt, Mycobacterium bovis subsp bovis AF2122/97
cgacaguugcgccagcguuagg

SEQ ID NO: 3142616 - RNA, 20 nt, Mycobacterium bovis subsp bovis AF2122/97
cgacaguuuaccgugccgcc

SEQ ID NO: 3142617 - RNA, 21 nt, Mycobacterium bovis subsp bovis AF2122/97
cgacaguuuaccgugccgccc

SEQ ID NO: 3142618 - RNA, 23 nt, Mycobacterium bovis subsp bovis AF2122/97
cgacaguuuaccgugccgcccgg

SEQ ID NO: 3142619 - RNA, 16 nt, Mycobacterium bovis subsp bovis AF2122/97
cgacaguuuucaccgc

SEQ ID NO: 3142620 - RNA, 20 nt, Mycobacterium bovis subsp bovis AF2122/97
cgacauacgucggggccgca

SEQ ID NO: 3142621 - RNA, 15 nt, Mycobacterium bovis subsp bovis AF2122/97
cgacauaggccaccu

SEQ ID NO: 3142622 - RNA, 16 nt, Mycobacterium bovis subsp bovis AF2122/97
cgacauaggccaccuc

SEQ ID NO: 3142623 - RNA, 17 nt, Mycobacterium bovis subsp bovis AF2122/97
cgacauaguuggcgccc

SEQ ID NO: 3142624 - RNA, 18 nt, Mycobacterium bovis subsp bovis AF2122/97
cgacauaguuggcgcccg

SEQ ID NO: 3142625 - RNA, 20 nt, Mycobacterium bovis subsp bovis AF2122/97
cgacauaguuggcgcccgaa

SEQ ID NO: 3142626 - RNA, 19 nt, Mycobacterium bovis subsp bovis AF2122/97
cgacaucaccaccgcacgg

SEQ ID NO: 3142627 - RNA, 18 nt, Mycobacterium bovis subsp bovis AF2122/97
cgacaucaccaccgccgg

SEQ ID NO: 3142628 - RNA, 20 nt, Mycobacterium bovis subsp bovis AF2122/97
cgacaucaccaccgccgggg

SEQ ID NO: 3142629 - RNA, 12 nt, Mycobacterium bovis subsp bovis AF2122/97
cgacaucaccga

SEQ ID NO: 3142630 - RNA, 15 nt, Mycobacterium bovis subsp bovis AF2122/97
cgacaucaccgaacg

SEQ ID NO: 3142631 - RNA, 17 nt, Mycobacterium bovis subsp bovis AF2122/97
cgacaucacucgcgcca

SEQ ID NO: 3142632 - RNA, 17 nt, Mycobacterium bovis subsp bovis AF2122/97
cgacauccacaccgcgg

SEQ ID NO: 3142633 - RNA, 19 nt, Mycobacterium bovis subsp bovis AF2122/97
cgacauccagaugcccagc

SEQ ID NO: 3142634 - RNA, 21 nt, Mycobacterium bovis subsp bovis AF2122/97
cgacaucgagaucgccguugc

SEQ ID NO: 3142635 - RNA, 14 nt, Mycobacterium bovis subsp bovis AF2122/97
cgacaucgcugcga

SEQ ID NO: 3142636 - RNA, 13 nt, Mycobacterium bovis subsp bovis AF2122/97
cgacaucggccag

SEQ ID NO: 3142637 - RNA, 14 nt, Mycobacterium bovis subsp bovis AF2122/97
cgacaucggcggcc

SEQ ID NO: 3142638 - RNA, 18 nt, Mycobacterium bovis subsp bovis AF2122/97
cgacaucgguggcccggu

SEQ ID NO: 3142639 - RNA, 17 nt, Mycobacterium bovis subsp bovis AF2122/97
cgacaucgguggcggcc

SEQ ID NO: 3142640 - RNA, 20 nt, Mycobacterium bovis subsp bovis AF2122/97
cgacaucgguggcggccucc

SEQ ID NO: 3142641 - RNA, 16 nt, Mycobacterium bovis subsp bovis AF2122/97
cgacaucgucaucagc

SEQ ID NO: 3142642 - RNA, 17 nt, Mycobacterium bovis subsp bovis AF2122/97
cgacaucgucauccagg

SEQ ID NO: 3142643 - RNA, 11 nt, Mycobacterium bovis subsp bovis AF2122/97
cgaccagcaga

SEQ ID NO: 3142644 - RNA, 13 nt, Mycobacterium bovis subsp bovis AF2122/97
cgaccagcagacc

SEQ ID NO: 3142645 - RNA, 12 nt, Mycobacterium bovis subsp bovis AF2122/97
cgaccagcagau

SEQ ID NO: 3142646 - RNA, 13 nt, Mycobacterium bovis subsp bovis AF2122/97
cgaccagcagauc

SEQ ID NO: 3142647 - RNA, 16 nt, Mycobacterium bovis subsp bovis AF2122/97
cgaccagcccgcucuu

SEQ ID NO: 3142648 - RNA, 17 nt, Mycobacterium bovis subsp bovis AF2122/97
cgaccagccgaucauca

SEQ ID NO: 3142649 - RNA, 14 nt, Mycobacterium bovis subsp bovis AF2122/97
cgaccagccguggu

SEQ ID NO: 3142650 - RNA, 13 nt, Mycobacterium bovis subsp bovis AF2122/97
cgaccagcgccga

SEQ ID NO: 3142651 - RNA, 14 nt, Mycobacterium bovis subsp bovis AF2122/97
cgaccagcgccgca

SEQ ID NO: 3142652 - RNA, 15 nt, Mycobacterium bovis subsp bovis AF2122/97
cgaccagcgcuagcg

SEQ ID NO: 3142653 - RNA, 14 nt, Mycobacterium bovis subsp bovis AF2122/97
cgaccagcggccga

SEQ ID NO: 3142654 - RNA, 16 nt, Mycobacterium bovis subsp bovis AF2122/97
cgaccagcggccgacc

SEQ ID NO: 3142655 - RNA, 18 nt, Mycobacterium bovis subsp bovis AF2122/97
cgaccagcucagcugcgg

SEQ ID NO: 3142656 - RNA, 21 nt, Mycobacterium bovis subsp bovis AF2122/97
cgaccaggaacggcucggccg

SEQ ID NO: 3142657 - RNA, 22 nt, Mycobacterium bovis subsp bovis AF2122/97
cgaccaggaacggcucggccgg

SEQ ID NO: 3142658 - RNA, 16 nt, Mycobacterium bovis subsp bovis AF2122/97
cgaccaggaccaccgc

SEQ ID NO: 3142659 - RNA, 20 nt, Mycobacterium bovis subsp bovis AF2122/97
cgaccaggaccggcugcagg

SEQ ID NO: 3142660 - RNA, 23 nt, Mycobacterium bovis subsp bovis AF2122/97
cgaccaggaccggcugcaggugc

SEQ ID NO: 3142661 - RNA, 19 nt, Mycobacterium bovis subsp bovis AF2122/97
cgaccaggccacugccgac

SEQ ID NO: 3142662 - RNA, 14 nt, Mycobacterium bovis subsp bovis AF2122/97
cgaccagggccgcc

SEQ ID NO: 3142663 - RNA, 15 nt, Mycobacterium bovis subsp bovis AF2122/97
cgaccagggccgccg

SEQ ID NO: 3142664 - RNA, 17 nt, Mycobacterium bovis subsp bovis AF2122/97
cgaccagggccgccgcu

SEQ ID NO: 3142665 - RNA, 20 nt, Mycobacterium bovis subsp bovis AF2122/97
cgaccagggccgccgcugcc

SEQ ID NO: 3142666 - RNA, 21 nt, Mycobacterium bovis subsp bovis AF2122/97
cgaccagggccgccgcugccg

SEQ ID NO: 3142667 - RNA, 16 nt, Mycobacterium bovis subsp bovis AF2122/97
cgaccaggucgccagc

SEQ ID NO: 3142668 - RNA, 22 nt, Mycobacterium bovis subsp bovis AF2122/97
cgaccaggucggcuucgacaac

SEQ ID NO: 3142669 - RNA, 22 nt, Mycobacterium bovis subsp bovis AF2122/97
cgaccagucgacgucucuggug

SEQ ID NO: 3142670 - RNA, 22 nt, Mycobacterium bovis subsp bovis AF2122/97
cgaccaguucggaaucggagcc

SEQ ID NO: 3142671 - RNA, 20 nt, Mycobacterium bovis subsp bovis AF2122/97
cgaccauaagcucguagagc

SEQ ID NO: 3142672 - RNA, 21 nt, Mycobacterium bovis subsp bovis AF2122/97
cgaccauacccgcgcgcacca

SEQ ID NO: 3142673 - RNA, 20 nt, Mycobacterium bovis subsp bovis AF2122/97
cgaccaucaccacggccgcc

SEQ ID NO: 3142674 - RNA, 17 nt, Mycobacterium bovis subsp bovis AF2122/97
cgaccaucaucucggug

SEQ ID NO: 3142675 - RNA, 19 nt, Mycobacterium bovis subsp bovis AF2122/97
cgaccaucucaccgggccc

SEQ ID NO: 3142676 - RNA, 18 nt, Mycobacterium bovis subsp bovis AF2122/97
cgaccaucucgacgucgg

SEQ ID NO: 3142677 - RNA, 20 nt, Mycobacterium bovis subsp bovis AF2122/97
cgaccaucucgacgucggug

SEQ ID NO: 3142678 - RNA, 14 nt, Mycobacterium bovis subsp bovis AF2122/97
cgaccaucugaucg

SEQ ID NO: 3142679 - RNA, 14 nt, Mycobacterium bovis subsp bovis AF2122/97
cgaccaugagccgg

SEQ ID NO: 3142680 - RNA, 17 nt, Mycobacterium bovis subsp bovis AF2122/97
cgaccaugagccggcgc

SEQ ID NO: 3142681 - RNA, 13 nt, Mycobacterium bovis subsp bovis AF2122/97
cgaccaugaugcc

SEQ ID NO: 3142682 - RNA, 15 nt, Mycobacterium bovis subsp bovis AF2122/97
cgaccaugcgaccgg

SEQ ID NO: 3142683 - RNA, 18 nt, Mycobacterium bovis subsp bovis AF2122/97
cgaccaugcgaccggcaa

SEQ ID NO: 3142684 - RNA, 14 nt, Mycobacterium bovis subsp bovis AF2122/97
cgaccaugcuccua

SEQ ID NO: 3142685 - RNA, 16 nt, Mycobacterium bovis subsp bovis AF2122/97
cgaccaugguagcgcc

SEQ ID NO: 3142686 - RNA, 17 nt, Mycobacterium bovis subsp bovis AF2122/97
cgaccaugguagcgccc

SEQ ID NO: 3142687 - RNA, 22 nt, Mycobacterium bovis subsp bovis AF2122/97
cgaccaugguagcgccccgaug

SEQ ID NO: 3142688 - RNA, 13 nt, Mycobacterium bovis subsp bovis AF2122/97
cgacccaacccga

SEQ ID NO: 3142689 - RNA, 16 nt, Mycobacterium bovis subsp bovis AF2122/97
cgacccaagucgccga

SEQ ID NO: 3142690 - RNA, 12 nt, Mycobacterium bovis subsp bovis AF2122/97
cgacccagcggu

SEQ ID NO: 3142691 - RNA, 19 nt, Mycobacterium bovis subsp bovis AF2122/97
cgacccagcgguugacccu

SEQ ID NO: 3142692 - RNA, 15 nt, Mycobacterium bovis subsp bovis AF2122/97
cgacccaucaccagc

SEQ ID NO: 3142693 - RNA, 16 nt, Mycobacterium bovis subsp bovis AF2122/97
cgacccaucaccagcg

SEQ ID NO: 3142694 - RNA, 21 nt, Mycobacterium bovis subsp bovis AF2122/97
cgacccaucaccagcggcugc

SEQ ID NO: 3142695 - RNA, 13 nt, Mycobacterium bovis subsp bovis AF2122/97
cgaccccaggcgc

SEQ ID NO: 3142696 - RNA, 18 nt, Mycobacterium bovis subsp bovis AF2122/97
cgacccccagcgcccgcc

SEQ ID NO: 3142697 - RNA, 19 nt, Mycobacterium bovis subsp bovis AF2122/97
cgacccccagcgcccgccg

SEQ ID NO: 3142698 - RNA, 20 nt, Mycobacterium bovis subsp bovis AF2122/97
cgacccccagcgcccgccgg

SEQ ID NO: 3142699 - RNA, 22 nt, Mycobacterium bovis subsp bovis AF2122/97
cgacccccgaucaggccgacgu

SEQ ID NO: 3142700 - RNA, 15 nt, Mycobacterium bovis subsp bovis AF2122/97
cgacccccgcaucgg

SEQ ID NO: 3142701 - RNA, 22 nt, Mycobacterium bovis subsp bovis AF2122/97
cgaccccgaacauccgccgccc

SEQ ID NO: 3142702 - RNA, 15 nt, Mycobacterium bovis subsp bovis AF2122/97
cgaccccgccgagcg

SEQ ID NO: 3142703 - RNA, 22 nt, Mycobacterium bovis subsp bovis AF2122/97
cgaccccgccgagcgcgccgaa

SEQ ID NO: 3142704 - RNA, 19 nt, Mycobacterium bovis subsp bovis AF2122/97
cgaccccgccgagcgguug

SEQ ID NO: 3142705 - RNA, 20 nt, Mycobacterium bovis subsp bovis AF2122/97
cgaccccgccgagcgguugc

SEQ ID NO: 3142706 - RNA, 16 nt, Mycobacterium bovis subsp bovis AF2122/97
cgaccccgcgccgaca

SEQ ID NO: 3142707 - RNA, 14 nt, Mycobacterium bovis subsp bovis AF2122/97
cgaccccggccagg

SEQ ID NO: 3142708 - RNA, 14 nt, Mycobacterium bovis subsp bovis AF2122/97
cgaccccggccccg

SEQ ID NO: 3142709 - RNA, 15 nt, Mycobacterium bovis subsp bovis AF2122/97
cgaccccggccccga

SEQ ID NO: 3142710 - RNA, 13 nt, Mycobacterium bovis subsp bovis AF2122/97
cgaccccggcggu

SEQ ID NO: 3142711 - RNA, 19 nt, Mycobacterium bovis subsp bovis AF2122/97
cgaccccucacccagcugg

SEQ ID NO: 3142712 - RNA, 17 nt, Mycobacterium bovis subsp bovis AF2122/97
cgacccgaacugggcga

SEQ ID NO: 3142713 - RNA, 19 nt, Mycobacterium bovis subsp bovis AF2122/97
cgacccgaacugggcgauc

SEQ ID NO: 3142714 - RNA, 15 nt, Mycobacterium bovis subsp bovis AF2122/97
cgacccgaagccgac

SEQ ID NO: 3142715 - RNA, 16 nt, Mycobacterium bovis subsp bovis AF2122/97
cgacccgacgcugguc

SEQ ID NO: 3142716 - RNA, 22 nt, Mycobacterium bovis subsp bovis AF2122/97
cgacccgaucaccuucggccga

SEQ ID NO: 3142717 - RNA, 15 nt, Mycobacterium bovis subsp bovis AF2122/97
cgacccgaugaccca

SEQ ID NO: 3142718 - RNA, 20 nt, Mycobacterium bovis subsp bovis AF2122/97
cgacccgaugcgucucgcgc

SEQ ID NO: 3142719 - RNA, 21 nt, Mycobacterium bovis subsp bovis AF2122/97
cgacccgcagaccgccaccgg

SEQ ID NO: 3142720 - RNA, 13 nt, Mycobacterium bovis subsp bovis AF2122/97
cgacccgcccgaa

SEQ ID NO: 3142721 - RNA, 17 nt, Mycobacterium bovis subsp bovis AF2122/97
cgacccgcccgaagaug

SEQ ID NO: 3142722 - RNA, 21 nt, Mycobacterium bovis subsp bovis AF2122/97
cgacccgccgacgccgccggc

SEQ ID NO: 3142723 - RNA, 22 nt, Mycobacterium bovis subsp bovis AF2122/97
cgacccgccgacgccgccggcc

SEQ ID NO: 3142724 - RNA, 13 nt, Mycobacterium bovis subsp bovis AF2122/97
cgacccgccgaug

SEQ ID NO: 3142725 - RNA, 22 nt, Mycobacterium bovis subsp bovis AF2122/97
cgacccgccgaugaugcggcgc

SEQ ID NO: 3142726 - RNA, 13 nt, Mycobacterium bovis subsp bovis AF2122/97
cgacccgccgccc

SEQ ID NO: 3142727 - RNA, 14 nt, Mycobacterium bovis subsp bovis AF2122/97
cgacccgccgcgcc

SEQ ID NO: 3142728 - RNA, 15 nt, Mycobacterium bovis subsp bovis AF2122/97
cgacccgccgcgccc

SEQ ID NO: 3142729 - RNA, 17 nt, Mycobacterium bovis subsp bovis AF2122/97
cgacccgccgcgcccgg

SEQ ID NO: 3142730 - RNA, 16 nt, Mycobacterium bovis subsp bovis AF2122/97
cgaccgcggccccgcc

SEQ ID NO: 3142731 - RNA, 14 nt, Mycobacterium bovis subsp bovis AF2122/97
cgaccgcggcccgg

SEQ ID NO: 3142732 - RNA, 21 nt, Mycobacterium bovis subsp bovis AF2122/97
cgaccgcggcccggacgucgg

SEQ ID NO: 3142733 - RNA, 16 nt, Mycobacterium bovis subsp bovis AF2122/97
cgaccgcggccgggug

SEQ ID NO: 3142734 - RNA, 14 nt, Mycobacterium bovis subsp bovis AF2122/97
cgaccgcggccuug

SEQ ID NO: 3142735 - RNA, 14 nt, Mycobacterium bovis subsp bovis AF2122/97
cgaccgcgggccga

SEQ ID NO: 3142736 - RNA, 18 nt, Mycobacterium bovis subsp bovis AF2122/97
cgaccgcgggccgacgca

SEQ ID NO: 3142737 - RNA, 22 nt, Mycobacterium bovis subsp bovis AF2122/97
cgaccgcgggccgacgcaggug

SEQ ID NO: 3142738 - RNA, 19 nt, Mycobacterium bovis subsp bovis AF2122/97
cgaccgcggggcagcgggc

SEQ ID NO: 3142739 - RNA, 23 nt, Mycobacterium bovis subsp bovis AF2122/97
cgaccgcggggcagcgggccgcc

SEQ ID NO: 3142740 - RNA, 22 nt, Mycobacterium bovis subsp bovis AF2122/97
cgaccgcgggucgugccagcag

SEQ ID NO: 3142741 - RNA, 14 nt, Mycobacterium bovis subsp bovis AF2122/97
cgaccgcggucgcu

SEQ ID NO: 3142742 - RNA, 20 nt, Mycobacterium bovis subsp bovis AF2122/97
cgaccgcguacaggccggcc

SEQ ID NO: 3142743 - RNA, 18 nt, Mycobacterium bovis subsp bovis AF2122/97
cgaccgcguuguccgcgg

SEQ ID NO: 3142744 - RNA, 21 nt, Mycobacterium bovis subsp bovis AF2122/97
cgaccgcguuguccgcggcca

SEQ ID NO: 3142745 - RNA, 20 nt, Mycobacterium bovis subsp bovis AF2122/97
cgaccgcguuuugcaggccc

SEQ ID NO: 3142746 - RNA, 20 nt, Mycobacterium bovis subsp bovis AF2122/97
cgaccgcuaugaugccgccg

SEQ ID NO: 3142747 - RNA, 21 nt, Mycobacterium bovis subsp bovis AF2122/97
cgaccgcuaugaugccgccgg

SEQ ID NO: 3142748 - RNA, 22 nt, Mycobacterium bovis subsp bovis AF2122/97
cgaccgcuaugaugccgccggu

SEQ ID NO: 3142749 - RNA, 24 nt, Mycobacterium bovis subsp bovis AF2122/97
cgaccgcuaugaugccgccggugc

SEQ ID NO: 3142750 - RNA, 13 nt, Mycobacterium bovis subsp bovis AF2122/97
cgaccgcucccgg

SEQ ID NO: 3142751 - RNA, 12 nt, Mycobacterium bovis subsp bovis AF2122/97
cgaccgcugagg

SEQ ID NO: 3142752 - RNA, 18 nt, Mycobacterium bovis subsp bovis AF2122/97
cgaccgcugaugaagaug

SEQ ID NO: 3142753 - RNA, 19 nt, Mycobacterium bovis subsp bovis AF2122/97
cgaccgcugaugaagauga

SEQ ID NO: 3142754 - RNA, 22 nt, Mycobacterium bovis subsp bovis AF2122/97
cgaccgcugguucucgcuguug

SEQ ID NO: 3142755 - RNA, 17 nt, Mycobacterium bovis subsp bovis AF2122/97
cgaccggaacuguggug

SEQ ID NO: 3142756 - RNA, 21 nt, Mycobacterium bovis subsp bovis AF2122/97
cgaccggaacuguggugccug

SEQ ID NO: 3142757 - RNA, 16 nt, Mycobacterium bovis subsp bovis AF2122/97
cgaccggaaugcccgg

SEQ ID NO: 3142758 - RNA, 18 nt, Mycobacterium bovis subsp bovis AF2122/97
cgaccggaaugcccgggc

SEQ ID NO: 3142759 - RNA, 19 nt, Mycobacterium bovis subsp bovis AF2122/97
cgaccggaaugcccgggcc

SEQ ID NO: 3142760 - RNA, 14 nt, Mycobacterium bovis subsp bovis AF2122/97
cgaccggacacucc

SEQ ID NO: 3142761 - RNA, 13 nt, Mycobacterium bovis subsp bovis AF2122/97
cgaccggaccggg

SEQ ID NO: 3142762 - RNA, 18 nt, Mycobacterium bovis subsp bovis AF2122/97
cgaccggacgagcgucag

SEQ ID NO: 3142763 - RNA, 15 nt, Mycobacterium bovis subsp bovis AF2122/97
cgaccggacgaucag

SEQ ID NO: 3142764 - RNA, 19 nt, Mycobacterium bovis subsp bovis AF2122/97
cgaccggacgaucagggug

SEQ ID NO: 3142765 - RNA, 15 nt, Mycobacterium bovis subsp bovis AF2122/97
cgaccggcaacgcgg

SEQ ID NO: 3142766 - RNA, 17 nt, Mycobacterium bovis subsp bovis AF2122/97
cgaccggcaacgcggcc

SEQ ID NO: 3142767 - RNA, 20 nt, Mycobacterium bovis subsp bovis AF2122/97
cgaccggcaacgcggccuug

SEQ ID NO: 3142768 - RNA, 12 nt, Mycobacterium bovis subsp bovis AF2122/97
cgaccggcaccc

SEQ ID NO: 3142769 - RNA, 14 nt, Mycobacterium bovis subsp bovis AF2122/97
cgaccggcacccgc

SEQ ID NO: 3142770 - RNA, 19 nt, Mycobacterium bovis subsp bovis AF2122/97
cgaccggcacccgcggcga

SEQ ID NO: 3142771 - RNA, 14 nt, Mycobacterium bovis subsp bovis AF2122/97
cgaccggccaacgc

SEQ ID NO: 3142772 - RNA, 18 nt, Mycobacterium bovis subsp bovis AF2122/97
cgaccggccaacgccgcc

SEQ ID NO: 3142773 - RNA, 14 nt, Mycobacterium bovis subsp bovis AF2122/97
cgaccggcccccgg

SEQ ID NO: 3142774 - RNA, 17 nt, Mycobacterium bovis subsp bovis AF2122/97
cgaccggcccccggucg

SEQ ID NO: 3142775 - RNA, 20 nt, Mycobacterium bovis subsp bovis AF2122/97
cgaccggcccgcauccgcac

SEQ ID NO: 3142776 - RNA, 21 nt, Mycobacterium bovis subsp bovis AF2122/97
cgaccggcccgcauccgcacc

SEQ ID NO: 3142777 - RNA, 13 nt, Mycobacterium bovis subsp bovis AF2122/97
cgaccggccggcc

SEQ ID NO: 3142778 - RNA, 16 nt, Mycobacterium bovis subsp bovis AF2122/97
cgaccggcgaccggcg

SEQ ID NO: 3142779 - RNA, 19 nt, Mycobacterium bovis subsp bovis AF2122/97
cgaccggcgggaugcgcgc

SEQ ID NO: 3142780 - RNA, 21 nt, Mycobacterium bovis subsp bovis AF2122/97
cgaccggcgggaugcgcgccc

SEQ ID NO: 3142781 - RNA, 23 nt, Mycobacterium bovis subsp bovis AF2122/97
cgaccggcgggaugcgcgcccga

SEQ ID NO: 3142782 - RNA, 12 nt, Mycobacterium bovis subsp bovis AF2122/97
cgaccggcguug

SEQ ID NO: 3142783 - RNA, 22 nt, Mycobacterium bovis subsp bovis AF2122/97
cgaccggcguugcguagacgaa

SEQ ID NO: 3142784 - RNA, 18 nt, Mycobacterium bovis subsp bovis AF2122/97
cgaccggcuaccggcgug

SEQ ID NO: 3142785 - RNA, 16 nt, Mycobacterium bovis subsp bovis AF2122/97
cgaccggcuccggaca

SEQ ID NO: 3142786 - RNA, 21 nt, Mycobacterium bovis subsp bovis AF2122/97
cgaccggcucggaaaccgccc

SEQ ID NO: 3142787 - RNA, 19 nt, Mycobacterium bovis subsp bovis AF2122/97
cgaccgggaucggcuccgc

SEQ ID NO: 3142788 - RNA, 16 nt, Mycobacterium bovis subsp bovis AF2122/97
cgaccggggaucgggg

SEQ ID NO: 3142789 - RNA, 19 nt, Mycobacterium bovis subsp bovis AF2122/97
cgaccgggucgcaaccgcc

SEQ ID NO: 3142790 - RNA, 22 nt, Mycobacterium bovis subsp bovis AF2122/97
cgaccgggucgcaaccgccgcc

SEQ ID NO: 3142791 - RNA, 22 nt, Mycobacterium bovis subsp bovis AF2122/97
cgaccgguacccguagcaccac

SEQ ID NO: 3142792 - RNA, 17 nt, Mycobacterium bovis subsp bovis AF2122/97
cgaccggucuggcgaug

SEQ ID NO: 3142793 - RNA, 18 nt, Mycobacterium bovis subsp bovis AF2122/97
cgaccggucuggcgauga

SEQ ID NO: 3142794 - RNA, 20 nt, Mycobacterium bovis subsp bovis AF2122/97
cgaccggucuggcgaugacg

SEQ ID NO: 3142795 - RNA, 13 nt, Mycobacterium bovis subsp bovis AF2122/97
cgaccggugaugu

SEQ ID NO: 3142796 - RNA, 15 nt, Mycobacterium bovis subsp bovis AF2122/97
cgaccgguggcaccg

SEQ ID NO: 3142797 - RNA, 17 nt, Mycobacterium bovis subsp bovis AF2122/97
cgaccgguggcaccggc

SEQ ID NO: 3142798 - RNA, 20 nt, Mycobacterium bovis subsp bovis AF2122/97
cgaccgguggcaccggcggc

SEQ ID NO: 3142799 - RNA, 17 nt, Mycobacterium bovis subsp bovis AF2122/97
cgaccguauugaccagc

SEQ ID NO: 3142800 - RNA, 20 nt, Mycobacterium bovis subsp bovis AF2122/97
cgaccguauugaccagcggg

SEQ ID NO: 3142801 - RNA, 12 nt, Mycobacterium bovis subsp bovis AF2122/97
cgaccgucacgc

SEQ ID NO: 3142802 - RNA, 17 nt, Mycobacterium bovis subsp bovis AF2122/97
cgaccgucagggucacc

SEQ ID NO: 3142803 - RNA, 17 nt, Mycobacterium bovis subsp bovis AF2122/97
cgaccgucaugaagccg

SEQ ID NO: 3142804 - RNA, 19 nt, Mycobacterium bovis subsp bovis AF2122/97
cgaccgucccagcgccgca

SEQ ID NO: 3142805 - RNA, 13 nt, Mycobacterium bovis subsp bovis AF2122/97
cgaccguccgggu

SEQ ID NO: 3142806 - RNA, 20 nt, Mycobacterium bovis subsp bovis AF2122/97
cgaccguccgggucaccagc

SEQ ID NO: 3142807 - RNA, 19 nt, Mycobacterium bovis subsp bovis AF2122/97
cgaccgucgauuucgacga

SEQ ID NO: 3142808 - RNA, 21 nt, Mycobacterium bovis subsp bovis AF2122/97
cgaccgucgauuucgacgacc

SEQ ID NO: 3142809 - RNA, 20 nt, Mycobacterium bovis subsp bovis AF2122/97
cgaccgucgcgcugccggcc

SEQ ID NO: 3142810 - RNA, 23 nt, Mycobacterium bovis subsp bovis AF2122/97
cgaccgucgcgcugccggccgcg

SEQ ID NO: 3142811 - RNA, 22 nt, Mycobacterium bovis subsp bovis AF2122/97
cgaccgucguccagacgccacu

SEQ ID NO: 3142812 - RNA, 17 nt, Mycobacterium bovis subsp bovis AF2122/97
cgaccgucgucgugcag

SEQ ID NO: 3142813 - RNA, 21 nt, Mycobacterium bovis subsp bovis AF2122/97
cgaccgucgucgugcaggcgc

SEQ ID NO: 3142814 - RNA, 14 nt, Mycobacterium bovis subsp bovis AF2122/97
cgaccgugaucagc

SEQ ID NO: 3142815 - RNA, 16 nt, Mycobacterium bovis subsp bovis AF2122/97
cgaccgugcugggcgc

SEQ ID NO: 3142816 - RNA, 16 nt, Mycobacterium bovis subsp bovis AF2122/97
cgacgacaaggugugg

SEQ ID NO: 3142817 - RNA, 19 nt, Mycobacterium bovis subsp bovis AF2122/97
cgacgacaaggugugguga

SEQ ID NO: 3142818 - RNA, 21 nt, Mycobacterium bovis subsp bovis AF2122/97
cgacgacaagguguggugaca

SEQ ID NO: 3142819 - RNA, 20 nt, Mycobacterium bovis subsp bovis AF2122/97
cgacgacaagugcccggcca

SEQ ID NO: 3142820 - RNA, 19 nt, Mycobacterium bovis subsp bovis AF2122/97
cgacgacacgccugggcga

SEQ ID NO: 3142821 - RNA, 19 nt, Mycobacterium bovis subsp bovis AF2122/97
cgacgacacguugacgaug

SEQ ID NO: 3142822 - RNA, 22 nt, Mycobacterium bovis subsp bovis AF2122/97
cgacgacacguugacgaugugc

SEQ ID NO: 3142823 - RNA, 14 nt, Mycobacterium bovis subsp bovis AF2122/97
cgacgacagcaccg

SEQ ID NO: 3142824 - RNA, 20 nt, Mycobacterium bovis subsp bovis AF2122/97
cgacgacauacgagcaguga

SEQ ID NO: 3142825 - RNA, 20 nt, Mycobacterium bovis subsp bovis AF2122/97
cgacgacaucgagccaacgc

SEQ ID NO: 3142826 - RNA, 21 nt, Mycobacterium bovis subsp bovis AF2122/97
cgacgacaucgguggcccggu

SEQ ID NO: 3142827 - RNA, 19 nt, Mycobacterium bovis subsp bovis AF2122/97
cgacgaccacaccacgaug

SEQ ID NO: 3142828 - RNA, 22 nt, Mycobacterium bovis subsp bovis AF2122/97
cgacgaccacaccacgauggcg

SEQ ID NO: 3142829 - RNA, 23 nt, Mycobacterium bovis subsp bovis AF2122/97
cgacgaccacaccacgauggcgg

SEQ ID NO: 3142830 - RNA, 12 nt, Mycobacterium bovis subsp bovis AF2122/97
cgacgaccagca

SEQ ID NO: 3142831 - RNA, 13 nt, Mycobacterium bovis subsp bovis AF2122/97
cgacgaccagcag

SEQ ID NO: 3142832 - RNA, 23 nt, Mycobacterium bovis subsp bovis AF2122/97
cgacgaccagguaaugguggcgu

SEQ ID NO: 3142833 - RNA, 13 nt, Mycobacterium bovis subsp bovis AF2122/97
cgacgacccgggu

SEQ ID NO: 3142834 - RNA, 14 nt, Mycobacterium bovis subsp bovis AF2122/97
cgacgacccggguc

SEQ ID NO: 3142835 - RNA, 18 nt, Mycobacterium bovis subsp bovis AF2122/97
cgacgacccgggucggca

SEQ ID NO: 3142836 - RNA, 19 nt, Mycobacterium bovis subsp bovis AF2122/97
cgacgacccgggucggcac

SEQ ID NO: 3142837 - RNA, 20 nt, Mycobacterium bovis subsp bovis AF2122/97
cgacgacccgggucggcacg

SEQ ID NO: 3142838 - RNA, 13 nt, Mycobacterium bovis subsp bovis AF2122/97
cgacgaccgucgg

SEQ ID NO: 3142839 - RNA, 14 nt, Mycobacterium bovis subsp bovis AF2122/97
cgacgaccucgacg

SEQ ID NO: 3142840 - RNA, 17 nt, Mycobacterium bovis subsp bovis AF2122/97
cgacgaccucgacguug

SEQ ID NO: 3142841 - RNA, 13 nt, Mycobacterium bovis subsp bovis AF2122/97
cgacgacgcgcgc

SEQ ID NO: 3142842 - RNA, 15 nt, Mycobacterium bovis subsp bovis AF2122/97
cgacgacggcaccga

SEQ ID NO: 3142843 - RNA, 14 nt, Mycobacterium bovis subsp bovis AF2122/97
cgacgacggccugc

SEQ ID NO: 3142844 - RNA, 14 nt, Mycobacterium bovis subsp bovis AF2122/97
cgacgacgggcgcc

SEQ ID NO: 3142845 - RNA, 14 nt, Mycobacterium bovis subsp bovis AF2122/97
cgacgacgggguug

SEQ ID NO: 3142846 - RNA, 16 nt, Mycobacterium bovis subsp bovis AF2122/97
cgacgacguccucgac

SEQ ID NO: 3142847 - RNA, 17 nt, Mycobacterium bovis subsp bovis AF2122/97
cgacgacguccucgacg

SEQ ID NO: 3142848 - RNA, 18 nt, Mycobacterium bovis subsp bovis AF2122/97
cgacgacguccucgacga

SEQ ID NO: 3142849 - RNA, 20 nt, Mycobacterium bovis subsp bovis AF2122/97
cgacgacguggcugcguucg

SEQ ID NO: 3142850 - RNA, 24 nt, Mycobacterium bovis subsp bovis AF2122/97
cgacgacuccggcaagcacaccgc

SEQ ID NO: 3142851 - RNA, 22 nt, Mycobacterium bovis subsp bovis AF2122/97
cgacgacuucgaaucaggcucc

SEQ ID NO: 3142852 - RNA, 23 nt, Mycobacterium bovis subsp bovis AF2122/97
cgacgacuuggauggccgaaccc

SEQ ID NO: 3142853 - RNA, 17 nt, Mycobacterium bovis subsp bovis AF2122/97
cgacgagaagacaccgc

SEQ ID NO: 3142854 - RNA, 21 nt, Mycobacterium bovis subsp bovis AF2122/97
cgacgagacgaaccgccgacg

SEQ ID NO: 3142855 - RNA, 23 nt, Mycobacterium bovis subsp bovis AF2122/97
cgacgagacgcaaaaucgcccga

SEQ ID NO: 3142856 - RNA, 14 nt, Mycobacterium bovis subsp bovis AF2122/97
cgacgagacggcag

SEQ ID NO: 3142857 - RNA, 15 nt, Mycobacterium bovis subsp bovis AF2122/97
cgacgagacggcagg

SEQ ID NO: 3142858 - RNA, 19 nt, Mycobacterium bovis subsp bovis AF2122/97
cgacgagauacggccacca

SEQ ID NO: 3142859 - RNA, 21 nt, Mycobacterium bovis subsp bovis AF2122/97
cgacgagauacggccaccagg

SEQ ID NO: 3142860 - RNA, 17 nt, Mycobacterium bovis subsp bovis AF2122/97
cgacgagaucagccucg

SEQ ID NO: 3142861 - RNA, 17 nt, Mycobacterium bovis subsp bovis AF2122/97
cgacgagauccagcgcc

SEQ ID NO: 3142862 - RNA, 18 nt, Mycobacterium bovis subsp bovis AF2122/97
cgacgagauugccgggcc

SEQ ID NO: 3142863 - RNA, 20 nt, Mycobacterium bovis subsp bovis AF2122/97
cgacgagauugccgggccgc

SEQ ID NO: 3142864 - RNA, 23 nt, Mycobacterium bovis subsp bovis AF2122/97
cgacgagauugccgggccgccga

SEQ ID NO: 3142865 - RNA, 13 nt, Mycobacterium bovis subsp bovis AF2122/97
cgacgagcaacgc

SEQ ID NO: 3142866 - RNA, 19 nt, Mycobacterium bovis subsp bovis AF2122/97
cgacgagcaacgccacccg

SEQ ID NO: 3142867 - RNA, 21 nt, Mycobacterium bovis subsp bovis AF2122/97
cgacgagcaccgcgccgcgcc

SEQ ID NO: 3142868 - RNA, 16 nt, Mycobacterium bovis subsp bovis AF2122/97
cgacgagcacgccgac

SEQ ID NO: 3142869 - RNA, 16 nt, Mycobacterium bovis subsp bovis AF2122/97
cgacgagcccaccguc

SEQ ID NO: 3142870 - RNA, 12 nt, Mycobacterium bovis subsp bovis AF2122/97
cgacgagccgca

SEQ ID NO: 3142871 - RNA, 14 nt, Mycobacterium bovis subsp bovis AF2122/97
cgacgagcgcagcg

SEQ ID NO: 3142872 - RNA, 16 nt, Mycobacterium bovis subsp bovis AF2122/97
cgacgagcgcagcgug

SEQ ID NO: 3142873 - RNA, 23 nt, Mycobacterium bovis subsp bovis AF2122/97
cgacgagcgccucaagcucgccg

SEQ ID NO: 3142874 - RNA, 16 nt, Mycobacterium bovis subsp bovis AF2122/97
cgacgaggacggcuug

SEQ ID NO: 3142875 - RNA, 19 nt, Mycobacterium bovis subsp bovis AF2122/97
cgacgaggagccucgaccg

SEQ ID NO: 3142876 - RNA, 18 nt, Mycobacterium bovis subsp bovis AF2122/97
cgacgaggaugucgauga

SEQ ID NO: 3142877 - RNA, 16 nt, Mycobacterium bovis subsp bovis AF2122/97
cgacgaggcaaugcga

SEQ ID NO: 3142878 - RNA, 16 nt, Mycobacterium bovis subsp bovis AF2122/97
cgacgagggccagcag

SEQ ID NO: 3142879 - RNA, 18 nt, Mycobacterium bovis subsp bovis AF2122/97
cgacgagggccagcagcc

SEQ ID NO: 3142880 - RNA, 14 nt, Mycobacterium bovis subsp bovis AF2122/97
cgacgagggcggga

SEQ ID NO: 3142881 - RNA, 17 nt, Mycobacterium bovis subsp bovis AF2122/97
cgacgagggcgggaccc

SEQ ID NO: 3142882 - RNA, 12 nt, Mycobacterium bovis subsp bovis AF2122/97
cgacgagucgcc

SEQ ID NO: 3142883 - RNA, 18 nt, Mycobacterium bovis subsp bovis AF2122/97
cgacgagucggcgggcga

SEQ ID NO: 3142884 - RNA, 19 nt, Mycobacterium bovis subsp bovis AF2122/97
cgacgagucggcgggcgac

SEQ ID NO: 3142885 - RNA, 21 nt, Mycobacterium bovis subsp bovis AF2122/97
cgacgagugguccggcggccg

SEQ ID NO: 3142886 - RNA, 17 nt, Mycobacterium bovis subsp bovis AF2122/97
cgacgaguugcgaacca

SEQ ID NO: 3142887 - RNA, 21 nt, Mycobacterium bovis subsp bovis AF2122/97
cgacgauagcggcccgaucac

SEQ ID NO: 3142888 - RNA, 22 nt, Mycobacterium bovis subsp bovis AF2122/97
cgacgauagcggcccgaucacc

SEQ ID NO: 3142889 - RNA, 17 nt, Mycobacterium bovis subsp bovis AF2122/97
cgacgauaucgggagcg

SEQ ID NO: 3142890 - RNA, 19 nt, Mycobacterium bovis subsp bovis AF2122/97
cgacgauaucgggagcggc

SEQ ID NO: 3142891 - RNA, 22 nt, Mycobacterium bovis subsp bovis AF2122/97
cgacgauaucgggagcggcugc

SEQ ID NO: 3142892 - RNA, 16 nt, Mycobacterium bovis subsp bovis AF2122/97
cgacgaucaacggaac

SEQ ID NO: 3142893 - RNA, 22 nt, Mycobacterium bovis subsp bovis AF2122/97
cgacgaucaagccuucgucgau

SEQ ID NO: 3142894 - RNA, 16 nt, Mycobacterium bovis subsp bovis AF2122/97
cgacgaucagcgagua

SEQ ID NO: 3142895 - RNA, 14 nt, Mycobacterium bovis subsp bovis AF2122/97
cgacgauccacggc

SEQ ID NO: 3142896 - RNA, 15 nt, Mycobacterium bovis subsp bovis AF2122/97
cgacgauccacggcg

SEQ ID NO: 3142897 - RNA, 19 nt, Mycobacterium bovis subsp bovis AF2122/97
cgacgauccacggcgaugc

SEQ ID NO: 3142898 - RNA, 15 nt, Mycobacterium bovis subsp bovis AF2122/97
cgacgaucgacgccg

SEQ ID NO: 3142899 - RNA, 15 nt, Mycobacterium bovis subsp bovis AF2122/97
cgacgaucgcgucgg

SEQ ID NO: 3142900 - RNA, 20 nt, Mycobacterium bovis subsp bovis AF2122/97
cgacgaucgucuugucgccg

SEQ ID NO: 3142901 - RNA, 21 nt, Mycobacterium bovis subsp bovis AF2122/97
cgacgaucucgccgccagcgc

SEQ ID NO: 3142902 - RNA, 17 nt, Mycobacterium bovis subsp bovis AF2122/97
cgacgaucucgccggcg

SEQ ID NO: 3142903 - RNA, 15 nt, Mycobacterium bovis subsp bovis AF2122/97
cgacgaucucggcgg

SEQ ID NO: 3142904 - RNA, 15 nt, Mycobacterium bovis subsp bovis AF2122/97
cgacgaucugcagca

SEQ ID NO: 3142905 - RNA, 22 nt, Mycobacterium bovis subsp bovis AF2122/97
cgacgaucugcagcacucggug

SEQ ID NO: 3142906 - RNA, 17 nt, Mycobacterium bovis subsp bovis AF2122/97
cgacgaugacgcgcgaa

SEQ ID NO: 3142907 - RNA, 14 nt, Mycobacterium bovis subsp bovis AF2122/97
cgacgaugacggug

SEQ ID NO: 3142908 - RNA, 13 nt, Mycobacterium bovis subsp bovis AF2122/97
cgacgaugccggc

SEQ ID NO: 3142909 - RNA, 15 nt, Mycobacterium bovis subsp bovis AF2122/97
cgacgaugccggccc

SEQ ID NO: 3142910 - RNA, 18 nt, Mycobacterium bovis subsp bovis AF2122/97
cgacgaugccggcccgca

SEQ ID NO: 3142911 - RNA, 15 nt, Mycobacterium bovis subsp bovis AF2122/97
cgacgaugccucggc

SEQ ID NO: 3142912 - RNA, 15 nt, Mycobacterium bovis subsp bovis AF2122/97
cgacgaugcgcacuc

SEQ ID NO: 3142913 - RNA, 17 nt, Mycobacterium bovis subsp bovis AF2122/97
cgacgaugucgaagauc

SEQ ID NO: 3142914 - RNA, 15 nt, Mycobacterium bovis subsp bovis AF2122/97
cgacgaugucgagcg

SEQ ID NO: 3142915 - RNA, 20 nt, Mycobacterium bovis subsp bovis AF2122/97
cgacgaugugcacggugugc

SEQ ID NO: 3142916 - RNA, 15 nt, Mycobacterium bovis subsp bovis AF2122/97
cgacgauguggucca

SEQ ID NO: 3142917 - RNA, 18 nt, Mycobacterium bovis subsp bovis AF2122/97
cgacgaugugguccaucg

SEQ ID NO: 3142918 - RNA, 22 nt, Mycobacterium bovis subsp bovis AF2122/97
cgacgauuaccagcggcaccgc

SEQ ID NO: 3142919 - RNA, 19 nt, Mycobacterium bovis subsp bovis AF2122/97
cgacgauucgagcgguugc

SEQ ID NO: 3142920 - RNA, 20 nt, Mycobacterium bovis subsp bovis AF2122/97
cgacgauuuuggcugcaguc

SEQ ID NO: 3142921 - RNA, 16 nt, Mycobacterium bovis subsp bovis AF2122/97
cgacgcaaagcagcgc

SEQ ID NO: 3142922 - RNA, 17 nt, Mycobacterium bovis subsp bovis AF2122/97
cgacgcaaagcagcgca

SEQ ID NO: 3142923 - RNA, 15 nt, Mycobacterium bovis subsp bovis AF2122/97
cgacgcacacccggu

SEQ ID NO: 3142924 - RNA, 14 nt, Mycobacterium bovis subsp bovis AF2122/97
cgacgcaccaacgc

SEQ ID NO: 3142925 - RNA, 20 nt, Mycobacterium bovis subsp bovis AF2122/97
cgacgcaccaacgcgaucag

SEQ ID NO: 3142926 - RNA, 13 nt, Mycobacterium bovis subsp bovis AF2122/97
cgacgcaccucgg

SEQ ID NO: 3142927 - RNA, 17 nt, Mycobacterium bovis subsp bovis AF2122/97
cgacgcaccucgguggc

SEQ ID NO: 3142928 - RNA, 22 nt, Mycobacterium bovis subsp bovis AF2122/97
cgacgcaccucgguggcugcca

SEQ ID NO: 3142929 - RNA, 12 nt, Mycobacterium bovis subsp bovis AF2122/97
cgacgcacugcc

SEQ ID NO: 3142930 - RNA, 20 nt, Mycobacterium bovis subsp bovis AF2122/97
cgacgcacugccccgcaucg

SEQ ID NO: 3142931 - RNA, 21 nt, Mycobacterium bovis subsp bovis AF2122/97
cgacgcagaccguccagcaac

SEQ ID NO: 3142932 - RNA, 20 nt, Mycobacterium bovis subsp bovis AF2122/97
cgacgcagcuugcccgacgg

SEQ ID NO: 3142933 - RNA, 21 nt, Mycobacterium bovis subsp bovis AF2122/97
cgacgcaggugaacgccggug

SEQ ID NO: 3142934 - RNA, 16 nt, Mycobacterium bovis subsp bovis AF2122/97
cgacgcauaaccggcg

SEQ ID NO: 3142935 - RNA, 17 nt, Mycobacterium bovis subsp bovis AF2122/97
cgacgcauaaccggcgc

SEQ ID NO: 3142936 - RNA, 21 nt, Mycobacterium bovis subsp bovis AF2122/97
cgacgcaugggucauggcgcu

SEQ ID NO: 3142937 - RNA, 17 nt, Mycobacterium bovis subsp bovis AF2122/97
cgacgcauuccucgacg

SEQ ID NO: 3142938 - RNA, 15 nt, Mycobacterium bovis subsp bovis AF2122/97
cgacgccaacgccag

SEQ ID NO: 3142939 - RNA, 16 nt, Mycobacterium bovis subsp bovis AF2122/97
cgacgccaacgccagc

SEQ ID NO: 3142940 - RNA, 20 nt, Mycobacterium bovis subsp bovis AF2122/97
cgacgccaaugccgcggagg

SEQ ID NO: 3142941 - RNA, 15 nt, Mycobacterium bovis subsp bovis AF2122/97
cgacgccaccgccac

SEQ ID NO: 3142942 - RNA, 20 nt, Mycobacterium bovis subsp bovis AF2122/97
cgacgccaccgccaccaccc

SEQ ID NO: 3142943 - RNA, 13 nt, Mycobacterium bovis subsp bovis AF2122/97
cgacgccaccgcg

SEQ ID NO: 3142944 - RNA, 14 nt, Mycobacterium bovis subsp bovis AF2122/97
cgacgccaccgcga

SEQ ID NO: 3142945 - RNA, 16 nt, Mycobacterium bovis subsp bovis AF2122/97
cgacgccaccgcgacu

SEQ ID NO: 3142946 - RNA, 14 nt, Mycobacterium bovis subsp bovis AF2122/97
cgacgccacgcguc

SEQ ID NO: 3142947 - RNA, 15 nt, Mycobacterium bovis subsp bovis AF2122/97
cgacgccacgcgucu

SEQ ID NO: 3142948 - RNA, 17 nt, Mycobacterium bovis subsp bovis AF2122/97
cgacgccagaacguggc

SEQ ID NO: 3142949 - RNA, 14 nt, Mycobacterium bovis subsp bovis AF2122/97
cgacgccagcugcc

SEQ ID NO: 3142950 - RNA, 17 nt, Mycobacterium bovis subsp bovis AF2122/97
cgacgccagcugcccga

SEQ ID NO: 3142951 - RNA, 18 nt, Mycobacterium bovis subsp bovis AF2122/97
cgacgccagcugcccgac

SEQ ID NO: 3142952 - RNA, 15 nt, Mycobacterium bovis subsp bovis AF2122/97
cgacgccaguguugc

SEQ ID NO: 3142953 - RNA, 22 nt, Mycobacterium bovis subsp bovis AF2122/97
cgacgccaucugcuggcuggga

SEQ ID NO: 3142954 - RNA, 23 nt, Mycobacterium bovis subsp bovis AF2122/97
cgacgccaucugcuggcugggaa

SEQ ID NO: 3142955 - RNA, 17 nt, Mycobacterium bovis subsp bovis AF2122/97
cgacgccaugagcgcgc

SEQ ID NO: 3142956 - RNA, 17 nt, Mycobacterium bovis subsp bovis AF2122/97
cgacgccauuggccugu

SEQ ID NO: 3142957 - RNA, 19 nt, Mycobacterium bovis subsp bovis AF2122/97
cgacgcccaggcauggccu

SEQ ID NO: 3142958 - RNA, 16 nt, Mycobacterium bovis subsp bovis AF2122/97
cgacgccccaggacac

SEQ ID NO: 3142959 - RNA, 19 nt, Mycobacterium bovis subsp bovis AF2122/97
cgacgccccgaucggccac

SEQ ID NO: 3142960 - RNA, 20 nt, Mycobacterium bovis subsp bovis AF2122/97
cgacgccccgaucggccacc

SEQ ID NO: 3142961 - RNA, 12 nt, Mycobacterium bovis subsp bovis AF2122/97
cgacgcccgacg

SEQ ID NO: 3142962 - RNA, 18 nt, Mycobacterium bovis subsp bovis AF2122/97
cgacgcccgacgaugugc

SEQ ID NO: 3142963 - RNA, 19 nt, Mycobacterium bovis subsp bovis AF2122/97
cgacgcccgauacgccacc

SEQ ID NO: 3142964 - RNA, 22 nt, Mycobacterium bovis subsp bovis AF2122/97
cgacgcccgauacgccaccggc

SEQ ID NO: 3142965 - RNA, 13 nt, Mycobacterium bovis subsp bovis AF2122/97
cgacgcccgccac

SEQ ID NO: 3142966 - RNA, 14 nt, Mycobacterium bovis subsp bovis AF2122/97
cgacgcccgccacc

SEQ ID NO: 3142967 - RNA, 16 nt, Mycobacterium bovis subsp bovis AF2122/97
cgacgcccgccaccgg

SEQ ID NO: 3142968 - RNA, 17 nt, Mycobacterium bovis subsp bovis AF2122/97
cgacgcccgccaccggg

SEQ ID NO: 3142969 - RNA, 12 nt, Mycobacterium bovis subsp bovis AF2122/97
cgacgcccgccc

SEQ ID NO: 3142970 - RNA, 14 nt, Mycobacterium bovis subsp bovis AF2122/97
cgacgcccgcccug

SEQ ID NO: 3142971 - RNA, 21 nt, Mycobacterium bovis subsp bovis AF2122/97
cgacgcccgcccuggcaacga

SEQ ID NO: 3142972 - RNA, 18 nt, Mycobacterium bovis subsp bovis AF2122/97
cgacgcccucacaacgau

SEQ ID NO: 3142973 - RNA, 17 nt, Mycobacterium bovis subsp bovis AF2122/97
cgacgccgaaaaugccg

SEQ ID NO: 3142974 - RNA, 23 nt, Mycobacterium bovis subsp bovis AF2122/97
cgacgccgaaaaugccgcccagc

SEQ ID NO: 3142975 - RNA, 16 nt, Mycobacterium bovis subsp bovis AF2122/97
cgacgccgacgaugac

SEQ ID NO: 3142976 - RNA, 23 nt, Mycobacterium bovis subsp bovis AF2122/97
cgacgccgagaccgccgcugccg

SEQ ID NO: 3142977 - RNA, 13 nt, Mycobacterium bovis subsp bovis AF2122/97
cgacgccgcagcg

SEQ ID NO: 3142978 - RNA, 12 nt, Mycobacterium bovis subsp bovis AF2122/97
cgacgccgccac

SEQ ID NO: 3142979 - RNA, 21 nt, Mycobacterium bovis subsp bovis AF2122/97
cgacgccgccacccggcgggc

SEQ ID NO: 3142980 - RNA, 22 nt, Mycobacterium bovis subsp bovis AF2122/97
cgacgccgccacccggcgggcg

SEQ ID NO: 3142981 - RNA, 15 nt, Mycobacterium bovis subsp bovis AF2122/97
cgacgccgccggccc

SEQ ID NO: 3142982 - RNA, 16 nt, Mycobacterium bovis subsp bovis AF2122/97
cgacgccgccggcccc

SEQ ID NO: 3142983 - RNA, 14 nt, Mycobacterium bovis subsp bovis AF2122/97
cgacgccgccggcg

SEQ ID NO: 3142984 - RNA, 15 nt, Mycobacterium bovis subsp bovis AF2122/97
cgacgccgccggcgc

SEQ ID NO: 3142985 - RNA, 13 nt, Mycobacterium bovis subsp bovis AF2122/97
cgacgccgcgcag

SEQ ID NO: 3142986 - RNA, 14 nt, Mycobacterium bovis subsp bovis AF2122/97
cgacgccgcgcagc

SEQ ID NO: 3142987 - RNA, 15 nt, Mycobacterium bovis subsp bovis AF2122/97
cgacgccgcgcagcc

SEQ ID NO: 3142988 - RNA, 20 nt, Mycobacterium bovis subsp bovis AF2122/97
cgacgccgcgcagccggccc

SEQ ID NO: 3142989 - RNA, 17 nt, Mycobacterium bovis subsp bovis AF2122/97
cgacggcauguaccgac

SEQ ID NO: 3142990 - RNA, 21 nt, Mycobacterium bovis subsp bovis AF2122/97
cgacggcauguaccgaccgcg

SEQ ID NO: 3142991 - RNA, 22 nt, Mycobacterium bovis subsp bovis AF2122/97
cgacggcauuucagcgcgccgc

SEQ ID NO: 3142992 - RNA, 13 nt, Mycobacterium bovis subsp bovis AF2122/97
cgacggccaagau

SEQ ID NO: 3142993 - RNA, 19 nt, Mycobacterium bovis subsp bovis AF2122/97
cgacggccaagaucggcgc

SEQ ID NO: 3142994 - RNA, 12 nt, Mycobacterium bovis subsp bovis AF2122/97
cgacggccaccc

SEQ ID NO: 3142995 - RNA, 13 nt, Mycobacterium bovis subsp bovis AF2122/97
cgacggccacccc

SEQ ID NO: 3142996 - RNA, 14 nt, Mycobacterium bovis subsp bovis AF2122/97
cgacggccaccccg

SEQ ID NO: 3142997 - RNA, 18 nt, Mycobacterium bovis subsp bovis AF2122/97
cgacggccaccccgucgg

SEQ ID NO: 3142998 - RNA, 15 nt, Mycobacterium bovis subsp bovis AF2122/97
cgacggccacggugg

SEQ ID NO: 3142999 - RNA, 20 nt, Mycobacterium bovis subsp bovis AF2122/97
cgacggccagcaagacgaug

SEQ ID NO: 3143000 - RNA, 23 nt, Mycobacterium bovis subsp bovis AF2122/97
cgacggccagcaagacgaugaca

SEQ ID NO: 3143001 - RNA, 13 nt, Mycobacterium bovis subsp bovis AF2122/97
cgacggccagcag

SEQ ID NO: 3143002 - RNA, 14 nt, Mycobacterium bovis subsp bovis AF2122/97
cgacggccagccca

SEQ ID NO: 3143003 - RNA, 22 nt, Mycobacterium bovis subsp bovis AF2122/97
cgacggccagcccagcagguuc

SEQ ID NO: 3143004 - RNA, 12 nt, Mycobacterium bovis subsp bovis AF2122/97
cgacggccagcg

SEQ ID NO: 3143005 - RNA, 18 nt, Mycobacterium bovis subsp bovis AF2122/97
cgacggccagcgcgucgg

SEQ ID NO: 3143006 - RNA, 16 nt, Mycobacterium bovis subsp bovis AF2122/97
cgacggccagugcgca

SEQ ID NO: 3143007 - RNA, 19 nt, Mycobacterium bovis subsp bovis AF2122/97
cgacggccaucgugcggca

SEQ ID NO: 3143008 - RNA, 16 nt, Mycobacterium bovis subsp bovis AF2122/97
cgacggcccgaucccg

SEQ ID NO: 3143009 - RNA, 13 nt, Mycobacterium bovis subsp bovis AF2122/97
cgacggcccgccg

SEQ ID NO: 3143010 - RNA, 13 nt, Mycobacterium bovis subsp bovis AF2122/97
cgacggcccucga

SEQ ID NO: 3143011 - RNA, 17 nt, Mycobacterium bovis subsp bovis AF2122/97
cgacggcccucgagcag

SEQ ID NO: 3143012 - RNA, 14 nt, Mycobacterium bovis subsp bovis AF2122/97
cgacggccgacaac

SEQ ID NO: 3143013 - RNA, 18 nt, Mycobacterium bovis subsp bovis AF2122/97
cgacggccgacaacccgg

SEQ ID NO: 3143014 - RNA, 14 nt, Mycobacterium bovis subsp bovis AF2122/97
cgacggccgccagc

SEQ ID NO: 3143015 - RNA, 15 nt, Mycobacterium bovis subsp bovis AF2122/97
cgacggccgccagca

SEQ ID NO: 3143016 - RNA, 13 nt, Mycobacterium bovis subsp bovis AF2122/97
cgacggccgcggc

SEQ ID NO: 3143017 - RNA, 19 nt, Mycobacterium bovis subsp bovis AF2122/97
cgacggccgcggcgucgug

SEQ ID NO: 3143018 - RNA, 11 nt, Mycobacterium bovis subsp bovis AF2122/97
cgacggccgcu

SEQ ID NO: 3143019 - RNA, 16 nt, Mycobacterium bovis subsp bovis AF2122/97
cgacggccgcucgggc

SEQ ID NO: 3143020 - RNA, 20 nt, Mycobacterium bovis subsp bovis AF2122/97
cgacggccgcucgggccagc

SEQ ID NO: 3143021 - RNA, 15 nt, Mycobacterium bovis subsp bovis AF2122/97
cgacggccggcaagc

SEQ ID NO: 3143022 - RNA, 17 nt, Mycobacterium bovis subsp bovis AF2122/97
cgacggccggcaagcag

SEQ ID NO: 3143023 - RNA, 15 nt, Mycobacterium bovis subsp bovis AF2122/97
cgacggccucgucga

SEQ ID NO: 3143024 - RNA, 19 nt, Mycobacterium bovis subsp bovis AF2122/97
cgacggccucgucgauguu

SEQ ID NO: 3143025 - RNA, 18 nt, Mycobacterium bovis subsp bovis AF2122/97
cgacggccuggggcagcc

SEQ ID NO: 3143026 - RNA, 23 nt, Mycobacterium bovis subsp bovis AF2122/97
cgacggccuggggcagccgggcg

SEQ ID NO: 3143027 - RNA, 20 nt, Mycobacterium bovis subsp bovis AF2122/97
cgacggccuuggcgacgucg

SEQ ID NO: 3143028 - RNA, 16 nt, Mycobacterium bovis subsp bovis AF2122/97
cgacggcgaccaccgc

SEQ ID NO: 3143029 - RNA, 19 nt, Mycobacterium bovis subsp bovis AF2122/97
cgacggcgaccaccgcggc

SEQ ID NO: 3143030 - RNA, 13 nt, Mycobacterium bovis subsp bovis AF2122/97
cgacggcgaccag

SEQ ID NO: 3143031 - RNA, 15 nt, Mycobacterium bovis subsp bovis AF2122/97
cgacggcgauggcgc

SEQ ID NO: 3143032 - RNA, 13 nt, Mycobacterium bovis subsp bovis AF2122/97
cgacggcgccauu

SEQ ID NO: 3143033 - RNA, 12 nt, Mycobacterium bovis subsp bovis AF2122/97
cgacggcgccca

SEQ ID NO: 3143034 - RNA, 17 nt, Mycobacterium bovis subsp bovis AF2122/97
cgacggcgcccagcgcu

SEQ ID NO: 3143035 - RNA, 22 nt, Mycobacterium bovis subsp bovis AF2122/97
cgacggcgcccagcgcuagccg

SEQ ID NO: 3143036 - RNA, 18 nt, Mycobacterium bovis subsp bovis AF2122/97
cgacggcgccccgcgcuu
